United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 56

SEQ ID NO: 1998004 - RNA, 14 nt, Shigella flexneri 2a str. 301
ccagcaaaaucacc

SEQ ID NO: 1998005 - RNA, 20 nt, Shigella flexneri 2a str. 301
ccagauuuauuuacuucugc

SEQ ID NO: 1998006 - RNA, 20 nt, Shigella flexneri 2a str. 301
ccagcacaucaucaaagcca

SEQ ID NO: 1998007 - RNA, 20 nt, Shigella flexneri 2a str. 301
ccagcacauaacucauacug

SEQ ID NO: 1998008 - RNA, 12 nt, Shigella flexneri 2a str. 301
ccagcaccagcu

SEQ ID NO: 1998009 - RNA, 13 nt, Shigella flexneri 2a str. 301
ccagcaccaguac

SEQ ID NO: 1998010 - RNA, 23 nt, Shigella flexneri 2a str. 301
ccagcaaggcgcuaaaagcauag

SEQ ID NO: 1998011 - RNA, 14 nt, Shigella flexneri 2a str. 301
ccagcaauccccag

SEQ ID NO: 1998012 - RNA, 22 nt, Shigella flexneri 2a str. 301
ccagcaauaauagcauccacca

SEQ ID NO: 1998013 - RNA, 23 nt, Shigella flexneri 2a str. 301
ccagcaauuuacgcuuuucuucc

SEQ ID NO: 1998014 - RNA, 20 nt, Shigella flexneri 2a str. 301
ccagcaauccccagacaaaa

SEQ ID NO: 1998015 - RNA, 22 nt, Shigella flexneri 2a str. 301
ccagccaacuugcccaggugug

SEQ ID NO: 1998016 - RNA, 12 nt, Shigella flexneri 2a str. 301
ccagccagcaga

SEQ ID NO: 1998017 - RNA, 12 nt, Shigella flexneri 2a str. 301
ccagccagagcc

SEQ ID NO: 1998018 - RNA, 22 nt, Shigella flexneri 2a str. 301
ccagccagacgccagccacagg

SEQ ID NO: 1998019 - RNA, 16 nt, Shigella flexneri 2a str. 301
ccagccagaaucauug

SEQ ID NO: 1998020 - RNA, 18 nt, Shigella flexneri 2a str. 301
ccagccaggguuauauaa

SEQ ID NO: 1998021 - RNA, 21 nt, Shigella flexneri 2a str. 301
ccagccaggguuauauaaaac

SEQ ID NO: 1998022 - RNA, 18 nt, Shigella flexneri 2a str. 301
ccagccauuaaccagcca

SEQ ID NO: 1998023 - RNA, 18 nt, Shigella flexneri 2a str. 301
ccagccaucuuucgcaga

SEQ ID NO: 1998024 - RNA, 13 nt, Shigella flexneri 2a str. 301
ccagcccuuuuga

SEQ ID NO: 1998025 - RNA, 11 nt, Shigella flexneri 2a str. 301
ccagccgagcc

SEQ ID NO: 1998026 - RNA, 21 nt, Shigella flexneri 2a str. 301
ccagcccgacgauaccgccgc

SEQ ID NO: 1998027 - RNA, 17 nt, Shigella flexneri 2a str. 301
ccagcaguuccagcaua

SEQ ID NO: 1998028 - RNA, 12 nt, Shigella flexneri 2a str. 301
ccagcaguuucu

SEQ ID NO: 1998029 - RNA, 15 nt, Shigella flexneri 2a str. 301
ccagcauaccuucca

SEQ ID NO: 1998030 - RNA, 17 nt, Shigella flexneri 2a str. 301
ccagcauacgcugccag

SEQ ID NO: 1998031 - RNA, 22 nt, Shigella flexneri 2a str. 301
ccagcauacgcugccagccauc

SEQ ID NO: 1998032 - RNA, 23 nt, Shigella flexneri 2a str. 301
ccagcauaguacgggcaauuuca

SEQ ID NO: 1998033 - RNA, 18 nt, Shigella flexneri 2a str. 301
ccagcaguaaaccaccca

SEQ ID NO: 1998034 - RNA, 23 nt, Shigella flexneri 2a str. 301
ccagcaguaaaccacccaccagc

SEQ ID NO: 1998035 - RNA, 16 nt, Shigella flexneri 2a str. 301
ccagcaguaaaccacc

SEQ ID NO: 1998036 - RNA, 18 nt, Shigella flexneri 2a str. 301
ccagcagggcaaacagca

SEQ ID NO: 1998037 - RNA, 14 nt, Shigella flexneri 2a str. 301
ccagcauuucuucc

SEQ ID NO: 1998038 - RNA, 11 nt, Shigella flexneri 2a str. 301
ccagcauuucu

SEQ ID NO: 1998039 - RNA, 15 nt, Shigella flexneri 2a str. 301
ccagcauucgcgcac

SEQ ID NO: 1998040 - RNA, 23 nt, Shigella flexneri 2a str. 301
ccagcaugugguuaccaucaacc

SEQ ID NO: 1998041 - RNA, 20 nt, Shigella flexneri 2a str. 301
ccagcauggcaauaaccgcu

SEQ ID NO: 1998042 - RNA, 13 nt, Shigella flexneri 2a str. 301
ccagcaugcauaa

SEQ ID NO: 1998043 - RNA, 17 nt, Shigella flexneri 2a str. 301
ccagcaugcauaacaga

SEQ ID NO: 1998044 - RNA, 23 nt, Shigella flexneri 2a str. 301
ccagcaugaucagcgcauagaga

SEQ ID NO: 1998045 - RNA, 12 nt, Shigella flexneri 2a str. 301
ccagcaucuccu

SEQ ID NO: 1998046 - RNA, 17 nt, Shigella flexneri 2a str. 301
ccagcaucggcagcgcc

SEQ ID NO: 1998047 - RNA, 17 nt, Shigella flexneri 2a str. 301
ccagcaucgaccaggau

SEQ ID NO: 1998048 - RNA, 17 nt, Shigella flexneri 2a str. 301
ccagcaucccggcagcc

SEQ ID NO: 1998049 - RNA, 13 nt, Shigella flexneri 2a str. 301
ccagcaucagcag

SEQ ID NO: 1998050 - RNA, 22 nt, Shigella flexneri 2a str. 301
cauagaaaaagaauugcagaua

SEQ ID NO: 1998051 - RNA, 18 nt, Shigella flexneri 2a str. 301
cauacuuauuaugaauga

SEQ ID NO: 1998052 - RNA, 22 nt, Shigella flexneri 2a str. 301
cauacugucuccacuauaaaaa

SEQ ID NO: 1998053 - RNA, 19 nt, Shigella flexneri 2a str. 301
cauacugccgaccaucugu

SEQ ID NO: 1998054 - RNA, 17 nt, Shigella flexneri 2a str. 301
cauacugcaucagcgcc

SEQ ID NO: 1998055 - RNA, 15 nt, Shigella flexneri 2a str. 301
cauacucuccuccag

SEQ ID NO: 1998056 - RNA, 18 nt, Shigella flexneri 2a str. 301
cauacugacaaacugcgc

SEQ ID NO: 1998057 - RNA, 14 nt, Shigella flexneri 2a str. 301
cauacucuccucca

SEQ ID NO: 1998058 - RNA, 14 nt, Shigella flexneri 2a str. 301
cagugcauccagca

SEQ ID NO: 1998059 - RNA, 22 nt, Shigella flexneri 2a str. 301
cagugcaggcaccagccccugg

SEQ ID NO: 1998060 - RNA, 13 nt, Shigella flexneri 2a str. 301
cagugcauuuucg

SEQ ID NO: 1998061 - RNA, 15 nt, Shigella flexneri 2a str. 301
cauagauaccuucuu

SEQ ID NO: 1998062 - RNA, 23 nt, Shigella flexneri 2a str. 301
cauagauuaauuucccaccacua

SEQ ID NO: 1998063 - RNA, 12 nt, Shigella flexneri 2a str. 301
cauagacuuccc

SEQ ID NO: 1998064 - RNA, 17 nt, Shigella flexneri 2a str. 301
cauagaggaauggcaga

SEQ ID NO: 1998065 - RNA, 14 nt, Shigella flexneri 2a str. 301
cauagaccauugca

SEQ ID NO: 1998066 - RNA, 15 nt, Shigella flexneri 2a str. 301
cauagaccauugcau

SEQ ID NO: 1998067 - RNA, 19 nt, Shigella flexneri 2a str. 301
cauaggugucaaccagcca

SEQ ID NO: 1998068 - RNA, 14 nt, Shigella flexneri 2a str. 301
cauauaaauuucau

SEQ ID NO: 1998069 - RNA, 20 nt, Shigella flexneri 2a str. 301
cauagcgacaggcuuucuuc

SEQ ID NO: 1998070 - RNA, 15 nt, Shigella flexneri 2a str. 301
cauagcgcccuuuca

SEQ ID NO: 1998071 - RNA, 19 nt, Shigella flexneri 2a str. 301
cauagcgcccuuucagcgc

SEQ ID NO: 1998072 - RNA, 16 nt, Shigella flexneri 2a str. 301
cauagcggagcaauuu

SEQ ID NO: 1998073 - RNA, 15 nt, Shigella flexneri 2a str. 301
cauagccgccgcgca

SEQ ID NO: 1998074 - RNA, 12 nt, Shigella flexneri 2a str. 301
cauagcauccca

SEQ ID NO: 1998075 - RNA, 13 nt, Shigella flexneri 2a str. 301
cauagcucgcuuc

SEQ ID NO: 1998076 - RNA, 20 nt, Shigella flexneri 2a str. 301
cauagcuaauccccuccagc

SEQ ID NO: 1998077 - RNA, 19 nt, Shigella flexneri 2a str. 301
caucaaaggcuucaacgac

SEQ ID NO: 1998078 - RNA, 22 nt, Shigella flexneri 2a str. 301
cauauuuucauuauugcgcaca

SEQ ID NO: 1998079 - RNA, 14 nt, Shigella flexneri 2a str. 301
caucaaauccccac

SEQ ID NO: 1998080 - RNA, 19 nt, Shigella flexneri 2a str. 301
caucaaauuugucgccaac

SEQ ID NO: 1998081 - RNA, 20 nt, Shigella flexneri 2a str. 301
caucaaaugcgcagccagcg

SEQ ID NO: 1998082 - RNA, 14 nt, Shigella flexneri 2a str. 301
caucaacacuuugg

SEQ ID NO: 1998083 - RNA, 20 nt, Shigella flexneri 2a str. 301
caucaaauggcauccuugcu

SEQ ID NO: 1998084 - RNA, 23 nt, Shigella flexneri 2a str. 301
caucaaauguugcguucaucagu

SEQ ID NO: 1998085 - RNA, 15 nt, Shigella flexneri 2a str. 301
caucaagcuguucuu

SEQ ID NO: 1998086 - RNA, 15 nt, Shigella flexneri 2a str. 301
caucaaguaaccuuu

SEQ ID NO: 1998087 - RNA, 20 nt, Shigella flexneri 2a str. 301
caucaaguaaccuuuaucgc

SEQ ID NO: 1998088 - RNA, 17 nt, Shigella flexneri 2a str. 301
cauaucaaaaagcugua

SEQ ID NO: 1998089 - RNA, 22 nt, Shigella flexneri 2a str. 301
cauauauuacaacguauuauau

SEQ ID NO: 1998090 - RNA, 17 nt, Shigella flexneri 2a str. 301
cauauucccgcaacuua

SEQ ID NO: 1998091 - RNA, 22 nt, Shigella flexneri 2a str. 301
cauauucgccgcccugcagcau

SEQ ID NO: 1998092 - RNA, 15 nt, Shigella flexneri 2a str. 301
cauauuccugaccca

SEQ ID NO: 1998093 - RNA, 15 nt, Shigella flexneri 2a str. 301
cauauucgccaccgc

SEQ ID NO: 1998094 - RNA, 17 nt, Shigella flexneri 2a str. 301
cauauucgccaccgcgc

SEQ ID NO: 1998095 - RNA, 16 nt, Shigella flexneri 2a str. 301
cauauugccgugcccc

SEQ ID NO: 1998096 - RNA, 18 nt, Shigella flexneri 2a str. 301
cauaucguagccccaguc

SEQ ID NO: 1998097 - RNA, 16 nt, Shigella flexneri 2a str. 301
cauaucgguaaaugcu

SEQ ID NO: 1998098 - RNA, 21 nt, Shigella flexneri 2a str. 301
caucacuuucggugacagaaa

SEQ ID NO: 1998099 - RNA, 16 nt, Shigella flexneri 2a str. 301
caucacugcaaauacc

SEQ ID NO: 1998100 - RNA, 18 nt, Shigella flexneri 2a str. 301
caucacuuuugaaaucaa

SEQ ID NO: 1998101 - RNA, 14 nt, Shigella flexneri 2a str. 301
caucaccgcaccac

SEQ ID NO: 1998102 - RNA, 20 nt, Shigella flexneri 2a str. 301
caucaccgcgaaauaaucaa

SEQ ID NO: 1998103 - RNA, 20 nt, Shigella flexneri 2a str. 301
caucaccgaugcccucaaua

SEQ ID NO: 1998104 - RNA, 17 nt, Shigella flexneri 2a str. 301
caucacgacagcaccac

SEQ ID NO: 1998105 - RNA, 13 nt, Shigella flexneri 2a str. 301
caucacgaaaucc

SEQ ID NO: 1998106 - RNA, 17 nt, Shigella flexneri 2a str. 301
caucaccuuccacauau

SEQ ID NO: 1998107 - RNA, 21 nt, Shigella flexneri 2a str. 301
caucaccugagcuggcagacc

SEQ ID NO: 1998108 - RNA, 13 nt, Shigella flexneri 2a str. 301
caucacaauggca

SEQ ID NO: 1998109 - RNA, 11 nt, Shigella flexneri 2a str. 301
caucacaccag

SEQ ID NO: 1998110 - RNA, 21 nt, Shigella flexneri 2a str. 301
caucacaccaguccagcgccu

SEQ ID NO: 1998111 - RNA, 13 nt, Shigella flexneri 2a str. 301
caucaauuugccc

SEQ ID NO: 1998112 - RNA, 17 nt, Shigella flexneri 2a str. 301
caucaauugcucacucc

SEQ ID NO: 1998113 - RNA, 22 nt, Shigella flexneri 2a str. 301
caucaauggcugcaaagcauuu

SEQ ID NO: 1998114 - RNA, 20 nt, Shigella flexneri 2a str. 301
caucaauugcucacucccgg

SEQ ID NO: 1998115 - RNA, 21 nt, Shigella flexneri 2a str. 301
caucaaguugauuuuucguuu

SEQ ID NO: 1998116 - RNA, 22 nt, Shigella flexneri 2a str. 301
caucaaguugauuuuucguuuu

SEQ ID NO: 1998117 - RNA, 13 nt, Shigella flexneri 2a str. 301
caucaauaaacaa

SEQ ID NO: 1998118 - RNA, 12 nt, Shigella flexneri 2a str. 301
caucaauaccau

SEQ ID NO: 1998119 - RNA, 17 nt, Shigella flexneri 2a str. 301
caucacccaacaauaac

SEQ ID NO: 1998120 - RNA, 17 nt, Shigella flexneri 2a str. 301
caucaccaguaccgcca

SEQ ID NO: 1998121 - RNA, 22 nt, Shigella flexneri 2a str. 301
caucaccccgccgggcuuacca

SEQ ID NO: 1998122 - RNA, 14 nt, Shigella flexneri 2a str. 301
caucaccccgcgcu

SEQ ID NO: 1998123 - RNA, 19 nt, Shigella flexneri 2a str. 301
caucaccaaugaaagcccc

SEQ ID NO: 1998124 - RNA, 22 nt, Shigella flexneri 2a str. 301
caucacauauucgccgcccugc

SEQ ID NO: 1998125 - RNA, 14 nt, Shigella flexneri 2a str. 301
caucacaucccagc

SEQ ID NO: 1998126 - RNA, 14 nt, Shigella flexneri 2a str. 301
caucgggaugcugg

SEQ ID NO: 1998127 - RNA, 21 nt, Shigella flexneri 2a str. 301
caucgggaagaggaucugcuc

SEQ ID NO: 1998128 - RNA, 20 nt, Shigella flexneri 2a str. 301
caucggcuuauucauaucaa

SEQ ID NO: 1998129 - RNA, 19 nt, Shigella flexneri 2a str. 301
caucggugaggaucaccag

SEQ ID NO: 1998130 - RNA, 15 nt, Shigella flexneri 2a str. 301
caucgguauaaccaa

SEQ ID NO: 1998131 - RNA, 12 nt, Shigella flexneri 2a str. 301
caucgugcacca

SEQ ID NO: 1998132 - RNA, 13 nt, Shigella flexneri 2a str. 301
caucgugcaccaa

SEQ ID NO: 1998133 - RNA, 13 nt, Shigella flexneri 2a str. 301
caucgucggccuu

SEQ ID NO: 1998134 - RNA, 23 nt, Shigella flexneri 2a str. 301
caucgucggccuuaaugcccacg

SEQ ID NO: 1998135 - RNA, 16 nt, Shigella flexneri 2a str. 301
caucgcccugauggcg

SEQ ID NO: 1998136 - RNA, 21 nt, Shigella flexneri 2a str. 301
caucgcccugauggcgcgcca

SEQ ID NO: 1998137 - RNA, 19 nt, Shigella flexneri 2a str. 301
caucggauugcuccugcuc

SEQ ID NO: 1998138 - RNA, 20 nt, Shigella flexneri 2a str. 301
caucggcagcgccaaucgcu

SEQ ID NO: 1998139 - RNA, 15 nt, Shigella flexneri 2a str. 301
caucggcagcgccag

SEQ ID NO: 1998140 - RNA, 17 nt, Shigella flexneri 2a str. 301
caucgccacggcaugaa

SEQ ID NO: 1998141 - RNA, 15 nt, Shigella flexneri 2a str. 301
caucgccagcagcca

SEQ ID NO: 1998142 - RNA, 16 nt, Shigella flexneri 2a str. 301
caucgccagcagccau

SEQ ID NO: 1998143 - RNA, 14 nt, Shigella flexneri 2a str. 301
caucgccaaacagg

SEQ ID NO: 1998144 - RNA, 22 nt, Shigella flexneri 2a str. 301
caucgcccaguugaucaccagu

SEQ ID NO: 1998145 - RNA, 17 nt, Shigella flexneri 2a str. 301
caucgccaguuuugcca

SEQ ID NO: 1998146 - RNA, 22 nt, Shigella flexneri 2a str. 301
caucgcauguugauuaccuguc

SEQ ID NO: 1998147 - RNA, 15 nt, Shigella flexneri 2a str. 301
caucgcaucaaaguu

SEQ ID NO: 1998148 - RNA, 18 nt, Shigella flexneri 2a str. 301
caucgaaccaucggcuuu

SEQ ID NO: 1998149 - RNA, 16 nt, Shigella flexneri 2a str. 301
cauccuuugcuggcaa

SEQ ID NO: 1998150 - RNA, 20 nt, Shigella flexneri 2a str. 301
caucgaagagacaaaaaagg

SEQ ID NO: 1998151 - RNA, 23 nt, Shigella flexneri 2a str. 301
cauccggcuuuuuuacaucauca

SEQ ID NO: 1998152 - RNA, 16 nt, Shigella flexneri 2a str. 301
cauccggcauuuugug

SEQ ID NO: 1998153 - RNA, 19 nt, Shigella flexneri 2a str. 301
cauccggcaugaacaaagc

SEQ ID NO: 1998154 - RNA, 22 nt, Shigella flexneri 2a str. 301
cauccggcaugaacaaagcgca

SEQ ID NO: 1998155 - RNA, 17 nt, Shigella flexneri 2a str. 301
cauccggcagccgugcc

SEQ ID NO: 1998156 - RNA, 22 nt, Shigella flexneri 2a str. 301
cauccggcagccgugcccaacu

SEQ ID NO: 1998157 - RNA, 15 nt, Shigella flexneri 2a str. 301
cauccggcauaaaca

SEQ ID NO: 1998158 - RNA, 14 nt, Shigella flexneri 2a str. 301
cauccggcauucag

SEQ ID NO: 1998159 - RNA, 21 nt, Shigella flexneri 2a str. 301
cauccggcauucagugcaaau

SEQ ID NO: 1998160 - RNA, 13 nt, Shigella flexneri 2a str. 301
cauccggcaccuu

SEQ ID NO: 1998161 - RNA, 22 nt, Shigella flexneri 2a str. 301
caucccaggccaaauccuucca

SEQ ID NO: 1998162 - RNA, 15 nt, Shigella flexneri 2a str. 301
caucccagcagagau

SEQ ID NO: 1998163 - RNA, 15 nt, Shigella flexneri 2a str. 301
caucccagacaccgc

SEQ ID NO: 1998164 - RNA, 23 nt, Shigella flexneri 2a str. 301
caucccagugcaauaccauggcu

SEQ ID NO: 1998165 - RNA, 17 nt, Shigella flexneri 2a str. 301
cauccccggcaaccaca

SEQ ID NO: 1998166 - RNA, 20 nt, Shigella flexneri 2a str. 301
cauccccggcaaccacaccc

SEQ ID NO: 1998167 - RNA, 20 nt, Shigella flexneri 2a str. 301
caucccauuucuccagcagu

SEQ ID NO: 1998168 - RNA, 18 nt, Shigella flexneri 2a str. 301
caucccggcagagaaaau

SEQ ID NO: 1998169 - RNA, 15 nt, Shigella flexneri 2a str. 301
cauccgcacaauccc

SEQ ID NO: 1998170 - RNA, 14 nt, Shigella flexneri 2a str. 301
cauccccucuucca

SEQ ID NO: 1998171 - RNA, 17 nt, Shigella flexneri 2a str. 301
caucccgaccaaugcau

SEQ ID NO: 1998172 - RNA, 18 nt, Shigella flexneri 2a str. 301
caucccgagucgcugagc

SEQ ID NO: 1998173 - RNA, 22 nt, Shigella flexneri 2a str. 301
cauccauucuugcgcggauggc

SEQ ID NO: 1998174 - RNA, 17 nt, Shigella flexneri 2a str. 301
cauccauugcauaaaca

SEQ ID NO: 1998175 - RNA, 12 nt, Shigella flexneri 2a str. 301
cauccaucaaau

SEQ ID NO: 1998176 - RNA, 16 nt, Shigella flexneri 2a str. 301
cauccauuacaucacg

SEQ ID NO: 1998177 - RNA, 22 nt, Shigella flexneri 2a str. 301
cauccauucggcgauuaacaag

SEQ ID NO: 1998178 - RNA, 23 nt, Shigella flexneri 2a str. 301
cauccagcuuuuuaaucgccauc

SEQ ID NO: 1998179 - RNA, 17 nt, Shigella flexneri 2a str. 301
cauccaggaacuccaga

SEQ ID NO: 1998180 - RNA, 18 nt, Shigella flexneri 2a str. 301
cauccaggaacuccagau

SEQ ID NO: 1998181 - RNA, 21 nt, Shigella flexneri 2a str. 301
cauccaggaacuccagaucca

SEQ ID NO: 1998182 - RNA, 13 nt, Shigella flexneri 2a str. 301
cauccagcucgug

SEQ ID NO: 1998183 - RNA, 20 nt, Shigella flexneri 2a str. 301
cauccagcuuuuagaucacu

SEQ ID NO: 1998184 - RNA, 21 nt, Shigella flexneri 2a str. 301
cauccagcuuuuuaaucgcca

SEQ ID NO: 1998185 - RNA, 12 nt, Shigella flexneri 2a str. 301
cauccaggccaa

SEQ ID NO: 1998186 - RNA, 21 nt, Shigella flexneri 2a str. 301
cauccaguggcagaguaauug

SEQ ID NO: 1998187 - RNA, 16 nt, Shigella flexneri 2a str. 301
cauccagugccgccug

SEQ ID NO: 1998188 - RNA, 12 nt, Shigella flexneri 2a str. 301
cauccagugcuu

SEQ ID NO: 1998189 - RNA, 19 nt, Shigella flexneri 2a str. 301
cauccaaaucgcccagcaa

SEQ ID NO: 1998190 - RNA, 14 nt, Shigella flexneri 2a str. 301
cauccaacaauagu

SEQ ID NO: 1998191 - RNA, 22 nt, Shigella flexneri 2a str. 301
cauccaacaauagugccgcacu

SEQ ID NO: 1998192 - RNA, 18 nt, Shigella flexneri 2a str. 301
cauccaaaucgcccagca

SEQ ID NO: 1998193 - RNA, 17 nt, Shigella flexneri 2a str. 301
caucauuuuuucaccaa

SEQ ID NO: 1998194 - RNA, 23 nt, Shigella flexneri 2a str. 301
caucaugcucagaugccugaugc

SEQ ID NO: 1998195 - RNA, 13 nt, Shigella flexneri 2a str. 301
caucauggaagca

SEQ ID NO: 1998196 - RNA, 20 nt, Shigella flexneri 2a str. 301
caucaugguuugcauccaca

SEQ ID NO: 1998197 - RNA, 17 nt, Shigella flexneri 2a str. 301
caucaugcacuccgcug

SEQ ID NO: 1998198 - RNA, 18 nt, Shigella flexneri 2a str. 301
caucagcauaaucaccag

SEQ ID NO: 1998199 - RNA, 16 nt, Shigella flexneri 2a str. 301
caucagcaucccaccu

SEQ ID NO: 1998200 - RNA, 23 nt, Shigella flexneri 2a str. 301
caucagcaucggugaggaucacc

SEQ ID NO: 1998201 - RNA, 15 nt, Shigella flexneri 2a str. 301
caucagcaugacaaa

SEQ ID NO: 1998202 - RNA, 13 nt, Shigella flexneri 2a str. 301
caucagcauucuc

SEQ ID NO: 1998203 - RNA, 14 nt, Shigella flexneri 2a str. 301
caucagccagaugc

SEQ ID NO: 1998204 - RNA, 17 nt, Shigella flexneri 2a str. 301
cauccaccagcaugaaa

SEQ ID NO: 1998205 - RNA, 20 nt, Shigella flexneri 2a str. 301
cauccagcguuaccggcuuc

SEQ ID NO: 1998206 - RNA, 22 nt, Shigella flexneri 2a str. 301
cauccagcacuugcaggaacag

SEQ ID NO: 1998207 - RNA, 14 nt, Shigella flexneri 2a str. 301
cauccagcagcaau

SEQ ID NO: 1998208 - RNA, 11 nt, Shigella flexneri 2a str. 301
cauccagcagu

SEQ ID NO: 1998209 - RNA, 15 nt, Shigella flexneri 2a str. 301
cauccagcagugacu

SEQ ID NO: 1998210 - RNA, 15 nt, Shigella flexneri 2a str. 301
cauccagcacuugca

SEQ ID NO: 1998211 - RNA, 20 nt, Shigella flexneri 2a str. 301
cauccagcaacaacagcgcg

SEQ ID NO: 1998212 - RNA, 20 nt, Shigella flexneri 2a str. 301
cauccagaccgcucagcucc

SEQ ID NO: 1998213 - RNA, 14 nt, Shigella flexneri 2a str. 301
caucuuuauauauu

SEQ ID NO: 1998214 - RNA, 21 nt, Shigella flexneri 2a str. 301
caucuuuauauauugggauca

SEQ ID NO: 1998215 - RNA, 18 nt, Shigella flexneri 2a str. 301
caucuuucagaaucaggu

SEQ ID NO: 1998216 - RNA, 18 nt, Shigella flexneri 2a str. 301
caucuucuucaauuuccg

SEQ ID NO: 1998217 - RNA, 21 nt, Shigella flexneri 2a str. 301
caucguguugaugcuccuggc

SEQ ID NO: 1998218 - RNA, 13 nt, Shigella flexneri 2a str. 301
caugaaaugaaaa

SEQ ID NO: 1998219 - RNA, 16 nt, Shigella flexneri 2a str. 301
caugaaaugaaaauca

SEQ ID NO: 1998220 - RNA, 14 nt, Shigella flexneri 2a str. 301
caugaacacacccg

SEQ ID NO: 1998221 - RNA, 12 nt, Shigella flexneri 2a str. 301
caugaaaugaaa

SEQ ID NO: 1998222 - RNA, 17 nt, Shigella flexneri 2a str. 301
caugaaauaaaaauaag

SEQ ID NO: 1998223 - RNA, 20 nt, Shigella flexneri 2a str. 301
caugaaauaaaaauaagaaa

SEQ ID NO: 1998224 - RNA, 19 nt, Shigella flexneri 2a str. 301
caugaaagcgaugcugaug

SEQ ID NO: 1998225 - RNA, 20 nt, Shigella flexneri 2a str. 301
caugaacaccuucucaggcc

SEQ ID NO: 1998226 - RNA, 15 nt, Shigella flexneri 2a str. 301
caugaaccugccgcc

SEQ ID NO: 1998227 - RNA, 21 nt, Shigella flexneri 2a str. 301
caugaacgcccgcaagccaac

SEQ ID NO: 1998228 - RNA, 17 nt, Shigella flexneri 2a str. 301
caugaaaaaacuggcua

SEQ ID NO: 1998229 - RNA, 22 nt, Shigella flexneri 2a str. 301
caugaaaaaacuggcuacccug

SEQ ID NO: 1998230 - RNA, 22 nt, Shigella flexneri 2a str. 301
caugaaacgcguucaggcgaac

SEQ ID NO: 1998231 - RNA, 15 nt, Shigella flexneri 2a str. 301
caucuuugaaaucac

SEQ ID NO: 1998232 - RNA, 15 nt, Shigella flexneri 2a str. 301
caugaauucgacuuu

SEQ ID NO: 1998233 - RNA, 22 nt, Shigella flexneri 2a str. 301
caugacagcgcccgacaagauc

SEQ ID NO: 1998234 - RNA, 16 nt, Shigella flexneri 2a str. 301
caugaccgaucaaggc

SEQ ID NO: 1998235 - RNA, 16 nt, Shigella flexneri 2a str. 301
caugaccgcuccgcca

SEQ ID NO: 1998236 - RNA, 23 nt, Shigella flexneri 2a str. 301
caugaccgugaucguggccauga

SEQ ID NO: 1998237 - RNA, 23 nt, Shigella flexneri 2a str. 301
caugaccacucauuacggucaaa

SEQ ID NO: 1998238 - RNA, 20 nt, Shigella flexneri 2a str. 301
caugaguaacagucaguuau

SEQ ID NO: 1998239 - RNA, 22 nt, Shigella flexneri 2a str. 301
caugauaccgauuacucagcaa

SEQ ID NO: 1998240 - RNA, 19 nt, Shigella flexneri 2a str. 301
caugauaagacgcgccagc

SEQ ID NO: 1998241 - RNA, 20 nt, Shigella flexneri 2a str. 301
caugauaauuccgccgccca

SEQ ID NO: 1998242 - RNA, 14 nt, Shigella flexneri 2a str. 301
caugaguugcugga

SEQ ID NO: 1998243 - RNA, 16 nt, Shigella flexneri 2a str. 301
caugacuacacuaaac

SEQ ID NO: 1998244 - RNA, 19 nt, Shigella flexneri 2a str. 301
caugacgcacuuucgcuuu

SEQ ID NO: 1998245 - RNA, 20 nt, Shigella flexneri 2a str. 301
caugccggccagcgccacca

SEQ ID NO: 1998246 - RNA, 17 nt, Shigella flexneri 2a str. 301
caugccggugaugccgc

SEQ ID NO: 1998247 - RNA, 16 nt, Shigella flexneri 2a str. 301
caugccgucaaaaaac

SEQ ID NO: 1998248 - RNA, 17 nt, Shigella flexneri 2a str. 301
caugccgaucgucuggg

SEQ ID NO: 1998249 - RNA, 14 nt, Shigella flexneri 2a str. 301
caugccuaccaaac

SEQ ID NO: 1998250 - RNA, 15 nt, Shigella flexneri 2a str. 301
caugccuaagcgaac

SEQ ID NO: 1998251 - RNA, 16 nt, Shigella flexneri 2a str. 301
caugcgaauacacccu

SEQ ID NO: 1998252 - RNA, 21 nt, Shigella flexneri 2a str. 301
caugcgauggagugagaaugc

SEQ ID NO: 1998253 - RNA, 14 nt, Shigella flexneri 2a str. 301
caugccauauuguu

SEQ ID NO: 1998254 - RNA, 17 nt, Shigella flexneri 2a str. 301
caugccauauuguuuca

SEQ ID NO: 1998255 - RNA, 16 nt, Shigella flexneri 2a str. 301
caugccaucugccagc

SEQ ID NO: 1998256 - RNA, 16 nt, Shigella flexneri 2a str. 301
caugcccgugcugaca

SEQ ID NO: 1998257 - RNA, 16 nt, Shigella flexneri 2a str. 301
caugccaaaagggagc

SEQ ID NO: 1998258 - RNA, 15 nt, Shigella flexneri 2a str. 301
caugcauaaugcagc

SEQ ID NO: 1998259 - RNA, 18 nt, Shigella flexneri 2a str. 301
caugcauaacagauaaau

SEQ ID NO: 1998260 - RNA, 23 nt, Shigella flexneri 2a str. 301
caugcagggcaaacucugagaga

SEQ ID NO: 1998261 - RNA, 14 nt, Shigella flexneri 2a str. 301
caugcagcuccacc

SEQ ID NO: 1998262 - RNA, 22 nt, Shigella flexneri 2a str. 301
caugcaggcggugcaauuccau

SEQ ID NO: 1998263 - RNA, 17 nt, Shigella flexneri 2a str. 301
caugcagcauggucagg

SEQ ID NO: 1998264 - RNA, 22 nt, Shigella flexneri 2a str. 301
caugcagaucguuuuccugcau

SEQ ID NO: 1998265 - RNA, 20 nt, Shigella flexneri 2a str. 301
caugcacgggcgcuuguuau

SEQ ID NO: 1998266 - RNA, 15 nt, Shigella flexneri 2a str. 301
caugcaaaccaucac

SEQ ID NO: 1998267 - RNA, 19 nt, Shigella flexneri 2a str. 301
caugcaauuaccgccacca

SEQ ID NO: 1998268 - RNA, 10 nt, Shigella flexneri 2a str. 301
caugcaauaa

SEQ ID NO: 1998269 - RNA, 20 nt, Shigella flexneri 2a str. 301
caugcacccucaacaacagc

SEQ ID NO: 1998270 - RNA, 22 nt, Shigella flexneri 2a str. 301
caugcaccugcuuccugaacuc

SEQ ID NO: 1998271 - RNA, 13 nt, Shigella flexneri 2a str. 301
caugcacccucaa

SEQ ID NO: 1998272 - RNA, 14 nt, Shigella flexneri 2a str. 301
caugaugacaacau

SEQ ID NO: 1998273 - RNA, 20 nt, Shigella flexneri 2a str. 301
caugaugaccgggcgcggcu

SEQ ID NO: 1998274 - RNA, 18 nt, Shigella flexneri 2a str. 301
caugaucauucaccagcc

SEQ ID NO: 1998275 - RNA, 16 nt, Shigella flexneri 2a str. 301
caugauucugagaaac

SEQ ID NO: 1998276 - RNA, 20 nt, Shigella flexneri 2a str. 301
caugauguggugcaaggaaa

SEQ ID NO: 1998277 - RNA, 18 nt, Shigella flexneri 2a str. 301
caugauguaagaugaaau

SEQ ID NO: 1998278 - RNA, 23 nt, Shigella flexneri 2a str. 301
caugaugaucuuaugauguaaau

SEQ ID NO: 1998279 - RNA, 14 nt, Shigella flexneri 2a str. 301
caugcguuuguagg

SEQ ID NO: 1998280 - RNA, 20 nt, Shigella flexneri 2a str. 301
caugcguugucgccauccag

SEQ ID NO: 1998281 - RNA, 14 nt, Shigella flexneri 2a str. 301
caugcggauaaauc

SEQ ID NO: 1998282 - RNA, 15 nt, Shigella flexneri 2a str. 301
cauggugucugauga

SEQ ID NO: 1998283 - RNA, 17 nt, Shigella flexneri 2a str. 301
cauggugucugaugagg

SEQ ID NO: 1998284 - RNA, 19 nt, Shigella flexneri 2a str. 301
cauggugucugaugaggca

SEQ ID NO: 1998285 - RNA, 14 nt, Shigella flexneri 2a str. 301
caugguguucagau

SEQ ID NO: 1998286 - RNA, 14 nt, Shigella flexneri 2a str. 301
caugggguuuuucg

SEQ ID NO: 1998287 - RNA, 18 nt, Shigella flexneri 2a str. 301
cauguagccgcuuuuucu

SEQ ID NO: 1998288 - RNA, 18 nt, Shigella flexneri 2a str. 301
caugguuugcauccacaa

SEQ ID NO: 1998289 - RNA, 21 nt, Shigella flexneri 2a str. 301
caugguuggccaucguaugau

SEQ ID NO: 1998290 - RNA, 20 nt, Shigella flexneri 2a str. 301
caugggagaacgaugcugcu

SEQ ID NO: 1998291 - RNA, 17 nt, Shigella flexneri 2a str. 301
cauggcggcagcgugcc

SEQ ID NO: 1998292 - RNA, 20 nt, Shigella flexneri 2a str. 301
cauguucuaugaagaacugg

SEQ ID NO: 1998293 - RNA, 23 nt, Shigella flexneri 2a str. 301
cauguaggaguugcggcuguaau

SEQ ID NO: 1998294 - RNA, 15 nt, Shigella flexneri 2a str. 301
cauguuugaaucaac

SEQ ID NO: 1998295 - RNA, 18 nt, Shigella flexneri 2a str. 301
cauguuguacaugcugcu

SEQ ID NO: 1998296 - RNA, 19 nt, Shigella flexneri 2a str. 301
cauguucauuuauuaccuu

SEQ ID NO: 1998297 - RNA, 16 nt, Shigella flexneri 2a str. 301
cauguugcgcagaguu

SEQ ID NO: 1998298 - RNA, 15 nt, Shigella flexneri 2a str. 301
cauguugcugaccuu

SEQ ID NO: 1998299 - RNA, 14 nt, Shigella flexneri 2a str. 301
cauuaaauccugaa

SEQ ID NO: 1998300 - RNA, 20 nt, Shigella flexneri 2a str. 301
cauuaaauccugaaaccaua

SEQ ID NO: 1998301 - RNA, 13 nt, Shigella flexneri 2a str. 301
cauuaaaaacccg

SEQ ID NO: 1998302 - RNA, 16 nt, Shigella flexneri 2a str. 301
cauuaacaggccaaau

SEQ ID NO: 1998303 - RNA, 15 nt, Shigella flexneri 2a str. 301
cauuaaccagccacu

SEQ ID NO: 1998304 - RNA, 15 nt, Shigella flexneri 2a str. 301
cauuaaccaaccacc

SEQ ID NO: 1998305 - RNA, 19 nt, Shigella flexneri 2a str. 301
cauuaaccguuuacgucau

SEQ ID NO: 1998306 - RNA, 22 nt, Shigella flexneri 2a str. 301
cauuaaccgugcgggcaucauc

SEQ ID NO: 1998307 - RNA, 18 nt, Shigella flexneri 2a str. 301
cauuaagaacuccagccc

SEQ ID NO: 1998308 - RNA, 19 nt, Shigella flexneri 2a str. 301
cauuaagauuaccuuccuc

SEQ ID NO: 1998309 - RNA, 17 nt, Shigella flexneri 2a str. 301
cauuaacgccccaauca

SEQ ID NO: 1998310 - RNA, 13 nt, Shigella flexneri 2a str. 301
cauuacagcgacu

SEQ ID NO: 1998311 - RNA, 14 nt, Shigella flexneri 2a str. 301
cauuaucaaacgug

SEQ ID NO: 1998312 - RNA, 14 nt, Shigella flexneri 2a str. 301
cauuaucaaagaug

SEQ ID NO: 1998313 - RNA, 16 nt, Shigella flexneri 2a str. 301
cauuacaagcccgcug

SEQ ID NO: 1998314 - RNA, 12 nt, Shigella flexneri 2a str. 301
cauuacaacaag

SEQ ID NO: 1998315 - RNA, 18 nt, Shigella flexneri 2a str. 301
cauuaugagugaugugcu

SEQ ID NO: 1998316 - RNA, 13 nt, Shigella flexneri 2a str. 301
cauuaucaccaaa

SEQ ID NO: 1998317 - RNA, 20 nt, Shigella flexneri 2a str. 301
cauuaucagagauucuuuuc

SEQ ID NO: 1998318 - RNA, 12 nt, Shigella flexneri 2a str. 301
cauuauccagcg

SEQ ID NO: 1998319 - RNA, 13 nt, Shigella flexneri 2a str. 301
cauuauccagcga

SEQ ID NO: 1998320 - RNA, 16 nt, Shigella flexneri 2a str. 301
cauuauuaaauuuaau

SEQ ID NO: 1998321 - RNA, 21 nt, Shigella flexneri 2a str. 301
cauuauuaaauuuaauaauaa

SEQ ID NO: 1998322 - RNA, 23 nt, Shigella flexneri 2a str. 301
cauuaugcuggaaucaauaauua

SEQ ID NO: 1998323 - RNA, 15 nt, Shigella flexneri 2a str. 301
cauuauucaggcacu

SEQ ID NO: 1998324 - RNA, 20 nt, Shigella flexneri 2a str. 301
cauucacaaacagcgccugu

SEQ ID NO: 1998325 - RNA, 12 nt, Shigella flexneri 2a str. 301
cauucaccuugg

SEQ ID NO: 1998326 - RNA, 14 nt, Shigella flexneri 2a str. 301
cauucaccaguuga

SEQ ID NO: 1998327 - RNA, 15 nt, Shigella flexneri 2a str. 301
cauucaccauuuuuu

SEQ ID NO: 1998328 - RNA, 18 nt, Shigella flexneri 2a str. 301
cauuccaccgaaacuuuu

SEQ ID NO: 1998329 - RNA, 22 nt, Shigella flexneri 2a str. 301
cauuccagaugugccaguugca

SEQ ID NO: 1998330 - RNA, 23 nt, Shigella flexneri 2a str. 301
cauucaugcgaauacacccugaa

SEQ ID NO: 1998331 - RNA, 23 nt, Shigella flexneri 2a str. 301
cauucagacacgccgccagacca

SEQ ID NO: 1998332 - RNA, 14 nt, Shigella flexneri 2a str. 301
cauucagacaggcg

SEQ ID NO: 1998333 - RNA, 16 nt, Shigella flexneri 2a str. 301
cauucaucgccuucuu

SEQ ID NO: 1998334 - RNA, 14 nt, Shigella flexneri 2a str. 301
cauugacgcuggcu

SEQ ID NO: 1998335 - RNA, 19 nt, Shigella flexneri 2a str. 301
cauugacgauagcgccgcc

SEQ ID NO: 1998336 - RNA, 11 nt, Shigella flexneri 2a str. 301
cauugaaugcg

SEQ ID NO: 1998337 - RNA, 20 nt, Shigella flexneri 2a str. 301
cauugaacuuguagcuuuca

SEQ ID NO: 1998338 - RNA, 15 nt, Shigella flexneri 2a str. 301
cauugaagaauuuuu

SEQ ID NO: 1998339 - RNA, 17 nt, Shigella flexneri 2a str. 301
cauugaagaauuuuugc

SEQ ID NO: 1998340 - RNA, 23 nt, Shigella flexneri 2a str. 301
cauugaacgggugauuuccccua

SEQ ID NO: 1998341 - RNA, 16 nt, Shigella flexneri 2a str. 301
cauucuuccuccagcg

SEQ ID NO: 1998342 - RNA, 22 nt, Shigella flexneri 2a str. 301
cauucccggucaguagaauaau

SEQ ID NO: 1998343 - RNA, 13 nt, Shigella flexneri 2a str. 301
cauuccaguccac

SEQ ID NO: 1998344 - RNA, 18 nt, Shigella flexneri 2a str. 301
cauucccccuuugaccag

SEQ ID NO: 1998345 - RNA, 16 nt, Shigella flexneri 2a str. 301
cauucucacuccagcc

SEQ ID NO: 1998346 - RNA, 18 nt, Shigella flexneri 2a str. 301
cauucucaucaccauucc

SEQ ID NO: 1998347 - RNA, 12 nt, Shigella flexneri 2a str. 301
cauucucacucc

SEQ ID NO: 1998348 - RNA, 13 nt, Shigella flexneri 2a str. 301
cauucucacucca

SEQ ID NO: 1998349 - RNA, 15 nt, Shigella flexneri 2a str. 301
cauucugacuggguc

SEQ ID NO: 1998350 - RNA, 12 nt, Shigella flexneri 2a str. 301
cauucugacugg

SEQ ID NO: 1998351 - RNA, 22 nt, Shigella flexneri 2a str. 301
cauucugcgcugacucuacuga

SEQ ID NO: 1998352 - RNA, 18 nt, Shigella flexneri 2a str. 301
ccucgggauccaugcacg

SEQ ID NO: 1998353 - RNA, 10 nt, Shigella flexneri 2a str. 301
ccugcacaug

SEQ ID NO: 1998354 - RNA, 20 nt, Shigella flexneri 2a str. 301
ccugcacaaauuugccgucg

SEQ ID NO: 1998355 - RNA, 15 nt, Shigella flexneri 2a str. 301
ccugcagggcuuuca

SEQ ID NO: 1998356 - RNA, 16 nt, Shigella flexneri 2a str. 301
ccugcacugcaggccg

SEQ ID NO: 1998357 - RNA, 17 nt, Shigella flexneri 2a str. 301
ccugcacuuaacaggau

SEQ ID NO: 1998358 - RNA, 18 nt, Shigella flexneri 2a str. 301
ccugccaucuggcaggcu

SEQ ID NO: 1998359 - RNA, 18 nt, Shigella flexneri 2a str. 301
ccugcccgcgauccagcg

SEQ ID NO: 1998360 - RNA, 21 nt, Shigella flexneri 2a str. 301
ccugccaguuauagcgcagac

SEQ ID NO: 1998361 - RNA, 19 nt, Shigella flexneri 2a str. 301
ccugccagaggagccauca

SEQ ID NO: 1998362 - RNA, 18 nt, Shigella flexneri 2a str. 301
ccugccagaugcagcggu

SEQ ID NO: 1998363 - RNA, 19 nt, Shigella flexneri 2a str. 301
ccugccagcgccgacagca

SEQ ID NO: 1998364 - RNA, 17 nt, Shigella flexneri 2a str. 301
ccugcagugaaauuaaa

SEQ ID NO: 1998365 - RNA, 13 nt, Shigella flexneri 2a str. 301
ccugcagugaaau

SEQ ID NO: 1998366 - RNA, 14 nt, Shigella flexneri 2a str. 301
ccugcagucaccug

SEQ ID NO: 1998367 - RNA, 21 nt, Shigella flexneri 2a str. 301
ccugcauacgacgugccgcag

SEQ ID NO: 1998368 - RNA, 22 nt, Shigella flexneri 2a str. 301
ccugcgacagggaucucuucca

SEQ ID NO: 1998369 - RNA, 13 nt, Shigella flexneri 2a str. 301
ccugcgacaggga

SEQ ID NO: 1998370 - RNA, 22 nt, Shigella flexneri 2a str. 301
ccugcggcaccuaauaacucuc

SEQ ID NO: 1998371 - RNA, 23 nt, Shigella flexneri 2a str. 301
ccugccgucugggcaaaaucauc

SEQ ID NO: 1998372 - RNA, 23 nt, Shigella flexneri 2a str. 301
ccugcucaagcguuucaucuuca

SEQ ID NO: 1998373 - RNA, 18 nt, Shigella flexneri 2a str. 301
ccugcgguaagucccggc

SEQ ID NO: 1998374 - RNA, 18 nt, Shigella flexneri 2a str. 301
ccugcgggcauuucgcuu

SEQ ID NO: 1998375 - RNA, 18 nt, Shigella flexneri 2a str. 301
ccugcggcuuccagagca

SEQ ID NO: 1998376 - RNA, 18 nt, Shigella flexneri 2a str. 301
ccugcgggagcgcuuuuu

SEQ ID NO: 1998377 - RNA, 15 nt, Shigella flexneri 2a str. 301
ccugcggccagcagc

SEQ ID NO: 1998378 - RNA, 22 nt, Shigella flexneri 2a str. 301
ccugcugcgccuguaacuguuc

SEQ ID NO: 1998379 - RNA, 20 nt, Shigella flexneri 2a str. 301
ccugcuggaaaggccgcgaa

SEQ ID NO: 1998380 - RNA, 13 nt, Shigella flexneri 2a str. 301
ccugcuggguaaa

SEQ ID NO: 1998381 - RNA, 23 nt, Shigella flexneri 2a str. 301
ccugcuggaaaggccgcgaaccg

SEQ ID NO: 1998382 - RNA, 22 nt, Shigella flexneri 2a str. 301
ccugcuuauagcgcaucgcagc

SEQ ID NO: 1998383 - RNA, 22 nt, Shigella flexneri 2a str. 301
ccugcuuccuuaaucccuggau

SEQ ID NO: 1998384 - RNA, 21 nt, Shigella flexneri 2a str. 301
ccugcuuaucgcccugcucca

SEQ ID NO: 1998385 - RNA, 21 nt, Shigella flexneri 2a str. 301
ccugcugucggcgguaagcca

SEQ ID NO: 1998386 - RNA, 13 nt, Shigella flexneri 2a str. 301
ccuggacagcucg

SEQ ID NO: 1998387 - RNA, 15 nt, Shigella flexneri 2a str. 301
ccuggaaccaggcgc

SEQ ID NO: 1998388 - RNA, 22 nt, Shigella flexneri 2a str. 301
ccuggaaaaagugccccagcuu

SEQ ID NO: 1998389 - RNA, 22 nt, Shigella flexneri 2a str. 301
ccugcuuugacaaagcucauug

SEQ ID NO: 1998390 - RNA, 22 nt, Shigella flexneri 2a str. 301
ccuggauugcaggggagcugca

SEQ ID NO: 1998391 - RNA, 16 nt, Shigella flexneri 2a str. 301
ccuggcauguggcggc

SEQ ID NO: 1998392 - RNA, 17 nt, Shigella flexneri 2a str. 301
ccuggcgaacauccagc

SEQ ID NO: 1998393 - RNA, 23 nt, Shigella flexneri 2a str. 301
ccuggccugggaucaucagcaaa

SEQ ID NO: 1998394 - RNA, 18 nt, Shigella flexneri 2a str. 301
ccuggcgcagcugcgcuu

SEQ ID NO: 1998395 - RNA, 17 nt, Shigella flexneri 2a str. 301
ccuggcgcagcugcgcu

SEQ ID NO: 1998396 - RNA, 14 nt, Shigella flexneri 2a str. 301
ccuggcgcuggcgu

SEQ ID NO: 1998397 - RNA, 16 nt, Shigella flexneri 2a str. 301
ccuggcgggaauaaaa

SEQ ID NO: 1998398 - RNA, 15 nt, Shigella flexneri 2a str. 301
ccuggcggggauuau

SEQ ID NO: 1998399 - RNA, 23 nt, Shigella flexneri 2a str. 301
ccuggcgggaauaaaagccagga

SEQ ID NO: 1998400 - RNA, 16 nt, Shigella flexneri 2a str. 301
ccuggcgucuggccca

SEQ ID NO: 1998401 - RNA, 14 nt, Shigella flexneri 2a str. 301
ccuggcucaagcac

SEQ ID NO: 1998402 - RNA, 18 nt, Shigella flexneri 2a str. 301
ccuggcucaagcaccauc

SEQ ID NO: 1998403 - RNA, 23 nt, Shigella flexneri 2a str. 301
ccuggcuuggcuggcgugagccg

SEQ ID NO: 1998404 - RNA, 16 nt, Shigella flexneri 2a str. 301
ccuggcuugccagcca

SEQ ID NO: 1998405 - RNA, 23 nt, Shigella flexneri 2a str. 301
ccuggcugauugauauccagauc

SEQ ID NO: 1998406 - RNA, 12 nt, Shigella flexneri 2a str. 301
ccuggcugguga

SEQ ID NO: 1998407 - RNA, 13 nt, Shigella flexneri 2a str. 301
ccuggucgcugau

SEQ ID NO: 1998408 - RNA, 23 nt, Shigella flexneri 2a str. 301
ccugguguucggcauucugcugg

SEQ ID NO: 1998409 - RNA, 16 nt, Shigella flexneri 2a str. 301
ccugggcaauggugaa

SEQ ID NO: 1998410 - RNA, 13 nt, Shigella flexneri 2a str. 301
ccugggcaauggu

SEQ ID NO: 1998411 - RNA, 13 nt, Shigella flexneri 2a str. 301
ccuucaauaucau

SEQ ID NO: 1998412 - RNA, 16 nt, Shigella flexneri 2a str. 301
ccuucacgcgcuccag

SEQ ID NO: 1998413 - RNA, 22 nt, Shigella flexneri 2a str. 301
ccuucacgaucgaagccgucag

SEQ ID NO: 1998414 - RNA, 22 nt, Shigella flexneri 2a str. 301
ccuucacauuucccggaauaau

SEQ ID NO: 1998415 - RNA, 17 nt, Shigella flexneri 2a str. 301
ccuucacaggccgccag

SEQ ID NO: 1998416 - RNA, 18 nt, Shigella flexneri 2a str. 301
ccuucacgacauaaacau

SEQ ID NO: 1998417 - RNA, 13 nt, Shigella flexneri 2a str. 301
ccuucacccauug

SEQ ID NO: 1998418 - RNA, 22 nt, Shigella flexneri 2a str. 301
ccuuauccagccuacaaaaacu

SEQ ID NO: 1998419 - RNA, 14 nt, Shigella flexneri 2a str. 301
ccuuauccagcaga

SEQ ID NO: 1998420 - RNA, 17 nt, Shigella flexneri 2a str. 301
ccuguaccuucagcggc

SEQ ID NO: 1998421 - RNA, 21 nt, Shigella flexneri 2a str. 301
ccuguaccuucagcggcagcu

SEQ ID NO: 1998422 - RNA, 13 nt, Shigella flexneri 2a str. 301
ccuguacggcagu

SEQ ID NO: 1998423 - RNA, 15 nt, Shigella flexneri 2a str. 301
ccuguacuguuucac

SEQ ID NO: 1998424 - RNA, 15 nt, Shigella flexneri 2a str. 301
ccuuaaucagaauuu

SEQ ID NO: 1998425 - RNA, 23 nt, Shigella flexneri 2a str. 301
ccuugaaaucguuugcauccagc

SEQ ID NO: 1998426 - RNA, 18 nt, Shigella flexneri 2a str. 301
ccuucuuugaacugaaua

SEQ ID NO: 1998427 - RNA, 16 nt, Shigella flexneri 2a str. 301
ccuucuugaacccuuu

SEQ ID NO: 1998428 - RNA, 16 nt, Shigella flexneri 2a str. 301
ccuucuuuaugucgca

SEQ ID NO: 1998429 - RNA, 20 nt, Shigella flexneri 2a str. 301
ccuucgcgguaaugacucca

SEQ ID NO: 1998430 - RNA, 14 nt, Shigella flexneri 2a str. 301
ccuucggauuuccg

SEQ ID NO: 1998431 - RNA, 14 nt, Shigella flexneri 2a str. 301
ccuucggccccauc

SEQ ID NO: 1998432 - RNA, 11 nt, Shigella flexneri 2a str. 301
ccuucuucauc

SEQ ID NO: 1998433 - RNA, 18 nt, Shigella flexneri 2a str. 301
ccuuccuuagcaaaauag

SEQ ID NO: 1998434 - RNA, 19 nt, Shigella flexneri 2a str. 301
ccuucgaaugccgcagcac

SEQ ID NO: 1998435 - RNA, 16 nt, Shigella flexneri 2a str. 301
ccuucagguuuuucag

SEQ ID NO: 1998436 - RNA, 22 nt, Shigella flexneri 2a str. 301
ccuucagucauauuucuguuug

SEQ ID NO: 1998437 - RNA, 14 nt, Shigella flexneri 2a str. 301
ccuucagccaccag

SEQ ID NO: 1998438 - RNA, 15 nt, Shigella flexneri 2a str. 301
ccuuuugcccggcaa

SEQ ID NO: 1998439 - RNA, 17 nt, Shigella flexneri 2a str. 301
ccuuugccuuccagcga

SEQ ID NO: 1998440 - RNA, 14 nt, Shigella flexneri 2a str. 301
ccuuugccaaaaug

SEQ ID NO: 1998441 - RNA, 21 nt, Shigella flexneri 2a str. 301
ccuuucggcgcagucacacca

SEQ ID NO: 1998442 - RNA, 13 nt, Shigella flexneri 2a str. 301
ccuuucggccaug

SEQ ID NO: 1998443 - RNA, 21 nt, Shigella flexneri 2a str. 301
ccuuucguuaaauucuucuga

SEQ ID NO: 1998444 - RNA, 22 nt, Shigella flexneri 2a str. 301
ccuuuccuuaagccagcgcccg

SEQ ID NO: 1998445 - RNA, 12 nt, Shigella flexneri 2a str. 301
ccuuuccuccug

SEQ ID NO: 1998446 - RNA, 13 nt, Shigella flexneri 2a str. 301
ccuuuccugacuc

SEQ ID NO: 1998447 - RNA, 17 nt, Shigella flexneri 2a str. 301
ccuuucccuauuuuuuc

SEQ ID NO: 1998448 - RNA, 16 nt, Shigella flexneri 2a str. 301
ccuuucccuauuuuuu

SEQ ID NO: 1998449 - RNA, 23 nt, Shigella flexneri 2a str. 301
ccuuucaugguugucaccgccag

SEQ ID NO: 1998450 - RNA, 20 nt, Shigella flexneri 2a str. 301
ccuuucagaguuguaccagc

SEQ ID NO: 1998451 - RNA, 19 nt, Shigella flexneri 2a str. 301
ccuuguuucuucaacgaag

SEQ ID NO: 1998452 - RNA, 16 nt, Shigella flexneri 2a str. 301
ccuuuacggcgcguca

SEQ ID NO: 1998453 - RNA, 20 nt, Shigella flexneri 2a str. 301
ccuuuaccgccacagcagcc

SEQ ID NO: 1998454 - RNA, 18 nt, Shigella flexneri 2a str. 301
ccuuuacgaagaaagcaa

SEQ ID NO: 1998455 - RNA, 23 nt, Shigella flexneri 2a str. 301
ccuuucacgccgggaaauuuuuc

SEQ ID NO: 1998456 - RNA, 21 nt, Shigella flexneri 2a str. 301
ccuuucaauaccgccugcaaa

SEQ ID NO: 1998457 - RNA, 12 nt, Shigella flexneri 2a str. 301
ccuuuauuuucu

SEQ ID NO: 1998458 - RNA, 18 nt, Shigella flexneri 2a str. 301
ccuuguuguaaugacaac

SEQ ID NO: 1998459 - RNA, 15 nt, Shigella flexneri 2a str. 301
ccuuguuuaaggaaa

SEQ ID NO: 1998460 - RNA, 19 nt, Shigella flexneri 2a str. 301
ccuugugggccugaaagcu

SEQ ID NO: 1998461 - RNA, 22 nt, Shigella flexneri 2a str. 301
ccuugucaugcagcuccaccga

SEQ ID NO: 1998462 - RNA, 19 nt, Shigella flexneri 2a str. 301
ccuugucaugcagcuccac

SEQ ID NO: 1998463 - RNA, 22 nt, Shigella flexneri 2a str. 301
ccuugucaucgucggccuuaau

SEQ ID NO: 1998464 - RNA, 15 nt, Shigella flexneri 2a str. 301
ccuugcucaaugagu

SEQ ID NO: 1998465 - RNA, 19 nt, Shigella flexneri 2a str. 301
ccuugcucauccauugcuu

SEQ ID NO: 1998466 - RNA, 18 nt, Shigella flexneri 2a str. 301
ccuugcuucgccaguucg

SEQ ID NO: 1998467 - RNA, 13 nt, Shigella flexneri 2a str. 301
ccuugcuucgcca

SEQ ID NO: 1998468 - RNA, 13 nt, Shigella flexneri 2a str. 301
cgacguaaaaaac

SEQ ID NO: 1998469 - RNA, 11 nt, Shigella flexneri 2a str. 301
cgacgggcgac

SEQ ID NO: 1998470 - RNA, 17 nt, Shigella flexneri 2a str. 301
cgacgcugaugucagca

SEQ ID NO: 1998471 - RNA, 13 nt, Shigella flexneri 2a str. 301
cgacgacgcgcgc

SEQ ID NO: 1998472 - RNA, 16 nt, Shigella flexneri 2a str. 301
cgacgcauacgauccu

SEQ ID NO: 1998473 - RNA, 14 nt, Shigella flexneri 2a str. 301
cgacgccaagaaag

SEQ ID NO: 1998474 - RNA, 14 nt, Shigella flexneri 2a str. 301
cgacgacaggcaag

SEQ ID NO: 1998475 - RNA, 12 nt, Shigella flexneri 2a str. 301
cgacgaagaaac

SEQ ID NO: 1998476 - RNA, 20 nt, Shigella flexneri 2a str. 301
cgaccuucgcggucagcgcc

SEQ ID NO: 1998477 - RNA, 22 nt, Shigella flexneri 2a str. 301
cgaccuucgcggucagcgccuc

SEQ ID NO: 1998478 - RNA, 15 nt, Shigella flexneri 2a str. 301
cgacgaacaccaacc

SEQ ID NO: 1998479 - RNA, 23 nt, Shigella flexneri 2a str. 301
cgacauuuccuggcgaacaucca

SEQ ID NO: 1998480 - RNA, 23 nt, Shigella flexneri 2a str. 301
cgacaucuuucugcgcaucuucc

SEQ ID NO: 1998481 - RNA, 15 nt, Shigella flexneri 2a str. 301
cgacaucugucagug

SEQ ID NO: 1998482 - RNA, 12 nt, Shigella flexneri 2a str. 301
cgaccaccaccg

SEQ ID NO: 1998483 - RNA, 12 nt, Shigella flexneri 2a str. 301
cgaccaccacca

SEQ ID NO: 1998484 - RNA, 14 nt, Shigella flexneri 2a str. 301
cgaccaucagcugc

SEQ ID NO: 1998485 - RNA, 18 nt, Shigella flexneri 2a str. 301
cgaccaucagcugccagg

SEQ ID NO: 1998486 - RNA, 17 nt, Shigella flexneri 2a str. 301
cgaccaggcaaaccagu

SEQ ID NO: 1998487 - RNA, 19 nt, Shigella flexneri 2a str. 301
cgaccaucggaucggccau

SEQ ID NO: 1998488 - RNA, 19 nt, Shigella flexneri 2a str. 301
cgaccaucggcaccaccaa

SEQ ID NO: 1998489 - RNA, 21 nt, Shigella flexneri 2a str. 301
cgaccaucuccuuacugcccc

SEQ ID NO: 1998490 - RNA, 13 nt, Shigella flexneri 2a str. 301
cgaccacuucaug

SEQ ID NO: 1998491 - RNA, 21 nt, Shigella flexneri 2a str. 301
cgaccagaucggucagugcca

SEQ ID NO: 1998492 - RNA, 12 nt, Shigella flexneri 2a str. 301
cgaccaggcaaa

SEQ ID NO: 1998493 - RNA, 22 nt, Shigella flexneri 2a str. 301
cgaccagcggaauucccgcuuc

SEQ ID NO: 1998494 - RNA, 21 nt, Shigella flexneri 2a str. 301
cgacccgacagaugcucgcca

SEQ ID NO: 1998495 - RNA, 16 nt, Shigella flexneri 2a str. 301
cgacccagaaacaggc

SEQ ID NO: 1998496 - RNA, 17 nt, Shigella flexneri 2a str. 301
cgaccgaacagaucacg

SEQ ID NO: 1998497 - RNA, 12 nt, Shigella flexneri 2a str. 301
cgaccgcagcau

SEQ ID NO: 1998498 - RNA, 22 nt, Shigella flexneri 2a str. 301
cgaccucaaaggccgacagcag

SEQ ID NO: 1998499 - RNA, 21 nt, Shigella flexneri 2a str. 301
cgaccucaagcucgccaccau

SEQ ID NO: 1998500 - RNA, 17 nt, Shigella flexneri 2a str. 301
cgaccggguuagucugg

SEQ ID NO: 1998501 - RNA, 21 nt, Shigella flexneri 2a str. 301
cgaccggccauuccagcaccc

SEQ ID NO: 1998502 - RNA, 19 nt, Shigella flexneri 2a str. 301
cgaccggcguaacggccac

SEQ ID NO: 1998503 - RNA, 17 nt, Shigella flexneri 2a str. 301
cgaagcccucaaacaac

SEQ ID NO: 1998504 - RNA, 23 nt, Shigella flexneri 2a str. 301
cgaagcccucaaacaacacagcg

SEQ ID NO: 1998505 - RNA, 18 nt, Shigella flexneri 2a str. 301
cgaagcucuguauauaaa

SEQ ID NO: 1998506 - RNA, 19 nt, Shigella flexneri 2a str. 301
cgaagcucuguauauaaau

SEQ ID NO: 1998507 - RNA, 21 nt, Shigella flexneri 2a str. 301
cgaagcccaucaguacaccac

SEQ ID NO: 1998508 - RNA, 23 nt, Shigella flexneri 2a str. 301
cgaagccauaucguucugccaga

SEQ ID NO: 1998509 - RNA, 21 nt, Shigella flexneri 2a str. 301
cgaagauguuguacagcgaaa

SEQ ID NO: 1998510 - RNA, 15 nt, Shigella flexneri 2a str. 301
cgaagccaauuugcg

SEQ ID NO: 1998511 - RNA, 18 nt, Shigella flexneri 2a str. 301
cgaagauuucguuuucua

SEQ ID NO: 1998512 - RNA, 22 nt, Shigella flexneri 2a str. 301
cgaagauggcauacaacgccau

SEQ ID NO: 1998513 - RNA, 15 nt, Shigella flexneri 2a str. 301
cgaaccuucgaaguc

SEQ ID NO: 1998514 - RNA, 18 nt, Shigella flexneri 2a str. 301
cgaaccuucgaagucgau

SEQ ID NO: 1998515 - RNA, 15 nt, Shigella flexneri 2a str. 301
ccuuuuuacccaugg

SEQ ID NO: 1998516 - RNA, 12 nt, Shigella flexneri 2a str. 301
ccuuuugcgcuc

SEQ ID NO: 1998517 - RNA, 13 nt, Shigella flexneri 2a str. 301
ccuuuuucaagcu

SEQ ID NO: 1998518 - RNA, 15 nt, Shigella flexneri 2a str. 301
cgaacuauuaaaauu

SEQ ID NO: 1998519 - RNA, 17 nt, Shigella flexneri 2a str. 301
cgaacguuuaauaaaac

SEQ ID NO: 1998520 - RNA, 17 nt, Shigella flexneri 2a str. 301
cgaacuccgaucccugc

SEQ ID NO: 1998521 - RNA, 16 nt, Shigella flexneri 2a str. 301
cgaacggguaaggaac

SEQ ID NO: 1998522 - RNA, 16 nt, Shigella flexneri 2a str. 301
cgaacguccagccagg

SEQ ID NO: 1998523 - RNA, 14 nt, Shigella flexneri 2a str. 301
cgaaucaacuccag

SEQ ID NO: 1998524 - RNA, 16 nt, Shigella flexneri 2a str. 301
cgaauauguuuuugca

SEQ ID NO: 1998525 - RNA, 16 nt, Shigella flexneri 2a str. 301
cgaaguuuuccucagu

SEQ ID NO: 1998526 - RNA, 12 nt, Shigella flexneri 2a str. 301
cgaaguuuuccu

SEQ ID NO: 1998527 - RNA, 21 nt, Shigella flexneri 2a str. 301
cgaaguggacgaacaguucaa

SEQ ID NO: 1998528 - RNA, 20 nt, Shigella flexneri 2a str. 301
cgaaguuguagcuggcuucg

SEQ ID NO: 1998529 - RNA, 16 nt, Shigella flexneri 2a str. 301
cgaaucugauuagccu

SEQ ID NO: 1998530 - RNA, 23 nt, Shigella flexneri 2a str. 301
cgaaugaaagaagcuuuccacgc

SEQ ID NO: 1998531 - RNA, 17 nt, Shigella flexneri 2a str. 301
cgaaucgcuucauuuac

SEQ ID NO: 1998532 - RNA, 22 nt, Shigella flexneri 2a str. 301
cgaauggcaucuacgcucucuu

SEQ ID NO: 1998533 - RNA, 21 nt, Shigella flexneri 2a str. 301
cgaauggaaagcccgccccgc

SEQ ID NO: 1998534 - RNA, 15 nt, Shigella flexneri 2a str. 301
cgaaugcagcuccac

SEQ ID NO: 1998535 - RNA, 17 nt, Shigella flexneri 2a str. 301
cgaauggguucgauuuc

SEQ ID NO: 1998536 - RNA, 17 nt, Shigella flexneri 2a str. 301
cgaauguuccaucacca

SEQ ID NO: 1998537 - RNA, 15 nt, Shigella flexneri 2a str. 301
cgaauuagcauggcu

SEQ ID NO: 1998538 - RNA, 18 nt, Shigella flexneri 2a str. 301
cgacagggaucucuucca

SEQ ID NO: 1998539 - RNA, 22 nt, Shigella flexneri 2a str. 301
cgacagggaucucuuccagugc

SEQ ID NO: 1998540 - RNA, 13 nt, Shigella flexneri 2a str. 301
cgacaggaacgcc

SEQ ID NO: 1998541 - RNA, 20 nt, Shigella flexneri 2a str. 301
cgacaguaccagcaguacag

SEQ ID NO: 1998542 - RNA, 19 nt, Shigella flexneri 2a str. 301
cgacauccaugcacugcaa

SEQ ID NO: 1998543 - RNA, 23 nt, Shigella flexneri 2a str. 301
cgacaucgccacggcaugaaagc

SEQ ID NO: 1998544 - RNA, 20 nt, Shigella flexneri 2a str. 301
cgacaucgacguagugaaau

SEQ ID NO: 1998545 - RNA, 16 nt, Shigella flexneri 2a str. 301
cgacaguuucaccugc

SEQ ID NO: 1998546 - RNA, 20 nt, Shigella flexneri 2a str. 301
cgacaguuucaccugcugau

SEQ ID NO: 1998547 - RNA, 23 nt, Shigella flexneri 2a str. 301
cgacauacucagcgccugcugca

SEQ ID NO: 1998548 - RNA, 19 nt, Shigella flexneri 2a str. 301
cgacagcguuucgccaccc

SEQ ID NO: 1998549 - RNA, 21 nt, Shigella flexneri 2a str. 301
cgacagaacggauaucgagaa

SEQ ID NO: 1998550 - RNA, 14 nt, Shigella flexneri 2a str. 301
cgacagaugcucgc

SEQ ID NO: 1998551 - RNA, 23 nt, Shigella flexneri 2a str. 301
cgacaaccugaccuuuuuucagc

SEQ ID NO: 1998552 - RNA, 22 nt, Shigella flexneri 2a str. 301
cgacaaauuucaucgcuacacc

SEQ ID NO: 1998553 - RNA, 22 nt, Shigella flexneri 2a str. 301
cgacaaaaucggaaacaaauac

SEQ ID NO: 1998554 - RNA, 21 nt, Shigella flexneri 2a str. 301
cgacaaaaucggaaacaaaua

SEQ ID NO: 1998555 - RNA, 16 nt, Shigella flexneri 2a str. 301
cgacaaaaauuacugc

SEQ ID NO: 1998556 - RNA, 22 nt, Shigella flexneri 2a str. 301
cgaauuuuccaugaccugccag

SEQ ID NO: 1998557 - RNA, 11 nt, Shigella flexneri 2a str. 301
cgacaccgccu

SEQ ID NO: 1998558 - RNA, 16 nt, Shigella flexneri 2a str. 301
cgacaagauccugaua

SEQ ID NO: 1998559 - RNA, 18 nt, Shigella flexneri 2a str. 301
cgacaacuggcagcaccg

SEQ ID NO: 1998560 - RNA, 17 nt, Shigella flexneri 2a str. 301
cgacaauaugcucucca

SEQ ID NO: 1998561 - RNA, 16 nt, Shigella flexneri 2a str. 301
cgacaaucgcaaauau

SEQ ID NO: 1998562 - RNA, 23 nt, Shigella flexneri 2a str. 301
cgacaauucgcguaguaaagccu

SEQ ID NO: 1998563 - RNA, 14 nt, Shigella flexneri 2a str. 301
cgacaauauugaug

SEQ ID NO: 1998564 - RNA, 18 nt, Shigella flexneri 2a str. 301
cgacaauaaucaccacac

SEQ ID NO: 1998565 - RNA, 13 nt, Shigella flexneri 2a str. 301
cgacaaugccaca

SEQ ID NO: 1998566 - RNA, 16 nt, Shigella flexneri 2a str. 301
cgacaaugccacaaac

SEQ ID NO: 1998567 - RNA, 21 nt, Shigella flexneri 2a str. 301
ccgguaugaauuugcagccau

SEQ ID NO: 1998568 - RNA, 20 nt, Shigella flexneri 2a str. 301
ccgguaucaaacccuuccau

SEQ ID NO: 1998569 - RNA, 18 nt, Shigella flexneri 2a str. 301
ccggucagcagcaccacc

SEQ ID NO: 1998570 - RNA, 13 nt, Shigella flexneri 2a str. 301
ccggucagguggu

SEQ ID NO: 1998571 - RNA, 13 nt, Shigella flexneri 2a str. 301
ccgguggcauccg

SEQ ID NO: 1998572 - RNA, 16 nt, Shigella flexneri 2a str. 301
ccgggugaacugccac

SEQ ID NO: 1998573 - RNA, 23 nt, Shigella flexneri 2a str. 301
ccgggugaacugccacacaggcc

SEQ ID NO: 1998574 - RNA, 14 nt, Shigella flexneri 2a str. 301
ccgggugaacugcc

SEQ ID NO: 1998575 - RNA, 13 nt, Shigella flexneri 2a str. 301
ccgggugcagaca

SEQ ID NO: 1998576 - RNA, 14 nt, Shigella flexneri 2a str. 301
ccgguaaucaggca

SEQ ID NO: 1998577 - RNA, 21 nt, Shigella flexneri 2a str. 301
ccgguaacguccaucacuucg

SEQ ID NO: 1998578 - RNA, 21 nt, Shigella flexneri 2a str. 301
ccgguacaaacaucauccagu

SEQ ID NO: 1998579 - RNA, 17 nt, Shigella flexneri 2a str. 301
ccggguuugccacauca

SEQ ID NO: 1998580 - RNA, 19 nt, Shigella flexneri 2a str. 301
ccggguuuucaaugauaaa

SEQ ID NO: 1998581 - RNA, 15 nt, Shigella flexneri 2a str. 301
ccgguaaagcaauga

SEQ ID NO: 1998582 - RNA, 14 nt, Shigella flexneri 2a str. 301
ccgggcacacuuag

SEQ ID NO: 1998583 - RNA, 13 nt, Shigella flexneri 2a str. 301
ccgggauugagau

SEQ ID NO: 1998584 - RNA, 17 nt, Shigella flexneri 2a str. 301
ccgggauggucagcgga

SEQ ID NO: 1998585 - RNA, 14 nt, Shigella flexneri 2a str. 301
ccgggcaaaaguca

SEQ ID NO: 1998586 - RNA, 22 nt, Shigella flexneri 2a str. 301
ccggcuccgguuaacgccgcgc

SEQ ID NO: 1998587 - RNA, 14 nt, Shigella flexneri 2a str. 301
ccgggcauauuucc

SEQ ID NO: 1998588 - RNA, 15 nt, Shigella flexneri 2a str. 301
ccgggcgauccggca

SEQ ID NO: 1998589 - RNA, 22 nt, Shigella flexneri 2a str. 301
aaaccgcgaugaccaaaaacau

SEQ ID NO: 1998590 - RNA, 19 nt, Shigella flexneri 2a str. 301
aaaccgccucaggcaacau

SEQ ID NO: 1998591 - RNA, 23 nt, Shigella flexneri 2a str. 301
aaaccgcgcagcgggcauuuuca

SEQ ID NO: 1998592 - RNA, 17 nt, Shigella flexneri 2a str. 301
ccggcgucgcauccggc

SEQ ID NO: 1998593 - RNA, 22 nt, Shigella flexneri 2a str. 301
ccggcguccaccugcgucgcgc

SEQ ID NO: 1998594 - RNA, 23 nt, Shigella flexneri 2a str. 301
ccggcguaccuuugccuuccagc

SEQ ID NO: 1998595 - RNA, 21 nt, Shigella flexneri 2a str. 301
ccggccaguaagcaguccagc

SEQ ID NO: 1998596 - RNA, 14 nt, Shigella flexneri 2a str. 301
ccggcaugaacaaa

SEQ ID NO: 1998597 - RNA, 19 nt, Shigella flexneri 2a str. 301
ccggcauccagccaaacau

SEQ ID NO: 1998598 - RNA, 23 nt, Shigella flexneri 2a str. 301
ccggcaucguuugcugccuucac

SEQ ID NO: 1998599 - RNA, 14 nt, Shigella flexneri 2a str. 301
ccggccuacacaug

SEQ ID NO: 1998600 - RNA, 16 nt, Shigella flexneri 2a str. 301
ccggcgaaagagcugg

SEQ ID NO: 1998601 - RNA, 13 nt, Shigella flexneri 2a str. 301
ccggcagagaaaa

SEQ ID NO: 1998602 - RNA, 22 nt, Shigella flexneri 2a str. 301
ccggcagagaaaaugccgcaca

SEQ ID NO: 1998603 - RNA, 18 nt, Shigella flexneri 2a str. 301
ccggcagaagcaaucauc

SEQ ID NO: 1998604 - RNA, 17 nt, Shigella flexneri 2a str. 301
ccggcagccccaaacag

SEQ ID NO: 1998605 - RNA, 15 nt, Shigella flexneri 2a str. 301
ccggcagcaugugua

SEQ ID NO: 1998606 - RNA, 14 nt, Shigella flexneri 2a str. 301
ccggcagucggcgc

SEQ ID NO: 1998607 - RNA, 15 nt, Shigella flexneri 2a str. 301
ccggcauaaacaacg

SEQ ID NO: 1998608 - RNA, 17 nt, Shigella flexneri 2a str. 301
ccggcauauccaccacc

SEQ ID NO: 1998609 - RNA, 15 nt, Shigella flexneri 2a str. 301
ccggcacauuucacu

SEQ ID NO: 1998610 - RNA, 19 nt, Shigella flexneri 2a str. 301
ccggcaaucggugcaaaug

SEQ ID NO: 1998611 - RNA, 16 nt, Shigella flexneri 2a str. 301
ccggcaaucgccagau

SEQ ID NO: 1998612 - RNA, 19 nt, Shigella flexneri 2a str. 301
ccggcaauaaaacagggcg

SEQ ID NO: 1998613 - RNA, 23 nt, Shigella flexneri 2a str. 301
ccggcaauaaaacagggcggaac

SEQ ID NO: 1998614 - RNA, 22 nt, Shigella flexneri 2a str. 301
ccggcaauucucugcuccugau

SEQ ID NO: 1998615 - RNA, 20 nt, Shigella flexneri 2a str. 301
ccggcacguuuuggcagaca

SEQ ID NO: 1998616 - RNA, 20 nt, Shigella flexneri 2a str. 301
ccgcuuucucugcaagaacu

SEQ ID NO: 1998617 - RNA, 16 nt, Shigella flexneri 2a str. 301
ccgcuuuccaggcauc

SEQ ID NO: 1998618 - RNA, 18 nt, Shigella flexneri 2a str. 301
ccgcuuuccaggcugugu

SEQ ID NO: 1998619 - RNA, 13 nt, Shigella flexneri 2a str. 301
ccgcuucgcucac

SEQ ID NO: 1998620 - RNA, 15 nt, Shigella flexneri 2a str. 301
ccgcuuuuccagcau

SEQ ID NO: 1998621 - RNA, 14 nt, Shigella flexneri 2a str. 301
ccgcuuuuccagca

SEQ ID NO: 1998622 - RNA, 12 nt, Shigella flexneri 2a str. 301
ccgcuuuuucaa

SEQ ID NO: 1998623 - RNA, 17 nt, Shigella flexneri 2a str. 301
ccgcuuucaauuagcuu

SEQ ID NO: 1998624 - RNA, 20 nt, Shigella flexneri 2a str. 301
ccggacccuggucaguuuca

SEQ ID NO: 1998625 - RNA, 17 nt, Shigella flexneri 2a str. 301
ccgcuguaauugccgcu

SEQ ID NO: 1998626 - RNA, 21 nt, Shigella flexneri 2a str. 301
ccgcugucgcagcgugcucuc

SEQ ID NO: 1998627 - RNA, 22 nt, Shigella flexneri 2a str. 301
ccgcuucaacgaccgcuuuugu

SEQ ID NO: 1998628 - RNA, 19 nt, Shigella flexneri 2a str. 301
ccgcuucaaucuucgauuu

SEQ ID NO: 1998629 - RNA, 16 nt, Shigella flexneri 2a str. 301
ccgcuucaaaguucug

SEQ ID NO: 1998630 - RNA, 21 nt, Shigella flexneri 2a str. 301
ccgcuuacaucaacucucuuu

SEQ ID NO: 1998631 - RNA, 13 nt, Shigella flexneri 2a str. 301
ccgcuuccagaaa

SEQ ID NO: 1998632 - RNA, 14 nt, Shigella flexneri 2a str. 301
ccgcuuccagcucc

SEQ ID NO: 1998633 - RNA, 13 nt, Shigella flexneri 2a str. 301
ccgcuucgcccgc

SEQ ID NO: 1998634 - RNA, 10 nt, Shigella flexneri 2a str. 301
ccgcuucccu

SEQ ID NO: 1998635 - RNA, 19 nt, Shigella flexneri 2a str. 301
ccggacggacuuccagcgg

SEQ ID NO: 1998636 - RNA, 14 nt, Shigella flexneri 2a str. 301
ccggauaucccagc

SEQ ID NO: 1998637 - RNA, 16 nt, Shigella flexneri 2a str. 301
ccggauauccacccgc

SEQ ID NO: 1998638 - RNA, 19 nt, Shigella flexneri 2a str. 301
ccggaugcgacauagaucu

SEQ ID NO: 1998639 - RNA, 15 nt, Shigella flexneri 2a str. 301
ccggaugccucuccu

SEQ ID NO: 1998640 - RNA, 22 nt, Shigella flexneri 2a str. 301
ccggaugcggcguaaacgcuuu

SEQ ID NO: 1998641 - RNA, 22 nt, Shigella flexneri 2a str. 301
ccggaugcggcgugaacgccuu

SEQ ID NO: 1998642 - RNA, 20 nt, Shigella flexneri 2a str. 301
ccggaugacacaucaccucc

SEQ ID NO: 1998643 - RNA, 13 nt, Shigella flexneri 2a str. 301
ccggauggcagag

SEQ ID NO: 1998644 - RNA, 14 nt, Shigella flexneri 2a str. 301
ccggauucagauug

SEQ ID NO: 1998645 - RNA, 19 nt, Shigella flexneri 2a str. 301
ccggcaacguugcccguac

SEQ ID NO: 1998646 - RNA, 19 nt, Shigella flexneri 2a str. 301
ccggcaagauuccagugcc

SEQ ID NO: 1998647 - RNA, 14 nt, Shigella flexneri 2a str. 301
ccggcaagauucca

SEQ ID NO: 1998648 - RNA, 14 nt, Shigella flexneri 2a str. 301
ccggcaaccacacc

SEQ ID NO: 1998649 - RNA, 18 nt, Shigella flexneri 2a str. 301
ccggcaacgucaguccca

SEQ ID NO: 1998650 - RNA, 15 nt, Shigella flexneri 2a str. 301
ccggcaauaaaacag

SEQ ID NO: 1998651 - RNA, 17 nt, Shigella flexneri 2a str. 301
ccggauuuucaccaucg

SEQ ID NO: 1998652 - RNA, 18 nt, Shigella flexneri 2a str. 301
ccggcaaaaacaacgagc

SEQ ID NO: 1998653 - RNA, 11 nt, Shigella flexneri 2a str. 301
ccggcaaaugu

SEQ ID NO: 1998654 - RNA, 22 nt, Shigella flexneri 2a str. 301
ccuacacauuaucucaacacac

SEQ ID NO: 1998655 - RNA, 18 nt, Shigella flexneri 2a str. 301
ccuacacauuaucucaac

SEQ ID NO: 1998656 - RNA, 23 nt, Shigella flexneri 2a str. 301
ccuacauagucccugcaauagau

SEQ ID NO: 1998657 - RNA, 20 nt, Shigella flexneri 2a str. 301
ccuacaugauuucugcaaua

SEQ ID NO: 1998658 - RNA, 12 nt, Shigella flexneri 2a str. 301
ccuaccaaaccu

SEQ ID NO: 1998659 - RNA, 16 nt, Shigella flexneri 2a str. 301
ccuaccaaaccugcac

SEQ ID NO: 1998660 - RNA, 14 nt, Shigella flexneri 2a str. 301
ccuaccauaaucag

SEQ ID NO: 1998661 - RNA, 23 nt, Shigella flexneri 2a str. 301
ccuaccauaaucagcguaugcag

SEQ ID NO: 1998662 - RNA, 19 nt, Shigella flexneri 2a str. 301
ccuacaacuccguugaaau

SEQ ID NO: 1998663 - RNA, 13 nt, Shigella flexneri 2a str. 301
ccuacaaaaucua

SEQ ID NO: 1998664 - RNA, 19 nt, Shigella flexneri 2a str. 301
ccuacaaaaucuugcaaaa

SEQ ID NO: 1998665 - RNA, 13 nt, Shigella flexneri 2a str. 301
ccuaauuuuuuga

SEQ ID NO: 1998666 - RNA, 13 nt, Shigella flexneri 2a str. 301
ccuacaaaaccug

SEQ ID NO: 1998667 - RNA, 17 nt, Shigella flexneri 2a str. 301
ccuaauuacauaacacu

SEQ ID NO: 1998668 - RNA, 18 nt, Shigella flexneri 2a str. 301
ccuaauuacauaacacua

SEQ ID NO: 1998669 - RNA, 22 nt, Shigella flexneri 2a str. 301
ccuacgugcgcaauaacccaga

SEQ ID NO: 1998670 - RNA, 18 nt, Shigella flexneri 2a str. 301
ccuacucucgcaugggga

SEQ ID NO: 1998671 - RNA, 21 nt, Shigella flexneri 2a str. 301
ccuacuuuuuaauucaggaaa

SEQ ID NO: 1998672 - RNA, 16 nt, Shigella flexneri 2a str. 301
ccuagcaaacuaucug

SEQ ID NO: 1998673 - RNA, 17 nt, Shigella flexneri 2a str. 301
ccuaccugcaguucauc

SEQ ID NO: 1998674 - RNA, 18 nt, Shigella flexneri 2a str. 301
ccuaccugcaguucauca

SEQ ID NO: 1998675 - RNA, 19 nt, Shigella flexneri 2a str. 301
ccuaccgccagguuucaau

SEQ ID NO: 1998676 - RNA, 21 nt, Shigella flexneri 2a str. 301
ccuacgugguuuaugcaauau

SEQ ID NO: 1998677 - RNA, 19 nt, Shigella flexneri 2a str. 301
ccuaguaccguuuuguaga

SEQ ID NO: 1998678 - RNA, 14 nt, Shigella flexneri 2a str. 301
ccuaggcauagaaa

SEQ ID NO: 1998679 - RNA, 12 nt, Shigella flexneri 2a str. 301
ccuauugcugcu

SEQ ID NO: 1998680 - RNA, 22 nt, Shigella flexneri 2a str. 301
ccuaucgaugaacgguuuaaac

SEQ ID NO: 1998681 - RNA, 14 nt, Shigella flexneri 2a str. 301
ccuauccagaagcc

SEQ ID NO: 1998682 - RNA, 17 nt, Shigella flexneri 2a str. 301
ccucacagcuaaucauc

SEQ ID NO: 1998683 - RNA, 22 nt, Shigella flexneri 2a str. 301
ccucaccauuccguuucuccac

SEQ ID NO: 1998684 - RNA, 15 nt, Shigella flexneri 2a str. 301
ccucacccuaacccu

SEQ ID NO: 1998685 - RNA, 19 nt, Shigella flexneri 2a str. 301
ccucagaguuaaccugaaa

SEQ ID NO: 1998686 - RNA, 20 nt, Shigella flexneri 2a str. 301
ccucaauuagcggcucaugu

SEQ ID NO: 1998687 - RNA, 19 nt, Shigella flexneri 2a str. 301
aaacgcaaacaccagcgaa

SEQ ID NO: 1998688 - RNA, 19 nt, Shigella flexneri 2a str. 301
aaacgcaagguuguugaaa

SEQ ID NO: 1998689 - RNA, 18 nt, Shigella flexneri 2a str. 301
ccuccacauucagucccg

SEQ ID NO: 1998690 - RNA, 19 nt, Shigella flexneri 2a str. 301
ccuccuguucugugcgcca

SEQ ID NO: 1998691 - RNA, 18 nt, Shigella flexneri 2a str. 301
ccuccugucuucccugcu

SEQ ID NO: 1998692 - RNA, 20 nt, Shigella flexneri 2a str. 301
ccuccuguucugcgcgccau

SEQ ID NO: 1998693 - RNA, 18 nt, Shigella flexneri 2a str. 301
ccuccgggaccuuucuga

SEQ ID NO: 1998694 - RNA, 23 nt, Shigella flexneri 2a str. 301
ccuccgggaccuuucugaugcau

SEQ ID NO: 1998695 - RNA, 15 nt, Shigella flexneri 2a str. 301
ccuccggcguuucag

SEQ ID NO: 1998696 - RNA, 14 nt, Shigella flexneri 2a str. 301
ccuccggcguacag

SEQ ID NO: 1998697 - RNA, 20 nt, Shigella flexneri 2a str. 301
ccuccauaagaguagcccga

SEQ ID NO: 1998698 - RNA, 17 nt, Shigella flexneri 2a str. 301
ccuccauugaauuuuau

SEQ ID NO: 1998699 - RNA, 15 nt, Shigella flexneri 2a str. 301
ccucgccgcuucccu

SEQ ID NO: 1998700 - RNA, 17 nt, Shigella flexneri 2a str. 301
ccucgaucggcucuucc

SEQ ID NO: 1998701 - RNA, 16 nt, Shigella flexneri 2a str. 301
ccucgaguccuuccag

SEQ ID NO: 1998702 - RNA, 22 nt, Shigella flexneri 2a str. 301
ccucgagaaauuuuuauuauuu

SEQ ID NO: 1998703 - RNA, 17 nt, Shigella flexneri 2a str. 301
ccuccuuuuaucaucac

SEQ ID NO: 1998704 - RNA, 19 nt, Shigella flexneri 2a str. 301
ccucgaccccgaacucauc

SEQ ID NO: 1998705 - RNA, 20 nt, Shigella flexneri 2a str. 301
ccguugugcgauccacgcca

SEQ ID NO: 1998706 - RNA, 18 nt, Shigella flexneri 2a str. 301
ccguuucccugucucuca

SEQ ID NO: 1998707 - RNA, 15 nt, Shigella flexneri 2a str. 301
ccguuuacggcuaaa

SEQ ID NO: 1998708 - RNA, 15 nt, Shigella flexneri 2a str. 301
ccguugaccagcauc

SEQ ID NO: 1998709 - RNA, 12 nt, Shigella flexneri 2a str. 301
ccguucuucccg

SEQ ID NO: 1998710 - RNA, 19 nt, Shigella flexneri 2a str. 301
ccguucuuaagauauaaag

SEQ ID NO: 1998711 - RNA, 17 nt, Shigella flexneri 2a str. 301
ccguucgcuaccuuuca

SEQ ID NO: 1998712 - RNA, 23 nt, Shigella flexneri 2a str. 301
ccguucauauggagcaaaagugg

SEQ ID NO: 1998713 - RNA, 17 nt, Shigella flexneri 2a str. 301
ccguuacgauucucugc

SEQ ID NO: 1998714 - RNA, 19 nt, Shigella flexneri 2a str. 301
ccguuauccugaucaagca

SEQ ID NO: 1998715 - RNA, 15 nt, Shigella flexneri 2a str. 301
ccguuaucacagcag

SEQ ID NO: 1998716 - RNA, 18 nt, Shigella flexneri 2a str. 301
ccguuauuacgcccgcca

SEQ ID NO: 1998717 - RNA, 17 nt, Shigella flexneri 2a str. 301
ccguucaaaacagcccu

SEQ ID NO: 1998718 - RNA, 17 nt, Shigella flexneri 2a str. 301
ccguuaaguuuaacugc

SEQ ID NO: 1998719 - RNA, 13 nt, Shigella flexneri 2a str. 301
ccguuaagcugga

SEQ ID NO: 1998720 - RNA, 20 nt, Shigella flexneri 2a str. 301
ccguuaacccgucugguuug

SEQ ID NO: 1998721 - RNA, 13 nt, Shigella flexneri 2a str. 301
ccuaaggaaucca

SEQ ID NO: 1998722 - RNA, 22 nt, Shigella flexneri 2a str. 301
ccuaaaggcaaaaugccagccc

SEQ ID NO: 1998723 - RNA, 14 nt, Shigella flexneri 2a str. 301
ccuaaagggcggca

SEQ ID NO: 1998724 - RNA, 13 nt, Shigella flexneri 2a str. 301
ccuaaaggcaaaa

SEQ ID NO: 1998725 - RNA, 21 nt, Shigella flexneri 2a str. 301
ccuaacacaugcaagucgaac

SEQ ID NO: 1998726 - RNA, 18 nt, Shigella flexneri 2a str. 301
ccuaacaaccauccccaa

SEQ ID NO: 1998727 - RNA, 15 nt, Shigella flexneri 2a str. 301
ccuaacauuuuacuu

SEQ ID NO: 1998728 - RNA, 23 nt, Shigella flexneri 2a str. 301
ccuaacccucuccccaagggggc

SEQ ID NO: 1998729 - RNA, 15 nt, Shigella flexneri 2a str. 301
ccuaacaaggcuucg

SEQ ID NO: 1998730 - RNA, 20 nt, Shigella flexneri 2a str. 301
ccguuucuacaagcagagag

SEQ ID NO: 1998731 - RNA, 12 nt, Shigella flexneri 2a str. 301
ccguuuucucca

SEQ ID NO: 1998732 - RNA, 23 nt, Shigella flexneri 2a str. 301
ccguuuugugguguuuuuuuaau

SEQ ID NO: 1998733 - RNA, 18 nt, Shigella flexneri 2a str. 301
ccuaaacguuuaaaaacu

SEQ ID NO: 1998734 - RNA, 18 nt, Shigella flexneri 2a str. 301
ccuaaaagcacgccagac

SEQ ID NO: 1998735 - RNA, 13 nt, Shigella flexneri 2a str. 301
ccguuuuuuuucu

SEQ ID NO: 1998736 - RNA, 17 nt, Shigella flexneri 2a str. 301
ccguuuuuugaaacagg

SEQ ID NO: 1998737 - RNA, 17 nt, Shigella flexneri 2a str. 301
ccgguuucaauccaggu

SEQ ID NO: 1998738 - RNA, 23 nt, Shigella flexneri 2a str. 301
ccgguugucaggaagccccagcu

SEQ ID NO: 1998739 - RNA, 19 nt, Shigella flexneri 2a str. 301
ccgguugcaguucugccau

SEQ ID NO: 1998740 - RNA, 23 nt, Shigella flexneri 2a str. 301
ccgguucgggaaauugcagagcu

SEQ ID NO: 1998741 - RNA, 15 nt, Shigella flexneri 2a str. 301
ccgguuccugcaucg

SEQ ID NO: 1998742 - RNA, 21 nt, Shigella flexneri 2a str. 301
ccgguucggccauauccagcc

SEQ ID NO: 1998743 - RNA, 15 nt, Shigella flexneri 2a str. 301
ccgguuaacgccgcg

SEQ ID NO: 1998744 - RNA, 19 nt, Shigella flexneri 2a str. 301
ccgguuaauugcgccagca

SEQ ID NO: 1998745 - RNA, 15 nt, Shigella flexneri 2a str. 301
ccgguucccagaccu

SEQ ID NO: 1998746 - RNA, 20 nt, Shigella flexneri 2a str. 301
ccgguuaaaucgacguucug

SEQ ID NO: 1998747 - RNA, 22 nt, Shigella flexneri 2a str. 301
ccgguuacgccaccagcugaca

SEQ ID NO: 1998748 - RNA, 17 nt, Shigella flexneri 2a str. 301
ccgucgccuucaacgua

SEQ ID NO: 1998749 - RNA, 17 nt, Shigella flexneri 2a str. 301
aaacgaccacucuuucg

SEQ ID NO: 1998750 - RNA, 18 nt, Shigella flexneri 2a str. 301
aaacgacgcagaacugaa

SEQ ID NO: 1998751 - RNA, 15 nt, Shigella flexneri 2a str. 301
ccgugcuguacagca

SEQ ID NO: 1998752 - RNA, 13 nt, Shigella flexneri 2a str. 301
ccgugcacaccga

SEQ ID NO: 1998753 - RNA, 13 nt, Shigella flexneri 2a str. 301
ccgugccagagca

SEQ ID NO: 1998754 - RNA, 16 nt, Shigella flexneri 2a str. 301
ccgugccccauauggc

SEQ ID NO: 1998755 - RNA, 14 nt, Shigella flexneri 2a str. 301
ccgucgugaaugcc

SEQ ID NO: 1998756 - RNA, 21 nt, Shigella flexneri 2a str. 301
ccgucguugagcaucugcaaa

SEQ ID NO: 1998757 - RNA, 22 nt, Shigella flexneri 2a str. 301
ccgucguuaccggucacuggca

SEQ ID NO: 1998758 - RNA, 14 nt, Shigella flexneri 2a str. 301
ccgucuacaaaaac

SEQ ID NO: 1998759 - RNA, 13 nt, Shigella flexneri 2a str. 301
ccgccguugcucu

SEQ ID NO: 1998760 - RNA, 14 nt, Shigella flexneri 2a str. 301
ccgccguugcucuu

SEQ ID NO: 1998761 - RNA, 16 nt, Shigella flexneri 2a str. 301
ccgccguugccgcagc

SEQ ID NO: 1998762 - RNA, 13 nt, Shigella flexneri 2a str. 301
ccgccucagccag

SEQ ID NO: 1998763 - RNA, 15 nt, Shigella flexneri 2a str. 301
ccgccucagccagaa

SEQ ID NO: 1998764 - RNA, 15 nt, Shigella flexneri 2a str. 301
ccgccucccuucgcu

SEQ ID NO: 1998765 - RNA, 19 nt, Shigella flexneri 2a str. 301
ccgccgguagucaccgccc

SEQ ID NO: 1998766 - RNA, 19 nt, Shigella flexneri 2a str. 301
ccgccggucaacgcgcggc

SEQ ID NO: 1998767 - RNA, 14 nt, Shigella flexneri 2a str. 301
ccgccgcagccgca

SEQ ID NO: 1998768 - RNA, 14 nt, Shigella flexneri 2a str. 301
ccgccgccacacgc

SEQ ID NO: 1998769 - RNA, 19 nt, Shigella flexneri 2a str. 301
ccgccgcgaaccugugaaa

SEQ ID NO: 1998770 - RNA, 23 nt, Shigella flexneri 2a str. 301
ccgccgccgcuucuggcggcggc

SEQ ID NO: 1998771 - RNA, 14 nt, Shigella flexneri 2a str. 301
ccgccgcuucgccc

SEQ ID NO: 1998772 - RNA, 12 nt, Shigella flexneri 2a str. 301
ccgccgcuccuc

SEQ ID NO: 1998773 - RNA, 14 nt, Shigella flexneri 2a str. 301
ccgccgcuccucau

SEQ ID NO: 1998774 - RNA, 21 nt, Shigella flexneri 2a str. 301
ccgccgcuauuauaucgcucu

SEQ ID NO: 1998775 - RNA, 15 nt, Shigella flexneri 2a str. 301
ccgcccauaaauucc

SEQ ID NO: 1998776 - RNA, 18 nt, Shigella flexneri 2a str. 301
ccgccccggguuuccugg

SEQ ID NO: 1998777 - RNA, 11 nt, Shigella flexneri 2a str. 301
ccgccccugca

SEQ ID NO: 1998778 - RNA, 12 nt, Shigella flexneri 2a str. 301
ccgcccagugcc

SEQ ID NO: 1998779 - RNA, 19 nt, Shigella flexneri 2a str. 301
ccgcccagaagcacugcca

SEQ ID NO: 1998780 - RNA, 13 nt, Shigella flexneri 2a str. 301
ccgcccaccacca

SEQ ID NO: 1998781 - RNA, 13 nt, Shigella flexneri 2a str. 301
ccgccaucuucuu

SEQ ID NO: 1998782 - RNA, 18 nt, Shigella flexneri 2a str. 301
ccgccaucucuuccagcg

SEQ ID NO: 1998783 - RNA, 13 nt, Shigella flexneri 2a str. 301
ccgccaugcauga

SEQ ID NO: 1998784 - RNA, 14 nt, Shigella flexneri 2a str. 301
ccgcccacaccagu

SEQ ID NO: 1998785 - RNA, 17 nt, Shigella flexneri 2a str. 301
ccgccauuucuccuccg

SEQ ID NO: 1998786 - RNA, 18 nt, Shigella flexneri 2a str. 301
ccgcccguuuucuccagc

SEQ ID NO: 1998787 - RNA, 19 nt, Shigella flexneri 2a str. 301
ccgcccguuuucuccagcg

SEQ ID NO: 1998788 - RNA, 21 nt, Shigella flexneri 2a str. 301
ccgcccugcggcugaccacca

SEQ ID NO: 1998789 - RNA, 18 nt, Shigella flexneri 2a str. 301
aaacccgguaagcauuua

SEQ ID NO: 1998790 - RNA, 18 nt, Shigella flexneri 2a str. 301
ccgccgauguugcaugau

SEQ ID NO: 1998791 - RNA, 17 nt, Shigella flexneri 2a str. 301
ccgccgaucucaccgau

SEQ ID NO: 1998792 - RNA, 15 nt, Shigella flexneri 2a str. 301
aaacccgccagacca

SEQ ID NO: 1998793 - RNA, 15 nt, Shigella flexneri 2a str. 301
aaacccgcaggcgca

SEQ ID NO: 1998794 - RNA, 16 nt, Shigella flexneri 2a str. 301
aaacccggccacagcg

SEQ ID NO: 1998795 - RNA, 14 nt, Shigella flexneri 2a str. 301
aaacccaggcuuaa

SEQ ID NO: 1998796 - RNA, 13 nt, Shigella flexneri 2a str. 301
aaaccauguccau

SEQ ID NO: 1998797 - RNA, 15 nt, Shigella flexneri 2a str. 301
ccgccacgcccuccu

SEQ ID NO: 1998798 - RNA, 22 nt, Shigella flexneri 2a str. 301
ccgccacgguaucaagcccgcc

SEQ ID NO: 1998799 - RNA, 22 nt, Shigella flexneri 2a str. 301
ccgccacuugagccuccagcgg

SEQ ID NO: 1998800 - RNA, 13 nt, Shigella flexneri 2a str. 301
ccgccagauaguu

SEQ ID NO: 1998801 - RNA, 15 nt, Shigella flexneri 2a str. 301
ccgccagaccacugc

SEQ ID NO: 1998802 - RNA, 11 nt, Shigella flexneri 2a str. 301
ccgccagacca

SEQ ID NO: 1998803 - RNA, 13 nt, Shigella flexneri 2a str. 301
ccgccagcaggaa

SEQ ID NO: 1998804 - RNA, 16 nt, Shigella flexneri 2a str. 301
ccgccagcaggaacga

SEQ ID NO: 1998805 - RNA, 18 nt, Shigella flexneri 2a str. 301
ccgccaacguucaccacg

SEQ ID NO: 1998806 - RNA, 21 nt, Shigella flexneri 2a str. 301
ccgccaauaaccggcacuuca

SEQ ID NO: 1998807 - RNA, 14 nt, Shigella flexneri 2a str. 301
ccgccacagcgcca

SEQ ID NO: 1998808 - RNA, 11 nt, Shigella flexneri 2a str. 301
ccgccaccagg

SEQ ID NO: 1998809 - RNA, 19 nt, Shigella flexneri 2a str. 301
aaaccagcaaacaggugcu

SEQ ID NO: 1998810 - RNA, 19 nt, Shigella flexneri 2a str. 301
aaaccagaaagggaagaac

SEQ ID NO: 1998811 - RNA, 21 nt, Shigella flexneri 2a str. 301
aaaccagaaagggaagaacau

SEQ ID NO: 1998812 - RNA, 21 nt, Shigella flexneri 2a str. 301
aaaccagacacuucaagaaua

SEQ ID NO: 1998813 - RNA, 15 nt, Shigella flexneri 2a str. 301
ccgccagcgccuggg

SEQ ID NO: 1998814 - RNA, 22 nt, Shigella flexneri 2a str. 301
aaaccaugacgcacuuucgcuu

SEQ ID NO: 1998815 - RNA, 17 nt, Shigella flexneri 2a str. 301
ccgccaguuuugugccc

SEQ ID NO: 1998816 - RNA, 19 nt, Shigella flexneri 2a str. 301
ccgccauaaacagcaggca

SEQ ID NO: 1998817 - RNA, 15 nt, Shigella flexneri 2a str. 301
ccgccauagaaagga

SEQ ID NO: 1998818 - RNA, 19 nt, Shigella flexneri 2a str. 301
ccgccaucgaguaccccuu

SEQ ID NO: 1998819 - RNA, 21 nt, Shigella flexneri 2a str. 301
ccgccaguucuuccaguuccg

SEQ ID NO: 1998820 - RNA, 15 nt, Shigella flexneri 2a str. 301
ccgccaguguggcgg

SEQ ID NO: 1998821 - RNA, 18 nt, Shigella flexneri 2a str. 301
ccgccaguuuguagccaa

SEQ ID NO: 1998822 - RNA, 20 nt, Shigella flexneri 2a str. 301
ccgccaguuugucuggcaau

SEQ ID NO: 1998823 - RNA, 21 nt, Shigella flexneri 2a str. 301
ccgccaguuuacugucugcuu

SEQ ID NO: 1998824 - RNA, 12 nt, Shigella flexneri 2a str. 301
ccgccaggcuuc

SEQ ID NO: 1998825 - RNA, 14 nt, Shigella flexneri 2a str. 301
ccgcaccaccagca

SEQ ID NO: 1998826 - RNA, 15 nt, Shigella flexneri 2a str. 301
ccgcacaauacauag

SEQ ID NO: 1998827 - RNA, 20 nt, Shigella flexneri 2a str. 301
ccgauuuucagccaucaucc

SEQ ID NO: 1998828 - RNA, 18 nt, Shigella flexneri 2a str. 301
ccgauuuuguaaaagaag

SEQ ID NO: 1998829 - RNA, 17 nt, Shigella flexneri 2a str. 301
ccgcaaaaccaacgccu

SEQ ID NO: 1998830 - RNA, 20 nt, Shigella flexneri 2a str. 301
ccgcaaaaggcgaaacgccu

SEQ ID NO: 1998831 - RNA, 17 nt, Shigella flexneri 2a str. 301
ccgauuacucagcaacu

SEQ ID NO: 1998832 - RNA, 15 nt, Shigella flexneri 2a str. 301
ccgauugauucccaa

SEQ ID NO: 1998833 - RNA, 19 nt, Shigella flexneri 2a str. 301
ccgauucccgggcacacuu

SEQ ID NO: 1998834 - RNA, 20 nt, Shigella flexneri 2a str. 301
ccgauuucaugaagcugaca

SEQ ID NO: 1998835 - RNA, 12 nt, Shigella flexneri 2a str. 301
ccgauuuaaccc

SEQ ID NO: 1998836 - RNA, 13 nt, Shigella flexneri 2a str. 301
ccgauuuguucuc

SEQ ID NO: 1998837 - RNA, 13 nt, Shigella flexneri 2a str. 301
ccgagcuggaaca

SEQ ID NO: 1998838 - RNA, 15 nt, Shigella flexneri 2a str. 301
ccgagcgucacuucg

SEQ ID NO: 1998839 - RNA, 14 nt, Shigella flexneri 2a str. 301
ccgcagcuccagcc

SEQ ID NO: 1998840 - RNA, 21 nt, Shigella flexneri 2a str. 301
ccgcagaucagaccaauccag

SEQ ID NO: 1998841 - RNA, 16 nt, Shigella flexneri 2a str. 301
ccgcaggcgcaauggc

SEQ ID NO: 1998842 - RNA, 19 nt, Shigella flexneri 2a str. 301
ccgcauccggcaucaacaa

SEQ ID NO: 1998843 - RNA, 19 nt, Shigella flexneri 2a str. 301
ccgcauccggcauaaacaa

SEQ ID NO: 1998844 - RNA, 18 nt, Shigella flexneri 2a str. 301
ccgcauccgggccagcgg

SEQ ID NO: 1998845 - RNA, 19 nt, Shigella flexneri 2a str. 301
ccgcauccgggccagcggc

SEQ ID NO: 1998846 - RNA, 19 nt, Shigella flexneri 2a str. 301
ccgcaucacuccacaccau

SEQ ID NO: 1998847 - RNA, 16 nt, Shigella flexneri 2a str. 301
ccgcauaccccuucac

SEQ ID NO: 1998848 - RNA, 15 nt, Shigella flexneri 2a str. 301
ccgcaucacgacagc

SEQ ID NO: 1998849 - RNA, 16 nt, Shigella flexneri 2a str. 301
ccgcaucaaugaccuu

SEQ ID NO: 1998850 - RNA, 22 nt, Shigella flexneri 2a str. 301
ccgcaucuucccagguuucaau

SEQ ID NO: 1998851 - RNA, 22 nt, Shigella flexneri 2a str. 301
ccgcaugccuaccaaaccugca

SEQ ID NO: 1998852 - RNA, 18 nt, Shigella flexneri 2a str. 301
ccgcauuauuucccggcu

SEQ ID NO: 1998853 - RNA, 13 nt, Shigella flexneri 2a str. 301
aaacagcaggcag

SEQ ID NO: 1998854 - RNA, 21 nt, Shigella flexneri 2a str. 301
aaacagcaaagcgugcaaaua

SEQ ID NO: 1998855 - RNA, 17 nt, Shigella flexneri 2a str. 301
cccuucagccaccaggu

SEQ ID NO: 1998856 - RNA, 18 nt, Shigella flexneri 2a str. 301
cccuucacucugcugcca

SEQ ID NO: 1998857 - RNA, 16 nt, Shigella flexneri 2a str. 301
cccuuauugcuaauga

SEQ ID NO: 1998858 - RNA, 15 nt, Shigella flexneri 2a str. 301
cccuuacccuuacuc

SEQ ID NO: 1998859 - RNA, 22 nt, Shigella flexneri 2a str. 301
cccuguuuuauuucccgcccgc

SEQ ID NO: 1998860 - RNA, 17 nt, Shigella flexneri 2a str. 301
cccuggucaguuucagc

SEQ ID NO: 1998861 - RNA, 17 nt, Shigella flexneri 2a str. 301
ccgaaaaaagucauuac

SEQ ID NO: 1998862 - RNA, 12 nt, Shigella flexneri 2a str. 301
ccgaaaaaggau

SEQ ID NO: 1998863 - RNA, 17 nt, Shigella flexneri 2a str. 301
aaacaggggcuggaaga

SEQ ID NO: 1998864 - RNA, 17 nt, Shigella flexneri 2a str. 301
aaacagggcaauuaaaa

SEQ ID NO: 1998865 - RNA, 22 nt, Shigella flexneri 2a str. 301
aaacagguaaagaccauaaaua

SEQ ID NO: 1998866 - RNA, 22 nt, Shigella flexneri 2a str. 301
aaacaggucuguaugacaacaa

SEQ ID NO: 1998867 - RNA, 11 nt, Shigella flexneri 2a str. 301
aaacagguacu

SEQ ID NO: 1998868 - RNA, 13 nt, Shigella flexneri 2a str. 301
aaacaggaucugg

SEQ ID NO: 1998869 - RNA, 22 nt, Shigella flexneri 2a str. 301
aaacaggauauguaagcagaaa

SEQ ID NO: 1998870 - RNA, 23 nt, Shigella flexneri 2a str. 301
aaacagcgcugcgaaaguaccau

SEQ ID NO: 1998871 - RNA, 16 nt, Shigella flexneri 2a str. 301
aaacagcgcugcgaaa

SEQ ID NO: 1998872 - RNA, 18 nt, Shigella flexneri 2a str. 301
aaacagcggccacucuuu

SEQ ID NO: 1998873 - RNA, 11 nt, Shigella flexneri 2a str. 301
aaacagcugcu

SEQ ID NO: 1998874 - RNA, 23 nt, Shigella flexneri 2a str. 301
aaacagcgcaccagaaacaauaa

SEQ ID NO: 1998875 - RNA, 13 nt, Shigella flexneri 2a str. 301
aaacagcccaauc

SEQ ID NO: 1998876 - RNA, 23 nt, Shigella flexneri 2a str. 301
aaacagccagcagcgaaucagcc

SEQ ID NO: 1998877 - RNA, 13 nt, Shigella flexneri 2a str. 301
ccgaagcagcuac

SEQ ID NO: 1998878 - RNA, 20 nt, Shigella flexneri 2a str. 301
ccgaagccguuagucaucau

SEQ ID NO: 1998879 - RNA, 14 nt, Shigella flexneri 2a str. 301
aaacauuagcgcau

SEQ ID NO: 1998880 - RNA, 15 nt, Shigella flexneri 2a str. 301
ccgaauccaguaagc

SEQ ID NO: 1998881 - RNA, 14 nt, Shigella flexneri 2a str. 301
aaacaucagcuauu

SEQ ID NO: 1998882 - RNA, 14 nt, Shigella flexneri 2a str. 301
aaacaucaccaaug

SEQ ID NO: 1998883 - RNA, 14 nt, Shigella flexneri 2a str. 301
ccgagaagcagcaa

SEQ ID NO: 1998884 - RNA, 18 nt, Shigella flexneri 2a str. 301
ccgagaauggacaccagc

SEQ ID NO: 1998885 - RNA, 15 nt, Shigella flexneri 2a str. 301
ccgagcaccacguug

SEQ ID NO: 1998886 - RNA, 13 nt, Shigella flexneri 2a str. 301
ccgagcagccacu

SEQ ID NO: 1998887 - RNA, 23 nt, Shigella flexneri 2a str. 301
ccgacgagaaaugucggcccgca

SEQ ID NO: 1998888 - RNA, 18 nt, Shigella flexneri 2a str. 301
ccgacgauaccgccgcac

SEQ ID NO: 1998889 - RNA, 23 nt, Shigella flexneri 2a str. 301
aaacauuagcgcaugaccaguga

SEQ ID NO: 1998890 - RNA, 17 nt, Shigella flexneri 2a str. 301
aaaccacgacuuuuugu

SEQ ID NO: 1998891 - RNA, 16 nt, Shigella flexneri 2a str. 301
aaaccacuuaauuauu

SEQ ID NO: 1998892 - RNA, 12 nt, Shigella flexneri 2a str. 301
ccgacagaauau

SEQ ID NO: 1998893 - RNA, 13 nt, Shigella flexneri 2a str. 301
ccgacagcaggcu

SEQ ID NO: 1998894 - RNA, 10 nt, Shigella flexneri 2a str. 301
ccgaccacuu

SEQ ID NO: 1998895 - RNA, 17 nt, Shigella flexneri 2a str. 301
ccgacauuugcacaaga

SEQ ID NO: 1998896 - RNA, 12 nt, Shigella flexneri 2a str. 301
ccgaccaccauu

SEQ ID NO: 1998897 - RNA, 21 nt, Shigella flexneri 2a str. 301
ccgacauugaaggauaagacg

SEQ ID NO: 1998898 - RNA, 17 nt, Shigella flexneri 2a str. 301
ccgacauuucugcugcc

SEQ ID NO: 1998899 - RNA, 16 nt, Shigella flexneri 2a str. 301
ccgaccaucgccagcu

SEQ ID NO: 1998900 - RNA, 20 nt, Shigella flexneri 2a str. 301
ccgaccauugccaguaacag

SEQ ID NO: 1998901 - RNA, 15 nt, Shigella flexneri 2a str. 301
ccgaccgcaaggaag

SEQ ID NO: 1998902 - RNA, 12 nt, Shigella flexneri 2a str. 301
cccgucagagca

SEQ ID NO: 1998903 - RNA, 21 nt, Shigella flexneri 2a str. 301
cccgucagagcaccaucgcug

SEQ ID NO: 1998904 - RNA, 12 nt, Shigella flexneri 2a str. 301
cccguagugugg

SEQ ID NO: 1998905 - RNA, 21 nt, Shigella flexneri 2a str. 301
cccgguaccuuugaacugcug

SEQ ID NO: 1998906 - RNA, 15 nt, Shigella flexneri 2a str. 301
cccgguaccuuugaa

SEQ ID NO: 1998907 - RNA, 14 nt, Shigella flexneri 2a str. 301
cccgguaucaaacc

SEQ ID NO: 1998908 - RNA, 15 nt, Shigella flexneri 2a str. 301
cccggcucauccccu

SEQ ID NO: 1998909 - RNA, 16 nt, Shigella flexneri 2a str. 301
cccgccggucaacgcg

SEQ ID NO: 1998910 - RNA, 15 nt, Shigella flexneri 2a str. 301
cccuaggcauagaaa

SEQ ID NO: 1998911 - RNA, 19 nt, Shigella flexneri 2a str. 301
cccguuuucuccagcgccg

SEQ ID NO: 1998912 - RNA, 13 nt, Shigella flexneri 2a str. 301
cccguuucccugu

SEQ ID NO: 1998913 - RNA, 18 nt, Shigella flexneri 2a str. 301
cccuaacccucuccccaa

SEQ ID NO: 1998914 - RNA, 14 nt, Shigella flexneri 2a str. 301
cccguuuucaccuu

SEQ ID NO: 1998915 - RNA, 23 nt, Shigella flexneri 2a str. 301
cccguggcgagcgauaacccagc

SEQ ID NO: 1998916 - RNA, 19 nt, Shigella flexneri 2a str. 301
cccguucauccgcuucagg

SEQ ID NO: 1998917 - RNA, 23 nt, Shigella flexneri 2a str. 301
cccguuccaccgcguuuuccagu

SEQ ID NO: 1998918 - RNA, 16 nt, Shigella flexneri 2a str. 301
cccgucguugcaauca

SEQ ID NO: 1998919 - RNA, 14 nt, Shigella flexneri 2a str. 301
cccgucuacaaaaa

SEQ ID NO: 1998920 - RNA, 18 nt, Shigella flexneri 2a str. 301
cccgucugacgcgugccu

SEQ ID NO: 1998921 - RNA, 15 nt, Shigella flexneri 2a str. 301
cccgucaccacuuca

SEQ ID NO: 1998922 - RNA, 11 nt, Shigella flexneri 2a str. 301
cccucaaacaa

SEQ ID NO: 1998923 - RNA, 15 nt, Shigella flexneri 2a str. 301
cccucaauaauaauc

SEQ ID NO: 1998924 - RNA, 19 nt, Shigella flexneri 2a str. 301
cccucacccuaacccucuc

SEQ ID NO: 1998925 - RNA, 20 nt, Shigella flexneri 2a str. 301
cccucacccuaacccucucc

SEQ ID NO: 1998926 - RNA, 18 nt, Shigella flexneri 2a str. 301
cccucagccagacagcau

SEQ ID NO: 1998927 - RNA, 18 nt, Shigella flexneri 2a str. 301
cccucauuccuccccgaa

SEQ ID NO: 1998928 - RNA, 14 nt, Shigella flexneri 2a str. 301
cccucgcccccuug

SEQ ID NO: 1998929 - RNA, 13 nt, Shigella flexneri 2a str. 301
cccucgcaccaaa

SEQ ID NO: 1998930 - RNA, 16 nt, Shigella flexneri 2a str. 301
cccucgaccaucuccu

SEQ ID NO: 1998931 - RNA, 17 nt, Shigella flexneri 2a str. 301
cccuccugauaacacag

SEQ ID NO: 1998932 - RNA, 23 nt, Shigella flexneri 2a str. 301
cccucguuuugccgccaucaucg

SEQ ID NO: 1998933 - RNA, 16 nt, Shigella flexneri 2a str. 301
cccucgccgcuucccu

SEQ ID NO: 1998934 - RNA, 20 nt, Shigella flexneri 2a str. 301
cccugaaucaaucagagcca

SEQ ID NO: 1998935 - RNA, 21 nt, Shigella flexneri 2a str. 301
cccucugcggcucucagccgc

SEQ ID NO: 1998936 - RNA, 22 nt, Shigella flexneri 2a str. 301
cccucugcggcucucagccgca

SEQ ID NO: 1998937 - RNA, 14 nt, Shigella flexneri 2a str. 301
cccucuucagccgc

SEQ ID NO: 1998938 - RNA, 16 nt, Shigella flexneri 2a str. 301
cccucugauuggcugu

SEQ ID NO: 1998939 - RNA, 21 nt, Shigella flexneri 2a str. 301
cccugauuaacgacacucucu

SEQ ID NO: 1998940 - RNA, 14 nt, Shigella flexneri 2a str. 301
cccugauaaaucac

SEQ ID NO: 1998941 - RNA, 15 nt, Shigella flexneri 2a str. 301
cccugauaaccgcau

SEQ ID NO: 1998942 - RNA, 22 nt, Shigella flexneri 2a str. 301
cccugauaauggcguauuucac

SEQ ID NO: 1998943 - RNA, 19 nt, Shigella flexneri 2a str. 301
cccugcggcgaugaccgcc

SEQ ID NO: 1998944 - RNA, 23 nt, Shigella flexneri 2a str. 301
cccugccaggucaucauugcagu

SEQ ID NO: 1998945 - RNA, 14 nt, Shigella flexneri 2a str. 301
cccugcggcugacc

SEQ ID NO: 1998946 - RNA, 17 nt, Shigella flexneri 2a str. 301
cccugcggcugaccacc

SEQ ID NO: 1998947 - RNA, 19 nt, Shigella flexneri 2a str. 301
cccugcggcugaccaccac

SEQ ID NO: 1998948 - RNA, 17 nt, Shigella flexneri 2a str. 301
cccugcgguuucaacga

SEQ ID NO: 1998949 - RNA, 20 nt, Shigella flexneri 2a str. 301
cccugcuaugcaagauguua

SEQ ID NO: 1998950 - RNA, 15 nt, Shigella flexneri 2a str. 301
cccugcucuuucagc

SEQ ID NO: 1998951 - RNA, 14 nt, Shigella flexneri 2a str. 301
cccccaccccggcc

SEQ ID NO: 1998952 - RNA, 14 nt, Shigella flexneri 2a str. 301
cccccaguaaauga

SEQ ID NO: 1998953 - RNA, 17 nt, Shigella flexneri 2a str. 301
ccccagucuuccugcgg

SEQ ID NO: 1998954 - RNA, 22 nt, Shigella flexneri 2a str. 301
ccccgcgcucacaccacagcag

SEQ ID NO: 1998955 - RNA, 17 nt, Shigella flexneri 2a str. 301
cccccugaagcaguuuc

SEQ ID NO: 1998956 - RNA, 23 nt, Shigella flexneri 2a str. 301
cccccgucaccggcacaaagcug

SEQ ID NO: 1998957 - RNA, 21 nt, Shigella flexneri 2a str. 301
ccccgagaaaaauagcauuaa

SEQ ID NO: 1998958 - RNA, 18 nt, Shigella flexneri 2a str. 301
ccccgagaaauacuggcu

SEQ ID NO: 1998959 - RNA, 19 nt, Shigella flexneri 2a str. 301
cccaugaugcgcggcucca

SEQ ID NO: 1998960 - RNA, 22 nt, Shigella flexneri 2a str. 301
cccaugaugcgcggcuccagaa

SEQ ID NO: 1998961 - RNA, 21 nt, Shigella flexneri 2a str. 301
cccaugcacucgaccacgccc

SEQ ID NO: 1998962 - RNA, 14 nt, Shigella flexneri 2a str. 301
cccaucucuucuuc

SEQ ID NO: 1998963 - RNA, 18 nt, Shigella flexneri 2a str. 301
cccaugaaauaaaaauaa

SEQ ID NO: 1998964 - RNA, 19 nt, Shigella flexneri 2a str. 301
cccaucuuuuuaaguuuau

SEQ ID NO: 1998965 - RNA, 14 nt, Shigella flexneri 2a str. 301
cccauuuuauuuuc

SEQ ID NO: 1998966 - RNA, 15 nt, Shigella flexneri 2a str. 301
cccauggcguagccg

SEQ ID NO: 1998967 - RNA, 17 nt, Shigella flexneri 2a str. 301
ccccagcagaauccggu

SEQ ID NO: 1998968 - RNA, 21 nt, Shigella flexneri 2a str. 301
ccccagcaucacgcccgcuuu

SEQ ID NO: 1998969 - RNA, 13 nt, Shigella flexneri 2a str. 301
ccccaccucauca

SEQ ID NO: 1998970 - RNA, 21 nt, Shigella flexneri 2a str. 301
ccccaccccggcccucucccu

SEQ ID NO: 1998971 - RNA, 19 nt, Shigella flexneri 2a str. 301
ccccacagacccagguaga

SEQ ID NO: 1998972 - RNA, 13 nt, Shigella flexneri 2a str. 301
ccccacagaccca

SEQ ID NO: 1998973 - RNA, 12 nt, Shigella flexneri 2a str. 301
ccccacagcucu

SEQ ID NO: 1998974 - RNA, 21 nt, Shigella flexneri 2a str. 301
ccccacagcucugcugucacc

SEQ ID NO: 1998975 - RNA, 13 nt, Shigella flexneri 2a str. 301
ccccaccagcaaa

SEQ ID NO: 1998976 - RNA, 18 nt, Shigella flexneri 2a str. 301
ccccacagggugagcaga

SEQ ID NO: 1998977 - RNA, 15 nt, Shigella flexneri 2a str. 301
cccauuuuuaauaau

SEQ ID NO: 1998978 - RNA, 19 nt, Shigella flexneri 2a str. 301
ccccaaaacguaaccaugu

SEQ ID NO: 1998979 - RNA, 21 nt, Shigella flexneri 2a str. 301
ccccaaaacguaaccaugugu

SEQ ID NO: 1998980 - RNA, 23 nt, Shigella flexneri 2a str. 301
ccccaaaaagauuaaaaaaacac

SEQ ID NO: 1998981 - RNA, 14 nt, Shigella flexneri 2a str. 301
cccgccaccggcuu

SEQ ID NO: 1998982 - RNA, 13 nt, Shigella flexneri 2a str. 301
cccgccagcgccu

SEQ ID NO: 1998983 - RNA, 15 nt, Shigella flexneri 2a str. 301
cccgccagcaccagc

SEQ ID NO: 1998984 - RNA, 19 nt, Shigella flexneri 2a str. 301
cccgccagcacgaccgcca

SEQ ID NO: 1998985 - RNA, 20 nt, Shigella flexneri 2a str. 301
cccgccauaacggcugucca

SEQ ID NO: 1998986 - RNA, 18 nt, Shigella flexneri 2a str. 301
cccgccaucaucccuaca

SEQ ID NO: 1998987 - RNA, 16 nt, Shigella flexneri 2a str. 301
cccgcacggccgcaag

SEQ ID NO: 1998988 - RNA, 21 nt, Shigella flexneri 2a str. 301
cccgcacgcuuaauugaaccu

SEQ ID NO: 1998989 - RNA, 18 nt, Shigella flexneri 2a str. 301
cccgcaagccaacauguu

SEQ ID NO: 1998990 - RNA, 23 nt, Shigella flexneri 2a str. 301
cccgcacagucacuacgcgaccg

SEQ ID NO: 1998991 - RNA, 19 nt, Shigella flexneri 2a str. 301
cccgacgauaccgccgcac

SEQ ID NO: 1998992 - RNA, 22 nt, Shigella flexneri 2a str. 301
ccccuuugaccagccagucagu

SEQ ID NO: 1998993 - RNA, 21 nt, Shigella flexneri 2a str. 301
ccccuuucuuauuuuucugca

SEQ ID NO: 1998994 - RNA, 13 nt, Shigella flexneri 2a str. 301
ccccuucugccgc

SEQ ID NO: 1998995 - RNA, 13 nt, Shigella flexneri 2a str. 301
cccgaccaaugca

SEQ ID NO: 1998996 - RNA, 22 nt, Shigella flexneri 2a str. 301
cccgaaaccgacuuacuuauuu

SEQ ID NO: 1998997 - RNA, 20 nt, Shigella flexneri 2a str. 301
ccccugccgcaaacgacacu

SEQ ID NO: 1998998 - RNA, 21 nt, Shigella flexneri 2a str. 301
ccccugagcguuacccgcagc

SEQ ID NO: 1998999 - RNA, 15 nt, Shigella flexneri 2a str. 301
ccccuccacauucag

SEQ ID NO: 1999000 - RNA, 12 nt, Shigella flexneri 2a str. 301
ccccgcuccggc

SEQ ID NO: 1999001 - RNA, 13 nt, Shigella flexneri 2a str. 301
ccccgcucacgca

SEQ ID NO: 1999002 - RNA, 12 nt, Shigella flexneri 2a str. 301
ccccgucaccac

SEQ ID NO: 1999003 - RNA, 17 nt, Shigella flexneri 2a str. 301
ccccgucagcaaaauac

SEQ ID NO: 1999004 - RNA, 22 nt, Shigella flexneri 2a str. 301
ccccgguuuuucuggcaccugu

SEQ ID NO: 1999005 - RNA, 18 nt, Shigella flexneri 2a str. 301
aaacaccagaaugcccca

SEQ ID NO: 1999006 - RNA, 14 nt, Shigella flexneri 2a str. 301
aaacaccagaaugc

SEQ ID NO: 1999007 - RNA, 13 nt, Shigella flexneri 2a str. 301
aaacaccagaaug

SEQ ID NO: 1999008 - RNA, 16 nt, Shigella flexneri 2a str. 301
aaacacaauauucaua

SEQ ID NO: 1999009 - RNA, 18 nt, Shigella flexneri 2a str. 301
aaacaauguucaucugca

SEQ ID NO: 1999010 - RNA, 21 nt, Shigella flexneri 2a str. 301
cccaguuucaugauauguuuu

SEQ ID NO: 1999011 - RNA, 17 nt, Shigella flexneri 2a str. 301
cccaucgcguuugcgcu

SEQ ID NO: 1999012 - RNA, 13 nt, Shigella flexneri 2a str. 301
cccaucaguagca

SEQ ID NO: 1999013 - RNA, 11 nt, Shigella flexneri 2a str. 301
cccauccacgc

SEQ ID NO: 1999014 - RNA, 23 nt, Shigella flexneri 2a str. 301
cccaucaucuggcugugauccau

SEQ ID NO: 1999015 - RNA, 20 nt, Shigella flexneri 2a str. 301
cccauauguucccgcgccuc

SEQ ID NO: 1999016 - RNA, 22 nt, Shigella flexneri 2a str. 301
cccauagauaccuucuugacau

SEQ ID NO: 1999017 - RNA, 11 nt, Shigella flexneri 2a str. 301
cccaucacuau

SEQ ID NO: 1999018 - RNA, 23 nt, Shigella flexneri 2a str. 301
cccaucacaauggcacaaauggc

SEQ ID NO: 1999019 - RNA, 14 nt, Shigella flexneri 2a str. 301
cccaucaacgccau

SEQ ID NO: 1999020 - RNA, 17 nt, Shigella flexneri 2a str. 301
cccaguaaccacgcagc

SEQ ID NO: 1999021 - RNA, 20 nt, Shigella flexneri 2a str. 301
cccagguuucaaugccgccg

SEQ ID NO: 1999022 - RNA, 20 nt, Shigella flexneri 2a str. 301
cccagugguuucgccagcac

SEQ ID NO: 1999023 - RNA, 23 nt, Shigella flexneri 2a str. 301
cccaguuauuaaaacgauagugg

SEQ ID NO: 1999024 - RNA, 15 nt, Shigella flexneri 2a str. 301
cccagucgucauccc

SEQ ID NO: 1999025 - RNA, 16 nt, Shigella flexneri 2a str. 301
cccaggcugugcgcca

SEQ ID NO: 1999026 - RNA, 20 nt, Shigella flexneri 2a str. 301
cccagggcaauguaacaccu

SEQ ID NO: 1999027 - RNA, 22 nt, Shigella flexneri 2a str. 301
cccagguauucggugugcagcg

SEQ ID NO: 1999028 - RNA, 20 nt, Shigella flexneri 2a str. 301
cccagaagguuucgccgcug

SEQ ID NO: 1999029 - RNA, 13 nt, Shigella flexneri 2a str. 301
cccagaacaaaua

SEQ ID NO: 1999030 - RNA, 23 nt, Shigella flexneri 2a str. 301
cccaaggcgaggggaccgccccu

SEQ ID NO: 1999031 - RNA, 17 nt, Shigella flexneri 2a str. 301
cccacuuucaggccagc

SEQ ID NO: 1999032 - RNA, 20 nt, Shigella flexneri 2a str. 301
cccagaugccagaaucccca

SEQ ID NO: 1999033 - RNA, 21 nt, Shigella flexneri 2a str. 301
cccagaugccagaauccccac

SEQ ID NO: 1999034 - RNA, 14 nt, Shigella flexneri 2a str. 301
cccagccuuuccug

SEQ ID NO: 1999035 - RNA, 23 nt, Shigella flexneri 2a str. 301
cccagcagagaucuuucacgccc

SEQ ID NO: 1999036 - RNA, 12 nt, Shigella flexneri 2a str. 301
cccagcagagau

SEQ ID NO: 1999037 - RNA, 13 nt, Shigella flexneri 2a str. 301
cccagcagcgccg

SEQ ID NO: 1999038 - RNA, 16 nt, Shigella flexneri 2a str. 301
cccagcccagcggaaa

SEQ ID NO: 1999039 - RNA, 13 nt, Shigella flexneri 2a str. 301
cccagcccagcgc

SEQ ID NO: 1999040 - RNA, 14 nt, Shigella flexneri 2a str. 301
cccagcccccagca

SEQ ID NO: 1999041 - RNA, 13 nt, Shigella flexneri 2a str. 301
cccaggcaccguc

SEQ ID NO: 1999042 - RNA, 21 nt, Shigella flexneri 2a str. 301
cccagcgugcguuuuuuguac

SEQ ID NO: 1999043 - RNA, 19 nt, Shigella flexneri 2a str. 301
cccagcguggagagcagca

SEQ ID NO: 1999044 - RNA, 21 nt, Shigella flexneri 2a str. 301
cccagcgucagcauaaaaaua

SEQ ID NO: 1999045 - RNA, 23 nt, Shigella flexneri 2a str. 301
cccagcgucagcaucauaccucc

SEQ ID NO: 1999046 - RNA, 15 nt, Shigella flexneri 2a str. 301
cccagcucuucucaa

SEQ ID NO: 1999047 - RNA, 17 nt, Shigella flexneri 2a str. 301
cccagcucaucagcauu

SEQ ID NO: 1999048 - RNA, 12 nt, Shigella flexneri 2a str. 301
cccagcgcgccg

SEQ ID NO: 1999049 - RNA, 18 nt, Shigella flexneri 2a str. 301
ccauccggccgccacaca

SEQ ID NO: 1999050 - RNA, 22 nt, Shigella flexneri 2a str. 301
ccauccggcgaauuaccagcca

SEQ ID NO: 1999051 - RNA, 21 nt, Shigella flexneri 2a str. 301
ccauccaggagauauugcugc

SEQ ID NO: 1999052 - RNA, 23 nt, Shigella flexneri 2a str. 301
ccauccagcuuuuagaucacuca

SEQ ID NO: 1999053 - RNA, 18 nt, Shigella flexneri 2a str. 301
ccauccagcaacaacagc

SEQ ID NO: 1999054 - RNA, 13 nt, Shigella flexneri 2a str. 301
ccauccagcaaca

SEQ ID NO: 1999055 - RNA, 15 nt, Shigella flexneri 2a str. 301
ccaucgccagugccg

SEQ ID NO: 1999056 - RNA, 17 nt, Shigella flexneri 2a str. 301
ccauccgucauccauac

SEQ ID NO: 1999057 - RNA, 21 nt, Shigella flexneri 2a str. 301
ccauauuuugaaucggcggcg

SEQ ID NO: 1999058 - RNA, 19 nt, Shigella flexneri 2a str. 301
ccauauuucuccauuagca

SEQ ID NO: 1999059 - RNA, 19 nt, Shigella flexneri 2a str. 301
ccauauggcugcauucaga

SEQ ID NO: 1999060 - RNA, 17 nt, Shigella flexneri 2a str. 301
ccauauggcccaucauc

SEQ ID NO: 1999061 - RNA, 18 nt, Shigella flexneri 2a str. 301
ccauauggcccaucaucu

SEQ ID NO: 1999062 - RNA, 14 nt, Shigella flexneri 2a str. 301
ccaucauacccaac

SEQ ID NO: 1999063 - RNA, 16 nt, Shigella flexneri 2a str. 301
ccaucaggcauuacug

SEQ ID NO: 1999064 - RNA, 18 nt, Shigella flexneri 2a str. 301
ccaugcauaaugcagcca

SEQ ID NO: 1999065 - RNA, 19 nt, Shigella flexneri 2a str. 301
ccaugcaggaucgcuccau

SEQ ID NO: 1999066 - RNA, 15 nt, Shigella flexneri 2a str. 301
ccaugcacugcaacg

SEQ ID NO: 1999067 - RNA, 21 nt, Shigella flexneri 2a str. 301
ccaugcacgauauaccgugcu

SEQ ID NO: 1999068 - RNA, 21 nt, Shigella flexneri 2a str. 301
ccaugcaauuaccgccaccag

SEQ ID NO: 1999069 - RNA, 20 nt, Shigella flexneri 2a str. 301
ccaugcaauauuguagcaac

SEQ ID NO: 1999070 - RNA, 18 nt, Shigella flexneri 2a str. 301
ccaugagaagcugaaauc

SEQ ID NO: 1999071 - RNA, 12 nt, Shigella flexneri 2a str. 301
ccaugagacaaa

SEQ ID NO: 1999072 - RNA, 14 nt, Shigella flexneri 2a str. 301
ccaugacuuucugg

SEQ ID NO: 1999073 - RNA, 19 nt, Shigella flexneri 2a str. 301
ccauggacauacgcaccuu

SEQ ID NO: 1999074 - RNA, 14 nt, Shigella flexneri 2a str. 301
ccauggacgcguca

SEQ ID NO: 1999075 - RNA, 22 nt, Shigella flexneri 2a str. 301
ccaugccaucugccagcaagcg

SEQ ID NO: 1999076 - RNA, 20 nt, Shigella flexneri 2a str. 301
ccaucgcuacauaacgcagc

SEQ ID NO: 1999077 - RNA, 18 nt, Shigella flexneri 2a str. 301
ccaucgcuacauaacgca

SEQ ID NO: 1999078 - RNA, 20 nt, Shigella flexneri 2a str. 301
ccaucgcuuuuaccagcaua

SEQ ID NO: 1999079 - RNA, 23 nt, Shigella flexneri 2a str. 301
ccaucggagcguugucguaacag

SEQ ID NO: 1999080 - RNA, 20 nt, Shigella flexneri 2a str. 301
ccaucggcauuaaucugcuc

SEQ ID NO: 1999081 - RNA, 17 nt, Shigella flexneri 2a str. 301
ccaucggcaccaccaaa

SEQ ID NO: 1999082 - RNA, 18 nt, Shigella flexneri 2a str. 301
ccaucguacaggcacaug

SEQ ID NO: 1999083 - RNA, 23 nt, Shigella flexneri 2a str. 301
ccaucguccagcagcaaugcagg

SEQ ID NO: 1999084 - RNA, 18 nt, Shigella flexneri 2a str. 301
ccaucguccgugaagaaa

SEQ ID NO: 1999085 - RNA, 18 nt, Shigella flexneri 2a str. 301
ccaucuucuugcagcuua

SEQ ID NO: 1999086 - RNA, 13 nt, Shigella flexneri 2a str. 301
ccaucuuuuuaag

SEQ ID NO: 1999087 - RNA, 13 nt, Shigella flexneri 2a str. 301
ccaucuucuucac

SEQ ID NO: 1999088 - RNA, 16 nt, Shigella flexneri 2a str. 301
ccauguguuuaucuau

SEQ ID NO: 1999089 - RNA, 13 nt, Shigella flexneri 2a str. 301
ccaugugcuggac

SEQ ID NO: 1999090 - RNA, 12 nt, Shigella flexneri 2a str. 301
ccauguugccug

SEQ ID NO: 1999091 - RNA, 21 nt, Shigella flexneri 2a str. 301
ccaugucgaaaccgacagccc

SEQ ID NO: 1999092 - RNA, 18 nt, Shigella flexneri 2a str. 301
ccauggcucaccagcagc

SEQ ID NO: 1999093 - RNA, 22 nt, Shigella flexneri 2a str. 301
ccauuauuaaauuuaauaauaa

SEQ ID NO: 1999094 - RNA, 19 nt, Shigella flexneri 2a str. 301
ccauuauccgucagccacu

SEQ ID NO: 1999095 - RNA, 17 nt, Shigella flexneri 2a str. 301
ccauucgcaaagucgau

SEQ ID NO: 1999096 - RNA, 16 nt, Shigella flexneri 2a str. 301
ccauuaaccagccacu

SEQ ID NO: 1999097 - RNA, 14 nt, Shigella flexneri 2a str. 301
ccauuaaccagcca

SEQ ID NO: 1999098 - RNA, 19 nt, Shigella flexneri 2a str. 301
ccauguuuaccaucugcgc

SEQ ID NO: 1999099 - RNA, 16 nt, Shigella flexneri 2a str. 301
cccaacugccugaugc

SEQ ID NO: 1999100 - RNA, 15 nt, Shigella flexneri 2a str. 301
cccaacguaacaaaa

SEQ ID NO: 1999101 - RNA, 20 nt, Shigella flexneri 2a str. 301
cccaacgcgccaccgaccag

SEQ ID NO: 1999102 - RNA, 15 nt, Shigella flexneri 2a str. 301
cccaacgccacucuc

SEQ ID NO: 1999103 - RNA, 17 nt, Shigella flexneri 2a str. 301
cccaacgcgccaccgac

SEQ ID NO: 1999104 - RNA, 15 nt, Shigella flexneri 2a str. 301
cccaacgcagcaaca

SEQ ID NO: 1999105 - RNA, 23 nt, Shigella flexneri 2a str. 301
cccaacgcaaagagagaagccag

SEQ ID NO: 1999106 - RNA, 23 nt, Shigella flexneri 2a str. 301
cccaaccuuguuucugagcauga

SEQ ID NO: 1999107 - RNA, 11 nt, Shigella flexneri 2a str. 301
ccauuuuucag

SEQ ID NO: 1999108 - RNA, 12 nt, Shigella flexneri 2a str. 301
ccauuuuuucgu

SEQ ID NO: 1999109 - RNA, 14 nt, Shigella flexneri 2a str. 301
ccauuucugcugcc

SEQ ID NO: 1999110 - RNA, 17 nt, Shigella flexneri 2a str. 301
ccauuucggcgugcugu

SEQ ID NO: 1999111 - RNA, 12 nt, Shigella flexneri 2a str. 301
ccauuucugcca

SEQ ID NO: 1999112 - RNA, 19 nt, Shigella flexneri 2a str. 301
ccauuuugccgguucccaa

SEQ ID NO: 1999113 - RNA, 20 nt, Shigella flexneri 2a str. 301
ccauuugugcauagcacacu

SEQ ID NO: 1999114 - RNA, 23 nt, Shigella flexneri 2a str. 301
ccauugcaucgaggaaaaccaga

SEQ ID NO: 1999115 - RNA, 21 nt, Shigella flexneri 2a str. 301
ccauugcucuggcaaacucgc

SEQ ID NO: 1999116 - RNA, 12 nt, Shigella flexneri 2a str. 301
ccauugcucugg

SEQ ID NO: 1999117 - RNA, 19 nt, Shigella flexneri 2a str. 301
ccauaauuacgcuguucau

SEQ ID NO: 1999118 - RNA, 18 nt, Shigella flexneri 2a str. 301
ccaguuuuuacgcccgug

SEQ ID NO: 1999119 - RNA, 21 nt, Shigella flexneri 2a str. 301
ccauaaaaugcaccuuacuca

SEQ ID NO: 1999120 - RNA, 18 nt, Shigella flexneri 2a str. 301
ccaguuuuucuuuuucaa

SEQ ID NO: 1999121 - RNA, 15 nt, Shigella flexneri 2a str. 301
ccaguuuuuguuucu

SEQ ID NO: 1999122 - RNA, 21 nt, Shigella flexneri 2a str. 301
ccaguuuugccagucagcucc

SEQ ID NO: 1999123 - RNA, 18 nt, Shigella flexneri 2a str. 301
ccaguugcuccagcaaua

SEQ ID NO: 1999124 - RNA, 16 nt, Shigella flexneri 2a str. 301
ccaguucccccugcca

SEQ ID NO: 1999125 - RNA, 13 nt, Shigella flexneri 2a str. 301
ccauaccugcaca

SEQ ID NO: 1999126 - RNA, 17 nt, Shigella flexneri 2a str. 301
ccauaccggcugcaaac

SEQ ID NO: 1999127 - RNA, 15 nt, Shigella flexneri 2a str. 301
ccauaccugcacaaa

SEQ ID NO: 1999128 - RNA, 16 nt, Shigella flexneri 2a str. 301
ccauacaucuucauca

SEQ ID NO: 1999129 - RNA, 19 nt, Shigella flexneri 2a str. 301
ccauacaucuucaucaucc

SEQ ID NO: 1999130 - RNA, 14 nt, Shigella flexneri 2a str. 301
ccauaccaugcacc

SEQ ID NO: 1999131 - RNA, 18 nt, Shigella flexneri 2a str. 301
ccauacauguacauggug

SEQ ID NO: 1999132 - RNA, 16 nt, Shigella flexneri 2a str. 301
ccauacagacacccac

SEQ ID NO: 1999133 - RNA, 16 nt, Shigella flexneri 2a str. 301
ccauagcgauguauuu

SEQ ID NO: 1999134 - RNA, 21 nt, Shigella flexneri 2a str. 301
ccauagcaucccaauacccgc

SEQ ID NO: 1999135 - RNA, 18 nt, Shigella flexneri 2a str. 301
ccauacggcucagcucug

SEQ ID NO: 1999136 - RNA, 20 nt, Shigella flexneri 2a str. 301
ccauaggaugagguuucccg

SEQ ID NO: 1999137 - RNA, 14 nt, Shigella flexneri 2a str. 301
ccauaugaauauau

SEQ ID NO: 1999138 - RNA, 15 nt, Shigella flexneri 2a str. 301
ccagugcagcgaagu

SEQ ID NO: 1999139 - RNA, 16 nt, Shigella flexneri 2a str. 301
ccagugcauccagcac

SEQ ID NO: 1999140 - RNA, 13 nt, Shigella flexneri 2a str. 301
ccagugcagcgcc

SEQ ID NO: 1999141 - RNA, 15 nt, Shigella flexneri 2a str. 301
ccagugccaaagcca

SEQ ID NO: 1999142 - RNA, 21 nt, Shigella flexneri 2a str. 301
ccagugaugcgcaggguaacg

SEQ ID NO: 1999143 - RNA, 13 nt, Shigella flexneri 2a str. 301
ccagugauuaacg

SEQ ID NO: 1999144 - RNA, 14 nt, Shigella flexneri 2a str. 301
ccagugauucagga

SEQ ID NO: 1999145 - RNA, 18 nt, Shigella flexneri 2a str. 301
ccagugauuuuugcugaa

SEQ ID NO: 1999146 - RNA, 19 nt, Shigella flexneri 2a str. 301
ccagugccggaugauucac

SEQ ID NO: 1999147 - RNA, 18 nt, Shigella flexneri 2a str. 301
ccagugccgcccaccacu

SEQ ID NO: 1999148 - RNA, 21 nt, Shigella flexneri 2a str. 301
ccagugcccgaccacuucaug

SEQ ID NO: 1999149 - RNA, 22 nt, Shigella flexneri 2a str. 301
ccaguucaacgcccgcuuucac

SEQ ID NO: 1999150 - RNA, 14 nt, Shigella flexneri 2a str. 301
ccaguuacugccac

SEQ ID NO: 1999151 - RNA, 21 nt, Shigella flexneri 2a str. 301
ccaguucaagugcuacccacu

SEQ ID NO: 1999152 - RNA, 22 nt, Shigella flexneri 2a str. 301
ccaguucacgcgauuucucauc

SEQ ID NO: 1999153 - RNA, 15 nt, Shigella flexneri 2a str. 301
ccaguuaucaagcca

SEQ ID NO: 1999154 - RNA, 15 nt, Shigella flexneri 2a str. 301
ccagugccucaagaa

SEQ ID NO: 1999155 - RNA, 17 nt, Shigella flexneri 2a str. 301
ccaguuccacuucugca

SEQ ID NO: 1999156 - RNA, 12 nt, Shigella flexneri 2a str. 301
ccaguucccccu

SEQ ID NO: 1999157 - RNA, 14 nt, Shigella flexneri 2a str. 301
ccaguucauuugaa

SEQ ID NO: 1999158 - RNA, 21 nt, Shigella flexneri 2a str. 301
ccagucccguacccagcaaga

SEQ ID NO: 1999159 - RNA, 20 nt, Shigella flexneri 2a str. 301
ccaguccgcgcuugccgccg

SEQ ID NO: 1999160 - RNA, 14 nt, Shigella flexneri 2a str. 301
ccaguccaucggca

SEQ ID NO: 1999161 - RNA, 16 nt, Shigella flexneri 2a str. 301
ccaguccugugacuca

SEQ ID NO: 1999162 - RNA, 19 nt, Shigella flexneri 2a str. 301
ccaguccugugacucaaug

SEQ ID NO: 1999163 - RNA, 19 nt, Shigella flexneri 2a str. 301
ccagucuuccugcggcaga

SEQ ID NO: 1999164 - RNA, 20 nt, Shigella flexneri 2a str. 301
ccagucguucaaccacuuca

SEQ ID NO: 1999165 - RNA, 15 nt, Shigella flexneri 2a str. 301
ccagucgucauccca

SEQ ID NO: 1999166 - RNA, 15 nt, Shigella flexneri 2a str. 301
ccagucgcugcugac

SEQ ID NO: 1999167 - RNA, 17 nt, Shigella flexneri 2a str. 301
ccagguuuaccagcagc

SEQ ID NO: 1999168 - RNA, 21 nt, Shigella flexneri 2a str. 301
ccagguuguacuuuccagcca

SEQ ID NO: 1999169 - RNA, 17 nt, Shigella flexneri 2a str. 301
ccaguaaccuuucagau

SEQ ID NO: 1999170 - RNA, 23 nt, Shigella flexneri 2a str. 301
ccaguaacagaacgcauaacagc

SEQ ID NO: 1999171 - RNA, 18 nt, Shigella flexneri 2a str. 301
ccaguaaagcagcgaagc

SEQ ID NO: 1999172 - RNA, 20 nt, Shigella flexneri 2a str. 301
ccagguuuucuuucaccucu

SEQ ID NO: 1999173 - RNA, 22 nt, Shigella flexneri 2a str. 301
ccagguuuucuuucaccucuuc

SEQ ID NO: 1999174 - RNA, 13 nt, Shigella flexneri 2a str. 301
ccaguaaggcugc

SEQ ID NO: 1999175 - RNA, 19 nt, Shigella flexneri 2a str. 301
ccaguaaggcaucuucuuc

SEQ ID NO: 1999176 - RNA, 19 nt, Shigella flexneri 2a str. 301
ccaguaagcaguccagcgc

SEQ ID NO: 1999177 - RNA, 21 nt, Shigella flexneri 2a str. 301
ccaguaagcaguccagcgccu

SEQ ID NO: 1999178 - RNA, 17 nt, Shigella flexneri 2a str. 301
ccaguaccagcagcgcc

SEQ ID NO: 1999179 - RNA, 24 nt, Shigella flexneri 2a str. 301
ccaguaccgccaccaccagacgca

SEQ ID NO: 1999180 - RNA, 17 nt, Shigella flexneri 2a str. 301
ccaguaccgccaccacc

SEQ ID NO: 1999181 - RNA, 11 nt, Shigella flexneri 2a str. 301
ccaguaccgau

SEQ ID NO: 1999182 - RNA, 16 nt, Shigella flexneri 2a str. 301
ccaguacaugaagcac

SEQ ID NO: 1999183 - RNA, 17 nt, Shigella flexneri 2a str. 301
ccaguacauugagaaua

SEQ ID NO: 1999184 - RNA, 18 nt, Shigella flexneri 2a str. 301
ccaguaccacccccagac

SEQ ID NO: 1999185 - RNA, 18 nt, Shigella flexneri 2a str. 301
ccaguaccgccagugcag

SEQ ID NO: 1999186 - RNA, 19 nt, Shigella flexneri 2a str. 301
ccaguaccgccagugcagc

SEQ ID NO: 1999187 - RNA, 13 nt, Shigella flexneri 2a str. 301
ccaguaccgccag

SEQ ID NO: 1999188 - RNA, 15 nt, Shigella flexneri 2a str. 301
ccaguacgccuucac

SEQ ID NO: 1999189 - RNA, 16 nt, Shigella flexneri 2a str. 301
ccaguacgccuucacg

SEQ ID NO: 1999190 - RNA, 13 nt, Shigella flexneri 2a str. 301
ccaguaauucagc

SEQ ID NO: 1999191 - RNA, 12 nt, Shigella flexneri 2a str. 301
ccagucagguac

SEQ ID NO: 1999192 - RNA, 15 nt, Shigella flexneri 2a str. 301
ccaguccagcugccg

SEQ ID NO: 1999193 - RNA, 22 nt, Shigella flexneri 2a str. 301
ccaguccagcgccugacguaac

SEQ ID NO: 1999194 - RNA, 12 nt, Shigella flexneri 2a str. 301
ccaguccaccca

SEQ ID NO: 1999195 - RNA, 23 nt, Shigella flexneri 2a str. 301
ccaguauugccaugcacgcaaga

SEQ ID NO: 1999196 - RNA, 19 nt, Shigella flexneri 2a str. 301
ccaguauuaccggcagagu

SEQ ID NO: 1999197 - RNA, 21 nt, Shigella flexneri 2a str. 301
ccagucacuucacaguuuuga

SEQ ID NO: 1999198 - RNA, 19 nt, Shigella flexneri 2a str. 301
ccaguacgcgcaaccccgc

SEQ ID NO: 1999199 - RNA, 18 nt, Shigella flexneri 2a str. 301
ccagguacgcaggcggcu

SEQ ID NO: 1999200 - RNA, 16 nt, Shigella flexneri 2a str. 301
ccagguggugcaggcu

SEQ ID NO: 1999201 - RNA, 17 nt, Shigella flexneri 2a str. 301
ccagguuaacgcaggcg

SEQ ID NO: 1999202 - RNA, 23 nt, Shigella flexneri 2a str. 301
ccagguaaacaccuucauccagc

SEQ ID NO: 1999203 - RNA, 17 nt, Shigella flexneri 2a str. 301
ccaggguuuuauuauuc

SEQ ID NO: 1999204 - RNA, 16 nt, Shigella flexneri 2a str. 301
ccagccgcgucugaau

SEQ ID NO: 1999205 - RNA, 22 nt, Shigella flexneri 2a str. 301
ccagccgcuaacuuccugcugg

SEQ ID NO: 1999206 - RNA, 22 nt, Shigella flexneri 2a str. 301
cggcggcucguuagacggcgcu

SEQ ID NO: 1999207 - RNA, 10 nt, Shigella flexneri 2a str. 301
cggcggcgga

SEQ ID NO: 1999208 - RNA, 13 nt, Shigella flexneri 2a str. 301
cggcgcucugccc

SEQ ID NO: 1999209 - RNA, 23 nt, Shigella flexneri 2a str. 301
cggcgcguugaugccgugcagca

SEQ ID NO: 1999210 - RNA, 17 nt, Shigella flexneri 2a str. 301
cggcggaaagggccgca

SEQ ID NO: 1999211 - RNA, 18 nt, Shigella flexneri 2a str. 301
cggcgcuuccagcaaauc

SEQ ID NO: 1999212 - RNA, 15 nt, Shigella flexneri 2a str. 301
cggcggugucgccag

SEQ ID NO: 1999213 - RNA, 17 nt, Shigella flexneri 2a str. 301
cggcgguugacgccccu

SEQ ID NO: 1999214 - RNA, 15 nt, Shigella flexneri 2a str. 301
cggcgguugacgccc

SEQ ID NO: 1999215 - RNA, 15 nt, Shigella flexneri 2a str. 301
cggcguaacgccacg

SEQ ID NO: 1999216 - RNA, 15 nt, Shigella flexneri 2a str. 301
cggcguaaacgccuu

SEQ ID NO: 1999217 - RNA, 21 nt, Shigella flexneri 2a str. 301
cggcggugagaagaccgccgc

SEQ ID NO: 1999218 - RNA, 18 nt, Shigella flexneri 2a str. 301
cggcggugaccagcagca

SEQ ID NO: 1999219 - RNA, 19 nt, Shigella flexneri 2a str. 301
cggcguaccuucaggcaca

SEQ ID NO: 1999220 - RNA, 20 nt, Shigella flexneri 2a str. 301
cggcgaguauucuugcugau

SEQ ID NO: 1999221 - RNA, 18 nt, Shigella flexneri 2a str. 301
cggcgcgaguuugccgcu

SEQ ID NO: 1999222 - RNA, 13 nt, Shigella flexneri 2a str. 301
cggcgcggcagcu

SEQ ID NO: 1999223 - RNA, 18 nt, Shigella flexneri 2a str. 301
cggccucuucaaacggca

SEQ ID NO: 1999224 - RNA, 14 nt, Shigella flexneri 2a str. 301
cggcgaaaacgcca

SEQ ID NO: 1999225 - RNA, 20 nt, Shigella flexneri 2a str. 301
cggccugcgcgaugaugcca

SEQ ID NO: 1999226 - RNA, 18 nt, Shigella flexneri 2a str. 301
cggcgacuggauaaugaa

SEQ ID NO: 1999227 - RNA, 13 nt, Shigella flexneri 2a str. 301
cggcgacugaggc

SEQ ID NO: 1999228 - RNA, 18 nt, Shigella flexneri 2a str. 301
cggccccaucgaaccauc

SEQ ID NO: 1999229 - RNA, 15 nt, Shigella flexneri 2a str. 301
cggccauugaauauu

SEQ ID NO: 1999230 - RNA, 22 nt, Shigella flexneri 2a str. 301
cggcaguucgguugggaucgcc

SEQ ID NO: 1999231 - RNA, 23 nt, Shigella flexneri 2a str. 301
cggcagugacugccccaguuccu

SEQ ID NO: 1999232 - RNA, 16 nt, Shigella flexneri 2a str. 301
cggcagugacugcccc

SEQ ID NO: 1999233 - RNA, 16 nt, Shigella flexneri 2a str. 301
cggcauaaacaaagug

SEQ ID NO: 1999234 - RNA, 18 nt, Shigella flexneri 2a str. 301
cggcauaaagcugcggau

SEQ ID NO: 1999235 - RNA, 19 nt, Shigella flexneri 2a str. 301
cggcauagccaccuggcug

SEQ ID NO: 1999236 - RNA, 21 nt, Shigella flexneri 2a str. 301
cggcauagccaccuggcugcg

SEQ ID NO: 1999237 - RNA, 17 nt, Shigella flexneri 2a str. 301
cggcaggguuugcgccc

SEQ ID NO: 1999238 - RNA, 17 nt, Shigella flexneri 2a str. 301
cggcagguugcagagca

SEQ ID NO: 1999239 - RNA, 19 nt, Shigella flexneri 2a str. 301
cggcaguaauaccagaccu

SEQ ID NO: 1999240 - RNA, 18 nt, Shigella flexneri 2a str. 301
cggcaguauagcggcaug

SEQ ID NO: 1999241 - RNA, 15 nt, Shigella flexneri 2a str. 301
cggcagucugcugac

SEQ ID NO: 1999242 - RNA, 20 nt, Shigella flexneri 2a str. 301
cggcagucugcugaccaccu

SEQ ID NO: 1999243 - RNA, 19 nt, Shigella flexneri 2a str. 301
cggcagucggcgcauaaug

SEQ ID NO: 1999244 - RNA, 14 nt, Shigella flexneri 2a str. 301
cggcaggugacugg

SEQ ID NO: 1999245 - RNA, 15 nt, Shigella flexneri 2a str. 301
cggcagcggcuucau

SEQ ID NO: 1999246 - RNA, 12 nt, Shigella flexneri 2a str. 301
cggcagcgucgg

SEQ ID NO: 1999247 - RNA, 14 nt, Shigella flexneri 2a str. 301
cggcagcuccagca

SEQ ID NO: 1999248 - RNA, 14 nt, Shigella flexneri 2a str. 301
cggcagcugcucgc

SEQ ID NO: 1999249 - RNA, 15 nt, Shigella flexneri 2a str. 301
cggcaggagccgaac

SEQ ID NO: 1999250 - RNA, 22 nt, Shigella flexneri 2a str. 301
cggcaggccuaacacaugcaag

SEQ ID NO: 1999251 - RNA, 15 nt, Shigella flexneri 2a str. 301
cggcagaaugguaac

SEQ ID NO: 1999252 - RNA, 14 nt, Shigella flexneri 2a str. 301
cggcagaaaaucca

SEQ ID NO: 1999253 - RNA, 18 nt, Shigella flexneri 2a str. 301
cggcacggaaagcagcau

SEQ ID NO: 1999254 - RNA, 20 nt, Shigella flexneri 2a str. 301
cggcagagaaaccacaucaa

SEQ ID NO: 1999255 - RNA, 15 nt, Shigella flexneri 2a str. 301
cggcagccugacgcc

SEQ ID NO: 1999256 - RNA, 14 nt, Shigella flexneri 2a str. 301
cgcuugacgcgucu

SEQ ID NO: 1999257 - RNA, 19 nt, Shigella flexneri 2a str. 301
cgcuugccugugccacggc

SEQ ID NO: 1999258 - RNA, 22 nt, Shigella flexneri 2a str. 301
cgcuugcugauaacgugcagcu

SEQ ID NO: 1999259 - RNA, 23 nt, Shigella flexneri 2a str. 301
cgcuugcugauaacgugcagcuu

SEQ ID NO: 1999260 - RNA, 15 nt, Shigella flexneri 2a str. 301
cggcacgccagucgg

SEQ ID NO: 1999261 - RNA, 19 nt, Shigella flexneri 2a str. 301
cggcacgcguugcgcauga

SEQ ID NO: 1999262 - RNA, 22 nt, Shigella flexneri 2a str. 301
cggcaucgccgcuaucgcugau

SEQ ID NO: 1999263 - RNA, 14 nt, Shigella flexneri 2a str. 301
cggcaucgcuccac

SEQ ID NO: 1999264 - RNA, 18 nt, Shigella flexneri 2a str. 301
cggcaucgcuccacgcca

SEQ ID NO: 1999265 - RNA, 21 nt, Shigella flexneri 2a str. 301
cggcaucgcuccacgccauau

SEQ ID NO: 1999266 - RNA, 18 nt, Shigella flexneri 2a str. 301
cggcaucuucuccacgcc

SEQ ID NO: 1999267 - RNA, 18 nt, Shigella flexneri 2a str. 301
cggcaucuuguucauagu

SEQ ID NO: 1999268 - RNA, 16 nt, Shigella flexneri 2a str. 301
cggcaugaaagcgaug

SEQ ID NO: 1999269 - RNA, 20 nt, Shigella flexneri 2a str. 301
cggcauccagguuucuucca

SEQ ID NO: 1999270 - RNA, 15 nt, Shigella flexneri 2a str. 301
cggcaucagcagaau

SEQ ID NO: 1999271 - RNA, 22 nt, Shigella flexneri 2a str. 301
cggcaucagcagaaucgcaacc

SEQ ID NO: 1999272 - RNA, 22 nt, Shigella flexneri 2a str. 301
cggcauacuuugauuaaccguu

SEQ ID NO: 1999273 - RNA, 17 nt, Shigella flexneri 2a str. 301
cggcauauccaccaccc

SEQ ID NO: 1999274 - RNA, 24 nt, Shigella flexneri 2a str. 301
cggcauuacugguuugcagauaac

SEQ ID NO: 1999275 - RNA, 16 nt, Shigella flexneri 2a str. 301
cggccaaaauguggau

SEQ ID NO: 1999276 - RNA, 21 nt, Shigella flexneri 2a str. 301
cggcaugaaaacccuucaaau

SEQ ID NO: 1999277 - RNA, 16 nt, Shigella flexneri 2a str. 301
cggcaugacgccgggc

SEQ ID NO: 1999278 - RNA, 17 nt, Shigella flexneri 2a str. 301
cggcaugagccgccgcc

SEQ ID NO: 1999279 - RNA, 14 nt, Shigella flexneri 2a str. 301
cggcauggaucgcc

SEQ ID NO: 1999280 - RNA, 16 nt, Shigella flexneri 2a str. 301
cggccagcaucgcaac

SEQ ID NO: 1999281 - RNA, 19 nt, Shigella flexneri 2a str. 301
cggccagccauccgucauc

SEQ ID NO: 1999282 - RNA, 22 nt, Shigella flexneri 2a str. 301
cggccagcgggcgucaaaauca

SEQ ID NO: 1999283 - RNA, 22 nt, Shigella flexneri 2a str. 301
cggccaguuucggacgcggcac

SEQ ID NO: 1999284 - RNA, 21 nt, Shigella flexneri 2a str. 301
cgccgacggucaggcuaauac

SEQ ID NO: 1999285 - RNA, 13 nt, Shigella flexneri 2a str. 301
cgccgcaaaucgu

SEQ ID NO: 1999286 - RNA, 20 nt, Shigella flexneri 2a str. 301
cgccgcacaauacauagaaa

SEQ ID NO: 1999287 - RNA, 15 nt, Shigella flexneri 2a str. 301
cgccgccacugccac

SEQ ID NO: 1999288 - RNA, 13 nt, Shigella flexneri 2a str. 301
cgccgccagcaac

SEQ ID NO: 1999289 - RNA, 18 nt, Shigella flexneri 2a str. 301
cgcccugcgcuggugaaa

SEQ ID NO: 1999290 - RNA, 15 nt, Shigella flexneri 2a str. 301
cgcccugcagcauca

SEQ ID NO: 1999291 - RNA, 13 nt, Shigella flexneri 2a str. 301
cgcccugcuccag

SEQ ID NO: 1999292 - RNA, 18 nt, Shigella flexneri 2a str. 301
cgcccugcggcugaccac

SEQ ID NO: 1999293 - RNA, 14 nt, Shigella flexneri 2a str. 301
cgccgaaaccgcgc

SEQ ID NO: 1999294 - RNA, 19 nt, Shigella flexneri 2a str. 301
cgcccgguuuucgcgcgca

SEQ ID NO: 1999295 - RNA, 22 nt, Shigella flexneri 2a str. 301
cgcccugauaaaucaccugcgc

SEQ ID NO: 1999296 - RNA, 12 nt, Shigella flexneri 2a str. 301
cgcccugccuuu

SEQ ID NO: 1999297 - RNA, 21 nt, Shigella flexneri 2a str. 301
cgcccguuuucuccagcgccg

SEQ ID NO: 1999298 - RNA, 14 nt, Shigella flexneri 2a str. 301
cgcccgucaacggu

SEQ ID NO: 1999299 - RNA, 22 nt, Shigella flexneri 2a str. 301
cgcccgucacguucugcgccgu

SEQ ID NO: 1999300 - RNA, 12 nt, Shigella flexneri 2a str. 301
cgcccaucauuc

SEQ ID NO: 1999301 - RNA, 19 nt, Shigella flexneri 2a str. 301
cgcccaucgcgcccgccgc

SEQ ID NO: 1999302 - RNA, 21 nt, Shigella flexneri 2a str. 301
cgccccagaccugaauuugcu

SEQ ID NO: 1999303 - RNA, 13 nt, Shigella flexneri 2a str. 301
cgcccagcuucau

SEQ ID NO: 1999304 - RNA, 22 nt, Shigella flexneri 2a str. 301
cgcccagcgucagcauaaaaau

SEQ ID NO: 1999305 - RNA, 17 nt, Shigella flexneri 2a str. 301
cgcccagcguugcacau

SEQ ID NO: 1999306 - RNA, 18 nt, Shigella flexneri 2a str. 301
cgcccagcgcaggaaaga

SEQ ID NO: 1999307 - RNA, 17 nt, Shigella flexneri 2a str. 301
cgccccuucugccgcaa

SEQ ID NO: 1999308 - RNA, 14 nt, Shigella flexneri 2a str. 301
cgccccuuccaggc

SEQ ID NO: 1999309 - RNA, 22 nt, Shigella flexneri 2a str. 301
cgccccugcgcuaaacaggauc

SEQ ID NO: 1999310 - RNA, 11 nt, Shigella flexneri 2a str. 301
cgccccugaca

SEQ ID NO: 1999311 - RNA, 15 nt, Shigella flexneri 2a str. 301
cgccccgugaugaac

SEQ ID NO: 1999312 - RNA, 18 nt, Shigella flexneri 2a str. 301
cgccccggcucgcgaccu

SEQ ID NO: 1999313 - RNA, 19 nt, Shigella flexneri 2a str. 301
cgccccggcucgcgaccuc

SEQ ID NO: 1999314 - RNA, 21 nt, Shigella flexneri 2a str. 301
cgccauuucuucuccggcauc

SEQ ID NO: 1999315 - RNA, 19 nt, Shigella flexneri 2a str. 301
cgccauugacguuccuuuc

SEQ ID NO: 1999316 - RNA, 19 nt, Shigella flexneri 2a str. 301
cgccauucauacccugaau

SEQ ID NO: 1999317 - RNA, 17 nt, Shigella flexneri 2a str. 301
cgcccagaccugcguuc

SEQ ID NO: 1999318 - RNA, 22 nt, Shigella flexneri 2a str. 301
cgcccaaucgaugggauauaac

SEQ ID NO: 1999319 - RNA, 13 nt, Shigella flexneri 2a str. 301
cgcccaauauccu

SEQ ID NO: 1999320 - RNA, 24 nt, Shigella flexneri 2a str. 301
cgcccacgcgcauucccagcgcgu

SEQ ID NO: 1999321 - RNA, 13 nt, Shigella flexneri 2a str. 301
cgcccaacacuuc

SEQ ID NO: 1999322 - RNA, 20 nt, Shigella flexneri 2a str. 301
cgccaucagugccaguacgc

SEQ ID NO: 1999323 - RNA, 14 nt, Shigella flexneri 2a str. 301
cgccauccaccagc

SEQ ID NO: 1999324 - RNA, 13 nt, Shigella flexneri 2a str. 301
cgccaucaggcag

SEQ ID NO: 1999325 - RNA, 18 nt, Shigella flexneri 2a str. 301
cgccaucaauaaccagcg

SEQ ID NO: 1999326 - RNA, 17 nt, Shigella flexneri 2a str. 301
cgccaucaaugugcuga

SEQ ID NO: 1999327 - RNA, 16 nt, Shigella flexneri 2a str. 301
cgccaucgccagcagc

SEQ ID NO: 1999328 - RNA, 14 nt, Shigella flexneri 2a str. 301
cgccaucgccagga

SEQ ID NO: 1999329 - RNA, 12 nt, Shigella flexneri 2a str. 301
cgccaucgccag

SEQ ID NO: 1999330 - RNA, 16 nt, Shigella flexneri 2a str. 301
cgccauguugccuggg

SEQ ID NO: 1999331 - RNA, 19 nt, Shigella flexneri 2a str. 301
cgccauguugccuggggag

SEQ ID NO: 1999332 - RNA, 14 nt, Shigella flexneri 2a str. 301
cgccauuaacauua

SEQ ID NO: 1999333 - RNA, 21 nt, Shigella flexneri 2a str. 301
cgccaucccuaccgcccgcgc

SEQ ID NO: 1999334 - RNA, 15 nt, Shigella flexneri 2a str. 301
cgccauccagccggg

SEQ ID NO: 1999335 - RNA, 22 nt, Shigella flexneri 2a str. 301
cgccauccgguuaucagaagau

SEQ ID NO: 1999336 - RNA, 16 nt, Shigella flexneri 2a str. 301
cgccauccgguuauca

SEQ ID NO: 1999337 - RNA, 13 nt, Shigella flexneri 2a str. 301
cgccauccggcgu

SEQ ID NO: 1999338 - RNA, 19 nt, Shigella flexneri 2a str. 301
cgccauaacggcuguccau

SEQ ID NO: 1999339 - RNA, 16 nt, Shigella flexneri 2a str. 301
cgccaguuuuuauacu

SEQ ID NO: 1999340 - RNA, 18 nt, Shigella flexneri 2a str. 301
cgccauaccaugcaccaa

SEQ ID NO: 1999341 - RNA, 20 nt, Shigella flexneri 2a str. 301
cgccauaccaugcaccaacc

SEQ ID NO: 1999342 - RNA, 13 nt, Shigella flexneri 2a str. 301
cgccaguugcggc

SEQ ID NO: 1999343 - RNA, 11 nt, Shigella flexneri 2a str. 301
cgccaguuuac

SEQ ID NO: 1999344 - RNA, 15 nt, Shigella flexneri 2a str. 301
cgccaguuacugcca

SEQ ID NO: 1999345 - RNA, 20 nt, Shigella flexneri 2a str. 301
cgccaguuacugcugacgcu

SEQ ID NO: 1999346 - RNA, 19 nt, Shigella flexneri 2a str. 301
cgccaguucuuccaguucc

SEQ ID NO: 1999347 - RNA, 11 nt, Shigella flexneri 2a str. 301
cgccagugacc

SEQ ID NO: 1999348 - RNA, 21 nt, Shigella flexneri 2a str. 301
cgccagugugcgucgguuuuu

SEQ ID NO: 1999349 - RNA, 23 nt, Shigella flexneri 2a str. 301
cgccaguaaucuggccaaugccu

SEQ ID NO: 1999350 - RNA, 15 nt, Shigella flexneri 2a str. 301
cgccaguacgcgccc

SEQ ID NO: 1999351 - RNA, 19 nt, Shigella flexneri 2a str. 301
cgccagguuucaauauccg

SEQ ID NO: 1999352 - RNA, 22 nt, Shigella flexneri 2a str. 301
cgccagguguuuaaccaacaca

SEQ ID NO: 1999353 - RNA, 18 nt, Shigella flexneri 2a str. 301
cgccaggucagagagcca

SEQ ID NO: 1999354 - RNA, 14 nt, Shigella flexneri 2a str. 301
cgccaggcgcugau

SEQ ID NO: 1999355 - RNA, 22 nt, Shigella flexneri 2a str. 301
cgccaggcuuuccgucagcggc

SEQ ID NO: 1999356 - RNA, 23 nt, Shigella flexneri 2a str. 301
cgccagcggcguuugcuccugcu

SEQ ID NO: 1999357 - RNA, 23 nt, Shigella flexneri 2a str. 301
cgccagcggagaaacuucugccg

SEQ ID NO: 1999358 - RNA, 22 nt, Shigella flexneri 2a str. 301
cgccagcgaauuccaguugauu

SEQ ID NO: 1999359 - RNA, 22 nt, Shigella flexneri 2a str. 301
cgccagcgaucuuucgcggcag

SEQ ID NO: 1999360 - RNA, 11 nt, Shigella flexneri 2a str. 301
cgccagcgcca

SEQ ID NO: 1999361 - RNA, 16 nt, Shigella flexneri 2a str. 301
cgccagcgaauuccag

SEQ ID NO: 1999362 - RNA, 14 nt, Shigella flexneri 2a str. 301
cgccagcgugguca

SEQ ID NO: 1999363 - RNA, 21 nt, Shigella flexneri 2a str. 301
cgccagcguugauguuccucc

SEQ ID NO: 1999364 - RNA, 19 nt, Shigella flexneri 2a str. 301
cgccagcgucucuucaauu

SEQ ID NO: 1999365 - RNA, 23 nt, Shigella flexneri 2a str. 301
cgccaggaaccugugacagcagc

SEQ ID NO: 1999366 - RNA, 14 nt, Shigella flexneri 2a str. 301
cgccaggccagccu

SEQ ID NO: 1999367 - RNA, 18 nt, Shigella flexneri 2a str. 301
cgcauaacucaccaucaa

SEQ ID NO: 1999368 - RNA, 17 nt, Shigella flexneri 2a str. 301
cgcauaacagagcgaag

SEQ ID NO: 1999369 - RNA, 15 nt, Shigella flexneri 2a str. 301
cgcauaacagcccgc

SEQ ID NO: 1999370 - RNA, 19 nt, Shigella flexneri 2a str. 301
cgcauaaugccugaugcga

SEQ ID NO: 1999371 - RNA, 13 nt, Shigella flexneri 2a str. 301
cgcauccggcaau

SEQ ID NO: 1999372 - RNA, 16 nt, Shigella flexneri 2a str. 301
cgcauccggcaauaag

SEQ ID NO: 1999373 - RNA, 23 nt, Shigella flexneri 2a str. 301
cgcauccggcaauucucucugau

SEQ ID NO: 1999374 - RNA, 14 nt, Shigella flexneri 2a str. 301
cgcauccggcaguu

SEQ ID NO: 1999375 - RNA, 19 nt, Shigella flexneri 2a str. 301
cgcauccggcaugaacaaa

SEQ ID NO: 1999376 - RNA, 17 nt, Shigella flexneri 2a str. 301
cgcauccgaucgcgcau

SEQ ID NO: 1999377 - RNA, 15 nt, Shigella flexneri 2a str. 301
cgcauccgcuugcgu

SEQ ID NO: 1999378 - RNA, 16 nt, Shigella flexneri 2a str. 301
cgcauaccgugucgga

SEQ ID NO: 1999379 - RNA, 18 nt, Shigella flexneri 2a str. 301
cgcauccggucacuuuca

SEQ ID NO: 1999380 - RNA, 18 nt, Shigella flexneri 2a str. 301
cgcauccgucgccgcuuu

SEQ ID NO: 1999381 - RNA, 14 nt, Shigella flexneri 2a str. 301
cgcauccgguuuac

SEQ ID NO: 1999382 - RNA, 23 nt, Shigella flexneri 2a str. 301
cgccaccagcgguuuuugcgcca

SEQ ID NO: 1999383 - RNA, 14 nt, Shigella flexneri 2a str. 301
cgccacgguguugu

SEQ ID NO: 1999384 - RNA, 18 nt, Shigella flexneri 2a str. 301
cgccacuucccagccuuc

SEQ ID NO: 1999385 - RNA, 23 nt, Shigella flexneri 2a str. 301
cgccacucucgccccuucuucua

SEQ ID NO: 1999386 - RNA, 13 nt, Shigella flexneri 2a str. 301
cgccacccagucc

SEQ ID NO: 1999387 - RNA, 14 nt, Shigella flexneri 2a str. 301
cgccaccucuuuca

SEQ ID NO: 1999388 - RNA, 20 nt, Shigella flexneri 2a str. 301
cgccaccucuuucaccaacg

SEQ ID NO: 1999389 - RNA, 12 nt, Shigella flexneri 2a str. 301
cgccacgacuca

SEQ ID NO: 1999390 - RNA, 16 nt, Shigella flexneri 2a str. 301
cgccacgggcaauaag

SEQ ID NO: 1999391 - RNA, 18 nt, Shigella flexneri 2a str. 301
cgccagcauucccgccag

SEQ ID NO: 1999392 - RNA, 20 nt, Shigella flexneri 2a str. 301
cgccagcaucggcagcgcca

SEQ ID NO: 1999393 - RNA, 12 nt, Shigella flexneri 2a str. 301
cgccagccacca

SEQ ID NO: 1999394 - RNA, 21 nt, Shigella flexneri 2a str. 301
cgccagccaggucgguccguc

SEQ ID NO: 1999395 - RNA, 14 nt, Shigella flexneri 2a str. 301
cgccagccgaugca

SEQ ID NO: 1999396 - RNA, 19 nt, Shigella flexneri 2a str. 301
cgccagcagggcaaacagc

SEQ ID NO: 1999397 - RNA, 20 nt, Shigella flexneri 2a str. 301
cgccagcagcagcgccaacg

SEQ ID NO: 1999398 - RNA, 15 nt, Shigella flexneri 2a str. 301
cgccagaugcggcgu

SEQ ID NO: 1999399 - RNA, 11 nt, Shigella flexneri 2a str. 301
cgccagaucag

SEQ ID NO: 1999400 - RNA, 14 nt, Shigella flexneri 2a str. 301
cgccagaucaggga

SEQ ID NO: 1999401 - RNA, 23 nt, Shigella flexneri 2a str. 301
cgccagaacacgcucccagcaga

SEQ ID NO: 1999402 - RNA, 19 nt, Shigella flexneri 2a str. 301
cgccacuuucacgccgcca

SEQ ID NO: 1999403 - RNA, 14 nt, Shigella flexneri 2a str. 301
cgccagaaguugcu

SEQ ID NO: 1999404 - RNA, 19 nt, Shigella flexneri 2a str. 301
cgccagacaauugccgcca

SEQ ID NO: 1999405 - RNA, 22 nt, Shigella flexneri 2a str. 301
cgccagacugcgcuaccaggaa

SEQ ID NO: 1999406 - RNA, 12 nt, Shigella flexneri 2a str. 301
cgccagaccuga

SEQ ID NO: 1999407 - RNA, 17 nt, Shigella flexneri 2a str. 301
cgccagaccaauagaaa

SEQ ID NO: 1999408 - RNA, 21 nt, Shigella flexneri 2a str. 301
cgccagaccagcuaccacgcc

SEQ ID NO: 1999409 - RNA, 17 nt, Shigella flexneri 2a str. 301
cgccagaccgcagaagc

SEQ ID NO: 1999410 - RNA, 15 nt, Shigella flexneri 2a str. 301
cgcacuuacagcaac

SEQ ID NO: 1999411 - RNA, 12 nt, Shigella flexneri 2a str. 301
cgcacuuaauau

SEQ ID NO: 1999412 - RNA, 13 nt, Shigella flexneri 2a str. 301
cgcacuuaauaua

SEQ ID NO: 1999413 - RNA, 22 nt, Shigella flexneri 2a str. 301
cgcagacacuuucccuggcgcu

SEQ ID NO: 1999414 - RNA, 13 nt, Shigella flexneri 2a str. 301
cgcacugcuugaa

SEQ ID NO: 1999415 - RNA, 22 nt, Shigella flexneri 2a str. 301
cgcacuggggggcuauccgcgc

SEQ ID NO: 1999416 - RNA, 20 nt, Shigella flexneri 2a str. 301
cgcacuggcgagcgccagca

SEQ ID NO: 1999417 - RNA, 15 nt, Shigella flexneri 2a str. 301
cgcacguauaaacau

SEQ ID NO: 1999418 - RNA, 17 nt, Shigella flexneri 2a str. 301
cgcaccgccaccaccga

SEQ ID NO: 1999419 - RNA, 17 nt, Shigella flexneri 2a str. 301
cgcaccggaacaaccca

SEQ ID NO: 1999420 - RNA, 15 nt, Shigella flexneri 2a str. 301
cgcaaucgcccagcg

SEQ ID NO: 1999421 - RNA, 18 nt, Shigella flexneri 2a str. 301
cgcaauggucccuugcug

SEQ ID NO: 1999422 - RNA, 16 nt, Shigella flexneri 2a str. 301
cgcaaugguguacuca

SEQ ID NO: 1999423 - RNA, 18 nt, Shigella flexneri 2a str. 301
cgcaauggccguuccggc

SEQ ID NO: 1999424 - RNA, 12 nt, Shigella flexneri 2a str. 301
cgcaaugugcuc

SEQ ID NO: 1999425 - RNA, 17 nt, Shigella flexneri 2a str. 301
cgcaauuaacgccccaa

SEQ ID NO: 1999426 - RNA, 23 nt, Shigella flexneri 2a str. 301
cgcaccaggcgaaaacgcugacc

SEQ ID NO: 1999427 - RNA, 22 nt, Shigella flexneri 2a str. 301
cgcaaucaccgggccgaugcgg

SEQ ID NO: 1999428 - RNA, 16 nt, Shigella flexneri 2a str. 301
cgcaaucagagauaua

SEQ ID NO: 1999429 - RNA, 20 nt, Shigella flexneri 2a str. 301
cgcaaucagagauauagucu

SEQ ID NO: 1999430 - RNA, 14 nt, Shigella flexneri 2a str. 301
cgcaaucagcaccg

SEQ ID NO: 1999431 - RNA, 15 nt, Shigella flexneri 2a str. 301
cgcaauacagccagc

SEQ ID NO: 1999432 - RNA, 17 nt, Shigella flexneri 2a str. 301
cgcaauaccggcaaaga

SEQ ID NO: 1999433 - RNA, 18 nt, Shigella flexneri 2a str. 301
cgcaauacgcuuguacuu

SEQ ID NO: 1999434 - RNA, 17 nt, Shigella flexneri 2a str. 301
cgcaauagcacugcuuu

SEQ ID NO: 1999435 - RNA, 15 nt, Shigella flexneri 2a str. 301
cgcaauaaucaucuc

SEQ ID NO: 1999436 - RNA, 16 nt, Shigella flexneri 2a str. 301
cgcaauaaacaugaug

SEQ ID NO: 1999437 - RNA, 16 nt, Shigella flexneri 2a str. 301
cgcaagccaacauguu

SEQ ID NO: 1999438 - RNA, 15 nt, Shigella flexneri 2a str. 301
cgauuucucagcaga

SEQ ID NO: 1999439 - RNA, 13 nt, Shigella flexneri 2a str. 301
cgcagcugagaaa

SEQ ID NO: 1999440 - RNA, 13 nt, Shigella flexneri 2a str. 301
cgcagcugaccuu

SEQ ID NO: 1999441 - RNA, 22 nt, Shigella flexneri 2a str. 301
cgcagcuccgggcucaugcugu

SEQ ID NO: 1999442 - RNA, 14 nt, Shigella flexneri 2a str. 301
cgcagccgaguaga

SEQ ID NO: 1999443 - RNA, 17 nt, Shigella flexneri 2a str. 301
cgcagccgccagaaaug

SEQ ID NO: 1999444 - RNA, 12 nt, Shigella flexneri 2a str. 301
cgcagcauugcu

SEQ ID NO: 1999445 - RNA, 21 nt, Shigella flexneri 2a str. 301
cgcagccagcguuacaaccuc

SEQ ID NO: 1999446 - RNA, 15 nt, Shigella flexneri 2a str. 301
cgcagccagcacugc

SEQ ID NO: 1999447 - RNA, 14 nt, Shigella flexneri 2a str. 301
cgcagccagcgcgc

SEQ ID NO: 1999448 - RNA, 18 nt, Shigella flexneri 2a str. 301
cgcagccaucaaccugug

SEQ ID NO: 1999449 - RNA, 17 nt, Shigella flexneri 2a str. 301
cgcagccaucagcgaga

SEQ ID NO: 1999450 - RNA, 15 nt, Shigella flexneri 2a str. 301
cgcagccaguuaacc

SEQ ID NO: 1999451 - RNA, 19 nt, Shigella flexneri 2a str. 301
cgcagcccagaugcggcgg

SEQ ID NO: 1999452 - RNA, 20 nt, Shigella flexneri 2a str. 301
cgcagcacccugaguuuuca

SEQ ID NO: 1999453 - RNA, 20 nt, Shigella flexneri 2a str. 301
cgcaguguaguucuggccuu

SEQ ID NO: 1999454 - RNA, 13 nt, Shigella flexneri 2a str. 301
cgcagucuuccca

SEQ ID NO: 1999455 - RNA, 14 nt, Shigella flexneri 2a str. 301
cgcagucuucccag

SEQ ID NO: 1999456 - RNA, 20 nt, Shigella flexneri 2a str. 301
cgcagugaagucgggcagaa

SEQ ID NO: 1999457 - RNA, 19 nt, Shigella flexneri 2a str. 301
cgcagugagaagccaccgc

SEQ ID NO: 1999458 - RNA, 17 nt, Shigella flexneri 2a str. 301
cgcaguugcaguaccag

SEQ ID NO: 1999459 - RNA, 18 nt, Shigella flexneri 2a str. 301
cgcauaaaacaacgccac

SEQ ID NO: 1999460 - RNA, 19 nt, Shigella flexneri 2a str. 301
cgcagucaugcgagaagca

SEQ ID NO: 1999461 - RNA, 23 nt, Shigella flexneri 2a str. 301
cgcaguaugcgauacccccagua

SEQ ID NO: 1999462 - RNA, 14 nt, Shigella flexneri 2a str. 301
cgcagucacaccag

SEQ ID NO: 1999463 - RNA, 16 nt, Shigella flexneri 2a str. 301
cgcagucucucuccgu

SEQ ID NO: 1999464 - RNA, 21 nt, Shigella flexneri 2a str. 301
cgcagucccuuucccaccggc

SEQ ID NO: 1999465 - RNA, 16 nt, Shigella flexneri 2a str. 301
cgcaguaccagcaacg

SEQ ID NO: 1999466 - RNA, 19 nt, Shigella flexneri 2a str. 301
cgcaguaaauccgccacuu

SEQ ID NO: 1999467 - RNA, 12 nt, Shigella flexneri 2a str. 301
cgcagguuuugc

SEQ ID NO: 1999468 - RNA, 19 nt, Shigella flexneri 2a str. 301
aaacgguuuauccccaagg

SEQ ID NO: 1999469 - RNA, 17 nt, Shigella flexneri 2a str. 301
aaacgguuuauccccaa

SEQ ID NO: 1999470 - RNA, 16 nt, Shigella flexneri 2a str. 301
aaacggugauacugau

SEQ ID NO: 1999471 - RNA, 18 nt, Shigella flexneri 2a str. 301
aaacgguugauaaaugag

SEQ ID NO: 1999472 - RNA, 21 nt, Shigella flexneri 2a str. 301
cgcaggugacgcgggcagcag

SEQ ID NO: 1999473 - RNA, 20 nt, Shigella flexneri 2a str. 301
cgcaggucauccggcacgcu

SEQ ID NO: 1999474 - RNA, 19 nt, Shigella flexneri 2a str. 301
cgaucagcaauuucuccgc

SEQ ID NO: 1999475 - RNA, 20 nt, Shigella flexneri 2a str. 301
cgaucaagauugauccccgc

SEQ ID NO: 1999476 - RNA, 12 nt, Shigella flexneri 2a str. 301
cgauauaauaaa

SEQ ID NO: 1999477 - RNA, 14 nt, Shigella flexneri 2a str. 301
cgauacuuuuucaa

SEQ ID NO: 1999478 - RNA, 22 nt, Shigella flexneri 2a str. 301
cgauaucgccauuaaacaaccc

SEQ ID NO: 1999479 - RNA, 17 nt, Shigella flexneri 2a str. 301
cgauauaaauuccacgc

SEQ ID NO: 1999480 - RNA, 16 nt, Shigella flexneri 2a str. 301
cgauacgggcucgggc

SEQ ID NO: 1999481 - RNA, 20 nt, Shigella flexneri 2a str. 301
cgauacuacguucaaucacc

SEQ ID NO: 1999482 - RNA, 17 nt, Shigella flexneri 2a str. 301
cgauacggcccagaccc

SEQ ID NO: 1999483 - RNA, 18 nt, Shigella flexneri 2a str. 301
cgauacccccaguaaaug

SEQ ID NO: 1999484 - RNA, 22 nt, Shigella flexneri 2a str. 301
cgauacgacacgccuccuggcu

SEQ ID NO: 1999485 - RNA, 14 nt, Shigella flexneri 2a str. 301
cgauaauaaagccu

SEQ ID NO: 1999486 - RNA, 17 nt, Shigella flexneri 2a str. 301
cgauaaggcgcugaagg

SEQ ID NO: 1999487 - RNA, 12 nt, Shigella flexneri 2a str. 301
cgauaagcaccg

SEQ ID NO: 1999488 - RNA, 21 nt, Shigella flexneri 2a str. 301
cgauaacucgcuuugcccaga

SEQ ID NO: 1999489 - RNA, 19 nt, Shigella flexneri 2a str. 301
cgauaacgccccaauccac

SEQ ID NO: 1999490 - RNA, 15 nt, Shigella flexneri 2a str. 301
cgaucgagaguggua

SEQ ID NO: 1999491 - RNA, 18 nt, Shigella flexneri 2a str. 301
cgaucgcaaauccauuca

SEQ ID NO: 1999492 - RNA, 22 nt, Shigella flexneri 2a str. 301
cgaucgccugguaccagcaccg

SEQ ID NO: 1999493 - RNA, 23 nt, Shigella flexneri 2a str. 301
cgaucaucacguuggucuggucg

SEQ ID NO: 1999494 - RNA, 15 nt, Shigella flexneri 2a str. 301
cgaucauauuguucc

SEQ ID NO: 1999495 - RNA, 13 nt, Shigella flexneri 2a str. 301
cgaucaucgacag

SEQ ID NO: 1999496 - RNA, 17 nt, Shigella flexneri 2a str. 301
cgauccaccaccgcaaa

SEQ ID NO: 1999497 - RNA, 13 nt, Shigella flexneri 2a str. 301
cgauccaccaccg

SEQ ID NO: 1999498 - RNA, 22 nt, Shigella flexneri 2a str. 301
cgaucauuggccggaauaccac

SEQ ID NO: 1999499 - RNA, 16 nt, Shigella flexneri 2a str. 301
cgaugaguuaagaaga

SEQ ID NO: 1999500 - RNA, 17 nt, Shigella flexneri 2a str. 301
cgaugacuguacagauc

SEQ ID NO: 1999501 - RNA, 14 nt, Shigella flexneri 2a str. 301
cgaugagaugacgc

SEQ ID NO: 1999502 - RNA, 22 nt, Shigella flexneri 2a str. 301
cgaugaccuugucaugcagcuc

SEQ ID NO: 1999503 - RNA, 13 nt, Shigella flexneri 2a str. 301
cgaugaccgccac

SEQ ID NO: 1999504 - RNA, 19 nt, Shigella flexneri 2a str. 301
cgaugaccuugucaugcag

SEQ ID NO: 1999505 - RNA, 13 nt, Shigella flexneri 2a str. 301
cgaugaaccguuc

SEQ ID NO: 1999506 - RNA, 23 nt, Shigella flexneri 2a str. 301
cgaucuugcgaccgcucuuuuuu

SEQ ID NO: 1999507 - RNA, 14 nt, Shigella flexneri 2a str. 301
cgaugaaacguguu

SEQ ID NO: 1999508 - RNA, 13 nt, Shigella flexneri 2a str. 301
cgaucgucugggc

SEQ ID NO: 1999509 - RNA, 13 nt, Shigella flexneri 2a str. 301
cgaucucaaucuu

SEQ ID NO: 1999510 - RNA, 17 nt, Shigella flexneri 2a str. 301
cgaucggcagcugucau

SEQ ID NO: 1999511 - RNA, 22 nt, Shigella flexneri 2a str. 301
cgaucggcgagucgcuccugcc

SEQ ID NO: 1999512 - RNA, 18 nt, Shigella flexneri 2a str. 301
cgaucucuucgccugccu

SEQ ID NO: 1999513 - RNA, 19 nt, Shigella flexneri 2a str. 301
cgauuaugagucgccugcu

SEQ ID NO: 1999514 - RNA, 15 nt, Shigella flexneri 2a str. 301
cgauuauccgccagu

SEQ ID NO: 1999515 - RNA, 18 nt, Shigella flexneri 2a str. 301
cgauuaauugccgccaga

SEQ ID NO: 1999516 - RNA, 19 nt, Shigella flexneri 2a str. 301
cgauuaaaaacccugcaga

SEQ ID NO: 1999517 - RNA, 16 nt, Shigella flexneri 2a str. 301
cgauuaaauucaccag

SEQ ID NO: 1999518 - RNA, 22 nt, Shigella flexneri 2a str. 301
cgauuaaauucaccaguuuacu

SEQ ID NO: 1999519 - RNA, 15 nt, Shigella flexneri 2a str. 301
cgauugugcugguga

SEQ ID NO: 1999520 - RNA, 16 nt, Shigella flexneri 2a str. 301
cgauucgguucaauac

SEQ ID NO: 1999521 - RNA, 19 nt, Shigella flexneri 2a str. 301
cgauuuaugauauuuuuuu

SEQ ID NO: 1999522 - RNA, 11 nt, Shigella flexneri 2a str. 301
cgauuucacaa

SEQ ID NO: 1999523 - RNA, 17 nt, Shigella flexneri 2a str. 301
cgauucacauuuaaaca

SEQ ID NO: 1999524 - RNA, 17 nt, Shigella flexneri 2a str. 301
cgauucacauaacggcc

SEQ ID NO: 1999525 - RNA, 17 nt, Shigella flexneri 2a str. 301
cgauggugaugagcuga

SEQ ID NO: 1999526 - RNA, 13 nt, Shigella flexneri 2a str. 301
cgauggugcacga

SEQ ID NO: 1999527 - RNA, 16 nt, Shigella flexneri 2a str. 301
cgauggugguggggga

SEQ ID NO: 1999528 - RNA, 23 nt, Shigella flexneri 2a str. 301
cgaugguggugggggaaggauua

SEQ ID NO: 1999529 - RNA, 23 nt, Shigella flexneri 2a str. 301
cgaugguugucacugcaucuucc

SEQ ID NO: 1999530 - RNA, 17 nt, Shigella flexneri 2a str. 301
cgauguacuucaacaua

SEQ ID NO: 1999531 - RNA, 14 nt, Shigella flexneri 2a str. 301
cgauguauccggca

SEQ ID NO: 1999532 - RNA, 16 nt, Shigella flexneri 2a str. 301
cgauguaggccugaua

SEQ ID NO: 1999533 - RNA, 18 nt, Shigella flexneri 2a str. 301
cgauggaaccguacagca

SEQ ID NO: 1999534 - RNA, 21 nt, Shigella flexneri 2a str. 301
cgcucggcaaagcgcugaaga

SEQ ID NO: 1999535 - RNA, 21 nt, Shigella flexneri 2a str. 301
cgcucggcaacaccucagcca

SEQ ID NO: 1999536 - RNA, 16 nt, Shigella flexneri 2a str. 301
cgcucguugcagaaug

SEQ ID NO: 1999537 - RNA, 15 nt, Shigella flexneri 2a str. 301
cgcucggcggcuggc

SEQ ID NO: 1999538 - RNA, 23 nt, Shigella flexneri 2a str. 301
cgcucuucaucgcuaaaauacug

SEQ ID NO: 1999539 - RNA, 21 nt, Shigella flexneri 2a str. 301
cgcucuucgaggccgcggcuc

SEQ ID NO: 1999540 - RNA, 22 nt, Shigella flexneri 2a str. 301
cgcucuguagggagagggccgg

SEQ ID NO: 1999541 - RNA, 16 nt, Shigella flexneri 2a str. 301
cgcucugcccaugcug

SEQ ID NO: 1999542 - RNA, 13 nt, Shigella flexneri 2a str. 301
cgcucugagcugc

SEQ ID NO: 1999543 - RNA, 16 nt, Shigella flexneri 2a str. 301
cgcucucuaucacgaa

SEQ ID NO: 1999544 - RNA, 19 nt, Shigella flexneri 2a str. 301
cgcucucgcagcucaucaa

SEQ ID NO: 1999545 - RNA, 17 nt, Shigella flexneri 2a str. 301
cgcucucaagccacuuu

SEQ ID NO: 1999546 - RNA, 20 nt, Shigella flexneri 2a str. 301
cgcucucaagccacuuuccu

SEQ ID NO: 1999547 - RNA, 23 nt, Shigella flexneri 2a str. 301
cgcugaaagaagcggugaaaaaa

SEQ ID NO: 1999548 - RNA, 21 nt, Shigella flexneri 2a str. 301
cgcucuuuuguucgcggcggc

SEQ ID NO: 1999549 - RNA, 23 nt, Shigella flexneri 2a str. 301
cgcucuuuuguucgcggcggccu

SEQ ID NO: 1999550 - RNA, 17 nt, Shigella flexneri 2a str. 301
cgcugaagaaaauggcc

SEQ ID NO: 1999551 - RNA, 24 nt, Shigella flexneri 2a str. 301
cgcugaagaaaauggccagccagc

SEQ ID NO: 1999552 - RNA, 16 nt, Shigella flexneri 2a str. 301
cgcugaacuggcgaag

SEQ ID NO: 1999553 - RNA, 17 nt, Shigella flexneri 2a str. 301
cgcugaacgcaccuucc

SEQ ID NO: 1999554 - RNA, 22 nt, Shigella flexneri 2a str. 301
cgcugaaucaacaggcgguaac

SEQ ID NO: 1999555 - RNA, 16 nt, Shigella flexneri 2a str. 301
cgcugaauaaucccca

SEQ ID NO: 1999556 - RNA, 18 nt, Shigella flexneri 2a str. 301
cgcucccggauaucccag

SEQ ID NO: 1999557 - RNA, 13 nt, Shigella flexneri 2a str. 301
cgcuccgucagca

SEQ ID NO: 1999558 - RNA, 14 nt, Shigella flexneri 2a str. 301
cgcuccgucagcac

SEQ ID NO: 1999559 - RNA, 21 nt, Shigella flexneri 2a str. 301
cgcuccggcggcacagccagc

SEQ ID NO: 1999560 - RNA, 17 nt, Shigella flexneri 2a str. 301
cgcucgaacagcugguu

SEQ ID NO: 1999561 - RNA, 14 nt, Shigella flexneri 2a str. 301
cgcucauacuucca

SEQ ID NO: 1999562 - RNA, 17 nt, Shigella flexneri 2a str. 301
cgcucauacuuccacgc

SEQ ID NO: 1999563 - RNA, 14 nt, Shigella flexneri 2a str. 301
cgcucaucugcugc

SEQ ID NO: 1999564 - RNA, 15 nt, Shigella flexneri 2a str. 301
cgcucagucggcgcu

SEQ ID NO: 1999565 - RNA, 22 nt, Shigella flexneri 2a str. 301
cgcucagucggcgcuuuugcau

SEQ ID NO: 1999566 - RNA, 22 nt, Shigella flexneri 2a str. 301
cgcuccaaggucuccgcccagc

SEQ ID NO: 1999567 - RNA, 19 nt, Shigella flexneri 2a str. 301
cgcuccauugcccgcccga

SEQ ID NO: 1999568 - RNA, 12 nt, Shigella flexneri 2a str. 301
cgcuccauucca

SEQ ID NO: 1999569 - RNA, 20 nt, Shigella flexneri 2a str. 301
cgcuccaggaguuccggguc

SEQ ID NO: 1999570 - RNA, 12 nt, Shigella flexneri 2a str. 301
cgcuccacuuca

SEQ ID NO: 1999571 - RNA, 19 nt, Shigella flexneri 2a str. 301
cgcucaauauccugaccuu

SEQ ID NO: 1999572 - RNA, 18 nt, Shigella flexneri 2a str. 301
cgcucaauaaucaaucuu

SEQ ID NO: 1999573 - RNA, 23 nt, Shigella flexneri 2a str. 301
cgcucaagaaagguugaggcuga

SEQ ID NO: 1999574 - RNA, 14 nt, Shigella flexneri 2a str. 301
cgcuauguuuauca

SEQ ID NO: 1999575 - RNA, 23 nt, Shigella flexneri 2a str. 301
cgcuauuugcgccuggauuuucu

SEQ ID NO: 1999576 - RNA, 16 nt, Shigella flexneri 2a str. 301
cgcucagcgccacauc

SEQ ID NO: 1999577 - RNA, 13 nt, Shigella flexneri 2a str. 301
cgcucacugcaaa

SEQ ID NO: 1999578 - RNA, 20 nt, Shigella flexneri 2a str. 301
cgcuacuuuuuucacccaca

SEQ ID NO: 1999579 - RNA, 14 nt, Shigella flexneri 2a str. 301
cgcuacuggacauu

SEQ ID NO: 1999580 - RNA, 21 nt, Shigella flexneri 2a str. 301
cgcuagcgucguggcaaaaug

SEQ ID NO: 1999581 - RNA, 21 nt, Shigella flexneri 2a str. 301
cgcuaucguccacgucaucaa

SEQ ID NO: 1999582 - RNA, 14 nt, Shigella flexneri 2a str. 301
cgcuaucagcgcca

SEQ ID NO: 1999583 - RNA, 13 nt, Shigella flexneri 2a str. 301
cgcuauccagcgc

SEQ ID NO: 1999584 - RNA, 15 nt, Shigella flexneri 2a str. 301
cgcuagugcauugag

SEQ ID NO: 1999585 - RNA, 21 nt, Shigella flexneri 2a str. 301
cgcgggcgaauuaucggcagc

SEQ ID NO: 1999586 - RNA, 16 nt, Shigella flexneri 2a str. 301
cgcgucagucgccccc

SEQ ID NO: 1999587 - RNA, 20 nt, Shigella flexneri 2a str. 301
cgcgucauugacgcuggcuu

SEQ ID NO: 1999588 - RNA, 12 nt, Shigella flexneri 2a str. 301
cgcuaccgccga

SEQ ID NO: 1999589 - RNA, 16 nt, Shigella flexneri 2a str. 301
cgcuaccugccgccac

SEQ ID NO: 1999590 - RNA, 20 nt, Shigella flexneri 2a str. 301
cgcuaccugccgccaccaug

SEQ ID NO: 1999591 - RNA, 22 nt, Shigella flexneri 2a str. 301
cgcguuguauaacguggugaaa

SEQ ID NO: 1999592 - RNA, 18 nt, Shigella flexneri 2a str. 301
cgcguuguugcaggaaca

SEQ ID NO: 1999593 - RNA, 16 nt, Shigella flexneri 2a str. 301
cgcguggaucaagcaa

SEQ ID NO: 1999594 - RNA, 19 nt, Shigella flexneri 2a str. 301
cgcguggaaaaacccauca

SEQ ID NO: 1999595 - RNA, 11 nt, Shigella flexneri 2a str. 301
cgcguggaaca

SEQ ID NO: 1999596 - RNA, 20 nt, Shigella flexneri 2a str. 301
cgcugccucucuucgcugcu

SEQ ID NO: 1999597 - RNA, 19 nt, Shigella flexneri 2a str. 301
cgcugccguugccgcucuu

SEQ ID NO: 1999598 - RNA, 23 nt, Shigella flexneri 2a str. 301
cgcugccuucggcgucuccaccu

SEQ ID NO: 1999599 - RNA, 21 nt, Shigella flexneri 2a str. 301
cgcugcgcuuacacacccggc

SEQ ID NO: 1999600 - RNA, 15 nt, Shigella flexneri 2a str. 301
cgcuggcaacacaga

SEQ ID NO: 1999601 - RNA, 17 nt, Shigella flexneri 2a str. 301
cgcuggagcacccgcgc

SEQ ID NO: 1999602 - RNA, 16 nt, Shigella flexneri 2a str. 301
cgcugcuuuccugcug

SEQ ID NO: 1999603 - RNA, 23 nt, Shigella flexneri 2a str. 301
cgcugcuuuccugcugcgccugu

SEQ ID NO: 1999604 - RNA, 16 nt, Shigella flexneri 2a str. 301
cgcuggaacgcuucug

SEQ ID NO: 1999605 - RNA, 20 nt, Shigella flexneri 2a str. 301
cgcugcuuguuccacuucau

SEQ ID NO: 1999606 - RNA, 22 nt, Shigella flexneri 2a str. 301
cgcuggagaacaaggcuuuaau

SEQ ID NO: 1999607 - RNA, 18 nt, Shigella flexneri 2a str. 301
cgcugcuguacuuuuucc

SEQ ID NO: 1999608 - RNA, 14 nt, Shigella flexneri 2a str. 301
cgcugcucuucagu

SEQ ID NO: 1999609 - RNA, 13 nt, Shigella flexneri 2a str. 301
cgcugcuaauuua

SEQ ID NO: 1999610 - RNA, 13 nt, Shigella flexneri 2a str. 301
cgcugcguagcca

SEQ ID NO: 1999611 - RNA, 17 nt, Shigella flexneri 2a str. 301
cgcugcggcgcgcaucu

SEQ ID NO: 1999612 - RNA, 24 nt, Shigella flexneri 2a str. 301
cgcugacgauuguagaaaaucuca

SEQ ID NO: 1999613 - RNA, 22 nt, Shigella flexneri 2a str. 301
cgcugagcgauaaaaucagaaa

SEQ ID NO: 1999614 - RNA, 19 nt, Shigella flexneri 2a str. 301
cgcugagacgcgcuugcau

SEQ ID NO: 1999615 - RNA, 18 nt, Shigella flexneri 2a str. 301
cgcugagguuaugcaaac

SEQ ID NO: 1999616 - RNA, 21 nt, Shigella flexneri 2a str. 301
cgcugauauucgacaccaucu

SEQ ID NO: 1999617 - RNA, 17 nt, Shigella flexneri 2a str. 301
cgcugauauacccuuca

SEQ ID NO: 1999618 - RNA, 16 nt, Shigella flexneri 2a str. 301
cgcugauugcuuucuu

SEQ ID NO: 1999619 - RNA, 19 nt, Shigella flexneri 2a str. 301
cgcugauugggaaaucaga

SEQ ID NO: 1999620 - RNA, 14 nt, Shigella flexneri 2a str. 301
cgcugauuuuucug

SEQ ID NO: 1999621 - RNA, 15 nt, Shigella flexneri 2a str. 301
cgcugauuaccuucc

SEQ ID NO: 1999622 - RNA, 22 nt, Shigella flexneri 2a str. 301
cgcugcacuuucucgacaucca

SEQ ID NO: 1999623 - RNA, 14 nt, Shigella flexneri 2a str. 301
cgcugcacuuucuc

SEQ ID NO: 1999624 - RNA, 20 nt, Shigella flexneri 2a str. 301
cgcugcauugcccaauacag

SEQ ID NO: 1999625 - RNA, 13 nt, Shigella flexneri 2a str. 301
cgcugccagccgc

SEQ ID NO: 1999626 - RNA, 15 nt, Shigella flexneri 2a str. 301
cgcugccagccgccg

SEQ ID NO: 1999627 - RNA, 18 nt, Shigella flexneri 2a str. 301
cgcugccccugguuaucu

SEQ ID NO: 1999628 - RNA, 20 nt, Shigella flexneri 2a str. 301
cgcuguaauuuuuuuauuga

SEQ ID NO: 1999629 - RNA, 18 nt, Shigella flexneri 2a str. 301
cgcuguagccgccgucgu

SEQ ID NO: 1999630 - RNA, 17 nt, Shigella flexneri 2a str. 301
cgcugucggugccauca

SEQ ID NO: 1999631 - RNA, 16 nt, Shigella flexneri 2a str. 301
cgcugugagcaggcgu

SEQ ID NO: 1999632 - RNA, 15 nt, Shigella flexneri 2a str. 301
cgcugucuuccuggu

SEQ ID NO: 1999633 - RNA, 23 nt, Shigella flexneri 2a str. 301
cgcugugcugcugacguagcagc

SEQ ID NO: 1999634 - RNA, 15 nt, Shigella flexneri 2a str. 301
cgcuguguaaaccca

SEQ ID NO: 1999635 - RNA, 18 nt, Shigella flexneri 2a str. 301
cgcuguguaaacccagcc

SEQ ID NO: 1999636 - RNA, 19 nt, Shigella flexneri 2a str. 301
cgcuggugaguaacgcgga

SEQ ID NO: 1999637 - RNA, 11 nt, Shigella flexneri 2a str. 301
cgcuguaaaug

SEQ ID NO: 1999638 - RNA, 19 nt, Shigella flexneri 2a str. 301
cgcuggcgcucaagucgaa

SEQ ID NO: 1999639 - RNA, 17 nt, Shigella flexneri 2a str. 301
cgcuggcuuugcccugg

SEQ ID NO: 1999640 - RNA, 15 nt, Shigella flexneri 2a str. 301
cgcuggcgcgccgcc

SEQ ID NO: 1999641 - RNA, 15 nt, Shigella flexneri 2a str. 301
cgcuuaacgcgggcu

SEQ ID NO: 1999642 - RNA, 14 nt, Shigella flexneri 2a str. 301
cgcuuaacgcgucu

SEQ ID NO: 1999643 - RNA, 14 nt, Shigella flexneri 2a str. 301
cgcuuaauccgcgc

SEQ ID NO: 1999644 - RNA, 15 nt, Shigella flexneri 2a str. 301
cgcuguugucugaau

SEQ ID NO: 1999645 - RNA, 17 nt, Shigella flexneri 2a str. 301
cgcuguugucugaauga

SEQ ID NO: 1999646 - RNA, 13 nt, Shigella flexneri 2a str. 301
cgcuucaccaccg

SEQ ID NO: 1999647 - RNA, 14 nt, Shigella flexneri 2a str. 301
cgcuuauccggccc

SEQ ID NO: 1999648 - RNA, 14 nt, Shigella flexneri 2a str. 301
cgcuuaucaggccu

SEQ ID NO: 1999649 - RNA, 19 nt, Shigella flexneri 2a str. 301
cgcuuacucauccacugcc

SEQ ID NO: 1999650 - RNA, 17 nt, Shigella flexneri 2a str. 301
cgcuuacgccugccagc

SEQ ID NO: 1999651 - RNA, 14 nt, Shigella flexneri 2a str. 301
cgcuucaggaauaa

SEQ ID NO: 1999652 - RNA, 19 nt, Shigella flexneri 2a str. 301
cgcuucagugacuucugcc

SEQ ID NO: 1999653 - RNA, 13 nt, Shigella flexneri 2a str. 301
cgcuuccagcaga

SEQ ID NO: 1999654 - RNA, 19 nt, Shigella flexneri 2a str. 301
cgcuuccagcgcaucugcc

SEQ ID NO: 1999655 - RNA, 23 nt, Shigella flexneri 2a str. 301
cgcuuccauugagaaagcccugg

SEQ ID NO: 1999656 - RNA, 16 nt, Shigella flexneri 2a str. 301
cgcuucgcccgccagc

SEQ ID NO: 1999657 - RNA, 14 nt, Shigella flexneri 2a str. 301
cgcuucucccagcc

SEQ ID NO: 1999658 - RNA, 17 nt, Shigella flexneri 2a str. 301
cgcuucggcggguuuuu

SEQ ID NO: 1999659 - RNA, 21 nt, Shigella flexneri 2a str. 301
cgcuucggcuccagcgcgucu

SEQ ID NO: 1999660 - RNA, 16 nt, Shigella flexneri 2a str. 301
cgcuucggcgccuuuu

SEQ ID NO: 1999661 - RNA, 22 nt, Shigella flexneri 2a str. 301
cgcuucuuccagcaucgccccc

SEQ ID NO: 1999662 - RNA, 20 nt, Shigella flexneri 2a str. 301
cgcuucugucgcuucacgca

SEQ ID NO: 1999663 - RNA, 11 nt, Shigella flexneri 2a str. 301
cgcuucugcca

SEQ ID NO: 1999664 - RNA, 23 nt, Shigella flexneri 2a str. 301
cgcggcgauaaugcccagcaacg

SEQ ID NO: 1999665 - RNA, 16 nt, Shigella flexneri 2a str. 301
cgcggcccaggcggcg

SEQ ID NO: 1999666 - RNA, 19 nt, Shigella flexneri 2a str. 301
cgcggaugcguuuuaccag

SEQ ID NO: 1999667 - RNA, 13 nt, Shigella flexneri 2a str. 301
cgcggcuccagaa

SEQ ID NO: 1999668 - RNA, 14 nt, Shigella flexneri 2a str. 301
cgcgcucuucuucg

SEQ ID NO: 1999669 - RNA, 16 nt, Shigella flexneri 2a str. 301
cgcgcucuuuaaaggc

SEQ ID NO: 1999670 - RNA, 22 nt, Shigella flexneri 2a str. 301
cgcgcugccagaaccgcuucuu

SEQ ID NO: 1999671 - RNA, 15 nt, Shigella flexneri 2a str. 301
cgcgcugauugccgu

SEQ ID NO: 1999672 - RNA, 17 nt, Shigella flexneri 2a str. 301
cgcgcuuuuuuuaugcc

SEQ ID NO: 1999673 - RNA, 16 nt, Shigella flexneri 2a str. 301
cgcggaagacccggcg

SEQ ID NO: 1999674 - RNA, 19 nt, Shigella flexneri 2a str. 301
cgcggaagacccggcggcg

SEQ ID NO: 1999675 - RNA, 15 nt, Shigella flexneri 2a str. 301
cgcgcguucgcagag

SEQ ID NO: 1999676 - RNA, 15 nt, Shigella flexneri 2a str. 301
cgcgcuacggccgcc

SEQ ID NO: 1999677 - RNA, 22 nt, Shigella flexneri 2a str. 301
cgcgcucgaagcgggcgcgcag

SEQ ID NO: 1999678 - RNA, 15 nt, Shigella flexneri 2a str. 301
cgcgcguaugcguca

SEQ ID NO: 1999679 - RNA, 16 nt, Shigella flexneri 2a str. 301
cgcgcgguaucaccac

SEQ ID NO: 1999680 - RNA, 18 nt, Shigella flexneri 2a str. 301
cgcgcgguaucaccaccc

SEQ ID NO: 1999681 - RNA, 18 nt, Shigella flexneri 2a str. 301
cgcgcaguuucuuaccua

SEQ ID NO: 1999682 - RNA, 14 nt, Shigella flexneri 2a str. 301
cgcgccaccgacca

SEQ ID NO: 1999683 - RNA, 13 nt, Shigella flexneri 2a str. 301
cgcgccagcuuag

SEQ ID NO: 1999684 - RNA, 16 nt, Shigella flexneri 2a str. 301
cgcgcacaucaggacg

SEQ ID NO: 1999685 - RNA, 18 nt, Shigella flexneri 2a str. 301
cgcgcaauauccugcgcu

SEQ ID NO: 1999686 - RNA, 15 nt, Shigella flexneri 2a str. 301
cgcgagguuuuccuu

SEQ ID NO: 1999687 - RNA, 14 nt, Shigella flexneri 2a str. 301
cgcgagguaacauc

SEQ ID NO: 1999688 - RNA, 13 nt, Shigella flexneri 2a str. 301
cgcgcgccaccau

SEQ ID NO: 1999689 - RNA, 13 nt, Shigella flexneri 2a str. 301
cgcgcgcagcacg

SEQ ID NO: 1999690 - RNA, 16 nt, Shigella flexneri 2a str. 301
cgcgccgggcagaguc

SEQ ID NO: 1999691 - RNA, 15 nt, Shigella flexneri 2a str. 301
cgcgccgccaacccc

SEQ ID NO: 1999692 - RNA, 19 nt, Shigella flexneri 2a str. 301
cgcgccaucugccgauacg

SEQ ID NO: 1999693 - RNA, 19 nt, Shigella flexneri 2a str. 301
cgccucacuauccgcccca

SEQ ID NO: 1999694 - RNA, 17 nt, Shigella flexneri 2a str. 301
cgccucccuucgcugcu

SEQ ID NO: 1999695 - RNA, 16 nt, Shigella flexneri 2a str. 301
cgccucgccgcugccu

SEQ ID NO: 1999696 - RNA, 14 nt, Shigella flexneri 2a str. 301
cgccuccuguucug

SEQ ID NO: 1999697 - RNA, 18 nt, Shigella flexneri 2a str. 301
cgccucgagaaauuuuua

SEQ ID NO: 1999698 - RNA, 19 nt, Shigella flexneri 2a str. 301
cgccguuuuuuuucuguca

SEQ ID NO: 1999699 - RNA, 15 nt, Shigella flexneri 2a str. 301
cgccuaaauccgcca

SEQ ID NO: 1999700 - RNA, 17 nt, Shigella flexneri 2a str. 301
cgccuacggcauucugc

SEQ ID NO: 1999701 - RNA, 15 nt, Shigella flexneri 2a str. 301
cgccuacggcauucu

SEQ ID NO: 1999702 - RNA, 19 nt, Shigella flexneri 2a str. 301
cgccucaagaaucacuuca

SEQ ID NO: 1999703 - RNA, 15 nt, Shigella flexneri 2a str. 301
cgccguugccgcagc

SEQ ID NO: 1999704 - RNA, 18 nt, Shigella flexneri 2a str. 301
cgccgucaucacgcaggc

SEQ ID NO: 1999705 - RNA, 17 nt, Shigella flexneri 2a str. 301
cgccgguuccagcuuca

SEQ ID NO: 1999706 - RNA, 16 nt, Shigella flexneri 2a str. 301
cgccgguuccagcuuc

SEQ ID NO: 1999707 - RNA, 16 nt, Shigella flexneri 2a str. 301
cgccgccgcuggcgug

SEQ ID NO: 1999708 - RNA, 17 nt, Shigella flexneri 2a str. 301
cgccgccgagcaccacg

SEQ ID NO: 1999709 - RNA, 11 nt, Shigella flexneri 2a str. 301
cgcgaccacca

SEQ ID NO: 1999710 - RNA, 23 nt, Shigella flexneri 2a str. 301
cgcgaccagcgucgcaucaggca

SEQ ID NO: 1999711 - RNA, 18 nt, Shigella flexneri 2a str. 301
cgccuucagguuuuucag

SEQ ID NO: 1999712 - RNA, 17 nt, Shigella flexneri 2a str. 301
cgccuucauucaggcca

SEQ ID NO: 1999713 - RNA, 20 nt, Shigella flexneri 2a str. 301
cgccuuauccggccuaccgu

SEQ ID NO: 1999714 - RNA, 15 nt, Shigella flexneri 2a str. 301
cgccuuauccggccu

SEQ ID NO: 1999715 - RNA, 18 nt, Shigella flexneri 2a str. 301
cgcgaaucuccacgccuu

SEQ ID NO: 1999716 - RNA, 21 nt, Shigella flexneri 2a str. 301
cgcgaacuaaacaacgccgcc

SEQ ID NO: 1999717 - RNA, 19 nt, Shigella flexneri 2a str. 301
cgcgaacggggcugccagc

SEQ ID NO: 1999718 - RNA, 13 nt, Shigella flexneri 2a str. 301
cgcgaacuggaug

SEQ ID NO: 1999719 - RNA, 18 nt, Shigella flexneri 2a str. 301
cgcgaacugucgguuugu

SEQ ID NO: 1999720 - RNA, 21 nt, Shigella flexneri 2a str. 301
cgcgaaccgccuggcgcugcu

SEQ ID NO: 1999721 - RNA, 18 nt, Shigella flexneri 2a str. 301
cgcgaacgugacacgcag

SEQ ID NO: 1999722 - RNA, 17 nt, Shigella flexneri 2a str. 301
cgcgaacuaaacaacgc

SEQ ID NO: 1999723 - RNA, 20 nt, Shigella flexneri 2a str. 301
cgcgaacuaaacaacgccgc

SEQ ID NO: 1999724 - RNA, 13 nt, Shigella flexneri 2a str. 301
cgcgaaccuguga

SEQ ID NO: 1999725 - RNA, 19 nt, Shigella flexneri 2a str. 301
cgccucguaaugcuccggc

SEQ ID NO: 1999726 - RNA, 13 nt, Shigella flexneri 2a str. 301
cgccucggggcca

SEQ ID NO: 1999727 - RNA, 15 nt, Shigella flexneri 2a str. 301
cgccugaucgcgcag

SEQ ID NO: 1999728 - RNA, 23 nt, Shigella flexneri 2a str. 301
cgccucugcaagguucuuugcug

SEQ ID NO: 1999729 - RNA, 17 nt, Shigella flexneri 2a str. 301
cgccucuucauacaucu

SEQ ID NO: 1999730 - RNA, 22 nt, Shigella flexneri 2a str. 301
cgccucuaacagaucauccauc

SEQ ID NO: 1999731 - RNA, 11 nt, Shigella flexneri 2a str. 301
cgccucuucca

SEQ ID NO: 1999732 - RNA, 14 nt, Shigella flexneri 2a str. 301
cgccugcagggcuu

SEQ ID NO: 1999733 - RNA, 14 nt, Shigella flexneri 2a str. 301
cgccugcaucucuu

SEQ ID NO: 1999734 - RNA, 13 nt, Shigella flexneri 2a str. 301
cgccugcaaauaa

SEQ ID NO: 1999735 - RNA, 18 nt, Shigella flexneri 2a str. 301
cgccugcaccauugcugc

SEQ ID NO: 1999736 - RNA, 12 nt, Shigella flexneri 2a str. 301
cgccugggaagu

SEQ ID NO: 1999737 - RNA, 16 nt, Shigella flexneri 2a str. 301
cgccuggaccagcggg

SEQ ID NO: 1999738 - RNA, 21 nt, Shigella flexneri 2a str. 301
uuuuucgcgcguuaucccuua

SEQ ID NO: 1999739 - RNA, 14 nt, Shigella flexneri 2a str. 301
uuuuucgauaauca

SEQ ID NO: 1999740 - RNA, 18 nt, Shigella flexneri 2a str. 301
uuuuucggacgauauuuu

SEQ ID NO: 1999741 - RNA, 14 nt, Shigella flexneri 2a str. 301
uuuuuccgcuuugu

SEQ ID NO: 1999742 - RNA, 23 nt, Shigella flexneri 2a str. 301
uuuuuccacuuccaccagcggcu

SEQ ID NO: 1999743 - RNA, 15 nt, Shigella flexneri 2a str. 301
uuuuuccgcaaaaac

SEQ ID NO: 1999744 - RNA, 16 nt, Shigella flexneri 2a str. 301
uuuuugagcagcauua

SEQ ID NO: 1999745 - RNA, 12 nt, Shigella flexneri 2a str. 301
uuuuucuucagu

SEQ ID NO: 1999746 - RNA, 12 nt, Shigella flexneri 2a str. 301
uuuuugaacaga

SEQ ID NO: 1999747 - RNA, 11 nt, Shigella flexneri 2a str. 301
uuuuugaagcg

SEQ ID NO: 1999748 - RNA, 23 nt, Shigella flexneri 2a str. 301
uuuuugcauaauuuccagcagug

SEQ ID NO: 1999749 - RNA, 15 nt, Shigella flexneri 2a str. 301
uuuuugcauuuccgc

SEQ ID NO: 1999750 - RNA, 22 nt, Shigella flexneri 2a str. 301
uuuuugcaaucagauaaaauac

SEQ ID NO: 1999751 - RNA, 18 nt, Shigella flexneri 2a str. 301
uuuuugccccagaauuuu

SEQ ID NO: 1999752 - RNA, 18 nt, Shigella flexneri 2a str. 301
uuuuugcguccuggcaac

SEQ ID NO: 1999753 - RNA, 20 nt, Shigella flexneri 2a str. 301
uuuuuggaggugaagguaag

SEQ ID NO: 1999754 - RNA, 16 nt, Shigella flexneri 2a str. 301
uuuuugguaaugacuc

SEQ ID NO: 1999755 - RNA, 15 nt, Shigella flexneri 2a str. 301
uuuuugggguuuuaa

SEQ ID NO: 1999756 - RNA, 16 nt, Shigella flexneri 2a str. 301
uuuuuuaaacauuaaa

SEQ ID NO: 1999757 - RNA, 13 nt, Shigella flexneri 2a str. 301
uuugugcauagca

SEQ ID NO: 1999758 - RNA, 16 nt, Shigella flexneri 2a str. 301
uuugugcagcaugcac

SEQ ID NO: 1999759 - RNA, 20 nt, Shigella flexneri 2a str. 301
uuugugccugaauuuugguc

SEQ ID NO: 1999760 - RNA, 20 nt, Shigella flexneri 2a str. 301
uuugucaguucggcaucauc

SEQ ID NO: 1999761 - RNA, 20 nt, Shigella flexneri 2a str. 301
uuugucaugacgacaaggca

SEQ ID NO: 1999762 - RNA, 15 nt, Shigella flexneri 2a str. 301
uuuguccccucauca

SEQ ID NO: 1999763 - RNA, 16 nt, Shigella flexneri 2a str. 301
uuugucgaacagguua

SEQ ID NO: 1999764 - RNA, 17 nt, Shigella flexneri 2a str. 301
uuugucucuucaugccu

SEQ ID NO: 1999765 - RNA, 12 nt, Shigella flexneri 2a str. 301
uuugucuucaau

SEQ ID NO: 1999766 - RNA, 20 nt, Shigella flexneri 2a str. 301
uuugucgccaacuucaugac

SEQ ID NO: 1999767 - RNA, 19 nt, Shigella flexneri 2a str. 301
uuugucgugggcaggaaaa

SEQ ID NO: 1999768 - RNA, 21 nt, Shigella flexneri 2a str. 301
uuugucguugcuaacaaugga

SEQ ID NO: 1999769 - RNA, 14 nt, Shigella flexneri 2a str. 301
uuuguuucugaauc

SEQ ID NO: 1999770 - RNA, 19 nt, Shigella flexneri 2a str. 301
uuuguuggcgaaaaucuuu

SEQ ID NO: 1999771 - RNA, 14 nt, Shigella flexneri 2a str. 301
uuuguugauuuccc

SEQ ID NO: 1999772 - RNA, 20 nt, Shigella flexneri 2a str. 301
uuuguuguucugucagccca

SEQ ID NO: 1999773 - RNA, 19 nt, Shigella flexneri 2a str. 301
uuuguuagcgaauaaagua

SEQ ID NO: 1999774 - RNA, 20 nt, Shigella flexneri 2a str. 301
uuuguuauccaccgaaauaa

SEQ ID NO: 1999775 - RNA, 16 nt, Shigella flexneri 2a str. 301
uuuguuacgauagaau

SEQ ID NO: 1999776 - RNA, 23 nt, Shigella flexneri 2a str. 301
uuuguuauuacugcguauuuccu

SEQ ID NO: 1999777 - RNA, 14 nt, Shigella flexneri 2a str. 301
uuuuaaauauaaaa

SEQ ID NO: 1999778 - RNA, 17 nt, Shigella flexneri 2a str. 301
uuuuaaacgaauaguuu

SEQ ID NO: 1999779 - RNA, 11 nt, Shigella flexneri 2a str. 301
uuuuaacuuac

SEQ ID NO: 1999780 - RNA, 23 nt, Shigella flexneri 2a str. 301
uuuuaagauccaguugaccugcg

SEQ ID NO: 1999781 - RNA, 20 nt, Shigella flexneri 2a str. 301
uuuuaagauccaguugaccu

SEQ ID NO: 1999782 - RNA, 16 nt, Shigella flexneri 2a str. 301
uuuuaagcagccaucu

SEQ ID NO: 1999783 - RNA, 16 nt, Shigella flexneri 2a str. 301
uuuggugagaacacca

SEQ ID NO: 1999784 - RNA, 17 nt, Shigella flexneri 2a str. 301
uuuggugagaacaccaa

SEQ ID NO: 1999785 - RNA, 18 nt, Shigella flexneri 2a str. 301
uuuggcuggaguggugaa

SEQ ID NO: 1999786 - RNA, 20 nt, Shigella flexneri 2a str. 301
uuuggcugagugaaucagaa

SEQ ID NO: 1999787 - RNA, 17 nt, Shigella flexneri 2a str. 301
uuuggcugucaguucac

SEQ ID NO: 1999788 - RNA, 11 nt, Shigella flexneri 2a str. 301
uuuggcucuuc

SEQ ID NO: 1999789 - RNA, 11 nt, Shigella flexneri 2a str. 301
uuuggcugccg

SEQ ID NO: 1999790 - RNA, 14 nt, Shigella flexneri 2a str. 301
uuuggcugccgcca

SEQ ID NO: 1999791 - RNA, 22 nt, Shigella flexneri 2a str. 301
uuuggcgaauuguucugcgcca

SEQ ID NO: 1999792 - RNA, 19 nt, Shigella flexneri 2a str. 301
uuuguagauugcacuugcu

SEQ ID NO: 1999793 - RNA, 13 nt, Shigella flexneri 2a str. 301
uuugucaaaaauc

SEQ ID NO: 1999794 - RNA, 16 nt, Shigella flexneri 2a str. 301
uuuguauuuauuuuca

SEQ ID NO: 1999795 - RNA, 20 nt, Shigella flexneri 2a str. 301
uuugcucgcgacguaauuua

SEQ ID NO: 1999796 - RNA, 15 nt, Shigella flexneri 2a str. 301
uuugcugauucuccc

SEQ ID NO: 1999797 - RNA, 13 nt, Shigella flexneri 2a str. 301
uuugcugaugcag

SEQ ID NO: 1999798 - RNA, 16 nt, Shigella flexneri 2a str. 301
uuugcugauauuuauc

SEQ ID NO: 1999799 - RNA, 22 nt, Shigella flexneri 2a str. 301
uuugcguagucugaccucuucu

SEQ ID NO: 1999800 - RNA, 21 nt, Shigella flexneri 2a str. 301
uuugcguccgguaauuuuuau

SEQ ID NO: 1999801 - RNA, 14 nt, Shigella flexneri 2a str. 301
uuugcguguuucag

SEQ ID NO: 1999802 - RNA, 22 nt, Shigella flexneri 2a str. 301
uuugcguccgguaauuuuuaua

SEQ ID NO: 1999803 - RNA, 20 nt, Shigella flexneri 2a str. 301
uuugcguuccaucagauuca

SEQ ID NO: 1999804 - RNA, 20 nt, Shigella flexneri 2a str. 301
uuugcguugcacgcagacac

SEQ ID NO: 1999805 - RNA, 20 nt, Shigella flexneri 2a str. 301
uuugcgcuuuuggcaggaac

SEQ ID NO: 1999806 - RNA, 21 nt, Shigella flexneri 2a str. 301
uuugcggaucaacuuuguucu

SEQ ID NO: 1999807 - RNA, 22 nt, Shigella flexneri 2a str. 301
uuugcuugccgguuauuuugcu

SEQ ID NO: 1999808 - RNA, 19 nt, Shigella flexneri 2a str. 301
uuugcuugccggaagcaaa

SEQ ID NO: 1999809 - RNA, 13 nt, Shigella flexneri 2a str. 301
uuugcuuccugag

SEQ ID NO: 1999810 - RNA, 15 nt, Shigella flexneri 2a str. 301
uuugcuguugccgcc

SEQ ID NO: 1999811 - RNA, 17 nt, Shigella flexneri 2a str. 301
uuuggcaaaugcaucag

SEQ ID NO: 1999812 - RNA, 21 nt, Shigella flexneri 2a str. 301
uuuggcaaaugcaucagugac

SEQ ID NO: 1999813 - RNA, 21 nt, Shigella flexneri 2a str. 301
uuuggcaaacuacaaauccaa

SEQ ID NO: 1999814 - RNA, 20 nt, Shigella flexneri 2a str. 301
uuuggcagacaaccauauuu

SEQ ID NO: 1999815 - RNA, 16 nt, Shigella flexneri 2a str. 301
uuuggcaaacuacaaa

SEQ ID NO: 1999816 - RNA, 18 nt, Shigella flexneri 2a str. 301
uuuggcaaacuacaaauc

SEQ ID NO: 1999817 - RNA, 17 nt, Shigella flexneri 2a str. 301
uuuuccagcugugccag

SEQ ID NO: 1999818 - RNA, 16 nt, Shigella flexneri 2a str. 301
uuuuccagcugugcca

SEQ ID NO: 1999819 - RNA, 12 nt, Shigella flexneri 2a str. 301
uuuucacauguu

SEQ ID NO: 1999820 - RNA, 13 nt, Shigella flexneri 2a str. 301
uuuucaauucucu

SEQ ID NO: 1999821 - RNA, 22 nt, Shigella flexneri 2a str. 301
uuuucaauucacgaauauuucc

SEQ ID NO: 1999822 - RNA, 23 nt, Shigella flexneri 2a str. 301
uuuucaauucacgaauauuuccc

SEQ ID NO: 1999823 - RNA, 16 nt, Shigella flexneri 2a str. 301
uuuucaaccuaaagua

SEQ ID NO: 1999824 - RNA, 21 nt, Shigella flexneri 2a str. 301
uuuucaagcucaaaauaauac

SEQ ID NO: 1999825 - RNA, 20 nt, Shigella flexneri 2a str. 301
uuuuauuucaguaauauaua

SEQ ID NO: 1999826 - RNA, 19 nt, Shigella flexneri 2a str. 301
uuuuauugcuucaccagca

SEQ ID NO: 1999827 - RNA, 21 nt, Shigella flexneri 2a str. 301
uuuuauuauucgcuaaucaau

SEQ ID NO: 1999828 - RNA, 23 nt, Shigella flexneri 2a str. 301
uuuuauggaucuuugacugaaau

SEQ ID NO: 1999829 - RNA, 18 nt, Shigella flexneri 2a str. 301
uuuucccugguaaaaaau

SEQ ID NO: 1999830 - RNA, 20 nt, Shigella flexneri 2a str. 301
uuuucccaacgugaccagua

SEQ ID NO: 1999831 - RNA, 18 nt, Shigella flexneri 2a str. 301
uuuucuauuuugcauuau

SEQ ID NO: 1999832 - RNA, 22 nt, Shigella flexneri 2a str. 301
uuuucgucguacccggcgacuu

SEQ ID NO: 1999833 - RNA, 19 nt, Shigella flexneri 2a str. 301
uuuucguuuggggcauauu

SEQ ID NO: 1999834 - RNA, 16 nt, Shigella flexneri 2a str. 301
uuuugaacagaccaca

SEQ ID NO: 1999835 - RNA, 23 nt, Shigella flexneri 2a str. 301
uuuugaagguucgggucagaguu

SEQ ID NO: 1999836 - RNA, 14 nt, Shigella flexneri 2a str. 301
uuuugauagugcgu

SEQ ID NO: 1999837 - RNA, 21 nt, Shigella flexneri 2a str. 301
uuuucuucagccccuccacau

SEQ ID NO: 1999838 - RNA, 17 nt, Shigella flexneri 2a str. 301
uuuucuguagauaaaac

SEQ ID NO: 1999839 - RNA, 24 nt, Shigella flexneri 2a str. 301
uuuucugucacaccuuauuuacau

SEQ ID NO: 1999840 - RNA, 22 nt, Shigella flexneri 2a str. 301
uuuuacguugcauuuccauaaa

SEQ ID NO: 1999841 - RNA, 15 nt, Shigella flexneri 2a str. 301
uuuuacguuuuaauc

SEQ ID NO: 1999842 - RNA, 20 nt, Shigella flexneri 2a str. 301
uuuuacccagcagcagcggu

SEQ ID NO: 1999843 - RNA, 16 nt, Shigella flexneri 2a str. 301
uuuuacccaugacuuu

SEQ ID NO: 1999844 - RNA, 16 nt, Shigella flexneri 2a str. 301
uuuuacauguucaaaa

SEQ ID NO: 1999845 - RNA, 20 nt, Shigella flexneri 2a str. 301
uuuuacauuauccagcgacu

SEQ ID NO: 1999846 - RNA, 21 nt, Shigella flexneri 2a str. 301
uuuuaaucaucugauaucuca

SEQ ID NO: 1999847 - RNA, 22 nt, Shigella flexneri 2a str. 301
uuuuaauagagauagccugauc

SEQ ID NO: 1999848 - RNA, 13 nt, Shigella flexneri 2a str. 301
uuuuaucccuucu

SEQ ID NO: 1999849 - RNA, 20 nt, Shigella flexneri 2a str. 301
uuuuaucggagaacaggaau

SEQ ID NO: 1999850 - RNA, 15 nt, Shigella flexneri 2a str. 301
uuuuaucugugaacu

SEQ ID NO: 1999851 - RNA, 12 nt, Shigella flexneri 2a str. 301
uuuuaugcguuc

SEQ ID NO: 1999852 - RNA, 23 nt, Shigella flexneri 2a str. 301
uuuuaguucacauagacccugcu

SEQ ID NO: 1999853 - RNA, 22 nt, Shigella flexneri 2a str. 301
uuuuagcuggugacaaaguaca

SEQ ID NO: 1999854 - RNA, 23 nt, Shigella flexneri 2a str. 301
uuuuauacaagggaaauaagaaa

SEQ ID NO: 1999855 - RNA, 21 nt, Shigella flexneri 2a str. 301
uugaacaaccagaaagaugca

SEQ ID NO: 1999856 - RNA, 22 nt, Shigella flexneri 2a str. 301
uugaagauguugccacacgccc

SEQ ID NO: 1999857 - RNA, 22 nt, Shigella flexneri 2a str. 301
uugaagcgcggaacaaauacuu

SEQ ID NO: 1999858 - RNA, 23 nt, Shigella flexneri 2a str. 301
uugaaggguauugccgaugaacg

SEQ ID NO: 1999859 - RNA, 16 nt, Shigella flexneri 2a str. 301
uugaaggcagcauucg

SEQ ID NO: 1999860 - RNA, 17 nt, Shigella flexneri 2a str. 301
uugaagucuuuuuucaa

SEQ ID NO: 1999861 - RNA, 20 nt, Shigella flexneri 2a str. 301
uugaagucuuuuuucaacuu

SEQ ID NO: 1999862 - RNA, 21 nt, Shigella flexneri 2a str. 301
uugaauaaauuggcuggggua

SEQ ID NO: 1999863 - RNA, 15 nt, Shigella flexneri 2a str. 301
uugaauaucuccucu

SEQ ID NO: 1999864 - RNA, 13 nt, Shigella flexneri 2a str. 301
uugacauguugcu

SEQ ID NO: 1999865 - RNA, 14 nt, Shigella flexneri 2a str. 301
uucuuucaccucuu

SEQ ID NO: 1999866 - RNA, 18 nt, Shigella flexneri 2a str. 301
uucuuucgcccaauaaaa

SEQ ID NO: 1999867 - RNA, 22 nt, Shigella flexneri 2a str. 301
uucuuuacugcccgcuugcgcc

SEQ ID NO: 1999868 - RNA, 21 nt, Shigella flexneri 2a str. 301
uucuuuauugauuaaaggaag

SEQ ID NO: 1999869 - RNA, 16 nt, Shigella flexneri 2a str. 301
uucuucuucugacuca

SEQ ID NO: 1999870 - RNA, 15 nt, Shigella flexneri 2a str. 301
uucuucuucagcgcu

SEQ ID NO: 1999871 - RNA, 18 nt, Shigella flexneri 2a str. 301
uucuuucucgcucaguuu

SEQ ID NO: 1999872 - RNA, 17 nt, Shigella flexneri 2a str. 301
uucuuucucgccuuucu

SEQ ID NO: 1999873 - RNA, 18 nt, Shigella flexneri 2a str. 301
uucuuuucgagcagguca

SEQ ID NO: 1999874 - RNA, 14 nt, Shigella flexneri 2a str. 301
uugaaaaaucaaaa

SEQ ID NO: 1999875 - RNA, 20 nt, Shigella flexneri 2a str. 301
uugaaaaauaaagucuuagc

SEQ ID NO: 1999876 - RNA, 23 nt, Shigella flexneri 2a str. 301
uugaaaaaucaaaaaacuggaaa

SEQ ID NO: 1999877 - RNA, 11 nt, Shigella flexneri 2a str. 301
uucuuuuucaa

SEQ ID NO: 1999878 - RNA, 19 nt, Shigella flexneri 2a str. 301
uucuuuugcgguuaauggu

SEQ ID NO: 1999879 - RNA, 16 nt, Shigella flexneri 2a str. 301
uugaaauauauccuau

SEQ ID NO: 1999880 - RNA, 16 nt, Shigella flexneri 2a str. 301
uugaccgccagcgcca

SEQ ID NO: 1999881 - RNA, 14 nt, Shigella flexneri 2a str. 301
uugacucucaucca

SEQ ID NO: 1999882 - RNA, 23 nt, Shigella flexneri 2a str. 301
uugacucgccuucaggaauacgc

SEQ ID NO: 1999883 - RNA, 13 nt, Shigella flexneri 2a str. 301
uugacugaaauuu

SEQ ID NO: 1999884 - RNA, 13 nt, Shigella flexneri 2a str. 301
uugauagaacaaa

SEQ ID NO: 1999885 - RNA, 14 nt, Shigella flexneri 2a str. 301
uugaggaucacaaa

SEQ ID NO: 1999886 - RNA, 17 nt, Shigella flexneri 2a str. 301
uugaggaguuuaauaaa

SEQ ID NO: 1999887 - RNA, 18 nt, Shigella flexneri 2a str. 301
uugaggaacucaaaccau

SEQ ID NO: 1999888 - RNA, 20 nt, Shigella flexneri 2a str. 301
uugcaccauccauuuuucac

SEQ ID NO: 1999889 - RNA, 17 nt, Shigella flexneri 2a str. 301
uugcaccgaggccaaaa

SEQ ID NO: 1999890 - RNA, 21 nt, Shigella flexneri 2a str. 301
uugcaccagcaacaagccagu

SEQ ID NO: 1999891 - RNA, 20 nt, Shigella flexneri 2a str. 301
uugcacgaaggugcauugcu

SEQ ID NO: 1999892 - RNA, 19 nt, Shigella flexneri 2a str. 301
uugcaccuuuuagcggaac

SEQ ID NO: 1999893 - RNA, 16 nt, Shigella flexneri 2a str. 301
uugcaccucugcugcu

SEQ ID NO: 1999894 - RNA, 14 nt, Shigella flexneri 2a str. 301
uugcaccugaucca

SEQ ID NO: 1999895 - RNA, 24 nt, Shigella flexneri 2a str. 301
uugcaacgaacgcauccgcuggcc

SEQ ID NO: 1999896 - RNA, 13 nt, Shigella flexneri 2a str. 301
uugcaacgcccau

SEQ ID NO: 1999897 - RNA, 16 nt, Shigella flexneri 2a str. 301
uugcacacuuuccaua

SEQ ID NO: 1999898 - RNA, 14 nt, Shigella flexneri 2a str. 301
uugcaaaaucaaau

SEQ ID NO: 1999899 - RNA, 17 nt, Shigella flexneri 2a str. 301
uugauuacacaaaucca

SEQ ID NO: 1999900 - RNA, 19 nt, Shigella flexneri 2a str. 301
uugauuacacaaauccagc

SEQ ID NO: 1999901 - RNA, 20 nt, Shigella flexneri 2a str. 301
uugauucaucucuucuuccg

SEQ ID NO: 1999902 - RNA, 22 nt, Shigella flexneri 2a str. 301
uugauuaccaauaucaaauaaa

SEQ ID NO: 1999903 - RNA, 17 nt, Shigella flexneri 2a str. 301
uugauguccaguuccca

SEQ ID NO: 1999904 - RNA, 21 nt, Shigella flexneri 2a str. 301
uugaucccggcuccaaugacu

SEQ ID NO: 1999905 - RNA, 22 nt, Shigella flexneri 2a str. 301
uugaugcgaguaaucaggcuau

SEQ ID NO: 1999906 - RNA, 13 nt, Shigella flexneri 2a str. 301
uugaucaccagug

SEQ ID NO: 1999907 - RNA, 22 nt, Shigella flexneri 2a str. 301
uugaucacccacaucagcggca

SEQ ID NO: 1999908 - RNA, 19 nt, Shigella flexneri 2a str. 301
uucuucuccggcauccuua

SEQ ID NO: 1999909 - RNA, 23 nt, Shigella flexneri 2a str. 301
uucuucgguucguaagcaagaac

SEQ ID NO: 1999910 - RNA, 17 nt, Shigella flexneri 2a str. 301
uucuucggucagagaau

SEQ ID NO: 1999911 - RNA, 20 nt, Shigella flexneri 2a str. 301
uucuucggucagagaaucga

SEQ ID NO: 1999912 - RNA, 21 nt, Shigella flexneri 2a str. 301
uucuucguuaaacagcuugga

SEQ ID NO: 1999913 - RNA, 22 nt, Shigella flexneri 2a str. 301
uucuucgucgucuucgucccag

SEQ ID NO: 1999914 - RNA, 20 nt, Shigella flexneri 2a str. 301
uucuucgcuuucgaacaacu

SEQ ID NO: 1999915 - RNA, 22 nt, Shigella flexneri 2a str. 301
uucuucgauguguugcaaauaa

SEQ ID NO: 1999916 - RNA, 19 nt, Shigella flexneri 2a str. 301
uucuguuuucguaauaauu

SEQ ID NO: 1999917 - RNA, 12 nt, Shigella flexneri 2a str. 301
uucugugcgcca

SEQ ID NO: 1999918 - RNA, 22 nt, Shigella flexneri 2a str. 301
uucugccuguccaccacgcugc

SEQ ID NO: 1999919 - RNA, 15 nt, Shigella flexneri 2a str. 301
uucuguagauaaaac

SEQ ID NO: 1999920 - RNA, 22 nt, Shigella flexneri 2a str. 301
uucuguagauaaaacacucuuu

SEQ ID NO: 1999921 - RNA, 19 nt, Shigella flexneri 2a str. 301
uucugcucgcgguuaaguu

SEQ ID NO: 1999922 - RNA, 18 nt, Shigella flexneri 2a str. 301
uucugccgcuuccagcag

SEQ ID NO: 1999923 - RNA, 19 nt, Shigella flexneri 2a str. 301
uucugccgcgcacgucagc

SEQ ID NO: 1999924 - RNA, 22 nt, Shigella flexneri 2a str. 301
uucugcccauuuaacguuaucu

SEQ ID NO: 1999925 - RNA, 23 nt, Shigella flexneri 2a str. 301
uucugcaauauauugaauuugga

SEQ ID NO: 1999926 - RNA, 14 nt, Shigella flexneri 2a str. 301
uucucuucugcuuu

SEQ ID NO: 1999927 - RNA, 15 nt, Shigella flexneri 2a str. 301
uucucugagaauaaa

SEQ ID NO: 1999928 - RNA, 17 nt, Shigella flexneri 2a str. 301
uucucugacgcucucua

SEQ ID NO: 1999929 - RNA, 20 nt, Shigella flexneri 2a str. 301
uucugauuuaaucuguauca

SEQ ID NO: 1999930 - RNA, 16 nt, Shigella flexneri 2a str. 301
uucucuuuccagcaac

SEQ ID NO: 1999931 - RNA, 11 nt, Shigella flexneri 2a str. 301
uucuccagcuu

SEQ ID NO: 1999932 - RNA, 16 nt, Shigella flexneri 2a str. 301
uucucaaucugcuugc

SEQ ID NO: 1999933 - RNA, 21 nt, Shigella flexneri 2a str. 301
uucucaaugcgucaguucaga

SEQ ID NO: 1999934 - RNA, 22 nt, Shigella flexneri 2a str. 301
uucucaccuauguggaaacagu

SEQ ID NO: 1999935 - RNA, 15 nt, Shigella flexneri 2a str. 301
uucucaccuugcucu

SEQ ID NO: 1999936 - RNA, 14 nt, Shigella flexneri 2a str. 301
uucucuauuucacc

SEQ ID NO: 1999937 - RNA, 15 nt, Shigella flexneri 2a str. 301
uucuccccccucuga

SEQ ID NO: 1999938 - RNA, 16 nt, Shigella flexneri 2a str. 301
uucucccuuaaaaaau

SEQ ID NO: 1999939 - RNA, 22 nt, Shigella flexneri 2a str. 301
uucgguauuaaucugccagcgu

SEQ ID NO: 1999940 - RNA, 20 nt, Shigella flexneri 2a str. 301
uucgguaaugacuccaacuu

SEQ ID NO: 1999941 - RNA, 21 nt, Shigella flexneri 2a str. 301
uucggguuauugguuaacaag

SEQ ID NO: 1999942 - RNA, 21 nt, Shigella flexneri 2a str. 301
uucgggauauggcgagaagag

SEQ ID NO: 1999943 - RNA, 16 nt, Shigella flexneri 2a str. 301
uucggcgggguuuuuu

SEQ ID NO: 1999944 - RNA, 14 nt, Shigella flexneri 2a str. 301
uuaucaggccuaca

SEQ ID NO: 1999945 - RNA, 18 nt, Shigella flexneri 2a str. 301
uuaucaggccuacaaaau

SEQ ID NO: 1999946 - RNA, 22 nt, Shigella flexneri 2a str. 301
uuaucagacaccgauugccccu

SEQ ID NO: 1999947 - RNA, 13 nt, Shigella flexneri 2a str. 301
uuaucagaucacg

SEQ ID NO: 1999948 - RNA, 17 nt, Shigella flexneri 2a str. 301
uucguuuuaaugcgauc

SEQ ID NO: 1999949 - RNA, 19 nt, Shigella flexneri 2a str. 301
uucguuuggggguaaccca

SEQ ID NO: 1999950 - RNA, 15 nt, Shigella flexneri 2a str. 301
uucguugaagucagg

SEQ ID NO: 1999951 - RNA, 22 nt, Shigella flexneri 2a str. 301
uucggugauauacgucacuuca

SEQ ID NO: 1999952 - RNA, 12 nt, Shigella flexneri 2a str. 301
uucguauuuaaa

SEQ ID NO: 1999953 - RNA, 22 nt, Shigella flexneri 2a str. 301
uucucaacacauuacugcuugc

SEQ ID NO: 1999954 - RNA, 18 nt, Shigella flexneri 2a str. 301
uucuacgugcgcuaugug

SEQ ID NO: 1999955 - RNA, 16 nt, Shigella flexneri 2a str. 301
uucuacacccagcccc

SEQ ID NO: 1999956 - RNA, 22 nt, Shigella flexneri 2a str. 301
uucuaccagguuucgcaauaac

SEQ ID NO: 1999957 - RNA, 15 nt, Shigella flexneri 2a str. 301
uuguuacgguguuca

SEQ ID NO: 1999958 - RNA, 13 nt, Shigella flexneri 2a str. 301
uugugcuucaguu

SEQ ID NO: 1999959 - RNA, 20 nt, Shigella flexneri 2a str. 301
uuguuaaauauuaaggguaa

SEQ ID NO: 1999960 - RNA, 20 nt, Shigella flexneri 2a str. 301
uugugcacgauugccggaug

SEQ ID NO: 1999961 - RNA, 20 nt, Shigella flexneri 2a str. 301
uugugcaaauucaauaaauu

SEQ ID NO: 1999962 - RNA, 16 nt, Shigella flexneri 2a str. 301
uugugcagcaugcacc

SEQ ID NO: 1999963 - RNA, 14 nt, Shigella flexneri 2a str. 301
uugugccagaccaa

SEQ ID NO: 1999964 - RNA, 18 nt, Shigella flexneri 2a str. 301
uugugccacgcuggcccg

SEQ ID NO: 1999965 - RNA, 13 nt, Shigella flexneri 2a str. 301
uugugccaguuca

SEQ ID NO: 1999966 - RNA, 18 nt, Shigella flexneri 2a str. 301
uugucuccaccaaugacg

SEQ ID NO: 1999967 - RNA, 16 nt, Shigella flexneri 2a str. 301
uugucucuucaugccu

SEQ ID NO: 1999968 - RNA, 21 nt, Shigella flexneri 2a str. 301
uugucgugggcaggaaaauca

SEQ ID NO: 1999969 - RNA, 14 nt, Shigella flexneri 2a str. 301
uugucgggcaggcu

SEQ ID NO: 1999970 - RNA, 18 nt, Shigella flexneri 2a str. 301
uugucagcccuuuuucac

SEQ ID NO: 1999971 - RNA, 21 nt, Shigella flexneri 2a str. 301
uugucagcaaucugauugaca

SEQ ID NO: 1999972 - RNA, 16 nt, Shigella flexneri 2a str. 301
uugucauaaccaaugu

SEQ ID NO: 1999973 - RNA, 14 nt, Shigella flexneri 2a str. 301
uugucauuggcagc

SEQ ID NO: 1999974 - RNA, 20 nt, Shigella flexneri 2a str. 301
uugucaugcgcucucccaug

SEQ ID NO: 1999975 - RNA, 13 nt, Shigella flexneri 2a str. 301
uugucaugcagcu

SEQ ID NO: 1999976 - RNA, 16 nt, Shigella flexneri 2a str. 301
uuguccauaaaaugca

SEQ ID NO: 1999977 - RNA, 14 nt, Shigella flexneri 2a str. 301
uuguccaguugccc

SEQ ID NO: 1999978 - RNA, 13 nt, Shigella flexneri 2a str. 301
uuguacaaaaaau

SEQ ID NO: 1999979 - RNA, 14 nt, Shigella flexneri 2a str. 301
uuguacaaaccaua

SEQ ID NO: 1999980 - RNA, 16 nt, Shigella flexneri 2a str. 301
uuguacuccagcagac

SEQ ID NO: 1999981 - RNA, 16 nt, Shigella flexneri 2a str. 301
uuguacuuuccagcca

SEQ ID NO: 1999982 - RNA, 16 nt, Shigella flexneri 2a str. 301
uuguauaacgugguga

SEQ ID NO: 1999983 - RNA, 14 nt, Shigella flexneri 2a str. 301
uugguuaacugaau

SEQ ID NO: 1999984 - RNA, 16 nt, Shigella flexneri 2a str. 301
uuguaagucagaaagc

SEQ ID NO: 1999985 - RNA, 12 nt, Shigella flexneri 2a str. 301
uuuaauuccugc

SEQ ID NO: 1999986 - RNA, 13 nt, Shigella flexneri 2a str. 301
uuuaauugccauu

SEQ ID NO: 1999987 - RNA, 12 nt, Shigella flexneri 2a str. 301
uuuaauucagga

SEQ ID NO: 1999988 - RNA, 17 nt, Shigella flexneri 2a str. 301
uuuaauuauccccucaa

SEQ ID NO: 1999989 - RNA, 20 nt, Shigella flexneri 2a str. 301
uuuaacgaagccguugcuga

SEQ ID NO: 1999990 - RNA, 20 nt, Shigella flexneri 2a str. 301
uuuaaaaccacuacccauau

SEQ ID NO: 1999991 - RNA, 21 nt, Shigella flexneri 2a str. 301
uuuaaaucaaacggugguugu

SEQ ID NO: 1999992 - RNA, 19 nt, Shigella flexneri 2a str. 301
uuuaaauaccuuacacuca

SEQ ID NO: 1999993 - RNA, 17 nt, Shigella flexneri 2a str. 301
uuuaacaauuuaucaga

SEQ ID NO: 1999994 - RNA, 17 nt, Shigella flexneri 2a str. 301
uuguugucuauuuccac

SEQ ID NO: 1999995 - RNA, 21 nt, Shigella flexneri 2a str. 301
uuguuggcgaaaaucuuugca

SEQ ID NO: 1999996 - RNA, 18 nt, Shigella flexneri 2a str. 301
uuguuggcgaaaaucuuu

SEQ ID NO: 1999997 - RNA, 13 nt, Shigella flexneri 2a str. 301
uuguucugaauca

SEQ ID NO: 1999998 - RNA, 17 nt, Shigella flexneri 2a str. 301
uuguuuuuucaaccuaa

SEQ ID NO: 1999999 - RNA, 23 nt, Shigella flexneri 2a str. 301
uugcuuaaauacgccucuucaua

SEQ ID NO: 2000000 - RNA, 14 nt, Shigella flexneri 2a str. 301
uugcuguuguucaa

SEQ ID NO: 2000001 - RNA, 14 nt, Shigella flexneri 2a str. 301
uugcuguugguuca

SEQ ID NO: 2000002 - RNA, 15 nt, Shigella flexneri 2a str. 301
uugcugaaauacaga

SEQ ID NO: 2000003 - RNA, 23 nt, Shigella flexneri 2a str. 301
uugcugagaucaaacucuuucaa

SEQ ID NO: 2000004 - RNA, 12 nt, Shigella flexneri 2a str. 301
uugcuccagaaa

SEQ ID NO: 2000005 - RNA, 16 nt, Shigella flexneri 2a str. 301
uugcucauccauugcu

SEQ ID NO: 2000006 - RNA, 14 nt, Shigella flexneri 2a str. 301
uugcugaacucgac

SEQ ID NO: 2000007 - RNA, 14 nt, Shigella flexneri 2a str. 301
uugcugcaccaggc

SEQ ID NO: 2000008 - RNA, 22 nt, Shigella flexneri 2a str. 301
uugcugccgccaguucuuccag

SEQ ID NO: 2000009 - RNA, 19 nt, Shigella flexneri 2a str. 301
uugcugccguuuucaaagg

SEQ ID NO: 2000010 - RNA, 13 nt, Shigella flexneri 2a str. 301
uugcugccuucac

SEQ ID NO: 2000011 - RNA, 20 nt, Shigella flexneri 2a str. 301
uugcugccgccaguucuucc

SEQ ID NO: 2000012 - RNA, 17 nt, Shigella flexneri 2a str. 301
uugcuuuugauguuuga

SEQ ID NO: 2000013 - RNA, 14 nt, Shigella flexneri 2a str. 301
uuggcagacaacca

SEQ ID NO: 2000014 - RNA, 13 nt, Shigella flexneri 2a str. 301
uuggcagaaacag

SEQ ID NO: 2000015 - RNA, 23 nt, Shigella flexneri 2a str. 301
uuggcagagcaacauacagugga

SEQ ID NO: 2000016 - RNA, 19 nt, Shigella flexneri 2a str. 301
uuggcaucgauaucaacca

SEQ ID NO: 2000017 - RNA, 21 nt, Shigella flexneri 2a str. 301
uuggcaucguauuucagaccu

SEQ ID NO: 2000018 - RNA, 23 nt, Shigella flexneri 2a str. 301
uuggcgcgaaccaucaccucuuc

SEQ ID NO: 2000019 - RNA, 16 nt, Shigella flexneri 2a str. 301
uuggcgcaauagcacu

SEQ ID NO: 2000020 - RNA, 16 nt, Shigella flexneri 2a str. 301
uuggcgauaccccaac

SEQ ID NO: 2000021 - RNA, 15 nt, Shigella flexneri 2a str. 301
uuggcguaccauuaa

SEQ ID NO: 2000022 - RNA, 13 nt, Shigella flexneri 2a str. 301
uuggggagacuaa

SEQ ID NO: 2000023 - RNA, 13 nt, Shigella flexneri 2a str. 301
uugguaaugacuc

SEQ ID NO: 2000024 - RNA, 17 nt, Shigella flexneri 2a str. 301
uugggcauuugcacaau

SEQ ID NO: 2000025 - RNA, 15 nt, Shigella flexneri 2a str. 301
uugguauucugggaa

SEQ ID NO: 2000026 - RNA, 16 nt, Shigella flexneri 2a str. 301
uugccaaauguugucu

SEQ ID NO: 2000027 - RNA, 16 nt, Shigella flexneri 2a str. 301
uugcccgcaaagauga

SEQ ID NO: 2000028 - RNA, 17 nt, Shigella flexneri 2a str. 301
uugccccucuaacucuu

SEQ ID NO: 2000029 - RNA, 16 nt, Shigella flexneri 2a str. 301
uugccacccaacgcca

SEQ ID NO: 2000030 - RNA, 11 nt, Shigella flexneri 2a str. 301
uugccacccug

SEQ ID NO: 2000031 - RNA, 21 nt, Shigella flexneri 2a str. 301
uugcccccugaagcaguuuca

SEQ ID NO: 2000032 - RNA, 18 nt, Shigella flexneri 2a str. 301
uugccgcagcaguugcca

SEQ ID NO: 2000033 - RNA, 15 nt, Shigella flexneri 2a str. 301
uugccgcacuuaaua

SEQ ID NO: 2000034 - RNA, 20 nt, Shigella flexneri 2a str. 301
uugcccuuuucaccaugggc

SEQ ID NO: 2000035 - RNA, 16 nt, Shigella flexneri 2a str. 301
uugcccucacccugua

SEQ ID NO: 2000036 - RNA, 21 nt, Shigella flexneri 2a str. 301
uugcccucugaauaacaccca

SEQ ID NO: 2000037 - RNA, 20 nt, Shigella flexneri 2a str. 301
uugcccgcgcguuaacuccc

SEQ ID NO: 2000038 - RNA, 16 nt, Shigella flexneri 2a str. 301
uugcaucgucuguuuu

SEQ ID NO: 2000039 - RNA, 16 nt, Shigella flexneri 2a str. 301
uugcaucccagaaaaa

SEQ ID NO: 2000040 - RNA, 17 nt, Shigella flexneri 2a str. 301
uugcauccggcauggca

SEQ ID NO: 2000041 - RNA, 21 nt, Shigella flexneri 2a str. 301
uugcauuccaguccacaucaa

SEQ ID NO: 2000042 - RNA, 17 nt, Shigella flexneri 2a str. 301
uugcauuuccauaaauu

SEQ ID NO: 2000043 - RNA, 22 nt, Shigella flexneri 2a str. 301
uugcagacccguuaagcguuca

SEQ ID NO: 2000044 - RNA, 16 nt, Shigella flexneri 2a str. 301
uugcagaucgccaaua

SEQ ID NO: 2000045 - RNA, 16 nt, Shigella flexneri 2a str. 301
uugcucauaaaaugau

SEQ ID NO: 2000046 - RNA, 23 nt, Shigella flexneri 2a str. 301
uugcucaggaguaaacuuucccu

SEQ ID NO: 2000047 - RNA, 19 nt, Shigella flexneri 2a str. 301
uugcucagaaucacgccaa

SEQ ID NO: 2000048 - RNA, 21 nt, Shigella flexneri 2a str. 301
uugcuauuuccaccucccccu

SEQ ID NO: 2000049 - RNA, 24 nt, Shigella flexneri 2a str. 301
uugcgcggauggccucugccagcu

SEQ ID NO: 2000050 - RNA, 16 nt, Shigella flexneri 2a str. 301
uugcguccauuuugag

SEQ ID NO: 2000051 - RNA, 16 nt, Shigella flexneri 2a str. 301
uugcgucagcuucaga

SEQ ID NO: 2000052 - RNA, 12 nt, Shigella flexneri 2a str. 301
uugcgucauggu

SEQ ID NO: 2000053 - RNA, 20 nt, Shigella flexneri 2a str. 301
uugcguacaccaacaucacg

SEQ ID NO: 2000054 - RNA, 21 nt, Shigella flexneri 2a str. 301
uugcgagccuguaccacaacc

SEQ ID NO: 2000055 - RNA, 18 nt, Shigella flexneri 2a str. 301
uugcgaauuauaauuccu

SEQ ID NO: 2000056 - RNA, 21 nt, Shigella flexneri 2a str. 301
uugcgaacgcguucacugccg

SEQ ID NO: 2000057 - RNA, 15 nt, Shigella flexneri 2a str. 301
uugcgcgacuuuuuc

SEQ ID NO: 2000058 - RNA, 21 nt, Shigella flexneri 2a str. 301
uugcgccgguuuaucuccgcu

SEQ ID NO: 2000059 - RNA, 15 nt, Shigella flexneri 2a str. 301
uugcgccuuuaauau

SEQ ID NO: 2000060 - RNA, 18 nt, Shigella flexneri 2a str. 301
uugcgauauucuucagua

SEQ ID NO: 2000061 - RNA, 17 nt, Shigella flexneri 2a str. 301
uugccggaugugaugca

SEQ ID NO: 2000062 - RNA, 15 nt, Shigella flexneri 2a str. 301
uugccggaugcgaca

SEQ ID NO: 2000063 - RNA, 22 nt, Shigella flexneri 2a str. 301
uuucugcagcgcggcgagagcu

SEQ ID NO: 2000064 - RNA, 15 nt, Shigella flexneri 2a str. 301
uuucugagcaucaca

SEQ ID NO: 2000065 - RNA, 20 nt, Shigella flexneri 2a str. 301
uuucugacuguguuagccug

SEQ ID NO: 2000066 - RNA, 11 nt, Shigella flexneri 2a str. 301
uuucugccuca

SEQ ID NO: 2000067 - RNA, 23 nt, Shigella flexneri 2a str. 301
uuucugccgcuguuuugucaucu

SEQ ID NO: 2000068 - RNA, 17 nt, Shigella flexneri 2a str. 301
uuucugccauuuugcuu

SEQ ID NO: 2000069 - RNA, 16 nt, Shigella flexneri 2a str. 301
uuucugccuugaguuu

SEQ ID NO: 2000070 - RNA, 15 nt, Shigella flexneri 2a str. 301
uuucugcuuuucccu

SEQ ID NO: 2000071 - RNA, 15 nt, Shigella flexneri 2a str. 301
uuucugaaacugauc

SEQ ID NO: 2000072 - RNA, 17 nt, Shigella flexneri 2a str. 301
uuucucuuucuucagca

SEQ ID NO: 2000073 - RNA, 20 nt, Shigella flexneri 2a str. 301
uuucucgguauuacaaugcg

SEQ ID NO: 2000074 - RNA, 12 nt, Shigella flexneri 2a str. 301
uuucucuuucuu

SEQ ID NO: 2000075 - RNA, 15 nt, Shigella flexneri 2a str. 301
uuucucuuucuucag

SEQ ID NO: 2000076 - RNA, 12 nt, Shigella flexneri 2a str. 301
uuucucuuucag

SEQ ID NO: 2000077 - RNA, 13 nt, Shigella flexneri 2a str. 301
uuucucuucaucu

SEQ ID NO: 2000078 - RNA, 19 nt, Shigella flexneri 2a str. 301
uuucuaugagaaaauuuca

SEQ ID NO: 2000079 - RNA, 12 nt, Shigella flexneri 2a str. 301
uuucucaauaua

SEQ ID NO: 2000080 - RNA, 14 nt, Shigella flexneri 2a str. 301
uuucucauuuuuua

SEQ ID NO: 2000081 - RNA, 11 nt, Shigella flexneri 2a str. 301
uuucucccccc

SEQ ID NO: 2000082 - RNA, 14 nt, Shigella flexneri 2a str. 301
uuucuccccccucu

SEQ ID NO: 2000083 - RNA, 15 nt, Shigella flexneri 2a str. 301
uuucucauccgcagu

SEQ ID NO: 2000084 - RNA, 11 nt, Shigella flexneri 2a str. 301
uuucucccucg

SEQ ID NO: 2000085 - RNA, 14 nt, Shigella flexneri 2a str. 301
uuucuccugcgccu

SEQ ID NO: 2000086 - RNA, 22 nt, Shigella flexneri 2a str. 301
uuucucgccaccggcacaucca

SEQ ID NO: 2000087 - RNA, 15 nt, Shigella flexneri 2a str. 301
uuucgucguacugac

SEQ ID NO: 2000088 - RNA, 21 nt, Shigella flexneri 2a str. 301
uuucguguggaguaauaauuu

SEQ ID NO: 2000089 - RNA, 16 nt, Shigella flexneri 2a str. 301
uuucggcaucagcaga

SEQ ID NO: 2000090 - RNA, 22 nt, Shigella flexneri 2a str. 301
uuucgcuucaaccaccucagua

SEQ ID NO: 2000091 - RNA, 19 nt, Shigella flexneri 2a str. 301
uuucggacgauauuuuucc

SEQ ID NO: 2000092 - RNA, 19 nt, Shigella flexneri 2a str. 301
uuucgcggcauaacagaau

SEQ ID NO: 2000093 - RNA, 17 nt, Shigella flexneri 2a str. 301
uuucgcggcauaacaga

SEQ ID NO: 2000094 - RNA, 23 nt, Shigella flexneri 2a str. 301
uuucgccgcauccggcaauucuc

SEQ ID NO: 2000095 - RNA, 13 nt, Shigella flexneri 2a str. 301
uuucgccuuucug

SEQ ID NO: 2000096 - RNA, 17 nt, Shigella flexneri 2a str. 301
uuucgccuuucugcaau

SEQ ID NO: 2000097 - RNA, 13 nt, Shigella flexneri 2a str. 301
uuucuaccagguu

SEQ ID NO: 2000098 - RNA, 13 nt, Shigella flexneri 2a str. 301
uuucuaauauuag

SEQ ID NO: 2000099 - RNA, 17 nt, Shigella flexneri 2a str. 301
uuucguuugaaaacugg

SEQ ID NO: 2000100 - RNA, 18 nt, Shigella flexneri 2a str. 301
uuuccccuaacucuuuca

SEQ ID NO: 2000101 - RNA, 22 nt, Shigella flexneri 2a str. 301
uuucccggcugauaaaguguuc

SEQ ID NO: 2000102 - RNA, 23 nt, Shigella flexneri 2a str. 301
uuucccgcacguuggcggugcca

SEQ ID NO: 2000103 - RNA, 14 nt, Shigella flexneri 2a str. 301
uuucccccacagcu

SEQ ID NO: 2000104 - RNA, 23 nt, Shigella flexneri 2a str. 301
uuucccccacagcucugcuguca

SEQ ID NO: 2000105 - RNA, 17 nt, Shigella flexneri 2a str. 301
uuucccauuaccauucc

SEQ ID NO: 2000106 - RNA, 21 nt, Shigella flexneri 2a str. 301
uuucccagcaagaaccaugca

SEQ ID NO: 2000107 - RNA, 13 nt, Shigella flexneri 2a str. 301
uuucccaccacua

SEQ ID NO: 2000108 - RNA, 23 nt, Shigella flexneri 2a str. 301
uuuccgaccaggcguucugccug

SEQ ID NO: 2000109 - RNA, 22 nt, Shigella flexneri 2a str. 301
uuucccuucacucugcugccac

SEQ ID NO: 2000110 - RNA, 14 nt, Shigella flexneri 2a str. 301
uuucccuguugccu

SEQ ID NO: 2000111 - RNA, 13 nt, Shigella flexneri 2a str. 301
uuucccuucucgu

SEQ ID NO: 2000112 - RNA, 17 nt, Shigella flexneri 2a str. 301
uuuccgccucaucaucg

SEQ ID NO: 2000113 - RNA, 23 nt, Shigella flexneri 2a str. 301
uuuccaguucacgaauauuuccc

SEQ ID NO: 2000114 - RNA, 16 nt, Shigella flexneri 2a str. 301
uuuccaguuugcguuc

SEQ ID NO: 2000115 - RNA, 16 nt, Shigella flexneri 2a str. 301
uuuccaucuuuccuca

SEQ ID NO: 2000116 - RNA, 13 nt, Shigella flexneri 2a str. 301
uuuccauuuuuca

SEQ ID NO: 2000117 - RNA, 14 nt, Shigella flexneri 2a str. 301
uuuccacuuccacc

SEQ ID NO: 2000118 - RNA, 23 nt, Shigella flexneri 2a str. 301
uuuccagaucgaucauauuuccu

SEQ ID NO: 2000119 - RNA, 15 nt, Shigella flexneri 2a str. 301
uuuccagcacaaagc

SEQ ID NO: 2000120 - RNA, 17 nt, Shigella flexneri 2a str. 301
uuuccaggcaucagcaa

SEQ ID NO: 2000121 - RNA, 21 nt, Shigella flexneri 2a str. 301
uuuccaggcuggcaggccuca

SEQ ID NO: 2000122 - RNA, 15 nt, Shigella flexneri 2a str. 301
uuuccagcauuucuu

SEQ ID NO: 2000123 - RNA, 19 nt, Shigella flexneri 2a str. 301
uuuccagcaguuccagcau

SEQ ID NO: 2000124 - RNA, 15 nt, Shigella flexneri 2a str. 301
uuucgauaaucauca

SEQ ID NO: 2000125 - RNA, 13 nt, Shigella flexneri 2a str. 301
uuucgauaaucaa

SEQ ID NO: 2000126 - RNA, 17 nt, Shigella flexneri 2a str. 301
uuucgauaucaagccau

SEQ ID NO: 2000127 - RNA, 13 nt, Shigella flexneri 2a str. 301
uuucgauugcaca

SEQ ID NO: 2000128 - RNA, 12 nt, Shigella flexneri 2a str. 301
uuucgcaaacca

SEQ ID NO: 2000129 - RNA, 15 nt, Shigella flexneri 2a str. 301
uuucgcaaaccaaac

SEQ ID NO: 2000130 - RNA, 12 nt, Shigella flexneri 2a str. 301
uuucgcacugca

SEQ ID NO: 2000131 - RNA, 15 nt, Shigella flexneri 2a str. 301
uuucgccacccaguc

SEQ ID NO: 2000132 - RNA, 19 nt, Shigella flexneri 2a str. 301
uuucgaaugcucaugaucg

SEQ ID NO: 2000133 - RNA, 17 nt, Shigella flexneri 2a str. 301
uuucgaauguggcagca

SEQ ID NO: 2000134 - RNA, 18 nt, Shigella flexneri 2a str. 301
uuucgacaauaaucaacg

SEQ ID NO: 2000135 - RNA, 17 nt, Shigella flexneri 2a str. 301
uuucgaacgccaguuca

SEQ ID NO: 2000136 - RNA, 18 nt, Shigella flexneri 2a str. 301
uuuccuccugucuucccu

SEQ ID NO: 2000137 - RNA, 17 nt, Shigella flexneri 2a str. 301
uuuccuauugcugcuga

SEQ ID NO: 2000138 - RNA, 21 nt, Shigella flexneri 2a str. 301
uuuccugcucaaugucuguca

SEQ ID NO: 2000139 - RNA, 16 nt, Shigella flexneri 2a str. 301
uuuccugagcacuggg

SEQ ID NO: 2000140 - RNA, 24 nt, Shigella flexneri 2a str. 301
uuuccuggucggcaaacugcugau

SEQ ID NO: 2000141 - RNA, 16 nt, Shigella flexneri 2a str. 301
uuuccugguucucacu

SEQ ID NO: 2000142 - RNA, 19 nt, Shigella flexneri 2a str. 301
uuuccugcugcaucugaaa

SEQ ID NO: 2000143 - RNA, 14 nt, Shigella flexneri 2a str. 301
uuuccggcagaagc

SEQ ID NO: 2000144 - RNA, 15 nt, Shigella flexneri 2a str. 301
uuuccggcagaagca

SEQ ID NO: 2000145 - RNA, 20 nt, Shigella flexneri 2a str. 301
uuuccggcggcggaaaguau

SEQ ID NO: 2000146 - RNA, 19 nt, Shigella flexneri 2a str. 301
uuuccguugugcgauccac

SEQ ID NO: 2000147 - RNA, 15 nt, Shigella flexneri 2a str. 301
uuuccgucagcggca

SEQ ID NO: 2000148 - RNA, 14 nt, Shigella flexneri 2a str. 301
uuugcauccagcuc

SEQ ID NO: 2000149 - RNA, 17 nt, Shigella flexneri 2a str. 301
uuugcauccacaacccg

SEQ ID NO: 2000150 - RNA, 18 nt, Shigella flexneri 2a str. 301
uuugcaugacgaucaacc

SEQ ID NO: 2000151 - RNA, 16 nt, Shigella flexneri 2a str. 301
uuugcauuacugcuau

SEQ ID NO: 2000152 - RNA, 14 nt, Shigella flexneri 2a str. 301
uuugcauaauuucc

SEQ ID NO: 2000153 - RNA, 20 nt, Shigella flexneri 2a str. 301
uuugcagugaucgugugcca

SEQ ID NO: 2000154 - RNA, 16 nt, Shigella flexneri 2a str. 301
uuugcagugcuuguua

SEQ ID NO: 2000155 - RNA, 19 nt, Shigella flexneri 2a str. 301
uuugcaggucguccugcaa

SEQ ID NO: 2000156 - RNA, 14 nt, Shigella flexneri 2a str. 301
uuugcaggaaaaac

SEQ ID NO: 2000157 - RNA, 15 nt, Shigella flexneri 2a str. 301
uuugcagcuuugcug

SEQ ID NO: 2000158 - RNA, 16 nt, Shigella flexneri 2a str. 301
uuugcagccauaaauu

SEQ ID NO: 2000159 - RNA, 18 nt, Shigella flexneri 2a str. 301
uuugcagccauaaauuua

SEQ ID NO: 2000160 - RNA, 20 nt, Shigella flexneri 2a str. 301
uuugcagccauaaauuuacc

SEQ ID NO: 2000161 - RNA, 21 nt, Shigella flexneri 2a str. 301
uuugcagccauaaauuuaccu

SEQ ID NO: 2000162 - RNA, 18 nt, Shigella flexneri 2a str. 301
uuugcaacgcuuugcuga

SEQ ID NO: 2000163 - RNA, 15 nt, Shigella flexneri 2a str. 301
uuugcaacuuucgcu

SEQ ID NO: 2000164 - RNA, 12 nt, Shigella flexneri 2a str. 301
uuugcagauuca

SEQ ID NO: 2000165 - RNA, 13 nt, Shigella flexneri 2a str. 301
uuugcacgcuuuc

SEQ ID NO: 2000166 - RNA, 19 nt, Shigella flexneri 2a str. 301
uuugccugugcaaccuuuu

SEQ ID NO: 2000167 - RNA, 13 nt, Shigella flexneri 2a str. 301
uuugccuccccaa

SEQ ID NO: 2000168 - RNA, 15 nt, Shigella flexneri 2a str. 301
uuugccuuauugccu

SEQ ID NO: 2000169 - RNA, 20 nt, Shigella flexneri 2a str. 301
uuugcgaacgcguucacugc

SEQ ID NO: 2000170 - RNA, 20 nt, Shigella flexneri 2a str. 301
uuugcgagucugcuccagaa

SEQ ID NO: 2000171 - RNA, 14 nt, Shigella flexneri 2a str. 301
uuugcgcaaucaca

SEQ ID NO: 2000172 - RNA, 23 nt, Shigella flexneri 2a str. 301
uuugcgccaucgccacaccagua

SEQ ID NO: 2000173 - RNA, 14 nt, Shigella flexneri 2a str. 301
uuugccacugccgg

SEQ ID NO: 2000174 - RNA, 20 nt, Shigella flexneri 2a str. 301
uuugccaauagcguuuugcg

SEQ ID NO: 2000175 - RNA, 17 nt, Shigella flexneri 2a str. 301
uuugccagaaauccagg

SEQ ID NO: 2000176 - RNA, 18 nt, Shigella flexneri 2a str. 301
uuugcauuacugcuaucu

SEQ ID NO: 2000177 - RNA, 24 nt, Shigella flexneri 2a str. 301
uuugcauuacugcuaucugccaga

SEQ ID NO: 2000178 - RNA, 19 nt, Shigella flexneri 2a str. 301
uuugcauucggauugcuau

SEQ ID NO: 2000179 - RNA, 15 nt, Shigella flexneri 2a str. 301
uuugcccgcuuggca

SEQ ID NO: 2000180 - RNA, 16 nt, Shigella flexneri 2a str. 301
uuugcccgcagaucca

SEQ ID NO: 2000181 - RNA, 15 nt, Shigella flexneri 2a str. 301
uuugccaucucugca

SEQ ID NO: 2000182 - RNA, 16 nt, Shigella flexneri 2a str. 301
uuugccaugcauaucc

SEQ ID NO: 2000183 - RNA, 12 nt, Shigella flexneri 2a str. 301
uuugaugcugua

SEQ ID NO: 2000184 - RNA, 13 nt, Shigella flexneri 2a str. 301
uuugauauuuauu

SEQ ID NO: 2000185 - RNA, 18 nt, Shigella flexneri 2a str. 301
uuugcaaaaucaaauaca

SEQ ID NO: 2000186 - RNA, 14 nt, Shigella flexneri 2a str. 301
uuugaguucacugc

SEQ ID NO: 2000187 - RNA, 22 nt, Shigella flexneri 2a str. 301
uuugauaaaccuccagcaucag

SEQ ID NO: 2000188 - RNA, 11 nt, Shigella flexneri 2a str. 301
uuugagcagca

SEQ ID NO: 2000189 - RNA, 22 nt, Shigella flexneri 2a str. 301
uuugagcaucaaacuuuuaaau

SEQ ID NO: 2000190 - RNA, 18 nt, Shigella flexneri 2a str. 301
uuugagaacgacagugac

SEQ ID NO: 2000191 - RNA, 19 nt, Shigella flexneri 2a str. 301
uuugacagccccugugcca

SEQ ID NO: 2000192 - RNA, 21 nt, Shigella flexneri 2a str. 301
uuugacuacgacgccaagaaa

SEQ ID NO: 2000193 - RNA, 16 nt, Shigella flexneri 2a str. 301
uuugacaacucaucac

SEQ ID NO: 2000194 - RNA, 21 nt, Shigella flexneri 2a str. 301
uuugaaugaguacugaugaau

SEQ ID NO: 2000195 - RNA, 17 nt, Shigella flexneri 2a str. 301
uuugaauaucuccucug

SEQ ID NO: 2000196 - RNA, 17 nt, Shigella flexneri 2a str. 301
uuucuuuggcaucaauc

SEQ ID NO: 2000197 - RNA, 13 nt, Shigella flexneri 2a str. 301
uuucuuucaucag

SEQ ID NO: 2000198 - RNA, 21 nt, Shigella flexneri 2a str. 301
uuucuuucgcccaauaaaaaa

SEQ ID NO: 2000199 - RNA, 18 nt, Shigella flexneri 2a str. 301
uuugaaauugugauaaaa

SEQ ID NO: 2000200 - RNA, 22 nt, Shigella flexneri 2a str. 301
uuugaacauaucagcgcaaaga

SEQ ID NO: 2000201 - RNA, 13 nt, Shigella flexneri 2a str. 301
uuucuugguaaug

SEQ ID NO: 2000202 - RNA, 21 nt, Shigella flexneri 2a str. 301
uuucuuaccccugauuuuguu

SEQ ID NO: 2000203 - RNA, 12 nt, Shigella flexneri 2a str. 301
uuucuuauuuuu

SEQ ID NO: 2000204 - RNA, 16 nt, Shigella flexneri 2a str. 301
uuucuucagccccucc

SEQ ID NO: 2000205 - RNA, 17 nt, Shigella flexneri 2a str. 301
uuucuggucauugccag

SEQ ID NO: 2000206 - RNA, 19 nt, Shigella flexneri 2a str. 301
uuucuggcaccuguaccag

SEQ ID NO: 2000207 - RNA, 21 nt, Shigella flexneri 2a str. 301
uuucuggguggcguuccagca

SEQ ID NO: 2000208 - RNA, 17 nt, Shigella flexneri 2a str. 301
uuucuggcaucacuucu

SEQ ID NO: 2000209 - RNA, 23 nt, Shigella flexneri 2a str. 301
uuucuggcggcuuauauauuaau

SEQ ID NO: 2000210 - RNA, 18 nt, Shigella flexneri 2a str. 301
uuucaaacucuucacacc

SEQ ID NO: 2000211 - RNA, 14 nt, Shigella flexneri 2a str. 301
uuucaaacaggcug

SEQ ID NO: 2000212 - RNA, 13 nt, Shigella flexneri 2a str. 301
uuucaaauuguuc

SEQ ID NO: 2000213 - RNA, 12 nt, Shigella flexneri 2a str. 301
uuucaaaaacaa

SEQ ID NO: 2000214 - RNA, 13 nt, Shigella flexneri 2a str. 301
uuuauuuuuccuc

SEQ ID NO: 2000215 - RNA, 22 nt, Shigella flexneri 2a str. 301
uuuauuuuuuuucaggaaauaa

SEQ ID NO: 2000216 - RNA, 19 nt, Shigella flexneri 2a str. 301
uuuauuucuguauuacaga

SEQ ID NO: 2000217 - RNA, 20 nt, Shigella flexneri 2a str. 301
uuuauucggcauacauaauc

SEQ ID NO: 2000218 - RNA, 13 nt, Shigella flexneri 2a str. 301
uuuauuauuguuu

SEQ ID NO: 2000219 - RNA, 11 nt, Shigella flexneri 2a str. 301
uuuauuauucc

SEQ ID NO: 2000220 - RNA, 15 nt, Shigella flexneri 2a str. 301
uuuauugacaaucgc

SEQ ID NO: 2000221 - RNA, 16 nt, Shigella flexneri 2a str. 301
uuuauugacauguuga

SEQ ID NO: 2000222 - RNA, 20 nt, Shigella flexneri 2a str. 301
uuuauucugacgccaccauu

SEQ ID NO: 2000223 - RNA, 15 nt, Shigella flexneri 2a str. 301
uuucacccacuaauc

SEQ ID NO: 2000224 - RNA, 20 nt, Shigella flexneri 2a str. 301
uuucacaggaaaaacuuuua

SEQ ID NO: 2000225 - RNA, 19 nt, Shigella flexneri 2a str. 301
uuucacagaagugaagcau

SEQ ID NO: 2000226 - RNA, 14 nt, Shigella flexneri 2a str. 301
uuucacaauugacg

SEQ ID NO: 2000227 - RNA, 19 nt, Shigella flexneri 2a str. 301
uuucaauuccauuucccug

SEQ ID NO: 2000228 - RNA, 12 nt, Shigella flexneri 2a str. 301
uuucaauuauca

SEQ ID NO: 2000229 - RNA, 23 nt, Shigella flexneri 2a str. 301
uuucaauucacgaauauuucccg

SEQ ID NO: 2000230 - RNA, 22 nt, Shigella flexneri 2a str. 301
uuucacgccgggaaauuuuucc

SEQ ID NO: 2000231 - RNA, 15 nt, Shigella flexneri 2a str. 301
uuucaccuuuuucca

SEQ ID NO: 2000232 - RNA, 14 nt, Shigella flexneri 2a str. 301
uuucacgaugaacu

SEQ ID NO: 2000233 - RNA, 21 nt, Shigella flexneri 2a str. 301
uuucacgagagauacgcuugc

SEQ ID NO: 2000234 - RNA, 19 nt, Shigella flexneri 2a str. 301
uuucacgaagcucucugcu

SEQ ID NO: 2000235 - RNA, 13 nt, Shigella flexneri 2a str. 301
uuucaccugcuga

SEQ ID NO: 2000236 - RNA, 19 nt, Shigella flexneri 2a str. 301
uuucaacguacucugccac

SEQ ID NO: 2000237 - RNA, 18 nt, Shigella flexneri 2a str. 301
uuucaagcucaaaauaau

SEQ ID NO: 2000238 - RNA, 21 nt, Shigella flexneri 2a str. 301
uuucaagcucaaaauaauaca

SEQ ID NO: 2000239 - RNA, 23 nt, Shigella flexneri 2a str. 301
uuucaagcucaaaauaauacaca

SEQ ID NO: 2000240 - RNA, 23 nt, Shigella flexneri 2a str. 301
uuucaacgacccagccagacgcc

SEQ ID NO: 2000241 - RNA, 17 nt, Shigella flexneri 2a str. 301
uuucaaccuaaaguaaa

SEQ ID NO: 2000242 - RNA, 18 nt, Shigella flexneri 2a str. 301
uuucaacaauacaaaugc

SEQ ID NO: 2000243 - RNA, 22 nt, Shigella flexneri 2a str. 301
uuucaauaaccugcaaaauagu

SEQ ID NO: 2000244 - RNA, 19 nt, Shigella flexneri 2a str. 301
uuucaauaucguuaucacc

SEQ ID NO: 2000245 - RNA, 23 nt, Shigella flexneri 2a str. 301
uuucaaugauaaaggucaucaca

SEQ ID NO: 2000246 - RNA, 13 nt, Shigella flexneri 2a str. 301
uuucaguuugccg

SEQ ID NO: 2000247 - RNA, 14 nt, Shigella flexneri 2a str. 301
uuucauacugccga

SEQ ID NO: 2000248 - RNA, 20 nt, Shigella flexneri 2a str. 301
uuucauaccccacauaguuu

SEQ ID NO: 2000249 - RNA, 18 nt, Shigella flexneri 2a str. 301
uuucauauuauuugcuau

SEQ ID NO: 2000250 - RNA, 21 nt, Shigella flexneri 2a str. 301
uuucauauucaauuugcaauu

SEQ ID NO: 2000251 - RNA, 19 nt, Shigella flexneri 2a str. 301
uuucauagauuaauuuccc

SEQ ID NO: 2000252 - RNA, 20 nt, Shigella flexneri 2a str. 301
uuucauagauuaauuuccca

SEQ ID NO: 2000253 - RNA, 19 nt, Shigella flexneri 2a str. 301
uuucaguuggcugacaaag

SEQ ID NO: 2000254 - RNA, 18 nt, Shigella flexneri 2a str. 301
uuucaguggguuaugaaa

SEQ ID NO: 2000255 - RNA, 14 nt, Shigella flexneri 2a str. 301
uuucaguaacauca

SEQ ID NO: 2000256 - RNA, 15 nt, Shigella flexneri 2a str. 301
uuucaguaauccuuu

SEQ ID NO: 2000257 - RNA, 17 nt, Shigella flexneri 2a str. 301
uuucaguauuuccacaa

SEQ ID NO: 2000258 - RNA, 16 nt, Shigella flexneri 2a str. 301
uuucagguuacgcccu

SEQ ID NO: 2000259 - RNA, 19 nt, Shigella flexneri 2a str. 301
uuucagauuguugacaaag

SEQ ID NO: 2000260 - RNA, 19 nt, Shigella flexneri 2a str. 301
uuucagauuauugacaaag

SEQ ID NO: 2000261 - RNA, 16 nt, Shigella flexneri 2a str. 301
uuucagaccagacugc

SEQ ID NO: 2000262 - RNA, 22 nt, Shigella flexneri 2a str. 301
uuucagaagcaugaacauugcu

SEQ ID NO: 2000263 - RNA, 20 nt, Shigella flexneri 2a str. 301
uuucacuucgucagaaaugg

SEQ ID NO: 2000264 - RNA, 22 nt, Shigella flexneri 2a str. 301
uuucagaaauuuggcuccucug

SEQ ID NO: 2000265 - RNA, 17 nt, Shigella flexneri 2a str. 301
uuucagaauagacaaaa

SEQ ID NO: 2000266 - RNA, 14 nt, Shigella flexneri 2a str. 301
uuucacuucugagu

SEQ ID NO: 2000267 - RNA, 16 nt, Shigella flexneri 2a str. 301
uuucacuuaaugaauc

SEQ ID NO: 2000268 - RNA, 14 nt, Shigella flexneri 2a str. 301
uuucagcacuuauc

SEQ ID NO: 2000269 - RNA, 14 nt, Shigella flexneri 2a str. 301
uuucagcaccagau

SEQ ID NO: 2000270 - RNA, 19 nt, Shigella flexneri 2a str. 301
uuucagcaccagauaauga

SEQ ID NO: 2000271 - RNA, 18 nt, Shigella flexneri 2a str. 301
uuucagcggcguguuauu

SEQ ID NO: 2000272 - RNA, 18 nt, Shigella flexneri 2a str. 301
uuucaggaaauaaauaau

SEQ ID NO: 2000273 - RNA, 19 nt, Shigella flexneri 2a str. 301
uuucaucccgagucgcuga

SEQ ID NO: 2000274 - RNA, 15 nt, Shigella flexneri 2a str. 301
uuucaucccucucau

SEQ ID NO: 2000275 - RNA, 21 nt, Shigella flexneri 2a str. 301
uuucaucaacugacuauccug

SEQ ID NO: 2000276 - RNA, 23 nt, Shigella flexneri 2a str. 301
uuucaucgcuuacccuaaauccg

SEQ ID NO: 2000277 - RNA, 21 nt, Shigella flexneri 2a str. 301
uuucaucgcuuucuuuauaga

SEQ ID NO: 2000278 - RNA, 23 nt, Shigella flexneri 2a str. 301
uuucaucggcaacgguaugaaau

SEQ ID NO: 2000279 - RNA, 22 nt, Shigella flexneri 2a str. 301
uuucaucgcccaggcaaguagc

SEQ ID NO: 2000280 - RNA, 14 nt, Shigella flexneri 2a str. 301
uuucauccugccau

SEQ ID NO: 2000281 - RNA, 17 nt, Shigella flexneri 2a str. 301
uuucaucuucuucgaaa

SEQ ID NO: 2000282 - RNA, 21 nt, Shigella flexneri 2a str. 301
uuucaugguuacgccggugau

SEQ ID NO: 2000283 - RNA, 16 nt, Shigella flexneri 2a str. 301
uuucaugguugucacc

SEQ ID NO: 2000284 - RNA, 19 nt, Shigella flexneri 2a str. 301
uuucauuuugauauuucgu

SEQ ID NO: 2000285 - RNA, 15 nt, Shigella flexneri 2a str. 301
uuuccacgcaggcau

SEQ ID NO: 2000286 - RNA, 20 nt, Shigella flexneri 2a str. 301
uuucauuugcgcggcaguca

SEQ ID NO: 2000287 - RNA, 21 nt, Shigella flexneri 2a str. 301
uuucauugaaugcggcaggca

SEQ ID NO: 2000288 - RNA, 17 nt, Shigella flexneri 2a str. 301
uuuaugcgcuaaauguu

SEQ ID NO: 2000289 - RNA, 22 nt, Shigella flexneri 2a str. 301
uuuaugcggcggaacaucaaag

SEQ ID NO: 2000290 - RNA, 19 nt, Shigella flexneri 2a str. 301
uuuaugcgccuuuaccaga

SEQ ID NO: 2000291 - RNA, 14 nt, Shigella flexneri 2a str. 301
uuuaugcacauugg

SEQ ID NO: 2000292 - RNA, 13 nt, Shigella flexneri 2a str. 301
uuuaugauauuuu

SEQ ID NO: 2000293 - RNA, 15 nt, Shigella flexneri 2a str. 301
uuuaugauauuuuuu

SEQ ID NO: 2000294 - RNA, 22 nt, Shigella flexneri 2a str. 301
uuuaugguagugccgucagcag

SEQ ID NO: 2000295 - RNA, 15 nt, Shigella flexneri 2a str. 301
uuuaugggagauuuu

SEQ ID NO: 2000296 - RNA, 16 nt, Shigella flexneri 2a str. 301
uuuaugggagauuuua

SEQ ID NO: 2000297 - RNA, 14 nt, Shigella flexneri 2a str. 301
uuuauguucagaua

SEQ ID NO: 2000298 - RNA, 16 nt, Shigella flexneri 2a str. 301
uuuaucaucacccaac

SEQ ID NO: 2000299 - RNA, 20 nt, Shigella flexneri 2a str. 301
uuuauccugacgagcuuucu

SEQ ID NO: 2000300 - RNA, 15 nt, Shigella flexneri 2a str. 301
uuuaucccuucucca

SEQ ID NO: 2000301 - RNA, 13 nt, Shigella flexneri 2a str. 301
uuuaucuucccag

SEQ ID NO: 2000302 - RNA, 22 nt, Shigella flexneri 2a str. 301
uuuaucuucaagaaucauaggc

SEQ ID NO: 2000303 - RNA, 20 nt, Shigella flexneri 2a str. 301
uuuaucugugaacucaggcu

SEQ ID NO: 2000304 - RNA, 16 nt, Shigella flexneri 2a str. 301
uuuauagggugccauu

SEQ ID NO: 2000305 - RNA, 13 nt, Shigella flexneri 2a str. 301
uuuaucaggccac

SEQ ID NO: 2000306 - RNA, 12 nt, Shigella flexneri 2a str. 301
uuuaucaggcca

SEQ ID NO: 2000307 - RNA, 16 nt, Shigella flexneri 2a str. 301
uuuaucacugugaugg

SEQ ID NO: 2000308 - RNA, 12 nt, Shigella flexneri 2a str. 301
uuuaucacugag

SEQ ID NO: 2000309 - RNA, 12 nt, Shigella flexneri 2a str. 301
uuuauaaagaac

SEQ ID NO: 2000310 - RNA, 19 nt, Shigella flexneri 2a str. 301
uuuauagcuuauucuuauu

SEQ ID NO: 2000311 - RNA, 20 nt, Shigella flexneri 2a str. 301
uuuauagagauuuuucccca

SEQ ID NO: 2000312 - RNA, 18 nt, Shigella flexneri 2a str. 301
uuuauaaucuuuaaaaaa

SEQ ID NO: 2000313 - RNA, 13 nt, Shigella flexneri 2a str. 301
uuuagcauaaaaa

SEQ ID NO: 2000314 - RNA, 14 nt, Shigella flexneri 2a str. 301
uuuagagaauuaau

SEQ ID NO: 2000315 - RNA, 17 nt, Shigella flexneri 2a str. 301
uuuagguacaaagccaa

SEQ ID NO: 2000316 - RNA, 13 nt, Shigella flexneri 2a str. 301
uuuaguauuguua

SEQ ID NO: 2000317 - RNA, 11 nt, Shigella flexneri 2a str. 301
uuuacuuugcu

SEQ ID NO: 2000318 - RNA, 16 nt, Shigella flexneri 2a str. 301
uuuacugucugcuucu

SEQ ID NO: 2000319 - RNA, 16 nt, Shigella flexneri 2a str. 301
uuuacuuacuucagca

SEQ ID NO: 2000320 - RNA, 13 nt, Shigella flexneri 2a str. 301
uuuacuucucagc

SEQ ID NO: 2000321 - RNA, 17 nt, Shigella flexneri 2a str. 301
uuuacugauaauuuuuu

SEQ ID NO: 2000322 - RNA, 22 nt, Shigella flexneri 2a str. 301
uuuacugacuagaugugcaguu

SEQ ID NO: 2000323 - RNA, 19 nt, Shigella flexneri 2a str. 301
uuuacuacguaauuucaau

SEQ ID NO: 2000324 - RNA, 14 nt, Shigella flexneri 2a str. 301
uuuacgcaaccaca

SEQ ID NO: 2000325 - RNA, 21 nt, Shigella flexneri 2a str. 301
uuuacgaagaaagcaauauug

SEQ ID NO: 2000326 - RNA, 16 nt, Shigella flexneri 2a str. 301
uuuacagcuuagcgcc

SEQ ID NO: 2000327 - RNA, 17 nt, Shigella flexneri 2a str. 301
uuuacggcugcauuaug

SEQ ID NO: 2000328 - RNA, 15 nt, Shigella flexneri 2a str. 301
uuuacgcuuuccagc

SEQ ID NO: 2000329 - RNA, 12 nt, Shigella flexneri 2a str. 301
uuuacgccgcau

SEQ ID NO: 2000330 - RNA, 18 nt, Shigella flexneri 2a str. 301
uuuacgcucccacggaau

SEQ ID NO: 2000331 - RNA, 18 nt, Shigella flexneri 2a str. 301
ucaggcgugauucauaca

SEQ ID NO: 2000332 - RNA, 14 nt, Shigella flexneri 2a str. 301
ucaggcguugaaaa

SEQ ID NO: 2000333 - RNA, 16 nt, Shigella flexneri 2a str. 301
ucaggcuacuuuucca

SEQ ID NO: 2000334 - RNA, 16 nt, Shigella flexneri 2a str. 301
ucaggcucucauuuuu

SEQ ID NO: 2000335 - RNA, 14 nt, Shigella flexneri 2a str. 301
ucaggcugcuaucc

SEQ ID NO: 2000336 - RNA, 18 nt, Shigella flexneri 2a str. 301
ucagguguuaguguucau

SEQ ID NO: 2000337 - RNA, 22 nt, Shigella flexneri 2a str. 301
ucaggugucuaacccgcgacug

SEQ ID NO: 2000338 - RNA, 14 nt, Shigella flexneri 2a str. 301
ucaggugucuggca

SEQ ID NO: 2000339 - RNA, 21 nt, Shigella flexneri 2a str. 301
ucaggguaaauuuauagucau

SEQ ID NO: 2000340 - RNA, 22 nt, Shigella flexneri 2a str. 301
ucagguaagcgauaaaaauacc

SEQ ID NO: 2000341 - RNA, 13 nt, Shigella flexneri 2a str. 301
ucagguaccagca

SEQ ID NO: 2000342 - RNA, 15 nt, Shigella flexneri 2a str. 301
ucagguaacagggaa

SEQ ID NO: 2000343 - RNA, 14 nt, Shigella flexneri 2a str. 301
ucagguaacaggga

SEQ ID NO: 2000344 - RNA, 20 nt, Shigella flexneri 2a str. 301
ucagguauucguuaaaacca

SEQ ID NO: 2000345 - RNA, 18 nt, Shigella flexneri 2a str. 301
ucagguagcgcauaagcc

SEQ ID NO: 2000346 - RNA, 17 nt, Shigella flexneri 2a str. 301
ucagguaacagggaacu

SEQ ID NO: 2000347 - RNA, 22 nt, Shigella flexneri 2a str. 301
ucaggcaagccgcuaacagcag

SEQ ID NO: 2000348 - RNA, 17 nt, Shigella flexneri 2a str. 301
ucaggcaacccagaaga

SEQ ID NO: 2000349 - RNA, 18 nt, Shigella flexneri 2a str. 301
ucaggcagauacaaccaa

SEQ ID NO: 2000350 - RNA, 20 nt, Shigella flexneri 2a str. 301
ucaggcaucgugcaccaauu

SEQ ID NO: 2000351 - RNA, 13 nt, Shigella flexneri 2a str. 301
ucaggcaucaugc

SEQ ID NO: 2000352 - RNA, 18 nt, Shigella flexneri 2a str. 301
ucaggcaggucuuucacc

SEQ ID NO: 2000353 - RNA, 12 nt, Shigella flexneri 2a str. 301
ucaggcagucug

SEQ ID NO: 2000354 - RNA, 17 nt, Shigella flexneri 2a str. 301
ucaggcaggucuuucac

SEQ ID NO: 2000355 - RNA, 22 nt, Shigella flexneri 2a str. 301
ucaggcagauacaaccaaucgc

SEQ ID NO: 2000356 - RNA, 13 nt, Shigella flexneri 2a str. 301
ucaggagcaggcu

SEQ ID NO: 2000357 - RNA, 13 nt, Shigella flexneri 2a str. 301
ucaggaguuuaau

SEQ ID NO: 2000358 - RNA, 17 nt, Shigella flexneri 2a str. 301
ucaggauauuuauauuu

SEQ ID NO: 2000359 - RNA, 18 nt, Shigella flexneri 2a str. 301
ucaggccuacaaaaucua

SEQ ID NO: 2000360 - RNA, 19 nt, Shigella flexneri 2a str. 301
ucaggccuacaaaugggca

SEQ ID NO: 2000361 - RNA, 15 nt, Shigella flexneri 2a str. 301
ucaggcggggucugg

SEQ ID NO: 2000362 - RNA, 15 nt, Shigella flexneri 2a str. 301
ucaggcgcugaaaga

SEQ ID NO: 2000363 - RNA, 18 nt, Shigella flexneri 2a str. 301
ucaggccgaggcacagca

SEQ ID NO: 2000364 - RNA, 15 nt, Shigella flexneri 2a str. 301
ucaggccggaauaac

SEQ ID NO: 2000365 - RNA, 21 nt, Shigella flexneri 2a str. 301
ucaggccacgucuuaauguaa

SEQ ID NO: 2000366 - RNA, 20 nt, Shigella flexneri 2a str. 301
ucaggcauucucgaauuaau

SEQ ID NO: 2000367 - RNA, 18 nt, Shigella flexneri 2a str. 301
ucaggcauucuuuuucau

SEQ ID NO: 2000368 - RNA, 12 nt, Shigella flexneri 2a str. 301
ucaggccaggau

SEQ ID NO: 2000369 - RNA, 17 nt, Shigella flexneri 2a str. 301
ucagcgggcagggcauc

SEQ ID NO: 2000370 - RNA, 15 nt, Shigella flexneri 2a str. 301
ucagcguuccccaga

SEQ ID NO: 2000371 - RNA, 18 nt, Shigella flexneri 2a str. 301
ucagcguugaaugcaugc

SEQ ID NO: 2000372 - RNA, 15 nt, Shigella flexneri 2a str. 301
ucagcguugccagua

SEQ ID NO: 2000373 - RNA, 13 nt, Shigella flexneri 2a str. 301
ucagcgugcccac

SEQ ID NO: 2000374 - RNA, 16 nt, Shigella flexneri 2a str. 301
ucagcgugacuggcag

SEQ ID NO: 2000375 - RNA, 14 nt, Shigella flexneri 2a str. 301
ucagcgguuuugcc

SEQ ID NO: 2000376 - RNA, 16 nt, Shigella flexneri 2a str. 301
ucagcgguggugaaaa

SEQ ID NO: 2000377 - RNA, 19 nt, Shigella flexneri 2a str. 301
ucagcggugccgcgauacc

SEQ ID NO: 2000378 - RNA, 12 nt, Shigella flexneri 2a str. 301
ucagcggugcgg

SEQ ID NO: 2000379 - RNA, 16 nt, Shigella flexneri 2a str. 301
ucagcguaucaauuaa

SEQ ID NO: 2000380 - RNA, 17 nt, Shigella flexneri 2a str. 301
ucagcguaugcagccag

SEQ ID NO: 2000381 - RNA, 16 nt, Shigella flexneri 2a str. 301
ucagcgcagcacccag

SEQ ID NO: 2000382 - RNA, 20 nt, Shigella flexneri 2a str. 301
ucagcgcaacuugcagaucc

SEQ ID NO: 2000383 - RNA, 14 nt, Shigella flexneri 2a str. 301
ucagcgcagcgcga

SEQ ID NO: 2000384 - RNA, 16 nt, Shigella flexneri 2a str. 301
ucagcgcauagagacu

SEQ ID NO: 2000385 - RNA, 14 nt, Shigella flexneri 2a str. 301
uaucuucgauaaac

SEQ ID NO: 2000386 - RNA, 19 nt, Shigella flexneri 2a str. 301
uaucuucccagccaaugca

SEQ ID NO: 2000387 - RNA, 10 nt, Shigella flexneri 2a str. 301
uaucuucaca

SEQ ID NO: 2000388 - RNA, 18 nt, Shigella flexneri 2a str. 301
uaucuucaaucagaugug

SEQ ID NO: 2000389 - RNA, 14 nt, Shigella flexneri 2a str. 301
uaucuucaaucaga

SEQ ID NO: 2000390 - RNA, 13 nt, Shigella flexneri 2a str. 301
uaucuucccagcg

SEQ ID NO: 2000391 - RNA, 15 nt, Shigella flexneri 2a str. 301
uaucuucccagccca

SEQ ID NO: 2000392 - RNA, 23 nt, Shigella flexneri 2a str. 301
uaucuucauccgccccggcuuca

SEQ ID NO: 2000393 - RNA, 14 nt, Shigella flexneri 2a str. 301
ucagcgccaggcuu

SEQ ID NO: 2000394 - RNA, 18 nt, Shigella flexneri 2a str. 301
ucagcgccagcgcggaag

SEQ ID NO: 2000395 - RNA, 13 nt, Shigella flexneri 2a str. 301
ucagcgccaaccc

SEQ ID NO: 2000396 - RNA, 15 nt, Shigella flexneri 2a str. 301
ucagcgccugcugca

SEQ ID NO: 2000397 - RNA, 19 nt, Shigella flexneri 2a str. 301
ucagcgcgacgcucggcug

SEQ ID NO: 2000398 - RNA, 22 nt, Shigella flexneri 2a str. 301
ucaggaauagcggcaagcccag

SEQ ID NO: 2000399 - RNA, 15 nt, Shigella flexneri 2a str. 301
ucaggaauauguuca

SEQ ID NO: 2000400 - RNA, 14 nt, Shigella flexneri 2a str. 301
ucagcuuuuccaua

SEQ ID NO: 2000401 - RNA, 19 nt, Shigella flexneri 2a str. 301
ucaggaacaccgcacgcag

SEQ ID NO: 2000402 - RNA, 12 nt, Shigella flexneri 2a str. 301
ucaggaaauaaa

SEQ ID NO: 2000403 - RNA, 16 nt, Shigella flexneri 2a str. 301
ucaggaaauaaauaau

SEQ ID NO: 2000404 - RNA, 19 nt, Shigella flexneri 2a str. 301
ucagcuuuggugaaaaaau

SEQ ID NO: 2000405 - RNA, 17 nt, Shigella flexneri 2a str. 301
ucagcuugcguccauaa

SEQ ID NO: 2000406 - RNA, 23 nt, Shigella flexneri 2a str. 301
ucagcuauucuuauaaagaaaau

SEQ ID NO: 2000407 - RNA, 14 nt, Shigella flexneri 2a str. 301
ucagcuaauggcug

SEQ ID NO: 2000408 - RNA, 21 nt, Shigella flexneri 2a str. 301
ucagcuccucuuucauuucac

SEQ ID NO: 2000409 - RNA, 14 nt, Shigella flexneri 2a str. 301
ucagcugccagggc

SEQ ID NO: 2000410 - RNA, 16 nt, Shigella flexneri 2a str. 301
ucagcucuuccuucag

SEQ ID NO: 2000411 - RNA, 18 nt, Shigella flexneri 2a str. 301
ucaguaaaguuaccuucg

SEQ ID NO: 2000412 - RNA, 14 nt, Shigella flexneri 2a str. 301
ucaguaaacgcuuu

SEQ ID NO: 2000413 - RNA, 18 nt, Shigella flexneri 2a str. 301
ucagguuuuucagcugcc

SEQ ID NO: 2000414 - RNA, 15 nt, Shigella flexneri 2a str. 301
ucaguagaauaaucu

SEQ ID NO: 2000415 - RNA, 22 nt, Shigella flexneri 2a str. 301
ucaguagcgcaaucaccaccac

SEQ ID NO: 2000416 - RNA, 13 nt, Shigella flexneri 2a str. 301
ucaguacaccacc

SEQ ID NO: 2000417 - RNA, 15 nt, Shigella flexneri 2a str. 301
ucaguauaacuacug

SEQ ID NO: 2000418 - RNA, 13 nt, Shigella flexneri 2a str. 301
ucaguauaacuac

SEQ ID NO: 2000419 - RNA, 13 nt, Shigella flexneri 2a str. 301
ucaguauggucga

SEQ ID NO: 2000420 - RNA, 18 nt, Shigella flexneri 2a str. 301
ucaguaugacuuuaugcu

SEQ ID NO: 2000421 - RNA, 13 nt, Shigella flexneri 2a str. 301
ucagucagcagug

SEQ ID NO: 2000422 - RNA, 16 nt, Shigella flexneri 2a str. 301
ucagucaguggcagca

SEQ ID NO: 2000423 - RNA, 23 nt, Shigella flexneri 2a str. 301
ucagucacgacaaagacaucaaa

SEQ ID NO: 2000424 - RNA, 13 nt, Shigella flexneri 2a str. 301
ucagucucaaacc

SEQ ID NO: 2000425 - RNA, 20 nt, Shigella flexneri 2a str. 301
ucagugucuuaucuggcauu

SEQ ID NO: 2000426 - RNA, 13 nt, Shigella flexneri 2a str. 301
ucagugucuuauc

SEQ ID NO: 2000427 - RNA, 14 nt, Shigella flexneri 2a str. 301
ucagugucgcagua

SEQ ID NO: 2000428 - RNA, 17 nt, Shigella flexneri 2a str. 301
ucaguggcuauuuacca

SEQ ID NO: 2000429 - RNA, 15 nt, Shigella flexneri 2a str. 301
ucagugggcgcugcu

SEQ ID NO: 2000430 - RNA, 21 nt, Shigella flexneri 2a str. 301
ucagugaccgaaccuguuuuc

SEQ ID NO: 2000431 - RNA, 17 nt, Shigella flexneri 2a str. 301
ucagugcaaaugccaga

SEQ ID NO: 2000432 - RNA, 23 nt, Shigella flexneri 2a str. 301
ucaguucguuuuacgcacuucuu

SEQ ID NO: 2000433 - RNA, 17 nt, Shigella flexneri 2a str. 301
ucaguugcaccugaucc

SEQ ID NO: 2000434 - RNA, 22 nt, Shigella flexneri 2a str. 301
ucaguugguuagagcacaucac

SEQ ID NO: 2000435 - RNA, 13 nt, Shigella flexneri 2a str. 301
ucaguuucagaaa

SEQ ID NO: 2000436 - RNA, 17 nt, Shigella flexneri 2a str. 301
ucaguuuaaccgggaga

SEQ ID NO: 2000437 - RNA, 16 nt, Shigella flexneri 2a str. 301
ucaguucagaauggcg

SEQ ID NO: 2000438 - RNA, 13 nt, Shigella flexneri 2a str. 301
ucaguucaaauuc

SEQ ID NO: 2000439 - RNA, 13 nt, Shigella flexneri 2a str. 301
ucaguucaccacu

SEQ ID NO: 2000440 - RNA, 12 nt, Shigella flexneri 2a str. 301
ucaguucaccau

SEQ ID NO: 2000441 - RNA, 13 nt, Shigella flexneri 2a str. 301
ucaguucaccauu

SEQ ID NO: 2000442 - RNA, 18 nt, Shigella flexneri 2a str. 301
ucaguuccgggaucacca

SEQ ID NO: 2000443 - RNA, 15 nt, Shigella flexneri 2a str. 301
ucaguuccugaucga

SEQ ID NO: 2000444 - RNA, 21 nt, Shigella flexneri 2a str. 301
ucaguuccugaucgauaaauu

SEQ ID NO: 2000445 - RNA, 22 nt, Shigella flexneri 2a str. 301
ucaguuaacggcaggaucaggc

SEQ ID NO: 2000446 - RNA, 14 nt, Shigella flexneri 2a str. 301
ucaguuaccugaau

SEQ ID NO: 2000447 - RNA, 20 nt, Shigella flexneri 2a str. 301
ucaguuaaucgcgaaauaac

SEQ ID NO: 2000448 - RNA, 15 nt, Shigella flexneri 2a str. 301
ucaguuugcaaaccc

SEQ ID NO: 2000449 - RNA, 18 nt, Shigella flexneri 2a str. 301
ucaguuuauagaacggca

SEQ ID NO: 2000450 - RNA, 14 nt, Shigella flexneri 2a str. 301
ucauaaaaauuaaa

SEQ ID NO: 2000451 - RNA, 18 nt, Shigella flexneri 2a str. 301
ucauaaauacagagcacg

SEQ ID NO: 2000452 - RNA, 21 nt, Shigella flexneri 2a str. 301
ucauaaacacgguuuuucauu

SEQ ID NO: 2000453 - RNA, 17 nt, Shigella flexneri 2a str. 301
ucauaaauucaaagugu

SEQ ID NO: 2000454 - RNA, 13 nt, Shigella flexneri 2a str. 301
ucaucaaagccaa

SEQ ID NO: 2000455 - RNA, 23 nt, Shigella flexneri 2a str. 301
ucaucaaacaacggcacuucaau

SEQ ID NO: 2000456 - RNA, 21 nt, Shigella flexneri 2a str. 301
ucaucaacugacuauccugga

SEQ ID NO: 2000457 - RNA, 19 nt, Shigella flexneri 2a str. 301
ucaucaagcuguucuuccc

SEQ ID NO: 2000458 - RNA, 18 nt, Shigella flexneri 2a str. 301
ucaucaagcugugccuga

SEQ ID NO: 2000459 - RNA, 21 nt, Shigella flexneri 2a str. 301
ucaucaacuggcaaccagaag

SEQ ID NO: 2000460 - RNA, 20 nt, Shigella flexneri 2a str. 301
ucaucaagcaaggccagguu

SEQ ID NO: 2000461 - RNA, 20 nt, Shigella flexneri 2a str. 301
ucaucaaucgcaaucuggca

SEQ ID NO: 2000462 - RNA, 15 nt, Shigella flexneri 2a str. 301
ucauauugcucugga

SEQ ID NO: 2000463 - RNA, 19 nt, Shigella flexneri 2a str. 301
ucauaucgacaacgaagcc

SEQ ID NO: 2000464 - RNA, 15 nt, Shigella flexneri 2a str. 301
ucauauuaucuaucg

SEQ ID NO: 2000465 - RNA, 20 nt, Shigella flexneri 2a str. 301
ucauauggagcaaaaguggu

SEQ ID NO: 2000466 - RNA, 12 nt, Shigella flexneri 2a str. 301
ucauauucacca

SEQ ID NO: 2000467 - RNA, 15 nt, Shigella flexneri 2a str. 301
ucauaugauucauau

SEQ ID NO: 2000468 - RNA, 21 nt, Shigella flexneri 2a str. 301
ucauacacuucacacacuuuu

SEQ ID NO: 2000469 - RNA, 13 nt, Shigella flexneri 2a str. 301
ucauacaccagcg

SEQ ID NO: 2000470 - RNA, 16 nt, Shigella flexneri 2a str. 301
ucauacaccagcggca

SEQ ID NO: 2000471 - RNA, 23 nt, Shigella flexneri 2a str. 301
ucauacaccguuuuacaacgcug

SEQ ID NO: 2000472 - RNA, 21 nt, Shigella flexneri 2a str. 301
ucauacagaugcugcucuuca

SEQ ID NO: 2000473 - RNA, 21 nt, Shigella flexneri 2a str. 301
ucauacaucgcgcuuaucgcc

SEQ ID NO: 2000474 - RNA, 18 nt, Shigella flexneri 2a str. 301
ucauacagcggacagcca

SEQ ID NO: 2000475 - RNA, 20 nt, Shigella flexneri 2a str. 301
ucauacccaacguaacaaaa

SEQ ID NO: 2000476 - RNA, 21 nt, Shigella flexneri 2a str. 301
ucauaagcaucccuuuaauua

SEQ ID NO: 2000477 - RNA, 22 nt, Shigella flexneri 2a str. 301
ucauaacucuccuguuuaauau

SEQ ID NO: 2000478 - RNA, 21 nt, Shigella flexneri 2a str. 301
ucauaagaagcuuuucucaau

SEQ ID NO: 2000479 - RNA, 12 nt, Shigella flexneri 2a str. 301
ucauaauggcug

SEQ ID NO: 2000480 - RNA, 14 nt, Shigella flexneri 2a str. 301
ucauaauggcugcc

SEQ ID NO: 2000481 - RNA, 17 nt, Shigella flexneri 2a str. 301
ucauaauaugaccugac

SEQ ID NO: 2000482 - RNA, 20 nt, Shigella flexneri 2a str. 301
ucauacgcguaaaacagcca

SEQ ID NO: 2000483 - RNA, 13 nt, Shigella flexneri 2a str. 301
ucauagaccauug

SEQ ID NO: 2000484 - RNA, 19 nt, Shigella flexneri 2a str. 301
ucauacugagcaaggcaua

SEQ ID NO: 2000485 - RNA, 13 nt, Shigella flexneri 2a str. 301
ucauacucugucu

SEQ ID NO: 2000486 - RNA, 13 nt, Shigella flexneri 2a str. 301
ucauacugaacuu

SEQ ID NO: 2000487 - RNA, 16 nt, Shigella flexneri 2a str. 301
ucauacucaccguuca

SEQ ID NO: 2000488 - RNA, 22 nt, Shigella flexneri 2a str. 301
ucauagauuaauuucccaccac

SEQ ID NO: 2000489 - RNA, 22 nt, Shigella flexneri 2a str. 301
ucauagcaguaccuccuucaca

SEQ ID NO: 2000490 - RNA, 18 nt, Shigella flexneri 2a str. 301
ucauagcgcccuuucagc

SEQ ID NO: 2000491 - RNA, 15 nt, Shigella flexneri 2a str. 301
ucauagccuuucaau

SEQ ID NO: 2000492 - RNA, 18 nt, Shigella flexneri 2a str. 301
ucauaguggguuucugcc

SEQ ID NO: 2000493 - RNA, 23 nt, Shigella flexneri 2a str. 301
ucauccgucaccggaauaaugau

SEQ ID NO: 2000494 - RNA, 15 nt, Shigella flexneri 2a str. 301
ucauccggcuguucc

SEQ ID NO: 2000495 - RNA, 18 nt, Shigella flexneri 2a str. 301
ucauccggcuuucuucug

SEQ ID NO: 2000496 - RNA, 14 nt, Shigella flexneri 2a str. 301
ucauccccucuucc

SEQ ID NO: 2000497 - RNA, 16 nt, Shigella flexneri 2a str. 301
ucauccauaaauaccu

SEQ ID NO: 2000498 - RNA, 17 nt, Shigella flexneri 2a str. 301
ucauccaucaaauuacc

SEQ ID NO: 2000499 - RNA, 13 nt, Shigella flexneri 2a str. 301
ucauccagcauca

SEQ ID NO: 2000500 - RNA, 15 nt, Shigella flexneri 2a str. 301
ucauccagugccgcc

SEQ ID NO: 2000501 - RNA, 23 nt, Shigella flexneri 2a str. 301
ucauccagcacuugcaggaacag

SEQ ID NO: 2000502 - RNA, 16 nt, Shigella flexneri 2a str. 301
ucauccagacugcuca

SEQ ID NO: 2000503 - RNA, 17 nt, Shigella flexneri 2a str. 301
ucauccagacugcucag

SEQ ID NO: 2000504 - RNA, 15 nt, Shigella flexneri 2a str. 301
ucauccuucagugcc

SEQ ID NO: 2000505 - RNA, 21 nt, Shigella flexneri 2a str. 301
ucauccuuccccgcuugggca

SEQ ID NO: 2000506 - RNA, 13 nt, Shigella flexneri 2a str. 301
ucaucgacaucaa

SEQ ID NO: 2000507 - RNA, 14 nt, Shigella flexneri 2a str. 301
ucaucgaauaaauu

SEQ ID NO: 2000508 - RNA, 16 nt, Shigella flexneri 2a str. 301
ucaucgaugcgaucau

SEQ ID NO: 2000509 - RNA, 15 nt, Shigella flexneri 2a str. 301
ucaucgauaccaaua

SEQ ID NO: 2000510 - RNA, 15 nt, Shigella flexneri 2a str. 301
ucaucgcuacaccaa

SEQ ID NO: 2000511 - RNA, 15 nt, Shigella flexneri 2a str. 301
ucaucgccuuccagc

SEQ ID NO: 2000512 - RNA, 20 nt, Shigella flexneri 2a str. 301
ucaucgcccuuuuuucaggu

SEQ ID NO: 2000513 - RNA, 19 nt, Shigella flexneri 2a str. 301
ucaucgcagauuucuucug

SEQ ID NO: 2000514 - RNA, 13 nt, Shigella flexneri 2a str. 301
ucaucauugcagu

SEQ ID NO: 2000515 - RNA, 17 nt, Shigella flexneri 2a str. 301
ucaucauugcagucaua

SEQ ID NO: 2000516 - RNA, 15 nt, Shigella flexneri 2a str. 301
ucaucaucuuuauau

SEQ ID NO: 2000517 - RNA, 19 nt, Shigella flexneri 2a str. 301
ucaucaugggcaagguauu

SEQ ID NO: 2000518 - RNA, 17 nt, Shigella flexneri 2a str. 301
ucaucaguuucaaaugg

SEQ ID NO: 2000519 - RNA, 21 nt, Shigella flexneri 2a str. 301
ucaucaguucaggaucugaca

SEQ ID NO: 2000520 - RNA, 19 nt, Shigella flexneri 2a str. 301
ucaucaguuccaguucauu

SEQ ID NO: 2000521 - RNA, 21 nt, Shigella flexneri 2a str. 301
ucaucaguaagccagcaccau

SEQ ID NO: 2000522 - RNA, 23 nt, Shigella flexneri 2a str. 301
ucaucagguuggaucaacaggca

SEQ ID NO: 2000523 - RNA, 17 nt, Shigella flexneri 2a str. 301
ucaucauaauggcugcc

SEQ ID NO: 2000524 - RNA, 18 nt, Shigella flexneri 2a str. 301
ucaucauagacuucccuc

SEQ ID NO: 2000525 - RNA, 19 nt, Shigella flexneri 2a str. 301
ucaucauaacccuuuccuu

SEQ ID NO: 2000526 - RNA, 22 nt, Shigella flexneri 2a str. 301
ucaucaucgcagauuucuucug

SEQ ID NO: 2000527 - RNA, 15 nt, Shigella flexneri 2a str. 301
ucaucaucgugcguu

SEQ ID NO: 2000528 - RNA, 13 nt, Shigella flexneri 2a str. 301
ucaucauccagca

SEQ ID NO: 2000529 - RNA, 21 nt, Shigella flexneri 2a str. 301
ucaucaucgcagauuucuucu

SEQ ID NO: 2000530 - RNA, 13 nt, Shigella flexneri 2a str. 301
ucaucaucagcau

SEQ ID NO: 2000531 - RNA, 19 nt, Shigella flexneri 2a str. 301
ucaucaucaggaacauccc

SEQ ID NO: 2000532 - RNA, 21 nt, Shigella flexneri 2a str. 301
ucaucaccccgcgcucacacc

SEQ ID NO: 2000533 - RNA, 20 nt, Shigella flexneri 2a str. 301
ucaucaccauuccgcaugau

SEQ ID NO: 2000534 - RNA, 21 nt, Shigella flexneri 2a str. 301
ucaucaauugcgcaccagcuu

SEQ ID NO: 2000535 - RNA, 21 nt, Shigella flexneri 2a str. 301
ucaucacgcgguuacgcaccg

SEQ ID NO: 2000536 - RNA, 19 nt, Shigella flexneri 2a str. 301
ucaucacgcgguuacgcac

SEQ ID NO: 2000537 - RNA, 15 nt, Shigella flexneri 2a str. 301
ucaucacgcgguuac

SEQ ID NO: 2000538 - RNA, 17 nt, Shigella flexneri 2a str. 301
ucaucacguuggucugg

SEQ ID NO: 2000539 - RNA, 21 nt, Shigella flexneri 2a str. 301
ucaucaccugagcuggcagac

SEQ ID NO: 2000540 - RNA, 17 nt, Shigella flexneri 2a str. 301
ucaucaccggggauaac

SEQ ID NO: 2000541 - RNA, 15 nt, Shigella flexneri 2a str. 301
ucaucacgcaucacu

SEQ ID NO: 2000542 - RNA, 18 nt, Shigella flexneri 2a str. 301
ucaucaccuccagccuga

SEQ ID NO: 2000543 - RNA, 19 nt, Shigella flexneri 2a str. 301
ucaucagcauaaucaccag

SEQ ID NO: 2000544 - RNA, 20 nt, Shigella flexneri 2a str. 301
ucaucagcauaaucaccagu

SEQ ID NO: 2000545 - RNA, 15 nt, Shigella flexneri 2a str. 301
ucaucagcauucuca

SEQ ID NO: 2000546 - RNA, 22 nt, Shigella flexneri 2a str. 301
ucaucaggccuacaaaaucuau

SEQ ID NO: 2000547 - RNA, 18 nt, Shigella flexneri 2a str. 301
ucaucaggccuacaaaau

SEQ ID NO: 2000548 - RNA, 17 nt, Shigella flexneri 2a str. 301
ucaucaggccuacaaaa

SEQ ID NO: 2000549 - RNA, 18 nt, Shigella flexneri 2a str. 301
ucaucaggccuggacucu

SEQ ID NO: 2000550 - RNA, 15 nt, Shigella flexneri 2a str. 301
ucaucacugaauuuc

SEQ ID NO: 2000551 - RNA, 23 nt, Shigella flexneri 2a str. 301
ucaucacuccccgcaacagugaa

SEQ ID NO: 2000552 - RNA, 22 nt, Shigella flexneri 2a str. 301
ucaucagcaaaggcgugaacuu

SEQ ID NO: 2000553 - RNA, 21 nt, Shigella flexneri 2a str. 301
ucaucggcggcagaugacuug

SEQ ID NO: 2000554 - RNA, 16 nt, Shigella flexneri 2a str. 301
ucaucggaucauuagu

SEQ ID NO: 2000555 - RNA, 22 nt, Shigella flexneri 2a str. 301
ucaucgggaagaggaucugcuc

SEQ ID NO: 2000556 - RNA, 16 nt, Shigella flexneri 2a str. 301
ucaucggguuacugau

SEQ ID NO: 2000557 - RNA, 22 nt, Shigella flexneri 2a str. 301
ucaucggugguguaaccuucac

SEQ ID NO: 2000558 - RNA, 13 nt, Shigella flexneri 2a str. 301
ucaucguagaaca

SEQ ID NO: 2000559 - RNA, 15 nt, Shigella flexneri 2a str. 301
ucaucucuccuuucg

SEQ ID NO: 2000560 - RNA, 22 nt, Shigella flexneri 2a str. 301
ucaucucuuccggcaccacaaa

SEQ ID NO: 2000561 - RNA, 16 nt, Shigella flexneri 2a str. 301
ucaucugauaucucac

SEQ ID NO: 2000562 - RNA, 19 nt, Shigella flexneri 2a str. 301
ucaucugauaucucaccag

SEQ ID NO: 2000563 - RNA, 19 nt, Shigella flexneri 2a str. 301
ucaucuggcguaccaauca

SEQ ID NO: 2000564 - RNA, 16 nt, Shigella flexneri 2a str. 301
ucaucugaccacggcc

SEQ ID NO: 2000565 - RNA, 22 nt, Shigella flexneri 2a str. 301
ucaucugaugauauuuuucccu

SEQ ID NO: 2000566 - RNA, 19 nt, Shigella flexneri 2a str. 301
ucaucuucgaaaguagaag

SEQ ID NO: 2000567 - RNA, 19 nt, Shigella flexneri 2a str. 301
ucaucuucucuauaaaaaa

SEQ ID NO: 2000568 - RNA, 21 nt, Shigella flexneri 2a str. 301
ucaucuucacuucaucccuga

SEQ ID NO: 2000569 - RNA, 16 nt, Shigella flexneri 2a str. 301
ucaucuucauaacuuu

SEQ ID NO: 2000570 - RNA, 20 nt, Shigella flexneri 2a str. 301
ucaugccgggcaaaagucac

SEQ ID NO: 2000571 - RNA, 21 nt, Shigella flexneri 2a str. 301
ucaugccgccgcagaaaaaga

SEQ ID NO: 2000572 - RNA, 18 nt, Shigella flexneri 2a str. 301
ucaugccaaaaauaaucu

SEQ ID NO: 2000573 - RNA, 18 nt, Shigella flexneri 2a str. 301
ucaugccgaucgucuggg

SEQ ID NO: 2000574 - RNA, 18 nt, Shigella flexneri 2a str. 301
ucaugcaucgguuuugcg

SEQ ID NO: 2000575 - RNA, 12 nt, Shigella flexneri 2a str. 301
ucaugcaauaaa

SEQ ID NO: 2000576 - RNA, 15 nt, Shigella flexneri 2a str. 301
ucaugcgccagguaa

SEQ ID NO: 2000577 - RNA, 22 nt, Shigella flexneri 2a str. 301
ucaugccggccagcgccaccac

SEQ ID NO: 2000578 - RNA, 15 nt, Shigella flexneri 2a str. 301
ucaugcguuuguagg

SEQ ID NO: 2000579 - RNA, 16 nt, Shigella flexneri 2a str. 301
ucaugcuauuccuuga

SEQ ID NO: 2000580 - RNA, 20 nt, Shigella flexneri 2a str. 301
ucaugcucagaugccugaug

SEQ ID NO: 2000581 - RNA, 17 nt, Shigella flexneri 2a str. 301
ucaugaacacacccgga

SEQ ID NO: 2000582 - RNA, 17 nt, Shigella flexneri 2a str. 301
ucaugacgccaccagcg

SEQ ID NO: 2000583 - RNA, 17 nt, Shigella flexneri 2a str. 301
ucaugauacagccgaca

SEQ ID NO: 2000584 - RNA, 12 nt, Shigella flexneri 2a str. 301
ucaugaugaccg

SEQ ID NO: 2000585 - RNA, 20 nt, Shigella flexneri 2a str. 301
ucaugaugugcuucaucaga

SEQ ID NO: 2000586 - RNA, 16 nt, Shigella flexneri 2a str. 301
ucauuauuaauauuca

SEQ ID NO: 2000587 - RNA, 13 nt, Shigella flexneri 2a str. 301
ucauuauuaauuu

SEQ ID NO: 2000588 - RNA, 21 nt, Shigella flexneri 2a str. 301
ucauuaugaucaaaaucauau

SEQ ID NO: 2000589 - RNA, 15 nt, Shigella flexneri 2a str. 301
ucauuauugucggug

SEQ ID NO: 2000590 - RNA, 18 nt, Shigella flexneri 2a str. 301
ucauucaacuuaagucuc

SEQ ID NO: 2000591 - RNA, 12 nt, Shigella flexneri 2a str. 301
ucauucaagauu

SEQ ID NO: 2000592 - RNA, 13 nt, Shigella flexneri 2a str. 301
ucauucaccaguu

SEQ ID NO: 2000593 - RNA, 16 nt, Shigella flexneri 2a str. 301
ucauuaggccauuuga

SEQ ID NO: 2000594 - RNA, 14 nt, Shigella flexneri 2a str. 301
ucauuacuuacaca

SEQ ID NO: 2000595 - RNA, 22 nt, Shigella flexneri 2a str. 301
ucauuaugagugaugugcucua

SEQ ID NO: 2000596 - RNA, 16 nt, Shigella flexneri 2a str. 301
ucauuaugaucaaaau

SEQ ID NO: 2000597 - RNA, 24 nt, Shigella flexneri 2a str. 301
ucauugccagcccuuuggcuguca

SEQ ID NO: 2000598 - RNA, 20 nt, Shigella flexneri 2a str. 301
ucauucugcaaggcaaaaua

SEQ ID NO: 2000599 - RNA, 23 nt, Shigella flexneri 2a str. 301
ucauucagugacagguugcucau

SEQ ID NO: 2000600 - RNA, 18 nt, Shigella flexneri 2a str. 301
ucauuccaccgaaacuuu

SEQ ID NO: 2000601 - RNA, 19 nt, Shigella flexneri 2a str. 301
ucauucgucuccuggccgu

SEQ ID NO: 2000602 - RNA, 16 nt, Shigella flexneri 2a str. 301
ucauucgguuuucaau

SEQ ID NO: 2000603 - RNA, 19 nt, Shigella flexneri 2a str. 301
ucauucgccgguuccagcu

SEQ ID NO: 2000604 - RNA, 21 nt, Shigella flexneri 2a str. 301
ucaugucacccacugugguau

SEQ ID NO: 2000605 - RNA, 15 nt, Shigella flexneri 2a str. 301
ucauguuaaauuccg

SEQ ID NO: 2000606 - RNA, 19 nt, Shigella flexneri 2a str. 301
ucauguuaaauuccggcuc

SEQ ID NO: 2000607 - RNA, 20 nt, Shigella flexneri 2a str. 301
ucaugugcaggauuaauaaa

SEQ ID NO: 2000608 - RNA, 23 nt, Shigella flexneri 2a str. 301
ucaugugcaggauuaauaaauuu

SEQ ID NO: 2000609 - RNA, 17 nt, Shigella flexneri 2a str. 301
ucauggcugacugucgc

SEQ ID NO: 2000610 - RNA, 16 nt, Shigella flexneri 2a str. 301
ucauggcagucuuaau

SEQ ID NO: 2000611 - RNA, 15 nt, Shigella flexneri 2a str. 301
ucauuaccuucaaca

SEQ ID NO: 2000612 - RNA, 12 nt, Shigella flexneri 2a str. 301
ucauuaccuuca

SEQ ID NO: 2000613 - RNA, 15 nt, Shigella flexneri 2a str. 301
ucauuacgccaguca

SEQ ID NO: 2000614 - RNA, 14 nt, Shigella flexneri 2a str. 301
ucauuacccaaaac

SEQ ID NO: 2000615 - RNA, 17 nt, Shigella flexneri 2a str. 301
ucauuaccgaacaacaa

SEQ ID NO: 2000616 - RNA, 20 nt, Shigella flexneri 2a str. 301
ucauuaccuuauaacgcuua

SEQ ID NO: 2000617 - RNA, 11 nt, Shigella flexneri 2a str. 301
ucauuaauauc

SEQ ID NO: 2000618 - RNA, 18 nt, Shigella flexneri 2a str. 301
ucauuaauaucuuucaua

SEQ ID NO: 2000619 - RNA, 13 nt, Shigella flexneri 2a str. 301
ucauuaccaagaa

SEQ ID NO: 2000620 - RNA, 14 nt, Shigella flexneri 2a str. 301
ucauuaccaagaaa

SEQ ID NO: 2000621 - RNA, 20 nt, Shigella flexneri 2a str. 301
ucauuaaccguuuacgucau

SEQ ID NO: 2000622 - RNA, 23 nt, Shigella flexneri 2a str. 301
ucauuaagaugcauuuauauuac

SEQ ID NO: 2000623 - RNA, 13 nt, Shigella flexneri 2a str. 301
uccaacaccaggc

SEQ ID NO: 2000624 - RNA, 19 nt, Shigella flexneri 2a str. 301
uccaaauccuucagcaacu

SEQ ID NO: 2000625 - RNA, 22 nt, Shigella flexneri 2a str. 301
uccaaaucgcaguagcgggcgu

SEQ ID NO: 2000626 - RNA, 14 nt, Shigella flexneri 2a str. 301
uccaaaauaaaaau

SEQ ID NO: 2000627 - RNA, 22 nt, Shigella flexneri 2a str. 301
ucauuuuuuuaaucgucaguuu

SEQ ID NO: 2000628 - RNA, 21 nt, Shigella flexneri 2a str. 301
ucauuuacaucacgcagcugc

SEQ ID NO: 2000629 - RNA, 22 nt, Shigella flexneri 2a str. 301
ucauuuaaaaagaaaaaacuaa

SEQ ID NO: 2000630 - RNA, 14 nt, Shigella flexneri 2a str. 301
ucauuuaugcuguc

SEQ ID NO: 2000631 - RNA, 22 nt, Shigella flexneri 2a str. 301
ucauuuaugcuguccuaaaaaa

SEQ ID NO: 2000632 - RNA, 15 nt, Shigella flexneri 2a str. 301
ucauuuacuggaugg

SEQ ID NO: 2000633 - RNA, 12 nt, Shigella flexneri 2a str. 301
ucauuguuaacg

SEQ ID NO: 2000634 - RNA, 23 nt, Shigella flexneri 2a str. 301
ucauugugguucucaauuacagu

SEQ ID NO: 2000635 - RNA, 22 nt, Shigella flexneri 2a str. 301
ucauuguguacauccuaaaggc

SEQ ID NO: 2000636 - RNA, 23 nt, Shigella flexneri 2a str. 301
ucauugucgggccgcacgcugua

SEQ ID NO: 2000637 - RNA, 17 nt, Shigella flexneri 2a str. 301
ucauugguccaucuuuu

SEQ ID NO: 2000638 - RNA, 19 nt, Shigella flexneri 2a str. 301
ucauugcggcaacaaugcu

SEQ ID NO: 2000639 - RNA, 17 nt, Shigella flexneri 2a str. 301
ucauugcuaucuccugu

SEQ ID NO: 2000640 - RNA, 21 nt, Shigella flexneri 2a str. 301
ucauuucccaucucaauauua

SEQ ID NO: 2000641 - RNA, 19 nt, Shigella flexneri 2a str. 301
ucauuucccuguugccugc

SEQ ID NO: 2000642 - RNA, 22 nt, Shigella flexneri 2a str. 301
ucauuugcgcggcagucacauu

SEQ ID NO: 2000643 - RNA, 13 nt, Shigella flexneri 2a str. 301
uccauaccggacu

SEQ ID NO: 2000644 - RNA, 16 nt, Shigella flexneri 2a str. 301
uccauacccagcauca

SEQ ID NO: 2000645 - RNA, 18 nt, Shigella flexneri 2a str. 301
uccauacccagcaucagu

SEQ ID NO: 2000646 - RNA, 21 nt, Shigella flexneri 2a str. 301
uccauacuuccacuaguauuu

SEQ ID NO: 2000647 - RNA, 23 nt, Shigella flexneri 2a str. 301
uccauaguguguuccucugcucc

SEQ ID NO: 2000648 - RNA, 13 nt, Shigella flexneri 2a str. 301
uccauaagguccu

SEQ ID NO: 2000649 - RNA, 17 nt, Shigella flexneri 2a str. 301
uccauaacggaggcuuc

SEQ ID NO: 2000650 - RNA, 15 nt, Shigella flexneri 2a str. 301
uccauacaucuucau

SEQ ID NO: 2000651 - RNA, 20 nt, Shigella flexneri 2a str. 301
uccauccagcaacaacagcg

SEQ ID NO: 2000652 - RNA, 16 nt, Shigella flexneri 2a str. 301
uccaucagauucagca

SEQ ID NO: 2000653 - RNA, 14 nt, Shigella flexneri 2a str. 301
uccaucgggcuauu

SEQ ID NO: 2000654 - RNA, 17 nt, Shigella flexneri 2a str. 301
uccauccggcaacauca

SEQ ID NO: 2000655 - RNA, 18 nt, Shigella flexneri 2a str. 301
uccaucgaccaaccuugc

SEQ ID NO: 2000656 - RNA, 16 nt, Shigella flexneri 2a str. 301
uccauauugucuucaa

SEQ ID NO: 2000657 - RNA, 17 nt, Shigella flexneri 2a str. 301
uccauauggcugcauuc

SEQ ID NO: 2000658 - RNA, 18 nt, Shigella flexneri 2a str. 301
uccaucacgcugaauuua

SEQ ID NO: 2000659 - RNA, 21 nt, Shigella flexneri 2a str. 301
uccaucaacauugguguguua

SEQ ID NO: 2000660 - RNA, 16 nt, Shigella flexneri 2a str. 301
uccagugcauccagca

SEQ ID NO: 2000661 - RNA, 21 nt, Shigella flexneri 2a str. 301
uccagugcguacccagcgugu

SEQ ID NO: 2000662 - RNA, 21 nt, Shigella flexneri 2a str. 301
uccagugcguccgguuuacuu

SEQ ID NO: 2000663 - RNA, 15 nt, Shigella flexneri 2a str. 301
uccagucgcugcuga

SEQ ID NO: 2000664 - RNA, 19 nt, Shigella flexneri 2a str. 301
uccagucguuaugcacgcu

SEQ ID NO: 2000665 - RNA, 16 nt, Shigella flexneri 2a str. 301
uccagucgagaaccug

SEQ ID NO: 2000666 - RNA, 11 nt, Shigella flexneri 2a str. 301
uccaguuucac

SEQ ID NO: 2000667 - RNA, 23 nt, Shigella flexneri 2a str. 301
uccaguuugcucaaauccaucag

SEQ ID NO: 2000668 - RNA, 20 nt, Shigella flexneri 2a str. 301
uccaguuaucgcgauacacc

SEQ ID NO: 2000669 - RNA, 20 nt, Shigella flexneri 2a str. 301
uccaguuaucaagccauagc

SEQ ID NO: 2000670 - RNA, 21 nt, Shigella flexneri 2a str. 301
uccaguuccuucaacccauca

SEQ ID NO: 2000671 - RNA, 20 nt, Shigella flexneri 2a str. 301
uccagugccggaugauucac

SEQ ID NO: 2000672 - RNA, 21 nt, Shigella flexneri 2a str. 301
uccagguccuccuguaccuuc

SEQ ID NO: 2000673 - RNA, 23 nt, Shigella flexneri 2a str. 301
uccagguccuccuguaccuucac

SEQ ID NO: 2000674 - RNA, 18 nt, Shigella flexneri 2a str. 301
uccaggguaaacaucggu

SEQ ID NO: 2000675 - RNA, 15 nt, Shigella flexneri 2a str. 301
uccaggguaaacauc

SEQ ID NO: 2000676 - RNA, 22 nt, Shigella flexneri 2a str. 301
uccagggggaagcgcaccaauu

SEQ ID NO: 2000677 - RNA, 16 nt, Shigella flexneri 2a str. 301
uccagguuucuuccag

SEQ ID NO: 2000678 - RNA, 12 nt, Shigella flexneri 2a str. 301
uccaguaagcug

SEQ ID NO: 2000679 - RNA, 16 nt, Shigella flexneri 2a str. 301
uccaguaagcugugcg

SEQ ID NO: 2000680 - RNA, 22 nt, Shigella flexneri 2a str. 301
uccaguacgcguacacuuuccu

SEQ ID NO: 2000681 - RNA, 22 nt, Shigella flexneri 2a str. 301
uccaguacaugaagcacugcau

SEQ ID NO: 2000682 - RNA, 20 nt, Shigella flexneri 2a str. 301
uccaguagauucaacauaau

SEQ ID NO: 2000683 - RNA, 23 nt, Shigella flexneri 2a str. 301
uccagcgguaacuuaucuguaau

SEQ ID NO: 2000684 - RNA, 17 nt, Shigella flexneri 2a str. 301
uccagcguuaccggcuu

SEQ ID NO: 2000685 - RNA, 13 nt, Shigella flexneri 2a str. 301
uccagcucaacca

SEQ ID NO: 2000686 - RNA, 23 nt, Shigella flexneri 2a str. 301
uccagcuuauuagggaucaucuu

SEQ ID NO: 2000687 - RNA, 17 nt, Shigella flexneri 2a str. 301
uccagcuucacuuucag

SEQ ID NO: 2000688 - RNA, 18 nt, Shigella flexneri 2a str. 301
uccagcuucacuuucagu

SEQ ID NO: 2000689 - RNA, 15 nt, Shigella flexneri 2a str. 301
uccagcuuccaggca

SEQ ID NO: 2000690 - RNA, 16 nt, Shigella flexneri 2a str. 301
uccagcucuucuucac

SEQ ID NO: 2000691 - RNA, 18 nt, Shigella flexneri 2a str. 301
uccagcucuuuuccagcc

SEQ ID NO: 2000692 - RNA, 14 nt, Shigella flexneri 2a str. 301
uccagcucuucuuc

SEQ ID NO: 2000693 - RNA, 15 nt, Shigella flexneri 2a str. 301
uccagcucuucuuca

SEQ ID NO: 2000694 - RNA, 15 nt, Shigella flexneri 2a str. 301
uccagcuccguccag

SEQ ID NO: 2000695 - RNA, 13 nt, Shigella flexneri 2a str. 301
uccagggccucuc

SEQ ID NO: 2000696 - RNA, 20 nt, Shigella flexneri 2a str. 301
uccaggcugcaaagucuggg

SEQ ID NO: 2000697 - RNA, 22 nt, Shigella flexneri 2a str. 301
uccaggcugcaaagucugggcu

SEQ ID NO: 2000698 - RNA, 20 nt, Shigella flexneri 2a str. 301
uccaggcagauuuuuuaacu

SEQ ID NO: 2000699 - RNA, 17 nt, Shigella flexneri 2a str. 301
uccaggagcuccagguc

SEQ ID NO: 2000700 - RNA, 13 nt, Shigella flexneri 2a str. 301
uccaggaacucca

SEQ ID NO: 2000701 - RNA, 17 nt, Shigella flexneri 2a str. 301
uccagcgccgcggcguu

SEQ ID NO: 2000702 - RNA, 18 nt, Shigella flexneri 2a str. 301
uccagcgccaguaauucu

SEQ ID NO: 2000703 - RNA, 22 nt, Shigella flexneri 2a str. 301
uccagcgccauuggcuuuugcu

SEQ ID NO: 2000704 - RNA, 14 nt, Shigella flexneri 2a str. 301
uccagcggcaggcc

SEQ ID NO: 2000705 - RNA, 14 nt, Shigella flexneri 2a str. 301
uccagcgauaauga

SEQ ID NO: 2000706 - RNA, 16 nt, Shigella flexneri 2a str. 301
uccagcgacuccaguu

SEQ ID NO: 2000707 - RNA, 16 nt, Shigella flexneri 2a str. 301
uccagcgcaucgaucu

SEQ ID NO: 2000708 - RNA, 20 nt, Shigella flexneri 2a str. 301
uccagcgcaucccauuucuc

SEQ ID NO: 2000709 - RNA, 21 nt, Shigella flexneri 2a str. 301
uccagccguuuaccccaguca

SEQ ID NO: 2000710 - RNA, 16 nt, Shigella flexneri 2a str. 301
uccagcaucuccugca

SEQ ID NO: 2000711 - RNA, 17 nt, Shigella flexneri 2a str. 301
uccagcaucgaccagga

SEQ ID NO: 2000712 - RNA, 18 nt, Shigella flexneri 2a str. 301
uccagcauaguacgggca

SEQ ID NO: 2000713 - RNA, 22 nt, Shigella flexneri 2a str. 301
uccagcauaccuuccagcgcgu

SEQ ID NO: 2000714 - RNA, 15 nt, Shigella flexneri 2a str. 301
uccagcauaccuucc

SEQ ID NO: 2000715 - RNA, 15 nt, Shigella flexneri 2a str. 301
uccagcauaaugacu

SEQ ID NO: 2000716 - RNA, 17 nt, Shigella flexneri 2a str. 301
uccagcauaaugacucu

SEQ ID NO: 2000717 - RNA, 15 nt, Shigella flexneri 2a str. 301
uccagcccugccagg

SEQ ID NO: 2000718 - RNA, 15 nt, Shigella flexneri 2a str. 301
uccagcaacaacagc

SEQ ID NO: 2000719 - RNA, 19 nt, Shigella flexneri 2a str. 301
uccagcaacaacagcgcga

SEQ ID NO: 2000720 - RNA, 19 nt, Shigella flexneri 2a str. 301
uccagcaaccaaugccacc

SEQ ID NO: 2000721 - RNA, 10 nt, Shigella flexneri 2a str. 301
uccagcacca

SEQ ID NO: 2000722 - RNA, 22 nt, Shigella flexneri 2a str. 301
uccagauucaguuucaccgcgu

SEQ ID NO: 2000723 - RNA, 14 nt, Shigella flexneri 2a str. 301
uccagauucucaua

SEQ ID NO: 2000724 - RNA, 21 nt, Shigella flexneri 2a str. 301
uccagauuuauaaaagaaaaa

SEQ ID NO: 2000725 - RNA, 20 nt, Shigella flexneri 2a str. 301
uccagaugcgagaugucccc

SEQ ID NO: 2000726 - RNA, 20 nt, Shigella flexneri 2a str. 301
uccagcagaccuucugccag

SEQ ID NO: 2000727 - RNA, 23 nt, Shigella flexneri 2a str. 301
uccagcacuugcaggaacagugc

SEQ ID NO: 2000728 - RNA, 17 nt, Shigella flexneri 2a str. 301
uccagcacggugaagaa

SEQ ID NO: 2000729 - RNA, 14 nt, Shigella flexneri 2a str. 301
uccagcaccaguuc

SEQ ID NO: 2000730 - RNA, 13 nt, Shigella flexneri 2a str. 301
uccagcaccacuu

SEQ ID NO: 2000731 - RNA, 21 nt, Shigella flexneri 2a str. 301
uccagcaccaguucacccuca

SEQ ID NO: 2000732 - RNA, 15 nt, Shigella flexneri 2a str. 301
uccagcaccgucacc

SEQ ID NO: 2000733 - RNA, 23 nt, Shigella flexneri 2a str. 301
uccagaauaucuucaaccgucac

SEQ ID NO: 2000734 - RNA, 23 nt, Shigella flexneri 2a str. 301
uccagauagaacaucucuuccca

SEQ ID NO: 2000735 - RNA, 22 nt, Shigella flexneri 2a str. 301
uccagaucgaucauauuuccuu

SEQ ID NO: 2000736 - RNA, 20 nt, Shigella flexneri 2a str. 301
uccagauccauaagguccuc

SEQ ID NO: 2000737 - RNA, 23 nt, Shigella flexneri 2a str. 301
uccagauccauaagguccuccag

SEQ ID NO: 2000738 - RNA, 18 nt, Shigella flexneri 2a str. 301
uccagaucgaucauauuu

SEQ ID NO: 2000739 - RNA, 19 nt, Shigella flexneri 2a str. 301
uccagaucuuuuugcgcaa

SEQ ID NO: 2000740 - RNA, 18 nt, Shigella flexneri 2a str. 301
uccagaccauauuuucau

SEQ ID NO: 2000741 - RNA, 20 nt, Shigella flexneri 2a str. 301
uccagacgcgcagcuucacu

SEQ ID NO: 2000742 - RNA, 22 nt, Shigella flexneri 2a str. 301
uccagacgggucauaaucagau

SEQ ID NO: 2000743 - RNA, 16 nt, Shigella flexneri 2a str. 301
uccacuauaaaaaaac

SEQ ID NO: 2000744 - RNA, 15 nt, Shigella flexneri 2a str. 301
uccacugcgagaaaa

SEQ ID NO: 2000745 - RNA, 19 nt, Shigella flexneri 2a str. 301
uccacucauuaauuuccug

SEQ ID NO: 2000746 - RNA, 19 nt, Shigella flexneri 2a str. 301
uccacuccgguguuuucuc

SEQ ID NO: 2000747 - RNA, 20 nt, Shigella flexneri 2a str. 301
uccacuccgguguuuucucu

SEQ ID NO: 2000748 - RNA, 21 nt, Shigella flexneri 2a str. 301
uccacuucaucaagcaaggcc

SEQ ID NO: 2000749 - RNA, 17 nt, Shigella flexneri 2a str. 301
uccacuucauaauccag

SEQ ID NO: 2000750 - RNA, 13 nt, Shigella flexneri 2a str. 301
uccacuucaucaa

SEQ ID NO: 2000751 - RNA, 21 nt, Shigella flexneri 2a str. 301
uccacuuccaccacuuccugc

SEQ ID NO: 2000752 - RNA, 14 nt, Shigella flexneri 2a str. 301
uccacuuccaccac

SEQ ID NO: 2000753 - RNA, 19 nt, Shigella flexneri 2a str. 301
uccacuggcugcuuucuuu

SEQ ID NO: 2000754 - RNA, 16 nt, Shigella flexneri 2a str. 301
uccacugucaaaucca

SEQ ID NO: 2000755 - RNA, 14 nt, Shigella flexneri 2a str. 301
uccacuugaaaauu

SEQ ID NO: 2000756 - RNA, 13 nt, Shigella flexneri 2a str. 301
uccacuugaaaau

SEQ ID NO: 2000757 - RNA, 16 nt, Shigella flexneri 2a str. 301
uccacuuucacgccca

SEQ ID NO: 2000758 - RNA, 15 nt, Shigella flexneri 2a str. 301
uccacuuucgcggcu

SEQ ID NO: 2000759 - RNA, 16 nt, Shigella flexneri 2a str. 301
uccacuuucgcggcuu

SEQ ID NO: 2000760 - RNA, 21 nt, Shigella flexneri 2a str. 301
uccacggacugaacgcccacg

SEQ ID NO: 2000761 - RNA, 19 nt, Shigella flexneri 2a str. 301
uccacggggacuccacacc

SEQ ID NO: 2000762 - RNA, 19 nt, Shigella flexneri 2a str. 301
uccacgguugguuuuaucc

SEQ ID NO: 2000763 - RNA, 18 nt, Shigella flexneri 2a str. 301
uccacgguucuccacucu

SEQ ID NO: 2000764 - RNA, 17 nt, Shigella flexneri 2a str. 301
uccacgcgccacgcacg

SEQ ID NO: 2000765 - RNA, 22 nt, Shigella flexneri 2a str. 301
uccacgccguuuuuacccagca

SEQ ID NO: 2000766 - RNA, 19 nt, Shigella flexneri 2a str. 301
uccacgcuauacagcagcc

SEQ ID NO: 2000767 - RNA, 23 nt, Shigella flexneri 2a str. 301
uccacgcggguuuacuacggcuu

SEQ ID NO: 2000768 - RNA, 13 nt, Shigella flexneri 2a str. 301
uccaccuggccug

SEQ ID NO: 2000769 - RNA, 16 nt, Shigella flexneri 2a str. 301
uccaccuccagcuccg

SEQ ID NO: 2000770 - RNA, 19 nt, Shigella flexneri 2a str. 301
uccaccuccagcuccgcca

SEQ ID NO: 2000771 - RNA, 17 nt, Shigella flexneri 2a str. 301
uccacgcccagcgcagg

SEQ ID NO: 2000772 - RNA, 15 nt, Shigella flexneri 2a str. 301
uccacgauacgcugc

SEQ ID NO: 2000773 - RNA, 18 nt, Shigella flexneri 2a str. 301
uccacgacguguuccuga

SEQ ID NO: 2000774 - RNA, 13 nt, Shigella flexneri 2a str. 301
uccaccagcggcu

SEQ ID NO: 2000775 - RNA, 13 nt, Shigella flexneri 2a str. 301
uccaccagcacca

SEQ ID NO: 2000776 - RNA, 16 nt, Shigella flexneri 2a str. 301
uccaccagauggcuuu

SEQ ID NO: 2000777 - RNA, 10 nt, Shigella flexneri 2a str. 301
uccaccagug

SEQ ID NO: 2000778 - RNA, 17 nt, Shigella flexneri 2a str. 301
uccacccgcagcaagcg

SEQ ID NO: 2000779 - RNA, 19 nt, Shigella flexneri 2a str. 301
uccaccgcguucagcagcu

SEQ ID NO: 2000780 - RNA, 17 nt, Shigella flexneri 2a str. 301
uccaccgauuuugagaa

SEQ ID NO: 2000781 - RNA, 18 nt, Shigella flexneri 2a str. 301
uccaccgcguucagcagc

SEQ ID NO: 2000782 - RNA, 13 nt, Shigella flexneri 2a str. 301
uccacagucaggc

SEQ ID NO: 2000783 - RNA, 15 nt, Shigella flexneri 2a str. 301
uccacauaaaguagc

SEQ ID NO: 2000784 - RNA, 23 nt, Shigella flexneri 2a str. 301
uccacacggagaguaaugccagu

SEQ ID NO: 2000785 - RNA, 15 nt, Shigella flexneri 2a str. 301
uccacaccacuuccg

SEQ ID NO: 2000786 - RNA, 20 nt, Shigella flexneri 2a str. 301
uccacauauuauugaaauca

SEQ ID NO: 2000787 - RNA, 16 nt, Shigella flexneri 2a str. 301
uccacaucggcaucag

SEQ ID NO: 2000788 - RNA, 21 nt, Shigella flexneri 2a str. 301
uccacaugguuuucaauuauc

SEQ ID NO: 2000789 - RNA, 20 nt, Shigella flexneri 2a str. 301
uccaccacccagcgccccca

SEQ ID NO: 2000790 - RNA, 23 nt, Shigella flexneri 2a str. 301
uccaccacgcuguagccgccguc

SEQ ID NO: 2000791 - RNA, 14 nt, Shigella flexneri 2a str. 301
uccaccacguuuuu

SEQ ID NO: 2000792 - RNA, 17 nt, Shigella flexneri 2a str. 301
uccaccacguuuuucaa

SEQ ID NO: 2000793 - RNA, 18 nt, Shigella flexneri 2a str. 301
uccaagucaacgucauua

SEQ ID NO: 2000794 - RNA, 19 nt, Shigella flexneri 2a str. 301
uccaagcgcggcaggcauc

SEQ ID NO: 2000795 - RNA, 21 nt, Shigella flexneri 2a str. 301
uccacaacgugggccuggcgu

SEQ ID NO: 2000796 - RNA, 11 nt, Shigella flexneri 2a str. 301
uccacaaaccg

SEQ ID NO: 2000797 - RNA, 15 nt, Shigella flexneri 2a str. 301
uccacaagaaugccu

SEQ ID NO: 2000798 - RNA, 15 nt, Shigella flexneri 2a str. 301
uccccgagaaauacu

SEQ ID NO: 2000799 - RNA, 17 nt, Shigella flexneri 2a str. 301
ucccccgcgagaagcgg

SEQ ID NO: 2000800 - RNA, 13 nt, Shigella flexneri 2a str. 301
uccccccucugau

SEQ ID NO: 2000801 - RNA, 15 nt, Shigella flexneri 2a str. 301
uccccccaugaaaua

SEQ ID NO: 2000802 - RNA, 19 nt, Shigella flexneri 2a str. 301
uccccccggcaucgcauuc

SEQ ID NO: 2000803 - RNA, 16 nt, Shigella flexneri 2a str. 301
uccccgcuucgcccgc

SEQ ID NO: 2000804 - RNA, 13 nt, Shigella flexneri 2a str. 301
uccccgcucuccc

SEQ ID NO: 2000805 - RNA, 14 nt, Shigella flexneri 2a str. 301
uccccggaaucaga

SEQ ID NO: 2000806 - RNA, 16 nt, Shigella flexneri 2a str. 301
uccccggaaucagagg

SEQ ID NO: 2000807 - RNA, 17 nt, Shigella flexneri 2a str. 301
uccccggcagugcuuuc

SEQ ID NO: 2000808 - RNA, 16 nt, Shigella flexneri 2a str. 301
uccccgcagcccaucc

SEQ ID NO: 2000809 - RNA, 14 nt, Shigella flexneri 2a str. 301
uccccauaucaggc

SEQ ID NO: 2000810 - RNA, 23 nt, Shigella flexneri 2a str. 301
ucccccacuuuuaaaucgccaag

SEQ ID NO: 2000811 - RNA, 22 nt, Shigella flexneri 2a str. 301
uccccagaauccaggaaagcca

SEQ ID NO: 2000812 - RNA, 13 nt, Shigella flexneri 2a str. 301
uccccagacaaaa

SEQ ID NO: 2000813 - RNA, 11 nt, Shigella flexneri 2a str. 301
uccccagaccu

SEQ ID NO: 2000814 - RNA, 16 nt, Shigella flexneri 2a str. 301
uccccagaccugcugu

SEQ ID NO: 2000815 - RNA, 17 nt, Shigella flexneri 2a str. 301
uccccagaccugcuguc

SEQ ID NO: 2000816 - RNA, 17 nt, Shigella flexneri 2a str. 301
uccccagaauccaggaa

SEQ ID NO: 2000817 - RNA, 17 nt, Shigella flexneri 2a str. 301
uccccagcggaaaauau

SEQ ID NO: 2000818 - RNA, 16 nt, Shigella flexneri 2a str. 301
uccccagggaacauuu

SEQ ID NO: 2000819 - RNA, 19 nt, Shigella flexneri 2a str. 301
uccccagggaacauuucuu

SEQ ID NO: 2000820 - RNA, 16 nt, Shigella flexneri 2a str. 301
uccccaccucaucaga

SEQ ID NO: 2000821 - RNA, 23 nt, Shigella flexneri 2a str. 301
uccccacucgccccgagaaaaau

SEQ ID NO: 2000822 - RNA, 15 nt, Shigella flexneri 2a str. 301
uccccaccucaucag

SEQ ID NO: 2000823 - RNA, 15 nt, Shigella flexneri 2a str. 301
uccccaaugaccuuu

SEQ ID NO: 2000824 - RNA, 11 nt, Shigella flexneri 2a str. 301
uccccaauacg

SEQ ID NO: 2000825 - RNA, 20 nt, Shigella flexneri 2a str. 301
uccccacaggcgaugcacau

SEQ ID NO: 2000826 - RNA, 16 nt, Shigella flexneri 2a str. 301
uccccacagaaacaau

SEQ ID NO: 2000827 - RNA, 14 nt, Shigella flexneri 2a str. 301
ucccauuuuugaau

SEQ ID NO: 2000828 - RNA, 15 nt, Shigella flexneri 2a str. 301
ucccagucuucauca

SEQ ID NO: 2000829 - RNA, 16 nt, Shigella flexneri 2a str. 301
ucccaggucaggcugc

SEQ ID NO: 2000830 - RNA, 11 nt, Shigella flexneri 2a str. 301
ucccaggcacc

SEQ ID NO: 2000831 - RNA, 22 nt, Shigella flexneri 2a str. 301
ucccagccacgaugauagccau

SEQ ID NO: 2000832 - RNA, 19 nt, Shigella flexneri 2a str. 301
ucccagcguggagagcagc

SEQ ID NO: 2000833 - RNA, 22 nt, Shigella flexneri 2a str. 301
ucccagcccccgcaauuccggu

SEQ ID NO: 2000834 - RNA, 13 nt, Shigella flexneri 2a str. 301
ucccagcccagcg

SEQ ID NO: 2000835 - RNA, 13 nt, Shigella flexneri 2a str. 301
ucccagcagagau

SEQ ID NO: 2000836 - RNA, 19 nt, Shigella flexneri 2a str. 301
ucccagcagagaucuuuca

SEQ ID NO: 2000837 - RNA, 19 nt, Shigella flexneri 2a str. 301
uccaucgucuccagagcag

SEQ ID NO: 2000838 - RNA, 19 nt, Shigella flexneri 2a str. 301
uccaucguccgugaagaaa

SEQ ID NO: 2000839 - RNA, 19 nt, Shigella flexneri 2a str. 301
uccaucuuuaugaaauauc

SEQ ID NO: 2000840 - RNA, 12 nt, Shigella flexneri 2a str. 301
uccaucuguauc

SEQ ID NO: 2000841 - RNA, 23 nt, Shigella flexneri 2a str. 301
uccaucucgccauccuuacgcag

SEQ ID NO: 2000842 - RNA, 16 nt, Shigella flexneri 2a str. 301
uccauugcucuggcaa

SEQ ID NO: 2000843 - RNA, 21 nt, Shigella flexneri 2a str. 301
uccauucaccauuuuuuaauu

SEQ ID NO: 2000844 - RNA, 20 nt, Shigella flexneri 2a str. 301
uccauucaccauuuuuuaau

SEQ ID NO: 2000845 - RNA, 22 nt, Shigella flexneri 2a str. 301
uccauuaccaguccugugacuc

SEQ ID NO: 2000846 - RNA, 21 nt, Shigella flexneri 2a str. 301
uccauuggcggcguccuggaa

SEQ ID NO: 2000847 - RNA, 20 nt, Shigella flexneri 2a str. 301
uccauugggcuguuauccca

SEQ ID NO: 2000848 - RNA, 18 nt, Shigella flexneri 2a str. 301
uccauuucccugacaaau

SEQ ID NO: 2000849 - RNA, 17 nt, Shigella flexneri 2a str. 301
uccauuuuucacuuaau

SEQ ID NO: 2000850 - RNA, 21 nt, Shigella flexneri 2a str. 301
ucccaaauaugaaaucucuug

SEQ ID NO: 2000851 - RNA, 17 nt, Shigella flexneri 2a str. 301
ucccaacaacagcgcgc

SEQ ID NO: 2000852 - RNA, 17 nt, Shigella flexneri 2a str. 301
ucccaaagaucuccuca

SEQ ID NO: 2000853 - RNA, 17 nt, Shigella flexneri 2a str. 301
ucccaagugauuuuuaa

SEQ ID NO: 2000854 - RNA, 13 nt, Shigella flexneri 2a str. 301
ucccaauauugca

SEQ ID NO: 2000855 - RNA, 22 nt, Shigella flexneri 2a str. 301
ucccacagccgucgagggcaac

SEQ ID NO: 2000856 - RNA, 16 nt, Shigella flexneri 2a str. 301
ucccaccugaaauggu

SEQ ID NO: 2000857 - RNA, 19 nt, Shigella flexneri 2a str. 301
ucccacgaccgcagcauug

SEQ ID NO: 2000858 - RNA, 13 nt, Shigella flexneri 2a str. 301
ucccacgccgaau

SEQ ID NO: 2000859 - RNA, 14 nt, Shigella flexneri 2a str. 301
ucccacggugcagc

SEQ ID NO: 2000860 - RNA, 14 nt, Shigella flexneri 2a str. 301
ucccagaccuucau

SEQ ID NO: 2000861 - RNA, 17 nt, Shigella flexneri 2a str. 301
ucccagagcgggcagac

SEQ ID NO: 2000862 - RNA, 17 nt, Shigella flexneri 2a str. 301
ucccacuuuuauuucac

SEQ ID NO: 2000863 - RNA, 15 nt, Shigella flexneri 2a str. 301
ucccgacucgccauu

SEQ ID NO: 2000864 - RNA, 16 nt, Shigella flexneri 2a str. 301
ucccgauaaccgcaaa

SEQ ID NO: 2000865 - RNA, 19 nt, Shigella flexneri 2a str. 301
ucccgcaggagcgccgaau

SEQ ID NO: 2000866 - RNA, 16 nt, Shigella flexneri 2a str. 301
ucccgcagcuccagcc

SEQ ID NO: 2000867 - RNA, 19 nt, Shigella flexneri 2a str. 301
ucccgcagccacgucaccu

SEQ ID NO: 2000868 - RNA, 22 nt, Shigella flexneri 2a str. 301
ucccgcagccacgucaccugcc

SEQ ID NO: 2000869 - RNA, 22 nt, Shigella flexneri 2a str. 301
uccccucaucagugaacccaua

SEQ ID NO: 2000870 - RNA, 16 nt, Shigella flexneri 2a str. 301
uccccucaauaauaau

SEQ ID NO: 2000871 - RNA, 14 nt, Shigella flexneri 2a str. 301
uccccucgcuccuc

SEQ ID NO: 2000872 - RNA, 22 nt, Shigella flexneri 2a str. 301
uccccucgccccuucggggaga

SEQ ID NO: 2000873 - RNA, 11 nt, Shigella flexneri 2a str. 301
uccccggugaa

SEQ ID NO: 2000874 - RNA, 14 nt, Shigella flexneri 2a str. 301
ucccgaaaaaccug

SEQ ID NO: 2000875 - RNA, 13 nt, Shigella flexneri 2a str. 301
uccccugcaauau

SEQ ID NO: 2000876 - RNA, 14 nt, Shigella flexneri 2a str. 301
uccccugcgcggcg

SEQ ID NO: 2000877 - RNA, 16 nt, Shigella flexneri 2a str. 301
uccccuggggagugac

SEQ ID NO: 2000878 - RNA, 17 nt, Shigella flexneri 2a str. 301
ucccggauaucccagcu

SEQ ID NO: 2000879 - RNA, 20 nt, Shigella flexneri 2a str. 301
ucccggauaaaucuccauuu

SEQ ID NO: 2000880 - RNA, 21 nt, Shigella flexneri 2a str. 301
ucccggcaagauuccagugcc

SEQ ID NO: 2000881 - RNA, 21 nt, Shigella flexneri 2a str. 301
ucccggcaaucaccgccagcg

SEQ ID NO: 2000882 - RNA, 16 nt, Shigella flexneri 2a str. 301
ucccggaugcaccauc

SEQ ID NO: 2000883 - RNA, 19 nt, Shigella flexneri 2a str. 301
ucccgcuucguuuucagcu

SEQ ID NO: 2000884 - RNA, 12 nt, Shigella flexneri 2a str. 301
ucccgcuggugc

SEQ ID NO: 2000885 - RNA, 14 nt, Shigella flexneri 2a str. 301
ucccgcucuguaag

SEQ ID NO: 2000886 - RNA, 15 nt, Shigella flexneri 2a str. 301
ucccggcagagaaaa

SEQ ID NO: 2000887 - RNA, 13 nt, Shigella flexneri 2a str. 301
ucccggugaagcg

SEQ ID NO: 2000888 - RNA, 14 nt, Shigella flexneri 2a str. 301
ucccgguuauuaaa

SEQ ID NO: 2000889 - RNA, 17 nt, Shigella flexneri 2a str. 301
ucccggucaguagaaua

SEQ ID NO: 2000890 - RNA, 17 nt, Shigella flexneri 2a str. 301
ucccguauuacugagau

SEQ ID NO: 2000891 - RNA, 12 nt, Shigella flexneri 2a str. 301
ucccuaaaauau

SEQ ID NO: 2000892 - RNA, 14 nt, Shigella flexneri 2a str. 301
ucccuaaaauauug

SEQ ID NO: 2000893 - RNA, 19 nt, Shigella flexneri 2a str. 301
ucccuacucucgcaugggg

SEQ ID NO: 2000894 - RNA, 22 nt, Shigella flexneri 2a str. 301
ucccucaacaacagucucugcc

SEQ ID NO: 2000895 - RNA, 23 nt, Shigella flexneri 2a str. 301
ucccucaacaacagucucugccg

SEQ ID NO: 2000896 - RNA, 18 nt, Shigella flexneri 2a str. 301
ucccuccacuccgguguu

SEQ ID NO: 2000897 - RNA, 22 nt, Shigella flexneri 2a str. 301
ucccugacaaaucaugcggaua

SEQ ID NO: 2000898 - RNA, 11 nt, Shigella flexneri 2a str. 301
ucccugaaggc

SEQ ID NO: 2000899 - RNA, 20 nt, Shigella flexneri 2a str. 301
ucccugaugcaucagucacg

SEQ ID NO: 2000900 - RNA, 18 nt, Shigella flexneri 2a str. 301
ucccugacgauagauaga

SEQ ID NO: 2000901 - RNA, 16 nt, Shigella flexneri 2a str. 301
ucccugccuccaugaa

SEQ ID NO: 2000902 - RNA, 11 nt, Shigella flexneri 2a str. 301
ucccugcauau

SEQ ID NO: 2000903 - RNA, 11 nt, Shigella flexneri 2a str. 301
ucccugcggua

SEQ ID NO: 2000904 - RNA, 15 nt, Shigella flexneri 2a str. 301
ucccugcgccagcgg

SEQ ID NO: 2000905 - RNA, 16 nt, Shigella flexneri 2a str. 301
ucccugcuguccugag

SEQ ID NO: 2000906 - RNA, 15 nt, Shigella flexneri 2a str. 301
ucccugguaaaaaau

SEQ ID NO: 2000907 - RNA, 19 nt, Shigella flexneri 2a str. 301
ucccugguaaaaaaugauu

SEQ ID NO: 2000908 - RNA, 15 nt, Shigella flexneri 2a str. 301
ucccuuacccuuacu

SEQ ID NO: 2000909 - RNA, 14 nt, Shigella flexneri 2a str. 301
ucccugucucucag

SEQ ID NO: 2000910 - RNA, 13 nt, Shigella flexneri 2a str. 301
ucccuuaaaaaau

SEQ ID NO: 2000911 - RNA, 19 nt, Shigella flexneri 2a str. 301
ucccuuaacacuuguuaug

SEQ ID NO: 2000912 - RNA, 20 nt, Shigella flexneri 2a str. 301
ucccuucagccaccagguuc

SEQ ID NO: 2000913 - RNA, 21 nt, Shigella flexneri 2a str. 301
ucccuucagccaccagguuca

SEQ ID NO: 2000914 - RNA, 17 nt, Shigella flexneri 2a str. 301
ucccuucagccaccagg

SEQ ID NO: 2000915 - RNA, 18 nt, Shigella flexneri 2a str. 301
ucccuucguucucugcaa

SEQ ID NO: 2000916 - RNA, 13 nt, Shigella flexneri 2a str. 301
ucccuuucugcag

SEQ ID NO: 2000917 - RNA, 22 nt, Shigella flexneri 2a str. 301
ucccuuucagcaaaccacugau

SEQ ID NO: 2000918 - RNA, 16 nt, Shigella flexneri 2a str. 301
ucccuugcucugguuc

SEQ ID NO: 2000919 - RNA, 13 nt, Shigella flexneri 2a str. 301
uccgaaaaaggau

SEQ ID NO: 2000920 - RNA, 20 nt, Shigella flexneri 2a str. 301
uccgaagccggacugggcgc

SEQ ID NO: 2000921 - RNA, 21 nt, Shigella flexneri 2a str. 301
uccgaauacggucuuuuuaua

SEQ ID NO: 2000922 - RNA, 19 nt, Shigella flexneri 2a str. 301
uccgaccuacaaaaccugc

SEQ ID NO: 2000923 - RNA, 18 nt, Shigella flexneri 2a str. 301
uccgacauuucugcugcc

SEQ ID NO: 2000924 - RNA, 20 nt, Shigella flexneri 2a str. 301
uccgacauuucugcugccua

SEQ ID NO: 2000925 - RNA, 18 nt, Shigella flexneri 2a str. 301
uccgacaucccgccagcc

SEQ ID NO: 2000926 - RNA, 23 nt, Shigella flexneri 2a str. 301
uccgagaaucguacucaccagac

SEQ ID NO: 2000927 - RNA, 13 nt, Shigella flexneri 2a str. 301
uccgaucccugcg

SEQ ID NO: 2000928 - RNA, 15 nt, Shigella flexneri 2a str. 301
uccgagguuaauauu

SEQ ID NO: 2000929 - RNA, 16 nt, Shigella flexneri 2a str. 301
uccgauuaccggcaac

SEQ ID NO: 2000930 - RNA, 15 nt, Shigella flexneri 2a str. 301
uccgaucgcgcauca

SEQ ID NO: 2000931 - RNA, 18 nt, Shigella flexneri 2a str. 301
uccgaucgcgcaucagca

SEQ ID NO: 2000932 - RNA, 13 nt, Shigella flexneri 2a str. 301
uccgauccucacu

SEQ ID NO: 2000933 - RNA, 22 nt, Shigella flexneri 2a str. 301
uccgcaagcgaaugaggcagca

SEQ ID NO: 2000934 - RNA, 13 nt, Shigella flexneri 2a str. 301
uccgauuuguucu

SEQ ID NO: 2000935 - RNA, 22 nt, Shigella flexneri 2a str. 301
uccgauuuguucucuucugcuu

SEQ ID NO: 2000936 - RNA, 19 nt, Shigella flexneri 2a str. 301
ucgcguuacuaccggcgug

SEQ ID NO: 2000937 - RNA, 14 nt, Shigella flexneri 2a str. 301
ucgcguucggaaau

SEQ ID NO: 2000938 - RNA, 15 nt, Shigella flexneri 2a str. 301
ucgcggucaaccauc

SEQ ID NO: 2000939 - RNA, 18 nt, Shigella flexneri 2a str. 301
ucgcgguaaacugcgucg

SEQ ID NO: 2000940 - RNA, 20 nt, Shigella flexneri 2a str. 301
ucgcuacaccaaucgucaau

SEQ ID NO: 2000941 - RNA, 17 nt, Shigella flexneri 2a str. 301
ucgcguugucauacgag

SEQ ID NO: 2000942 - RNA, 13 nt, Shigella flexneri 2a str. 301
ucgcuaccuuuca

SEQ ID NO: 2000943 - RNA, 21 nt, Shigella flexneri 2a str. 301
ucgcucaucgaagagacaaaa

SEQ ID NO: 2000944 - RNA, 16 nt, Shigella flexneri 2a str. 301
ucgcucaucugcugcg

SEQ ID NO: 2000945 - RNA, 17 nt, Shigella flexneri 2a str. 301
ucgcucaauauccugac

SEQ ID NO: 2000946 - RNA, 21 nt, Shigella flexneri 2a str. 301
ucgcugauugcuuucuuucac

SEQ ID NO: 2000947 - RNA, 17 nt, Shigella flexneri 2a str. 301
ucgcugcagcucugcgc

SEQ ID NO: 2000948 - RNA, 11 nt, Shigella flexneri 2a str. 301
ucgcugccaca

SEQ ID NO: 2000949 - RNA, 15 nt, Shigella flexneri 2a str. 301
ucgcugaauaucuuu

SEQ ID NO: 2000950 - RNA, 14 nt, Shigella flexneri 2a str. 301
ucgcuucuagugcu

SEQ ID NO: 2000951 - RNA, 13 nt, Shigella flexneri 2a str. 301
ucgcuuaauugac

SEQ ID NO: 2000952 - RNA, 20 nt, Shigella flexneri 2a str. 301
ucgcuuaauggaaaacuguu

SEQ ID NO: 2000953 - RNA, 18 nt, Shigella flexneri 2a str. 301
ucgcugccgauaauacuc

SEQ ID NO: 2000954 - RNA, 17 nt, Shigella flexneri 2a str. 301
ucgcugauuugcuucaa

SEQ ID NO: 2000955 - RNA, 22 nt, Shigella flexneri 2a str. 301
ucgcuuaagccaucaucaauau

SEQ ID NO: 2000956 - RNA, 20 nt, Shigella flexneri 2a str. 301
ucggaaacaaauacaugaug

SEQ ID NO: 2000957 - RNA, 23 nt, Shigella flexneri 2a str. 301
ucggaacaacagucccaggcaga

SEQ ID NO: 2000958 - RNA, 17 nt, Shigella flexneri 2a str. 301
ucggaaauaaucaccug

SEQ ID NO: 2000959 - RNA, 21 nt, Shigella flexneri 2a str. 301
ucggaaugccggaaucagaau

SEQ ID NO: 2000960 - RNA, 13 nt, Shigella flexneri 2a str. 301
ucggaauaagacu

SEQ ID NO: 2000961 - RNA, 13 nt, Shigella flexneri 2a str. 301
ucggcacugacca

SEQ ID NO: 2000962 - RNA, 22 nt, Shigella flexneri 2a str. 301
ucggcacugaccaccaccaccu

SEQ ID NO: 2000963 - RNA, 20 nt, Shigella flexneri 2a str. 301
ucggcaccauuuaaaucaau

SEQ ID NO: 2000964 - RNA, 16 nt, Shigella flexneri 2a str. 301
ucggcaaucacgcccg

SEQ ID NO: 2000965 - RNA, 22 nt, Shigella flexneri 2a str. 301
ucggcaacuuuggguugccgcc

SEQ ID NO: 2000966 - RNA, 17 nt, Shigella flexneri 2a str. 301
ucggacgauauuuuucc

SEQ ID NO: 2000967 - RNA, 17 nt, Shigella flexneri 2a str. 301
ucgccagguuaaacauc

SEQ ID NO: 2000968 - RNA, 20 nt, Shigella flexneri 2a str. 301
ucgccaggcguuugaaaaag

SEQ ID NO: 2000969 - RNA, 18 nt, Shigella flexneri 2a str. 301
ucgccaguaccagcagcg

SEQ ID NO: 2000970 - RNA, 13 nt, Shigella flexneri 2a str. 301
ucgccgccgcugg

SEQ ID NO: 2000971 - RNA, 18 nt, Shigella flexneri 2a str. 301
ucgccgccgcaaacaucg

SEQ ID NO: 2000972 - RNA, 17 nt, Shigella flexneri 2a str. 301
ucgcgaggagaggccuu

SEQ ID NO: 2000973 - RNA, 18 nt, Shigella flexneri 2a str. 301
ucgcgacgaccacccacc

SEQ ID NO: 2000974 - RNA, 18 nt, Shigella flexneri 2a str. 301
ucgcgaccgccuucaguc

SEQ ID NO: 2000975 - RNA, 21 nt, Shigella flexneri 2a str. 301
ucgcgaccucaagcucgccac

SEQ ID NO: 2000976 - RNA, 15 nt, Shigella flexneri 2a str. 301
ucgcgagauacaucg

SEQ ID NO: 2000977 - RNA, 12 nt, Shigella flexneri 2a str. 301
ucgcgaaaugca

SEQ ID NO: 2000978 - RNA, 19 nt, Shigella flexneri 2a str. 301
ucgccuuucggcugcagca

SEQ ID NO: 2000979 - RNA, 17 nt, Shigella flexneri 2a str. 301
ucgccuccuguucugug

SEQ ID NO: 2000980 - RNA, 14 nt, Shigella flexneri 2a str. 301
ucgccucgccgaaa

SEQ ID NO: 2000981 - RNA, 16 nt, Shigella flexneri 2a str. 301
ucgccuuucggcugca

SEQ ID NO: 2000982 - RNA, 20 nt, Shigella flexneri 2a str. 301
ucgccugaauuacugggaug

SEQ ID NO: 2000983 - RNA, 24 nt, Shigella flexneri 2a str. 301
ucgcgcaauugccagacaacauga

SEQ ID NO: 2000984 - RNA, 15 nt, Shigella flexneri 2a str. 301
ucgcgcaaccagucc

SEQ ID NO: 2000985 - RNA, 20 nt, Shigella flexneri 2a str. 301
ucgcgccaaucagcgcagca

SEQ ID NO: 2000986 - RNA, 18 nt, Shigella flexneri 2a str. 301
ucgcgcccaaaccaccca

SEQ ID NO: 2000987 - RNA, 12 nt, Shigella flexneri 2a str. 301
ucgcgccagcca

SEQ ID NO: 2000988 - RNA, 17 nt, Shigella flexneri 2a str. 301
ucgcgccaucaaaucug

SEQ ID NO: 2000989 - RNA, 17 nt, Shigella flexneri 2a str. 301
ucgcgccuuacgcugcg

SEQ ID NO: 2000990 - RNA, 19 nt, Shigella flexneri 2a str. 301
ucgcgcgggaaaucaaguu

SEQ ID NO: 2000991 - RNA, 20 nt, Shigella flexneri 2a str. 301
ucgcgcuuaucgccagcgcc

SEQ ID NO: 2000992 - RNA, 22 nt, Shigella flexneri 2a str. 301
ucgcggcgauauccagcgcggc

SEQ ID NO: 2000993 - RNA, 13 nt, Shigella flexneri 2a str. 301
ucgagccuuuacg

SEQ ID NO: 2000994 - RNA, 20 nt, Shigella flexneri 2a str. 301
ucgagacgggcgaggaaauu

SEQ ID NO: 2000995 - RNA, 18 nt, Shigella flexneri 2a str. 301
ucgagauaccuaacauuu

SEQ ID NO: 2000996 - RNA, 22 nt, Shigella flexneri 2a str. 301
ucgagagaauggggucagcagg

SEQ ID NO: 2000997 - RNA, 18 nt, Shigella flexneri 2a str. 301
ucgacggggauguuccau

SEQ ID NO: 2000998 - RNA, 20 nt, Shigella flexneri 2a str. 301
ucgacggggugcgguaaaac

SEQ ID NO: 2000999 - RNA, 12 nt, Shigella flexneri 2a str. 301
ucgacgggccca

SEQ ID NO: 2001000 - RNA, 21 nt, Shigella flexneri 2a str. 301
ucgacggcuggacaaaauacu

SEQ ID NO: 2001001 - RNA, 17 nt, Shigella flexneri 2a str. 301
ucgacgagaauuuccuu

SEQ ID NO: 2001002 - RNA, 18 nt, Shigella flexneri 2a str. 301
ucgacgagaauuuccuuc

SEQ ID NO: 2001003 - RNA, 13 nt, Shigella flexneri 2a str. 301
ucgacuccuauua

SEQ ID NO: 2001004 - RNA, 12 nt, Shigella flexneri 2a str. 301
ucgaccagccag

SEQ ID NO: 2001005 - RNA, 21 nt, Shigella flexneri 2a str. 301
ucgaccaggccaucagcagcg

SEQ ID NO: 2001006 - RNA, 21 nt, Shigella flexneri 2a str. 301
ucgacaugguuggccaucgua

SEQ ID NO: 2001007 - RNA, 14 nt, Shigella flexneri 2a str. 301
ucgacaaaaucccg

SEQ ID NO: 2001008 - RNA, 18 nt, Shigella flexneri 2a str. 301
ucgacaguuucaccugcu

SEQ ID NO: 2001009 - RNA, 15 nt, Shigella flexneri 2a str. 301
ucgacaguugcugcg

SEQ ID NO: 2001010 - RNA, 14 nt, Shigella flexneri 2a str. 301
ucgacauauucacc

SEQ ID NO: 2001011 - RNA, 22 nt, Shigella flexneri 2a str. 301
ucgacaucgucuuuuucucccu

SEQ ID NO: 2001012 - RNA, 14 nt, Shigella flexneri 2a str. 301
ucgacaucugcaau

SEQ ID NO: 2001013 - RNA, 19 nt, Shigella flexneri 2a str. 301
ucgaauuacacagccacag

SEQ ID NO: 2001014 - RNA, 20 nt, Shigella flexneri 2a str. 301
uccuguugucuuuccagacu

SEQ ID NO: 2001015 - RNA, 13 nt, Shigella flexneri 2a str. 301
uccuguuucacuu

SEQ ID NO: 2001016 - RNA, 18 nt, Shigella flexneri 2a str. 301
uccuguuuuuaagugaug

SEQ ID NO: 2001017 - RNA, 17 nt, Shigella flexneri 2a str. 301
ucgaagaucagcauaau

SEQ ID NO: 2001018 - RNA, 16 nt, Shigella flexneri 2a str. 301
ucgcauuaacagccag

SEQ ID NO: 2001019 - RNA, 13 nt, Shigella flexneri 2a str. 301
ucgcauccucuuu

SEQ ID NO: 2001020 - RNA, 16 nt, Shigella flexneri 2a str. 301
ucgcauccgacaucaa

SEQ ID NO: 2001021 - RNA, 19 nt, Shigella flexneri 2a str. 301
ucgcauccgacaucaaccg

SEQ ID NO: 2001022 - RNA, 20 nt, Shigella flexneri 2a str. 301
ucgcaggcgguggaagcacc

SEQ ID NO: 2001023 - RNA, 17 nt, Shigella flexneri 2a str. 301
ucgcagcgugcucucaa

SEQ ID NO: 2001024 - RNA, 22 nt, Shigella flexneri 2a str. 301
ucgcagagaucauacagaugcu

SEQ ID NO: 2001025 - RNA, 15 nt, Shigella flexneri 2a str. 301
ucgcagacugggcaa

SEQ ID NO: 2001026 - RNA, 17 nt, Shigella flexneri 2a str. 301
ucgcagcaaacgaaagc

SEQ ID NO: 2001027 - RNA, 13 nt, Shigella flexneri 2a str. 301
ucgcagaugaauu

SEQ ID NO: 2001028 - RNA, 17 nt, Shigella flexneri 2a str. 301
ucgcaaacaguacaucu

SEQ ID NO: 2001029 - RNA, 19 nt, Shigella flexneri 2a str. 301
ucgauuuuuuccagcgcau

SEQ ID NO: 2001030 - RNA, 22 nt, Shigella flexneri 2a str. 301
ucgcaaaccacgguuucagugg

SEQ ID NO: 2001031 - RNA, 13 nt, Shigella flexneri 2a str. 301
ucgccagaaauca

SEQ ID NO: 2001032 - RNA, 22 nt, Shigella flexneri 2a str. 301
ucgccagauagauugcgcuggc

SEQ ID NO: 2001033 - RNA, 14 nt, Shigella flexneri 2a str. 301
ucgccagaaggugg

SEQ ID NO: 2001034 - RNA, 15 nt, Shigella flexneri 2a str. 301
ucgccagcggcagcu

SEQ ID NO: 2001035 - RNA, 12 nt, Shigella flexneri 2a str. 301
ucgccagcucaa

SEQ ID NO: 2001036 - RNA, 20 nt, Shigella flexneri 2a str. 301
ucgccagcgccagcgcuucc

SEQ ID NO: 2001037 - RNA, 12 nt, Shigella flexneri 2a str. 301
ucgccagcggca

SEQ ID NO: 2001038 - RNA, 18 nt, Shigella flexneri 2a str. 301
ucgauaccaucgcuucau

SEQ ID NO: 2001039 - RNA, 23 nt, Shigella flexneri 2a str. 301
ucgauacucgcagucaacaagca

SEQ ID NO: 2001040 - RNA, 14 nt, Shigella flexneri 2a str. 301
uccugccacuguuc

SEQ ID NO: 2001041 - RNA, 20 nt, Shigella flexneri 2a str. 301
uccugcacaaauuugccguc

SEQ ID NO: 2001042 - RNA, 18 nt, Shigella flexneri 2a str. 301
uccugccgaucaacugcg

SEQ ID NO: 2001043 - RNA, 23 nt, Shigella flexneri 2a str. 301
uccugcaaacaguaacccggcac

SEQ ID NO: 2001044 - RNA, 14 nt, Shigella flexneri 2a str. 301
uccugcaacagcac

SEQ ID NO: 2001045 - RNA, 17 nt, Shigella flexneri 2a str. 301
uccugauuuaacaucuc

SEQ ID NO: 2001046 - RNA, 15 nt, Shigella flexneri 2a str. 301
uccugauacaugaau

SEQ ID NO: 2001047 - RNA, 22 nt, Shigella flexneri 2a str. 301
uccugauaaaaaccauucaggc

SEQ ID NO: 2001048 - RNA, 15 nt, Shigella flexneri 2a str. 301
uccugagcacugggg

SEQ ID NO: 2001049 - RNA, 20 nt, Shigella flexneri 2a str. 301
uccugacuuugccccagcgg

SEQ ID NO: 2001050 - RNA, 18 nt, Shigella flexneri 2a str. 301
uccugguaguccaggaug

SEQ ID NO: 2001051 - RNA, 18 nt, Shigella flexneri 2a str. 301
uccuggggguucaucacc

SEQ ID NO: 2001052 - RNA, 18 nt, Shigella flexneri 2a str. 301
uccuggggucaucagcau

SEQ ID NO: 2001053 - RNA, 17 nt, Shigella flexneri 2a str. 301
uccuguuccauggugua

SEQ ID NO: 2001054 - RNA, 18 nt, Shigella flexneri 2a str. 301
uccuggucggcaaacugc

SEQ ID NO: 2001055 - RNA, 21 nt, Shigella flexneri 2a str. 301
uccuggcgguuaauaaugauu

SEQ ID NO: 2001056 - RNA, 20 nt, Shigella flexneri 2a str. 301
uccuggcgguuaauaaugau

SEQ ID NO: 2001057 - RNA, 19 nt, Shigella flexneri 2a str. 301
uccuggcgguuaauaauga

SEQ ID NO: 2001058 - RNA, 14 nt, Shigella flexneri 2a str. 301
uccuggcuuggcug

SEQ ID NO: 2001059 - RNA, 16 nt, Shigella flexneri 2a str. 301
uccuggcuuggcuggc

SEQ ID NO: 2001060 - RNA, 13 nt, Shigella flexneri 2a str. 301
uccugcgccagcc

SEQ ID NO: 2001061 - RNA, 17 nt, Shigella flexneri 2a str. 301
uccuggccgugaagaag

SEQ ID NO: 2001062 - RNA, 14 nt, Shigella flexneri 2a str. 301
uccugaagacgccu

SEQ ID NO: 2001063 - RNA, 14 nt, Shigella flexneri 2a str. 301
uccugaacuuucuc

SEQ ID NO: 2001064 - RNA, 20 nt, Shigella flexneri 2a str. 301
uccugaagacgccucgcauu

SEQ ID NO: 2001065 - RNA, 15 nt, Shigella flexneri 2a str. 301
uccugaagaugcugc

SEQ ID NO: 2001066 - RNA, 23 nt, Shigella flexneri 2a str. 301
uccugaaaccauagcaucccaau

SEQ ID NO: 2001067 - RNA, 14 nt, Shigella flexneri 2a str. 301
uccugaaaccauag

SEQ ID NO: 2001068 - RNA, 21 nt, Shigella flexneri 2a str. 301
uccugaaacgcggcguaaccg

SEQ ID NO: 2001069 - RNA, 15 nt, Shigella flexneri 2a str. 301
uccugaaauuccuga

SEQ ID NO: 2001070 - RNA, 17 nt, Shigella flexneri 2a str. 301
uccugaauggugaccug

SEQ ID NO: 2001071 - RNA, 18 nt, Shigella flexneri 2a str. 301
uccugacaagguacgaaa

SEQ ID NO: 2001072 - RNA, 18 nt, Shigella flexneri 2a str. 301
uccugacccucucggcau

SEQ ID NO: 2001073 - RNA, 20 nt, Shigella flexneri 2a str. 301
uccugacuccuguaucguca

SEQ ID NO: 2001074 - RNA, 13 nt, Shigella flexneri 2a str. 301
uccugaccaccau

SEQ ID NO: 2001075 - RNA, 15 nt, Shigella flexneri 2a str. 301
uccucuauauuucac

SEQ ID NO: 2001076 - RNA, 20 nt, Shigella flexneri 2a str. 301
uccucgaguccuuccagguc

SEQ ID NO: 2001077 - RNA, 20 nt, Shigella flexneri 2a str. 301
uccucgccguuuucuggggc

SEQ ID NO: 2001078 - RNA, 22 nt, Shigella flexneri 2a str. 301
uccucacuguuuucuaacucau

SEQ ID NO: 2001079 - RNA, 19 nt, Shigella flexneri 2a str. 301
uccuaugcaacaacugaaa

SEQ ID NO: 2001080 - RNA, 13 nt, Shigella flexneri 2a str. 301
uccucccguuaug

SEQ ID NO: 2001081 - RNA, 17 nt, Shigella flexneri 2a str. 301
uccuccguauccuguca

SEQ ID NO: 2001082 - RNA, 23 nt, Shigella flexneri 2a str. 301
uccuccguauccugucauacgcg

SEQ ID NO: 2001083 - RNA, 16 nt, Shigella flexneri 2a str. 301
uccuccugucuucccu

SEQ ID NO: 2001084 - RNA, 15 nt, Shigella flexneri 2a str. 301
uccuaacaaccaucc

SEQ ID NO: 2001085 - RNA, 21 nt, Shigella flexneri 2a str. 301
uccuacaacugggacaugauu

SEQ ID NO: 2001086 - RNA, 14 nt, Shigella flexneri 2a str. 301
uccuacacauacuu

SEQ ID NO: 2001087 - RNA, 19 nt, Shigella flexneri 2a str. 301
uccguuugcgucaugguau

SEQ ID NO: 2001088 - RNA, 14 nt, Shigella flexneri 2a str. 301
uccguuuuccagcc

SEQ ID NO: 2001089 - RNA, 16 nt, Shigella flexneri 2a str. 301
uccguuucuaucucuu

SEQ ID NO: 2001090 - RNA, 16 nt, Shigella flexneri 2a str. 301
uccguucucaccagcu

SEQ ID NO: 2001091 - RNA, 15 nt, Shigella flexneri 2a str. 301
uccguuaucacagca

SEQ ID NO: 2001092 - RNA, 21 nt, Shigella flexneri 2a str. 301
uccguuaaccgugggaaacag

SEQ ID NO: 2001093 - RNA, 20 nt, Shigella flexneri 2a str. 301
uccgucgcgaaucccgugcc

SEQ ID NO: 2001094 - RNA, 20 nt, Shigella flexneri 2a str. 301
uccgucccagccuugccaga

SEQ ID NO: 2001095 - RNA, 21 nt, Shigella flexneri 2a str. 301
uccguccuccguaucuuguca

SEQ ID NO: 2001096 - RNA, 12 nt, Shigella flexneri 2a str. 301
uccggcaccauu

SEQ ID NO: 2001097 - RNA, 15 nt, Shigella flexneri 2a str. 301
uccggcagcagaaag

SEQ ID NO: 2001098 - RNA, 22 nt, Shigella flexneri 2a str. 301
uccggcagaagcaaucauccca

SEQ ID NO: 2001099 - RNA, 16 nt, Shigella flexneri 2a str. 301
uccggcagcagaaagc

SEQ ID NO: 2001100 - RNA, 16 nt, Shigella flexneri 2a str. 301
uccggcagcaugugua

SEQ ID NO: 2001101 - RNA, 13 nt, Shigella flexneri 2a str. 301
uccggcagcgaac

SEQ ID NO: 2001102 - RNA, 14 nt, Shigella flexneri 2a str. 301
uccggcaguuucau

SEQ ID NO: 2001103 - RNA, 22 nt, Shigella flexneri 2a str. 301
uccggcauaaacaaagugcacu

SEQ ID NO: 2001104 - RNA, 17 nt, Shigella flexneri 2a str. 301
uccggcauacaguaacu

SEQ ID NO: 2001105 - RNA, 23 nt, Shigella flexneri 2a str. 301
uccggcaucaacaaagugcacgu

SEQ ID NO: 2001106 - RNA, 21 nt, Shigella flexneri 2a str. 301
uccggcauuugagcaggaugc

SEQ ID NO: 2001107 - RNA, 20 nt, Shigella flexneri 2a str. 301
uccggcaucguuugcugccu

SEQ ID NO: 2001108 - RNA, 15 nt, Shigella flexneri 2a str. 301
uccggcaccuuuuca

SEQ ID NO: 2001109 - RNA, 20 nt, Shigella flexneri 2a str. 301
uccggcaccuuuucaucagg

SEQ ID NO: 2001110 - RNA, 21 nt, Shigella flexneri 2a str. 301
uccggcaaucggugcaaaugc

SEQ ID NO: 2001111 - RNA, 23 nt, Shigella flexneri 2a str. 301
uccggcaaucggugcaaaugcca

SEQ ID NO: 2001112 - RNA, 15 nt, Shigella flexneri 2a str. 301
uccggcaauggcugc

SEQ ID NO: 2001113 - RNA, 17 nt, Shigella flexneri 2a str. 301
uccggauucaaaccuaa

SEQ ID NO: 2001114 - RNA, 19 nt, Shigella flexneri 2a str. 301
uccggacuccgcaccgccg

SEQ ID NO: 2001115 - RNA, 23 nt, Shigella flexneri 2a str. 301
uccggcgcgauaucgacgaccug

SEQ ID NO: 2001116 - RNA, 22 nt, Shigella flexneri 2a str. 301
uccggcggcacagccagcgcug

SEQ ID NO: 2001117 - RNA, 20 nt, Shigella flexneri 2a str. 301
uccggcguuuugauuuucac

SEQ ID NO: 2001118 - RNA, 17 nt, Shigella flexneri 2a str. 301
uccggcguuuucaacca

SEQ ID NO: 2001119 - RNA, 23 nt, Shigella flexneri 2a str. 301
uccggcgguaaaugcucauacca

SEQ ID NO: 2001120 - RNA, 17 nt, Shigella flexneri 2a str. 301
uccggcugccagccagg

SEQ ID NO: 2001121 - RNA, 20 nt, Shigella flexneri 2a str. 301
uccggcugaggcguuucaac

SEQ ID NO: 2001122 - RNA, 16 nt, Shigella flexneri 2a str. 301
uccggccgccacacag

SEQ ID NO: 2001123 - RNA, 15 nt, Shigella flexneri 2a str. 301
uccggcgacacaucu

SEQ ID NO: 2001124 - RNA, 23 nt, Shigella flexneri 2a str. 301
uccggcugggcgugaaucugccu

SEQ ID NO: 2001125 - RNA, 17 nt, Shigella flexneri 2a str. 301
uccggcuugaaccagcc

SEQ ID NO: 2001126 - RNA, 17 nt, Shigella flexneri 2a str. 301
uccgggagcaauuugua

SEQ ID NO: 2001127 - RNA, 20 nt, Shigella flexneri 2a str. 301
uccgggaaaacgcuggcagc

SEQ ID NO: 2001128 - RNA, 20 nt, Shigella flexneri 2a str. 301
uccgggaaauccucaaccgg

SEQ ID NO: 2001129 - RNA, 19 nt, Shigella flexneri 2a str. 301
uccgggccgaacaucagau

SEQ ID NO: 2001130 - RNA, 22 nt, Shigella flexneri 2a str. 301
uccgggccgaacaucagauaau

SEQ ID NO: 2001131 - RNA, 12 nt, Shigella flexneri 2a str. 301
uccgggccagcg

SEQ ID NO: 2001132 - RNA, 17 nt, Shigella flexneri 2a str. 301
uccgggauggucagcgg

SEQ ID NO: 2001133 - RNA, 16 nt, Shigella flexneri 2a str. 301
uccgggauggucagcg

SEQ ID NO: 2001134 - RNA, 16 nt, Shigella flexneri 2a str. 301
uccgggaucaccagac

SEQ ID NO: 2001135 - RNA, 19 nt, Shigella flexneri 2a str. 301
uccggguuugccacaucac

SEQ ID NO: 2001136 - RNA, 18 nt, Shigella flexneri 2a str. 301
uccgguaacgguguugag

SEQ ID NO: 2001137 - RNA, 12 nt, Shigella flexneri 2a str. 301
uccgguaauuuu

SEQ ID NO: 2001138 - RNA, 14 nt, Shigella flexneri 2a str. 301
uccgggucuguaaa

SEQ ID NO: 2001139 - RNA, 14 nt, Shigella flexneri 2a str. 301
uccggggaagcgca

SEQ ID NO: 2001140 - RNA, 17 nt, Shigella flexneri 2a str. 301
uccgggccgcaaaccag

SEQ ID NO: 2001141 - RNA, 23 nt, Shigella flexneri 2a str. 301
uccgggcugguuuucagcgaaac

SEQ ID NO: 2001142 - RNA, 14 nt, Shigella flexneri 2a str. 301
uccguaaaacucag

SEQ ID NO: 2001143 - RNA, 14 nt, Shigella flexneri 2a str. 301
uccguaccagccuu

SEQ ID NO: 2001144 - RNA, 14 nt, Shigella flexneri 2a str. 301
uccguaauuuuuac

SEQ ID NO: 2001145 - RNA, 18 nt, Shigella flexneri 2a str. 301
uccguauaccgucaggau

SEQ ID NO: 2001146 - RNA, 14 nt, Shigella flexneri 2a str. 301
uccguagugaaaaa

SEQ ID NO: 2001147 - RNA, 22 nt, Shigella flexneri 2a str. 301
uccgguguuuucucucucugca

SEQ ID NO: 2001148 - RNA, 16 nt, Shigella flexneri 2a str. 301
uccgguguuuucucuc

SEQ ID NO: 2001149 - RNA, 23 nt, Shigella flexneri 2a str. 301
uccgguauacgucccggugaagc

SEQ ID NO: 2001150 - RNA, 15 nt, Shigella flexneri 2a str. 301
uccggugcaacugcu

SEQ ID NO: 2001151 - RNA, 21 nt, Shigella flexneri 2a str. 301
uccgcauuuguaggcaggaua

SEQ ID NO: 2001152 - RNA, 14 nt, Shigella flexneri 2a str. 301
uccgccaauuucau

SEQ ID NO: 2001153 - RNA, 23 nt, Shigella flexneri 2a str. 301
uccgcaggugacgcgggcagcag

SEQ ID NO: 2001154 - RNA, 12 nt, Shigella flexneri 2a str. 301
uccgcaaucaaa

SEQ ID NO: 2001155 - RNA, 23 nt, Shigella flexneri 2a str. 301
uccgcaaucaaaugacugguuuu

SEQ ID NO: 2001156 - RNA, 13 nt, Shigella flexneri 2a str. 301
uccgcaaugugua

SEQ ID NO: 2001157 - RNA, 18 nt, Shigella flexneri 2a str. 301
uccgcacguuagaaacaa

SEQ ID NO: 2001158 - RNA, 16 nt, Shigella flexneri 2a str. 301
uccgcagacacuuucc

SEQ ID NO: 2001159 - RNA, 20 nt, Shigella flexneri 2a str. 301
uccgcaccugaguaauuaau

SEQ ID NO: 2001160 - RNA, 17 nt, Shigella flexneri 2a str. 301
uccgccguggaugcgau

SEQ ID NO: 2001161 - RNA, 18 nt, Shigella flexneri 2a str. 301
uccgccgucgggucagcu

SEQ ID NO: 2001162 - RNA, 19 nt, Shigella flexneri 2a str. 301
uccgccgcuguggcaggua

SEQ ID NO: 2001163 - RNA, 12 nt, Shigella flexneri 2a str. 301
uccgccgucacc

SEQ ID NO: 2001164 - RNA, 15 nt, Shigella flexneri 2a str. 301
uccgccgucaccauu

SEQ ID NO: 2001165 - RNA, 16 nt, Shigella flexneri 2a str. 301
uccgccgccagcagac

SEQ ID NO: 2001166 - RNA, 16 nt, Shigella flexneri 2a str. 301
uccgccaguuuguagc

SEQ ID NO: 2001167 - RNA, 13 nt, Shigella flexneri 2a str. 301
uccgccagcggcg

SEQ ID NO: 2001168 - RNA, 15 nt, Shigella flexneri 2a str. 301
uccgccagcgggccg

SEQ ID NO: 2001169 - RNA, 21 nt, Shigella flexneri 2a str. 301
uccgccagcuccgggcugguu

SEQ ID NO: 2001170 - RNA, 17 nt, Shigella flexneri 2a str. 301
uccgccagccuacagaa

SEQ ID NO: 2001171 - RNA, 11 nt, Shigella flexneri 2a str. 301
uccgccagcga

SEQ ID NO: 2001172 - RNA, 23 nt, Shigella flexneri 2a str. 301
uccgccucuaacagaucauccau

SEQ ID NO: 2001173 - RNA, 16 nt, Shigella flexneri 2a str. 301
uccgccucuuucacuc

SEQ ID NO: 2001174 - RNA, 17 nt, Shigella flexneri 2a str. 301
uccgcgaacagcagcgg

SEQ ID NO: 2001175 - RNA, 19 nt, Shigella flexneri 2a str. 301
uccgcgucauugacgcugg

SEQ ID NO: 2001176 - RNA, 15 nt, Shigella flexneri 2a str. 301
uccgcgccgcgguac

SEQ ID NO: 2001177 - RNA, 18 nt, Shigella flexneri 2a str. 301
uccgcuucaccaccgcaa

SEQ ID NO: 2001178 - RNA, 16 nt, Shigella flexneri 2a str. 301
uccgcuggcgucuggg

SEQ ID NO: 2001179 - RNA, 23 nt, Shigella flexneri 2a str. 301
uccgcuuuguguaaguuuaaccu

SEQ ID NO: 2001180 - RNA, 19 nt, Shigella flexneri 2a str. 301
uccgcuuucgguuuuucua

SEQ ID NO: 2001181 - RNA, 13 nt, Shigella flexneri 2a str. 301
uccgcuucugcuu

SEQ ID NO: 2001182 - RNA, 23 nt, Shigella flexneri 2a str. 301
uccggacaugcugcacgccaucu

SEQ ID NO: 2001183 - RNA, 17 nt, Shigella flexneri 2a str. 301
uccggaauacuauucac

SEQ ID NO: 2001184 - RNA, 17 nt, Shigella flexneri 2a str. 301
uccgcuaucaguucaga

SEQ ID NO: 2001185 - RNA, 21 nt, Shigella flexneri 2a str. 301
uccgcuaucaguucagaagcu

SEQ ID NO: 2001186 - RNA, 20 nt, Shigella flexneri 2a str. 301
uccgcuaguguacccuucgu

SEQ ID NO: 2001187 - RNA, 22 nt, Shigella flexneri 2a str. 301
uccgcuaccggaucgcuuucuu

SEQ ID NO: 2001188 - RNA, 15 nt, Shigella flexneri 2a str. 301
uccgcgugacgcugg

SEQ ID NO: 2001189 - RNA, 17 nt, Shigella flexneri 2a str. 301
uccgcgugacgcuggca

SEQ ID NO: 2001190 - RNA, 17 nt, Shigella flexneri 2a str. 301
uccgcgucuuaucaggc

SEQ ID NO: 2001191 - RNA, 13 nt, Shigella flexneri 2a str. 301
uccgcucuuucac

SEQ ID NO: 2001192 - RNA, 16 nt, Shigella flexneri 2a str. 301
uccgcugacagcgcgu

SEQ ID NO: 2001193 - RNA, 20 nt, Shigella flexneri 2a str. 301
uccgcucggucacugacacc

SEQ ID NO: 2001194 - RNA, 22 nt, Shigella flexneri 2a str. 301
ucucaucgccaucaauaaccag

SEQ ID NO: 2001195 - RNA, 21 nt, Shigella flexneri 2a str. 301
ucucaucgcugcgcucuaaaa

SEQ ID NO: 2001196 - RNA, 13 nt, Shigella flexneri 2a str. 301
ucucaucaguuaa

SEQ ID NO: 2001197 - RNA, 14 nt, Shigella flexneri 2a str. 301
ucuccacagucagg

SEQ ID NO: 2001198 - RNA, 21 nt, Shigella flexneri 2a str. 301
ucuccaacaucgaaaacgcca

SEQ ID NO: 2001199 - RNA, 18 nt, Shigella flexneri 2a str. 301
ucucaggacguuuucagc

SEQ ID NO: 2001200 - RNA, 19 nt, Shigella flexneri 2a str. 301
ucucaguggcuauuuacca

SEQ ID NO: 2001201 - RNA, 19 nt, Shigella flexneri 2a str. 301
ucuccauggauacauucca

SEQ ID NO: 2001202 - RNA, 16 nt, Shigella flexneri 2a str. 301
ucuccacuauaaaaaa

SEQ ID NO: 2001203 - RNA, 11 nt, Shigella flexneri 2a str. 301
ucuccccccuc

SEQ ID NO: 2001204 - RNA, 19 nt, Shigella flexneri 2a str. 301
ucuccccccucugaucagu

SEQ ID NO: 2001205 - RNA, 12 nt, Shigella flexneri 2a str. 301
ucuccccaaggg

SEQ ID NO: 2001206 - RNA, 15 nt, Shigella flexneri 2a str. 301
ucuccccaagggggc

SEQ ID NO: 2001207 - RNA, 13 nt, Shigella flexneri 2a str. 301
ucucccaguaagc

SEQ ID NO: 2001208 - RNA, 15 nt, Shigella flexneri 2a str. 301
ucuccuguuucacuu

SEQ ID NO: 2001209 - RNA, 15 nt, Shigella flexneri 2a str. 301
ucuccguucaguuua

SEQ ID NO: 2001210 - RNA, 18 nt, Shigella flexneri 2a str. 301
ucucagcacauugauggc

SEQ ID NO: 2001211 - RNA, 11 nt, Shigella flexneri 2a str. 301
ucucagcagac

SEQ ID NO: 2001212 - RNA, 20 nt, Shigella flexneri 2a str. 301
ucucacuuggguaacagccc

SEQ ID NO: 2001213 - RNA, 18 nt, Shigella flexneri 2a str. 301
ucucacuguucacuuuug

SEQ ID NO: 2001214 - RNA, 19 nt, Shigella flexneri 2a str. 301
ucucacuccagccagagcc

SEQ ID NO: 2001215 - RNA, 22 nt, Shigella flexneri 2a str. 301
ucucaccguugccaaccugaac

SEQ ID NO: 2001216 - RNA, 22 nt, Shigella flexneri 2a str. 301
ucucacccggaggaaagcaccu

SEQ ID NO: 2001217 - RNA, 15 nt, Shigella flexneri 2a str. 301
ucucaauaucaucau

SEQ ID NO: 2001218 - RNA, 12 nt, Shigella flexneri 2a str. 301
ucucaagccacu

SEQ ID NO: 2001219 - RNA, 17 nt, Shigella flexneri 2a str. 301
ucucaagccacuuuccu

SEQ ID NO: 2001220 - RNA, 18 nt, Shigella flexneri 2a str. 301
ucucaagccacuuuccuu

SEQ ID NO: 2001221 - RNA, 19 nt, Shigella flexneri 2a str. 301
ucucaaucucuuuuuccac

SEQ ID NO: 2001222 - RNA, 13 nt, Shigella flexneri 2a str. 301
ucucaaucaccac

SEQ ID NO: 2001223 - RNA, 12 nt, Shigella flexneri 2a str. 301
ucucaaucuuca

SEQ ID NO: 2001224 - RNA, 18 nt, Shigella flexneri 2a str. 301
ucucaauguauucccgua

SEQ ID NO: 2001225 - RNA, 15 nt, Shigella flexneri 2a str. 301
ucucaauuacaguuu

SEQ ID NO: 2001226 - RNA, 19 nt, Shigella flexneri 2a str. 301
ucucaauuacaguuucuga

SEQ ID NO: 2001227 - RNA, 15 nt, Shigella flexneri 2a str. 301
ucucaauuuucacuu

SEQ ID NO: 2001228 - RNA, 17 nt, Shigella flexneri 2a str. 301
ucuauugcaacauguug

SEQ ID NO: 2001229 - RNA, 18 nt, Shigella flexneri 2a str. 301
ucuauugcaacauguuga

SEQ ID NO: 2001230 - RNA, 22 nt, Shigella flexneri 2a str. 301
ucucaaccuuuccuuguaacgc

SEQ ID NO: 2001231 - RNA, 20 nt, Shigella flexneri 2a str. 301
ucuaugguuuuuucuacaca

SEQ ID NO: 2001232 - RNA, 15 nt, Shigella flexneri 2a str. 301
ucuauucaccgcauc

SEQ ID NO: 2001233 - RNA, 21 nt, Shigella flexneri 2a str. 301
ucuauucaccgcaucaauauu

SEQ ID NO: 2001234 - RNA, 13 nt, Shigella flexneri 2a str. 301
ucuaucuuucaga

SEQ ID NO: 2001235 - RNA, 20 nt, Shigella flexneri 2a str. 301
ucuaugagaaaauuucauua

SEQ ID NO: 2001236 - RNA, 10 nt, Shigella flexneri 2a str. 301
ucuaucugcc

SEQ ID NO: 2001237 - RNA, 18 nt, Shigella flexneri 2a str. 301
ucuaucaacaguuuguug

SEQ ID NO: 2001238 - RNA, 21 nt, Shigella flexneri 2a str. 301
ucuaucaaggcgauguuccuu

SEQ ID NO: 2001239 - RNA, 18 nt, Shigella flexneri 2a str. 301
ucuauauacaaucacacu

SEQ ID NO: 2001240 - RNA, 14 nt, Shigella flexneri 2a str. 301
ucuauaccgcugaa

SEQ ID NO: 2001241 - RNA, 22 nt, Shigella flexneri 2a str. 301
ucuaccuuaacgguaucuuucc

SEQ ID NO: 2001242 - RNA, 14 nt, Shigella flexneri 2a str. 301
ucuaccgccagcca

SEQ ID NO: 2001243 - RNA, 17 nt, Shigella flexneri 2a str. 301
ucuaccguuggccugau

SEQ ID NO: 2001244 - RNA, 19 nt, Shigella flexneri 2a str. 301
ucuaccgucuguaaccaga

SEQ ID NO: 2001245 - RNA, 20 nt, Shigella flexneri 2a str. 301
ucuacugaaggcgcauugcu

SEQ ID NO: 2001246 - RNA, 19 nt, Shigella flexneri 2a str. 301
ucuacagcuucacgcgcca

SEQ ID NO: 2001247 - RNA, 22 nt, Shigella flexneri 2a str. 301
ucuacacgcuaccaaaaaauca

SEQ ID NO: 2001248 - RNA, 19 nt, Shigella flexneri 2a str. 301
ucuacagaaaugaaaaaau

SEQ ID NO: 2001249 - RNA, 17 nt, Shigella flexneri 2a str. 301
ucuacacgcuaccaaaa

SEQ ID NO: 2001250 - RNA, 14 nt, Shigella flexneri 2a str. 301
ucuaccacaugauu

SEQ ID NO: 2001251 - RNA, 16 nt, Shigella flexneri 2a str. 301
ucuaccagcaccugcu

SEQ ID NO: 2001252 - RNA, 22 nt, Shigella flexneri 2a str. 301
ucuaccaugaugauaucacugg

SEQ ID NO: 2001253 - RNA, 16 nt, Shigella flexneri 2a str. 301
ucuaauccugaagacg

SEQ ID NO: 2001254 - RNA, 22 nt, Shigella flexneri 2a str. 301
ucuaauggugaacugacagcca

SEQ ID NO: 2001255 - RNA, 12 nt, Shigella flexneri 2a str. 301
ucuacaccaacg

SEQ ID NO: 2001256 - RNA, 15 nt, Shigella flexneri 2a str. 301
ucuaacagaucaucc

SEQ ID NO: 2001257 - RNA, 13 nt, Shigella flexneri 2a str. 301
ucuaaauuuugca

SEQ ID NO: 2001258 - RNA, 21 nt, Shigella flexneri 2a str. 301
ucuaacaaccuugccauucca

SEQ ID NO: 2001259 - RNA, 22 nt, Shigella flexneri 2a str. 301
ucguuuuaaugcgauccugagc

SEQ ID NO: 2001260 - RNA, 18 nt, Shigella flexneri 2a str. 301
ucguuuggggcauauuau

SEQ ID NO: 2001261 - RNA, 17 nt, Shigella flexneri 2a str. 301
ucguuugcaggccugau

SEQ ID NO: 2001262 - RNA, 22 nt, Shigella flexneri 2a str. 301
ucguugcgccgggaugauggcu

SEQ ID NO: 2001263 - RNA, 19 nt, Shigella flexneri 2a str. 301
ucguugcagaaugauggcu

SEQ ID NO: 2001264 - RNA, 19 nt, Shigella flexneri 2a str. 301
ucguugauaauaaagcuac

SEQ ID NO: 2001265 - RNA, 21 nt, Shigella flexneri 2a str. 301
ucguguugaugcuccuggcga

SEQ ID NO: 2001266 - RNA, 14 nt, Shigella flexneri 2a str. 301
ucguugaagucagg

SEQ ID NO: 2001267 - RNA, 14 nt, Shigella flexneri 2a str. 301
ucggcaucgcucca

SEQ ID NO: 2001268 - RNA, 15 nt, Shigella flexneri 2a str. 301
ucggcaucagcagaa

SEQ ID NO: 2001269 - RNA, 19 nt, Shigella flexneri 2a str. 301
ucggcaucgccaccguuau

SEQ ID NO: 2001270 - RNA, 15 nt, Shigella flexneri 2a str. 301
ucggcauucugcugg

SEQ ID NO: 2001271 - RNA, 18 nt, Shigella flexneri 2a str. 301
ucggcauucugcuggccu

SEQ ID NO: 2001272 - RNA, 19 nt, Shigella flexneri 2a str. 301
ucggcauucugcuggccug

SEQ ID NO: 2001273 - RNA, 16 nt, Shigella flexneri 2a str. 301
ucggcauggggucagg

SEQ ID NO: 2001274 - RNA, 24 nt, Shigella flexneri 2a str. 301
ucgguguuaaaacgcacgcuguca

SEQ ID NO: 2001275 - RNA, 16 nt, Shigella flexneri 2a str. 301
ucggcauaaagcugcg

SEQ ID NO: 2001276 - RNA, 13 nt, Shigella flexneri 2a str. 301
ucggcauaaucau

SEQ ID NO: 2001277 - RNA, 14 nt, Shigella flexneri 2a str. 301
ucggcagucugcug

SEQ ID NO: 2001278 - RNA, 17 nt, Shigella flexneri 2a str. 301
ucggcagcgccaaucgc

SEQ ID NO: 2001279 - RNA, 16 nt, Shigella flexneri 2a str. 301
ucgguucaauacccac

SEQ ID NO: 2001280 - RNA, 20 nt, Shigella flexneri 2a str. 301
ucgguucaagauucaguuca

SEQ ID NO: 2001281 - RNA, 18 nt, Shigella flexneri 2a str. 301
ucgguuaccacaccggca

SEQ ID NO: 2001282 - RNA, 16 nt, Shigella flexneri 2a str. 301
ucgguugccauaaccu

SEQ ID NO: 2001283 - RNA, 12 nt, Shigella flexneri 2a str. 301
ucgguugccaua

SEQ ID NO: 2001284 - RNA, 19 nt, Shigella flexneri 2a str. 301
ucgguuuaaccggccuuuu

SEQ ID NO: 2001285 - RNA, 14 nt, Shigella flexneri 2a str. 301
ucguagccaccauc

SEQ ID NO: 2001286 - RNA, 22 nt, Shigella flexneri 2a str. 301
ucguauuuauuuuccaaaauaa

SEQ ID NO: 2001287 - RNA, 20 nt, Shigella flexneri 2a str. 301
ucgucacggugcgucggcuu

SEQ ID NO: 2001288 - RNA, 13 nt, Shigella flexneri 2a str. 301
ucgucaaccugua

SEQ ID NO: 2001289 - RNA, 21 nt, Shigella flexneri 2a str. 301
ucgucaacaaacgugaagaac

SEQ ID NO: 2001290 - RNA, 13 nt, Shigella flexneri 2a str. 301
ucgucagauuuua

SEQ ID NO: 2001291 - RNA, 16 nt, Shigella flexneri 2a str. 301
ucgucaucccagucuu

SEQ ID NO: 2001292 - RNA, 20 nt, Shigella flexneri 2a str. 301
ucgugcuggauuugugucag

SEQ ID NO: 2001293 - RNA, 15 nt, Shigella flexneri 2a str. 301
ucgugcguuuguagg

SEQ ID NO: 2001294 - RNA, 17 nt, Shigella flexneri 2a str. 301
ucgugcuaacguuuagu

SEQ ID NO: 2001295 - RNA, 20 nt, Shigella flexneri 2a str. 301
ucgugcggguaaccagccaa

SEQ ID NO: 2001296 - RNA, 21 nt, Shigella flexneri 2a str. 301
ucguggcaaucguagcccagc

SEQ ID NO: 2001297 - RNA, 22 nt, Shigella flexneri 2a str. 301
ucguguggaguaauaauuucug

SEQ ID NO: 2001298 - RNA, 21 nt, Shigella flexneri 2a str. 301
ucguguaacguacugcuuugu

SEQ ID NO: 2001299 - RNA, 16 nt, Shigella flexneri 2a str. 301
ucgugguaagaaggcc

SEQ ID NO: 2001300 - RNA, 21 nt, Shigella flexneri 2a str. 301
ucgugcaccaauugccggaug

SEQ ID NO: 2001301 - RNA, 21 nt, Shigella flexneri 2a str. 301
ucgucugggcauugaaggcag

SEQ ID NO: 2001302 - RNA, 14 nt, Shigella flexneri 2a str. 301
ucgucuccuggccg

SEQ ID NO: 2001303 - RNA, 18 nt, Shigella flexneri 2a str. 301
ucuuccuggcuuggcugg

SEQ ID NO: 2001304 - RNA, 18 nt, Shigella flexneri 2a str. 301
ucuuccugauacaugaau

SEQ ID NO: 2001305 - RNA, 22 nt, Shigella flexneri 2a str. 301
ucuuccguagcggcucggaaua

SEQ ID NO: 2001306 - RNA, 18 nt, Shigella flexneri 2a str. 301
ucuuccggcgauucuuug

SEQ ID NO: 2001307 - RNA, 22 nt, Shigella flexneri 2a str. 301
ucuuccgggcuauauacccuuc

SEQ ID NO: 2001308 - RNA, 14 nt, Shigella flexneri 2a str. 301
ucuuccgcuucaau

SEQ ID NO: 2001309 - RNA, 15 nt, Shigella flexneri 2a str. 301
ucuucauuaccuuca

SEQ ID NO: 2001310 - RNA, 19 nt, Shigella flexneri 2a str. 301
ucuucauuaaaccagugcc

SEQ ID NO: 2001311 - RNA, 21 nt, Shigella flexneri 2a str. 301
ucuucccugcugaauccccuu

SEQ ID NO: 2001312 - RNA, 13 nt, Shigella flexneri 2a str. 301
ucuucccuuguua

SEQ ID NO: 2001313 - RNA, 13 nt, Shigella flexneri 2a str. 301
ucuucccuuucug

SEQ ID NO: 2001314 - RNA, 20 nt, Shigella flexneri 2a str. 301
ucuuaaucgcuucuucuuua

SEQ ID NO: 2001315 - RNA, 17 nt, Shigella flexneri 2a str. 301
ucuuaaucgcuucuucu

SEQ ID NO: 2001316 - RNA, 22 nt, Shigella flexneri 2a str. 301
ucuuacagaaaugguaaagaag

SEQ ID NO: 2001317 - RNA, 14 nt, Shigella flexneri 2a str. 301
ucuucagccugcac

SEQ ID NO: 2001318 - RNA, 17 nt, Shigella flexneri 2a str. 301
ucuucgauauugacgau

SEQ ID NO: 2001319 - RNA, 19 nt, Shigella flexneri 2a str. 301
ucuucgaguaaaaauauuu

SEQ ID NO: 2001320 - RNA, 20 nt, Shigella flexneri 2a str. 301
ucuucgacaaucgcaaauau

SEQ ID NO: 2001321 - RNA, 23 nt, Shigella flexneri 2a str. 301
ucuucgaagaucucgguaacgau

SEQ ID NO: 2001322 - RNA, 16 nt, Shigella flexneri 2a str. 301
ucuuccuucagcuccc

SEQ ID NO: 2001323 - RNA, 13 nt, Shigella flexneri 2a str. 301
ucuucgccugccu

SEQ ID NO: 2001324 - RNA, 18 nt, Shigella flexneri 2a str. 301
ucuucgccgaacacacau

SEQ ID NO: 2001325 - RNA, 19 nt, Shigella flexneri 2a str. 301
ucuucgcacuuaccuucac

SEQ ID NO: 2001326 - RNA, 20 nt, Shigella flexneri 2a str. 301
ucuucguagcguuuuuucau

SEQ ID NO: 2001327 - RNA, 21 nt, Shigella flexneri 2a str. 301
ucuucgguggucauuuuauug

SEQ ID NO: 2001328 - RNA, 13 nt, Shigella flexneri 2a str. 301
ucuucgucgucuu

SEQ ID NO: 2001329 - RNA, 15 nt, Shigella flexneri 2a str. 301
ucuucgucccagucg

SEQ ID NO: 2001330 - RNA, 20 nt, Shigella flexneri 2a str. 301
ucuucucgauaaaaccuucc

SEQ ID NO: 2001331 - RNA, 15 nt, Shigella flexneri 2a str. 301
ucuucucgauaaaac

SEQ ID NO: 2001332 - RNA, 22 nt, Shigella flexneri 2a str. 301
ucuucucaaccuuuccuuguaa

SEQ ID NO: 2001333 - RNA, 15 nt, Shigella flexneri 2a str. 301
ucuucucaacgugga

SEQ ID NO: 2001334 - RNA, 22 nt, Shigella flexneri 2a str. 301
ucuucucaacguggauaccgau

SEQ ID NO: 2001335 - RNA, 20 nt, Shigella flexneri 2a str. 301
ucuucuaacgacauuuucug

SEQ ID NO: 2001336 - RNA, 18 nt, Shigella flexneri 2a str. 301
ucuucuagcgcaauaacc

SEQ ID NO: 2001337 - RNA, 22 nt, Shigella flexneri 2a str. 301
ucuucuagcgcaauaacccuga

SEQ ID NO: 2001338 - RNA, 14 nt, Shigella flexneri 2a str. 301
ucuugauuuacuac

SEQ ID NO: 2001339 - RNA, 20 nt, Shigella flexneri 2a str. 301
ucuugccuuuccuccugucu

SEQ ID NO: 2001340 - RNA, 22 nt, Shigella flexneri 2a str. 301
ucuugccuuaaugcuugugccg

SEQ ID NO: 2001341 - RNA, 18 nt, Shigella flexneri 2a str. 301
ucuugccaucaaucacuu

SEQ ID NO: 2001342 - RNA, 16 nt, Shigella flexneri 2a str. 301
ucuuguaaauuuccca

SEQ ID NO: 2001343 - RNA, 17 nt, Shigella flexneri 2a str. 301
ucuuguaaauuucccac

SEQ ID NO: 2001344 - RNA, 16 nt, Shigella flexneri 2a str. 301
ucuuguaggccugaua

SEQ ID NO: 2001345 - RNA, 21 nt, Shigella flexneri 2a str. 301
ucuugucaggccggaauaacu

SEQ ID NO: 2001346 - RNA, 11 nt, Shigella flexneri 2a str. 301
ucuuuaaacag

SEQ ID NO: 2001347 - RNA, 15 nt, Shigella flexneri 2a str. 301
ucuuuaaacaguuuu

SEQ ID NO: 2001348 - RNA, 19 nt, Shigella flexneri 2a str. 301
ucuuuaaaucacccgugag

SEQ ID NO: 2001349 - RNA, 21 nt, Shigella flexneri 2a str. 301
ucuuuaccgcgaccaccacca

SEQ ID NO: 2001350 - RNA, 16 nt, Shigella flexneri 2a str. 301
ucuuuaguuaauuucg

SEQ ID NO: 2001351 - RNA, 13 nt, Shigella flexneri 2a str. 301
ucuugauaccaaa

SEQ ID NO: 2001352 - RNA, 13 nt, Shigella flexneri 2a str. 301
ucuugaaaccaga

SEQ ID NO: 2001353 - RNA, 12 nt, Shigella flexneri 2a str. 301
ucuugacgcuga

SEQ ID NO: 2001354 - RNA, 23 nt, Shigella flexneri 2a str. 301
ucuugacgcugauuuuuuuucaa

SEQ ID NO: 2001355 - RNA, 18 nt, Shigella flexneri 2a str. 301
ucuucuucacuucuucaa

SEQ ID NO: 2001356 - RNA, 14 nt, Shigella flexneri 2a str. 301
ucuucuucacucuc

SEQ ID NO: 2001357 - RNA, 20 nt, Shigella flexneri 2a str. 301
ucuucuugcagcuuaaucau

SEQ ID NO: 2001358 - RNA, 20 nt, Shigella flexneri 2a str. 301
ucuucuugaccguuuuacuc

SEQ ID NO: 2001359 - RNA, 15 nt, Shigella flexneri 2a str. 301
ucuucugguuuuucu

SEQ ID NO: 2001360 - RNA, 18 nt, Shigella flexneri 2a str. 301
ucuucuggguugccugau

SEQ ID NO: 2001361 - RNA, 14 nt, Shigella flexneri 2a str. 301
ucuucugcaagcau

SEQ ID NO: 2001362 - RNA, 18 nt, Shigella flexneri 2a str. 301
ucuucugcagucaccugc

SEQ ID NO: 2001363 - RNA, 21 nt, Shigella flexneri 2a str. 301
ucuucugaaaaggucacuccc

SEQ ID NO: 2001364 - RNA, 20 nt, Shigella flexneri 2a str. 301
ucugaaugguggugugcuca

SEQ ID NO: 2001365 - RNA, 21 nt, Shigella flexneri 2a str. 301
ucugaauuucagcgccugaua

SEQ ID NO: 2001366 - RNA, 12 nt, Shigella flexneri 2a str. 301
ucugaauuucag

SEQ ID NO: 2001367 - RNA, 20 nt, Shigella flexneri 2a str. 301
ucugaccacggccacagcca

SEQ ID NO: 2001368 - RNA, 19 nt, Shigella flexneri 2a str. 301
ucugacauuuuuacuccuu

SEQ ID NO: 2001369 - RNA, 17 nt, Shigella flexneri 2a str. 301
ucugagcggccuuuucc

SEQ ID NO: 2001370 - RNA, 15 nt, Shigella flexneri 2a str. 301
ucugaccggccagca

SEQ ID NO: 2001371 - RNA, 20 nt, Shigella flexneri 2a str. 301
ucugagccagcuucccaaag

SEQ ID NO: 2001372 - RNA, 18 nt, Shigella flexneri 2a str. 301
ucugauguuguuuuuaac

SEQ ID NO: 2001373 - RNA, 22 nt, Shigella flexneri 2a str. 301
ucugauuacuuccuucaugggg

SEQ ID NO: 2001374 - RNA, 17 nt, Shigella flexneri 2a str. 301
ucugauacaugcuguug

SEQ ID NO: 2001375 - RNA, 19 nt, Shigella flexneri 2a str. 301
ucugauacugcuccggcgc

SEQ ID NO: 2001376 - RNA, 24 nt, Shigella flexneri 2a str. 301
ucuccuuuauagugugcaaucacu

SEQ ID NO: 2001377 - RNA, 21 nt, Shigella flexneri 2a str. 301
ucucgcucgagagagaaaaua

SEQ ID NO: 2001378 - RNA, 22 nt, Shigella flexneri 2a str. 301
ucugaaaucaucaauaccagcc

SEQ ID NO: 2001379 - RNA, 23 nt, Shigella flexneri 2a str. 301
ucugccuugaguuuuucaucccu

SEQ ID NO: 2001380 - RNA, 18 nt, Shigella flexneri 2a str. 301
ucugccuguaugugcccg

SEQ ID NO: 2001381 - RNA, 22 nt, Shigella flexneri 2a str. 301
ucugccgggaagcucucuucca

SEQ ID NO: 2001382 - RNA, 23 nt, Shigella flexneri 2a str. 301
ucugccgggaagcucucuuccag

SEQ ID NO: 2001383 - RNA, 17 nt, Shigella flexneri 2a str. 301
ucugccugauccugggc

SEQ ID NO: 2001384 - RNA, 14 nt, Shigella flexneri 2a str. 301
ucugccucugccag

SEQ ID NO: 2001385 - RNA, 17 nt, Shigella flexneri 2a str. 301
ucugccgcuuccagcag

SEQ ID NO: 2001386 - RNA, 16 nt, Shigella flexneri 2a str. 301
ucugccggaagacaca

SEQ ID NO: 2001387 - RNA, 21 nt, Shigella flexneri 2a str. 301
ucugcccgagauacaucaccg

SEQ ID NO: 2001388 - RNA, 22 nt, Shigella flexneri 2a str. 301
ucugcccaucauaccugagugg

SEQ ID NO: 2001389 - RNA, 14 nt, Shigella flexneri 2a str. 301
ucugcccaugcugg

SEQ ID NO: 2001390 - RNA, 13 nt, Shigella flexneri 2a str. 301
ucugcauuuucuc

SEQ ID NO: 2001391 - RNA, 14 nt, Shigella flexneri 2a str. 301
ucugcauuuucucg

SEQ ID NO: 2001392 - RNA, 21 nt, Shigella flexneri 2a str. 301
ucugcauggucgauucuuaua

SEQ ID NO: 2001393 - RNA, 13 nt, Shigella flexneri 2a str. 301
ucugccacuucuu

SEQ ID NO: 2001394 - RNA, 18 nt, Shigella flexneri 2a str. 301
ucugccaguuguugcuga

SEQ ID NO: 2001395 - RNA, 21 nt, Shigella flexneri 2a str. 301
ucugccaucauggcauccugu

SEQ ID NO: 2001396 - RNA, 12 nt, Shigella flexneri 2a str. 301
ucugcagcuuua

SEQ ID NO: 2001397 - RNA, 20 nt, Shigella flexneri 2a str. 301
ucugauuuaaccaacaauaa

SEQ ID NO: 2001398 - RNA, 14 nt, Shigella flexneri 2a str. 301
ucugauugccuucc

SEQ ID NO: 2001399 - RNA, 19 nt, Shigella flexneri 2a str. 301
ucuguuugcaggugaccag

SEQ ID NO: 2001400 - RNA, 16 nt, Shigella flexneri 2a str. 301
ucuguuuccagauuuu

SEQ ID NO: 2001401 - RNA, 19 nt, Shigella flexneri 2a str. 301
ucuguugccgcuacaucac

SEQ ID NO: 2001402 - RNA, 18 nt, Shigella flexneri 2a str. 301
ucuuaaaauaguccugag

SEQ ID NO: 2001403 - RNA, 14 nt, Shigella flexneri 2a str. 301
ucugugccgcugac

SEQ ID NO: 2001404 - RNA, 15 nt, Shigella flexneri 2a str. 301
ucuguauauaaaugu

SEQ ID NO: 2001405 - RNA, 14 nt, Shigella flexneri 2a str. 301
ucuggugaccuggg

SEQ ID NO: 2001406 - RNA, 15 nt, Shigella flexneri 2a str. 301
ucuggucaugaaccu

SEQ ID NO: 2001407 - RNA, 14 nt, Shigella flexneri 2a str. 301
ucugguauuaaccg

SEQ ID NO: 2001408 - RNA, 14 nt, Shigella flexneri 2a str. 301
ucugggcugaagag

SEQ ID NO: 2001409 - RNA, 15 nt, Shigella flexneri 2a str. 301
ucuggcgauuuugaa

SEQ ID NO: 2001410 - RNA, 17 nt, Shigella flexneri 2a str. 301
ucuggggcguguuuugu

SEQ ID NO: 2001411 - RNA, 16 nt, Shigella flexneri 2a str. 301
ucuggguugccugaug

SEQ ID NO: 2001412 - RNA, 16 nt, Shigella flexneri 2a str. 301
ucuggguggcguucca

SEQ ID NO: 2001413 - RNA, 17 nt, Shigella flexneri 2a str. 301
ucugguaaaccuuccac

SEQ ID NO: 2001414 - RNA, 15 nt, Shigella flexneri 2a str. 301
ucuggcauuuggcuc

SEQ ID NO: 2001415 - RNA, 15 nt, Shigella flexneri 2a str. 301
ucuggcaccuguacc

SEQ ID NO: 2001416 - RNA, 14 nt, Shigella flexneri 2a str. 301
ucuggcacauuuug

SEQ ID NO: 2001417 - RNA, 16 nt, Shigella flexneri 2a str. 301
ucuggccguacccagc

SEQ ID NO: 2001418 - RNA, 18 nt, Shigella flexneri 2a str. 301
ucuggccugagacugaug

SEQ ID NO: 2001419 - RNA, 19 nt, Shigella flexneri 2a str. 301
ucuggcgacauuuucucua

SEQ ID NO: 2001420 - RNA, 17 nt, Shigella flexneri 2a str. 301
ucuggcgagucaccaua

SEQ ID NO: 2001421 - RNA, 22 nt, Shigella flexneri 2a str. 301
ucugcuuucauucgguuuucaa

SEQ ID NO: 2001422 - RNA, 17 nt, Shigella flexneri 2a str. 301
ucugcuuucucagcaaa

SEQ ID NO: 2001423 - RNA, 17 nt, Shigella flexneri 2a str. 301
ucugcuuuucccuccac

SEQ ID NO: 2001424 - RNA, 18 nt, Shigella flexneri 2a str. 301
ucugcuuuucccuccacu

SEQ ID NO: 2001425 - RNA, 23 nt, Shigella flexneri 2a str. 301
ucuggauccacgauuaucaccug

SEQ ID NO: 2001426 - RNA, 20 nt, Shigella flexneri 2a str. 301
ucugcuucugccugggccug

SEQ ID NO: 2001427 - RNA, 14 nt, Shigella flexneri 2a str. 301
ucugcgacuguucg

SEQ ID NO: 2001428 - RNA, 16 nt, Shigella flexneri 2a str. 301
ucugcgcacacacgcc

SEQ ID NO: 2001429 - RNA, 23 nt, Shigella flexneri 2a str. 301
ucugcgccaccacaacauuccca

SEQ ID NO: 2001430 - RNA, 13 nt, Shigella flexneri 2a str. 301
ucugcgccagcga

SEQ ID NO: 2001431 - RNA, 20 nt, Shigella flexneri 2a str. 301
ucugcgccgagggaaauaga

SEQ ID NO: 2001432 - RNA, 15 nt, Shigella flexneri 2a str. 301
ucugcgcccagcaac

SEQ ID NO: 2001433 - RNA, 21 nt, Shigella flexneri 2a str. 301
ugggauaugagcgauuuuuua

SEQ ID NO: 2001434 - RNA, 15 nt, Shigella flexneri 2a str. 301
uggcuuugcccuggc

SEQ ID NO: 2001435 - RNA, 17 nt, Shigella flexneri 2a str. 301
uggcuuugcccuuucug

SEQ ID NO: 2001436 - RNA, 16 nt, Shigella flexneri 2a str. 301
uggcuuuccgggagca

SEQ ID NO: 2001437 - RNA, 14 nt, Shigella flexneri 2a str. 301
uggcuuuccgggag

SEQ ID NO: 2001438 - RNA, 13 nt, Shigella flexneri 2a str. 301
ugggauuaaaaag

SEQ ID NO: 2001439 - RNA, 15 nt, Shigella flexneri 2a str. 301
ugggaucaaaaaugu

SEQ ID NO: 2001440 - RNA, 24 nt, Shigella flexneri 2a str. 301
ugggcaucgcgacagugcauaaau

SEQ ID NO: 2001441 - RNA, 16 nt, Shigella flexneri 2a str. 301
ugggcaauuucuuuug

SEQ ID NO: 2001442 - RNA, 22 nt, Shigella flexneri 2a str. 301
ugggcaggaaaaucagcaucaa

SEQ ID NO: 2001443 - RNA, 18 nt, Shigella flexneri 2a str. 301
ugggcauugaaggcagca

SEQ ID NO: 2001444 - RNA, 16 nt, Shigella flexneri 2a str. 301
ugggccugaaagcuca

SEQ ID NO: 2001445 - RNA, 20 nt, Shigella flexneri 2a str. 301
ugggcugacauuaucagaca

SEQ ID NO: 2001446 - RNA, 15 nt, Shigella flexneri 2a str. 301
ugggcugccccagcc

SEQ ID NO: 2001447 - RNA, 19 nt, Shigella flexneri 2a str. 301
uggggcaggggcuucuucc

SEQ ID NO: 2001448 - RNA, 22 nt, Shigella flexneri 2a str. 301
uggguaccgagaaaaucauccg

SEQ ID NO: 2001449 - RNA, 14 nt, Shigella flexneri 2a str. 301
uggguacgaaaagg

SEQ ID NO: 2001450 - RNA, 18 nt, Shigella flexneri 2a str. 301
uggguacgaaaagggcug

SEQ ID NO: 2001451 - RNA, 20 nt, Shigella flexneri 2a str. 301
uggguacgaaaagggcugga

SEQ ID NO: 2001452 - RNA, 19 nt, Shigella flexneri 2a str. 301
uggguauauuucaggccaa

SEQ ID NO: 2001453 - RNA, 21 nt, Shigella flexneri 2a str. 301
uggucuccacgcuuaacaacc

SEQ ID NO: 2001454 - RNA, 16 nt, Shigella flexneri 2a str. 301
uggucugaaucaacac

SEQ ID NO: 2001455 - RNA, 15 nt, Shigella flexneri 2a str. 301
uggugacaccaugcc

SEQ ID NO: 2001456 - RNA, 14 nt, Shigella flexneri 2a str. 301
uggugaccugcagc

SEQ ID NO: 2001457 - RNA, 17 nt, Shigella flexneri 2a str. 301
uggucgugaucaaugug

SEQ ID NO: 2001458 - RNA, 23 nt, Shigella flexneri 2a str. 301
ugguccuucaucuucaacugcca

SEQ ID NO: 2001459 - RNA, 19 nt, Shigella flexneri 2a str. 301
ugguccuggcugauugaua

SEQ ID NO: 2001460 - RNA, 14 nt, Shigella flexneri 2a str. 301
uggucgauuccucg

SEQ ID NO: 2001461 - RNA, 23 nt, Shigella flexneri 2a str. 301
ugguguugcguuuuuaucuucac

SEQ ID NO: 2001462 - RNA, 23 nt, Shigella flexneri 2a str. 301
ugguguuauaggccccugccuca

SEQ ID NO: 2001463 - RNA, 13 nt, Shigella flexneri 2a str. 301
ugguguuaaaucu

SEQ ID NO: 2001464 - RNA, 20 nt, Shigella flexneri 2a str. 301
ugguguggagugcagcaugc

SEQ ID NO: 2001465 - RNA, 15 nt, Shigella flexneri 2a str. 301
ugguggagauaaacu

SEQ ID NO: 2001466 - RNA, 14 nt, Shigella flexneri 2a str. 301
ugguggcagccagc

SEQ ID NO: 2001467 - RNA, 22 nt, Shigella flexneri 2a str. 301
uggugagccacauugcaucuga

SEQ ID NO: 2001468 - RNA, 14 nt, Shigella flexneri 2a str. 301
uggugagccugcug

SEQ ID NO: 2001469 - RNA, 17 nt, Shigella flexneri 2a str. 301
uggugagccugcugucc

SEQ ID NO: 2001470 - RNA, 23 nt, Shigella flexneri 2a str. 301
uggugauaaaacgcagucuuccc

SEQ ID NO: 2001471 - RNA, 21 nt, Shigella flexneri 2a str. 301
ugguauaaggcgcaauaauca

SEQ ID NO: 2001472 - RNA, 21 nt, Shigella flexneri 2a str. 301
ugguaucgccacaauaacugc

SEQ ID NO: 2001473 - RNA, 22 nt, Shigella flexneri 2a str. 301
ugguauaaaauagcaauauuuu

SEQ ID NO: 2001474 - RNA, 17 nt, Shigella flexneri 2a str. 301
ugguacuggugcaaaac

SEQ ID NO: 2001475 - RNA, 20 nt, Shigella flexneri 2a str. 301
ugguacuucaaucgccacca

SEQ ID NO: 2001476 - RNA, 14 nt, Shigella flexneri 2a str. 301
ugguacuuucacag

SEQ ID NO: 2001477 - RNA, 22 nt, Shigella flexneri 2a str. 301
ugguacgucaccacacgccgca

SEQ ID NO: 2001478 - RNA, 19 nt, Shigella flexneri 2a str. 301
uggucagaaaaguaaacca

SEQ ID NO: 2001479 - RNA, 12 nt, Shigella flexneri 2a str. 301
uggucagcaucg

SEQ ID NO: 2001480 - RNA, 21 nt, Shigella flexneri 2a str. 301
uggucaguaagccuuucagga

SEQ ID NO: 2001481 - RNA, 17 nt, Shigella flexneri 2a str. 301
ugguauuaaauuugcuu

SEQ ID NO: 2001482 - RNA, 17 nt, Shigella flexneri 2a str. 301
ugggugucgccuuccac

SEQ ID NO: 2001483 - RNA, 18 nt, Shigella flexneri 2a str. 301
uggguucgauuucauuca

SEQ ID NO: 2001484 - RNA, 15 nt, Shigella flexneri 2a str. 301
ugguacauaacacaa

SEQ ID NO: 2001485 - RNA, 19 nt, Shigella flexneri 2a str. 301
ugguaaaaccgacuuaaaa

SEQ ID NO: 2001486 - RNA, 16 nt, Shigella flexneri 2a str. 301
uggguuucuaauuuuu

SEQ ID NO: 2001487 - RNA, 21 nt, Shigella flexneri 2a str. 301
uguauguaggguacagcacga

SEQ ID NO: 2001488 - RNA, 22 nt, Shigella flexneri 2a str. 301
uguauuccuggccgugaagaag

SEQ ID NO: 2001489 - RNA, 13 nt, Shigella flexneri 2a str. 301
uguauucaugccc

SEQ ID NO: 2001490 - RNA, 21 nt, Shigella flexneri 2a str. 301
uguaucggcggcgauguccag

SEQ ID NO: 2001491 - RNA, 21 nt, Shigella flexneri 2a str. 301
uguaucgacgcgccagcaccg

SEQ ID NO: 2001492 - RNA, 21 nt, Shigella flexneri 2a str. 301
uguaucaacaauaaaaccagu

SEQ ID NO: 2001493 - RNA, 14 nt, Shigella flexneri 2a str. 301
uguauauaaauguu

SEQ ID NO: 2001494 - RNA, 14 nt, Shigella flexneri 2a str. 301
uguauaucaaacca

SEQ ID NO: 2001495 - RNA, 19 nt, Shigella flexneri 2a str. 301
uguagaaaaucucaaugua

SEQ ID NO: 2001496 - RNA, 13 nt, Shigella flexneri 2a str. 301
uguagaaaaucuc

SEQ ID NO: 2001497 - RNA, 18 nt, Shigella flexneri 2a str. 301
uguagaccggauaaggaa

SEQ ID NO: 2001498 - RNA, 18 nt, Shigella flexneri 2a str. 301
uguagauaaaacacucuu

SEQ ID NO: 2001499 - RNA, 19 nt, Shigella flexneri 2a str. 301
uguagcacuugcagcuccu

SEQ ID NO: 2001500 - RNA, 18 nt, Shigella flexneri 2a str. 301
uguagcguuaccagcaaa

SEQ ID NO: 2001501 - RNA, 18 nt, Shigella flexneri 2a str. 301
uguagccaauaaaugcca

SEQ ID NO: 2001502 - RNA, 19 nt, Shigella flexneri 2a str. 301
uguagccaauaaaugccac

SEQ ID NO: 2001503 - RNA, 23 nt, Shigella flexneri 2a str. 301
uguaguacccggccuguuuaucc

SEQ ID NO: 2001504 - RNA, 21 nt, Shigella flexneri 2a str. 301
uguaguccuaacagagcacug

SEQ ID NO: 2001505 - RNA, 18 nt, Shigella flexneri 2a str. 301
uguaguccuaacagagca

SEQ ID NO: 2001506 - RNA, 17 nt, Shigella flexneri 2a str. 301
uguaggccugauaagug

SEQ ID NO: 2001507 - RNA, 15 nt, Shigella flexneri 2a str. 301
uguaguucuggccuu

SEQ ID NO: 2001508 - RNA, 14 nt, Shigella flexneri 2a str. 301
uguaguuauccgca

SEQ ID NO: 2001509 - RNA, 13 nt, Shigella flexneri 2a str. 301
uguagugcuccca

SEQ ID NO: 2001510 - RNA, 14 nt, Shigella flexneri 2a str. 301
uguaaaccucuuuc

SEQ ID NO: 2001511 - RNA, 13 nt, Shigella flexneri 2a str. 301
uguaaaccucuuu

SEQ ID NO: 2001512 - RNA, 23 nt, Shigella flexneri 2a str. 301
uguaaaaccaacaguaucugaau

SEQ ID NO: 2001513 - RNA, 23 nt, Shigella flexneri 2a str. 301
uguaaaaugagugccaaaaaaau

SEQ ID NO: 2001514 - RNA, 15 nt, Shigella flexneri 2a str. 301
ugguuauauuucccc

SEQ ID NO: 2001515 - RNA, 14 nt, Shigella flexneri 2a str. 301
ugguuauauuuccc

SEQ ID NO: 2001516 - RNA, 14 nt, Shigella flexneri 2a str. 301
ugguucaagagaga

SEQ ID NO: 2001517 - RNA, 21 nt, Shigella flexneri 2a str. 301
ugguucagugggcgcugcugu

SEQ ID NO: 2001518 - RNA, 22 nt, Shigella flexneri 2a str. 301
ugguucagacgcuacuuuuuuc

SEQ ID NO: 2001519 - RNA, 22 nt, Shigella flexneri 2a str. 301
uguaaauacucuugugccaguu

SEQ ID NO: 2001520 - RNA, 21 nt, Shigella flexneri 2a str. 301
uguaacugcguuucuggcuua

SEQ ID NO: 2001521 - RNA, 19 nt, Shigella flexneri 2a str. 301
uguaacgccuuuuccagcg

SEQ ID NO: 2001522 - RNA, 17 nt, Shigella flexneri 2a str. 301
uguaaccuaauuuauua

SEQ ID NO: 2001523 - RNA, 22 nt, Shigella flexneri 2a str. 301
uguaauaguguauuaaucuauu

SEQ ID NO: 2001524 - RNA, 22 nt, Shigella flexneri 2a str. 301
uguaauuugaucgauggcagua

SEQ ID NO: 2001525 - RNA, 15 nt, Shigella flexneri 2a str. 301
uguacaacuuucucg

SEQ ID NO: 2001526 - RNA, 15 nt, Shigella flexneri 2a str. 301
uguacaaacccagcc

SEQ ID NO: 2001527 - RNA, 14 nt, Shigella flexneri 2a str. 301
uguaccacaaccug

SEQ ID NO: 2001528 - RNA, 13 nt, Shigella flexneri 2a str. 301
uguacuuuccagc

SEQ ID NO: 2001529 - RNA, 15 nt, Shigella flexneri 2a str. 301
uguacuccagcagac

SEQ ID NO: 2001530 - RNA, 18 nt, Shigella flexneri 2a str. 301
uguacgucauccguggcg

SEQ ID NO: 2001531 - RNA, 16 nt, Shigella flexneri 2a str. 301
uguaccuucagcggca

SEQ ID NO: 2001532 - RNA, 14 nt, Shigella flexneri 2a str. 301
uguacgacaaaaga

SEQ ID NO: 2001533 - RNA, 15 nt, Shigella flexneri 2a str. 301
uggcccuugcucaau

SEQ ID NO: 2001534 - RNA, 22 nt, Shigella flexneri 2a str. 301
uggccgauccggacaugcugca

SEQ ID NO: 2001535 - RNA, 13 nt, Shigella flexneri 2a str. 301
uggcccaucaucu

SEQ ID NO: 2001536 - RNA, 16 nt, Shigella flexneri 2a str. 301
uggccauuucugccag

SEQ ID NO: 2001537 - RNA, 17 nt, Shigella flexneri 2a str. 301
uggccauugagagcaac

SEQ ID NO: 2001538 - RNA, 11 nt, Shigella flexneri 2a str. 301
uggcccgccgc

SEQ ID NO: 2001539 - RNA, 22 nt, Shigella flexneri 2a str. 301
uggccccgcuuacgcugauuaa

SEQ ID NO: 2001540 - RNA, 18 nt, Shigella flexneri 2a str. 301
uggcccggaauggugcug

SEQ ID NO: 2001541 - RNA, 16 nt, Shigella flexneri 2a str. 301
uggcaucgggcacagc

SEQ ID NO: 2001542 - RNA, 19 nt, Shigella flexneri 2a str. 301
uggcaucgggcacagcggu

SEQ ID NO: 2001543 - RNA, 22 nt, Shigella flexneri 2a str. 301
uggcauccuugcuaaccaacaa

SEQ ID NO: 2001544 - RNA, 15 nt, Shigella flexneri 2a str. 301
uggcauccuguuuuc

SEQ ID NO: 2001545 - RNA, 17 nt, Shigella flexneri 2a str. 301
uggcaucgauaucaacc

SEQ ID NO: 2001546 - RNA, 19 nt, Shigella flexneri 2a str. 301
uggcaucgauaucaaccag

SEQ ID NO: 2001547 - RNA, 14 nt, Shigella flexneri 2a str. 301
uggcaucacuucuu

SEQ ID NO: 2001548 - RNA, 21 nt, Shigella flexneri 2a str. 301
uggcaucagaggaaugauuuc

SEQ ID NO: 2001549 - RNA, 18 nt, Shigella flexneri 2a str. 301
uggcauuggccguugcca

SEQ ID NO: 2001550 - RNA, 18 nt, Shigella flexneri 2a str. 301
uggcauucucacuccagc

SEQ ID NO: 2001551 - RNA, 20 nt, Shigella flexneri 2a str. 301
uggcauucucacuccagcca

SEQ ID NO: 2001552 - RNA, 17 nt, Shigella flexneri 2a str. 301
uggcauucucacuccag

SEQ ID NO: 2001553 - RNA, 17 nt, Shigella flexneri 2a str. 301
uggcauuuugcaguaac

SEQ ID NO: 2001554 - RNA, 22 nt, Shigella flexneri 2a str. 301
uggccagagugcguuccccgaa

SEQ ID NO: 2001555 - RNA, 14 nt, Shigella flexneri 2a str. 301
uggccgugcagacc

SEQ ID NO: 2001556 - RNA, 19 nt, Shigella flexneri 2a str. 301
uggcgaacccaaccgugag

SEQ ID NO: 2001557 - RNA, 18 nt, Shigella flexneri 2a str. 301
uggcgaaauguguuggca

SEQ ID NO: 2001558 - RNA, 23 nt, Shigella flexneri 2a str. 301
uggccuacgguucgggcacagau

SEQ ID NO: 2001559 - RNA, 18 nt, Shigella flexneri 2a str. 301
uggccugcucaacugcca

SEQ ID NO: 2001560 - RNA, 21 nt, Shigella flexneri 2a str. 301
uggccugagacugaugacaaa

SEQ ID NO: 2001561 - RNA, 20 nt, Shigella flexneri 2a str. 301
uggcgauaaucagcgccagc

SEQ ID NO: 2001562 - RNA, 22 nt, Shigella flexneri 2a str. 301
uggcgaucgucgcuccaugaga

SEQ ID NO: 2001563 - RNA, 18 nt, Shigella flexneri 2a str. 301
uggcgauguaauucagcc

SEQ ID NO: 2001564 - RNA, 14 nt, Shigella flexneri 2a str. 301
uggcgacaaggcgu

SEQ ID NO: 2001565 - RNA, 12 nt, Shigella flexneri 2a str. 301
uggcgagagccg

SEQ ID NO: 2001566 - RNA, 22 nt, Shigella flexneri 2a str. 301
uggcgacgccgcgguucuucca

SEQ ID NO: 2001567 - RNA, 17 nt, Shigella flexneri 2a str. 301
uggcgcacauccgcguc

SEQ ID NO: 2001568 - RNA, 16 nt, Shigella flexneri 2a str. 301
uggcgauuauuuuccg

SEQ ID NO: 2001569 - RNA, 19 nt, Shigella flexneri 2a str. 301
uggcgauguaauucagcca

SEQ ID NO: 2001570 - RNA, 21 nt, Shigella flexneri 2a str. 301
uggcgcgaaaacaacuggcaa

SEQ ID NO: 2001571 - RNA, 16 nt, Shigella flexneri 2a str. 301
uggcggaauaccgaca

SEQ ID NO: 2001572 - RNA, 19 nt, Shigella flexneri 2a str. 301
uggagcaacacgccagcgu

SEQ ID NO: 2001573 - RNA, 22 nt, Shigella flexneri 2a str. 301
uggagauauuuuuauggcaggu

SEQ ID NO: 2001574 - RNA, 16 nt, Shigella flexneri 2a str. 301
uggagauaaacuccac

SEQ ID NO: 2001575 - RNA, 19 nt, Shigella flexneri 2a str. 301
uggagcuaaacagcgcugc

SEQ ID NO: 2001576 - RNA, 16 nt, Shigella flexneri 2a str. 301
uggagugcagcaugca

SEQ ID NO: 2001577 - RNA, 15 nt, Shigella flexneri 2a str. 301
uggagugagaaugca

SEQ ID NO: 2001578 - RNA, 22 nt, Shigella flexneri 2a str. 301
uggagucauuaccgaacaacaa

SEQ ID NO: 2001579 - RNA, 15 nt, Shigella flexneri 2a str. 301
uggaguaauaauuuc

SEQ ID NO: 2001580 - RNA, 13 nt, Shigella flexneri 2a str. 301
uggaguaauaauu

SEQ ID NO: 2001581 - RNA, 18 nt, Shigella flexneri 2a str. 301
uggagggaaauuaaaugg

SEQ ID NO: 2001582 - RNA, 17 nt, Shigella flexneri 2a str. 301
uggagaguugcaccagc

SEQ ID NO: 2001583 - RNA, 22 nt, Shigella flexneri 2a str. 301
uggagaguugcaccagcaacaa

SEQ ID NO: 2001584 - RNA, 16 nt, Shigella flexneri 2a str. 301
uggagaacgccugugu

SEQ ID NO: 2001585 - RNA, 16 nt, Shigella flexneri 2a str. 301
uggagagcagcaucaa

SEQ ID NO: 2001586 - RNA, 18 nt, Shigella flexneri 2a str. 301
uggacucccagaacaacc

SEQ ID NO: 2001587 - RNA, 16 nt, Shigella flexneri 2a str. 301
uggacuugaaccagcg

SEQ ID NO: 2001588 - RNA, 18 nt, Shigella flexneri 2a str. 301
uggacuuuaugaaccuga

SEQ ID NO: 2001589 - RNA, 18 nt, Shigella flexneri 2a str. 301
uggacguuugauuuuuaa

SEQ ID NO: 2001590 - RNA, 12 nt, Shigella flexneri 2a str. 301
uggacguuacca

SEQ ID NO: 2001591 - RNA, 21 nt, Shigella flexneri 2a str. 301
uggacgcucaggcuacuuuuc

SEQ ID NO: 2001592 - RNA, 13 nt, Shigella flexneri 2a str. 301
uggacgguaaaaa

SEQ ID NO: 2001593 - RNA, 15 nt, Shigella flexneri 2a str. 301
uggaucaagccccag

SEQ ID NO: 2001594 - RNA, 19 nt, Shigella flexneri 2a str. 301
uggaucaagccccagcagg

SEQ ID NO: 2001595 - RNA, 21 nt, Shigella flexneri 2a str. 301
uggaucaagccccagcaggau

SEQ ID NO: 2001596 - RNA, 14 nt, Shigella flexneri 2a str. 301
uggaguggcccagg

SEQ ID NO: 2001597 - RNA, 13 nt, Shigella flexneri 2a str. 301
uggaguggcccag

SEQ ID NO: 2001598 - RNA, 21 nt, Shigella flexneri 2a str. 301
uggaguuaaauuaauaaucac

SEQ ID NO: 2001599 - RNA, 13 nt, Shigella flexneri 2a str. 301
uggauaaucauac

SEQ ID NO: 2001600 - RNA, 20 nt, Shigella flexneri 2a str. 301
uggauaauccaucccgcucu

SEQ ID NO: 2001601 - RNA, 15 nt, Shigella flexneri 2a str. 301
uggaucccagaagau

SEQ ID NO: 2001602 - RNA, 23 nt, Shigella flexneri 2a str. 301
uggaucaaggauugcagcacuga

SEQ ID NO: 2001603 - RNA, 18 nt, Shigella flexneri 2a str. 301
uggaucgagauugucggc

SEQ ID NO: 2001604 - RNA, 20 nt, Shigella flexneri 2a str. 301
uggaugcgauguucccccag

SEQ ID NO: 2001605 - RNA, 23 nt, Shigella flexneri 2a str. 301
uggaugcgauguucccccagcca

SEQ ID NO: 2001606 - RNA, 18 nt, Shigella flexneri 2a str. 301
uggaugaacauaaucugc

SEQ ID NO: 2001607 - RNA, 22 nt, Shigella flexneri 2a str. 301
uggauggcaaagugcaucucac

SEQ ID NO: 2001608 - RNA, 15 nt, Shigella flexneri 2a str. 301
uggcaguacgcuggg

SEQ ID NO: 2001609 - RNA, 19 nt, Shigella flexneri 2a str. 301
uggcagggaaucagauuca

SEQ ID NO: 2001610 - RNA, 14 nt, Shigella flexneri 2a str. 301
uggcauauuccgcc

SEQ ID NO: 2001611 - RNA, 23 nt, Shigella flexneri 2a str. 301
uggcauagcgggcauuuuuucca

SEQ ID NO: 2001612 - RNA, 13 nt, Shigella flexneri 2a str. 301
uggcaggcucaga

SEQ ID NO: 2001613 - RNA, 18 nt, Shigella flexneri 2a str. 301
uggcagccauaaucacuc

SEQ ID NO: 2001614 - RNA, 23 nt, Shigella flexneri 2a str. 301
uggcagccauaaucacucuuccc

SEQ ID NO: 2001615 - RNA, 22 nt, Shigella flexneri 2a str. 301
uggcagcguuaugucccgcugg

SEQ ID NO: 2001616 - RNA, 13 nt, Shigella flexneri 2a str. 301
uggcagccaggcg

SEQ ID NO: 2001617 - RNA, 15 nt, Shigella flexneri 2a str. 301
uggcagauaaacaac

SEQ ID NO: 2001618 - RNA, 22 nt, Shigella flexneri 2a str. 301
uggcagaauuugaggaagcugc

SEQ ID NO: 2001619 - RNA, 16 nt, Shigella flexneri 2a str. 301
uggcagaaacagccau

SEQ ID NO: 2001620 - RNA, 14 nt, Shigella flexneri 2a str. 301
uggcacccagcgcu

SEQ ID NO: 2001621 - RNA, 13 nt, Shigella flexneri 2a str. 301
uggcaccgcagau

SEQ ID NO: 2001622 - RNA, 22 nt, Shigella flexneri 2a str. 301
uggcacaaucucggcgcucaau

SEQ ID NO: 2001623 - RNA, 21 nt, Shigella flexneri 2a str. 301
uggcacaagaaguaacaacug

SEQ ID NO: 2001624 - RNA, 20 nt, Shigella flexneri 2a str. 301
uggcacaugcauaaagcggu

SEQ ID NO: 2001625 - RNA, 15 nt, Shigella flexneri 2a str. 301
uggcacagaagucac

SEQ ID NO: 2001626 - RNA, 16 nt, Shigella flexneri 2a str. 301
uggcacagaagucacc

SEQ ID NO: 2001627 - RNA, 18 nt, Shigella flexneri 2a str. 301
uggcaauagcggacacua

SEQ ID NO: 2001628 - RNA, 21 nt, Shigella flexneri 2a str. 301
uggcaauagcuucuuccacau

SEQ ID NO: 2001629 - RNA, 12 nt, Shigella flexneri 2a str. 301
uggcaauggcuu

SEQ ID NO: 2001630 - RNA, 20 nt, Shigella flexneri 2a str. 301
uggcaaugagcaguuugguu

SEQ ID NO: 2001631 - RNA, 15 nt, Shigella flexneri 2a str. 301
uggcaaccagcagau

SEQ ID NO: 2001632 - RNA, 16 nt, Shigella flexneri 2a str. 301
uggcaaccagcggcug

SEQ ID NO: 2001633 - RNA, 14 nt, Shigella flexneri 2a str. 301
uggcaacaauggca

SEQ ID NO: 2001634 - RNA, 17 nt, Shigella flexneri 2a str. 301
uggcaaacugaguggag

SEQ ID NO: 2001635 - RNA, 17 nt, Shigella flexneri 2a str. 301
uggcaaagguucaagca

SEQ ID NO: 2001636 - RNA, 14 nt, Shigella flexneri 2a str. 301
uggcaaacuacaaa

SEQ ID NO: 2001637 - RNA, 14 nt, Shigella flexneri 2a str. 301
uggcaaaaucaaaa

SEQ ID NO: 2001638 - RNA, 17 nt, Shigella flexneri 2a str. 301
uggcaaaacggcucuua

SEQ ID NO: 2001639 - RNA, 14 nt, Shigella flexneri 2a str. 301
uggauuaucuucac

SEQ ID NO: 2001640 - RNA, 13 nt, Shigella flexneri 2a str. 301
uggauuaucuuca

SEQ ID NO: 2001641 - RNA, 14 nt, Shigella flexneri 2a str. 301
uggauucagcaccg

SEQ ID NO: 2001642 - RNA, 13 nt, Shigella flexneri 2a str. 301
uggauucagcacc

SEQ ID NO: 2001643 - RNA, 16 nt, Shigella flexneri 2a str. 301
uggauugcugaaauac

SEQ ID NO: 2001644 - RNA, 19 nt, Shigella flexneri 2a str. 301
uggauugcugaaauacaga

SEQ ID NO: 2001645 - RNA, 21 nt, Shigella flexneri 2a str. 301
uggauuuaccguuaagcugga

SEQ ID NO: 2001646 - RNA, 15 nt, Shigella flexneri 2a str. 301
uguuugacaacucau

SEQ ID NO: 2001647 - RNA, 16 nt, Shigella flexneri 2a str. 301
uguuugaaucaacaua

SEQ ID NO: 2001648 - RNA, 18 nt, Shigella flexneri 2a str. 301
uguuugacaacucaucac

SEQ ID NO: 2001649 - RNA, 23 nt, Shigella flexneri 2a str. 301
uguuugcauccggcacaaugcuu

SEQ ID NO: 2001650 - RNA, 14 nt, Shigella flexneri 2a str. 301
uguuucugguggaa

SEQ ID NO: 2001651 - RNA, 13 nt, Shigella flexneri 2a str. 301
uguuucucuuucu

SEQ ID NO: 2001652 - RNA, 18 nt, Shigella flexneri 2a str. 301
uguuucggugaauucagc

SEQ ID NO: 2001653 - RNA, 13 nt, Shigella flexneri 2a str. 301
uguuuuauauaac

SEQ ID NO: 2001654 - RNA, 22 nt, Shigella flexneri 2a str. 301
uguuuuaacacacaauuaccuu

SEQ ID NO: 2001655 - RNA, 17 nt, Shigella flexneri 2a str. 301
uguuuuccgaugagcga

SEQ ID NO: 2001656 - RNA, 13 nt, Shigella flexneri 2a str. 301
uguuuuauguuca

SEQ ID NO: 2001657 - RNA, 14 nt, Shigella flexneri 2a str. 301
uguuuugaacuuca

SEQ ID NO: 2001658 - RNA, 11 nt, Shigella flexneri 2a str. 301
uguuuucucuc

SEQ ID NO: 2001659 - RNA, 22 nt, Shigella flexneri 2a str. 301
uguuuaucuauaacaaaacuga

SEQ ID NO: 2001660 - RNA, 23 nt, Shigella flexneri 2a str. 301
uguuuagccgcuucugcagcuuu

SEQ ID NO: 2001661 - RNA, 16 nt, Shigella flexneri 2a str. 301
uguuuagccacaccga

SEQ ID NO: 2001662 - RNA, 22 nt, Shigella flexneri 2a str. 301
uguuuagcuucugcguggccuu

SEQ ID NO: 2001663 - RNA, 19 nt, Shigella flexneri 2a str. 301
uguuuaccggugccagcaa

SEQ ID NO: 2001664 - RNA, 13 nt, Shigella flexneri 2a str. 301
uguuuaaccaaca

SEQ ID NO: 2001665 - RNA, 14 nt, Shigella flexneri 2a str. 301
uguuucaggaacac

SEQ ID NO: 2001666 - RNA, 16 nt, Shigella flexneri 2a str. 301
uguuucauaucaccgu

SEQ ID NO: 2001667 - RNA, 17 nt, Shigella flexneri 2a str. 301
uguuuccuuaugacuac

SEQ ID NO: 2001668 - RNA, 15 nt, Shigella flexneri 2a str. 301
uguuucgaucagcaa

SEQ ID NO: 2001669 - RNA, 12 nt, Shigella flexneri 2a str. 301
uguuucagaaau

SEQ ID NO: 2001670 - RNA, 13 nt, Shigella flexneri 2a str. 301
uguuuauguugug

SEQ ID NO: 2001671 - RNA, 15 nt, Shigella flexneri 2a str. 301
uguuuaucuucccag

SEQ ID NO: 2001672 - RNA, 21 nt, Shigella flexneri 2a str. 301
uuaaaguugagcgaaaacgaa

SEQ ID NO: 2001673 - RNA, 12 nt, Shigella flexneri 2a str. 301
uuaaagccggug

SEQ ID NO: 2001674 - RNA, 13 nt, Shigella flexneri 2a str. 301
uuaaaacuaaaaa

SEQ ID NO: 2001675 - RNA, 16 nt, Shigella flexneri 2a str. 301
uuaaaaccgaggggcu

SEQ ID NO: 2001676 - RNA, 17 nt, Shigella flexneri 2a str. 301
uuaaaacaauauaaccu

SEQ ID NO: 2001677 - RNA, 13 nt, Shigella flexneri 2a str. 301
uuaaaaacagcca

SEQ ID NO: 2001678 - RNA, 21 nt, Shigella flexneri 2a str. 301
uuaaaaaaggugcucaaugag

SEQ ID NO: 2001679 - RNA, 20 nt, Shigella flexneri 2a str. 301
uuaaaaagaaaaaacuaaca

SEQ ID NO: 2001680 - RNA, 15 nt, Shigella flexneri 2a str. 301
uguuuuuucaaccua

SEQ ID NO: 2001681 - RNA, 15 nt, Shigella flexneri 2a str. 301
uguuuuuaagguuuc

SEQ ID NO: 2001682 - RNA, 17 nt, Shigella flexneri 2a str. 301
uguuuuuaguuaaaucg

SEQ ID NO: 2001683 - RNA, 16 nt, Shigella flexneri 2a str. 301
uguuaucccgaugaug

SEQ ID NO: 2001684 - RNA, 15 nt, Shigella flexneri 2a str. 301
uguuaaggaaauccu

SEQ ID NO: 2001685 - RNA, 15 nt, Shigella flexneri 2a str. 301
uguuaucgaguucau

SEQ ID NO: 2001686 - RNA, 19 nt, Shigella flexneri 2a str. 301
uguuaucguuugcauuauc

SEQ ID NO: 2001687 - RNA, 12 nt, Shigella flexneri 2a str. 301
uguucacugccg

SEQ ID NO: 2001688 - RNA, 18 nt, Shigella flexneri 2a str. 301
uguucagauggccaauaa

SEQ ID NO: 2001689 - RNA, 14 nt, Shigella flexneri 2a str. 301
uguucagauggcca

SEQ ID NO: 2001690 - RNA, 13 nt, Shigella flexneri 2a str. 301
uguucagauaaug

SEQ ID NO: 2001691 - RNA, 17 nt, Shigella flexneri 2a str. 301
uguucagaaugcccacg

SEQ ID NO: 2001692 - RNA, 13 nt, Shigella flexneri 2a str. 301
uguucagcaaaug

SEQ ID NO: 2001693 - RNA, 22 nt, Shigella flexneri 2a str. 301
uguucagcgggcagggcaucaa

SEQ ID NO: 2001694 - RNA, 18 nt, Shigella flexneri 2a str. 301
uguucagcgggcagggca

SEQ ID NO: 2001695 - RNA, 19 nt, Shigella flexneri 2a str. 301
uguuauuuaauuacugaga

SEQ ID NO: 2001696 - RNA, 19 nt, Shigella flexneri 2a str. 301
uguucacgaaaacagcgca

SEQ ID NO: 2001697 - RNA, 13 nt, Shigella flexneri 2a str. 301
uguuccgucagcc

SEQ ID NO: 2001698 - RNA, 22 nt, Shigella flexneri 2a str. 301
uguuccggcuuucugggaugau

SEQ ID NO: 2001699 - RNA, 12 nt, Shigella flexneri 2a str. 301
uguuccucugcu

SEQ ID NO: 2001700 - RNA, 14 nt, Shigella flexneri 2a str. 301
uguuccucugcucc

SEQ ID NO: 2001701 - RNA, 20 nt, Shigella flexneri 2a str. 301
uguuccugaacgcccgcaua

SEQ ID NO: 2001702 - RNA, 20 nt, Shigella flexneri 2a str. 301
uguucguuguaucaacagcg

SEQ ID NO: 2001703 - RNA, 23 nt, Shigella flexneri 2a str. 301
uguuccagacgcugcauugacaa

SEQ ID NO: 2001704 - RNA, 18 nt, Shigella flexneri 2a str. 301
uguuccaguugauacagg

SEQ ID NO: 2001705 - RNA, 12 nt, Shigella flexneri 2a str. 301
uguuccagugcg

SEQ ID NO: 2001706 - RNA, 16 nt, Shigella flexneri 2a str. 301
uguuccagcaaauccc

SEQ ID NO: 2001707 - RNA, 21 nt, Shigella flexneri 2a str. 301
uguuccacucuuucagcacca

SEQ ID NO: 2001708 - RNA, 18 nt, Shigella flexneri 2a str. 301
uguucccgcgccucaggc

SEQ ID NO: 2001709 - RNA, 15 nt, Shigella flexneri 2a str. 301
uguuccgccagcgac

SEQ ID NO: 2001710 - RNA, 15 nt, Shigella flexneri 2a str. 301
uguuccaucuuuaug

SEQ ID NO: 2001711 - RNA, 16 nt, Shigella flexneri 2a str. 301
uguugcaggaacagaa

SEQ ID NO: 2001712 - RNA, 14 nt, Shigella flexneri 2a str. 301
uguugcugaaauuc

SEQ ID NO: 2001713 - RNA, 18 nt, Shigella flexneri 2a str. 301
uguugcugccgacaaaug

SEQ ID NO: 2001714 - RNA, 14 nt, Shigella flexneri 2a str. 301
uguuggauccccug

SEQ ID NO: 2001715 - RNA, 16 nt, Shigella flexneri 2a str. 301
uguuggaacccgcagc

SEQ ID NO: 2001716 - RNA, 20 nt, Shigella flexneri 2a str. 301
uguugcaccgaguucuucac

SEQ ID NO: 2001717 - RNA, 19 nt, Shigella flexneri 2a str. 301
uguugcaccaucaggcaua

SEQ ID NO: 2001718 - RNA, 23 nt, Shigella flexneri 2a str. 301
uguugcaggaaaagguaggccug

SEQ ID NO: 2001719 - RNA, 13 nt, Shigella flexneri 2a str. 301
uguugcaaacuga

SEQ ID NO: 2001720 - RNA, 21 nt, Shigella flexneri 2a str. 301
uguugauuucccgcacguugg

SEQ ID NO: 2001721 - RNA, 13 nt, Shigella flexneri 2a str. 301
uguucucagcaca

SEQ ID NO: 2001722 - RNA, 21 nt, Shigella flexneri 2a str. 301
uguuguauccuguuuuuaagu

SEQ ID NO: 2001723 - RNA, 17 nt, Shigella flexneri 2a str. 301
uguuguacaugcugcuu

SEQ ID NO: 2001724 - RNA, 20 nt, Shigella flexneri 2a str. 301
uguuguagaccggaaaaggu

SEQ ID NO: 2001725 - RNA, 16 nt, Shigella flexneri 2a str. 301
uguuguaagcuugaca

SEQ ID NO: 2001726 - RNA, 14 nt, Shigella flexneri 2a str. 301
uguuguuucagaaa

SEQ ID NO: 2001727 - RNA, 20 nt, Shigella flexneri 2a str. 301
uguuguuuuuucaaccuaaa

SEQ ID NO: 2001728 - RNA, 19 nt, Shigella flexneri 2a str. 301
ugugccugaauauacgcca

SEQ ID NO: 2001729 - RNA, 14 nt, Shigella flexneri 2a str. 301
ugugcgcacauugc

SEQ ID NO: 2001730 - RNA, 14 nt, Shigella flexneri 2a str. 301
ugugcaccuuuucc

SEQ ID NO: 2001731 - RNA, 15 nt, Shigella flexneri 2a str. 301
ugugcagcaugcacc

SEQ ID NO: 2001732 - RNA, 17 nt, Shigella flexneri 2a str. 301
ugucacgucucaucagg

SEQ ID NO: 2001733 - RNA, 14 nt, Shigella flexneri 2a str. 301
ugucacguuuugug

SEQ ID NO: 2001734 - RNA, 17 nt, Shigella flexneri 2a str. 301
ugucacugacuauuucc

SEQ ID NO: 2001735 - RNA, 16 nt, Shigella flexneri 2a str. 301
ugucagcacuuccagc

SEQ ID NO: 2001736 - RNA, 16 nt, Shigella flexneri 2a str. 301
ugugacagcagcggca

SEQ ID NO: 2001737 - RNA, 15 nt, Shigella flexneri 2a str. 301
ugugaccccaucauu

SEQ ID NO: 2001738 - RNA, 22 nt, Shigella flexneri 2a str. 301
ugugacguguccguuuguggug

SEQ ID NO: 2001739 - RNA, 16 nt, Shigella flexneri 2a str. 301
ugugacgacaccaucu

SEQ ID NO: 2001740 - RNA, 15 nt, Shigella flexneri 2a str. 301
uguggcccagccuuu

SEQ ID NO: 2001741 - RNA, 17 nt, Shigella flexneri 2a str. 301
ugugggauugcuucagu

SEQ ID NO: 2001742 - RNA, 15 nt, Shigella flexneri 2a str. 301
ugugggauugcuuca

SEQ ID NO: 2001743 - RNA, 12 nt, Shigella flexneri 2a str. 301
uguggcuggggu

SEQ ID NO: 2001744 - RNA, 18 nt, Shigella flexneri 2a str. 301
uguggcggcgcgaggcga

SEQ ID NO: 2001745 - RNA, 17 nt, Shigella flexneri 2a str. 301
uguuaacagcaacauag

SEQ ID NO: 2001746 - RNA, 15 nt, Shigella flexneri 2a str. 301
uguguuugaucacuu

SEQ ID NO: 2001747 - RNA, 15 nt, Shigella flexneri 2a str. 301
ugugugccagguucg

SEQ ID NO: 2001748 - RNA, 13 nt, Shigella flexneri 2a str. 301
ugugucagcgcca

SEQ ID NO: 2001749 - RNA, 13 nt, Shigella flexneri 2a str. 301
ugugucacuuuga

SEQ ID NO: 2001750 - RNA, 23 nt, Shigella flexneri 2a str. 301
uuacccuacaccaugccggugau

SEQ ID NO: 2001751 - RNA, 21 nt, Shigella flexneri 2a str. 301
uuaccgauccccggauucaug

SEQ ID NO: 2001752 - RNA, 13 nt, Shigella flexneri 2a str. 301
uuaccgcaccacc

SEQ ID NO: 2001753 - RNA, 19 nt, Shigella flexneri 2a str. 301
uuaccgcccccgcuaucca

SEQ ID NO: 2001754 - RNA, 19 nt, Shigella flexneri 2a str. 301
uuaccgcuauuugcgccug

SEQ ID NO: 2001755 - RNA, 19 nt, Shigella flexneri 2a str. 301
uuaccggugccagcaacug

SEQ ID NO: 2001756 - RNA, 16 nt, Shigella flexneri 2a str. 301
uuaccggucacuggca

SEQ ID NO: 2001757 - RNA, 14 nt, Shigella flexneri 2a str. 301
uuaccggcagagug

SEQ ID NO: 2001758 - RNA, 23 nt, Shigella flexneri 2a str. 301
uuaccugaaugcucugaggcuga

SEQ ID NO: 2001759 - RNA, 19 nt, Shigella flexneri 2a str. 301
uuacacaaauccagcaccg

SEQ ID NO: 2001760 - RNA, 13 nt, Shigella flexneri 2a str. 301
uuacacaauuuug

SEQ ID NO: 2001761 - RNA, 19 nt, Shigella flexneri 2a str. 301
uuacaccaauaccgcccac

SEQ ID NO: 2001762 - RNA, 21 nt, Shigella flexneri 2a str. 301
uuacaguagcuauaaaccugc

SEQ ID NO: 2001763 - RNA, 23 nt, Shigella flexneri 2a str. 301
uuaccaccuuacuuacacaucaa

SEQ ID NO: 2001764 - RNA, 18 nt, Shigella flexneri 2a str. 301
uuaccaccgucaaaaaaa

SEQ ID NO: 2001765 - RNA, 22 nt, Shigella flexneri 2a str. 301
uuaccagcaaauugaggaucug

SEQ ID NO: 2001766 - RNA, 23 nt, Shigella flexneri 2a str. 301
uuaauccgcaaauaacguaaaaa

SEQ ID NO: 2001767 - RNA, 13 nt, Shigella flexneri 2a str. 301
uuaaucgcuucau

SEQ ID NO: 2001768 - RNA, 21 nt, Shigella flexneri 2a str. 301
uuaaucgucgguuccguucau

SEQ ID NO: 2001769 - RNA, 12 nt, Shigella flexneri 2a str. 301
uuaauucuaaaa

SEQ ID NO: 2001770 - RNA, 18 nt, Shigella flexneri 2a str. 301
uuaauuacugagaacgca

SEQ ID NO: 2001771 - RNA, 17 nt, Shigella flexneri 2a str. 301
uuaaugugucugaaagc

SEQ ID NO: 2001772 - RNA, 16 nt, Shigella flexneri 2a str. 301
uuaauuuucgcccguu

SEQ ID NO: 2001773 - RNA, 16 nt, Shigella flexneri 2a str. 301
uuaauauuaacuuaau

SEQ ID NO: 2001774 - RNA, 19 nt, Shigella flexneri 2a str. 301
uuaauaugcucaacaauaa

SEQ ID NO: 2001775 - RNA, 18 nt, Shigella flexneri 2a str. 301
uuaauccacagcaaugca

SEQ ID NO: 2001776 - RNA, 13 nt, Shigella flexneri 2a str. 301
uuaaucaucauua

SEQ ID NO: 2001777 - RNA, 19 nt, Shigella flexneri 2a str. 301
uuaaucaucaaugccagca

SEQ ID NO: 2001778 - RNA, 16 nt, Shigella flexneri 2a str. 301
uuaaucaucaacuggc

SEQ ID NO: 2001779 - RNA, 16 nt, Shigella flexneri 2a str. 301
uuaaucagugcaauca

SEQ ID NO: 2001780 - RNA, 13 nt, Shigella flexneri 2a str. 301
uuaaucagugcaa

SEQ ID NO: 2001781 - RNA, 14 nt, Shigella flexneri 2a str. 301
uuaauaauaaguau

SEQ ID NO: 2001782 - RNA, 20 nt, Shigella flexneri 2a str. 301
uuaaguguccgccaauuuca

SEQ ID NO: 2001783 - RNA, 14 nt, Shigella flexneri 2a str. 301
uuaauaaucacaua

SEQ ID NO: 2001784 - RNA, 14 nt, Shigella flexneri 2a str. 301
uuaaauccugcaca

SEQ ID NO: 2001785 - RNA, 22 nt, Shigella flexneri 2a str. 301
uuaacugggcgucaaagugaaa

SEQ ID NO: 2001786 - RNA, 22 nt, Shigella flexneri 2a str. 301
uuaagaagaucguggagaacaa

SEQ ID NO: 2001787 - RNA, 16 nt, Shigella flexneri 2a str. 301
uuaacugauauuuaaa

SEQ ID NO: 2001788 - RNA, 17 nt, Shigella flexneri 2a str. 301
uuaacugcuuaucauca

SEQ ID NO: 2001789 - RNA, 21 nt, Shigella flexneri 2a str. 301
uuaacugcccgaucaacggau

SEQ ID NO: 2001790 - RNA, 18 nt, Shigella flexneri 2a str. 301
uuaacugcgcgauuauca

SEQ ID NO: 2001791 - RNA, 19 nt, Shigella flexneri 2a str. 301
uuaacugcgcgauuaucau

SEQ ID NO: 2001792 - RNA, 17 nt, Shigella flexneri 2a str. 301
uuaacucgagcagcuga

SEQ ID NO: 2001793 - RNA, 23 nt, Shigella flexneri 2a str. 301
uuaagacuggcaaagcaggccag

SEQ ID NO: 2001794 - RNA, 15 nt, Shigella flexneri 2a str. 301
uuaaggcaagaaaau

SEQ ID NO: 2001795 - RNA, 13 nt, Shigella flexneri 2a str. 301
uuaaggguaaaaa

SEQ ID NO: 2001796 - RNA, 14 nt, Shigella flexneri 2a str. 301
uuaaguaugcaaua

SEQ ID NO: 2001797 - RNA, 16 nt, Shigella flexneri 2a str. 301
uuaagucggucaagua

SEQ ID NO: 2001798 - RNA, 15 nt, Shigella flexneri 2a str. 301
uuaggcacaucaaca

SEQ ID NO: 2001799 - RNA, 17 nt, Shigella flexneri 2a str. 301
uuaggauacuuaucugg

SEQ ID NO: 2001800 - RNA, 14 nt, Shigella flexneri 2a str. 301
uuagcuuuaaucca

SEQ ID NO: 2001801 - RNA, 15 nt, Shigella flexneri 2a str. 301
uuagcgccagccaga

SEQ ID NO: 2001802 - RNA, 19 nt, Shigella flexneri 2a str. 301
uuagccuguaaugucaucu

SEQ ID NO: 2001803 - RNA, 19 nt, Shigella flexneri 2a str. 301
uuagccgcagguaaacuca

SEQ ID NO: 2001804 - RNA, 16 nt, Shigella flexneri 2a str. 301
uuagccgccagcucuu

SEQ ID NO: 2001805 - RNA, 14 nt, Shigella flexneri 2a str. 301
uuagcccuuuguag

SEQ ID NO: 2001806 - RNA, 21 nt, Shigella flexneri 2a str. 301
uuagccaggcaccgaaaauca

SEQ ID NO: 2001807 - RNA, 14 nt, Shigella flexneri 2a str. 301
uuagcaucagucuc

SEQ ID NO: 2001808 - RNA, 16 nt, Shigella flexneri 2a str. 301
uuagcaauauuuuuau

SEQ ID NO: 2001809 - RNA, 14 nt, Shigella flexneri 2a str. 301
uuagcaauccuuga

SEQ ID NO: 2001810 - RNA, 18 nt, Shigella flexneri 2a str. 301
uuagcaaaauagcuguuu

SEQ ID NO: 2001811 - RNA, 20 nt, Shigella flexneri 2a str. 301
uuagcaacaggccaguucga

SEQ ID NO: 2001812 - RNA, 13 nt, Shigella flexneri 2a str. 301
uuagaugcuuuca

SEQ ID NO: 2001813 - RNA, 21 nt, Shigella flexneri 2a str. 301
uuagaugugggcaaucucacu

SEQ ID NO: 2001814 - RNA, 18 nt, Shigella flexneri 2a str. 301
uuagaugauggcauucuc

SEQ ID NO: 2001815 - RNA, 16 nt, Shigella flexneri 2a str. 301
uuagaugauggcauuc

SEQ ID NO: 2001816 - RNA, 15 nt, Shigella flexneri 2a str. 301
uuagauaaaaaugaa

SEQ ID NO: 2001817 - RNA, 13 nt, Shigella flexneri 2a str. 301
uuacuuacacauc

SEQ ID NO: 2001818 - RNA, 19 nt, Shigella flexneri 2a str. 301
uuacuucacgcagucgcag

SEQ ID NO: 2001819 - RNA, 14 nt, Shigella flexneri 2a str. 301
uuacuuacgaaaaa

SEQ ID NO: 2001820 - RNA, 13 nt, Shigella flexneri 2a str. 301
uuaccuucauuug

SEQ ID NO: 2001821 - RNA, 21 nt, Shigella flexneri 2a str. 301
uuagaaauucacagguaacau

SEQ ID NO: 2001822 - RNA, 16 nt, Shigella flexneri 2a str. 301
uuagaaacaaaaaaac

SEQ ID NO: 2001823 - RNA, 23 nt, Shigella flexneri 2a str. 301
uuacuucugcugcacgaaauugc

SEQ ID NO: 2001824 - RNA, 17 nt, Shigella flexneri 2a str. 301
uuauacuuuguuauuca

SEQ ID NO: 2001825 - RNA, 13 nt, Shigella flexneri 2a str. 301
uuauaaaugugua

SEQ ID NO: 2001826 - RNA, 17 nt, Shigella flexneri 2a str. 301
uuauauaacgccauauu

SEQ ID NO: 2001827 - RNA, 18 nt, Shigella flexneri 2a str. 301
uuauauggaaaaauauuc

SEQ ID NO: 2001828 - RNA, 21 nt, Shigella flexneri 2a str. 301
uuauauugauuaccaauauca

SEQ ID NO: 2001829 - RNA, 23 nt, Shigella flexneri 2a str. 301
uuaucacgaugcuaaaaacauca

SEQ ID NO: 2001830 - RNA, 19 nt, Shigella flexneri 2a str. 301
uuaucaccuguugcccuuu

SEQ ID NO: 2001831 - RNA, 16 nt, Shigella flexneri 2a str. 301
uuauauuugaacaucg

SEQ ID NO: 2001832 - RNA, 11 nt, Shigella flexneri 2a str. 301
uuauauuuccc

SEQ ID NO: 2001833 - RNA, 21 nt, Shigella flexneri 2a str. 301
uuaguauuguuaaauauuaag

SEQ ID NO: 2001834 - RNA, 18 nt, Shigella flexneri 2a str. 301
uuagucccaaacagcaga

SEQ ID NO: 2001835 - RNA, 20 nt, Shigella flexneri 2a str. 301
uuagucgcccauuuugccac

SEQ ID NO: 2001836 - RNA, 22 nt, Shigella flexneri 2a str. 301
uuagugccgcuggcauacaguu

SEQ ID NO: 2001837 - RNA, 14 nt, Shigella flexneri 2a str. 301
uuaguguucauaaa

SEQ ID NO: 2001838 - RNA, 20 nt, Shigella flexneri 2a str. 301
uuagggugaggggaacagac

SEQ ID NO: 2001839 - RNA, 20 nt, Shigella flexneri 2a str. 301
uuagggugaggggaacccgu

SEQ ID NO: 2001840 - RNA, 13 nt, Shigella flexneri 2a str. 301
uuaggggacauuu

SEQ ID NO: 2001841 - RNA, 12 nt, Shigella flexneri 2a str. 301
uuagguggaaga

SEQ ID NO: 2001842 - RNA, 17 nt, Shigella flexneri 2a str. 301
uuagguacaaagccaac

SEQ ID NO: 2001843 - RNA, 22 nt, Shigella flexneri 2a str. 301
uuagguacaaagccaacagcag

SEQ ID NO: 2001844 - RNA, 19 nt, Shigella flexneri 2a str. 301
uuaguauuguuaaauauua

SEQ ID NO: 2001845 - RNA, 16 nt, Shigella flexneri 2a str. 301
ugcuggucgucucgug

SEQ ID NO: 2001846 - RNA, 17 nt, Shigella flexneri 2a str. 301
ugcuggguuauuucauu

SEQ ID NO: 2001847 - RNA, 18 nt, Shigella flexneri 2a str. 301
ugcuggcaugaaugguca

SEQ ID NO: 2001848 - RNA, 20 nt, Shigella flexneri 2a str. 301
ugcugucuuuuuacucccgc

SEQ ID NO: 2001849 - RNA, 17 nt, Shigella flexneri 2a str. 301
ugcugucggcaaaucaa

SEQ ID NO: 2001850 - RNA, 15 nt, Shigella flexneri 2a str. 301
ugcugucggcgguaa

SEQ ID NO: 2001851 - RNA, 17 nt, Shigella flexneri 2a str. 301
ugcugucggcugccagc

SEQ ID NO: 2001852 - RNA, 21 nt, Shigella flexneri 2a str. 301
ugcugguucugcggguuaguc

SEQ ID NO: 2001853 - RNA, 13 nt, Shigella flexneri 2a str. 301
ugcuggugguggu

SEQ ID NO: 2001854 - RNA, 17 nt, Shigella flexneri 2a str. 301
ugcugucaccgaagcgg

SEQ ID NO: 2001855 - RNA, 15 nt, Shigella flexneri 2a str. 301
ugcugacaaugugcu

SEQ ID NO: 2001856 - RNA, 14 nt, Shigella flexneri 2a str. 301
ugcugaccaccagc

SEQ ID NO: 2001857 - RNA, 14 nt, Shigella flexneri 2a str. 301
ugcuggauaagaug

SEQ ID NO: 2001858 - RNA, 19 nt, Shigella flexneri 2a str. 301
ugcuggaucaaggauugca

SEQ ID NO: 2001859 - RNA, 12 nt, Shigella flexneri 2a str. 301
ugcuggcauuac

SEQ ID NO: 2001860 - RNA, 14 nt, Shigella flexneri 2a str. 301
ugcuggcaaaucag

SEQ ID NO: 2001861 - RNA, 19 nt, Shigella flexneri 2a str. 301
ugcuucguuaacgugucau

SEQ ID NO: 2001862 - RNA, 22 nt, Shigella flexneri 2a str. 301
ugcuucucuucagccaacgcau

SEQ ID NO: 2001863 - RNA, 18 nt, Shigella flexneri 2a str. 301
ugcuucugacuauauaaa

SEQ ID NO: 2001864 - RNA, 15 nt, Shigella flexneri 2a str. 301
ugcuucggucagcac

SEQ ID NO: 2001865 - RNA, 13 nt, Shigella flexneri 2a str. 301
ugcuucgcucucu

SEQ ID NO: 2001866 - RNA, 15 nt, Shigella flexneri 2a str. 301
ugcuuccggcaagca

SEQ ID NO: 2001867 - RNA, 19 nt, Shigella flexneri 2a str. 301
ugcuuccggcaagcaaaug

SEQ ID NO: 2001868 - RNA, 12 nt, Shigella flexneri 2a str. 301
ugcuuccugaac

SEQ ID NO: 2001869 - RNA, 15 nt, Shigella flexneri 2a str. 301
ugcuuccgccagcgg

SEQ ID NO: 2001870 - RNA, 23 nt, Shigella flexneri 2a str. 301
ugcuuaaggcagaaacaaacgca

SEQ ID NO: 2001871 - RNA, 18 nt, Shigella flexneri 2a str. 301
ugcuuaaauuucuuacca

SEQ ID NO: 2001872 - RNA, 22 nt, Shigella flexneri 2a str. 301
ugcuuaacauuggucagagcau

SEQ ID NO: 2001873 - RNA, 18 nt, Shigella flexneri 2a str. 301
ugcuuaaaccauuccagc

SEQ ID NO: 2001874 - RNA, 19 nt, Shigella flexneri 2a str. 301
ugcuguuuuuucaggcccu

SEQ ID NO: 2001875 - RNA, 17 nt, Shigella flexneri 2a str. 301
ugcuuucagcacuuauc

SEQ ID NO: 2001876 - RNA, 18 nt, Shigella flexneri 2a str. 301
ugcuuguggcggaaagac

SEQ ID NO: 2001877 - RNA, 14 nt, Shigella flexneri 2a str. 301
ugcuugucccaacc

SEQ ID NO: 2001878 - RNA, 20 nt, Shigella flexneri 2a str. 301
ugcuugucccaaccuuguuu

SEQ ID NO: 2001879 - RNA, 19 nt, Shigella flexneri 2a str. 301
ugcuuucuuucacggccac

SEQ ID NO: 2001880 - RNA, 19 nt, Shigella flexneri 2a str. 301
ugcuuuccaacuguaccag

SEQ ID NO: 2001881 - RNA, 20 nt, Shigella flexneri 2a str. 301
ugcuuucagcacuuaucucu

SEQ ID NO: 2001882 - RNA, 14 nt, Shigella flexneri 2a str. 301
ugcuuuuuuccaua

SEQ ID NO: 2001883 - RNA, 14 nt, Shigella flexneri 2a str. 301
uggaaacagcacca

SEQ ID NO: 2001884 - RNA, 19 nt, Shigella flexneri 2a str. 301
uggaaacggacagaccugc

SEQ ID NO: 2001885 - RNA, 13 nt, Shigella flexneri 2a str. 301
uggaacccgcagc

SEQ ID NO: 2001886 - RNA, 20 nt, Shigella flexneri 2a str. 301
uggaacaucaccccgccggg

SEQ ID NO: 2001887 - RNA, 17 nt, Shigella flexneri 2a str. 301
uggaacgcguacagaaa

SEQ ID NO: 2001888 - RNA, 22 nt, Shigella flexneri 2a str. 301
uggaacgcguacagaaaacuca

SEQ ID NO: 2001889 - RNA, 20 nt, Shigella flexneri 2a str. 301
uggaacgcguaucuuuauaa

SEQ ID NO: 2001890 - RNA, 18 nt, Shigella flexneri 2a str. 301
uggaagaaaccagcgugu

SEQ ID NO: 2001891 - RNA, 18 nt, Shigella flexneri 2a str. 301
uggaagcagaucuggaag

SEQ ID NO: 2001892 - RNA, 18 nt, Shigella flexneri 2a str. 301
uggaagcgcccgucacug

SEQ ID NO: 2001893 - RNA, 21 nt, Shigella flexneri 2a str. 301
uggaagagcgacaaucccugc

SEQ ID NO: 2001894 - RNA, 19 nt, Shigella flexneri 2a str. 301
uggaagguaaggauaaaaa

SEQ ID NO: 2001895 - RNA, 16 nt, Shigella flexneri 2a str. 301
uggaaucacucaucau

SEQ ID NO: 2001896 - RNA, 19 nt, Shigella flexneri 2a str. 301
uggaaucacucaucaugca

SEQ ID NO: 2001897 - RNA, 22 nt, Shigella flexneri 2a str. 301
uggaauauccgucacuucagga

SEQ ID NO: 2001898 - RNA, 21 nt, Shigella flexneri 2a str. 301
uggaauaagccaaauccagcg

SEQ ID NO: 2001899 - RNA, 19 nt, Shigella flexneri 2a str. 301
uggaauacauauauuacaa

SEQ ID NO: 2001900 - RNA, 15 nt, Shigella flexneri 2a str. 301
uggaaguuacucaaa

SEQ ID NO: 2001901 - RNA, 17 nt, Shigella flexneri 2a str. 301
uggaauuccuuucccua

SEQ ID NO: 2001902 - RNA, 15 nt, Shigella flexneri 2a str. 301
uggaauuuguccacc

SEQ ID NO: 2001903 - RNA, 21 nt, Shigella flexneri 2a str. 301
uggaauuuguccaccaauagc

SEQ ID NO: 2001904 - RNA, 12 nt, Shigella flexneri 2a str. 301
uggaauggucaa

SEQ ID NO: 2001905 - RNA, 19 nt, Shigella flexneri 2a str. 301
uggaauuacugauugcuca

SEQ ID NO: 2001906 - RNA, 14 nt, Shigella flexneri 2a str. 301
uggaaugagcaucu

SEQ ID NO: 2001907 - RNA, 16 nt, Shigella flexneri 2a str. 301
uggacgauaagcaccg

SEQ ID NO: 2001908 - RNA, 20 nt, Shigella flexneri 2a str. 301
uggacgacagcaacaucguu

SEQ ID NO: 2001909 - RNA, 13 nt, Shigella flexneri 2a str. 301
uggacgaacaguu

SEQ ID NO: 2001910 - RNA, 13 nt, Shigella flexneri 2a str. 301
uggacauucuccg

SEQ ID NO: 2001911 - RNA, 12 nt, Shigella flexneri 2a str. 301
uggacaccagcu

SEQ ID NO: 2001912 - RNA, 14 nt, Shigella flexneri 2a str. 301
uggacaacauuccu

SEQ ID NO: 2001913 - RNA, 17 nt, Shigella flexneri 2a str. 301
uggacauagcucugcca

SEQ ID NO: 2001914 - RNA, 20 nt, Shigella flexneri 2a str. 301
ugcuccccagaauccaggaa

SEQ ID NO: 2001915 - RNA, 19 nt, Shigella flexneri 2a str. 301
ugcuccccagggaacauuu

SEQ ID NO: 2001916 - RNA, 14 nt, Shigella flexneri 2a str. 301
ugcucgcuggaagu

SEQ ID NO: 2001917 - RNA, 16 nt, Shigella flexneri 2a str. 301
ugcucgcuggcaggcc

SEQ ID NO: 2001918 - RNA, 17 nt, Shigella flexneri 2a str. 301
ugcuccagcagauggca

SEQ ID NO: 2001919 - RNA, 20 nt, Shigella flexneri 2a str. 301
ugcuccagucguucaaccac

SEQ ID NO: 2001920 - RNA, 13 nt, Shigella flexneri 2a str. 301
ugcuccagucguu

SEQ ID NO: 2001921 - RNA, 21 nt, Shigella flexneri 2a str. 301
ugcucagaaucacgccaacaa

SEQ ID NO: 2001922 - RNA, 20 nt, Shigella flexneri 2a str. 301
ugcucacgccacgguauuag

SEQ ID NO: 2001923 - RNA, 19 nt, Shigella flexneri 2a str. 301
ugcucagcccguaacucac

SEQ ID NO: 2001924 - RNA, 22 nt, Shigella flexneri 2a str. 301
ugcucuaacccuuccagauuca

SEQ ID NO: 2001925 - RNA, 15 nt, Shigella flexneri 2a str. 301
ugcucuaacccuucc

SEQ ID NO: 2001926 - RNA, 22 nt, Shigella flexneri 2a str. 301
ugcucucaucacuacagcgaaa

SEQ ID NO: 2001927 - RNA, 21 nt, Shigella flexneri 2a str. 301
ugcucucaaagacguuaaaaa

SEQ ID NO: 2001928 - RNA, 18 nt, Shigella flexneri 2a str. 301
ugcucugcagcagccugc

SEQ ID NO: 2001929 - RNA, 16 nt, Shigella flexneri 2a str. 301
ugcucuuuauaauuau

SEQ ID NO: 2001930 - RNA, 16 nt, Shigella flexneri 2a str. 301
ugcugaauccccuucu

SEQ ID NO: 2001931 - RNA, 21 nt, Shigella flexneri 2a str. 301
ugcucuggucugccauaauau

SEQ ID NO: 2001932 - RNA, 13 nt, Shigella flexneri 2a str. 301
ugcucuucuuuca

SEQ ID NO: 2001933 - RNA, 18 nt, Shigella flexneri 2a str. 301
ugcguuuuuaucuucaca

SEQ ID NO: 2001934 - RNA, 13 nt, Shigella flexneri 2a str. 301
ugcuaacucauca

SEQ ID NO: 2001935 - RNA, 19 nt, Shigella flexneri 2a str. 301
ugcuacggcaauucccaga

SEQ ID NO: 2001936 - RNA, 21 nt, Shigella flexneri 2a str. 301
ugcuacaggguaaaaagaggu

SEQ ID NO: 2001937 - RNA, 23 nt, Shigella flexneri 2a str. 301
ugcuaccgcuucgcucacaucau

SEQ ID NO: 2001938 - RNA, 12 nt, Shigella flexneri 2a str. 301
ugcuaucacaau

SEQ ID NO: 2001939 - RNA, 23 nt, Shigella flexneri 2a str. 301
ugcuaguuaucuccuugcuggug

SEQ ID NO: 2001940 - RNA, 20 nt, Shigella flexneri 2a str. 301
ugcuagcggguuaagcgcgc

SEQ ID NO: 2001941 - RNA, 13 nt, Shigella flexneri 2a str. 301
ugcuauuccuuga

SEQ ID NO: 2001942 - RNA, 15 nt, Shigella flexneri 2a str. 301
ugcuauuccuugaaa

SEQ ID NO: 2001943 - RNA, 22 nt, Shigella flexneri 2a str. 301
ugcuaugguccguucucaccag

SEQ ID NO: 2001944 - RNA, 22 nt, Shigella flexneri 2a str. 301
ugcuauccaguacauugagaau

SEQ ID NO: 2001945 - RNA, 21 nt, Shigella flexneri 2a str. 301
ugcucaacaaaccguugcugc

SEQ ID NO: 2001946 - RNA, 19 nt, Shigella flexneri 2a str. 301
ugcucaaacuucgucacag

SEQ ID NO: 2001947 - RNA, 12 nt, Shigella flexneri 2a str. 301
ugcggcaaauac

SEQ ID NO: 2001948 - RNA, 24 nt, Shigella flexneri 2a str. 301
ugcgcuuccugcaacgagugcauc

SEQ ID NO: 2001949 - RNA, 14 nt, Shigella flexneri 2a str. 301
ugcgcuuccugcag

SEQ ID NO: 2001950 - RNA, 21 nt, Shigella flexneri 2a str. 301
ugcgcuuccagcuccauccac

SEQ ID NO: 2001951 - RNA, 19 nt, Shigella flexneri 2a str. 301
ugcggcuuauucauuacuu

SEQ ID NO: 2001952 - RNA, 20 nt, Shigella flexneri 2a str. 301
ugcggcugguuacucaccag

SEQ ID NO: 2001953 - RNA, 19 nt, Shigella flexneri 2a str. 301
ugcggcucucuuucuccag

SEQ ID NO: 2001954 - RNA, 13 nt, Shigella flexneri 2a str. 301
ugcggcugcaucu

SEQ ID NO: 2001955 - RNA, 18 nt, Shigella flexneri 2a str. 301
ugcggcggcgcaccggcc

SEQ ID NO: 2001956 - RNA, 21 nt, Shigella flexneri 2a str. 301
ugcggcaggacagucagaccg

SEQ ID NO: 2001957 - RNA, 22 nt, Shigella flexneri 2a str. 301
ugcggcgguaucgucgggcugg

SEQ ID NO: 2001958 - RNA, 16 nt, Shigella flexneri 2a str. 301
ugcggcguaaaugccu

SEQ ID NO: 2001959 - RNA, 18 nt, Shigella flexneri 2a str. 301
ugcgccacaaccguccuc

SEQ ID NO: 2001960 - RNA, 17 nt, Shigella flexneri 2a str. 301
ugcgccacaccacugcg

SEQ ID NO: 2001961 - RNA, 12 nt, Shigella flexneri 2a str. 301
ugcgccaauacc

SEQ ID NO: 2001962 - RNA, 18 nt, Shigella flexneri 2a str. 301
ugcgccacaggucagcag

SEQ ID NO: 2001963 - RNA, 20 nt, Shigella flexneri 2a str. 301
ugcgcuccggcggcacagcc

SEQ ID NO: 2001964 - RNA, 18 nt, Shigella flexneri 2a str. 301
ugcgcaucaucgauacca

SEQ ID NO: 2001965 - RNA, 13 nt, Shigella flexneri 2a str. 301
ugcgcuucaccag

SEQ ID NO: 2001966 - RNA, 22 nt, Shigella flexneri 2a str. 301
ugcgcucuucaacuucagcagc

SEQ ID NO: 2001967 - RNA, 12 nt, Shigella flexneri 2a str. 301
ugcgcucuuccg

SEQ ID NO: 2001968 - RNA, 11 nt, Shigella flexneri 2a str. 301
ugcgcucuccc

SEQ ID NO: 2001969 - RNA, 23 nt, Shigella flexneri 2a str. 301
ugcgggagcgcuuuuuuccugcc

SEQ ID NO: 2001970 - RNA, 13 nt, Shigella flexneri 2a str. 301
ugcgggccaaaga

SEQ ID NO: 2001971 - RNA, 15 nt, Shigella flexneri 2a str. 301
ugcguacuucuuacc

SEQ ID NO: 2001972 - RNA, 15 nt, Shigella flexneri 2a str. 301
ugcguagcugagcaa

SEQ ID NO: 2001973 - RNA, 20 nt, Shigella flexneri 2a str. 301
ugcguagucugaccucuucu

SEQ ID NO: 2001974 - RNA, 14 nt, Shigella flexneri 2a str. 301
ugcguacaccaaca

SEQ ID NO: 2001975 - RNA, 15 nt, Shigella flexneri 2a str. 301
ugcguacaccaacau

SEQ ID NO: 2001976 - RNA, 13 nt, Shigella flexneri 2a str. 301
ugcguacccggau

SEQ ID NO: 2001977 - RNA, 21 nt, Shigella flexneri 2a str. 301
ugcguaaucuuuucauauuau

SEQ ID NO: 2001978 - RNA, 22 nt, Shigella flexneri 2a str. 301
ugcgguaguuucuccccaugga

SEQ ID NO: 2001979 - RNA, 17 nt, Shigella flexneri 2a str. 301
ugcggguuuucgcugcc

SEQ ID NO: 2001980 - RNA, 18 nt, Shigella flexneri 2a str. 301
ugcgguaaccuggcaguu

SEQ ID NO: 2001981 - RNA, 20 nt, Shigella flexneri 2a str. 301
ugcguuaagacuuuuuucau

SEQ ID NO: 2001982 - RNA, 19 nt, Shigella flexneri 2a str. 301
ugcguggcaucaaacacug

SEQ ID NO: 2001983 - RNA, 21 nt, Shigella flexneri 2a str. 301
ugcguggcagauuaggauuaa

SEQ ID NO: 2001984 - RNA, 20 nt, Shigella flexneri 2a str. 301
ugcguucagcaguucugcca

SEQ ID NO: 2001985 - RNA, 14 nt, Shigella flexneri 2a str. 301
ugcguucaucaguu

SEQ ID NO: 2001986 - RNA, 13 nt, Shigella flexneri 2a str. 301
ugcguucagcagu

SEQ ID NO: 2001987 - RNA, 23 nt, Shigella flexneri 2a str. 301
ugcguucgcgaccggcgauggca

SEQ ID NO: 2001988 - RNA, 20 nt, Shigella flexneri 2a str. 301
ugcgucgacauagccauccc

SEQ ID NO: 2001989 - RNA, 13 nt, Shigella flexneri 2a str. 301
ugcgucgccgccu

SEQ ID NO: 2001990 - RNA, 16 nt, Shigella flexneri 2a str. 301
ugcgucauccagcacu

SEQ ID NO: 2001991 - RNA, 13 nt, Shigella flexneri 2a str. 301
ugcgucagcuuca

SEQ ID NO: 2001992 - RNA, 23 nt, Shigella flexneri 2a str. 301
ugcgucaagcgguaaccauccau

SEQ ID NO: 2001993 - RNA, 13 nt, Shigella flexneri 2a str. 301
ugccagaacugau

SEQ ID NO: 2001994 - RNA, 20 nt, Shigella flexneri 2a str. 301
ugccagaauagccgcagcca

SEQ ID NO: 2001995 - RNA, 16 nt, Shigella flexneri 2a str. 301
ugccacuggccccacc

SEQ ID NO: 2001996 - RNA, 19 nt, Shigella flexneri 2a str. 301
ugccaccagugcaggcacc

SEQ ID NO: 2001997 - RNA, 15 nt, Shigella flexneri 2a str. 301
ugccaccagcgcaau

SEQ ID NO: 2001998 - RNA, 14 nt, Shigella flexneri 2a str. 301
ugccaccacugcaa

SEQ ID NO: 2001999 - RNA, 18 nt, Shigella flexneri 2a str. 301
ugccaccacugcaaugac

SEQ ID NO: 2002000 - RNA, 14 nt, Shigella flexneri 2a str. 301
ugccaccagcagcg

SEQ ID NO: 2002001 - RNA, 22 nt, Shigella flexneri 2a str. 301
ugccaccacaccggaccagacg

SEQ ID NO: 2002002 - RNA, 13 nt, Shigella flexneri 2a str. 301
ugccaccacaccg

SEQ ID NO: 2002003 - RNA, 13 nt, Shigella flexneri 2a str. 301
ugccacaucacug

SEQ ID NO: 2002004 - RNA, 11 nt, Shigella flexneri 2a str. 301
ugccacaucac

SEQ ID NO: 2002005 - RNA, 23 nt, Shigella flexneri 2a str. 301
ugccacaguuuuacugcagccag

SEQ ID NO: 2002006 - RNA, 15 nt, Shigella flexneri 2a str. 301
ugccaaucagcagaa

SEQ ID NO: 2002007 - RNA, 21 nt, Shigella flexneri 2a str. 301
ugccaaucuucacaucaucau

SEQ ID NO: 2002008 - RNA, 14 nt, Shigella flexneri 2a str. 301
ugcaggucguccug

SEQ ID NO: 2002009 - RNA, 20 nt, Shigella flexneri 2a str. 301
ugcagucauaaccaguccau

SEQ ID NO: 2002010 - RNA, 13 nt, Shigella flexneri 2a str. 301
ugccaacuggcau

SEQ ID NO: 2002011 - RNA, 23 nt, Shigella flexneri 2a str. 301
ugccauacgugguugccgaagau

SEQ ID NO: 2002012 - RNA, 15 nt, Shigella flexneri 2a str. 301
ugccauauagcccca

SEQ ID NO: 2002013 - RNA, 13 nt, Shigella flexneri 2a str. 301
ugccauacagaca

SEQ ID NO: 2002014 - RNA, 19 nt, Shigella flexneri 2a str. 301
ugccagugccguuccagcc

SEQ ID NO: 2002015 - RNA, 14 nt, Shigella flexneri 2a str. 301
ugccagugcugcuu

SEQ ID NO: 2002016 - RNA, 17 nt, Shigella flexneri 2a str. 301
ugccagugagugaaauu

SEQ ID NO: 2002017 - RNA, 16 nt, Shigella flexneri 2a str. 301
ugccagugaaaguuuu

SEQ ID NO: 2002018 - RNA, 15 nt, Shigella flexneri 2a str. 301
ugccaguucccccug

SEQ ID NO: 2002019 - RNA, 23 nt, Shigella flexneri 2a str. 301
ugccauauucgcuuucagcgagu

SEQ ID NO: 2002020 - RNA, 14 nt, Shigella flexneri 2a str. 301
ugcccaacauacug

SEQ ID NO: 2002021 - RNA, 13 nt, Shigella flexneri 2a str. 301
ugcccaacugccu

SEQ ID NO: 2002022 - RNA, 15 nt, Shigella flexneri 2a str. 301
ugccauuuuuuauug

SEQ ID NO: 2002023 - RNA, 15 nt, Shigella flexneri 2a str. 301
ugccagcaaauagau

SEQ ID NO: 2002024 - RNA, 12 nt, Shigella flexneri 2a str. 301
ugccagcaccac

SEQ ID NO: 2002025 - RNA, 20 nt, Shigella flexneri 2a str. 301
ugccagcguaaauccugacg

SEQ ID NO: 2002026 - RNA, 19 nt, Shigella flexneri 2a str. 301
ugccagccaucuuucgcag

SEQ ID NO: 2002027 - RNA, 18 nt, Shigella flexneri 2a str. 301
ugccagccaugagacaaa

SEQ ID NO: 2002028 - RNA, 12 nt, Shigella flexneri 2a str. 301
ugccagcaugca

SEQ ID NO: 2002029 - RNA, 20 nt, Shigella flexneri 2a str. 301
ugccagccacaccuggugca

SEQ ID NO: 2002030 - RNA, 22 nt, Shigella flexneri 2a str. 301
ugccagccaggauaugcgccuu

SEQ ID NO: 2002031 - RNA, 15 nt, Shigella flexneri 2a str. 301
ugccagcguugagga

SEQ ID NO: 2002032 - RNA, 22 nt, Shigella flexneri 2a str. 301
ugccagcucuuucgacagcgau

SEQ ID NO: 2002033 - RNA, 16 nt, Shigella flexneri 2a str. 301
ugccagcugcugugga

SEQ ID NO: 2002034 - RNA, 18 nt, Shigella flexneri 2a str. 301
ugccagcuuucaccugcg

SEQ ID NO: 2002035 - RNA, 14 nt, Shigella flexneri 2a str. 301
ugccaggaccauuc

SEQ ID NO: 2002036 - RNA, 15 nt, Shigella flexneri 2a str. 301
ugccaguaguucauc

SEQ ID NO: 2002037 - RNA, 18 nt, Shigella flexneri 2a str. 301
ugccagucaaucauccau

SEQ ID NO: 2002038 - RNA, 22 nt, Shigella flexneri 2a str. 301
ugcccaugauaguguccauuaa

SEQ ID NO: 2002039 - RNA, 13 nt, Shigella flexneri 2a str. 301
ugcccaucucuuc

SEQ ID NO: 2002040 - RNA, 22 nt, Shigella flexneri 2a str. 301
ugcccacgcgcacgcugguaac

SEQ ID NO: 2002041 - RNA, 15 nt, Shigella flexneri 2a str. 301
ugcccagcaaaaagc

SEQ ID NO: 2002042 - RNA, 22 nt, Shigella flexneri 2a str. 301
ugcccagcucaaucaacuccau

SEQ ID NO: 2002043 - RNA, 17 nt, Shigella flexneri 2a str. 301
ugcccagcgcgccgcca

SEQ ID NO: 2002044 - RNA, 15 nt, Shigella flexneri 2a str. 301
ugccccugaauaauc

SEQ ID NO: 2002045 - RNA, 13 nt, Shigella flexneri 2a str. 301
ugcccaugcgcuc

SEQ ID NO: 2002046 - RNA, 16 nt, Shigella flexneri 2a str. 301
ugcccauguaguaccc

SEQ ID NO: 2002047 - RNA, 16 nt, Shigella flexneri 2a str. 301
ugcccccucacaugag

SEQ ID NO: 2002048 - RNA, 17 nt, Shigella flexneri 2a str. 301
ugcccgcccgacaaagc

SEQ ID NO: 2002049 - RNA, 21 nt, Shigella flexneri 2a str. 301
ugccgaaaaaagucauuacca

SEQ ID NO: 2002050 - RNA, 14 nt, Shigella flexneri 2a str. 301
ugccgaaaugucuu

SEQ ID NO: 2002051 - RNA, 14 nt, Shigella flexneri 2a str. 301
ugccgaacguacgc

SEQ ID NO: 2002052 - RNA, 12 nt, Shigella flexneri 2a str. 301
ugccgaaaaaag

SEQ ID NO: 2002053 - RNA, 14 nt, Shigella flexneri 2a str. 301
ugcccggucaggau

SEQ ID NO: 2002054 - RNA, 15 nt, Shigella flexneri 2a str. 301
ugcccggucaggaug

SEQ ID NO: 2002055 - RNA, 22 nt, Shigella flexneri 2a str. 301
ugcccggcugcgcgacuucauu

SEQ ID NO: 2002056 - RNA, 16 nt, Shigella flexneri 2a str. 301
ugcccgccgugcugcc

SEQ ID NO: 2002057 - RNA, 17 nt, Shigella flexneri 2a str. 301
ugcccggcccggaggau

SEQ ID NO: 2002058 - RNA, 20 nt, Shigella flexneri 2a str. 301
ugccgauggcgcaaacuuaa

SEQ ID NO: 2002059 - RNA, 20 nt, Shigella flexneri 2a str. 301
ugccgaugauuuacaucuuc

SEQ ID NO: 2002060 - RNA, 13 nt, Shigella flexneri 2a str. 301
ugccgcacaucac

SEQ ID NO: 2002061 - RNA, 15 nt, Shigella flexneri 2a str. 301
ugccgcacaucaccg

SEQ ID NO: 2002062 - RNA, 14 nt, Shigella flexneri 2a str. 301
ugccgcaaaaccca

SEQ ID NO: 2002063 - RNA, 17 nt, Shigella flexneri 2a str. 301
ugccgcaaaacccaggc

SEQ ID NO: 2002064 - RNA, 19 nt, Shigella flexneri 2a str. 301
ugccgcaaaacccaggcuu

SEQ ID NO: 2002065 - RNA, 21 nt, Shigella flexneri 2a str. 301
ugccgcaaaacccaggcuuaa

SEQ ID NO: 2002066 - RNA, 23 nt, Shigella flexneri 2a str. 301
ugccgacaaaugcaguuuuuaau

SEQ ID NO: 2002067 - RNA, 15 nt, Shigella flexneri 2a str. 301
ugccgacaucgccac

SEQ ID NO: 2002068 - RNA, 22 nt, Shigella flexneri 2a str. 301
ugccgaacguaggcuggauaag

SEQ ID NO: 2002069 - RNA, 16 nt, Shigella flexneri 2a str. 301
ugccgacaaaugcagu

SEQ ID NO: 2002070 - RNA, 17 nt, Shigella flexneri 2a str. 301
ugcgcaaugcguuuagu

SEQ ID NO: 2002071 - RNA, 12 nt, Shigella flexneri 2a str. 301
ugcgcacaucaa

SEQ ID NO: 2002072 - RNA, 20 nt, Shigella flexneri 2a str. 301
ugcgcaccggguaaugacuc

SEQ ID NO: 2002073 - RNA, 18 nt, Shigella flexneri 2a str. 301
ugcgcagaguuuccaggc

SEQ ID NO: 2002074 - RNA, 20 nt, Shigella flexneri 2a str. 301
ugcgcagaguuuccaggcug

SEQ ID NO: 2002075 - RNA, 18 nt, Shigella flexneri 2a str. 301
ugcgcaguaccagcaacg

SEQ ID NO: 2002076 - RNA, 17 nt, Shigella flexneri 2a str. 301
ugcgcaguacugugaac

SEQ ID NO: 2002077 - RNA, 14 nt, Shigella flexneri 2a str. 301
ugcgcaucaaagcc

SEQ ID NO: 2002078 - RNA, 19 nt, Shigella flexneri 2a str. 301
ugcgcagcggugagccagg

SEQ ID NO: 2002079 - RNA, 20 nt, Shigella flexneri 2a str. 301
ugcgcagcggugagccagga

SEQ ID NO: 2002080 - RNA, 21 nt, Shigella flexneri 2a str. 301
ugcgaugaacgccugggaagu

SEQ ID NO: 2002081 - RNA, 14 nt, Shigella flexneri 2a str. 301
ugcgauccugcaga

SEQ ID NO: 2002082 - RNA, 18 nt, Shigella flexneri 2a str. 301
ugcgaugcuugacguguc

SEQ ID NO: 2002083 - RNA, 22 nt, Shigella flexneri 2a str. 301
ugcgauggcaaaagacaccauc

SEQ ID NO: 2002084 - RNA, 22 nt, Shigella flexneri 2a str. 301
ugcgauacaggaaugcagucgc

SEQ ID NO: 2002085 - RNA, 15 nt, Shigella flexneri 2a str. 301
ugcgaucaggcauuc

SEQ ID NO: 2002086 - RNA, 14 nt, Shigella flexneri 2a str. 301
ugcgaucagugcau

SEQ ID NO: 2002087 - RNA, 14 nt, Shigella flexneri 2a str. 301
ugcgaucaggcauu

SEQ ID NO: 2002088 - RNA, 15 nt, Shigella flexneri 2a str. 301
ugcgauauucuucag

SEQ ID NO: 2002089 - RNA, 17 nt, Shigella flexneri 2a str. 301
ugcgauagccuucagug

SEQ ID NO: 2002090 - RNA, 22 nt, Shigella flexneri 2a str. 301
ugcgcaaaauucacgccacugu

SEQ ID NO: 2002091 - RNA, 17 nt, Shigella flexneri 2a str. 301
ugcgcaaacuucuucag

SEQ ID NO: 2002092 - RNA, 20 nt, Shigella flexneri 2a str. 301
ugcgcaaccguaaacgauca

SEQ ID NO: 2002093 - RNA, 17 nt, Shigella flexneri 2a str. 301
ugcgcaacgcaaucccc

SEQ ID NO: 2002094 - RNA, 11 nt, Shigella flexneri 2a str. 301
ugcgcaauaac

SEQ ID NO: 2002095 - RNA, 19 nt, Shigella flexneri 2a str. 301
ugcgcaacugaggcaauaa

SEQ ID NO: 2002096 - RNA, 21 nt, Shigella flexneri 2a str. 301
ugcgcaacugaggcaauaaug

SEQ ID NO: 2002097 - RNA, 22 nt, Shigella flexneri 2a str. 301
ugcgcaacugaggcaauaauga

SEQ ID NO: 2002098 - RNA, 16 nt, Shigella flexneri 2a str. 301
ugcgacagauucgcgg

SEQ ID NO: 2002099 - RNA, 20 nt, Shigella flexneri 2a str. 301
ugcgacaacuggcagcaccg

SEQ ID NO: 2002100 - RNA, 22 nt, Shigella flexneri 2a str. 301
ugcgacagagauauucagcccg

SEQ ID NO: 2002101 - RNA, 13 nt, Shigella flexneri 2a str. 301
ugcgaauuauaau

SEQ ID NO: 2002102 - RNA, 18 nt, Shigella flexneri 2a str. 301
ugcgaauugccaccaucc

SEQ ID NO: 2002103 - RNA, 22 nt, Shigella flexneri 2a str. 301
ugcgaauaagcugcgugacgaa

SEQ ID NO: 2002104 - RNA, 13 nt, Shigella flexneri 2a str. 301
ugcgaagccgcau

SEQ ID NO: 2002105 - RNA, 15 nt, Shigella flexneri 2a str. 301
ugcgaagguggcgga

SEQ ID NO: 2002106 - RNA, 16 nt, Shigella flexneri 2a str. 301
ugccuuuuuuguacuc

SEQ ID NO: 2002107 - RNA, 17 nt, Shigella flexneri 2a str. 301
ugcgaaagcgucagcuu

SEQ ID NO: 2002108 - RNA, 22 nt, Shigella flexneri 2a str. 301
ugcgaaagcgucagcuuucaga

SEQ ID NO: 2002109 - RNA, 18 nt, Shigella flexneri 2a str. 301
ugcgaaaguaccauuaau

SEQ ID NO: 2002110 - RNA, 16 nt, Shigella flexneri 2a str. 301
ugcgaaagcgagcagu

SEQ ID NO: 2002111 - RNA, 21 nt, Shigella flexneri 2a str. 301
ugcgacagggaucucuuccag

SEQ ID NO: 2002112 - RNA, 21 nt, Shigella flexneri 2a str. 301
ugcgagguuauccgccagcgc

SEQ ID NO: 2002113 - RNA, 19 nt, Shigella flexneri 2a str. 301
ugcgaguguuaccuucauc

SEQ ID NO: 2002114 - RNA, 17 nt, Shigella flexneri 2a str. 301
ugccggaugugaugcau

SEQ ID NO: 2002115 - RNA, 13 nt, Shigella flexneri 2a str. 301
ugccgucagcagg

SEQ ID NO: 2002116 - RNA, 19 nt, Shigella flexneri 2a str. 301
ugccgucagccacuucuuc

SEQ ID NO: 2002117 - RNA, 21 nt, Shigella flexneri 2a str. 301
ugccgucaauuuuaagcagau

SEQ ID NO: 2002118 - RNA, 12 nt, Shigella flexneri 2a str. 301
ugccgccaggcu

SEQ ID NO: 2002119 - RNA, 16 nt, Shigella flexneri 2a str. 301
ugccggauauucagua

SEQ ID NO: 2002120 - RNA, 18 nt, Shigella flexneri 2a str. 301
ugccggagucgcauuaac

SEQ ID NO: 2002121 - RNA, 20 nt, Shigella flexneri 2a str. 301
ugccggaucacguacacaac

SEQ ID NO: 2002122 - RNA, 15 nt, Shigella flexneri 2a str. 301
ugccggaucaggcgu

SEQ ID NO: 2002123 - RNA, 15 nt, Shigella flexneri 2a str. 301
ugccggaugcaugau

SEQ ID NO: 2002124 - RNA, 23 nt, Shigella flexneri 2a str. 301
ugccggaugcggcguaaaugccu

SEQ ID NO: 2002125 - RNA, 20 nt, Shigella flexneri 2a str. 301
ugccggaugcggugcaagca

SEQ ID NO: 2002126 - RNA, 22 nt, Shigella flexneri 2a str. 301
ugccuugaguuuuucaucccuc

SEQ ID NO: 2002127 - RNA, 22 nt, Shigella flexneri 2a str. 301
ugccuuugaaaucgaacagguu

SEQ ID NO: 2002128 - RNA, 17 nt, Shigella flexneri 2a str. 301
ugccuuuccuccugucu

SEQ ID NO: 2002129 - RNA, 18 nt, Shigella flexneri 2a str. 301
ugccuugugggccugaaa

SEQ ID NO: 2002130 - RNA, 19 nt, Shigella flexneri 2a str. 301
ugccuuauccggcaugaaa

SEQ ID NO: 2002131 - RNA, 23 nt, Shigella flexneri 2a str. 301
ugccuucacggcuuugucauuaa

SEQ ID NO: 2002132 - RNA, 21 nt, Shigella flexneri 2a str. 301
ugccuucacaggccgccaggc

SEQ ID NO: 2002133 - RNA, 17 nt, Shigella flexneri 2a str. 301
ugccugcgaagcucuuu

SEQ ID NO: 2002134 - RNA, 22 nt, Shigella flexneri 2a str. 301
ugccucaacccuuuuuuaaaca

SEQ ID NO: 2002135 - RNA, 20 nt, Shigella flexneri 2a str. 301
ugccucaacccuuuuuuaaa

SEQ ID NO: 2002136 - RNA, 15 nt, Shigella flexneri 2a str. 301
ugccuacauauuuuu

SEQ ID NO: 2002137 - RNA, 15 nt, Shigella flexneri 2a str. 301
ugccuacguuuuuua

SEQ ID NO: 2002138 - RNA, 17 nt, Shigella flexneri 2a str. 301
ugccugauggccugcuc

SEQ ID NO: 2002139 - RNA, 22 nt, Shigella flexneri 2a str. 301
ugccugaugcgcuacgcuuauc

SEQ ID NO: 2002140 - RNA, 17 nt, Shigella flexneri 2a str. 301
ugccugcacuuuguguc

SEQ ID NO: 2002141 - RNA, 21 nt, Shigella flexneri 2a str. 301
ugccugcagcugcucauuaca

SEQ ID NO: 2002142 - RNA, 13 nt, Shigella flexneri 2a str. 301
ugaaucugagcau

SEQ ID NO: 2002143 - RNA, 14 nt, Shigella flexneri 2a str. 301
ugaaugaguacuga

SEQ ID NO: 2002144 - RNA, 20 nt, Shigella flexneri 2a str. 301
ugaauauuccacagcucacg

SEQ ID NO: 2002145 - RNA, 14 nt, Shigella flexneri 2a str. 301
ugaauaucuuucuc

SEQ ID NO: 2002146 - RNA, 16 nt, Shigella flexneri 2a str. 301
ugaauauauaauuaaa

SEQ ID NO: 2002147 - RNA, 22 nt, Shigella flexneri 2a str. 301
ucuuuauaaccacgcaaaaucc

SEQ ID NO: 2002148 - RNA, 17 nt, Shigella flexneri 2a str. 301
ucuuuaguuaauuucgc

SEQ ID NO: 2002149 - RNA, 19 nt, Shigella flexneri 2a str. 301
ucuuuauagagauuuuucc

SEQ ID NO: 2002150 - RNA, 13 nt, Shigella flexneri 2a str. 301
ucuuuauauauug

SEQ ID NO: 2002151 - RNA, 22 nt, Shigella flexneri 2a str. 301
ucuuuauauauugggaucaaaa

SEQ ID NO: 2002152 - RNA, 18 nt, Shigella flexneri 2a str. 301
ugaaugauaaaauucauu

SEQ ID NO: 2002153 - RNA, 15 nt, Shigella flexneri 2a str. 301
ugaauuguuuuauaa

SEQ ID NO: 2002154 - RNA, 19 nt, Shigella flexneri 2a str. 301
ugaauuuacacaauuuugu

SEQ ID NO: 2002155 - RNA, 23 nt, Shigella flexneri 2a str. 301
ugaauugaaaaguccaggcugca

SEQ ID NO: 2002156 - RNA, 14 nt, Shigella flexneri 2a str. 301
ugaauuguuuuaua

SEQ ID NO: 2002157 - RNA, 13 nt, Shigella flexneri 2a str. 301
ugacaacuuucau

SEQ ID NO: 2002158 - RNA, 18 nt, Shigella flexneri 2a str. 301
ugacaagcguaugauugc

SEQ ID NO: 2002159 - RNA, 15 nt, Shigella flexneri 2a str. 301
ugacaagcucaccuc

SEQ ID NO: 2002160 - RNA, 20 nt, Shigella flexneri 2a str. 301
ugacaacguagcguuaaaac

SEQ ID NO: 2002161 - RNA, 16 nt, Shigella flexneri 2a str. 301
ugacaacucaucacug

SEQ ID NO: 2002162 - RNA, 19 nt, Shigella flexneri 2a str. 301
ugacacaggcagcaaucac

SEQ ID NO: 2002163 - RNA, 18 nt, Shigella flexneri 2a str. 301
ugacacaucaccuccagc

SEQ ID NO: 2002164 - RNA, 15 nt, Shigella flexneri 2a str. 301
ugacaccagcacauc

SEQ ID NO: 2002165 - RNA, 13 nt, Shigella flexneri 2a str. 301
ugacacccaaugu

SEQ ID NO: 2002166 - RNA, 11 nt, Shigella flexneri 2a str. 301
ugacaccagca

SEQ ID NO: 2002167 - RNA, 16 nt, Shigella flexneri 2a str. 301
ugacaccagcauaaua

SEQ ID NO: 2002168 - RNA, 16 nt, Shigella flexneri 2a str. 301
ugacaaacacaaaacu

SEQ ID NO: 2002169 - RNA, 22 nt, Shigella flexneri 2a str. 301
ugacaaacgcaaaacugccuga

SEQ ID NO: 2002170 - RNA, 19 nt, Shigella flexneri 2a str. 301
ugacaaauuccgaacaaaa

SEQ ID NO: 2002171 - RNA, 22 nt, Shigella flexneri 2a str. 301
ugacaaaucaugcggauauaaa

SEQ ID NO: 2002172 - RNA, 21 nt, Shigella flexneri 2a str. 301
ugacagguugcucauaaaaug

SEQ ID NO: 2002173 - RNA, 16 nt, Shigella flexneri 2a str. 301
ugacaguuuauuuucu

SEQ ID NO: 2002174 - RNA, 14 nt, Shigella flexneri 2a str. 301
ugacauaaugcaaa

SEQ ID NO: 2002175 - RNA, 13 nt, Shigella flexneri 2a str. 301
ugacauaauuggc

SEQ ID NO: 2002176 - RNA, 20 nt, Shigella flexneri 2a str. 301
ugacauaguagccagccaga

SEQ ID NO: 2002177 - RNA, 21 nt, Shigella flexneri 2a str. 301
ugacauauaaccggcaacaga

SEQ ID NO: 2002178 - RNA, 19 nt, Shigella flexneri 2a str. 301
ugacauaguagccagccag

SEQ ID NO: 2002179 - RNA, 18 nt, Shigella flexneri 2a str. 301
ugaccacuuugcgcuccu

SEQ ID NO: 2002180 - RNA, 17 nt, Shigella flexneri 2a str. 301
ugaccacggccacagcc

SEQ ID NO: 2002181 - RNA, 20 nt, Shigella flexneri 2a str. 301
ugaccacggccacagccagc

SEQ ID NO: 2002182 - RNA, 22 nt, Shigella flexneri 2a str. 301
ugaccaguugcuccagcaauaa

SEQ ID NO: 2002183 - RNA, 20 nt, Shigella flexneri 2a str. 301
ugaccaguugcuccagcaau

SEQ ID NO: 2002184 - RNA, 14 nt, Shigella flexneri 2a str. 301
ugaccauaaaaggc

SEQ ID NO: 2002185 - RNA, 21 nt, Shigella flexneri 2a str. 301
ugaccaccaccaccugcaucu

SEQ ID NO: 2002186 - RNA, 14 nt, Shigella flexneri 2a str. 301
ugacacggaacaac

SEQ ID NO: 2002187 - RNA, 24 nt, Shigella flexneri 2a str. 301
ugacacgggaaaccaacuccagcg

SEQ ID NO: 2002188 - RNA, 16 nt, Shigella flexneri 2a str. 301
ugacagacuccgccuc

SEQ ID NO: 2002189 - RNA, 17 nt, Shigella flexneri 2a str. 301
ugacagauuugauuauc

SEQ ID NO: 2002190 - RNA, 23 nt, Shigella flexneri 2a str. 301
ugacagcgcccgacaagauccug

SEQ ID NO: 2002191 - RNA, 23 nt, Shigella flexneri 2a str. 301
ugacagccccugugccagcucgu

SEQ ID NO: 2002192 - RNA, 16 nt, Shigella flexneri 2a str. 301
ugacagggugagcagg

SEQ ID NO: 2002193 - RNA, 17 nt, Shigella flexneri 2a str. 301
ugacaggcgggaagaac

SEQ ID NO: 2002194 - RNA, 15 nt, Shigella flexneri 2a str. 301
ugacagggugagcag

SEQ ID NO: 2002195 - RNA, 23 nt, Shigella flexneri 2a str. 301
ugaccgugcgggcgaaagcagaa

SEQ ID NO: 2002196 - RNA, 16 nt, Shigella flexneri 2a str. 301
ugaccuacgcuuucga

SEQ ID NO: 2002197 - RNA, 22 nt, Shigella flexneri 2a str. 301
ugaccuagcaaacuaucugugu

SEQ ID NO: 2002198 - RNA, 17 nt, Shigella flexneri 2a str. 301
ugacgacuuuuuccauu

SEQ ID NO: 2002199 - RNA, 11 nt, Shigella flexneri 2a str. 301
ugaccugcaaa

SEQ ID NO: 2002200 - RNA, 21 nt, Shigella flexneri 2a str. 301
ugacgaucaacccaguugauc

SEQ ID NO: 2002201 - RNA, 23 nt, Shigella flexneri 2a str. 301
ugacgcugauuuuuuuucaaccu

SEQ ID NO: 2002202 - RNA, 16 nt, Shigella flexneri 2a str. 301
ugacgcuggcagaaag

SEQ ID NO: 2002203 - RNA, 17 nt, Shigella flexneri 2a str. 301
ugaccauuaucaaacag

SEQ ID NO: 2002204 - RNA, 13 nt, Shigella flexneri 2a str. 301
ugaccaugcucaa

SEQ ID NO: 2002205 - RNA, 16 nt, Shigella flexneri 2a str. 301
ugaccaucuuccagca

SEQ ID NO: 2002206 - RNA, 13 nt, Shigella flexneri 2a str. 301
ugacccagcacca

SEQ ID NO: 2002207 - RNA, 18 nt, Shigella flexneri 2a str. 301
ugacccaguagacgagcc

SEQ ID NO: 2002208 - RNA, 14 nt, Shigella flexneri 2a str. 301
ugaccgucuuucau

SEQ ID NO: 2002209 - RNA, 21 nt, Shigella flexneri 2a str. 301
ugacucggagucgacuucaga

SEQ ID NO: 2002210 - RNA, 21 nt, Shigella flexneri 2a str. 301
ugacucggcucauuauuugcc

SEQ ID NO: 2002211 - RNA, 21 nt, Shigella flexneri 2a str. 301
ugacucggacgcguuucauuc

SEQ ID NO: 2002212 - RNA, 22 nt, Shigella flexneri 2a str. 301
ugacugcuuuuacaaaaucuuc

SEQ ID NO: 2002213 - RNA, 16 nt, Shigella flexneri 2a str. 301
ugacuggcucuuuuuc

SEQ ID NO: 2002214 - RNA, 19 nt, Shigella flexneri 2a str. 301
ugacugguagugcaguaca

SEQ ID NO: 2002215 - RNA, 21 nt, Shigella flexneri 2a str. 301
ugacugguagugcaguacauc

SEQ ID NO: 2002216 - RNA, 13 nt, Shigella flexneri 2a str. 301
ugacuggcauuac

SEQ ID NO: 2002217 - RNA, 19 nt, Shigella flexneri 2a str. 301
ugacucagaccauauuccc

SEQ ID NO: 2002218 - RNA, 16 nt, Shigella flexneri 2a str. 301
ugacucagcaucugca

SEQ ID NO: 2002219 - RNA, 21 nt, Shigella flexneri 2a str. 301
ugacuccaacuuacugauagu

SEQ ID NO: 2002220 - RNA, 18 nt, Shigella flexneri 2a str. 301
ugacuccaacuuacugau

SEQ ID NO: 2002221 - RNA, 23 nt, Shigella flexneri 2a str. 301
ugacgcuguuguuuuuucaaccu

SEQ ID NO: 2002222 - RNA, 19 nt, Shigella flexneri 2a str. 301
ugacggaucccgccaacag

SEQ ID NO: 2002223 - RNA, 18 nt, Shigella flexneri 2a str. 301
ugagaacgacagugacuu

SEQ ID NO: 2002224 - RNA, 21 nt, Shigella flexneri 2a str. 301
ugagaacgacagugacuuccg

SEQ ID NO: 2002225 - RNA, 14 nt, Shigella flexneri 2a str. 301
ugagaacgcccauc

SEQ ID NO: 2002226 - RNA, 19 nt, Shigella flexneri 2a str. 301
ugacuuuugcccggcauga

SEQ ID NO: 2002227 - RNA, 16 nt, Shigella flexneri 2a str. 301
ugacuuuugcccggca

SEQ ID NO: 2002228 - RNA, 18 nt, Shigella flexneri 2a str. 301
ugacuuuuacagcuuagc

SEQ ID NO: 2002229 - RNA, 13 nt, Shigella flexneri 2a str. 301
ugacuguacagau

SEQ ID NO: 2002230 - RNA, 16 nt, Shigella flexneri 2a str. 301
ugacuguacagauccg

SEQ ID NO: 2002231 - RNA, 19 nt, Shigella flexneri 2a str. 301
ugacuguaggccggauaag

SEQ ID NO: 2002232 - RNA, 21 nt, Shigella flexneri 2a str. 301
ugacuugccgcaaaacccagg

SEQ ID NO: 2002233 - RNA, 17 nt, Shigella flexneri 2a str. 301
ugacuuugauccagcca

SEQ ID NO: 2002234 - RNA, 22 nt, Shigella flexneri 2a str. 301
ugacuuugccgauuuaacccug

SEQ ID NO: 2002235 - RNA, 21 nt, Shigella flexneri 2a str. 301
ugacuuucuggcacgaccugg

SEQ ID NO: 2002236 - RNA, 13 nt, Shigella flexneri 2a str. 301
ugagccgccgcca

SEQ ID NO: 2002237 - RNA, 13 nt, Shigella flexneri 2a str. 301
ugagcaaacaguu

SEQ ID NO: 2002238 - RNA, 19 nt, Shigella flexneri 2a str. 301
ugagcaaacaguucugcag

SEQ ID NO: 2002239 - RNA, 21 nt, Shigella flexneri 2a str. 301
ugagcaaacaguucugcagcg

SEQ ID NO: 2002240 - RNA, 12 nt, Shigella flexneri 2a str. 301
ugagcagaaaaa

SEQ ID NO: 2002241 - RNA, 13 nt, Shigella flexneri 2a str. 301
ugagcacuggggc

SEQ ID NO: 2002242 - RNA, 17 nt, Shigella flexneri 2a str. 301
ugagcagaaccuuuuuu

SEQ ID NO: 2002243 - RNA, 21 nt, Shigella flexneri 2a str. 301
ugagccagugccgaaaugucu

SEQ ID NO: 2002244 - RNA, 19 nt, Shigella flexneri 2a str. 301
ugagaucaaacucuuucaa

SEQ ID NO: 2002245 - RNA, 22 nt, Shigella flexneri 2a str. 301
ugagaugacgccacuggcuggg

SEQ ID NO: 2002246 - RNA, 20 nt, Shigella flexneri 2a str. 301
ugagauggcuucaucccagu

SEQ ID NO: 2002247 - RNA, 21 nt, Shigella flexneri 2a str. 301
ugagauaccaguugaucaaau

SEQ ID NO: 2002248 - RNA, 15 nt, Shigella flexneri 2a str. 301
ugagauacucaagca

SEQ ID NO: 2002249 - RNA, 22 nt, Shigella flexneri 2a str. 301
ugagauacucaagcagccaggu

SEQ ID NO: 2002250 - RNA, 20 nt, Shigella flexneri 2a str. 301
ugagaucauuauuaaacaga

SEQ ID NO: 2002251 - RNA, 14 nt, Shigella flexneri 2a str. 301
ugagauauuuaaau

SEQ ID NO: 2002252 - RNA, 16 nt, Shigella flexneri 2a str. 301
ugagaauaaccucuuu

SEQ ID NO: 2002253 - RNA, 22 nt, Shigella flexneri 2a str. 301
ugagaauaaucaccuuuaaccu

SEQ ID NO: 2002254 - RNA, 21 nt, Shigella flexneri 2a str. 301
ugaggauuacgucuuuacuaa

SEQ ID NO: 2002255 - RNA, 16 nt, Shigella flexneri 2a str. 301
ugaggauucacacagu

SEQ ID NO: 2002256 - RNA, 17 nt, Shigella flexneri 2a str. 301
ugaggcagcaaggaaaa

SEQ ID NO: 2002257 - RNA, 16 nt, Shigella flexneri 2a str. 301
ugaggcugaccccaac

SEQ ID NO: 2002258 - RNA, 16 nt, Shigella flexneri 2a str. 301
ugagguccagcgagcc

SEQ ID NO: 2002259 - RNA, 23 nt, Shigella flexneri 2a str. 301
ugaggguguuggaacccgcagcc

SEQ ID NO: 2002260 - RNA, 16 nt, Shigella flexneri 2a str. 301
ugagggcaaacaccgc

SEQ ID NO: 2002261 - RNA, 22 nt, Shigella flexneri 2a str. 301
ugaggcuuuaauaccugccugg

SEQ ID NO: 2002262 - RNA, 16 nt, Shigella flexneri 2a str. 301
ugaguaauaacuuccu

SEQ ID NO: 2002263 - RNA, 16 nt, Shigella flexneri 2a str. 301
ugaguaaacuuuugga

SEQ ID NO: 2002264 - RNA, 14 nt, Shigella flexneri 2a str. 301
ugagguuucccgcc

SEQ ID NO: 2002265 - RNA, 19 nt, Shigella flexneri 2a str. 301
ugaguauuacuuuguaaau

SEQ ID NO: 2002266 - RNA, 15 nt, Shigella flexneri 2a str. 301
ugaguaccagcgcac

SEQ ID NO: 2002267 - RNA, 18 nt, Shigella flexneri 2a str. 301
ugaguacugaugaauaaa

SEQ ID NO: 2002268 - RNA, 20 nt, Shigella flexneri 2a str. 301
ugaggauuacgucuuuacua

SEQ ID NO: 2002269 - RNA, 14 nt, Shigella flexneri 2a str. 301
ugaggaagcgcagc

SEQ ID NO: 2002270 - RNA, 20 nt, Shigella flexneri 2a str. 301
ugagcugcgcgacucccuga

SEQ ID NO: 2002271 - RNA, 18 nt, Shigella flexneri 2a str. 301
ugagcugccucgcugaag

SEQ ID NO: 2002272 - RNA, 17 nt, Shigella flexneri 2a str. 301
ugagcuggucugaauca

SEQ ID NO: 2002273 - RNA, 13 nt, Shigella flexneri 2a str. 301
ugagcgauaccca

SEQ ID NO: 2002274 - RNA, 20 nt, Shigella flexneri 2a str. 301
ugagcgauacccauuuuauu

SEQ ID NO: 2002275 - RNA, 16 nt, Shigella flexneri 2a str. 301
ugagcgauaaacaagu

SEQ ID NO: 2002276 - RNA, 23 nt, Shigella flexneri 2a str. 301
ugagcuaaugcaaaucacgcugc

SEQ ID NO: 2002277 - RNA, 14 nt, Shigella flexneri 2a str. 301
ugagcguuucaaaa

SEQ ID NO: 2002278 - RNA, 18 nt, Shigella flexneri 2a str. 301
ugagcgguuucgccuccu

SEQ ID NO: 2002279 - RNA, 15 nt, Shigella flexneri 2a str. 301
ugagcguauccagca

SEQ ID NO: 2002280 - RNA, 12 nt, Shigella flexneri 2a str. 301
ugagcguuaccc

SEQ ID NO: 2002281 - RNA, 13 nt, Shigella flexneri 2a str. 301
ugagcgucauuau

SEQ ID NO: 2002282 - RNA, 18 nt, Shigella flexneri 2a str. 301
ugcaggauuaauaaauuu

SEQ ID NO: 2002283 - RNA, 16 nt, Shigella flexneri 2a str. 301
ugcaggcuauuucugg

SEQ ID NO: 2002284 - RNA, 20 nt, Shigella flexneri 2a str. 301
ugcaggcgcagauacagccu

SEQ ID NO: 2002285 - RNA, 11 nt, Shigella flexneri 2a str. 301
ugcaggcuggu

SEQ ID NO: 2002286 - RNA, 20 nt, Shigella flexneri 2a str. 301
ugcagcuuuaacgaucacug

SEQ ID NO: 2002287 - RNA, 17 nt, Shigella flexneri 2a str. 301
ugcagcugccuggccca

SEQ ID NO: 2002288 - RNA, 18 nt, Shigella flexneri 2a str. 301
ugcagcguuucgcgcgcg

SEQ ID NO: 2002289 - RNA, 21 nt, Shigella flexneri 2a str. 301
ugcagcggucacauguuccag

SEQ ID NO: 2002290 - RNA, 18 nt, Shigella flexneri 2a str. 301
ugcagcguaaaccccuua

SEQ ID NO: 2002291 - RNA, 17 nt, Shigella flexneri 2a str. 301
ugcagcggguuaauuuc

SEQ ID NO: 2002292 - RNA, 16 nt, Shigella flexneri 2a str. 301
ugcagcguacuucaug

SEQ ID NO: 2002293 - RNA, 18 nt, Shigella flexneri 2a str. 301
ugcagcggaucgccgccg

SEQ ID NO: 2002294 - RNA, 14 nt, Shigella flexneri 2a str. 301
ugcagcacugauaa

SEQ ID NO: 2002295 - RNA, 23 nt, Shigella flexneri 2a str. 301
ugcagcacacauuauaggccuga

SEQ ID NO: 2002296 - RNA, 17 nt, Shigella flexneri 2a str. 301
ugcagcccagcaucaga

SEQ ID NO: 2002297 - RNA, 22 nt, Shigella flexneri 2a str. 301
ugcagaucgcgauagugcuuaa

SEQ ID NO: 2002298 - RNA, 15 nt, Shigella flexneri 2a str. 301
ugcagauauugcacc

SEQ ID NO: 2002299 - RNA, 19 nt, Shigella flexneri 2a str. 301
ugcagauuugccaguaccg

SEQ ID NO: 2002300 - RNA, 20 nt, Shigella flexneri 2a str. 301
ugcagcaaacgauucaaaag

SEQ ID NO: 2002301 - RNA, 15 nt, Shigella flexneri 2a str. 301
ugcagauaccacauc

SEQ ID NO: 2002302 - RNA, 17 nt, Shigella flexneri 2a str. 301
ugcagauaccacaucaa

SEQ ID NO: 2002303 - RNA, 14 nt, Shigella flexneri 2a str. 301
ugcagacaaaguga

SEQ ID NO: 2002304 - RNA, 22 nt, Shigella flexneri 2a str. 301
ugcagaccgcugacggcagcga

SEQ ID NO: 2002305 - RNA, 16 nt, Shigella flexneri 2a str. 301
ugcagaaugauggcug

SEQ ID NO: 2002306 - RNA, 13 nt, Shigella flexneri 2a str. 301
ugcaauaaauaug

SEQ ID NO: 2002307 - RNA, 18 nt, Shigella flexneri 2a str. 301
ugcaauaauggaaccuaa

SEQ ID NO: 2002308 - RNA, 22 nt, Shigella flexneri 2a str. 301
ugcaauaauggaaccuaacgcu

SEQ ID NO: 2002309 - RNA, 22 nt, Shigella flexneri 2a str. 301
ugcaagguggucagacggaaca

SEQ ID NO: 2002310 - RNA, 18 nt, Shigella flexneri 2a str. 301
ugcaaggugaaagcaauu

SEQ ID NO: 2002311 - RNA, 14 nt, Shigella flexneri 2a str. 301
ugcaaggcuugaac

SEQ ID NO: 2002312 - RNA, 17 nt, Shigella flexneri 2a str. 301
ugcaagccuguaguaca

SEQ ID NO: 2002313 - RNA, 18 nt, Shigella flexneri 2a str. 301
ugcaagcgggguaaaugc

SEQ ID NO: 2002314 - RNA, 17 nt, Shigella flexneri 2a str. 301
ugcaaacgauaaaagug

SEQ ID NO: 2002315 - RNA, 15 nt, Shigella flexneri 2a str. 301
ugcaaugucaucagc

SEQ ID NO: 2002316 - RNA, 19 nt, Shigella flexneri 2a str. 301
ugcaaugccguuugcugca

SEQ ID NO: 2002317 - RNA, 23 nt, Shigella flexneri 2a str. 301
ugcaaugccguuugcugcaugau

SEQ ID NO: 2002318 - RNA, 24 nt, Shigella flexneri 2a str. 301
ugcaaucuacaaaagauuauugcu

SEQ ID NO: 2002319 - RNA, 20 nt, Shigella flexneri 2a str. 301
ugcacaaucguguggcauca

SEQ ID NO: 2002320 - RNA, 20 nt, Shigella flexneri 2a str. 301
ugcacaccgcggaacgcacu

SEQ ID NO: 2002321 - RNA, 18 nt, Shigella flexneri 2a str. 301
ugcacaccccgcgcagcu

SEQ ID NO: 2002322 - RNA, 22 nt, Shigella flexneri 2a str. 301
ugcacaagcgauaacucgcuuu

SEQ ID NO: 2002323 - RNA, 18 nt, Shigella flexneri 2a str. 301
ugcacaaauagccagcag

SEQ ID NO: 2002324 - RNA, 17 nt, Shigella flexneri 2a str. 301
ugcacguuaucagacac

SEQ ID NO: 2002325 - RNA, 22 nt, Shigella flexneri 2a str. 301
ugcacguuaucagacaccagcc

SEQ ID NO: 2002326 - RNA, 13 nt, Shigella flexneri 2a str. 301
ugcacugggagaa

SEQ ID NO: 2002327 - RNA, 17 nt, Shigella flexneri 2a str. 301
ugcacuuaacaggaucu

SEQ ID NO: 2002328 - RNA, 17 nt, Shigella flexneri 2a str. 301
ugcacuuugucaauaau

SEQ ID NO: 2002329 - RNA, 21 nt, Shigella flexneri 2a str. 301
ugcagaaauugucuccaccaa

SEQ ID NO: 2002330 - RNA, 14 nt, Shigella flexneri 2a str. 301
ugcacauuccagau

SEQ ID NO: 2002331 - RNA, 22 nt, Shigella flexneri 2a str. 301
ugcaccaacccuaacccaacau

SEQ ID NO: 2002332 - RNA, 23 nt, Shigella flexneri 2a str. 301
ugcacgaccggguuuucaaugau

SEQ ID NO: 2002333 - RNA, 17 nt, Shigella flexneri 2a str. 301
ugcaccuuuuccaccaa

SEQ ID NO: 2002334 - RNA, 14 nt, Shigella flexneri 2a str. 301
ugcacgaaaccacu

SEQ ID NO: 2002335 - RNA, 16 nt, Shigella flexneri 2a str. 301
ugcacgaaccagagac

SEQ ID NO: 2002336 - RNA, 15 nt, Shigella flexneri 2a str. 301
ugcacagcacgcuuu

SEQ ID NO: 2002337 - RNA, 12 nt, Shigella flexneri 2a str. 301
ugcacaggcaac

SEQ ID NO: 2002338 - RNA, 12 nt, Shigella flexneri 2a str. 301
ugcacaggcaau

SEQ ID NO: 2002339 - RNA, 14 nt, Shigella flexneri 2a str. 301
ugcacaugcaacgu

SEQ ID NO: 2002340 - RNA, 13 nt, Shigella flexneri 2a str. 301
ugcacaugcuuca

SEQ ID NO: 2002341 - RNA, 20 nt, Shigella flexneri 2a str. 301
ugcacauccacgccuuuuuu

SEQ ID NO: 2002342 - RNA, 14 nt, Shigella flexneri 2a str. 301
ugcacaucuaacca

SEQ ID NO: 2002343 - RNA, 18 nt, Shigella flexneri 2a str. 301
ugaguggaguccagcgcc

SEQ ID NO: 2002344 - RNA, 18 nt, Shigella flexneri 2a str. 301
ugaguggugaaaaaaagg

SEQ ID NO: 2002345 - RNA, 13 nt, Shigella flexneri 2a str. 301
ugagugaaucaga

SEQ ID NO: 2002346 - RNA, 19 nt, Shigella flexneri 2a str. 301
ugauauugcccgugacucc

SEQ ID NO: 2002347 - RNA, 18 nt, Shigella flexneri 2a str. 301
ugauauuucggcauuuuu

SEQ ID NO: 2002348 - RNA, 22 nt, Shigella flexneri 2a str. 301
ugauaucccgcgcguuuuucuu

SEQ ID NO: 2002349 - RNA, 16 nt, Shigella flexneri 2a str. 301
ugauauauuuuuaaau

SEQ ID NO: 2002350 - RNA, 19 nt, Shigella flexneri 2a str. 301
ugauauauuuuuaaauaua

SEQ ID NO: 2002351 - RNA, 15 nt, Shigella flexneri 2a str. 301
ugauaucaaaacgcu

SEQ ID NO: 2002352 - RNA, 22 nt, Shigella flexneri 2a str. 301
ugauauccaccgcguucagcag

SEQ ID NO: 2002353 - RNA, 22 nt, Shigella flexneri 2a str. 301
ugaucagccccggcaaaugacg

SEQ ID NO: 2002354 - RNA, 23 nt, Shigella flexneri 2a str. 301
ugaucagacacguuaauggcuuu

SEQ ID NO: 2002355 - RNA, 16 nt, Shigella flexneri 2a str. 301
ugaucagcaaucugaa

SEQ ID NO: 2002356 - RNA, 14 nt, Shigella flexneri 2a str. 301
ugauauuuucugcc

SEQ ID NO: 2002357 - RNA, 15 nt, Shigella flexneri 2a str. 301
ugauauuuuucccug

SEQ ID NO: 2002358 - RNA, 23 nt, Shigella flexneri 2a str. 301
ugaucaccguaaugaugauccag

SEQ ID NO: 2002359 - RNA, 18 nt, Shigella flexneri 2a str. 301
ugaucacuuucaccggcg

SEQ ID NO: 2002360 - RNA, 18 nt, Shigella flexneri 2a str. 301
ugauccuggauuuccucg

SEQ ID NO: 2002361 - RNA, 21 nt, Shigella flexneri 2a str. 301
ugauccugcaacagcaccagc

SEQ ID NO: 2002362 - RNA, 23 nt, Shigella flexneri 2a str. 301
ugaucccgauggucagcuucacc

SEQ ID NO: 2002363 - RNA, 20 nt, Shigella flexneri 2a str. 301
ugauccgccgcgcggugggc

SEQ ID NO: 2002364 - RNA, 13 nt, Shigella flexneri 2a str. 301
ugauccaggagcu

SEQ ID NO: 2002365 - RNA, 18 nt, Shigella flexneri 2a str. 301
ugauccacgguucuccac

SEQ ID NO: 2002366 - RNA, 20 nt, Shigella flexneri 2a str. 301
ugauccagaugugcaccuuu

SEQ ID NO: 2002367 - RNA, 17 nt, Shigella flexneri 2a str. 301
ugauccccgcuuccugc

SEQ ID NO: 2002368 - RNA, 15 nt, Shigella flexneri 2a str. 301
ugauccccgcuuccu

SEQ ID NO: 2002369 - RNA, 19 nt, Shigella flexneri 2a str. 301
ugauccaucagguaguguu

SEQ ID NO: 2002370 - RNA, 14 nt, Shigella flexneri 2a str. 301
ugaugcaccaccug

SEQ ID NO: 2002371 - RNA, 16 nt, Shigella flexneri 2a str. 301
ugaugccagcgaggua

SEQ ID NO: 2002372 - RNA, 14 nt, Shigella flexneri 2a str. 301
ugaugcauuuuuua

SEQ ID NO: 2002373 - RNA, 19 nt, Shigella flexneri 2a str. 301
ugaugauuuccggcagcau

SEQ ID NO: 2002374 - RNA, 19 nt, Shigella flexneri 2a str. 301
ugaugcgcuucgcuuauca

SEQ ID NO: 2002375 - RNA, 23 nt, Shigella flexneri 2a str. 301
ugaugcgcuucgcuuaccaugcc

SEQ ID NO: 2002376 - RNA, 16 nt, Shigella flexneri 2a str. 301
ugaugcgcggcuccag

SEQ ID NO: 2002377 - RNA, 14 nt, Shigella flexneri 2a str. 301
ugaugcgcuaugcu

SEQ ID NO: 2002378 - RNA, 21 nt, Shigella flexneri 2a str. 301
ugauggacauucuccggcagg

SEQ ID NO: 2002379 - RNA, 22 nt, Shigella flexneri 2a str. 301
ugauggaaaauuguuccgucag

SEQ ID NO: 2002380 - RNA, 16 nt, Shigella flexneri 2a str. 301
ugaucgccgcacuuuc

SEQ ID NO: 2002381 - RNA, 15 nt, Shigella flexneri 2a str. 301
ugaucgccauauuuc

SEQ ID NO: 2002382 - RNA, 20 nt, Shigella flexneri 2a str. 301
ugaucgccauauuucuccau

SEQ ID NO: 2002383 - RNA, 16 nt, Shigella flexneri 2a str. 301
ugaucgcguuuuuugu

SEQ ID NO: 2002384 - RNA, 11 nt, Shigella flexneri 2a str. 301
ugaugaaucag

SEQ ID NO: 2002385 - RNA, 16 nt, Shigella flexneri 2a str. 301
ugaugaaguccacgcg

SEQ ID NO: 2002386 - RNA, 21 nt, Shigella flexneri 2a str. 301
ugaucggcuggcgaaccagga

SEQ ID NO: 2002387 - RNA, 16 nt, Shigella flexneri 2a str. 301
ugaugacugaugcuuu

SEQ ID NO: 2002388 - RNA, 19 nt, Shigella flexneri 2a str. 301
ugauuuuuuccaacaggcg

SEQ ID NO: 2002389 - RNA, 17 nt, Shigella flexneri 2a str. 301
ugauuuuucguuuuaau

SEQ ID NO: 2002390 - RNA, 18 nt, Shigella flexneri 2a str. 301
ugauuuuucguuuuaaug

SEQ ID NO: 2002391 - RNA, 20 nt, Shigella flexneri 2a str. 301
ugcaaaaaauacguaaaauc

SEQ ID NO: 2002392 - RNA, 22 nt, Shigella flexneri 2a str. 301
ugcaaaaaauugcgucaguauu

SEQ ID NO: 2002393 - RNA, 23 nt, Shigella flexneri 2a str. 301
ugauuguugcgccaguaaauuua

SEQ ID NO: 2002394 - RNA, 13 nt, Shigella flexneri 2a str. 301
ugauucucccuca

SEQ ID NO: 2002395 - RNA, 17 nt, Shigella flexneri 2a str. 301
ugauucucccucaucau

SEQ ID NO: 2002396 - RNA, 21 nt, Shigella flexneri 2a str. 301
ugauucgcgccacguucggug

SEQ ID NO: 2002397 - RNA, 20 nt, Shigella flexneri 2a str. 301
ugauuuaaaaaauggccaga

SEQ ID NO: 2002398 - RNA, 20 nt, Shigella flexneri 2a str. 301
ugauuuaaaaccacuaccca

SEQ ID NO: 2002399 - RNA, 22 nt, Shigella flexneri 2a str. 301
ugauuuaaccaacaauaaaauu

SEQ ID NO: 2002400 - RNA, 19 nt, Shigella flexneri 2a str. 301
ugauuucgucauccggugu

SEQ ID NO: 2002401 - RNA, 22 nt, Shigella flexneri 2a str. 301
ugauuuccccuaacucuuucaa

SEQ ID NO: 2002402 - RNA, 20 nt, Shigella flexneri 2a str. 301
ugauuucuggcggauuuuua

SEQ ID NO: 2002403 - RNA, 16 nt, Shigella flexneri 2a str. 301
ugauggcccguuuuag

SEQ ID NO: 2002404 - RNA, 22 nt, Shigella flexneri 2a str. 301
ugauggccagauaacccagggg

SEQ ID NO: 2002405 - RNA, 20 nt, Shigella flexneri 2a str. 301
ugauggcauaacguugcagc

SEQ ID NO: 2002406 - RNA, 17 nt, Shigella flexneri 2a str. 301
ugauggcgauaaucuuu

SEQ ID NO: 2002407 - RNA, 19 nt, Shigella flexneri 2a str. 301
ugaugguaaaauaucacuc

SEQ ID NO: 2002408 - RNA, 23 nt, Shigella flexneri 2a str. 301
ugaugguaugcgaagguggcgga

SEQ ID NO: 2002409 - RNA, 15 nt, Shigella flexneri 2a str. 301
ugaugggcgaagaga

SEQ ID NO: 2002410 - RNA, 16 nt, Shigella flexneri 2a str. 301
ugaugggcagaauaac

SEQ ID NO: 2002411 - RNA, 14 nt, Shigella flexneri 2a str. 301
ugaugucacagccg

SEQ ID NO: 2002412 - RNA, 20 nt, Shigella flexneri 2a str. 301
ugaugucagcacuuccagcu

SEQ ID NO: 2002413 - RNA, 14 nt, Shigella flexneri 2a str. 301
ugauucacaguuaa

SEQ ID NO: 2002414 - RNA, 13 nt, Shigella flexneri 2a str. 301
ugauuaucggcau

SEQ ID NO: 2002415 - RNA, 15 nt, Shigella flexneri 2a str. 301
ugauuaugucaucau

SEQ ID NO: 2002416 - RNA, 21 nt, Shigella flexneri 2a str. 301
ugaugucguguuaauuaccua

SEQ ID NO: 2002417 - RNA, 21 nt, Shigella flexneri 2a str. 301
ugaugugacgcugucuuauca

SEQ ID NO: 2002418 - RNA, 16 nt, Shigella flexneri 2a str. 301
ugaugugcuucaucag

SEQ ID NO: 2002419 - RNA, 23 nt, Shigella flexneri 2a str. 301
gaccgcuucaaaguucugugucu

SEQ ID NO: 2002420 - RNA, 22 nt, Shigella flexneri 2a str. 301
gaccggcaaucgcgccagaaca

SEQ ID NO: 2002421 - RNA, 16 nt, Shigella flexneri 2a str. 301
gaccguccaggcgguc

SEQ ID NO: 2002422 - RNA, 20 nt, Shigella flexneri 2a str. 301
gaccguacccgcugcugacu

SEQ ID NO: 2002423 - RNA, 14 nt, Shigella flexneri 2a str. 301
gaccgggcgcggcu

SEQ ID NO: 2002424 - RNA, 17 nt, Shigella flexneri 2a str. 301
gaccucaagcucgccac

SEQ ID NO: 2002425 - RNA, 19 nt, Shigella flexneri 2a str. 301
gaccucaagcucgccacca

SEQ ID NO: 2002426 - RNA, 19 nt, Shigella flexneri 2a str. 301
gaccgugaucguggccaug

SEQ ID NO: 2002427 - RNA, 17 nt, Shigella flexneri 2a str. 301
gaccgucgccuucaacg

SEQ ID NO: 2002428 - RNA, 18 nt, Shigella flexneri 2a str. 301
gaccguuccauucaaacg

SEQ ID NO: 2002429 - RNA, 24 nt, Shigella flexneri 2a str. 301
gaccguugauuuuauuggcauggu

SEQ ID NO: 2002430 - RNA, 22 nt, Shigella flexneri 2a str. 301
gaccguuagcauauugcaggcu

SEQ ID NO: 2002431 - RNA, 15 nt, Shigella flexneri 2a str. 301
gaccguuuucaccag

SEQ ID NO: 2002432 - RNA, 16 nt, Shigella flexneri 2a str. 301
gaccuacaaaaccugc

SEQ ID NO: 2002433 - RNA, 16 nt, Shigella flexneri 2a str. 301
gaccuggcgcuucacu

SEQ ID NO: 2002434 - RNA, 15 nt, Shigella flexneri 2a str. 301
gaccugggaaaucca

SEQ ID NO: 2002435 - RNA, 23 nt, Shigella flexneri 2a str. 301
gaccugucggggccagcgcaucc

SEQ ID NO: 2002436 - RNA, 21 nt, Shigella flexneri 2a str. 301
gaccugcgucaccacauccag

SEQ ID NO: 2002437 - RNA, 20 nt, Shigella flexneri 2a str. 301
gaccugcgucaccacaucca

SEQ ID NO: 2002438 - RNA, 19 nt, Shigella flexneri 2a str. 301
gaccugcccaaucaugaac

SEQ ID NO: 2002439 - RNA, 18 nt, Shigella flexneri 2a str. 301
gaccugacuguuccagca

SEQ ID NO: 2002440 - RNA, 23 nt, Shigella flexneri 2a str. 301
gaccucuuaaugcaggcagcacu

SEQ ID NO: 2002441 - RNA, 18 nt, Shigella flexneri 2a str. 301
gaccugaauuugcuccag

SEQ ID NO: 2002442 - RNA, 20 nt, Shigella flexneri 2a str. 301
gacccugcguugucgcagug

SEQ ID NO: 2002443 - RNA, 22 nt, Shigella flexneri 2a str. 301
gacccugcguugucgcagugaa

SEQ ID NO: 2002444 - RNA, 23 nt, Shigella flexneri 2a str. 301
gacccugcguugucgcagugaag

SEQ ID NO: 2002445 - RNA, 19 nt, Shigella flexneri 2a str. 301
gacccugcucuuucagcac

SEQ ID NO: 2002446 - RNA, 23 nt, Shigella flexneri 2a str. 301
gacccugcucuuucagcaccgcg

SEQ ID NO: 2002447 - RNA, 19 nt, Shigella flexneri 2a str. 301
gacccugcuucggcggggu

SEQ ID NO: 2002448 - RNA, 15 nt, Shigella flexneri 2a str. 301
gacccggcggcgcgc

SEQ ID NO: 2002449 - RNA, 15 nt, Shigella flexneri 2a str. 301
gacccgcagccagca

SEQ ID NO: 2002450 - RNA, 18 nt, Shigella flexneri 2a str. 301
gaccgauccaguggcugu

SEQ ID NO: 2002451 - RNA, 13 nt, Shigella flexneri 2a str. 301
gaccgccagcgcc

SEQ ID NO: 2002452 - RNA, 12 nt, Shigella flexneri 2a str. 301
gaccgccaggca

SEQ ID NO: 2002453 - RNA, 17 nt, Shigella flexneri 2a str. 301
gaccgaugucgucccuu

SEQ ID NO: 2002454 - RNA, 15 nt, Shigella flexneri 2a str. 301
gaccgcaaccggccg

SEQ ID NO: 2002455 - RNA, 14 nt, Shigella flexneri 2a str. 301
gaccgcagaagccg

SEQ ID NO: 2002456 - RNA, 19 nt, Shigella flexneri 2a str. 301
gaccccaaccgcccugcgg

SEQ ID NO: 2002457 - RNA, 22 nt, Shigella flexneri 2a str. 301
gacccauuuugccgguucccaa

SEQ ID NO: 2002458 - RNA, 18 nt, Shigella flexneri 2a str. 301
gacccagccagacgccag

SEQ ID NO: 2002459 - RNA, 11 nt, Shigella flexneri 2a str. 301
gacccagcaag

SEQ ID NO: 2002460 - RNA, 18 nt, Shigella flexneri 2a str. 301
gaccaucuuccaguugca

SEQ ID NO: 2002461 - RNA, 16 nt, Shigella flexneri 2a str. 301
gacccaccccagcagc

SEQ ID NO: 2002462 - RNA, 17 nt, Shigella flexneri 2a str. 301
gaccauauuagccgcca

SEQ ID NO: 2002463 - RNA, 16 nt, Shigella flexneri 2a str. 301
gaccauauuagccgcc

SEQ ID NO: 2002464 - RNA, 17 nt, Shigella flexneri 2a str. 301
gaccaucagcaugacaa

SEQ ID NO: 2002465 - RNA, 13 nt, Shigella flexneri 2a str. 301
gaccaucccacca

SEQ ID NO: 2002466 - RNA, 20 nt, Shigella flexneri 2a str. 301
gaccaucccaccaccagcaa

SEQ ID NO: 2002467 - RNA, 17 nt, Shigella flexneri 2a str. 301
gaccauaaauaugguga

SEQ ID NO: 2002468 - RNA, 19 nt, Shigella flexneri 2a str. 301
gaccauaaauauggugaaa

SEQ ID NO: 2002469 - RNA, 22 nt, Shigella flexneri 2a str. 301
gaccaguuuuuucaccagcgcu

SEQ ID NO: 2002470 - RNA, 13 nt, Shigella flexneri 2a str. 301
gaccauaacccgc

SEQ ID NO: 2002471 - RNA, 15 nt, Shigella flexneri 2a str. 301
gaccauacagcagca

SEQ ID NO: 2002472 - RNA, 18 nt, Shigella flexneri 2a str. 301
gaccauacagcagcaacg

SEQ ID NO: 2002473 - RNA, 14 nt, Shigella flexneri 2a str. 301
gacgcgauccgccg

SEQ ID NO: 2002474 - RNA, 17 nt, Shigella flexneri 2a str. 301
gacgcgcaucacgacaa

SEQ ID NO: 2002475 - RNA, 18 nt, Shigella flexneri 2a str. 301
gacgcgcagcuucacuuc

SEQ ID NO: 2002476 - RNA, 13 nt, Shigella flexneri 2a str. 301
gacgcgccagcac

SEQ ID NO: 2002477 - RNA, 14 nt, Shigella flexneri 2a str. 301
gacgccgucaaaac

SEQ ID NO: 2002478 - RNA, 19 nt, Shigella flexneri 2a str. 301
gacgccgucaaaacgcgac

SEQ ID NO: 2002479 - RNA, 21 nt, Shigella flexneri 2a str. 301
gacgccgccggugucgcaccu

SEQ ID NO: 2002480 - RNA, 19 nt, Shigella flexneri 2a str. 301
gacgccgcgguucuuccaa

SEQ ID NO: 2002481 - RNA, 13 nt, Shigella flexneri 2a str. 301
gacgcagucaugc

SEQ ID NO: 2002482 - RNA, 19 nt, Shigella flexneri 2a str. 301
gacgcagucaugcgagaag

SEQ ID NO: 2002483 - RNA, 22 nt, Shigella flexneri 2a str. 301
gacgcauccgaucgcgcaucag

SEQ ID NO: 2002484 - RNA, 14 nt, Shigella flexneri 2a str. 301
gacgcccacgcggu

SEQ ID NO: 2002485 - RNA, 16 nt, Shigella flexneri 2a str. 301
gacgccacuggcuggg

SEQ ID NO: 2002486 - RNA, 16 nt, Shigella flexneri 2a str. 301
gacgccacaaucugau

SEQ ID NO: 2002487 - RNA, 19 nt, Shigella flexneri 2a str. 301
gacgcccugcgcuggugaa

SEQ ID NO: 2002488 - RNA, 16 nt, Shigella flexneri 2a str. 301
gacggaauaaacccac

SEQ ID NO: 2002489 - RNA, 19 nt, Shigella flexneri 2a str. 301
gacggaauauugaugacgc

SEQ ID NO: 2002490 - RNA, 23 nt, Shigella flexneri 2a str. 301
gacggauaaggcguuuacgccgc

SEQ ID NO: 2002491 - RNA, 21 nt, Shigella flexneri 2a str. 301
gacggccucugcggaggccgu

SEQ ID NO: 2002492 - RNA, 23 nt, Shigella flexneri 2a str. 301
gacgcugaugucagcacuuccag

SEQ ID NO: 2002493 - RNA, 16 nt, Shigella flexneri 2a str. 301
gacgcgguaaaagccc

SEQ ID NO: 2002494 - RNA, 17 nt, Shigella flexneri 2a str. 301
gacgcgguaaaagccca

SEQ ID NO: 2002495 - RNA, 17 nt, Shigella flexneri 2a str. 301
gacgcgguauuggugaa

SEQ ID NO: 2002496 - RNA, 19 nt, Shigella flexneri 2a str. 301
gacgcucgccauuuuucag

SEQ ID NO: 2002497 - RNA, 15 nt, Shigella flexneri 2a str. 301
gacgacgacgcgcgc

SEQ ID NO: 2002498 - RNA, 14 nt, Shigella flexneri 2a str. 301
gacgacgaagaaac

SEQ ID NO: 2002499 - RNA, 22 nt, Shigella flexneri 2a str. 301
gacgacgccccggccuugccug

SEQ ID NO: 2002500 - RNA, 11 nt, Shigella flexneri 2a str. 301
gacgacgcuga

SEQ ID NO: 2002501 - RNA, 15 nt, Shigella flexneri 2a str. 301
gacgaccugauuuug

SEQ ID NO: 2002502 - RNA, 14 nt, Shigella flexneri 2a str. 301
gacgaccaaugaca

SEQ ID NO: 2002503 - RNA, 13 nt, Shigella flexneri 2a str. 301
gacgacaccaucu

SEQ ID NO: 2002504 - RNA, 12 nt, Shigella flexneri 2a str. 301
gacgacaggcaa

SEQ ID NO: 2002505 - RNA, 15 nt, Shigella flexneri 2a str. 301
gacgaacuucacggu

SEQ ID NO: 2002506 - RNA, 16 nt, Shigella flexneri 2a str. 301
gacgaaauccccccgg

SEQ ID NO: 2002507 - RNA, 15 nt, Shigella flexneri 2a str. 301
gacgaaagucugggc

SEQ ID NO: 2002508 - RNA, 13 nt, Shigella flexneri 2a str. 301
gaccuuuuuucag

SEQ ID NO: 2002509 - RNA, 23 nt, Shigella flexneri 2a str. 301
gacgcagaccaaagucaaacugg

SEQ ID NO: 2002510 - RNA, 12 nt, Shigella flexneri 2a str. 301
gacgcagcaugc

SEQ ID NO: 2002511 - RNA, 22 nt, Shigella flexneri 2a str. 301
gacgcaggaugcaauuguugag

SEQ ID NO: 2002512 - RNA, 18 nt, Shigella flexneri 2a str. 301
gacgcaaccgcaaaugau

SEQ ID NO: 2002513 - RNA, 15 nt, Shigella flexneri 2a str. 301
gacgauugugcuggu

SEQ ID NO: 2002514 - RNA, 16 nt, Shigella flexneri 2a str. 301
gacgauuacucgccuu

SEQ ID NO: 2002515 - RNA, 21 nt, Shigella flexneri 2a str. 301
gacgaugggucacugugacgu

SEQ ID NO: 2002516 - RNA, 17 nt, Shigella flexneri 2a str. 301
gacgauagaaccuucca

SEQ ID NO: 2002517 - RNA, 23 nt, Shigella flexneri 2a str. 301
gacgauagauagagaaguaaccg

SEQ ID NO: 2002518 - RNA, 12 nt, Shigella flexneri 2a str. 301
gacgaucaccac

SEQ ID NO: 2002519 - RNA, 15 nt, Shigella flexneri 2a str. 301
gacgaucaacccagu

SEQ ID NO: 2002520 - RNA, 16 nt, Shigella flexneri 2a str. 301
gacgaucgcagaugaa

SEQ ID NO: 2002521 - RNA, 13 nt, Shigella flexneri 2a str. 301
gacgagcgcuggu

SEQ ID NO: 2002522 - RNA, 16 nt, Shigella flexneri 2a str. 301
gacacaggcagcaauc

SEQ ID NO: 2002523 - RNA, 23 nt, Shigella flexneri 2a str. 301
gacacagauaccaaaaucggcaa

SEQ ID NO: 2002524 - RNA, 15 nt, Shigella flexneri 2a str. 301
gacacaucuaaugcu

SEQ ID NO: 2002525 - RNA, 19 nt, Shigella flexneri 2a str. 301
gacacaguucuucaaaaau

SEQ ID NO: 2002526 - RNA, 15 nt, Shigella flexneri 2a str. 301
gacacaacuggcgca

SEQ ID NO: 2002527 - RNA, 21 nt, Shigella flexneri 2a str. 301
gacacacgagaguuaguguua

SEQ ID NO: 2002528 - RNA, 16 nt, Shigella flexneri 2a str. 301
gacacacugaaccgcg

SEQ ID NO: 2002529 - RNA, 18 nt, Shigella flexneri 2a str. 301
gacaauuuguuggcgaaa

SEQ ID NO: 2002530 - RNA, 20 nt, Shigella flexneri 2a str. 301
gacacccucgaccaaaugaa

SEQ ID NO: 2002531 - RNA, 13 nt, Shigella flexneri 2a str. 301
gacacuccuuccu

SEQ ID NO: 2002532 - RNA, 13 nt, Shigella flexneri 2a str. 301
gacacuauuuccc

SEQ ID NO: 2002533 - RNA, 21 nt, Shigella flexneri 2a str. 301
gacacgcuaccuugagguggu

SEQ ID NO: 2002534 - RNA, 16 nt, Shigella flexneri 2a str. 301
gacacggcguauacaa

SEQ ID NO: 2002535 - RNA, 18 nt, Shigella flexneri 2a str. 301
gacagcaucguccgccag

SEQ ID NO: 2002536 - RNA, 12 nt, Shigella flexneri 2a str. 301
gacagcaugggg

SEQ ID NO: 2002537 - RNA, 20 nt, Shigella flexneri 2a str. 301
gacagcaucauaguggguuu

SEQ ID NO: 2002538 - RNA, 20 nt, Shigella flexneri 2a str. 301
gacagcccggcauguuucaa

SEQ ID NO: 2002539 - RNA, 15 nt, Shigella flexneri 2a str. 301
gacagcgauuccagu

SEQ ID NO: 2002540 - RNA, 20 nt, Shigella flexneri 2a str. 301
gacagcucguuaaucagaau

SEQ ID NO: 2002541 - RNA, 12 nt, Shigella flexneri 2a str. 301
gacagacuggcu

SEQ ID NO: 2002542 - RNA, 23 nt, Shigella flexneri 2a str. 301
gacagacgacgacgcgcgcgggu

SEQ ID NO: 2002543 - RNA, 21 nt, Shigella flexneri 2a str. 301
gacagaacucguucagcgcau

SEQ ID NO: 2002544 - RNA, 20 nt, Shigella flexneri 2a str. 301
gacagauucaugcugcggcu

SEQ ID NO: 2002545 - RNA, 18 nt, Shigella flexneri 2a str. 301
gacagcaaagugccccca

SEQ ID NO: 2002546 - RNA, 15 nt, Shigella flexneri 2a str. 301
gacagaugcucgcca

SEQ ID NO: 2002547 - RNA, 22 nt, Shigella flexneri 2a str. 301
gacagauuuugccagcaugacu

SEQ ID NO: 2002548 - RNA, 20 nt, Shigella flexneri 2a str. 301
gacagagauucgguaaccau

SEQ ID NO: 2002549 - RNA, 23 nt, Shigella flexneri 2a str. 301
gacagaucugccuguccggaaua

SEQ ID NO: 2002550 - RNA, 16 nt, Shigella flexneri 2a str. 301
gacagcaggcucagaa

SEQ ID NO: 2002551 - RNA, 19 nt, Shigella flexneri 2a str. 301
gacaauaugcucuccacca

SEQ ID NO: 2002552 - RNA, 20 nt, Shigella flexneri 2a str. 301
gacaauagcuaacgaaaaug

SEQ ID NO: 2002553 - RNA, 12 nt, Shigella flexneri 2a str. 301
gacaauaauauc

SEQ ID NO: 2002554 - RNA, 21 nt, Shigella flexneri 2a str. 301
gacaauaauacccagcaccgc

SEQ ID NO: 2002555 - RNA, 23 nt, Shigella flexneri 2a str. 301
gacaauaauacccagcaccgcag

SEQ ID NO: 2002556 - RNA, 20 nt, Shigella flexneri 2a str. 301
gacaaucgcuucgucaagac

SEQ ID NO: 2002557 - RNA, 15 nt, Shigella flexneri 2a str. 301
gacaaugcaguucca

SEQ ID NO: 2002558 - RNA, 20 nt, Shigella flexneri 2a str. 301
gacaacgccuuguucgcccu

SEQ ID NO: 2002559 - RNA, 18 nt, Shigella flexneri 2a str. 301
gacaacgccauauaaauu

SEQ ID NO: 2002560 - RNA, 18 nt, Shigella flexneri 2a str. 301
gacaaccagcuucaacga

SEQ ID NO: 2002561 - RNA, 13 nt, Shigella flexneri 2a str. 301
gacaacaucaucu

SEQ ID NO: 2002562 - RNA, 22 nt, Shigella flexneri 2a str. 301
gacaaggcaggcaucaaugaaa

SEQ ID NO: 2002563 - RNA, 12 nt, Shigella flexneri 2a str. 301
gacaacuucccu

SEQ ID NO: 2002564 - RNA, 19 nt, Shigella flexneri 2a str. 301
gacaagcguaugauugccu

SEQ ID NO: 2002565 - RNA, 17 nt, Shigella flexneri 2a str. 301
gacaagcgucgcaucag

SEQ ID NO: 2002566 - RNA, 13 nt, Shigella flexneri 2a str. 301
gacaagcuuacgu

SEQ ID NO: 2002567 - RNA, 17 nt, Shigella flexneri 2a str. 301
gacaacugcauuuucaa

SEQ ID NO: 2002568 - RNA, 21 nt, Shigella flexneri 2a str. 301
gacaaacagcucgacaccaaa

SEQ ID NO: 2002569 - RNA, 17 nt, Shigella flexneri 2a str. 301
gacaaacauugcugcca

SEQ ID NO: 2002570 - RNA, 14 nt, Shigella flexneri 2a str. 301
gacaaacaaugaga

SEQ ID NO: 2002571 - RNA, 14 nt, Shigella flexneri 2a str. 301
gacaaacacaaaac

SEQ ID NO: 2002572 - RNA, 22 nt, Shigella flexneri 2a str. 301
gacaaacgcuguaauuaccagc

SEQ ID NO: 2002573 - RNA, 19 nt, Shigella flexneri 2a str. 301
gacaacaaaacgggggcua

SEQ ID NO: 2002574 - RNA, 18 nt, Shigella flexneri 2a str. 301
gacaaaucagaacggaau

SEQ ID NO: 2002575 - RNA, 23 nt, Shigella flexneri 2a str. 301
gacaaauccuucacuuuugccag

SEQ ID NO: 2002576 - RNA, 19 nt, Shigella flexneri 2a str. 301
gaauuuuuccguugcugau

SEQ ID NO: 2002577 - RNA, 12 nt, Shigella flexneri 2a str. 301
gaauuuuccuuc

SEQ ID NO: 2002578 - RNA, 15 nt, Shigella flexneri 2a str. 301
gaauuuuccuucgga

SEQ ID NO: 2002579 - RNA, 22 nt, Shigella flexneri 2a str. 301
gaauuuuuuauagaccuuaauu

SEQ ID NO: 2002580 - RNA, 21 nt, Shigella flexneri 2a str. 301
gaauuugucgauuuccaucuc

SEQ ID NO: 2002581 - RNA, 23 nt, Shigella flexneri 2a str. 301
gaauuuuaguucacauagacccu

SEQ ID NO: 2002582 - RNA, 21 nt, Shigella flexneri 2a str. 301
gaccacccaccgcagcccaga

SEQ ID NO: 2002583 - RNA, 17 nt, Shigella flexneri 2a str. 301
gaccacccaccgcagcc

SEQ ID NO: 2002584 - RNA, 19 nt, Shigella flexneri 2a str. 301
gaccaccauauucgccacc

SEQ ID NO: 2002585 - RNA, 23 nt, Shigella flexneri 2a str. 301
gaccacuuuccucaucagaaaga

SEQ ID NO: 2002586 - RNA, 17 nt, Shigella flexneri 2a str. 301
gaccagaaacgccacca

SEQ ID NO: 2002587 - RNA, 19 nt, Shigella flexneri 2a str. 301
gaccagaauaagucuggca

SEQ ID NO: 2002588 - RNA, 20 nt, Shigella flexneri 2a str. 301
gaccacggccacagccagcc

SEQ ID NO: 2002589 - RNA, 16 nt, Shigella flexneri 2a str. 301
gaccacggccacagcc

SEQ ID NO: 2002590 - RNA, 20 nt, Shigella flexneri 2a str. 301
gaccaaaggcgaugcuguau

SEQ ID NO: 2002591 - RNA, 18 nt, Shigella flexneri 2a str. 301
gaccaacuucagcaacaa

SEQ ID NO: 2002592 - RNA, 23 nt, Shigella flexneri 2a str. 301
gaccaccaccgauauugccaccu

SEQ ID NO: 2002593 - RNA, 13 nt, Shigella flexneri 2a str. 301
gaccaauccagcc

SEQ ID NO: 2002594 - RNA, 14 nt, Shigella flexneri 2a str. 301
gaccaaucaccacu

SEQ ID NO: 2002595 - RNA, 20 nt, Shigella flexneri 2a str. 301
gaccaaucacacaaccaugc

SEQ ID NO: 2002596 - RNA, 13 nt, Shigella flexneri 2a str. 301
gaccaauccgcca

SEQ ID NO: 2002597 - RNA, 15 nt, Shigella flexneri 2a str. 301
gaccaauccgccagc

SEQ ID NO: 2002598 - RNA, 21 nt, Shigella flexneri 2a str. 301
gaccagcgucgcaucaggcau

SEQ ID NO: 2002599 - RNA, 19 nt, Shigella flexneri 2a str. 301
gaccagcggguugcugaga

SEQ ID NO: 2002600 - RNA, 22 nt, Shigella flexneri 2a str. 301
gaccagcgccgcaacuaccagc

SEQ ID NO: 2002601 - RNA, 22 nt, Shigella flexneri 2a str. 301
gaccagcgauaaaaauccgcca

SEQ ID NO: 2002602 - RNA, 15 nt, Shigella flexneri 2a str. 301
gaccagcaacaaaua

SEQ ID NO: 2002603 - RNA, 22 nt, Shigella flexneri 2a str. 301
gaccagaugcgacguaaaaacu

SEQ ID NO: 2002604 - RNA, 18 nt, Shigella flexneri 2a str. 301
gaccagcaucccggcagc

SEQ ID NO: 2002605 - RNA, 16 nt, Shigella flexneri 2a str. 301
gaccagccaggccgcc

SEQ ID NO: 2002606 - RNA, 16 nt, Shigella flexneri 2a str. 301
gaccaggaaacccaac

SEQ ID NO: 2002607 - RNA, 19 nt, Shigella flexneri 2a str. 301
gaccagcugccgacgccag

SEQ ID NO: 2002608 - RNA, 23 nt, Shigella flexneri 2a str. 301
gaccagcugccgacgccaguucu

SEQ ID NO: 2002609 - RNA, 16 nt, Shigella flexneri 2a str. 301
gaccaggcaaaccagu

SEQ ID NO: 2002610 - RNA, 20 nt, Shigella flexneri 2a str. 301
gaccaggauuugauggucuc

SEQ ID NO: 2002611 - RNA, 19 nt, Shigella flexneri 2a str. 301
gaccaggccaucagcagcg

SEQ ID NO: 2002612 - RNA, 15 nt, Shigella flexneri 2a str. 301
gaccaggccaucagc

SEQ ID NO: 2002613 - RNA, 20 nt, Shigella flexneri 2a str. 301
gaccaggccaucagcagcgg

SEQ ID NO: 2002614 - RNA, 18 nt, Shigella flexneri 2a str. 301
gaccaguucacaccagcc

SEQ ID NO: 2002615 - RNA, 20 nt, Shigella flexneri 2a str. 301
gaccagggcgucaccuugcc

SEQ ID NO: 2002616 - RNA, 18 nt, Shigella flexneri 2a str. 301
gacauuguuuccauaugu

SEQ ID NO: 2002617 - RNA, 16 nt, Shigella flexneri 2a str. 301
gacauuguuuccauau

SEQ ID NO: 2002618 - RNA, 15 nt, Shigella flexneri 2a str. 301
gacauucugacuggu

SEQ ID NO: 2002619 - RNA, 16 nt, Shigella flexneri 2a str. 301
gacauucaccucacga

SEQ ID NO: 2002620 - RNA, 22 nt, Shigella flexneri 2a str. 301
gacaugcaucacgcgcaucugu

SEQ ID NO: 2002621 - RNA, 19 nt, Shigella flexneri 2a str. 301
gacauggcccagcccacug

SEQ ID NO: 2002622 - RNA, 20 nt, Shigella flexneri 2a str. 301
gacauggugcgauuaagaua

SEQ ID NO: 2002623 - RNA, 17 nt, Shigella flexneri 2a str. 301
gacauuacggauuaaau

SEQ ID NO: 2002624 - RNA, 14 nt, Shigella flexneri 2a str. 301
gacauguugcugac

SEQ ID NO: 2002625 - RNA, 15 nt, Shigella flexneri 2a str. 301
gacauguugcugacc

SEQ ID NO: 2002626 - RNA, 22 nt, Shigella flexneri 2a str. 301
gacaucuuucugcgcaucuucc

SEQ ID NO: 2002627 - RNA, 17 nt, Shigella flexneri 2a str. 301
gacaucgucaggggcau

SEQ ID NO: 2002628 - RNA, 14 nt, Shigella flexneri 2a str. 301
gacaucguaaagcu

SEQ ID NO: 2002629 - RNA, 18 nt, Shigella flexneri 2a str. 301
gacaucguaaagcugcgc

SEQ ID NO: 2002630 - RNA, 14 nt, Shigella flexneri 2a str. 301
gacaucgugcuggu

SEQ ID NO: 2002631 - RNA, 23 nt, Shigella flexneri 2a str. 301
gacaucuuucugcgcaucuuccc

SEQ ID NO: 2002632 - RNA, 13 nt, Shigella flexneri 2a str. 301
gacaugacccggc

SEQ ID NO: 2002633 - RNA, 22 nt, Shigella flexneri 2a str. 301
gacaugaucuuuuuauugaaga

SEQ ID NO: 2002634 - RNA, 13 nt, Shigella flexneri 2a str. 301
gacaugcaucacg

SEQ ID NO: 2002635 - RNA, 23 nt, Shigella flexneri 2a str. 301
gacaucgccacggcaugaaagcg

SEQ ID NO: 2002636 - RNA, 20 nt, Shigella flexneri 2a str. 301
gacauccagcccggcggcgu

SEQ ID NO: 2002637 - RNA, 17 nt, Shigella flexneri 2a str. 301
gacaucccgccagccgc

SEQ ID NO: 2002638 - RNA, 15 nt, Shigella flexneri 2a str. 301
gacaucccagugcaa

SEQ ID NO: 2002639 - RNA, 18 nt, Shigella flexneri 2a str. 301
gacaucagcauccgcacg

SEQ ID NO: 2002640 - RNA, 22 nt, Shigella flexneri 2a str. 301
gacaguccccucgccccuccgg

SEQ ID NO: 2002641 - RNA, 14 nt, Shigella flexneri 2a str. 301
gacaguaucaucau

SEQ ID NO: 2002642 - RNA, 19 nt, Shigella flexneri 2a str. 301
gacaguaucaucauuauua

SEQ ID NO: 2002643 - RNA, 20 nt, Shigella flexneri 2a str. 301
gacaguaaucuaccccagug

SEQ ID NO: 2002644 - RNA, 19 nt, Shigella flexneri 2a str. 301
gacaggucagcgccuggcu

SEQ ID NO: 2002645 - RNA, 13 nt, Shigella flexneri 2a str. 301
gacaguaaaguuu

SEQ ID NO: 2002646 - RNA, 17 nt, Shigella flexneri 2a str. 301
gacaggcgaaacccgcu

SEQ ID NO: 2002647 - RNA, 17 nt, Shigella flexneri 2a str. 301
gacaucaacgaugccuu

SEQ ID NO: 2002648 - RNA, 13 nt, Shigella flexneri 2a str. 301
gacaucaagaaau

SEQ ID NO: 2002649 - RNA, 12 nt, Shigella flexneri 2a str. 301
gacauauuuuug

SEQ ID NO: 2002650 - RNA, 16 nt, Shigella flexneri 2a str. 301
gacauauaaccggcaa

SEQ ID NO: 2002651 - RNA, 13 nt, Shigella flexneri 2a str. 301
gacauaugcuuaa

SEQ ID NO: 2002652 - RNA, 14 nt, Shigella flexneri 2a str. 301
gacauauaaccggc

SEQ ID NO: 2002653 - RNA, 16 nt, Shigella flexneri 2a str. 301
gacauagucaucaucu

SEQ ID NO: 2002654 - RNA, 20 nt, Shigella flexneri 2a str. 301
gacauagucaucaucucugu

SEQ ID NO: 2002655 - RNA, 20 nt, Shigella flexneri 2a str. 301
gacagugggauuaaaaagua

SEQ ID NO: 2002656 - RNA, 17 nt, Shigella flexneri 2a str. 301
gacaguuaucaaauuca

SEQ ID NO: 2002657 - RNA, 16 nt, Shigella flexneri 2a str. 301
gacaguucaaucuccg

SEQ ID NO: 2002658 - RNA, 16 nt, Shigella flexneri 2a str. 301
gacaguugauccagcu

SEQ ID NO: 2002659 - RNA, 17 nt, Shigella flexneri 2a str. 301
gacaguugauccagcuu

SEQ ID NO: 2002660 - RNA, 18 nt, Shigella flexneri 2a str. 301
gacauaaacauuccacuu

SEQ ID NO: 2002661 - RNA, 16 nt, Shigella flexneri 2a str. 301
gacauaaacaccagca

SEQ ID NO: 2002662 - RNA, 17 nt, Shigella flexneri 2a str. 301
gacauaaacaccagcaa

SEQ ID NO: 2002663 - RNA, 17 nt, Shigella flexneri 2a str. 301
gacuucuucauucaucc

SEQ ID NO: 2002664 - RNA, 21 nt, Shigella flexneri 2a str. 301
gacuucuucauucauccgccg

SEQ ID NO: 2002665 - RNA, 14 nt, Shigella flexneri 2a str. 301
gacuucuucauuca

SEQ ID NO: 2002666 - RNA, 15 nt, Shigella flexneri 2a str. 301
gacuucugcuuucau

SEQ ID NO: 2002667 - RNA, 23 nt, Shigella flexneri 2a str. 301
gacuugcucaggaguaaacuuuc

SEQ ID NO: 2002668 - RNA, 14 nt, Shigella flexneri 2a str. 301
gacuuauucuucaa

SEQ ID NO: 2002669 - RNA, 14 nt, Shigella flexneri 2a str. 301
gacuucagauaaau

SEQ ID NO: 2002670 - RNA, 13 nt, Shigella flexneri 2a str. 301
gacuuauucuuca

SEQ ID NO: 2002671 - RNA, 14 nt, Shigella flexneri 2a str. 301
gacuucccucccgu

SEQ ID NO: 2002672 - RNA, 13 nt, Shigella flexneri 2a str. 301
gacuuccacuucc

SEQ ID NO: 2002673 - RNA, 12 nt, Shigella flexneri 2a str. 301
gacuuccgggau

SEQ ID NO: 2002674 - RNA, 18 nt, Shigella flexneri 2a str. 301
gacugucgcagccagcgc

SEQ ID NO: 2002675 - RNA, 18 nt, Shigella flexneri 2a str. 301
gacugucagaugcggcuu

SEQ ID NO: 2002676 - RNA, 21 nt, Shigella flexneri 2a str. 301
gacuguuauugcgcaggcgcg

SEQ ID NO: 2002677 - RNA, 15 nt, Shigella flexneri 2a str. 301
gacuuauaagucuca

SEQ ID NO: 2002678 - RNA, 19 nt, Shigella flexneri 2a str. 301
gacuuauaagucucagaaa

SEQ ID NO: 2002679 - RNA, 19 nt, Shigella flexneri 2a str. 301
gacuguacagauccgccau

SEQ ID NO: 2002680 - RNA, 20 nt, Shigella flexneri 2a str. 301
gacuguacagauccgccauu

SEQ ID NO: 2002681 - RNA, 12 nt, Shigella flexneri 2a str. 301
gacugucagaug

SEQ ID NO: 2002682 - RNA, 20 nt, Shigella flexneri 2a str. 301
gacuggcucuuuuucggggc

SEQ ID NO: 2002683 - RNA, 21 nt, Shigella flexneri 2a str. 301
gacuggcggcaaaacagggcu

SEQ ID NO: 2002684 - RNA, 16 nt, Shigella flexneri 2a str. 301
gacuggcgagauccgg

SEQ ID NO: 2002685 - RNA, 21 nt, Shigella flexneri 2a str. 301
gacuuuauaccuugcggaagc

SEQ ID NO: 2002686 - RNA, 20 nt, Shigella flexneri 2a str. 301
gacuuuguuuuuaguuaaau

SEQ ID NO: 2002687 - RNA, 20 nt, Shigella flexneri 2a str. 301
gacuuucuccgcauccggca

SEQ ID NO: 2002688 - RNA, 12 nt, Shigella flexneri 2a str. 301
gacuuuucaagu

SEQ ID NO: 2002689 - RNA, 21 nt, Shigella flexneri 2a str. 301
gacuuugacauguugcugacc

SEQ ID NO: 2002690 - RNA, 17 nt, Shigella flexneri 2a str. 301
gacuuuugcccggcaug

SEQ ID NO: 2002691 - RNA, 22 nt, Shigella flexneri 2a str. 301
gacuuuucauaagcgucagaaa

SEQ ID NO: 2002692 - RNA, 23 nt, Shigella flexneri 2a str. 301
gacuuuuuccaguccacguucaa

SEQ ID NO: 2002693 - RNA, 15 nt, Shigella flexneri 2a str. 301
gacuuuuuccugcuc

SEQ ID NO: 2002694 - RNA, 23 nt, Shigella flexneri 2a str. 301
gacuuuuuucaugggugccagau

SEQ ID NO: 2002695 - RNA, 14 nt, Shigella flexneri 2a str. 301
gagaaaaagcgaag

SEQ ID NO: 2002696 - RNA, 22 nt, Shigella flexneri 2a str. 301
gacuuuuuccugcucaaugucu

SEQ ID NO: 2002697 - RNA, 22 nt, Shigella flexneri 2a str. 301
gagaaaaaaaagcauccgauga

SEQ ID NO: 2002698 - RNA, 23 nt, Shigella flexneri 2a str. 301
gagaaaguaaaccaccaguccuu

SEQ ID NO: 2002699 - RNA, 22 nt, Shigella flexneri 2a str. 301
gagaacaccaccugccagagcu

SEQ ID NO: 2002700 - RNA, 16 nt, Shigella flexneri 2a str. 301
gagaacaccaccugcc

SEQ ID NO: 2002701 - RNA, 19 nt, Shigella flexneri 2a str. 301
gagaaaaugccgcacauca

SEQ ID NO: 2002702 - RNA, 21 nt, Shigella flexneri 2a str. 301
gagaaaaccgaugcagugcgg

SEQ ID NO: 2002703 - RNA, 11 nt, Shigella flexneri 2a str. 301
gagaaaaauag

SEQ ID NO: 2002704 - RNA, 18 nt, Shigella flexneri 2a str. 301
gagaaaccacaucaaucc

SEQ ID NO: 2002705 - RNA, 23 nt, Shigella flexneri 2a str. 301
gagaaaauuucauuaauaucagg

SEQ ID NO: 2002706 - RNA, 12 nt, Shigella flexneri 2a str. 301
gagacgcgcuug

SEQ ID NO: 2002707 - RNA, 14 nt, Shigella flexneri 2a str. 301
gagacucaaacccc

SEQ ID NO: 2002708 - RNA, 21 nt, Shigella flexneri 2a str. 301
gagacgguuaaaaacagccag

SEQ ID NO: 2002709 - RNA, 13 nt, Shigella flexneri 2a str. 301
gagagaagaaacg

SEQ ID NO: 2002710 - RNA, 11 nt, Shigella flexneri 2a str. 301
gagagaaaaaa

SEQ ID NO: 2002711 - RNA, 12 nt, Shigella flexneri 2a str. 301
gagagaaaaaaa

SEQ ID NO: 2002712 - RNA, 16 nt, Shigella flexneri 2a str. 301
gagagaaaaaaaagca

SEQ ID NO: 2002713 - RNA, 15 nt, Shigella flexneri 2a str. 301
gagagaaaagcaaaa

SEQ ID NO: 2002714 - RNA, 22 nt, Shigella flexneri 2a str. 301
gagagguaaaaccugacaacaa

SEQ ID NO: 2002715 - RNA, 17 nt, Shigella flexneri 2a str. 301
gagagguaaaaccugac

SEQ ID NO: 2002716 - RNA, 22 nt, Shigella flexneri 2a str. 301
gagaggcugaaggcgcuccccu

SEQ ID NO: 2002717 - RNA, 15 nt, Shigella flexneri 2a str. 301
gagagcgccagaagu

SEQ ID NO: 2002718 - RNA, 13 nt, Shigella flexneri 2a str. 301
gagagagaaaaua

SEQ ID NO: 2002719 - RNA, 19 nt, Shigella flexneri 2a str. 301
gagagccggacugacauua

SEQ ID NO: 2002720 - RNA, 15 nt, Shigella flexneri 2a str. 301
gagaagcuggaaggg

SEQ ID NO: 2002721 - RNA, 14 nt, Shigella flexneri 2a str. 301
gagaagcuggaagg

SEQ ID NO: 2002722 - RNA, 13 nt, Shigella flexneri 2a str. 301
gagaagcaccgcc

SEQ ID NO: 2002723 - RNA, 16 nt, Shigella flexneri 2a str. 301
gagaagccaccgcgcc

SEQ ID NO: 2002724 - RNA, 18 nt, Shigella flexneri 2a str. 301
gagaagguugccauaucu

SEQ ID NO: 2002725 - RNA, 19 nt, Shigella flexneri 2a str. 301
gagaauaagcgcagcugcu

SEQ ID NO: 2002726 - RNA, 22 nt, Shigella flexneri 2a str. 301
gagaauaagcgcagcugcuauu

SEQ ID NO: 2002727 - RNA, 20 nt, Shigella flexneri 2a str. 301
gagaacgacauggcccagcc

SEQ ID NO: 2002728 - RNA, 14 nt, Shigella flexneri 2a str. 301
gagaacugaaccaa

SEQ ID NO: 2002729 - RNA, 16 nt, Shigella flexneri 2a str. 301
gagaauuccggcagag

SEQ ID NO: 2002730 - RNA, 16 nt, Shigella flexneri 2a str. 301
gagaauugaaguuuaa

SEQ ID NO: 2002731 - RNA, 18 nt, Shigella flexneri 2a str. 301
gagaaucgauaugucuuu

SEQ ID NO: 2002732 - RNA, 23 nt, Shigella flexneri 2a str. 301
gagacauugugugaaaucagcac

SEQ ID NO: 2002733 - RNA, 19 nt, Shigella flexneri 2a str. 301
gagacauuacguccaucac

SEQ ID NO: 2002734 - RNA, 19 nt, Shigella flexneri 2a str. 301
gagacagccgaaaagguag

SEQ ID NO: 2002735 - RNA, 13 nt, Shigella flexneri 2a str. 301
gagacaaaaaagg

SEQ ID NO: 2002736 - RNA, 20 nt, Shigella flexneri 2a str. 301
gacucuuacucuuucaauuu

SEQ ID NO: 2002737 - RNA, 18 nt, Shigella flexneri 2a str. 301
gacucuguagcgggaaag

SEQ ID NO: 2002738 - RNA, 14 nt, Shigella flexneri 2a str. 301
gacucugaaacucg

SEQ ID NO: 2002739 - RNA, 15 nt, Shigella flexneri 2a str. 301
gacucucauuuuuca

SEQ ID NO: 2002740 - RNA, 16 nt, Shigella flexneri 2a str. 301
gacucgguugcacaga

SEQ ID NO: 2002741 - RNA, 20 nt, Shigella flexneri 2a str. 301
gacugaaauuacaggcagua

SEQ ID NO: 2002742 - RNA, 20 nt, Shigella flexneri 2a str. 301
gacugaaaguacuucacaau

SEQ ID NO: 2002743 - RNA, 14 nt, Shigella flexneri 2a str. 301
gacugauaucccgc

SEQ ID NO: 2002744 - RNA, 20 nt, Shigella flexneri 2a str. 301
gacugaugugauccaucagg

SEQ ID NO: 2002745 - RNA, 14 nt, Shigella flexneri 2a str. 301
gacugcccgcgagc

SEQ ID NO: 2002746 - RNA, 15 nt, Shigella flexneri 2a str. 301
gacugccccaguucc

SEQ ID NO: 2002747 - RNA, 18 nt, Shigella flexneri 2a str. 301
gacugccgcucaccugac

SEQ ID NO: 2002748 - RNA, 23 nt, Shigella flexneri 2a str. 301
gacuggaauaagccaaauccagc

SEQ ID NO: 2002749 - RNA, 16 nt, Shigella flexneri 2a str. 301
gacuggcaaagcaggc

SEQ ID NO: 2002750 - RNA, 21 nt, Shigella flexneri 2a str. 301
gacugcuuuuacaaaaucuuc

SEQ ID NO: 2002751 - RNA, 18 nt, Shigella flexneri 2a str. 301
gacuggaauaagccaaau

SEQ ID NO: 2002752 - RNA, 14 nt, Shigella flexneri 2a str. 301
gacuggaaaucaaa

SEQ ID NO: 2002753 - RNA, 13 nt, Shigella flexneri 2a str. 301
gacugcuccugua

SEQ ID NO: 2002754 - RNA, 18 nt, Shigella flexneri 2a str. 301
gacugcgccacuucccag

SEQ ID NO: 2002755 - RNA, 22 nt, Shigella flexneri 2a str. 301
gacugcgccacuucccagccuu

SEQ ID NO: 2002756 - RNA, 15 nt, Shigella flexneri 2a str. 301
gacugcgcgccgccg

SEQ ID NO: 2002757 - RNA, 14 nt, Shigella flexneri 2a str. 301
gacuccaacuuacu

SEQ ID NO: 2002758 - RNA, 15 nt, Shigella flexneri 2a str. 301
gacuccaguuuguuc

SEQ ID NO: 2002759 - RNA, 16 nt, Shigella flexneri 2a str. 301
gacucgccgcugugga

SEQ ID NO: 2002760 - RNA, 21 nt, Shigella flexneri 2a str. 301
gacucggagucgacuucagau

SEQ ID NO: 2002761 - RNA, 18 nt, Shigella flexneri 2a str. 301
gacucccgcgccgcagcc

SEQ ID NO: 2002762 - RNA, 21 nt, Shigella flexneri 2a str. 301
gacuccuguaucgucacuggu

SEQ ID NO: 2002763 - RNA, 20 nt, Shigella flexneri 2a str. 301
gacuacgacgccaagaaaga

SEQ ID NO: 2002764 - RNA, 21 nt, Shigella flexneri 2a str. 301
gacuaccggggacaggcggcc

SEQ ID NO: 2002765 - RNA, 16 nt, Shigella flexneri 2a str. 301
gacuagcucaauaaaa

SEQ ID NO: 2002766 - RNA, 21 nt, Shigella flexneri 2a str. 301
gacuagcucaauaaaagaaau

SEQ ID NO: 2002767 - RNA, 16 nt, Shigella flexneri 2a str. 301
gacuagugauaaccac

SEQ ID NO: 2002768 - RNA, 13 nt, Shigella flexneri 2a str. 301
gacuauuucuuca

SEQ ID NO: 2002769 - RNA, 19 nt, Shigella flexneri 2a str. 301
gacucaaaccccgcagcaa

SEQ ID NO: 2002770 - RNA, 19 nt, Shigella flexneri 2a str. 301
gacuauuuuuuugauaauc

SEQ ID NO: 2002771 - RNA, 18 nt, Shigella flexneri 2a str. 301
gacucaauggcauccgcc

SEQ ID NO: 2002772 - RNA, 20 nt, Shigella flexneri 2a str. 301
gacuaucgcgacgaauaggu

SEQ ID NO: 2002773 - RNA, 13 nt, Shigella flexneri 2a str. 301
gacuaucaucgcc

SEQ ID NO: 2002774 - RNA, 15 nt, Shigella flexneri 2a str. 301
gacuauucagcucuu

SEQ ID NO: 2002775 - RNA, 22 nt, Shigella flexneri 2a str. 301
gacguuuuagccauaaacgggc

SEQ ID NO: 2002776 - RNA, 20 nt, Shigella flexneri 2a str. 301
gacguuuuacagcaacgggc

SEQ ID NO: 2002777 - RNA, 14 nt, Shigella flexneri 2a str. 301
gacguuguucaggu

SEQ ID NO: 2002778 - RNA, 11 nt, Shigella flexneri 2a str. 301
gacuaaaaccc

SEQ ID NO: 2002779 - RNA, 21 nt, Shigella flexneri 2a str. 301
gacuaaauuucacugcuuaau

SEQ ID NO: 2002780 - RNA, 14 nt, Shigella flexneri 2a str. 301
gacuaacuucugau

SEQ ID NO: 2002781 - RNA, 16 nt, Shigella flexneri 2a str. 301
gacuaauacaccauca

SEQ ID NO: 2002782 - RNA, 22 nt, Shigella flexneri 2a str. 301
gacguugauucacuuucugaag

SEQ ID NO: 2002783 - RNA, 14 nt, Shigella flexneri 2a str. 301
gacguucaguuccg

SEQ ID NO: 2002784 - RNA, 14 nt, Shigella flexneri 2a str. 301
gacguucugccaaa

SEQ ID NO: 2002785 - RNA, 17 nt, Shigella flexneri 2a str. 301
gacguucuuccugugga

SEQ ID NO: 2002786 - RNA, 17 nt, Shigella flexneri 2a str. 301
gacguuaauaaaauuua

SEQ ID NO: 2002787 - RNA, 20 nt, Shigella flexneri 2a str. 301
gacgugcaccgucacuucuu

SEQ ID NO: 2002788 - RNA, 21 nt, Shigella flexneri 2a str. 301
gacgugcgggcgcaagggugc

SEQ ID NO: 2002789 - RNA, 17 nt, Shigella flexneri 2a str. 301
gacgugucuuaucaggc

SEQ ID NO: 2002790 - RNA, 17 nt, Shigella flexneri 2a str. 301
gacgucgcgaauggccu

SEQ ID NO: 2002791 - RNA, 14 nt, Shigella flexneri 2a str. 301
gacgucauagcagu

SEQ ID NO: 2002792 - RNA, 22 nt, Shigella flexneri 2a str. 301
gacggugacacuuugcgccauc

SEQ ID NO: 2002793 - RNA, 20 nt, Shigella flexneri 2a str. 301
gacgguaaaaagaaaguuug

SEQ ID NO: 2002794 - RNA, 21 nt, Shigella flexneri 2a str. 301
gacguaaugauguaaaaauac

SEQ ID NO: 2002795 - RNA, 16 nt, Shigella flexneri 2a str. 301
gacguaaagaagaugu

SEQ ID NO: 2002796 - RNA, 23 nt, Shigella flexneri 2a str. 301
gacgggcauuucgucuugcagga

SEQ ID NO: 2002797 - RNA, 17 nt, Shigella flexneri 2a str. 301
gacgggauagcucaaug

SEQ ID NO: 2002798 - RNA, 14 nt, Shigella flexneri 2a str. 301
gacgggcugguagg

SEQ ID NO: 2002799 - RNA, 13 nt, Shigella flexneri 2a str. 301
gacggcguucuuu

SEQ ID NO: 2002800 - RNA, 20 nt, Shigella flexneri 2a str. 301
gacggcugauaugccagacu

SEQ ID NO: 2002801 - RNA, 22 nt, Shigella flexneri 2a str. 301
gacgggaaacucugcuggcgga

SEQ ID NO: 2002802 - RNA, 23 nt, Shigella flexneri 2a str. 301
gacggcgcucuugcggcauuucg

SEQ ID NO: 2002803 - RNA, 13 nt, Shigella flexneri 2a str. 301
gagcugcaaggca

SEQ ID NO: 2002804 - RNA, 14 nt, Shigella flexneri 2a str. 301
gagcugauuuccgg

SEQ ID NO: 2002805 - RNA, 13 nt, Shigella flexneri 2a str. 301
gagcuaucucccu

SEQ ID NO: 2002806 - RNA, 20 nt, Shigella flexneri 2a str. 301
gagcuaccggauuuuuuuuc

SEQ ID NO: 2002807 - RNA, 23 nt, Shigella flexneri 2a str. 301
gagcgguaaagaacugagcgccg

SEQ ID NO: 2002808 - RNA, 23 nt, Shigella flexneri 2a str. 301
gagcguauccagcauaccuucca

SEQ ID NO: 2002809 - RNA, 19 nt, Shigella flexneri 2a str. 301
gagcguaucggcuccugga

SEQ ID NO: 2002810 - RNA, 18 nt, Shigella flexneri 2a str. 301
gagcgucauauagccgcc

SEQ ID NO: 2002811 - RNA, 19 nt, Shigella flexneri 2a str. 301
gagcguauccagcauaccu

SEQ ID NO: 2002812 - RNA, 22 nt, Shigella flexneri 2a str. 301
gagcgacaccucccagcgcggu

SEQ ID NO: 2002813 - RNA, 20 nt, Shigella flexneri 2a str. 301
gagcgcuggugacaucgcca

SEQ ID NO: 2002814 - RNA, 22 nt, Shigella flexneri 2a str. 301
gagcgcuggugacaucgccaga

SEQ ID NO: 2002815 - RNA, 15 nt, Shigella flexneri 2a str. 301
gagcgccccagaccu

SEQ ID NO: 2002816 - RNA, 17 nt, Shigella flexneri 2a str. 301
gaggccaauuuggcugc

SEQ ID NO: 2002817 - RNA, 15 nt, Shigella flexneri 2a str. 301
gaggccaaucagcaa

SEQ ID NO: 2002818 - RNA, 21 nt, Shigella flexneri 2a str. 301
gaggccaaaaccacagugacc

SEQ ID NO: 2002819 - RNA, 17 nt, Shigella flexneri 2a str. 301
gaggcauuggcaaauuu

SEQ ID NO: 2002820 - RNA, 20 nt, Shigella flexneri 2a str. 301
gaggccuucgccugaugaua

SEQ ID NO: 2002821 - RNA, 17 nt, Shigella flexneri 2a str. 301
gaggauaauauuuuugc

SEQ ID NO: 2002822 - RNA, 18 nt, Shigella flexneri 2a str. 301
gaggauaugcaucaugaa

SEQ ID NO: 2002823 - RNA, 23 nt, Shigella flexneri 2a str. 301
gaggauucgaaccucggaaugcc

SEQ ID NO: 2002824 - RNA, 15 nt, Shigella flexneri 2a str. 301
gaggaugcacucgca

SEQ ID NO: 2002825 - RNA, 21 nt, Shigella flexneri 2a str. 301
gaggauguuacaaccuccucc

SEQ ID NO: 2002826 - RNA, 15 nt, Shigella flexneri 2a str. 301
gagcuugauccuaca

SEQ ID NO: 2002827 - RNA, 23 nt, Shigella flexneri 2a str. 301
gagcuuuuuuaauguggcugggg

SEQ ID NO: 2002828 - RNA, 21 nt, Shigella flexneri 2a str. 301
gagcuuauuuguugagcugga

SEQ ID NO: 2002829 - RNA, 20 nt, Shigella flexneri 2a str. 301
gagcuggcgaacgugcagga

SEQ ID NO: 2002830 - RNA, 19 nt, Shigella flexneri 2a str. 301
gagcuggaaguuacucaaa

SEQ ID NO: 2002831 - RNA, 12 nt, Shigella flexneri 2a str. 301
gagcuggucuga

SEQ ID NO: 2002832 - RNA, 18 nt, Shigella flexneri 2a str. 301
gagcugguaaccgcggcu

SEQ ID NO: 2002833 - RNA, 16 nt, Shigella flexneri 2a str. 301
gaggagccaucaccau

SEQ ID NO: 2002834 - RNA, 21 nt, Shigella flexneri 2a str. 301
gaggagagugcaaugaaaaac

SEQ ID NO: 2002835 - RNA, 13 nt, Shigella flexneri 2a str. 301
gaggaauggcaga

SEQ ID NO: 2002836 - RNA, 21 nt, Shigella flexneri 2a str. 301
gaggaagcgcagcagcgcgcc

SEQ ID NO: 2002837 - RNA, 16 nt, Shigella flexneri 2a str. 301
gagcaccuuuuuucug

SEQ ID NO: 2002838 - RNA, 22 nt, Shigella flexneri 2a str. 301
gagcacgacuuucucuucaucu

SEQ ID NO: 2002839 - RNA, 17 nt, Shigella flexneri 2a str. 301
gagcacggcaucccaac

SEQ ID NO: 2002840 - RNA, 17 nt, Shigella flexneri 2a str. 301
gagcacuuuucugguca

SEQ ID NO: 2002841 - RNA, 19 nt, Shigella flexneri 2a str. 301
gagcacugcgcccgccagc

SEQ ID NO: 2002842 - RNA, 15 nt, Shigella flexneri 2a str. 301
gagcacuauccgaca

SEQ ID NO: 2002843 - RNA, 20 nt, Shigella flexneri 2a str. 301
gagcacugcgcccgccagca

SEQ ID NO: 2002844 - RNA, 21 nt, Shigella flexneri 2a str. 301
gagcacugcgcccgccagcau

SEQ ID NO: 2002845 - RNA, 21 nt, Shigella flexneri 2a str. 301
gagcagagaaacgccagcagc

SEQ ID NO: 2002846 - RNA, 17 nt, Shigella flexneri 2a str. 301
gagcagauacugaugaa

SEQ ID NO: 2002847 - RNA, 21 nt, Shigella flexneri 2a str. 301
gagcaaugaucucaauaguuc

SEQ ID NO: 2002848 - RNA, 19 nt, Shigella flexneri 2a str. 301
gagcaauguaaggugcauc

SEQ ID NO: 2002849 - RNA, 14 nt, Shigella flexneri 2a str. 301
gagcacaugcagug

SEQ ID NO: 2002850 - RNA, 22 nt, Shigella flexneri 2a str. 301
gagcaauuuuuugcgccagcgc

SEQ ID NO: 2002851 - RNA, 23 nt, Shigella flexneri 2a str. 301
gagcaauaaaaacuccgccgcau

SEQ ID NO: 2002852 - RNA, 10 nt, Shigella flexneri 2a str. 301
gagcaaugau

SEQ ID NO: 2002853 - RNA, 16 nt, Shigella flexneri 2a str. 301
gagcaaggcauaggcu

SEQ ID NO: 2002854 - RNA, 17 nt, Shigella flexneri 2a str. 301
gagcaaggcauaggcuu

SEQ ID NO: 2002855 - RNA, 22 nt, Shigella flexneri 2a str. 301
gagauuuuacccaugacuuuga

SEQ ID NO: 2002856 - RNA, 16 nt, Shigella flexneri 2a str. 301
gagauuugcuccagcg

SEQ ID NO: 2002857 - RNA, 19 nt, Shigella flexneri 2a str. 301
gagcaaacaguucugcagc

SEQ ID NO: 2002858 - RNA, 18 nt, Shigella flexneri 2a str. 301
gagauuuuuccccaccuc

SEQ ID NO: 2002859 - RNA, 20 nt, Shigella flexneri 2a str. 301
gagcaaaaaaccgccauuca

SEQ ID NO: 2002860 - RNA, 17 nt, Shigella flexneri 2a str. 301
gagcaaaccacaggccg

SEQ ID NO: 2002861 - RNA, 20 nt, Shigella flexneri 2a str. 301
gagcaacagaguugccacua

SEQ ID NO: 2002862 - RNA, 19 nt, Shigella flexneri 2a str. 301
gagagugacgucauagcag

SEQ ID NO: 2002863 - RNA, 19 nt, Shigella flexneri 2a str. 301
gagaguacugccgggaaga

SEQ ID NO: 2002864 - RNA, 21 nt, Shigella flexneri 2a str. 301
gagauagauuaguuguacauu

SEQ ID NO: 2002865 - RNA, 22 nt, Shigella flexneri 2a str. 301
gagauaccaguugaucaaauaa

SEQ ID NO: 2002866 - RNA, 16 nt, Shigella flexneri 2a str. 301
gagauauuccccagac

SEQ ID NO: 2002867 - RNA, 21 nt, Shigella flexneri 2a str. 301
gagaucauuauuaaacagaca

SEQ ID NO: 2002868 - RNA, 21 nt, Shigella flexneri 2a str. 301
gagauuggucaguaagccuuu

SEQ ID NO: 2002869 - RNA, 13 nt, Shigella flexneri 2a str. 301
gagauguugcaaa

SEQ ID NO: 2002870 - RNA, 16 nt, Shigella flexneri 2a str. 301
gagaucggccagcacc

SEQ ID NO: 2002871 - RNA, 18 nt, Shigella flexneri 2a str. 301
gagaugacgccacuggcu

SEQ ID NO: 2002872 - RNA, 16 nt, Shigella flexneri 2a str. 301
gagcaggagcagcagg

SEQ ID NO: 2002873 - RNA, 18 nt, Shigella flexneri 2a str. 301
gagcagccaccacuugca

SEQ ID NO: 2002874 - RNA, 18 nt, Shigella flexneri 2a str. 301
gagcaggcguuaaaacag

SEQ ID NO: 2002875 - RNA, 15 nt, Shigella flexneri 2a str. 301
gagcaggcugcacug

SEQ ID NO: 2002876 - RNA, 19 nt, Shigella flexneri 2a str. 301
gagcauucccgccaucguu

SEQ ID NO: 2002877 - RNA, 17 nt, Shigella flexneri 2a str. 301
gagcaugcuccggccuu

SEQ ID NO: 2002878 - RNA, 17 nt, Shigella flexneri 2a str. 301
gagccaaacgcccagcu

SEQ ID NO: 2002879 - RNA, 15 nt, Shigella flexneri 2a str. 301
gagcaucugcaaaau

SEQ ID NO: 2002880 - RNA, 18 nt, Shigella flexneri 2a str. 301
gagcaucgcccaggcgac

SEQ ID NO: 2002881 - RNA, 13 nt, Shigella flexneri 2a str. 301
gagcauaaaaguu

SEQ ID NO: 2002882 - RNA, 23 nt, Shigella flexneri 2a str. 301
gagcauaucgacgaaccauuucg

SEQ ID NO: 2002883 - RNA, 22 nt, Shigella flexneri 2a str. 301
gagccaguuggcguaccauuaa

SEQ ID NO: 2002884 - RNA, 14 nt, Shigella flexneri 2a str. 301
gagcccagaugccg

SEQ ID NO: 2002885 - RNA, 22 nt, Shigella flexneri 2a str. 301
gagcccaucacaauggcacaaa

SEQ ID NO: 2002886 - RNA, 21 nt, Shigella flexneri 2a str. 301
gagccauugcccgaugcgcaa

SEQ ID NO: 2002887 - RNA, 14 nt, Shigella flexneri 2a str. 301
gagccgcuggcggu

SEQ ID NO: 2002888 - RNA, 15 nt, Shigella flexneri 2a str. 301
gagccgauauccgga

SEQ ID NO: 2002889 - RNA, 22 nt, Shigella flexneri 2a str. 301
gauguguuccgcaaucaaauga

SEQ ID NO: 2002890 - RNA, 17 nt, Shigella flexneri 2a str. 301
gauguguugcaaauaau

SEQ ID NO: 2002891 - RNA, 14 nt, Shigella flexneri 2a str. 301
gauguucaauaaaa

SEQ ID NO: 2002892 - RNA, 21 nt, Shigella flexneri 2a str. 301
gauguuguacagcgaaacaua

SEQ ID NO: 2002893 - RNA, 21 nt, Shigella flexneri 2a str. 301
gauuaccaauaucaaauaaaa

SEQ ID NO: 2002894 - RNA, 17 nt, Shigella flexneri 2a str. 301
gauuacuuuauuuauau

SEQ ID NO: 2002895 - RNA, 13 nt, Shigella flexneri 2a str. 301
gauuacuuuauuu

SEQ ID NO: 2002896 - RNA, 13 nt, Shigella flexneri 2a str. 301
gauuacaaauaaa

SEQ ID NO: 2002897 - RNA, 19 nt, Shigella flexneri 2a str. 301
gauuacacaaauccagcac

SEQ ID NO: 2002898 - RNA, 18 nt, Shigella flexneri 2a str. 301
gauuaauuucccaccacu

SEQ ID NO: 2002899 - RNA, 18 nt, Shigella flexneri 2a str. 301
gaugugggcaaucucacu

SEQ ID NO: 2002900 - RNA, 16 nt, Shigella flexneri 2a str. 301
gaugugccggauagcg

SEQ ID NO: 2002901 - RNA, 14 nt, Shigella flexneri 2a str. 301
gaugugauccauca

SEQ ID NO: 2002902 - RNA, 18 nt, Shigella flexneri 2a str. 301
gaugugcaguuccugcaa

SEQ ID NO: 2002903 - RNA, 17 nt, Shigella flexneri 2a str. 301
gaugugcaguuccugca

SEQ ID NO: 2002904 - RNA, 14 nt, Shigella flexneri 2a str. 301
gaugugaacccuga

SEQ ID NO: 2002905 - RNA, 18 nt, Shigella flexneri 2a str. 301
gaugucggcauaaagcug

SEQ ID NO: 2002906 - RNA, 21 nt, Shigella flexneri 2a str. 301
gauggcuauuacuuuaagccu

SEQ ID NO: 2002907 - RNA, 11 nt, Shigella flexneri 2a str. 301
gauggcugggg

SEQ ID NO: 2002908 - RNA, 19 nt, Shigella flexneri 2a str. 301
gauggcugggguaccugga

SEQ ID NO: 2002909 - RNA, 15 nt, Shigella flexneri 2a str. 301
gauucacaguuaagu

SEQ ID NO: 2002910 - RNA, 21 nt, Shigella flexneri 2a str. 301
gauucagcgucgucagcaguu

SEQ ID NO: 2002911 - RNA, 20 nt, Shigella flexneri 2a str. 301
gauucauacagcggccagcc

SEQ ID NO: 2002912 - RNA, 17 nt, Shigella flexneri 2a str. 301
gauuauauggaaaaaua

SEQ ID NO: 2002913 - RNA, 13 nt, Shigella flexneri 2a str. 301
gauuccacucauu

SEQ ID NO: 2002914 - RNA, 15 nt, Shigella flexneri 2a str. 301
gauuccacucauuaa

SEQ ID NO: 2002915 - RNA, 19 nt, Shigella flexneri 2a str. 301
gauucccagucauccggcu

SEQ ID NO: 2002916 - RNA, 22 nt, Shigella flexneri 2a str. 301
gauucauccguuucccuguuca

SEQ ID NO: 2002917 - RNA, 18 nt, Shigella flexneri 2a str. 301
gauucaucucuucuuccg

SEQ ID NO: 2002918 - RNA, 23 nt, Shigella flexneri 2a str. 301
gauucauccguuucucuguucag

SEQ ID NO: 2002919 - RNA, 12 nt, Shigella flexneri 2a str. 301
gauucaugcugc

SEQ ID NO: 2002920 - RNA, 19 nt, Shigella flexneri 2a str. 301
gauucauugagcugcaacc

SEQ ID NO: 2002921 - RNA, 20 nt, Shigella flexneri 2a str. 301
gauucauugagcugcaacca

SEQ ID NO: 2002922 - RNA, 20 nt, Shigella flexneri 2a str. 301
gauuccugcgcuuccagcuc

SEQ ID NO: 2002923 - RNA, 15 nt, Shigella flexneri 2a str. 301
gauuccgccgccauu

SEQ ID NO: 2002924 - RNA, 18 nt, Shigella flexneri 2a str. 301
gauucccauuauuucaac

SEQ ID NO: 2002925 - RNA, 16 nt, Shigella flexneri 2a str. 301
gauuuucgaaaaaaaa

SEQ ID NO: 2002926 - RNA, 16 nt, Shigella flexneri 2a str. 301
gauuuugcaauaaugg

SEQ ID NO: 2002927 - RNA, 12 nt, Shigella flexneri 2a str. 301
gauuuucugcuc

SEQ ID NO: 2002928 - RNA, 16 nt, Shigella flexneri 2a str. 301
gcaaaaaaccaucccu

SEQ ID NO: 2002929 - RNA, 22 nt, Shigella flexneri 2a str. 301
gcaaaaaaaacgggcauggugu

SEQ ID NO: 2002930 - RNA, 13 nt, Shigella flexneri 2a str. 301
gcaaaaauuugcg

SEQ ID NO: 2002931 - RNA, 19 nt, Shigella flexneri 2a str. 301
gauuuuuuccaacaggcga

SEQ ID NO: 2002932 - RNA, 16 nt, Shigella flexneri 2a str. 301
gauuuuuuccagcgca

SEQ ID NO: 2002933 - RNA, 11 nt, Shigella flexneri 2a str. 301
gauuucauuca

SEQ ID NO: 2002934 - RNA, 12 nt, Shigella flexneri 2a str. 301
gauuuccagcuc

SEQ ID NO: 2002935 - RNA, 19 nt, Shigella flexneri 2a str. 301
gauuucguagacugcagcg

SEQ ID NO: 2002936 - RNA, 13 nt, Shigella flexneri 2a str. 301
gauuucccggcac

SEQ ID NO: 2002937 - RNA, 13 nt, Shigella flexneri 2a str. 301
gauuuccuucagc

SEQ ID NO: 2002938 - RNA, 20 nt, Shigella flexneri 2a str. 301
gauuugugcacgugccagau

SEQ ID NO: 2002939 - RNA, 15 nt, Shigella flexneri 2a str. 301
gauuucuccccccuc

SEQ ID NO: 2002940 - RNA, 16 nt, Shigella flexneri 2a str. 301
gauugccgcgagaacu

SEQ ID NO: 2002941 - RNA, 15 nt, Shigella flexneri 2a str. 301
gauugggauuaaagc

SEQ ID NO: 2002942 - RNA, 14 nt, Shigella flexneri 2a str. 301
gauuguagaaaauc

SEQ ID NO: 2002943 - RNA, 20 nt, Shigella flexneri 2a str. 301
gauuuacuacguaauuucaa

SEQ ID NO: 2002944 - RNA, 14 nt, Shigella flexneri 2a str. 301
gauuuacuauuauu

SEQ ID NO: 2002945 - RNA, 12 nt, Shigella flexneri 2a str. 301
gauuucaucgcc

SEQ ID NO: 2002946 - RNA, 19 nt, Shigella flexneri 2a str. 301
gauuucaucgcccaggcaa

SEQ ID NO: 2002947 - RNA, 17 nt, Shigella flexneri 2a str. 301
gauuuaugauauuuuuu

SEQ ID NO: 2002948 - RNA, 23 nt, Shigella flexneri 2a str. 301
gauucgucaauaucgagacgggc

SEQ ID NO: 2002949 - RNA, 22 nt, Shigella flexneri 2a str. 301
gauucguuuuucuucagcagcc

SEQ ID NO: 2002950 - RNA, 17 nt, Shigella flexneri 2a str. 301
gauucgcccugcauauu

SEQ ID NO: 2002951 - RNA, 20 nt, Shigella flexneri 2a str. 301
gauugcaccaccagacgagc

SEQ ID NO: 2002952 - RNA, 23 nt, Shigella flexneri 2a str. 301
gauugccagcauaaucaccauca

SEQ ID NO: 2002953 - RNA, 13 nt, Shigella flexneri 2a str. 301
gauugccacccug

SEQ ID NO: 2002954 - RNA, 20 nt, Shigella flexneri 2a str. 301
gauugccacccugcggcugc

SEQ ID NO: 2002955 - RNA, 22 nt, Shigella flexneri 2a str. 301
gauugcagacaaagugagcuuu

SEQ ID NO: 2002956 - RNA, 21 nt, Shigella flexneri 2a str. 301
gauugcauaaugguggagugg

SEQ ID NO: 2002957 - RNA, 16 nt, Shigella flexneri 2a str. 301
gauugauuuaucaggu

SEQ ID NO: 2002958 - RNA, 13 nt, Shigella flexneri 2a str. 301
gaugcccccagca

SEQ ID NO: 2002959 - RNA, 13 nt, Shigella flexneri 2a str. 301
gaugcccagcuca

SEQ ID NO: 2002960 - RNA, 18 nt, Shigella flexneri 2a str. 301
gaugccgguuaauacgcc

SEQ ID NO: 2002961 - RNA, 19 nt, Shigella flexneri 2a str. 301
gaugccugauguacaacca

SEQ ID NO: 2002962 - RNA, 21 nt, Shigella flexneri 2a str. 301
gaugccgucuuugucggugga

SEQ ID NO: 2002963 - RNA, 20 nt, Shigella flexneri 2a str. 301
gaugcgcuacgcuuaucagg

SEQ ID NO: 2002964 - RNA, 15 nt, Shigella flexneri 2a str. 301
gauggcauucucacu

SEQ ID NO: 2002965 - RNA, 15 nt, Shigella flexneri 2a str. 301
gaugcggcguaaacg

SEQ ID NO: 2002966 - RNA, 14 nt, Shigella flexneri 2a str. 301
gaugcggcggacgu

SEQ ID NO: 2002967 - RNA, 12 nt, Shigella flexneri 2a str. 301
gauggcccggcg

SEQ ID NO: 2002968 - RNA, 18 nt, Shigella flexneri 2a str. 301
gaugccaguaauccggcu

SEQ ID NO: 2002969 - RNA, 23 nt, Shigella flexneri 2a str. 301
gaugccaguauuaccggcagagu

SEQ ID NO: 2002970 - RNA, 23 nt, Shigella flexneri 2a str. 301
gaugccagaaagcguauccauca

SEQ ID NO: 2002971 - RNA, 18 nt, Shigella flexneri 2a str. 301
gaugccagcgaagaagug

SEQ ID NO: 2002972 - RNA, 15 nt, Shigella flexneri 2a str. 301
gaugcagcaucaugu

SEQ ID NO: 2002973 - RNA, 16 nt, Shigella flexneri 2a str. 301
gaugaguuaagaagau

SEQ ID NO: 2002974 - RNA, 14 nt, Shigella flexneri 2a str. 301
gaugaugcucccca

SEQ ID NO: 2002975 - RNA, 22 nt, Shigella flexneri 2a str. 301
gaugaugugaauggccagacac

SEQ ID NO: 2002976 - RNA, 17 nt, Shigella flexneri 2a str. 301
gaugaccuugucaugca

SEQ ID NO: 2002977 - RNA, 23 nt, Shigella flexneri 2a str. 301
gaugaggcaccuguaguguguug

SEQ ID NO: 2002978 - RNA, 22 nt, Shigella flexneri 2a str. 301
gaugauaaccccgcaauuucau

SEQ ID NO: 2002979 - RNA, 14 nt, Shigella flexneri 2a str. 301
gaugaguugaaaac

SEQ ID NO: 2002980 - RNA, 17 nt, Shigella flexneri 2a str. 301
gaugaguugaaaaccuc

SEQ ID NO: 2002981 - RNA, 20 nt, Shigella flexneri 2a str. 301
gaugaggcguuaacagcgca

SEQ ID NO: 2002982 - RNA, 14 nt, Shigella flexneri 2a str. 301
gaucugauucugau

SEQ ID NO: 2002983 - RNA, 16 nt, Shigella flexneri 2a str. 301
gaucugauuuuccucc

SEQ ID NO: 2002984 - RNA, 17 nt, Shigella flexneri 2a str. 301
gaucucuucgccugccu

SEQ ID NO: 2002985 - RNA, 15 nt, Shigella flexneri 2a str. 301
gaucucuucgccugc

SEQ ID NO: 2002986 - RNA, 23 nt, Shigella flexneri 2a str. 301
gaucucuuccagugccucaagaa

SEQ ID NO: 2002987 - RNA, 17 nt, Shigella flexneri 2a str. 301
gaucuccucaccauucc

SEQ ID NO: 2002988 - RNA, 17 nt, Shigella flexneri 2a str. 301
gaucuccuuggagaaag

SEQ ID NO: 2002989 - RNA, 22 nt, Shigella flexneri 2a str. 301
gaucucgccagugaccaccguc

SEQ ID NO: 2002990 - RNA, 16 nt, Shigella flexneri 2a str. 301
gaucuccgccugauua

SEQ ID NO: 2002991 - RNA, 19 nt, Shigella flexneri 2a str. 301
gauccccgcuuccugcagc

SEQ ID NO: 2002992 - RNA, 16 nt, Shigella flexneri 2a str. 301
gaucccagagcgggca

SEQ ID NO: 2002993 - RNA, 15 nt, Shigella flexneri 2a str. 301
gaucgugugccacca

SEQ ID NO: 2002994 - RNA, 14 nt, Shigella flexneri 2a str. 301
gaucguugaccuga

SEQ ID NO: 2002995 - RNA, 16 nt, Shigella flexneri 2a str. 301
gaucguugcgcugguc

SEQ ID NO: 2002996 - RNA, 16 nt, Shigella flexneri 2a str. 301
gaugaaauaguugcau

SEQ ID NO: 2002997 - RNA, 20 nt, Shigella flexneri 2a str. 301
gaugaaacguguuucucaaa

SEQ ID NO: 2002998 - RNA, 14 nt, Shigella flexneri 2a str. 301
gaugaacauaaucu

SEQ ID NO: 2002999 - RNA, 15 nt, Shigella flexneri 2a str. 301
gaugaacaacccuaa

SEQ ID NO: 2003000 - RNA, 21 nt, Shigella flexneri 2a str. 301
gaugaaauagacauuacgcau

SEQ ID NO: 2003001 - RNA, 17 nt, Shigella flexneri 2a str. 301
gaucuuugacugaaauu

SEQ ID NO: 2003002 - RNA, 23 nt, Shigella flexneri 2a str. 301
gaugaaaaaaccagaaagggaag

SEQ ID NO: 2003003 - RNA, 22 nt, Shigella flexneri 2a str. 301
gaugaaaaaaccagaaagggaa

SEQ ID NO: 2003004 - RNA, 18 nt, Shigella flexneri 2a str. 301
gaucuuaugauguaaaua

SEQ ID NO: 2003005 - RNA, 21 nt, Shigella flexneri 2a str. 301
gaucuucauagauagccagca

SEQ ID NO: 2003006 - RNA, 14 nt, Shigella flexneri 2a str. 301
gaucuguuuaucac

SEQ ID NO: 2003007 - RNA, 16 nt, Shigella flexneri 2a str. 301
gaucuguugcuggcuu

SEQ ID NO: 2003008 - RNA, 16 nt, Shigella flexneri 2a str. 301
gaucugguaucgccac

SEQ ID NO: 2003009 - RNA, 12 nt, Shigella flexneri 2a str. 301
gaucugcggguu

SEQ ID NO: 2003010 - RNA, 20 nt, Shigella flexneri 2a str. 301
gaucacagcaguccagcgcg

SEQ ID NO: 2003011 - RNA, 23 nt, Shigella flexneri 2a str. 301
gauauuucaccagcgcacgcagg

SEQ ID NO: 2003012 - RNA, 13 nt, Shigella flexneri 2a str. 301
gaucaaacgaagc

SEQ ID NO: 2003013 - RNA, 21 nt, Shigella flexneri 2a str. 301
gaucacauccaguacgccuuc

SEQ ID NO: 2003014 - RNA, 14 nt, Shigella flexneri 2a str. 301
gaucaccacaccgu

SEQ ID NO: 2003015 - RNA, 17 nt, Shigella flexneri 2a str. 301
gaucaccgcagaagcga

SEQ ID NO: 2003016 - RNA, 20 nt, Shigella flexneri 2a str. 301
gauauucaucuccagcacgu

SEQ ID NO: 2003017 - RNA, 20 nt, Shigella flexneri 2a str. 301
gauauucaggcguugaaaaa

SEQ ID NO: 2003018 - RNA, 16 nt, Shigella flexneri 2a str. 301
gauauucaguaaugaa

SEQ ID NO: 2003019 - RNA, 21 nt, Shigella flexneri 2a str. 301
gauauuuucccaacgugacca

SEQ ID NO: 2003020 - RNA, 14 nt, Shigella flexneri 2a str. 301
gauauuccugaaug

SEQ ID NO: 2003021 - RNA, 13 nt, Shigella flexneri 2a str. 301
gauauuccccaga

SEQ ID NO: 2003022 - RNA, 21 nt, Shigella flexneri 2a str. 301
gauccauacucuuucccggca

SEQ ID NO: 2003023 - RNA, 20 nt, Shigella flexneri 2a str. 301
gauccauaagguccuccagc

SEQ ID NO: 2003024 - RNA, 14 nt, Shigella flexneri 2a str. 301
gauccagugcguau

SEQ ID NO: 2003025 - RNA, 15 nt, Shigella flexneri 2a str. 301
gauccaguggcugug

SEQ ID NO: 2003026 - RNA, 16 nt, Shigella flexneri 2a str. 301
gauccaggaacagaag

SEQ ID NO: 2003027 - RNA, 15 nt, Shigella flexneri 2a str. 301
gauccagcgcaauac

SEQ ID NO: 2003028 - RNA, 19 nt, Shigella flexneri 2a str. 301
gaucaucauuacguucuua

SEQ ID NO: 2003029 - RNA, 19 nt, Shigella flexneri 2a str. 301
gaucaugccgcaauugucu

SEQ ID NO: 2003030 - RNA, 13 nt, Shigella flexneri 2a str. 301
gaucauccgcaca

SEQ ID NO: 2003031 - RNA, 19 nt, Shigella flexneri 2a str. 301
gaucacgcggucaaugguc

SEQ ID NO: 2003032 - RNA, 14 nt, Shigella flexneri 2a str. 301
gaucacuuccagca

SEQ ID NO: 2003033 - RNA, 16 nt, Shigella flexneri 2a str. 301
gaucacuuccagcagu

SEQ ID NO: 2003034 - RNA, 20 nt, Shigella flexneri 2a str. 301
gaucacuucgcgcaaccagu

SEQ ID NO: 2003035 - RNA, 20 nt, Shigella flexneri 2a str. 301
gaucagaagcguaaccgagc

SEQ ID NO: 2003036 - RNA, 16 nt, Shigella flexneri 2a str. 301
gaucaguuccagcagc

SEQ ID NO: 2003037 - RNA, 18 nt, Shigella flexneri 2a str. 301
gaucaguuucagaaaaag

SEQ ID NO: 2003038 - RNA, 19 nt, Shigella flexneri 2a str. 301
gaucagcaaauccaucgcc

SEQ ID NO: 2003039 - RNA, 19 nt, Shigella flexneri 2a str. 301
gauagccgaccgcaaggaa

SEQ ID NO: 2003040 - RNA, 17 nt, Shigella flexneri 2a str. 301
gauagccauuaucauga

SEQ ID NO: 2003041 - RNA, 12 nt, Shigella flexneri 2a str. 301
gauagcugguga

SEQ ID NO: 2003042 - RNA, 20 nt, Shigella flexneri 2a str. 301
gauagugcugccaucuucuu

SEQ ID NO: 2003043 - RNA, 21 nt, Shigella flexneri 2a str. 301
gauaguguuuuauguucagau

SEQ ID NO: 2003044 - RNA, 16 nt, Shigella flexneri 2a str. 301
gauaguucaacagauu

SEQ ID NO: 2003045 - RNA, 22 nt, Shigella flexneri 2a str. 301
gauauaauaaaccugccuuaca

SEQ ID NO: 2003046 - RNA, 13 nt, Shigella flexneri 2a str. 301
gauauaaauucca

SEQ ID NO: 2003047 - RNA, 17 nt, Shigella flexneri 2a str. 301
gauauaccgugcugacu

SEQ ID NO: 2003048 - RNA, 13 nt, Shigella flexneri 2a str. 301
gauauacccgcca

SEQ ID NO: 2003049 - RNA, 17 nt, Shigella flexneri 2a str. 301
gauauaaaccugagaac

SEQ ID NO: 2003050 - RNA, 22 nt, Shigella flexneri 2a str. 301
gauauaaacggucuacauugcu

SEQ ID NO: 2003051 - RNA, 16 nt, Shigella flexneri 2a str. 301
gauaccuaacauuuua

SEQ ID NO: 2003052 - RNA, 21 nt, Shigella flexneri 2a str. 301
gauaccgguucgugccacagu

SEQ ID NO: 2003053 - RNA, 18 nt, Shigella flexneri 2a str. 301
gauaaggcaacgccccuu

SEQ ID NO: 2003054 - RNA, 22 nt, Shigella flexneri 2a str. 301
gauaaggcgcugaaggcacaga

SEQ ID NO: 2003055 - RNA, 19 nt, Shigella flexneri 2a str. 301
gauaaggugccaauccuuc

SEQ ID NO: 2003056 - RNA, 20 nt, Shigella flexneri 2a str. 301
gauaagcguagcgcaucagg

SEQ ID NO: 2003057 - RNA, 23 nt, Shigella flexneri 2a str. 301
gauaagcguagcgcaucaggcaa

SEQ ID NO: 2003058 - RNA, 20 nt, Shigella flexneri 2a str. 301
gauacgguuuuuugaacaga

SEQ ID NO: 2003059 - RNA, 13 nt, Shigella flexneri 2a str. 301
gauaccuaacauu

SEQ ID NO: 2003060 - RNA, 18 nt, Shigella flexneri 2a str. 301
gauacguccaccccagca

SEQ ID NO: 2003061 - RNA, 19 nt, Shigella flexneri 2a str. 301
gauacucaagcagccaggu

SEQ ID NO: 2003062 - RNA, 20 nt, Shigella flexneri 2a str. 301
gauagaacaucucuucccau

SEQ ID NO: 2003063 - RNA, 17 nt, Shigella flexneri 2a str. 301
gauagagagcagucagg

SEQ ID NO: 2003064 - RNA, 23 nt, Shigella flexneri 2a str. 301
gaggggcuuucccguuucagccc

SEQ ID NO: 2003065 - RNA, 17 nt, Shigella flexneri 2a str. 301
gagggcaaacaggcgcu

SEQ ID NO: 2003066 - RNA, 19 nt, Shigella flexneri 2a str. 301
gagguacaaccgcaaaggu

SEQ ID NO: 2003067 - RNA, 18 nt, Shigella flexneri 2a str. 301
gagguacgcuccagcagg

SEQ ID NO: 2003068 - RNA, 15 nt, Shigella flexneri 2a str. 301
gagguacgcccagcg

SEQ ID NO: 2003069 - RNA, 18 nt, Shigella flexneri 2a str. 301
gagggaucgacagauccc

SEQ ID NO: 2003070 - RNA, 22 nt, Shigella flexneri 2a str. 301
gagggcaaaggcgcggcggcga

SEQ ID NO: 2003071 - RNA, 23 nt, Shigella flexneri 2a str. 301
gaggcuuuaauaccugccuggua

SEQ ID NO: 2003072 - RNA, 22 nt, Shigella flexneri 2a str. 301
gaggcuucuuuuuuauggcugg

SEQ ID NO: 2003073 - RNA, 19 nt, Shigella flexneri 2a str. 301
gagggaaccuguucaacaa

SEQ ID NO: 2003074 - RNA, 18 nt, Shigella flexneri 2a str. 301
gagggaauccagcaauaa

SEQ ID NO: 2003075 - RNA, 17 nt, Shigella flexneri 2a str. 301
gagggaaauagagaaau

SEQ ID NO: 2003076 - RNA, 20 nt, Shigella flexneri 2a str. 301
gagggaaacggagcaaaaaa

SEQ ID NO: 2003077 - RNA, 19 nt, Shigella flexneri 2a str. 301
gaggcugaccccaaccgcc

SEQ ID NO: 2003078 - RNA, 14 nt, Shigella flexneri 2a str. 301
gaggucaaaaucca

SEQ ID NO: 2003079 - RNA, 15 nt, Shigella flexneri 2a str. 301
gaguaaacggcagag

SEQ ID NO: 2003080 - RNA, 15 nt, Shigella flexneri 2a str. 301
gaguaaaaauauuuc

SEQ ID NO: 2003081 - RNA, 20 nt, Shigella flexneri 2a str. 301
gagguuggcucaucaagcac

SEQ ID NO: 2003082 - RNA, 12 nt, Shigella flexneri 2a str. 301
gaguaaucaggc

SEQ ID NO: 2003083 - RNA, 12 nt, Shigella flexneri 2a str. 301
gaguaaucacau

SEQ ID NO: 2003084 - RNA, 16 nt, Shigella flexneri 2a str. 301
gaguaaauugcaaacc

SEQ ID NO: 2003085 - RNA, 17 nt, Shigella flexneri 2a str. 301
gauaagaugcgccagca

SEQ ID NO: 2003086 - RNA, 18 nt, Shigella flexneri 2a str. 301
gauaagaugguuauccag

SEQ ID NO: 2003087 - RNA, 19 nt, Shigella flexneri 2a str. 301
gauaagaugguuauccagc

SEQ ID NO: 2003088 - RNA, 19 nt, Shigella flexneri 2a str. 301
gauaagacgcgccagcguc

SEQ ID NO: 2003089 - RNA, 21 nt, Shigella flexneri 2a str. 301
gauaacucaaaaauaaucauc

SEQ ID NO: 2003090 - RNA, 14 nt, Shigella flexneri 2a str. 301
gauaacccagcgca

SEQ ID NO: 2003091 - RNA, 17 nt, Shigella flexneri 2a str. 301
gauaacccggcggcgga

SEQ ID NO: 2003092 - RNA, 19 nt, Shigella flexneri 2a str. 301
gauaaccaucuucuucacu

SEQ ID NO: 2003093 - RNA, 20 nt, Shigella flexneri 2a str. 301
gauaaccacguucauuucau

SEQ ID NO: 2003094 - RNA, 17 nt, Shigella flexneri 2a str. 301
gauaacacgguaaugac

SEQ ID NO: 2003095 - RNA, 14 nt, Shigella flexneri 2a str. 301
gauaaacuccugca

SEQ ID NO: 2003096 - RNA, 22 nt, Shigella flexneri 2a str. 301
gauaaaucccgccgcuucacca

SEQ ID NO: 2003097 - RNA, 12 nt, Shigella flexneri 2a str. 301
gauaaauauuau

SEQ ID NO: 2003098 - RNA, 18 nt, Shigella flexneri 2a str. 301
gauaaaucuccauuucau

SEQ ID NO: 2003099 - RNA, 12 nt, Shigella flexneri 2a str. 301
gauaaaucucau

SEQ ID NO: 2003100 - RNA, 17 nt, Shigella flexneri 2a str. 301
gauaaauuacugccgcu

SEQ ID NO: 2003101 - RNA, 16 nt, Shigella flexneri 2a str. 301
gauaaacggcaggaga

SEQ ID NO: 2003102 - RNA, 17 nt, Shigella flexneri 2a str. 301
gauaaacguacauccau

SEQ ID NO: 2003103 - RNA, 17 nt, Shigella flexneri 2a str. 301
gauaaaccuccagcauc

SEQ ID NO: 2003104 - RNA, 20 nt, Shigella flexneri 2a str. 301
gauaaacaucgggacaugau

SEQ ID NO: 2003105 - RNA, 15 nt, Shigella flexneri 2a str. 301
gauaaacaguuucgc

SEQ ID NO: 2003106 - RNA, 19 nt, Shigella flexneri 2a str. 301
gauaaacaguuucgccagg

SEQ ID NO: 2003107 - RNA, 15 nt, Shigella flexneri 2a str. 301
gaguuuggugccacg

SEQ ID NO: 2003108 - RNA, 13 nt, Shigella flexneri 2a str. 301
gagugaaaaugcc

SEQ ID NO: 2003109 - RNA, 11 nt, Shigella flexneri 2a str. 301
gagugaacacg

SEQ ID NO: 2003110 - RNA, 22 nt, Shigella flexneri 2a str. 301
gagugacgucauagcaguaccu

SEQ ID NO: 2003111 - RNA, 15 nt, Shigella flexneri 2a str. 301
gaguccuuccagguc

SEQ ID NO: 2003112 - RNA, 15 nt, Shigella flexneri 2a str. 301
gaguggcccagguua

SEQ ID NO: 2003113 - RNA, 18 nt, Shigella flexneri 2a str. 301
gaguggauuaucuucacc

SEQ ID NO: 2003114 - RNA, 13 nt, Shigella flexneri 2a str. 301
gaguguuccucug

SEQ ID NO: 2003115 - RNA, 21 nt, Shigella flexneri 2a str. 301
gaguugagcaguccccacauc

SEQ ID NO: 2003116 - RNA, 14 nt, Shigella flexneri 2a str. 301
gaguguggcguggc

SEQ ID NO: 2003117 - RNA, 18 nt, Shigella flexneri 2a str. 301
gagugguuagagcacaga

SEQ ID NO: 2003118 - RNA, 15 nt, Shigella flexneri 2a str. 301
gaguuucucgccaga

SEQ ID NO: 2003119 - RNA, 22 nt, Shigella flexneri 2a str. 301
gaguugcaccagcaacaagcca

SEQ ID NO: 2003120 - RNA, 17 nt, Shigella flexneri 2a str. 301
gcagacaaucacaucac

SEQ ID NO: 2003121 - RNA, 13 nt, Shigella flexneri 2a str. 301
gcagacaacccac

SEQ ID NO: 2003122 - RNA, 14 nt, Shigella flexneri 2a str. 301
gcagacacugcuga

SEQ ID NO: 2003123 - RNA, 22 nt, Shigella flexneri 2a str. 301
gcagacacggcguauacaagaa

SEQ ID NO: 2003124 - RNA, 23 nt, Shigella flexneri 2a str. 301
gcagacacggcguauacaagaac

SEQ ID NO: 2003125 - RNA, 22 nt, Shigella flexneri 2a str. 301
gcagaccaaggugcuuuaacga

SEQ ID NO: 2003126 - RNA, 14 nt, Shigella flexneri 2a str. 301
gcagaccagcaaaa

SEQ ID NO: 2003127 - RNA, 13 nt, Shigella flexneri 2a str. 301
gcagaccugcuuu

SEQ ID NO: 2003128 - RNA, 21 nt, Shigella flexneri 2a str. 301
gcagaccugcuuuguucagcc

SEQ ID NO: 2003129 - RNA, 23 nt, Shigella flexneri 2a str. 301
gcagacguuuuuucugccccagu

SEQ ID NO: 2003130 - RNA, 15 nt, Shigella flexneri 2a str. 301
gcagacggcucaucu

SEQ ID NO: 2003131 - RNA, 13 nt, Shigella flexneri 2a str. 301
gcagacggcuguc

SEQ ID NO: 2003132 - RNA, 19 nt, Shigella flexneri 2a str. 301
gcagacggcucaucacccc

SEQ ID NO: 2003133 - RNA, 16 nt, Shigella flexneri 2a str. 301
gcagacgcucguuaaa

SEQ ID NO: 2003134 - RNA, 11 nt, Shigella flexneri 2a str. 301
gcagacgccac

SEQ ID NO: 2003135 - RNA, 17 nt, Shigella flexneri 2a str. 301
gcagagaucgccccggc

SEQ ID NO: 2003136 - RNA, 22 nt, Shigella flexneri 2a str. 301
gcagagaucgccccggcaagaa

SEQ ID NO: 2003137 - RNA, 23 nt, Shigella flexneri 2a str. 301
gcagagaucauacagaugcugcu

SEQ ID NO: 2003138 - RNA, 18 nt, Shigella flexneri 2a str. 301
gcagagaaaccacaucaa

SEQ ID NO: 2003139 - RNA, 21 nt, Shigella flexneri 2a str. 301
gcagagaaacgccagcagcag

SEQ ID NO: 2003140 - RNA, 13 nt, Shigella flexneri 2a str. 301
gcagaguuuccag

SEQ ID NO: 2003141 - RNA, 13 nt, Shigella flexneri 2a str. 301
gcagauaacccag

SEQ ID NO: 2003142 - RNA, 14 nt, Shigella flexneri 2a str. 301
gcagauaacccagc

SEQ ID NO: 2003143 - RNA, 22 nt, Shigella flexneri 2a str. 301
gcagauaacccagcagcccgag

SEQ ID NO: 2003144 - RNA, 14 nt, Shigella flexneri 2a str. 301
gcagagccugaaua

SEQ ID NO: 2003145 - RNA, 17 nt, Shigella flexneri 2a str. 301
gcagaaauaccccgcca

SEQ ID NO: 2003146 - RNA, 13 nt, Shigella flexneri 2a str. 301
gcagaaauacccc

SEQ ID NO: 2003147 - RNA, 12 nt, Shigella flexneri 2a str. 301
gcagaacaucca

SEQ ID NO: 2003148 - RNA, 20 nt, Shigella flexneri 2a str. 301
gcagaacauaaaaaccugua

SEQ ID NO: 2003149 - RNA, 18 nt, Shigella flexneri 2a str. 301
gcagaaacaaccugagcg

SEQ ID NO: 2003150 - RNA, 15 nt, Shigella flexneri 2a str. 301
gcagaaaaagaagcc

SEQ ID NO: 2003151 - RNA, 24 nt, Shigella flexneri 2a str. 301
gcagaaaaagagcaucagcagugc

SEQ ID NO: 2003152 - RNA, 23 nt, Shigella flexneri 2a str. 301
gcagaaguuguccaugugcugga

SEQ ID NO: 2003153 - RNA, 15 nt, Shigella flexneri 2a str. 301
gcagaagcauuuuac

SEQ ID NO: 2003154 - RNA, 23 nt, Shigella flexneri 2a str. 301
gcagaagcaaucaucccagugga

SEQ ID NO: 2003155 - RNA, 20 nt, Shigella flexneri 2a str. 301
gcagaacggugcgaccaaac

SEQ ID NO: 2003156 - RNA, 13 nt, Shigella flexneri 2a str. 301
gcacuuuguccgc

SEQ ID NO: 2003157 - RNA, 14 nt, Shigella flexneri 2a str. 301
gcacuuuguccgcu

SEQ ID NO: 2003158 - RNA, 17 nt, Shigella flexneri 2a str. 301
gcacuuucgccugcggc

SEQ ID NO: 2003159 - RNA, 14 nt, Shigella flexneri 2a str. 301
gcacuuccagcggc

SEQ ID NO: 2003160 - RNA, 14 nt, Shigella flexneri 2a str. 301
gcacgcgcuucaca

SEQ ID NO: 2003161 - RNA, 21 nt, Shigella flexneri 2a str. 301
gcacuugcaggaacagugccu

SEQ ID NO: 2003162 - RNA, 14 nt, Shigella flexneri 2a str. 301
gcacuugcagcucc

SEQ ID NO: 2003163 - RNA, 12 nt, Shigella flexneri 2a str. 301
gcacuugcagga

SEQ ID NO: 2003164 - RNA, 15 nt, Shigella flexneri 2a str. 301
gcacuucuuccgggc

SEQ ID NO: 2003165 - RNA, 13 nt, Shigella flexneri 2a str. 301
gcacuucuuccuu

SEQ ID NO: 2003166 - RNA, 18 nt, Shigella flexneri 2a str. 301
gcacuuccgcccaucgca

SEQ ID NO: 2003167 - RNA, 18 nt, Shigella flexneri 2a str. 301
gcagcccauucuccgagg

SEQ ID NO: 2003168 - RNA, 23 nt, Shigella flexneri 2a str. 301
gcagcccauccggcgaauuacca

SEQ ID NO: 2003169 - RNA, 13 nt, Shigella flexneri 2a str. 301
gcagccccgccgg

SEQ ID NO: 2003170 - RNA, 15 nt, Shigella flexneri 2a str. 301
gcagccccgccggga

SEQ ID NO: 2003171 - RNA, 19 nt, Shigella flexneri 2a str. 301
gcagccaucaccacgcuga

SEQ ID NO: 2003172 - RNA, 19 nt, Shigella flexneri 2a str. 301
gcagccaucugaugauauu

SEQ ID NO: 2003173 - RNA, 19 nt, Shigella flexneri 2a str. 301
gcagccaggccauuuuuuc

SEQ ID NO: 2003174 - RNA, 13 nt, Shigella flexneri 2a str. 301
gcagccaggccau

SEQ ID NO: 2003175 - RNA, 18 nt, Shigella flexneri 2a str. 301
gcagccagcacugccgca

SEQ ID NO: 2003176 - RNA, 16 nt, Shigella flexneri 2a str. 301
gcagccagcgcgccuu

SEQ ID NO: 2003177 - RNA, 18 nt, Shigella flexneri 2a str. 301
gcagccagcgucacccag

SEQ ID NO: 2003178 - RNA, 19 nt, Shigella flexneri 2a str. 301
gcagccgugcccaacugcc

SEQ ID NO: 2003179 - RNA, 14 nt, Shigella flexneri 2a str. 301
gcagccgugcccaa

SEQ ID NO: 2003180 - RNA, 19 nt, Shigella flexneri 2a str. 301
gcagccgguauccagcgcg

SEQ ID NO: 2003181 - RNA, 16 nt, Shigella flexneri 2a str. 301
gcagccgguauccagc

SEQ ID NO: 2003182 - RNA, 16 nt, Shigella flexneri 2a str. 301
gcagaucguuuuccug

SEQ ID NO: 2003183 - RNA, 23 nt, Shigella flexneri 2a str. 301
gcagauacauugccaccaccagc

SEQ ID NO: 2003184 - RNA, 15 nt, Shigella flexneri 2a str. 301
gcagauaccacauca

SEQ ID NO: 2003185 - RNA, 22 nt, Shigella flexneri 2a str. 301
gcagauauaaaaaauccccggc

SEQ ID NO: 2003186 - RNA, 17 nt, Shigella flexneri 2a str. 301
gcagauaucccgccagc

SEQ ID NO: 2003187 - RNA, 16 nt, Shigella flexneri 2a str. 301
gcagaucaaauucaau

SEQ ID NO: 2003188 - RNA, 19 nt, Shigella flexneri 2a str. 301
gcagauauucguucagaua

SEQ ID NO: 2003189 - RNA, 17 nt, Shigella flexneri 2a str. 301
gcagauauggaaagcgg

SEQ ID NO: 2003190 - RNA, 14 nt, Shigella flexneri 2a str. 301
gcagauccugauuu

SEQ ID NO: 2003191 - RNA, 17 nt, Shigella flexneri 2a str. 301
gcagcaacucuuuuucc

SEQ ID NO: 2003192 - RNA, 13 nt, Shigella flexneri 2a str. 301
gcagcaagccauc

SEQ ID NO: 2003193 - RNA, 18 nt, Shigella flexneri 2a str. 301
gcagcaaccgguaaagaa

SEQ ID NO: 2003194 - RNA, 19 nt, Shigella flexneri 2a str. 301
gcagcaaccgguaaagaag

SEQ ID NO: 2003195 - RNA, 20 nt, Shigella flexneri 2a str. 301
gcagcaaccgguaaagaaga

SEQ ID NO: 2003196 - RNA, 17 nt, Shigella flexneri 2a str. 301
gcagcaacgaugacauc

SEQ ID NO: 2003197 - RNA, 16 nt, Shigella flexneri 2a str. 301
gcagcaaucacugcca

SEQ ID NO: 2003198 - RNA, 21 nt, Shigella flexneri 2a str. 301
gcagcaggaucuccagcuccc

SEQ ID NO: 2003199 - RNA, 17 nt, Shigella flexneri 2a str. 301
gcagcacuacaccccag

SEQ ID NO: 2003200 - RNA, 14 nt, Shigella flexneri 2a str. 301
gcaggcuucaacac

SEQ ID NO: 2003201 - RNA, 22 nt, Shigella flexneri 2a str. 301
gcagggccguuuucguuacucc

SEQ ID NO: 2003202 - RNA, 15 nt, Shigella flexneri 2a str. 301
gcaggcuggugguga

SEQ ID NO: 2003203 - RNA, 14 nt, Shigella flexneri 2a str. 301
gcaggcgcugaaaa

SEQ ID NO: 2003204 - RNA, 15 nt, Shigella flexneri 2a str. 301
gcaggauuaauaaau

SEQ ID NO: 2003205 - RNA, 16 nt, Shigella flexneri 2a str. 301
gcaggaugcagaaacc

SEQ ID NO: 2003206 - RNA, 18 nt, Shigella flexneri 2a str. 301
gcaggaucuccagcuccc

SEQ ID NO: 2003207 - RNA, 15 nt, Shigella flexneri 2a str. 301
gcaggagcagcaggu

SEQ ID NO: 2003208 - RNA, 14 nt, Shigella flexneri 2a str. 301
gcaggagcagcccc

SEQ ID NO: 2003209 - RNA, 20 nt, Shigella flexneri 2a str. 301
gcaggagcagccccugcgcc

SEQ ID NO: 2003210 - RNA, 20 nt, Shigella flexneri 2a str. 301
gcaggccggguuuucucccu

SEQ ID NO: 2003211 - RNA, 16 nt, Shigella flexneri 2a str. 301
gcagcucaucaagcug

SEQ ID NO: 2003212 - RNA, 21 nt, Shigella flexneri 2a str. 301
gcagcuccaccgauuuugaga

SEQ ID NO: 2003213 - RNA, 21 nt, Shigella flexneri 2a str. 301
gcagcucgcguucggaaauau

SEQ ID NO: 2003214 - RNA, 18 nt, Shigella flexneri 2a str. 301
gcagcgugcucucaaaua

SEQ ID NO: 2003215 - RNA, 23 nt, Shigella flexneri 2a str. 301
gcagcguucauaaauacagagca

SEQ ID NO: 2003216 - RNA, 18 nt, Shigella flexneri 2a str. 301
gcagcgugauccaccccu

SEQ ID NO: 2003217 - RNA, 19 nt, Shigella flexneri 2a str. 301
gcagcgugcucucaaauau

SEQ ID NO: 2003218 - RNA, 15 nt, Shigella flexneri 2a str. 301
gcagcguuuccagcc

SEQ ID NO: 2003219 - RNA, 15 nt, Shigella flexneri 2a str. 301
gcagcucacgcacga

SEQ ID NO: 2003220 - RNA, 20 nt, Shigella flexneri 2a str. 301
gcaggacugaaauuacaggc

SEQ ID NO: 2003221 - RNA, 12 nt, Shigella flexneri 2a str. 301
gcaggaacugcu

SEQ ID NO: 2003222 - RNA, 20 nt, Shigella flexneri 2a str. 301
gcagcuuaaucauaauguug

SEQ ID NO: 2003223 - RNA, 15 nt, Shigella flexneri 2a str. 301
gcagcuuaucuuuuu

SEQ ID NO: 2003224 - RNA, 18 nt, Shigella flexneri 2a str. 301
gcagcuucacaaaggcuu

SEQ ID NO: 2003225 - RNA, 12 nt, Shigella flexneri 2a str. 301
gcagcuucacgg

SEQ ID NO: 2003226 - RNA, 17 nt, Shigella flexneri 2a str. 301
gcagcuucuuauccagc

SEQ ID NO: 2003227 - RNA, 23 nt, Shigella flexneri 2a str. 301
gcagcuucucgugaaacucacgc

SEQ ID NO: 2003228 - RNA, 22 nt, Shigella flexneri 2a str. 301
gcagcuucucgugaaacucacg

SEQ ID NO: 2003229 - RNA, 21 nt, Shigella flexneri 2a str. 301
gcaggaaauuauggaucacca

SEQ ID NO: 2003230 - RNA, 17 nt, Shigella flexneri 2a str. 301
gcaguacggcagcaauc

SEQ ID NO: 2003231 - RNA, 13 nt, Shigella flexneri 2a str. 301
gcaguacgccacc

SEQ ID NO: 2003232 - RNA, 15 nt, Shigella flexneri 2a str. 301
gcaguacgcggcggu

SEQ ID NO: 2003233 - RNA, 22 nt, Shigella flexneri 2a str. 301
gcaguaccacgguacgccagag

SEQ ID NO: 2003234 - RNA, 17 nt, Shigella flexneri 2a str. 301
gcaguaccuccuucaca

SEQ ID NO: 2003235 - RNA, 21 nt, Shigella flexneri 2a str. 301
gcaguaaucggcgaaaccgcg

SEQ ID NO: 2003236 - RNA, 21 nt, Shigella flexneri 2a str. 301
gcaguaccaccggacgcacac

SEQ ID NO: 2003237 - RNA, 20 nt, Shigella flexneri 2a str. 301
gcaguaaggucaucaaucau

SEQ ID NO: 2003238 - RNA, 22 nt, Shigella flexneri 2a str. 301
gcaguggcuaagcaggcuggcu

SEQ ID NO: 2003239 - RNA, 12 nt, Shigella flexneri 2a str. 301
gcaguggcuucg

SEQ ID NO: 2003240 - RNA, 19 nt, Shigella flexneri 2a str. 301
gcagugaagucgggcagaa

SEQ ID NO: 2003241 - RNA, 20 nt, Shigella flexneri 2a str. 301
gcaguguaacaaaaaacaaa

SEQ ID NO: 2003242 - RNA, 19 nt, Shigella flexneri 2a str. 301
gcaguggguaaugcuguga

SEQ ID NO: 2003243 - RNA, 14 nt, Shigella flexneri 2a str. 301
gcagugacugcccc

SEQ ID NO: 2003244 - RNA, 14 nt, Shigella flexneri 2a str. 301
gcaguggugcggcu

SEQ ID NO: 2003245 - RNA, 17 nt, Shigella flexneri 2a str. 301
gcaguugcaguaccagu

SEQ ID NO: 2003246 - RNA, 16 nt, Shigella flexneri 2a str. 301
gcaguugcuucaucuc

SEQ ID NO: 2003247 - RNA, 18 nt, Shigella flexneri 2a str. 301
gcaguucugccaggcugg

SEQ ID NO: 2003248 - RNA, 23 nt, Shigella flexneri 2a str. 301
gcaguuaucugccgaacaggcug

SEQ ID NO: 2003249 - RNA, 12 nt, Shigella flexneri 2a str. 301
gcaguuccugca

SEQ ID NO: 2003250 - RNA, 16 nt, Shigella flexneri 2a str. 301
gcauacaacgccauga

SEQ ID NO: 2003251 - RNA, 14 nt, Shigella flexneri 2a str. 301
gcauacaaauaagu

SEQ ID NO: 2003252 - RNA, 23 nt, Shigella flexneri 2a str. 301
gcauaaccagagagcuuauccag

SEQ ID NO: 2003253 - RNA, 14 nt, Shigella flexneri 2a str. 301
gcauaacguaaugc

SEQ ID NO: 2003254 - RNA, 15 nt, Shigella flexneri 2a str. 301
gcauaacucaccauc

SEQ ID NO: 2003255 - RNA, 13 nt, Shigella flexneri 2a str. 301
gcauaaaccacag

SEQ ID NO: 2003256 - RNA, 13 nt, Shigella flexneri 2a str. 301
gcauaacagagcg

SEQ ID NO: 2003257 - RNA, 21 nt, Shigella flexneri 2a str. 301
gcauaacagauaaaucauaau

SEQ ID NO: 2003258 - RNA, 19 nt, Shigella flexneri 2a str. 301
gcaggguacugcgcgccgc

SEQ ID NO: 2003259 - RNA, 16 nt, Shigella flexneri 2a str. 301
gcagggucagcaucaa

SEQ ID NO: 2003260 - RNA, 17 nt, Shigella flexneri 2a str. 301
gcagggcuaucuggaga

SEQ ID NO: 2003261 - RNA, 13 nt, Shigella flexneri 2a str. 301
gcaggggcgggga

SEQ ID NO: 2003262 - RNA, 20 nt, Shigella flexneri 2a str. 301
gcagggcgcggaaauggccc

SEQ ID NO: 2003263 - RNA, 15 nt, Shigella flexneri 2a str. 301
gcagguacgguacug

SEQ ID NO: 2003264 - RNA, 14 nt, Shigella flexneri 2a str. 301
gcagguaagaguuu

SEQ ID NO: 2003265 - RNA, 14 nt, Shigella flexneri 2a str. 301
gcagguaaucugcc

SEQ ID NO: 2003266 - RNA, 15 nt, Shigella flexneri 2a str. 301
gcaggucagucagug

SEQ ID NO: 2003267 - RNA, 17 nt, Shigella flexneri 2a str. 301
gcagguuccacggcaug

SEQ ID NO: 2003268 - RNA, 13 nt, Shigella flexneri 2a str. 301
gcagguuaccggu

SEQ ID NO: 2003269 - RNA, 17 nt, Shigella flexneri 2a str. 301
gcacgcaggccacgaau

SEQ ID NO: 2003270 - RNA, 23 nt, Shigella flexneri 2a str. 301
gcacgcagugguuaacaaucaca

SEQ ID NO: 2003271 - RNA, 23 nt, Shigella flexneri 2a str. 301
gcacgaauucaacgcguuuuuuc

SEQ ID NO: 2003272 - RNA, 18 nt, Shigella flexneri 2a str. 301
gcacgaugauauggucaa

SEQ ID NO: 2003273 - RNA, 14 nt, Shigella flexneri 2a str. 301
gcacgaaccagaga

SEQ ID NO: 2003274 - RNA, 17 nt, Shigella flexneri 2a str. 301
gcaccggacgcuuguca

SEQ ID NO: 2003275 - RNA, 18 nt, Shigella flexneri 2a str. 301
gcaccggaacaacccagc

SEQ ID NO: 2003276 - RNA, 19 nt, Shigella flexneri 2a str. 301
gcaccuaauaacucuccuc

SEQ ID NO: 2003277 - RNA, 14 nt, Shigella flexneri 2a str. 301
gcaccuacagccau

SEQ ID NO: 2003278 - RNA, 18 nt, Shigella flexneri 2a str. 301
gcaccguuggcgcuggcg

SEQ ID NO: 2003279 - RNA, 21 nt, Shigella flexneri 2a str. 301
gcaccguuggcgcuggcggcu

SEQ ID NO: 2003280 - RNA, 21 nt, Shigella flexneri 2a str. 301
gcaccuggggcuugccagagc

SEQ ID NO: 2003281 - RNA, 15 nt, Shigella flexneri 2a str. 301
gcaccugccagcgcc

SEQ ID NO: 2003282 - RNA, 14 nt, Shigella flexneri 2a str. 301
gcacccgcguggcc

SEQ ID NO: 2003283 - RNA, 14 nt, Shigella flexneri 2a str. 301
gcacccgccagcgc

SEQ ID NO: 2003284 - RNA, 15 nt, Shigella flexneri 2a str. 301
gcaccgaagcccauc

SEQ ID NO: 2003285 - RNA, 18 nt, Shigella flexneri 2a str. 301
gcacccgcuucagugacu

SEQ ID NO: 2003286 - RNA, 14 nt, Shigella flexneri 2a str. 301
gcacaggcaucacu

SEQ ID NO: 2003287 - RNA, 23 nt, Shigella flexneri 2a str. 301
gcacagcggaguaaucgccagca

SEQ ID NO: 2003288 - RNA, 18 nt, Shigella flexneri 2a str. 301
gcacagguggcaaacgcc

SEQ ID NO: 2003289 - RNA, 20 nt, Shigella flexneri 2a str. 301
gcacaguacgcgcccgccgc

SEQ ID NO: 2003290 - RNA, 16 nt, Shigella flexneri 2a str. 301
gcacagcaggccaaga

SEQ ID NO: 2003291 - RNA, 18 nt, Shigella flexneri 2a str. 301
gcacagccagcgcuggca

SEQ ID NO: 2003292 - RNA, 23 nt, Shigella flexneri 2a str. 301
gcacagcccgccgccauccugaa

SEQ ID NO: 2003293 - RNA, 22 nt, Shigella flexneri 2a str. 301
gcacagcacgcuuuucagugcc

SEQ ID NO: 2003294 - RNA, 23 nt, Shigella flexneri 2a str. 301
gcaaugagagggcgauaaaucuc

SEQ ID NO: 2003295 - RNA, 22 nt, Shigella flexneri 2a str. 301
gcaaugaaccgguaugaauuug

SEQ ID NO: 2003296 - RNA, 17 nt, Shigella flexneri 2a str. 301
gcaaugccauccagcuu

SEQ ID NO: 2003297 - RNA, 12 nt, Shigella flexneri 2a str. 301
gcacaacaggcu

SEQ ID NO: 2003298 - RNA, 15 nt, Shigella flexneri 2a str. 301
gcacaaauagccagc

SEQ ID NO: 2003299 - RNA, 15 nt, Shigella flexneri 2a str. 301
gcacaaaguggcggc

SEQ ID NO: 2003300 - RNA, 17 nt, Shigella flexneri 2a str. 301
gcaccaucccuaugcau

SEQ ID NO: 2003301 - RNA, 17 nt, Shigella flexneri 2a str. 301
gcaccauccgcccacac

SEQ ID NO: 2003302 - RNA, 13 nt, Shigella flexneri 2a str. 301
gcaccaucucuua

SEQ ID NO: 2003303 - RNA, 18 nt, Shigella flexneri 2a str. 301
gcaccaucaaaguuuuua

SEQ ID NO: 2003304 - RNA, 17 nt, Shigella flexneri 2a str. 301
gcaccauuuaaaucaau

SEQ ID NO: 2003305 - RNA, 20 nt, Shigella flexneri 2a str. 301
gcaccauugcugccgccagu

SEQ ID NO: 2003306 - RNA, 11 nt, Shigella flexneri 2a str. 301
gcaccauucca

SEQ ID NO: 2003307 - RNA, 19 nt, Shigella flexneri 2a str. 301
gcaccagccccuggaaaaa

SEQ ID NO: 2003308 - RNA, 22 nt, Shigella flexneri 2a str. 301
gcaccagccccuggaaaaagug

SEQ ID NO: 2003309 - RNA, 12 nt, Shigella flexneri 2a str. 301
gcaccaguaacg

SEQ ID NO: 2003310 - RNA, 21 nt, Shigella flexneri 2a str. 301
gcaccaguucgccguacugac

SEQ ID NO: 2003311 - RNA, 14 nt, Shigella flexneri 2a str. 301
gcaccauaaaucca

SEQ ID NO: 2003312 - RNA, 24 nt, Shigella flexneri 2a str. 301
gcaccaguggucuuuagacugcca

SEQ ID NO: 2003313 - RNA, 15 nt, Shigella flexneri 2a str. 301
gcaccaguucacccu

SEQ ID NO: 2003314 - RNA, 17 nt, Shigella flexneri 2a str. 301
gcaccaccaaaaacgcc

SEQ ID NO: 2003315 - RNA, 19 nt, Shigella flexneri 2a str. 301
gcaccaccaaaaacgccau

SEQ ID NO: 2003316 - RNA, 21 nt, Shigella flexneri 2a str. 301
gcacauuagcgaccuucugaa

SEQ ID NO: 2003317 - RNA, 15 nt, Shigella flexneri 2a str. 301
gcacauucugacugg

SEQ ID NO: 2003318 - RNA, 20 nt, Shigella flexneri 2a str. 301
gcacaucgacggugacacuu

SEQ ID NO: 2003319 - RNA, 18 nt, Shigella flexneri 2a str. 301
gcacaucgcugugcugcu

SEQ ID NO: 2003320 - RNA, 17 nt, Shigella flexneri 2a str. 301
gcacaugcauaaagcgg

SEQ ID NO: 2003321 - RNA, 12 nt, Shigella flexneri 2a str. 301
gcacaugcugac

SEQ ID NO: 2003322 - RNA, 24 nt, Shigella flexneri 2a str. 301
gcaagcgggguaaaugccaucagg

SEQ ID NO: 2003323 - RNA, 17 nt, Shigella flexneri 2a str. 301
gcaaggaaagccacugu

SEQ ID NO: 2003324 - RNA, 15 nt, Shigella flexneri 2a str. 301
gcaagagcaaauaaa

SEQ ID NO: 2003325 - RNA, 17 nt, Shigella flexneri 2a str. 301
gcaagagcaggcuuuug

SEQ ID NO: 2003326 - RNA, 16 nt, Shigella flexneri 2a str. 301
gcaagagcaaauaaaa

SEQ ID NO: 2003327 - RNA, 15 nt, Shigella flexneri 2a str. 301
gcaacgucuucccga

SEQ ID NO: 2003328 - RNA, 18 nt, Shigella flexneri 2a str. 301
gcaacgucaguaaccgcu

SEQ ID NO: 2003329 - RNA, 12 nt, Shigella flexneri 2a str. 301
gcaacgucaguc

SEQ ID NO: 2003330 - RNA, 23 nt, Shigella flexneri 2a str. 301
gcaacguccugagcauuugcacc

SEQ ID NO: 2003331 - RNA, 17 nt, Shigella flexneri 2a str. 301
gcaacuccaucaagcua

SEQ ID NO: 2003332 - RNA, 19 nt, Shigella flexneri 2a str. 301
gcaacucauuuacagaaac

SEQ ID NO: 2003333 - RNA, 15 nt, Shigella flexneri 2a str. 301
gcaacuaccagcagu

SEQ ID NO: 2003334 - RNA, 15 nt, Shigella flexneri 2a str. 301
gcaacuacguuuuua

SEQ ID NO: 2003335 - RNA, 20 nt, Shigella flexneri 2a str. 301
gcaacguuguuccuuccagc

SEQ ID NO: 2003336 - RNA, 14 nt, Shigella flexneri 2a str. 301
gcaacuaccagcag

SEQ ID NO: 2003337 - RNA, 13 nt, Shigella flexneri 2a str. 301
gcaacucgaugcu

SEQ ID NO: 2003338 - RNA, 16 nt, Shigella flexneri 2a str. 301
gcaacucgaugcugcc

SEQ ID NO: 2003339 - RNA, 19 nt, Shigella flexneri 2a str. 301
gcaacugacugacuucaac

SEQ ID NO: 2003340 - RNA, 16 nt, Shigella flexneri 2a str. 301
gcaacugacuggcucu

SEQ ID NO: 2003341 - RNA, 18 nt, Shigella flexneri 2a str. 301
gcaacugaggcaauaaug

SEQ ID NO: 2003342 - RNA, 19 nt, Shigella flexneri 2a str. 301
gcaacugaggcaauaauga

SEQ ID NO: 2003343 - RNA, 13 nt, Shigella flexneri 2a str. 301
gcaacugcggcgc

SEQ ID NO: 2003344 - RNA, 14 nt, Shigella flexneri 2a str. 301
gcaacugcgcggca

SEQ ID NO: 2003345 - RNA, 22 nt, Shigella flexneri 2a str. 301
gcaacugcuucaaaaaaauucu

SEQ ID NO: 2003346 - RNA, 12 nt, Shigella flexneri 2a str. 301
gcaacugauuua

SEQ ID NO: 2003347 - RNA, 19 nt, Shigella flexneri 2a str. 301
gcaacucuuuuuccugcug

SEQ ID NO: 2003348 - RNA, 20 nt, Shigella flexneri 2a str. 301
gcaauaauccccgccaggau

SEQ ID NO: 2003349 - RNA, 20 nt, Shigella flexneri 2a str. 301
gcaauaaucucuuuacccag

SEQ ID NO: 2003350 - RNA, 21 nt, Shigella flexneri 2a str. 301
gcaauaauagccccaaccgaa

SEQ ID NO: 2003351 - RNA, 18 nt, Shigella flexneri 2a str. 301
gcaauaaccaucagcugu

SEQ ID NO: 2003352 - RNA, 19 nt, Shigella flexneri 2a str. 301
gcaaguuucgugcuuagau

SEQ ID NO: 2003353 - RNA, 13 nt, Shigella flexneri 2a str. 301
gcaauaacacgcu

SEQ ID NO: 2003354 - RNA, 20 nt, Shigella flexneri 2a str. 301
gcaaggcgcggguuucaaca

SEQ ID NO: 2003355 - RNA, 15 nt, Shigella flexneri 2a str. 301
gcaagggccgcagcu

SEQ ID NO: 2003356 - RNA, 14 nt, Shigella flexneri 2a str. 301
gcaauccaguccac

SEQ ID NO: 2003357 - RNA, 23 nt, Shigella flexneri 2a str. 301
gcaauccaguccaccugaccugc

SEQ ID NO: 2003358 - RNA, 20 nt, Shigella flexneri 2a str. 301
gcaauccagcucuuuuccag

SEQ ID NO: 2003359 - RNA, 18 nt, Shigella flexneri 2a str. 301
gcaaucauucccagaccu

SEQ ID NO: 2003360 - RNA, 18 nt, Shigella flexneri 2a str. 301
gcaaucagauaaaauaca

SEQ ID NO: 2003361 - RNA, 14 nt, Shigella flexneri 2a str. 301
gcaauccauaacgc

SEQ ID NO: 2003362 - RNA, 23 nt, Shigella flexneri 2a str. 301
gcaauccauaacgcuccuacacc

SEQ ID NO: 2003363 - RNA, 16 nt, Shigella flexneri 2a str. 301
gcaauccuaaaucgcu

SEQ ID NO: 2003364 - RNA, 22 nt, Shigella flexneri 2a str. 301
gcaaucgaguuugccgcugucc

SEQ ID NO: 2003365 - RNA, 14 nt, Shigella flexneri 2a str. 301
gcaaucgcccagcg

SEQ ID NO: 2003366 - RNA, 14 nt, Shigella flexneri 2a str. 301
gcaaucgagcccag

SEQ ID NO: 2003367 - RNA, 16 nt, Shigella flexneri 2a str. 301
gcaaucggcugcaccu

SEQ ID NO: 2003368 - RNA, 23 nt, Shigella flexneri 2a str. 301
gcaaucacugccagaauagccgc

SEQ ID NO: 2003369 - RNA, 22 nt, Shigella flexneri 2a str. 301
gcaaucagauaaaauacacuuu

SEQ ID NO: 2003370 - RNA, 23 nt, Shigella flexneri 2a str. 301
gcaaucagugguguagggcaggc

SEQ ID NO: 2003371 - RNA, 22 nt, Shigella flexneri 2a str. 301
gcaaucaucuuguaggccugau

SEQ ID NO: 2003372 - RNA, 14 nt, Shigella flexneri 2a str. 301
gcaaucaucuugua

SEQ ID NO: 2003373 - RNA, 22 nt, Shigella flexneri 2a str. 301
gcaaucaucgaugcgaucauua

SEQ ID NO: 2003374 - RNA, 13 nt, Shigella flexneri 2a str. 301
gcaaucaucccag

SEQ ID NO: 2003375 - RNA, 15 nt, Shigella flexneri 2a str. 301
gcaauaccauuuaca

SEQ ID NO: 2003376 - RNA, 16 nt, Shigella flexneri 2a str. 301
gcaauaauuuacagcc

SEQ ID NO: 2003377 - RNA, 21 nt, Shigella flexneri 2a str. 301
gcaauaccuggcgcagcugcg

SEQ ID NO: 2003378 - RNA, 19 nt, Shigella flexneri 2a str. 301
gcaauaccgccguuaacac

SEQ ID NO: 2003379 - RNA, 21 nt, Shigella flexneri 2a str. 301
gcaauacagguuucaaugcac

SEQ ID NO: 2003380 - RNA, 23 nt, Shigella flexneri 2a str. 301
gcaauacgcuugaagccuucgcc

SEQ ID NO: 2003381 - RNA, 13 nt, Shigella flexneri 2a str. 301
gcaauacuggcag

SEQ ID NO: 2003382 - RNA, 12 nt, Shigella flexneri 2a str. 301
gcaaaacgcugc

SEQ ID NO: 2003383 - RNA, 20 nt, Shigella flexneri 2a str. 301
gcaaaaccucuuccagcaga

SEQ ID NO: 2003384 - RNA, 12 nt, Shigella flexneri 2a str. 301
gcaacaacagcg

SEQ ID NO: 2003385 - RNA, 12 nt, Shigella flexneri 2a str. 301
gcaacaaauaaa

SEQ ID NO: 2003386 - RNA, 16 nt, Shigella flexneri 2a str. 301
gcaacaacugaaaaaa

SEQ ID NO: 2003387 - RNA, 12 nt, Shigella flexneri 2a str. 301
gcaacaacugaa

SEQ ID NO: 2003388 - RNA, 17 nt, Shigella flexneri 2a str. 301
gcaacaaucgggaaaau

SEQ ID NO: 2003389 - RNA, 22 nt, Shigella flexneri 2a str. 301
gcaacaaugcucucuucgccaa

SEQ ID NO: 2003390 - RNA, 15 nt, Shigella flexneri 2a str. 301
gcaacacgccagcgu

SEQ ID NO: 2003391 - RNA, 15 nt, Shigella flexneri 2a str. 301
gcaacagaguugcca

SEQ ID NO: 2003392 - RNA, 18 nt, Shigella flexneri 2a str. 301
gcaacauguugaaucuuc

SEQ ID NO: 2003393 - RNA, 14 nt, Shigella flexneri 2a str. 301
gcaacauguugaau

SEQ ID NO: 2003394 - RNA, 15 nt, Shigella flexneri 2a str. 301
gcaaccagcaggcug

SEQ ID NO: 2003395 - RNA, 17 nt, Shigella flexneri 2a str. 301
gcaaccagcaggcuggu

SEQ ID NO: 2003396 - RNA, 18 nt, Shigella flexneri 2a str. 301
gcaaccacaaaacacucu

SEQ ID NO: 2003397 - RNA, 15 nt, Shigella flexneri 2a str. 301
gcaacauacugcccg

SEQ ID NO: 2003398 - RNA, 15 nt, Shigella flexneri 2a str. 301
gcaacauaggcugcu

SEQ ID NO: 2003399 - RNA, 19 nt, Shigella flexneri 2a str. 301
gcaacaugaaacagaaaau

SEQ ID NO: 2003400 - RNA, 16 nt, Shigella flexneri 2a str. 301
gcaacaugcuggccuu

SEQ ID NO: 2003401 - RNA, 23 nt, Shigella flexneri 2a str. 301
gcaacaucaaauuacagcaccuu

SEQ ID NO: 2003402 - RNA, 16 nt, Shigella flexneri 2a str. 301
gcaacaguaauaaugc

SEQ ID NO: 2003403 - RNA, 23 nt, Shigella flexneri 2a str. 301
gcaacagcgccgagcaccgaccc

SEQ ID NO: 2003404 - RNA, 16 nt, Shigella flexneri 2a str. 301
gcaacgccuaaacuaa

SEQ ID NO: 2003405 - RNA, 17 nt, Shigella flexneri 2a str. 301
gcaacgccucaugcagg

SEQ ID NO: 2003406 - RNA, 17 nt, Shigella flexneri 2a str. 301
gcaacgccguaagcgcg

SEQ ID NO: 2003407 - RNA, 23 nt, Shigella flexneri 2a str. 301
gcaacgccuuugucgggcaggcu

SEQ ID NO: 2003408 - RNA, 13 nt, Shigella flexneri 2a str. 301
gcaacgcgcguga

SEQ ID NO: 2003409 - RNA, 17 nt, Shigella flexneri 2a str. 301
gcaacgcccaucaacau

SEQ ID NO: 2003410 - RNA, 23 nt, Shigella flexneri 2a str. 301
gcaacgacgguaaaccacgccag

SEQ ID NO: 2003411 - RNA, 21 nt, Shigella flexneri 2a str. 301
gcaacgcuucguagaagccau

SEQ ID NO: 2003412 - RNA, 15 nt, Shigella flexneri 2a str. 301
gcaacgcggcgguga

SEQ ID NO: 2003413 - RNA, 22 nt, Shigella flexneri 2a str. 301
gcaaccguucggaaaaauauau

SEQ ID NO: 2003414 - RNA, 15 nt, Shigella flexneri 2a str. 301
gcaaccuaaaccaaa

SEQ ID NO: 2003415 - RNA, 15 nt, Shigella flexneri 2a str. 301
gcaaccguggugagu

SEQ ID NO: 2003416 - RNA, 14 nt, Shigella flexneri 2a str. 301
gcaacccgccaggu

SEQ ID NO: 2003417 - RNA, 16 nt, Shigella flexneri 2a str. 301
gcaaccggcgcggcag

SEQ ID NO: 2003418 - RNA, 23 nt, Shigella flexneri 2a str. 301
gcaaccgcugagcgauaaaauca

SEQ ID NO: 2003419 - RNA, 21 nt, Shigella flexneri 2a str. 301
gcaaccgcauccagauucuca

SEQ ID NO: 2003420 - RNA, 16 nt, Shigella flexneri 2a str. 301
gcccgacaaagcauga

SEQ ID NO: 2003421 - RNA, 14 nt, Shigella flexneri 2a str. 301
gccccuguugaaau

SEQ ID NO: 2003422 - RNA, 21 nt, Shigella flexneri 2a str. 301
gccccuguugaaaucgggcag

SEQ ID NO: 2003423 - RNA, 14 nt, Shigella flexneri 2a str. 301
gcccgacgaggcgc

SEQ ID NO: 2003424 - RNA, 20 nt, Shigella flexneri 2a str. 301
gccccuggucauaggccgcu

SEQ ID NO: 2003425 - RNA, 18 nt, Shigella flexneri 2a str. 301
gccccggcucgcgaccuc

SEQ ID NO: 2003426 - RNA, 20 nt, Shigella flexneri 2a str. 301
gccccgcgcggcgcaggcgc

SEQ ID NO: 2003427 - RNA, 21 nt, Shigella flexneri 2a str. 301
gccccgcgcggcgcaggcgcu

SEQ ID NO: 2003428 - RNA, 17 nt, Shigella flexneri 2a str. 301
gccccgcucgcuggugc

SEQ ID NO: 2003429 - RNA, 16 nt, Shigella flexneri 2a str. 301
gcccgcauagagaaaa

SEQ ID NO: 2003430 - RNA, 19 nt, Shigella flexneri 2a str. 301
gcccgcagccaucacugac

SEQ ID NO: 2003431 - RNA, 18 nt, Shigella flexneri 2a str. 301
gcccgccaaccaccgcca

SEQ ID NO: 2003432 - RNA, 12 nt, Shigella flexneri 2a str. 301
gcccgagcgcca

SEQ ID NO: 2003433 - RNA, 21 nt, Shigella flexneri 2a str. 301
gcccgacgauaccgccgcaca

SEQ ID NO: 2003434 - RNA, 18 nt, Shigella flexneri 2a str. 301
gcccgacgauaccgccgc

SEQ ID NO: 2003435 - RNA, 21 nt, Shigella flexneri 2a str. 301
gcccgacuugagcgcagucug

SEQ ID NO: 2003436 - RNA, 23 nt, Shigella flexneri 2a str. 301
gcccgcgauaaaaauccuguucc

SEQ ID NO: 2003437 - RNA, 14 nt, Shigella flexneri 2a str. 301
gcccgccagcaccg

SEQ ID NO: 2003438 - RNA, 13 nt, Shigella flexneri 2a str. 301
gcccgccagcacc

SEQ ID NO: 2003439 - RNA, 13 nt, Shigella flexneri 2a str. 301
gcccgccgccauc

SEQ ID NO: 2003440 - RNA, 13 nt, Shigella flexneri 2a str. 301
gcccgccgccauu

SEQ ID NO: 2003441 - RNA, 15 nt, Shigella flexneri 2a str. 301
gcccgcugccgcaga

SEQ ID NO: 2003442 - RNA, 14 nt, Shigella flexneri 2a str. 301
gcccgcuuccagcg

SEQ ID NO: 2003443 - RNA, 16 nt, Shigella flexneri 2a str. 301
gcccgcugaaaagcgg

SEQ ID NO: 2003444 - RNA, 18 nt, Shigella flexneri 2a str. 301
gcccgguaaacguggugc

SEQ ID NO: 2003445 - RNA, 11 nt, Shigella flexneri 2a str. 301
gcccguccauc

SEQ ID NO: 2003446 - RNA, 19 nt, Shigella flexneri 2a str. 301
gcccucauucgaaaccacc

SEQ ID NO: 2003447 - RNA, 19 nt, Shigella flexneri 2a str. 301
gcccguuuucuccagcgcc

SEQ ID NO: 2003448 - RNA, 15 nt, Shigella flexneri 2a str. 301
gcccguuuugagaaa

SEQ ID NO: 2003449 - RNA, 22 nt, Shigella flexneri 2a str. 301
gcccguuucucuuaaaugcaca

SEQ ID NO: 2003450 - RNA, 17 nt, Shigella flexneri 2a str. 301
gcccguuggcagaccgc

SEQ ID NO: 2003451 - RNA, 13 nt, Shigella flexneri 2a str. 301
gcccucucaaccg

SEQ ID NO: 2003452 - RNA, 17 nt, Shigella flexneri 2a str. 301
gcccugcccguugccag

SEQ ID NO: 2003453 - RNA, 19 nt, Shigella flexneri 2a str. 301
gcccuggguaccgagaaaa

SEQ ID NO: 2003454 - RNA, 19 nt, Shigella flexneri 2a str. 301
gcccugcuccagcaacuca

SEQ ID NO: 2003455 - RNA, 17 nt, Shigella flexneri 2a str. 301
gcccugcuccagcaacu

SEQ ID NO: 2003456 - RNA, 20 nt, Shigella flexneri 2a str. 301
gcccugcggcugaccaccac

SEQ ID NO: 2003457 - RNA, 18 nt, Shigella flexneri 2a str. 301
gcccugcggcuggcacaa

SEQ ID NO: 2003458 - RNA, 14 nt, Shigella flexneri 2a str. 301
gcccauaccacagc

SEQ ID NO: 2003459 - RNA, 15 nt, Shigella flexneri 2a str. 301
gcccaucaacaugcc

SEQ ID NO: 2003460 - RNA, 15 nt, Shigella flexneri 2a str. 301
gcccaucauccgcgc

SEQ ID NO: 2003461 - RNA, 15 nt, Shigella flexneri 2a str. 301
gcccaucaucuggcu

SEQ ID NO: 2003462 - RNA, 14 nt, Shigella flexneri 2a str. 301
gcccaucaugcgcc

SEQ ID NO: 2003463 - RNA, 18 nt, Shigella flexneri 2a str. 301
gcccaucgcgcccgccgc

SEQ ID NO: 2003464 - RNA, 17 nt, Shigella flexneri 2a str. 301
gcccaucgccagugccg

SEQ ID NO: 2003465 - RNA, 20 nt, Shigella flexneri 2a str. 301
gcccaggcgaccaggccggu

SEQ ID NO: 2003466 - RNA, 21 nt, Shigella flexneri 2a str. 301
gcccaggugugucucaagucg

SEQ ID NO: 2003467 - RNA, 21 nt, Shigella flexneri 2a str. 301
gcccagguuauacaccuguuc

SEQ ID NO: 2003468 - RNA, 15 nt, Shigella flexneri 2a str. 301
gcccaguucagcggc

SEQ ID NO: 2003469 - RNA, 18 nt, Shigella flexneri 2a str. 301
gcccagugaccaaaggcg

SEQ ID NO: 2003470 - RNA, 16 nt, Shigella flexneri 2a str. 301
gcccaguaccgccagu

SEQ ID NO: 2003471 - RNA, 22 nt, Shigella flexneri 2a str. 301
gccaugcguuuuaccgccucgc

SEQ ID NO: 2003472 - RNA, 20 nt, Shigella flexneri 2a str. 301
gcccacguuucacugccgga

SEQ ID NO: 2003473 - RNA, 14 nt, Shigella flexneri 2a str. 301
gcccagcacccagu

SEQ ID NO: 2003474 - RNA, 22 nt, Shigella flexneri 2a str. 301
gcccagcgucagcauaaaaaua

SEQ ID NO: 2003475 - RNA, 22 nt, Shigella flexneri 2a str. 301
gcccagcucauucagccggguu

SEQ ID NO: 2003476 - RNA, 17 nt, Shigella flexneri 2a str. 301
gcccaugauagugucca

SEQ ID NO: 2003477 - RNA, 22 nt, Shigella flexneri 2a str. 301
gcccauguccgcggccuuuucc

SEQ ID NO: 2003478 - RNA, 17 nt, Shigella flexneri 2a str. 301
gcccauuauugacagac

SEQ ID NO: 2003479 - RNA, 16 nt, Shigella flexneri 2a str. 301
gcccauuccaguaauu

SEQ ID NO: 2003480 - RNA, 20 nt, Shigella flexneri 2a str. 301
gcccauugagcuggucugaa

SEQ ID NO: 2003481 - RNA, 14 nt, Shigella flexneri 2a str. 301
gcccauuuugccac

SEQ ID NO: 2003482 - RNA, 13 nt, Shigella flexneri 2a str. 301
gcccauuuugcca

SEQ ID NO: 2003483 - RNA, 16 nt, Shigella flexneri 2a str. 301
gccccagaccugaauu

SEQ ID NO: 2003484 - RNA, 13 nt, Shigella flexneri 2a str. 301
gccccacaccgcg

SEQ ID NO: 2003485 - RNA, 14 nt, Shigella flexneri 2a str. 301
gccccacagaccca

SEQ ID NO: 2003486 - RNA, 15 nt, Shigella flexneri 2a str. 301
gccccacagacccag

SEQ ID NO: 2003487 - RNA, 17 nt, Shigella flexneri 2a str. 301
gccccagaugccagaau

SEQ ID NO: 2003488 - RNA, 22 nt, Shigella flexneri 2a str. 301
gccccagcaggauguuccggca

SEQ ID NO: 2003489 - RNA, 17 nt, Shigella flexneri 2a str. 301
gccccagcgucagcauc

SEQ ID NO: 2003490 - RNA, 19 nt, Shigella flexneri 2a str. 301
gccccagcgucagcaucau

SEQ ID NO: 2003491 - RNA, 12 nt, Shigella flexneri 2a str. 301
gccccaguuccg

SEQ ID NO: 2003492 - RNA, 15 nt, Shigella flexneri 2a str. 301
gccccgagaaaaaua

SEQ ID NO: 2003493 - RNA, 16 nt, Shigella flexneri 2a str. 301
gccccgagaaaaauag

SEQ ID NO: 2003494 - RNA, 15 nt, Shigella flexneri 2a str. 301
gcccccgggccuccc

SEQ ID NO: 2003495 - RNA, 22 nt, Shigella flexneri 2a str. 301
gcccccugaagcaguuucacca

SEQ ID NO: 2003496 - RNA, 15 nt, Shigella flexneri 2a str. 301
gccagccucauccau

SEQ ID NO: 2003497 - RNA, 17 nt, Shigella flexneri 2a str. 301
gccagcagggcaaacag

SEQ ID NO: 2003498 - RNA, 20 nt, Shigella flexneri 2a str. 301
gccagcagggcaaacagcac

SEQ ID NO: 2003499 - RNA, 18 nt, Shigella flexneri 2a str. 301
gccagcagagggauaucu

SEQ ID NO: 2003500 - RNA, 15 nt, Shigella flexneri 2a str. 301
gccagcagagcaaaa

SEQ ID NO: 2003501 - RNA, 14 nt, Shigella flexneri 2a str. 301
gccagcagcagcgu

SEQ ID NO: 2003502 - RNA, 11 nt, Shigella flexneri 2a str. 301
gccagcaggaa

SEQ ID NO: 2003503 - RNA, 12 nt, Shigella flexneri 2a str. 301
gccagcggcggc

SEQ ID NO: 2003504 - RNA, 17 nt, Shigella flexneri 2a str. 301
gccagcgggccggaggg

SEQ ID NO: 2003505 - RNA, 15 nt, Shigella flexneri 2a str. 301
gccagcguaaauccu

SEQ ID NO: 2003506 - RNA, 22 nt, Shigella flexneri 2a str. 301
gccagcguaccaugauccugca

SEQ ID NO: 2003507 - RNA, 17 nt, Shigella flexneri 2a str. 301
gccagcgucaucauaga

SEQ ID NO: 2003508 - RNA, 21 nt, Shigella flexneri 2a str. 301
gccaggcuuuccgucagcggc

SEQ ID NO: 2003509 - RNA, 21 nt, Shigella flexneri 2a str. 301
gccaguaaauuuaucaaugca

SEQ ID NO: 2003510 - RNA, 14 nt, Shigella flexneri 2a str. 301
gccaguaacucauu

SEQ ID NO: 2003511 - RNA, 23 nt, Shigella flexneri 2a str. 301
gccaggguuucggcuuuuuccug

SEQ ID NO: 2003512 - RNA, 23 nt, Shigella flexneri 2a str. 301
gccagguauucaugcccgcgcaa

SEQ ID NO: 2003513 - RNA, 17 nt, Shigella flexneri 2a str. 301
gccaggacgcaguccag

SEQ ID NO: 2003514 - RNA, 18 nt, Shigella flexneri 2a str. 301
gccaggaaccugugacag

SEQ ID NO: 2003515 - RNA, 14 nt, Shigella flexneri 2a str. 301
gccaguuacugcca

SEQ ID NO: 2003516 - RNA, 16 nt, Shigella flexneri 2a str. 301
gccaguguuaaccaga

SEQ ID NO: 2003517 - RNA, 14 nt, Shigella flexneri 2a str. 301
gccaguucucacca

SEQ ID NO: 2003518 - RNA, 13 nt, Shigella flexneri 2a str. 301
gccaguucuucca

SEQ ID NO: 2003519 - RNA, 12 nt, Shigella flexneri 2a str. 301
gccaguuccccc

SEQ ID NO: 2003520 - RNA, 14 nt, Shigella flexneri 2a str. 301
gccaguucccccug

SEQ ID NO: 2003521 - RNA, 14 nt, Shigella flexneri 2a str. 301
gccaguuccgccgg

SEQ ID NO: 2003522 - RNA, 22 nt, Shigella flexneri 2a str. 301
gccaguucggaugugaaccuca

SEQ ID NO: 2003523 - RNA, 23 nt, Shigella flexneri 2a str. 301
gccaguuuggucuggcaaaaaua

SEQ ID NO: 2003524 - RNA, 22 nt, Shigella flexneri 2a str. 301
gccaguuuugugcccgcgugga

SEQ ID NO: 2003525 - RNA, 14 nt, Shigella flexneri 2a str. 301
gccauaaacagcag

SEQ ID NO: 2003526 - RNA, 14 nt, Shigella flexneri 2a str. 301
gccaguuuuuguuu

SEQ ID NO: 2003527 - RNA, 15 nt, Shigella flexneri 2a str. 301
gccaguuuuuguuuc

SEQ ID NO: 2003528 - RNA, 16 nt, Shigella flexneri 2a str. 301
gccaguuguugcugaa

SEQ ID NO: 2003529 - RNA, 16 nt, Shigella flexneri 2a str. 301
gccagugccaaagcca

SEQ ID NO: 2003530 - RNA, 17 nt, Shigella flexneri 2a str. 301
gccagugccgcccacca

SEQ ID NO: 2003531 - RNA, 15 nt, Shigella flexneri 2a str. 301
gccagugccgguggc

SEQ ID NO: 2003532 - RNA, 21 nt, Shigella flexneri 2a str. 301
gccagugauugcuugccccuu

SEQ ID NO: 2003533 - RNA, 22 nt, Shigella flexneri 2a str. 301
gccagugagugaaauuuugggc

SEQ ID NO: 2003534 - RNA, 23 nt, Shigella flexneri 2a str. 301
gccagugaccaccgucccaguaa

SEQ ID NO: 2003535 - RNA, 21 nt, Shigella flexneri 2a str. 301
gccagucgcgccuuacgcugc

SEQ ID NO: 2003536 - RNA, 15 nt, Shigella flexneri 2a str. 301
gccaguaaucuucaa

SEQ ID NO: 2003537 - RNA, 20 nt, Shigella flexneri 2a str. 301
gccaguaaucuggccaaugc

SEQ ID NO: 2003538 - RNA, 19 nt, Shigella flexneri 2a str. 301
gccaguaaucuggccaaug

SEQ ID NO: 2003539 - RNA, 18 nt, Shigella flexneri 2a str. 301
gccaguaaucuggccaau

SEQ ID NO: 2003540 - RNA, 19 nt, Shigella flexneri 2a str. 301
gccaguaauccggcuuccu

SEQ ID NO: 2003541 - RNA, 15 nt, Shigella flexneri 2a str. 301
gccaguaagcagucc

SEQ ID NO: 2003542 - RNA, 14 nt, Shigella flexneri 2a str. 301
gccaguaccagcag

SEQ ID NO: 2003543 - RNA, 15 nt, Shigella flexneri 2a str. 301
gccaguaccagcagc

SEQ ID NO: 2003544 - RNA, 18 nt, Shigella flexneri 2a str. 301
gccaguaccagcagcgcc

SEQ ID NO: 2003545 - RNA, 20 nt, Shigella flexneri 2a str. 301
gccagucgcacacaacagac

SEQ ID NO: 2003546 - RNA, 18 nt, Shigella flexneri 2a str. 301
gccauauuuaaagaagag

SEQ ID NO: 2003547 - RNA, 19 nt, Shigella flexneri 2a str. 301
gccauauuguuucaacaca

SEQ ID NO: 2003548 - RNA, 14 nt, Shigella flexneri 2a str. 301
gccauccagcagac

SEQ ID NO: 2003549 - RNA, 18 nt, Shigella flexneri 2a str. 301
gccaucccuaccgcccgc

SEQ ID NO: 2003550 - RNA, 22 nt, Shigella flexneri 2a str. 301
gccaucccuaccgcccgcgcgg

SEQ ID NO: 2003551 - RNA, 20 nt, Shigella flexneri 2a str. 301
gccaucccugucguccagac

SEQ ID NO: 2003552 - RNA, 13 nt, Shigella flexneri 2a str. 301
gccauaaauuuac

SEQ ID NO: 2003553 - RNA, 15 nt, Shigella flexneri 2a str. 301
gccauaaauuuaccu

SEQ ID NO: 2003554 - RNA, 20 nt, Shigella flexneri 2a str. 301
gccauaaccccaccagcaug

SEQ ID NO: 2003555 - RNA, 19 nt, Shigella flexneri 2a str. 301
gccauaccaugcaccaacc

SEQ ID NO: 2003556 - RNA, 15 nt, Shigella flexneri 2a str. 301
gccauacagacaccc

SEQ ID NO: 2003557 - RNA, 12 nt, Shigella flexneri 2a str. 301
gccaugcauauc

SEQ ID NO: 2003558 - RNA, 17 nt, Shigella flexneri 2a str. 301
gccaugcccgugcugac

SEQ ID NO: 2003559 - RNA, 19 nt, Shigella flexneri 2a str. 301
gccaucgccugaucgccau

SEQ ID NO: 2003560 - RNA, 22 nt, Shigella flexneri 2a str. 301
gccaucgccaggaacaacgaca

SEQ ID NO: 2003561 - RNA, 15 nt, Shigella flexneri 2a str. 301
gccaucgccagcagc

SEQ ID NO: 2003562 - RNA, 15 nt, Shigella flexneri 2a str. 301
gccauccgcugcggu

SEQ ID NO: 2003563 - RNA, 13 nt, Shigella flexneri 2a str. 301
gccauccgcguga

SEQ ID NO: 2003564 - RNA, 14 nt, Shigella flexneri 2a str. 301
gccacggcgcagcu

SEQ ID NO: 2003565 - RNA, 14 nt, Shigella flexneri 2a str. 301
gccacgcuggcccg

SEQ ID NO: 2003566 - RNA, 17 nt, Shigella flexneri 2a str. 301
gccacgcguuugggcca

SEQ ID NO: 2003567 - RNA, 21 nt, Shigella flexneri 2a str. 301
gccacgcguuugggccaaugc

SEQ ID NO: 2003568 - RNA, 13 nt, Shigella flexneri 2a str. 301
gccacgguaaaac

SEQ ID NO: 2003569 - RNA, 21 nt, Shigella flexneri 2a str. 301
gccacgguaucaagcccgccg

SEQ ID NO: 2003570 - RNA, 19 nt, Shigella flexneri 2a str. 301
gccacgguaucaagcccgc

SEQ ID NO: 2003571 - RNA, 20 nt, Shigella flexneri 2a str. 301
gccacucggacaccucacca

SEQ ID NO: 2003572 - RNA, 22 nt, Shigella flexneri 2a str. 301
gccagaccuaccaucuccugca

SEQ ID NO: 2003573 - RNA, 19 nt, Shigella flexneri 2a str. 301
gccagaccuccguuuuucu

SEQ ID NO: 2003574 - RNA, 17 nt, Shigella flexneri 2a str. 301
gccagagugcguucacc

SEQ ID NO: 2003575 - RNA, 17 nt, Shigella flexneri 2a str. 301
gccagacaaaccacgcc

SEQ ID NO: 2003576 - RNA, 21 nt, Shigella flexneri 2a str. 301
gccagaaauggcccaaaaggc

SEQ ID NO: 2003577 - RNA, 14 nt, Shigella flexneri 2a str. 301
gccagaaaucagcu

SEQ ID NO: 2003578 - RNA, 21 nt, Shigella flexneri 2a str. 301
gccagaacagcuacagcauca

SEQ ID NO: 2003579 - RNA, 21 nt, Shigella flexneri 2a str. 301
gccagaaccgcguagggcgga

SEQ ID NO: 2003580 - RNA, 17 nt, Shigella flexneri 2a str. 301
gccacugcccgagaaca

SEQ ID NO: 2003581 - RNA, 21 nt, Shigella flexneri 2a str. 301
gccagaauagccgcagccauc

SEQ ID NO: 2003582 - RNA, 14 nt, Shigella flexneri 2a str. 301
gccagaauagcgcc

SEQ ID NO: 2003583 - RNA, 14 nt, Shigella flexneri 2a str. 301
gccagaaucaccuc

SEQ ID NO: 2003584 - RNA, 17 nt, Shigella flexneri 2a str. 301
gccagaauccccacugc

SEQ ID NO: 2003585 - RNA, 23 nt, Shigella flexneri 2a str. 301
gccagaaucaccucuuuuuccac

SEQ ID NO: 2003586 - RNA, 19 nt, Shigella flexneri 2a str. 301
gccagcaaaaucaccauca

SEQ ID NO: 2003587 - RNA, 23 nt, Shigella flexneri 2a str. 301
gccagcaaaaugcauaaccgcag

SEQ ID NO: 2003588 - RNA, 18 nt, Shigella flexneri 2a str. 301
gccagauguugucucaga

SEQ ID NO: 2003589 - RNA, 22 nt, Shigella flexneri 2a str. 301
gccagauguugucucagcuuca

SEQ ID NO: 2003590 - RNA, 16 nt, Shigella flexneri 2a str. 301
gccagauucuccaaca

SEQ ID NO: 2003591 - RNA, 15 nt, Shigella flexneri 2a str. 301
gccagauguugucuc

SEQ ID NO: 2003592 - RNA, 16 nt, Shigella flexneri 2a str. 301
gccagauggcauccag

SEQ ID NO: 2003593 - RNA, 14 nt, Shigella flexneri 2a str. 301
gccagauggcaucc

SEQ ID NO: 2003594 - RNA, 19 nt, Shigella flexneri 2a str. 301
gccagauaaauauuauugg

SEQ ID NO: 2003595 - RNA, 19 nt, Shigella flexneri 2a str. 301
gccagauacaucagcgaca

SEQ ID NO: 2003596 - RNA, 18 nt, Shigella flexneri 2a str. 301
gccagauacaucagcgac

SEQ ID NO: 2003597 - RNA, 15 nt, Shigella flexneri 2a str. 301
gccagauaagacgcg

SEQ ID NO: 2003598 - RNA, 21 nt, Shigella flexneri 2a str. 301
gccagaucgccugccgccagu

SEQ ID NO: 2003599 - RNA, 22 nt, Shigella flexneri 2a str. 301
gcauacccagaacuaucauacu

SEQ ID NO: 2003600 - RNA, 13 nt, Shigella flexneri 2a str. 301
gcauaccccuuca

SEQ ID NO: 2003601 - RNA, 17 nt, Shigella flexneri 2a str. 301
gcauacccagaacuauc

SEQ ID NO: 2003602 - RNA, 17 nt, Shigella flexneri 2a str. 301
gcauagcagcacaccac

SEQ ID NO: 2003603 - RNA, 13 nt, Shigella flexneri 2a str. 301
gcauaccuucaca

SEQ ID NO: 2003604 - RNA, 20 nt, Shigella flexneri 2a str. 301
gccacaggcggucgaacagg

SEQ ID NO: 2003605 - RNA, 20 nt, Shigella flexneri 2a str. 301
gccacaguuuuacugcagcc

SEQ ID NO: 2003606 - RNA, 17 nt, Shigella flexneri 2a str. 301
gccacaggcuuuccuga

SEQ ID NO: 2003607 - RNA, 22 nt, Shigella flexneri 2a str. 301
gccacaguucgaggaucgcggg

SEQ ID NO: 2003608 - RNA, 19 nt, Shigella flexneri 2a str. 301
gccacaguugaucagccag

SEQ ID NO: 2003609 - RNA, 22 nt, Shigella flexneri 2a str. 301
gcauagcuaauccccuccagcg

SEQ ID NO: 2003610 - RNA, 12 nt, Shigella flexneri 2a str. 301
gcauagcuggcg

SEQ ID NO: 2003611 - RNA, 13 nt, Shigella flexneri 2a str. 301
gccaccaggccac

SEQ ID NO: 2003612 - RNA, 18 nt, Shigella flexneri 2a str. 301
gccaccagcgucagaaac

SEQ ID NO: 2003613 - RNA, 23 nt, Shigella flexneri 2a str. 301
gccaccagcgguuuuugcgccau

SEQ ID NO: 2003614 - RNA, 17 nt, Shigella flexneri 2a str. 301
gccaccagcaacagcgc

SEQ ID NO: 2003615 - RNA, 21 nt, Shigella flexneri 2a str. 301
gccacauccgcgguaucgccg

SEQ ID NO: 2003616 - RNA, 18 nt, Shigella flexneri 2a str. 301
gccacauuagauaaaaau

SEQ ID NO: 2003617 - RNA, 19 nt, Shigella flexneri 2a str. 301
gccacgccacagccgagcg

SEQ ID NO: 2003618 - RNA, 23 nt, Shigella flexneri 2a str. 301
gccacgcacgccugcaucucuuc

SEQ ID NO: 2003619 - RNA, 19 nt, Shigella flexneri 2a str. 301
gccacgaaacugcuggcuu

SEQ ID NO: 2003620 - RNA, 14 nt, Shigella flexneri 2a str. 301
gccaccuuucuguu

SEQ ID NO: 2003621 - RNA, 14 nt, Shigella flexneri 2a str. 301
gccaccugccggag

SEQ ID NO: 2003622 - RNA, 12 nt, Shigella flexneri 2a str. 301
gccaccugugca

SEQ ID NO: 2003623 - RNA, 23 nt, Shigella flexneri 2a str. 301
gccaccggcuuucgcuucaacca

SEQ ID NO: 2003624 - RNA, 13 nt, Shigella flexneri 2a str. 301
gccgccaucaucg

SEQ ID NO: 2003625 - RNA, 21 nt, Shigella flexneri 2a str. 301
gccgccauccugaaucaccug

SEQ ID NO: 2003626 - RNA, 16 nt, Shigella flexneri 2a str. 301
gccgccaucucuucca

SEQ ID NO: 2003627 - RNA, 18 nt, Shigella flexneri 2a str. 301
gccgccaucucuuccagc

SEQ ID NO: 2003628 - RNA, 22 nt, Shigella flexneri 2a str. 301
gccgccauugacguuccuuucu

SEQ ID NO: 2003629 - RNA, 18 nt, Shigella flexneri 2a str. 301
gccgccaguacgcgcccg

SEQ ID NO: 2003630 - RNA, 17 nt, Shigella flexneri 2a str. 301
gccgccccagucaguaa

SEQ ID NO: 2003631 - RNA, 17 nt, Shigella flexneri 2a str. 301
gccgcccguuuucucca

SEQ ID NO: 2003632 - RNA, 22 nt, Shigella flexneri 2a str. 301
gccgcgacuauucacugcgccu

SEQ ID NO: 2003633 - RNA, 13 nt, Shigella flexneri 2a str. 301
gccgccucccuuc

SEQ ID NO: 2003634 - RNA, 13 nt, Shigella flexneri 2a str. 301
gccgccgcaaccg

SEQ ID NO: 2003635 - RNA, 20 nt, Shigella flexneri 2a str. 301
gccgccagacguccggcgcu

SEQ ID NO: 2003636 - RNA, 18 nt, Shigella flexneri 2a str. 301
gccgccagacugcgagaa

SEQ ID NO: 2003637 - RNA, 22 nt, Shigella flexneri 2a str. 301
gccgccagaccacugcgccgcu

SEQ ID NO: 2003638 - RNA, 13 nt, Shigella flexneri 2a str. 301
gccgcaucuggca

SEQ ID NO: 2003639 - RNA, 18 nt, Shigella flexneri 2a str. 301
gccgcauugguaaagccg

SEQ ID NO: 2003640 - RNA, 17 nt, Shigella flexneri 2a str. 301
gccgccaacccuucugc

SEQ ID NO: 2003641 - RNA, 18 nt, Shigella flexneri 2a str. 301
gccgccaacccuucugca

SEQ ID NO: 2003642 - RNA, 23 nt, Shigella flexneri 2a str. 301
gccgccaaucacgcccauugagc

SEQ ID NO: 2003643 - RNA, 14 nt, Shigella flexneri 2a str. 301
gccgccacagcgcc

SEQ ID NO: 2003644 - RNA, 18 nt, Shigella flexneri 2a str. 301
gccgcaggcuguuacccc

SEQ ID NO: 2003645 - RNA, 16 nt, Shigella flexneri 2a str. 301
gccgcaguaaagcgca

SEQ ID NO: 2003646 - RNA, 13 nt, Shigella flexneri 2a str. 301
gccgcauccggca

SEQ ID NO: 2003647 - RNA, 21 nt, Shigella flexneri 2a str. 301
gccgcaucguccugcgcagga

SEQ ID NO: 2003648 - RNA, 13 nt, Shigella flexneri 2a str. 301
gccgcagcaaccg

SEQ ID NO: 2003649 - RNA, 23 nt, Shigella flexneri 2a str. 301
gccgcagcggcgauuucuuuauc

SEQ ID NO: 2003650 - RNA, 21 nt, Shigella flexneri 2a str. 301
gccgcacauuucccggccacg

SEQ ID NO: 2003651 - RNA, 19 nt, Shigella flexneri 2a str. 301
gccgcaccaggaucuuuug

SEQ ID NO: 2003652 - RNA, 15 nt, Shigella flexneri 2a str. 301
gccgaugccgcugca

SEQ ID NO: 2003653 - RNA, 20 nt, Shigella flexneri 2a str. 301
gccgauaccaucacaccucg

SEQ ID NO: 2003654 - RNA, 15 nt, Shigella flexneri 2a str. 301
gccgaucgucugggc

SEQ ID NO: 2003655 - RNA, 14 nt, Shigella flexneri 2a str. 301
gccggggcgcggcg

SEQ ID NO: 2003656 - RNA, 15 nt, Shigella flexneri 2a str. 301
gccgcuguaauacca

SEQ ID NO: 2003657 - RNA, 21 nt, Shigella flexneri 2a str. 301
gccgcuuuaugugcuucuacc

SEQ ID NO: 2003658 - RNA, 17 nt, Shigella flexneri 2a str. 301
gccggacccacaccccc

SEQ ID NO: 2003659 - RNA, 18 nt, Shigella flexneri 2a str. 301
gccggaccaucuuccagu

SEQ ID NO: 2003660 - RNA, 20 nt, Shigella flexneri 2a str. 301
gccggacgcugagcacguuu

SEQ ID NO: 2003661 - RNA, 21 nt, Shigella flexneri 2a str. 301
gccggaugacagacuccgccu

SEQ ID NO: 2003662 - RNA, 14 nt, Shigella flexneri 2a str. 301
gccggaugacagac

SEQ ID NO: 2003663 - RNA, 20 nt, Shigella flexneri 2a str. 301
gccggauuugagaucggaaa

SEQ ID NO: 2003664 - RNA, 21 nt, Shigella flexneri 2a str. 301
gccggagggauguggcccagc

SEQ ID NO: 2003665 - RNA, 23 nt, Shigella flexneri 2a str. 301
gccggauaaacaauguuauccgg

SEQ ID NO: 2003666 - RNA, 20 nt, Shigella flexneri 2a str. 301
gccgcggcucaggcgcacgc

SEQ ID NO: 2003667 - RNA, 20 nt, Shigella flexneri 2a str. 301
gccgcgguaucaaacacagg

SEQ ID NO: 2003668 - RNA, 15 nt, Shigella flexneri 2a str. 301
gccgcuaacagcagc

SEQ ID NO: 2003669 - RNA, 24 nt, Shigella flexneri 2a str. 301
gccgcuaacgucuaguaaagcaga

SEQ ID NO: 2003670 - RNA, 20 nt, Shigella flexneri 2a str. 301
gccgcuaauggugcgcgcac

SEQ ID NO: 2003671 - RNA, 14 nt, Shigella flexneri 2a str. 301
gccgcuaccgcccu

SEQ ID NO: 2003672 - RNA, 21 nt, Shigella flexneri 2a str. 301
gccgcuacggaagaugaaaaa

SEQ ID NO: 2003673 - RNA, 17 nt, Shigella flexneri 2a str. 301
gccucguucuucccucc

SEQ ID NO: 2003674 - RNA, 21 nt, Shigella flexneri 2a str. 301
gccucuaacagaucauccauc

SEQ ID NO: 2003675 - RNA, 18 nt, Shigella flexneri 2a str. 301
gccucgguaagcaaagcg

SEQ ID NO: 2003676 - RNA, 16 nt, Shigella flexneri 2a str. 301
gccucgccgaaacgcu

SEQ ID NO: 2003677 - RNA, 15 nt, Shigella flexneri 2a str. 301
gccucccauuuccug

SEQ ID NO: 2003678 - RNA, 20 nt, Shigella flexneri 2a str. 301
gccuccuguucugcgcgcca

SEQ ID NO: 2003679 - RNA, 23 nt, Shigella flexneri 2a str. 301
gccucaguggcugcguuucaugu

SEQ ID NO: 2003680 - RNA, 17 nt, Shigella flexneri 2a str. 301
gccucacgaucacagca

SEQ ID NO: 2003681 - RNA, 13 nt, Shigella flexneri 2a str. 301
gccguucuucagc

SEQ ID NO: 2003682 - RNA, 16 nt, Shigella flexneri 2a str. 301
gccguugaguucaaau

SEQ ID NO: 2003683 - RNA, 17 nt, Shigella flexneri 2a str. 301
gccgugucggugcucau

SEQ ID NO: 2003684 - RNA, 22 nt, Shigella flexneri 2a str. 301
gccgugauuccgccgcacgagc

SEQ ID NO: 2003685 - RNA, 21 nt, Shigella flexneri 2a str. 301
gccgguaacgcuuucucacca

SEQ ID NO: 2003686 - RNA, 14 nt, Shigella flexneri 2a str. 301
gccucaagcacccg

SEQ ID NO: 2003687 - RNA, 22 nt, Shigella flexneri 2a str. 301
gccucaacccuuuuuuaaacau

SEQ ID NO: 2003688 - RNA, 15 nt, Shigella flexneri 2a str. 301
gccuacggcauucug

SEQ ID NO: 2003689 - RNA, 15 nt, Shigella flexneri 2a str. 301
gccuacgcguccccu

SEQ ID NO: 2003690 - RNA, 15 nt, Shigella flexneri 2a str. 301
gccuauccagaagcc

SEQ ID NO: 2003691 - RNA, 19 nt, Shigella flexneri 2a str. 301
gccuauccagaagccugcu

SEQ ID NO: 2003692 - RNA, 20 nt, Shigella flexneri 2a str. 301
gccuacaaguccguugaaaa

SEQ ID NO: 2003693 - RNA, 18 nt, Shigella flexneri 2a str. 301
gccuaccaaaccugcacg

SEQ ID NO: 2003694 - RNA, 17 nt, Shigella flexneri 2a str. 301
gccuaagccauuuaacu

SEQ ID NO: 2003695 - RNA, 14 nt, Shigella flexneri 2a str. 301
gccuaacaccauca

SEQ ID NO: 2003696 - RNA, 21 nt, Shigella flexneri 2a str. 301
gccuaauccagccuacaaauu

SEQ ID NO: 2003697 - RNA, 22 nt, Shigella flexneri 2a str. 301
gccugccauuggcaggcucugg

SEQ ID NO: 2003698 - RNA, 18 nt, Shigella flexneri 2a str. 301
gccugccagucaaucauc

SEQ ID NO: 2003699 - RNA, 15 nt, Shigella flexneri 2a str. 301
gccugccagucaauc

SEQ ID NO: 2003700 - RNA, 16 nt, Shigella flexneri 2a str. 301
gccugccaucuggcag

SEQ ID NO: 2003701 - RNA, 16 nt, Shigella flexneri 2a str. 301
gccugccagcaugcau

SEQ ID NO: 2003702 - RNA, 16 nt, Shigella flexneri 2a str. 301
gccugcauccgccauc

SEQ ID NO: 2003703 - RNA, 19 nt, Shigella flexneri 2a str. 301
gccugcaccauugcugccg

SEQ ID NO: 2003704 - RNA, 15 nt, Shigella flexneri 2a str. 301
gccugcaccauugcu

SEQ ID NO: 2003705 - RNA, 21 nt, Shigella flexneri 2a str. 301
gccugcacggagauauccagc

SEQ ID NO: 2003706 - RNA, 12 nt, Shigella flexneri 2a str. 301
gccugcacucag

SEQ ID NO: 2003707 - RNA, 16 nt, Shigella flexneri 2a str. 301
gccugccgcauccggu

SEQ ID NO: 2003708 - RNA, 15 nt, Shigella flexneri 2a str. 301
gccugccugcagcug

SEQ ID NO: 2003709 - RNA, 17 nt, Shigella flexneri 2a str. 301
gccugccugcagcugcu

SEQ ID NO: 2003710 - RNA, 21 nt, Shigella flexneri 2a str. 301
gccugcgacagggaucucuuc

SEQ ID NO: 2003711 - RNA, 15 nt, Shigella flexneri 2a str. 301
gccugcgaagcucuu

SEQ ID NO: 2003712 - RNA, 14 nt, Shigella flexneri 2a str. 301
gccugcaaauaaau

SEQ ID NO: 2003713 - RNA, 13 nt, Shigella flexneri 2a str. 301
gccugcaaauaaa

SEQ ID NO: 2003714 - RNA, 22 nt, Shigella flexneri 2a str. 301
gccugauggcgcuacgcuuauc

SEQ ID NO: 2003715 - RNA, 16 nt, Shigella flexneri 2a str. 301
gccugauguacaacca

SEQ ID NO: 2003716 - RNA, 21 nt, Shigella flexneri 2a str. 301
gccugauacaggaaggccgga

SEQ ID NO: 2003717 - RNA, 14 nt, Shigella flexneri 2a str. 301
gccugaucgcgcaa

SEQ ID NO: 2003718 - RNA, 24 nt, Shigella flexneri 2a str. 301
gccugaugcgacgcugcgcgucuu

SEQ ID NO: 2003719 - RNA, 19 nt, Shigella flexneri 2a str. 301
gccugaugcgacgcuugca

SEQ ID NO: 2003720 - RNA, 13 nt, Shigella flexneri 2a str. 301
gccugaugcguug

SEQ ID NO: 2003721 - RNA, 20 nt, Shigella flexneri 2a str. 301
gccugacagcacgccccggc

SEQ ID NO: 2003722 - RNA, 15 nt, Shigella flexneri 2a str. 301
gccugacggacgcgc

SEQ ID NO: 2003723 - RNA, 22 nt, Shigella flexneri 2a str. 301
gccugauacagccaaaucauca

SEQ ID NO: 2003724 - RNA, 15 nt, Shigella flexneri 2a str. 301
gccugauaagacgcg

SEQ ID NO: 2003725 - RNA, 16 nt, Shigella flexneri 2a str. 301
gccugauagcccgcac

SEQ ID NO: 2003726 - RNA, 21 nt, Shigella flexneri 2a str. 301
gccugauagcccgcacaaagc

SEQ ID NO: 2003727 - RNA, 20 nt, Shigella flexneri 2a str. 301
gccugauaagcguagcgcau

SEQ ID NO: 2003728 - RNA, 14 nt, Shigella flexneri 2a str. 301
gccucuuuauaaau

SEQ ID NO: 2003729 - RNA, 13 nt, Shigella flexneri 2a str. 301
gccucuuuauaaa

SEQ ID NO: 2003730 - RNA, 21 nt, Shigella flexneri 2a str. 301
gccugaaaacgaaaucguugu

SEQ ID NO: 2003731 - RNA, 17 nt, Shigella flexneri 2a str. 301
gccucuuuuaaccucag

SEQ ID NO: 2003732 - RNA, 18 nt, Shigella flexneri 2a str. 301
gccugaaauaaugcagcg

SEQ ID NO: 2003733 - RNA, 16 nt, Shigella flexneri 2a str. 301
gccugaauauccagau

SEQ ID NO: 2003734 - RNA, 12 nt, Shigella flexneri 2a str. 301
gccugaaugcuu

SEQ ID NO: 2003735 - RNA, 12 nt, Shigella flexneri 2a str. 301
gccugaauuacu

SEQ ID NO: 2003736 - RNA, 23 nt, Shigella flexneri 2a str. 301
gccucugccagcugcucauagcg

SEQ ID NO: 2003737 - RNA, 19 nt, Shigella flexneri 2a str. 301
gccucuuacgccgccacag

SEQ ID NO: 2003738 - RNA, 13 nt, Shigella flexneri 2a str. 301
gccucuauuaaaa

SEQ ID NO: 2003739 - RNA, 20 nt, Shigella flexneri 2a str. 301
gccucucggaucgguggcgc

SEQ ID NO: 2003740 - RNA, 22 nt, Shigella flexneri 2a str. 301
gccucuccuuuaccacucucgg

SEQ ID NO: 2003741 - RNA, 15 nt, Shigella flexneri 2a str. 301
gccucucuucgcugc

SEQ ID NO: 2003742 - RNA, 15 nt, Shigella flexneri 2a str. 301
gccugugcaaccuuu

SEQ ID NO: 2003743 - RNA, 15 nt, Shigella flexneri 2a str. 301
gccugugccugagcc

SEQ ID NO: 2003744 - RNA, 16 nt, Shigella flexneri 2a str. 301
gccugugccugagccg

SEQ ID NO: 2003745 - RNA, 16 nt, Shigella flexneri 2a str. 301
gccugugucaggccgg

SEQ ID NO: 2003746 - RNA, 18 nt, Shigella flexneri 2a str. 301
gccuguuccagacgcugc

SEQ ID NO: 2003747 - RNA, 19 nt, Shigella flexneri 2a str. 301
gccuguccaccacgcugca

SEQ ID NO: 2003748 - RNA, 20 nt, Shigella flexneri 2a str. 301
gccugucaccgccuccaccu

SEQ ID NO: 2003749 - RNA, 20 nt, Shigella flexneri 2a str. 301
gccuguaccacaaccugcac

SEQ ID NO: 2003750 - RNA, 15 nt, Shigella flexneri 2a str. 301
gccuguacuuccugu

SEQ ID NO: 2003751 - RNA, 18 nt, Shigella flexneri 2a str. 301
gccugggcgauuuccuuc

SEQ ID NO: 2003752 - RNA, 15 nt, Shigella flexneri 2a str. 301
gccuggguuuucaca

SEQ ID NO: 2003753 - RNA, 20 nt, Shigella flexneri 2a str. 301
gccuggguuuucacagaagu

SEQ ID NO: 2003754 - RNA, 18 nt, Shigella flexneri 2a str. 301
gccugguaccagcaccgu

SEQ ID NO: 2003755 - RNA, 22 nt, Shigella flexneri 2a str. 301
gccugguggucgaaaaucugcc

SEQ ID NO: 2003756 - RNA, 14 nt, Shigella flexneri 2a str. 301
gccuggcucaagca

SEQ ID NO: 2003757 - RNA, 16 nt, Shigella flexneri 2a str. 301
gccugcggcgcaugca

SEQ ID NO: 2003758 - RNA, 10 nt, Shigella flexneri 2a str. 301
gccugcucca

SEQ ID NO: 2003759 - RNA, 16 nt, Shigella flexneri 2a str. 301
gccuggauggcuugcu

SEQ ID NO: 2003760 - RNA, 15 nt, Shigella flexneri 2a str. 301
gccuggauggcuugc

SEQ ID NO: 2003761 - RNA, 14 nt, Shigella flexneri 2a str. 301
gccugcuuuugcca

SEQ ID NO: 2003762 - RNA, 14 nt, Shigella flexneri 2a str. 301
gccugcuuugacaa

SEQ ID NO: 2003763 - RNA, 22 nt, Shigella flexneri 2a str. 301
gccugcuggcuagccucccugc

SEQ ID NO: 2003764 - RNA, 22 nt, Shigella flexneri 2a str. 301
gccugcuuccgguuguucaacc

SEQ ID NO: 2003765 - RNA, 21 nt, Shigella flexneri 2a str. 301
gcgggccauccaccagugacu

SEQ ID NO: 2003766 - RNA, 22 nt, Shigella flexneri 2a str. 301
gcgggcgagacugcgcgccgcc

SEQ ID NO: 2003767 - RNA, 16 nt, Shigella flexneri 2a str. 301
gcggggcuaccgccag

SEQ ID NO: 2003768 - RNA, 21 nt, Shigella flexneri 2a str. 301
gcggggaucacuccccgccgu

SEQ ID NO: 2003769 - RNA, 14 nt, Shigella flexneri 2a str. 301
gcggcuuauauauu

SEQ ID NO: 2003770 - RNA, 15 nt, Shigella flexneri 2a str. 301
gcggcuuauucauua

SEQ ID NO: 2003771 - RNA, 12 nt, Shigella flexneri 2a str. 301
gcggcugcgcag

SEQ ID NO: 2003772 - RNA, 12 nt, Shigella flexneri 2a str. 301
gcggcugccagc

SEQ ID NO: 2003773 - RNA, 23 nt, Shigella flexneri 2a str. 301
gcggcucuccugaacuuucuccc

SEQ ID NO: 2003774 - RNA, 12 nt, Shigella flexneri 2a str. 301
gcggcucuccug

SEQ ID NO: 2003775 - RNA, 23 nt, Shigella flexneri 2a str. 301
gcggcuucgguuuuguugccgcc

SEQ ID NO: 2003776 - RNA, 13 nt, Shigella flexneri 2a str. 301
gcgggcaagcggc

SEQ ID NO: 2003777 - RNA, 13 nt, Shigella flexneri 2a str. 301
gcggguuagucug

SEQ ID NO: 2003778 - RNA, 16 nt, Shigella flexneri 2a str. 301
gcggguuaaccagcac

SEQ ID NO: 2003779 - RNA, 14 nt, Shigella flexneri 2a str. 301
gcggucaaugguca

SEQ ID NO: 2003780 - RNA, 15 nt, Shigella flexneri 2a str. 301
gcgguaucaccaccc

SEQ ID NO: 2003781 - RNA, 16 nt, Shigella flexneri 2a str. 301
gcgguaucaccaccca

SEQ ID NO: 2003782 - RNA, 18 nt, Shigella flexneri 2a str. 301
gcggguuucaacauuucc

SEQ ID NO: 2003783 - RNA, 14 nt, Shigella flexneri 2a str. 301
gcggucagcugcug

SEQ ID NO: 2003784 - RNA, 15 nt, Shigella flexneri 2a str. 301
gcgguguaggccuga

SEQ ID NO: 2003785 - RNA, 17 nt, Shigella flexneri 2a str. 301
gcgguguauaccagcuc

SEQ ID NO: 2003786 - RNA, 18 nt, Shigella flexneri 2a str. 301
gcgguguacccugcucgc

SEQ ID NO: 2003787 - RNA, 17 nt, Shigella flexneri 2a str. 301
gcggugcgaauugccac

SEQ ID NO: 2003788 - RNA, 17 nt, Shigella flexneri 2a str. 301
gcggugcgaugccuggc

SEQ ID NO: 2003789 - RNA, 15 nt, Shigella flexneri 2a str. 301
gcguaguaaagccuu

SEQ ID NO: 2003790 - RNA, 19 nt, Shigella flexneri 2a str. 301
gcguacuggcaaucgccag

SEQ ID NO: 2003791 - RNA, 15 nt, Shigella flexneri 2a str. 301
gcguacaccaacauc

SEQ ID NO: 2003792 - RNA, 19 nt, Shigella flexneri 2a str. 301
gcguacagagggcaggcaa

SEQ ID NO: 2003793 - RNA, 12 nt, Shigella flexneri 2a str. 301
gcguacagcgcg

SEQ ID NO: 2003794 - RNA, 13 nt, Shigella flexneri 2a str. 301
gcguacaccaaca

SEQ ID NO: 2003795 - RNA, 20 nt, Shigella flexneri 2a str. 301
gcgguugcugucggcggcga

SEQ ID NO: 2003796 - RNA, 14 nt, Shigella flexneri 2a str. 301
gcguaaaucaaacc

SEQ ID NO: 2003797 - RNA, 21 nt, Shigella flexneri 2a str. 301
gcgguuuucucuuuaaacaga

SEQ ID NO: 2003798 - RNA, 16 nt, Shigella flexneri 2a str. 301
gcgguuguucaagcau

SEQ ID NO: 2003799 - RNA, 18 nt, Shigella flexneri 2a str. 301
gcggcgaucuuuuaauaa

SEQ ID NO: 2003800 - RNA, 16 nt, Shigella flexneri 2a str. 301
gcggcgaugaccgcca

SEQ ID NO: 2003801 - RNA, 21 nt, Shigella flexneri 2a str. 301
gcggcgauaauauugaugcac

SEQ ID NO: 2003802 - RNA, 14 nt, Shigella flexneri 2a str. 301
gcggcgaaggugcc

SEQ ID NO: 2003803 - RNA, 19 nt, Shigella flexneri 2a str. 301
gcggcgaagauacccgcga

SEQ ID NO: 2003804 - RNA, 22 nt, Shigella flexneri 2a str. 301
gcggcgaacugccgaucaccac

SEQ ID NO: 2003805 - RNA, 14 nt, Shigella flexneri 2a str. 301
gcggccguuccauu

SEQ ID NO: 2003806 - RNA, 15 nt, Shigella flexneri 2a str. 301
gcggcagccaccgcc

SEQ ID NO: 2003807 - RNA, 23 nt, Shigella flexneri 2a str. 301
gcggcagcgugccaggcgcgcuu

SEQ ID NO: 2003808 - RNA, 19 nt, Shigella flexneri 2a str. 301
gcggcagguugaugaugac

SEQ ID NO: 2003809 - RNA, 15 nt, Shigella flexneri 2a str. 301
gcggcaguaaauauu

SEQ ID NO: 2003810 - RNA, 21 nt, Shigella flexneri 2a str. 301
gcggcauccagguuucuucca

SEQ ID NO: 2003811 - RNA, 16 nt, Shigella flexneri 2a str. 301
gcggcauacagccagg

SEQ ID NO: 2003812 - RNA, 19 nt, Shigella flexneri 2a str. 301
gcggcaguauagcggcaug

SEQ ID NO: 2003813 - RNA, 22 nt, Shigella flexneri 2a str. 301
gcgcuggugacaucgccagaga

SEQ ID NO: 2003814 - RNA, 12 nt, Shigella flexneri 2a str. 301
gcgcuggugguc

SEQ ID NO: 2003815 - RNA, 16 nt, Shigella flexneri 2a str. 301
gcgcugugagcaggcg

SEQ ID NO: 2003816 - RNA, 20 nt, Shigella flexneri 2a str. 301
gcggcagcaggaucuccagc

SEQ ID NO: 2003817 - RNA, 12 nt, Shigella flexneri 2a str. 301
gcggcagcaggu

SEQ ID NO: 2003818 - RNA, 17 nt, Shigella flexneri 2a str. 301
gcggcagcaauggcacu

SEQ ID NO: 2003819 - RNA, 18 nt, Shigella flexneri 2a str. 301
gcggcacuguuucgccag

SEQ ID NO: 2003820 - RNA, 20 nt, Shigella flexneri 2a str. 301
gcggcacuguuucgccaggu

SEQ ID NO: 2003821 - RNA, 22 nt, Shigella flexneri 2a str. 301
gcggcacugguacucaaccgcc

SEQ ID NO: 2003822 - RNA, 14 nt, Shigella flexneri 2a str. 301
gcggcagaaugguu

SEQ ID NO: 2003823 - RNA, 19 nt, Shigella flexneri 2a str. 301
gcgcuuaacgcgggcuucu

SEQ ID NO: 2003824 - RNA, 20 nt, Shigella flexneri 2a str. 301
gcggccccauuuauuucuca

SEQ ID NO: 2003825 - RNA, 22 nt, Shigella flexneri 2a str. 301
gcggccagccauccgucaucca

SEQ ID NO: 2003826 - RNA, 18 nt, Shigella flexneri 2a str. 301
gcggcauuucgccgagca

SEQ ID NO: 2003827 - RNA, 22 nt, Shigella flexneri 2a str. 301
gcggccaaccauccgucaucca

SEQ ID NO: 2003828 - RNA, 16 nt, Shigella flexneri 2a str. 301
gcggcauuacgcccga

SEQ ID NO: 2003829 - RNA, 16 nt, Shigella flexneri 2a str. 301
gcggcaucuucuccac

SEQ ID NO: 2003830 - RNA, 14 nt, Shigella flexneri 2a str. 301
gcggcaucuucucc

SEQ ID NO: 2003831 - RNA, 15 nt, Shigella flexneri 2a str. 301
gcucgcuggcaggcc

SEQ ID NO: 2003832 - RNA, 12 nt, Shigella flexneri 2a str. 301
gcucgcuggaag

SEQ ID NO: 2003833 - RNA, 13 nt, Shigella flexneri 2a str. 301
gcucggcggcugg

SEQ ID NO: 2003834 - RNA, 18 nt, Shigella flexneri 2a str. 301
gcucggcggcuggcugga

SEQ ID NO: 2003835 - RNA, 22 nt, Shigella flexneri 2a str. 301
gcucgcgcuugcggaagcaacc

SEQ ID NO: 2003836 - RNA, 19 nt, Shigella flexneri 2a str. 301
gcucgcgccgcauccgaca

SEQ ID NO: 2003837 - RNA, 22 nt, Shigella flexneri 2a str. 301
gcucgcgccagguguuuaacca

SEQ ID NO: 2003838 - RNA, 23 nt, Shigella flexneri 2a str. 301
gcucgccuuucggcugcagcagu

SEQ ID NO: 2003839 - RNA, 13 nt, Shigella flexneri 2a str. 301
gcucgacagcgcu

SEQ ID NO: 2003840 - RNA, 16 nt, Shigella flexneri 2a str. 301
gcucgacaccaaacag

SEQ ID NO: 2003841 - RNA, 17 nt, Shigella flexneri 2a str. 301
gcucgaacgccucugca

SEQ ID NO: 2003842 - RNA, 17 nt, Shigella flexneri 2a str. 301
gcucgaagcgggcgcgc

SEQ ID NO: 2003843 - RNA, 19 nt, Shigella flexneri 2a str. 301
gcuccgggcugguuuucag

SEQ ID NO: 2003844 - RNA, 15 nt, Shigella flexneri 2a str. 301
gcuccgcaagcgaau

SEQ ID NO: 2003845 - RNA, 14 nt, Shigella flexneri 2a str. 301
gcuccguaaacccc

SEQ ID NO: 2003846 - RNA, 13 nt, Shigella flexneri 2a str. 301
gcuccguaaaccc

SEQ ID NO: 2003847 - RNA, 15 nt, Shigella flexneri 2a str. 301
gcuccguccagccac

SEQ ID NO: 2003848 - RNA, 18 nt, Shigella flexneri 2a str. 301
gcuccguccagccaccgc

SEQ ID NO: 2003849 - RNA, 18 nt, Shigella flexneri 2a str. 301
gcucccuggcccaucgcc

SEQ ID NO: 2003850 - RNA, 22 nt, Shigella flexneri 2a str. 301
gcucccuuuggccgcucgggaa

SEQ ID NO: 2003851 - RNA, 18 nt, Shigella flexneri 2a str. 301
gcuccauaauugccagcu

SEQ ID NO: 2003852 - RNA, 23 nt, Shigella flexneri 2a str. 301
gcucaaucguaugaucauccgcc

SEQ ID NO: 2003853 - RNA, 18 nt, Shigella flexneri 2a str. 301
gcucaaugguguuuucca

SEQ ID NO: 2003854 - RNA, 22 nt, Shigella flexneri 2a str. 301
gcucaaugagcaccuuuuuucu

SEQ ID NO: 2003855 - RNA, 23 nt, Shigella flexneri 2a str. 301
gcucaauugacaguuuauuuucu

SEQ ID NO: 2003856 - RNA, 16 nt, Shigella flexneri 2a str. 301
gcuacugucuaaaaua

SEQ ID NO: 2003857 - RNA, 23 nt, Shigella flexneri 2a str. 301
gcucacuucgcuuacgccugcca

SEQ ID NO: 2003858 - RNA, 23 nt, Shigella flexneri 2a str. 301
gcucagaaucacgccaacaaaca

SEQ ID NO: 2003859 - RNA, 11 nt, Shigella flexneri 2a str. 301
gcucagacucu

SEQ ID NO: 2003860 - RNA, 23 nt, Shigella flexneri 2a str. 301
gcucaccaaaaccgagaagcagc

SEQ ID NO: 2003861 - RNA, 19 nt, Shigella flexneri 2a str. 301
gcucaccacgcagcagcca

SEQ ID NO: 2003862 - RNA, 18 nt, Shigella flexneri 2a str. 301
gcucaccagcagcggucg

SEQ ID NO: 2003863 - RNA, 14 nt, Shigella flexneri 2a str. 301
gcucauucuuccuc

SEQ ID NO: 2003864 - RNA, 18 nt, Shigella flexneri 2a str. 301
gcucauugcggcaacaau

SEQ ID NO: 2003865 - RNA, 19 nt, Shigella flexneri 2a str. 301
gcuccagauuaccagcgac

SEQ ID NO: 2003866 - RNA, 14 nt, Shigella flexneri 2a str. 301
gcucaucagcuccg

SEQ ID NO: 2003867 - RNA, 14 nt, Shigella flexneri 2a str. 301
gcucaucaagcaca

SEQ ID NO: 2003868 - RNA, 18 nt, Shigella flexneri 2a str. 301
gcucaguugcaucgucug

SEQ ID NO: 2003869 - RNA, 21 nt, Shigella flexneri 2a str. 301
gcucauaaaaucacgcgccug

SEQ ID NO: 2003870 - RNA, 13 nt, Shigella flexneri 2a str. 301
gcucauagccacu

SEQ ID NO: 2003871 - RNA, 15 nt, Shigella flexneri 2a str. 301
gcucaucaagcuguu

SEQ ID NO: 2003872 - RNA, 21 nt, Shigella flexneri 2a str. 301
gcucagucggcgcuuuugcau

SEQ ID NO: 2003873 - RNA, 15 nt, Shigella flexneri 2a str. 301
gcucaguugguuaga

SEQ ID NO: 2003874 - RNA, 16 nt, Shigella flexneri 2a str. 301
gcucagucacuucaaa

SEQ ID NO: 2003875 - RNA, 13 nt, Shigella flexneri 2a str. 301
gcuaaguugaauc

SEQ ID NO: 2003876 - RNA, 23 nt, Shigella flexneri 2a str. 301
gcuaauaccgucgaugccaauaa

SEQ ID NO: 2003877 - RNA, 18 nt, Shigella flexneri 2a str. 301
gcuaaucucuucaccaua

SEQ ID NO: 2003878 - RNA, 14 nt, Shigella flexneri 2a str. 301
gcuaaugcaaauca

SEQ ID NO: 2003879 - RNA, 20 nt, Shigella flexneri 2a str. 301
gcuaaucggcugcagugcaa

SEQ ID NO: 2003880 - RNA, 17 nt, Shigella flexneri 2a str. 301
gcuaaaaguuuuagcau

SEQ ID NO: 2003881 - RNA, 21 nt, Shigella flexneri 2a str. 301
gcuaaccgcuuuuccagcaua

SEQ ID NO: 2003882 - RNA, 13 nt, Shigella flexneri 2a str. 301
gcuaacagcagca

SEQ ID NO: 2003883 - RNA, 16 nt, Shigella flexneri 2a str. 301
gcuaacaggcuuuuac

SEQ ID NO: 2003884 - RNA, 17 nt, Shigella flexneri 2a str. 301
gcuaaauaaccagcaua

SEQ ID NO: 2003885 - RNA, 21 nt, Shigella flexneri 2a str. 301
gcuaaauguuuaguauuguua

SEQ ID NO: 2003886 - RNA, 14 nt, Shigella flexneri 2a str. 301
gcuaccaccaaacg

SEQ ID NO: 2003887 - RNA, 13 nt, Shigella flexneri 2a str. 301
gcuaccaaaaaau

SEQ ID NO: 2003888 - RNA, 15 nt, Shigella flexneri 2a str. 301
gcuacauacuuaaau

SEQ ID NO: 2003889 - RNA, 17 nt, Shigella flexneri 2a str. 301
gcuacaggguaaaaaga

SEQ ID NO: 2003890 - RNA, 17 nt, Shigella flexneri 2a str. 301
gcuacaacaucguaucu

SEQ ID NO: 2003891 - RNA, 13 nt, Shigella flexneri 2a str. 301
gcuacgccagcaa

SEQ ID NO: 2003892 - RNA, 17 nt, Shigella flexneri 2a str. 301
gcuacgcagaaccagaa

SEQ ID NO: 2003893 - RNA, 17 nt, Shigella flexneri 2a str. 301
gcuacgcuuaucaggcc

SEQ ID NO: 2003894 - RNA, 20 nt, Shigella flexneri 2a str. 301
gcuacggcguuucacuucug

SEQ ID NO: 2003895 - RNA, 16 nt, Shigella flexneri 2a str. 301
gcuacguagccagauu

SEQ ID NO: 2003896 - RNA, 20 nt, Shigella flexneri 2a str. 301
gcuacguucugcguaauguu

SEQ ID NO: 2003897 - RNA, 15 nt, Shigella flexneri 2a str. 301
gcuaccgcccugagc

SEQ ID NO: 2003898 - RNA, 20 nt, Shigella flexneri 2a str. 301
gcuaccgcccugagcaucaa

SEQ ID NO: 2003899 - RNA, 22 nt, Shigella flexneri 2a str. 301
gcuaccggacaguuugaucagu

SEQ ID NO: 2003900 - RNA, 20 nt, Shigella flexneri 2a str. 301
gcgugcccgggucagcgcca

SEQ ID NO: 2003901 - RNA, 13 nt, Shigella flexneri 2a str. 301
gcguauccuccug

SEQ ID NO: 2003902 - RNA, 19 nt, Shigella flexneri 2a str. 301
gcguaucgacaaucaccag

SEQ ID NO: 2003903 - RNA, 17 nt, Shigella flexneri 2a str. 301
gcguauccagcauaccu

SEQ ID NO: 2003904 - RNA, 22 nt, Shigella flexneri 2a str. 301
gcguaucaauuaacgguugcgg

SEQ ID NO: 2003905 - RNA, 19 nt, Shigella flexneri 2a str. 301
gcgucucuuuucguuuugg

SEQ ID NO: 2003906 - RNA, 14 nt, Shigella flexneri 2a str. 301
gcguaucuguggcg

SEQ ID NO: 2003907 - RNA, 14 nt, Shigella flexneri 2a str. 301
gcgucuuaucaggc

SEQ ID NO: 2003908 - RNA, 18 nt, Shigella flexneri 2a str. 301
gcgucugcgugcggcggu

SEQ ID NO: 2003909 - RNA, 19 nt, Shigella flexneri 2a str. 301
gcgugaacgugcaaaauca

SEQ ID NO: 2003910 - RNA, 16 nt, Shigella flexneri 2a str. 301
gcgucuuccgugccug

SEQ ID NO: 2003911 - RNA, 16 nt, Shigella flexneri 2a str. 301
gcgucuuaucuggccu

SEQ ID NO: 2003912 - RNA, 23 nt, Shigella flexneri 2a str. 301
gcguucccguccgcacgcuggag

SEQ ID NO: 2003913 - RNA, 13 nt, Shigella flexneri 2a str. 301
gcguuaugacgcg

SEQ ID NO: 2003914 - RNA, 16 nt, Shigella flexneri 2a str. 301
gcguucgccaaaccca

SEQ ID NO: 2003915 - RNA, 14 nt, Shigella flexneri 2a str. 301
gcguuaacuuguug

SEQ ID NO: 2003916 - RNA, 14 nt, Shigella flexneri 2a str. 301
gcguuaccagcaaa

SEQ ID NO: 2003917 - RNA, 18 nt, Shigella flexneri 2a str. 301
gcguuagacgcguuuaca

SEQ ID NO: 2003918 - RNA, 16 nt, Shigella flexneri 2a str. 301
gcguuagccauaaaac

SEQ ID NO: 2003919 - RNA, 16 nt, Shigella flexneri 2a str. 301
gcguuacgacuguuga

SEQ ID NO: 2003920 - RNA, 16 nt, Shigella flexneri 2a str. 301
gcuaaaaacaucauga

SEQ ID NO: 2003921 - RNA, 14 nt, Shigella flexneri 2a str. 301
gcuaaaaacaucau

SEQ ID NO: 2003922 - RNA, 12 nt, Shigella flexneri 2a str. 301
gcguuuuuucau

SEQ ID NO: 2003923 - RNA, 23 nt, Shigella flexneri 2a str. 301
gcguuuuucuucagccccuccac

SEQ ID NO: 2003924 - RNA, 13 nt, Shigella flexneri 2a str. 301
gcguuuuucuuca

SEQ ID NO: 2003925 - RNA, 13 nt, Shigella flexneri 2a str. 301
gcguuuuucagaa

SEQ ID NO: 2003926 - RNA, 17 nt, Shigella flexneri 2a str. 301
gcguuuuuaucuucaca

SEQ ID NO: 2003927 - RNA, 23 nt, Shigella flexneri 2a str. 301
gcguuuugauuuucaccagcauc

SEQ ID NO: 2003928 - RNA, 15 nt, Shigella flexneri 2a str. 301
gcguuuguccgccgg

SEQ ID NO: 2003929 - RNA, 19 nt, Shigella flexneri 2a str. 301
gcguuugaaaaagccaaaa

SEQ ID NO: 2003930 - RNA, 12 nt, Shigella flexneri 2a str. 301
gcguuuguugcg

SEQ ID NO: 2003931 - RNA, 17 nt, Shigella flexneri 2a str. 301
gcguuuuaccaguuuca

SEQ ID NO: 2003932 - RNA, 16 nt, Shigella flexneri 2a str. 301
gcguuuucaaccagcc

SEQ ID NO: 2003933 - RNA, 23 nt, Shigella flexneri 2a str. 301
gcguucugguaaaccuuccacac

SEQ ID NO: 2003934 - RNA, 13 nt, Shigella flexneri 2a str. 301
gcguucugccugg

SEQ ID NO: 2003935 - RNA, 17 nt, Shigella flexneri 2a str. 301
gcguuuccagcaccagu

SEQ ID NO: 2003936 - RNA, 12 nt, Shigella flexneri 2a str. 301
gcgcgccaggcg

SEQ ID NO: 2003937 - RNA, 18 nt, Shigella flexneri 2a str. 301
gcgcgagccauaaacuga

SEQ ID NO: 2003938 - RNA, 14 nt, Shigella flexneri 2a str. 301
gcgcgacuuuuucc

SEQ ID NO: 2003939 - RNA, 14 nt, Shigella flexneri 2a str. 301
gcgcgacgcucggc

SEQ ID NO: 2003940 - RNA, 15 nt, Shigella flexneri 2a str. 301
gcgcgacgcucggcu

SEQ ID NO: 2003941 - RNA, 18 nt, Shigella flexneri 2a str. 301
gcgcgagguuaaaaagug

SEQ ID NO: 2003942 - RNA, 17 nt, Shigella flexneri 2a str. 301
gcgccguuuuuuuucug

SEQ ID NO: 2003943 - RNA, 15 nt, Shigella flexneri 2a str. 301
gcgcgaacagcacau

SEQ ID NO: 2003944 - RNA, 21 nt, Shigella flexneri 2a str. 301
gcgcgaauggaaagcccgccc

SEQ ID NO: 2003945 - RNA, 19 nt, Shigella flexneri 2a str. 301
gcgcgaauauggcggcggc

SEQ ID NO: 2003946 - RNA, 22 nt, Shigella flexneri 2a str. 301
gcgcgaauggaaagcccgcccc

SEQ ID NO: 2003947 - RNA, 14 nt, Shigella flexneri 2a str. 301
gcgcgacaauauuc

SEQ ID NO: 2003948 - RNA, 20 nt, Shigella flexneri 2a str. 301
gcgcgaacugucgguuugua

SEQ ID NO: 2003949 - RNA, 20 nt, Shigella flexneri 2a str. 301
gcgcgaacuggaugaaaaaa

SEQ ID NO: 2003950 - RNA, 17 nt, Shigella flexneri 2a str. 301
gcgcggcauuacgcccg

SEQ ID NO: 2003951 - RNA, 21 nt, Shigella flexneri 2a str. 301
gcgcggcaauuagcggccagc

SEQ ID NO: 2003952 - RNA, 21 nt, Shigella flexneri 2a str. 301
gcgcggcaauuagcggcuggc

SEQ ID NO: 2003953 - RNA, 14 nt, Shigella flexneri 2a str. 301
gcgcggcagccacc

SEQ ID NO: 2003954 - RNA, 16 nt, Shigella flexneri 2a str. 301
gcgcggcacccgcagg

SEQ ID NO: 2003955 - RNA, 16 nt, Shigella flexneri 2a str. 301
gcgcgcugccagaacc

SEQ ID NO: 2003956 - RNA, 15 nt, Shigella flexneri 2a str. 301
gcgcgugagcuggga

SEQ ID NO: 2003957 - RNA, 13 nt, Shigella flexneri 2a str. 301
gcgcguuaacucc

SEQ ID NO: 2003958 - RNA, 21 nt, Shigella flexneri 2a str. 301
gcgcuagcuucagguguuagu

SEQ ID NO: 2003959 - RNA, 21 nt, Shigella flexneri 2a str. 301
gcgcuagccucagguguuagu

SEQ ID NO: 2003960 - RNA, 17 nt, Shigella flexneri 2a str. 301
gcgcuaaaagcauagcc

SEQ ID NO: 2003961 - RNA, 18 nt, Shigella flexneri 2a str. 301
gcgcuaaaaauagcgacu

SEQ ID NO: 2003962 - RNA, 13 nt, Shigella flexneri 2a str. 301
gcgcuaacucauc

SEQ ID NO: 2003963 - RNA, 13 nt, Shigella flexneri 2a str. 301
gcgcuaagcgaac

SEQ ID NO: 2003964 - RNA, 14 nt, Shigella flexneri 2a str. 301
gcgcuauccugguu

SEQ ID NO: 2003965 - RNA, 21 nt, Shigella flexneri 2a str. 301
gcgcuauguuuaucaggccaa

SEQ ID NO: 2003966 - RNA, 15 nt, Shigella flexneri 2a str. 301
gcgcucagcgccaca

SEQ ID NO: 2003967 - RNA, 12 nt, Shigella flexneri 2a str. 301
gcgcugccagaa

SEQ ID NO: 2003968 - RNA, 16 nt, Shigella flexneri 2a str. 301
gcgcucugcccaugcu

SEQ ID NO: 2003969 - RNA, 21 nt, Shigella flexneri 2a str. 301
gcgcugccucucuucgcugcu

SEQ ID NO: 2003970 - RNA, 13 nt, Shigella flexneri 2a str. 301
gcgcugcggcgcg

SEQ ID NO: 2003971 - RNA, 18 nt, Shigella flexneri 2a str. 301
gcgcugcgcuuaucaggc

SEQ ID NO: 2003972 - RNA, 13 nt, Shigella flexneri 2a str. 301
gcgcuccaggagu

SEQ ID NO: 2003973 - RNA, 21 nt, Shigella flexneri 2a str. 301
gcgcucauuuucucuuucagc

SEQ ID NO: 2003974 - RNA, 19 nt, Shigella flexneri 2a str. 301
gcgcucgaagcgggcgcgc

SEQ ID NO: 2003975 - RNA, 13 nt, Shigella flexneri 2a str. 301
gcgcuccuguucc

SEQ ID NO: 2003976 - RNA, 14 nt, Shigella flexneri 2a str. 301
gcgccgccacugcc

SEQ ID NO: 2003977 - RNA, 16 nt, Shigella flexneri 2a str. 301
gcgccgaguaaaaaaa

SEQ ID NO: 2003978 - RNA, 20 nt, Shigella flexneri 2a str. 301
gcgccgcaacuaccagcagu

SEQ ID NO: 2003979 - RNA, 14 nt, Shigella flexneri 2a str. 301
gcgccgacagcagc

SEQ ID NO: 2003980 - RNA, 15 nt, Shigella flexneri 2a str. 301
gcgccgacccugcgu

SEQ ID NO: 2003981 - RNA, 19 nt, Shigella flexneri 2a str. 301
gcgccgugcaacugcggcg

SEQ ID NO: 2003982 - RNA, 23 nt, Shigella flexneri 2a str. 301
gcgccgugaacguggccaugagc

SEQ ID NO: 2003983 - RNA, 17 nt, Shigella flexneri 2a str. 301
gcgccguccacaaaccg

SEQ ID NO: 2003984 - RNA, 17 nt, Shigella flexneri 2a str. 301
gcgccgcucaguacgag

SEQ ID NO: 2003985 - RNA, 15 nt, Shigella flexneri 2a str. 301
gcgcccgccagcauc

SEQ ID NO: 2003986 - RNA, 13 nt, Shigella flexneri 2a str. 301
gcgcccgccagca

SEQ ID NO: 2003987 - RNA, 19 nt, Shigella flexneri 2a str. 301
gcgcccaguggaugcgcca

SEQ ID NO: 2003988 - RNA, 13 nt, Shigella flexneri 2a str. 301
gcgccccacugga

SEQ ID NO: 2003989 - RNA, 22 nt, Shigella flexneri 2a str. 301
gcgccaugcguuuuaccgccuc

SEQ ID NO: 2003990 - RNA, 14 nt, Shigella flexneri 2a str. 301
gcgccauuuuucac

SEQ ID NO: 2003991 - RNA, 15 nt, Shigella flexneri 2a str. 301
gcgccagcgucauca

SEQ ID NO: 2003992 - RNA, 15 nt, Shigella flexneri 2a str. 301
gcgcaggauaaccuu

SEQ ID NO: 2003993 - RNA, 20 nt, Shigella flexneri 2a str. 301
gcgcagcuuugugcuucagu

SEQ ID NO: 2003994 - RNA, 24 nt, Shigella flexneri 2a str. 301
gcgccagacccagacgcucagggu

SEQ ID NO: 2003995 - RNA, 19 nt, Shigella flexneri 2a str. 301
gcgccagagcgcggcguga

SEQ ID NO: 2003996 - RNA, 17 nt, Shigella flexneri 2a str. 301
gcgccagauagccgacc

SEQ ID NO: 2003997 - RNA, 20 nt, Shigella flexneri 2a str. 301
gcgccagcgaagccagcucc

SEQ ID NO: 2003998 - RNA, 14 nt, Shigella flexneri 2a str. 301
gcgccagcgcuucc

SEQ ID NO: 2003999 - RNA, 17 nt, Shigella flexneri 2a str. 301
gcgccagcggccagcgc

SEQ ID NO: 2004000 - RNA, 13 nt, Shigella flexneri 2a str. 301
gcgccagcggcag

SEQ ID NO: 2004001 - RNA, 18 nt, Shigella flexneri 2a str. 301
gcgauauaauaaaccugc

SEQ ID NO: 2004002 - RNA, 12 nt, Shigella flexneri 2a str. 301
gcgagggagaaa

SEQ ID NO: 2004003 - RNA, 15 nt, Shigella flexneri 2a str. 301
gcgagguccagcucc

SEQ ID NO: 2004004 - RNA, 18 nt, Shigella flexneri 2a str. 301
gcgagguacgcccagcgc

SEQ ID NO: 2004005 - RNA, 18 nt, Shigella flexneri 2a str. 301
gcgaucgaccugcgccug

SEQ ID NO: 2004006 - RNA, 20 nt, Shigella flexneri 2a str. 301
gcgaucgaccugcgccugca

SEQ ID NO: 2004007 - RNA, 16 nt, Shigella flexneri 2a str. 301
gcgaucgacgcgucca

SEQ ID NO: 2004008 - RNA, 21 nt, Shigella flexneri 2a str. 301
gcgauccgguacuggcguggg

SEQ ID NO: 2004009 - RNA, 18 nt, Shigella flexneri 2a str. 301
gcgaucccagagcgggca

SEQ ID NO: 2004010 - RNA, 17 nt, Shigella flexneri 2a str. 301
gcgauggacgcagacca

SEQ ID NO: 2004011 - RNA, 14 nt, Shigella flexneri 2a str. 301
gcgaugccaguaau

SEQ ID NO: 2004012 - RNA, 13 nt, Shigella flexneri 2a str. 301
gcgaugaugccaa

SEQ ID NO: 2004013 - RNA, 16 nt, Shigella flexneri 2a str. 301
gcgaugaccaaaaaca

SEQ ID NO: 2004014 - RNA, 20 nt, Shigella flexneri 2a str. 301
gcgaugaaaaucaccggaug

SEQ ID NO: 2004015 - RNA, 18 nt, Shigella flexneri 2a str. 301
gcgacuucuucccaccau

SEQ ID NO: 2004016 - RNA, 23 nt, Shigella flexneri 2a str. 301
gcgagaucuuuaucaaucaccgc

SEQ ID NO: 2004017 - RNA, 23 nt, Shigella flexneri 2a str. 301
gcgagccuguaccacaaccugca

SEQ ID NO: 2004018 - RNA, 19 nt, Shigella flexneri 2a str. 301
gcgacugcaaaaagcaggu

SEQ ID NO: 2004019 - RNA, 17 nt, Shigella flexneri 2a str. 301
gcgacugaggcugucau

SEQ ID NO: 2004020 - RNA, 15 nt, Shigella flexneri 2a str. 301
gcgcagcagcgcgcc

SEQ ID NO: 2004021 - RNA, 13 nt, Shigella flexneri 2a str. 301
gcgcagcacccag

SEQ ID NO: 2004022 - RNA, 15 nt, Shigella flexneri 2a str. 301
gcgcacgucagccuc

SEQ ID NO: 2004023 - RNA, 18 nt, Shigella flexneri 2a str. 301
gcgcacuaugugccagcu

SEQ ID NO: 2004024 - RNA, 16 nt, Shigella flexneri 2a str. 301
gcgcacucgcagacaa

SEQ ID NO: 2004025 - RNA, 12 nt, Shigella flexneri 2a str. 301
gcgcaaucacca

SEQ ID NO: 2004026 - RNA, 20 nt, Shigella flexneri 2a str. 301
gcgcaauaugcggugccauu

SEQ ID NO: 2004027 - RNA, 20 nt, Shigella flexneri 2a str. 301
gcgcaauguugcgggggcuu

SEQ ID NO: 2004028 - RNA, 17 nt, Shigella flexneri 2a str. 301
gcgcaauuuccauugcu

SEQ ID NO: 2004029 - RNA, 17 nt, Shigella flexneri 2a str. 301
gcgcagcugagaaaaag

SEQ ID NO: 2004030 - RNA, 18 nt, Shigella flexneri 2a str. 301
gcgcagcauaaucggcug

SEQ ID NO: 2004031 - RNA, 23 nt, Shigella flexneri 2a str. 301
gcgauucccguuuauggucgggu

SEQ ID NO: 2004032 - RNA, 23 nt, Shigella flexneri 2a str. 301
gcgauugccguuggcguugcacc

SEQ ID NO: 2004033 - RNA, 12 nt, Shigella flexneri 2a str. 301
gcgauugccgca

SEQ ID NO: 2004034 - RNA, 21 nt, Shigella flexneri 2a str. 301
gcgauucauaugcgccagcug

SEQ ID NO: 2004035 - RNA, 17 nt, Shigella flexneri 2a str. 301
gcgauuaugaaacaaga

SEQ ID NO: 2004036 - RNA, 21 nt, Shigella flexneri 2a str. 301
gcgauuauuuauucccgccag

SEQ ID NO: 2004037 - RNA, 14 nt, Shigella flexneri 2a str. 301
gcgauuaagaaugc

SEQ ID NO: 2004038 - RNA, 13 nt, Shigella flexneri 2a str. 301
gcgauuaauaaaa

SEQ ID NO: 2004039 - RNA, 16 nt, Shigella flexneri 2a str. 301
gcgauggcggcagccu

SEQ ID NO: 2004040 - RNA, 14 nt, Shigella flexneri 2a str. 301
gcgauggcccgcuu

SEQ ID NO: 2004041 - RNA, 22 nt, Shigella flexneri 2a str. 301
gcgaugguacuucaaucgccac

SEQ ID NO: 2004042 - RNA, 12 nt, Shigella flexneri 2a str. 301
gcgaugguggug

SEQ ID NO: 2004043 - RNA, 22 nt, Shigella flexneri 2a str. 301
gcgaugguggugggggaaggau

SEQ ID NO: 2004044 - RNA, 12 nt, Shigella flexneri 2a str. 301
gcgauuuccuuc

SEQ ID NO: 2004045 - RNA, 23 nt, Shigella flexneri 2a str. 301
gcgauuucacaagacuguaaaua

SEQ ID NO: 2004046 - RNA, 16 nt, Shigella flexneri 2a str. 301
gcgcaaacuuaucgug

SEQ ID NO: 2004047 - RNA, 15 nt, Shigella flexneri 2a str. 301
gcgcaaacagugacc

SEQ ID NO: 2004048 - RNA, 16 nt, Shigella flexneri 2a str. 301
gcgcaaaggccagcaa

SEQ ID NO: 2004049 - RNA, 13 nt, Shigella flexneri 2a str. 301
gcgcaaaggccag

SEQ ID NO: 2004050 - RNA, 15 nt, Shigella flexneri 2a str. 301
gcgcaacaaauaaaa

SEQ ID NO: 2004051 - RNA, 15 nt, Shigella flexneri 2a str. 301
gcgcaaauugcuggu

SEQ ID NO: 2004052 - RNA, 21 nt, Shigella flexneri 2a str. 301
gcgcaaaucagauugccacag

SEQ ID NO: 2004053 - RNA, 20 nt, Shigella flexneri 2a str. 301
gcgcaacaaauaaaagcaaa

SEQ ID NO: 2004054 - RNA, 22 nt, Shigella flexneri 2a str. 301
gcgcaacaaauaaaagcaaaaa

SEQ ID NO: 2004055 - RNA, 22 nt, Shigella flexneri 2a str. 301
gcgcaauauccugcgcuuccug

SEQ ID NO: 2004056 - RNA, 16 nt, Shigella flexneri 2a str. 301
gcgaaagcuggcacug

SEQ ID NO: 2004057 - RNA, 12 nt, Shigella flexneri 2a str. 301
gcgaaauaauca

SEQ ID NO: 2004058 - RNA, 20 nt, Shigella flexneri 2a str. 301
gcgaacagcacaucagccag

SEQ ID NO: 2004059 - RNA, 18 nt, Shigella flexneri 2a str. 301
gcgaacaacagaucaaca

SEQ ID NO: 2004060 - RNA, 13 nt, Shigella flexneri 2a str. 301
gccuuuuccagcg

SEQ ID NO: 2004061 - RNA, 23 nt, Shigella flexneri 2a str. 301
gccuuugaaaauaacaucgccag

SEQ ID NO: 2004062 - RNA, 14 nt, Shigella flexneri 2a str. 301
gccuuguuugauca

SEQ ID NO: 2004063 - RNA, 14 nt, Shigella flexneri 2a str. 301
gccuuguuucuuca

SEQ ID NO: 2004064 - RNA, 17 nt, Shigella flexneri 2a str. 301
gccuuuaccgccacagc

SEQ ID NO: 2004065 - RNA, 17 nt, Shigella flexneri 2a str. 301
gccuuuauuaaugacau

SEQ ID NO: 2004066 - RNA, 14 nt, Shigella flexneri 2a str. 301
gccuuucucagaga

SEQ ID NO: 2004067 - RNA, 21 nt, Shigella flexneri 2a str. 301
gccuuuccuccugucuucccu

SEQ ID NO: 2004068 - RNA, 19 nt, Shigella flexneri 2a str. 301
gccuuucgagaagcaagca

SEQ ID NO: 2004069 - RNA, 22 nt, Shigella flexneri 2a str. 301
gccuuucgagaagcaagcauua

SEQ ID NO: 2004070 - RNA, 23 nt, Shigella flexneri 2a str. 301
gccuuucacgccgggaaauuuuu

SEQ ID NO: 2004071 - RNA, 18 nt, Shigella flexneri 2a str. 301
gcgaaguagacagcguuu

SEQ ID NO: 2004072 - RNA, 13 nt, Shigella flexneri 2a str. 301
gcgaacucuuccg

SEQ ID NO: 2004073 - RNA, 22 nt, Shigella flexneri 2a str. 301
gcgaauaaaguagaaauuauuu

SEQ ID NO: 2004074 - RNA, 18 nt, Shigella flexneri 2a str. 301
gcgaauuugaauauauac

SEQ ID NO: 2004075 - RNA, 15 nt, Shigella flexneri 2a str. 301
gcgacaaucccugca

SEQ ID NO: 2004076 - RNA, 20 nt, Shigella flexneri 2a str. 301
gcgaccuacacgccuucucc

SEQ ID NO: 2004077 - RNA, 15 nt, Shigella flexneri 2a str. 301
gcgaccguuuucacc

SEQ ID NO: 2004078 - RNA, 13 nt, Shigella flexneri 2a str. 301
gcgaccucaagcu

SEQ ID NO: 2004079 - RNA, 22 nt, Shigella flexneri 2a str. 301
gcgaccucaagcucgccaccau

SEQ ID NO: 2004080 - RNA, 20 nt, Shigella flexneri 2a str. 301
gcgaccagcgucgcaucagg

SEQ ID NO: 2004081 - RNA, 18 nt, Shigella flexneri 2a str. 301
gcgacagauuuugccagc

SEQ ID NO: 2004082 - RNA, 16 nt, Shigella flexneri 2a str. 301
gcgacagauucgcggg

SEQ ID NO: 2004083 - RNA, 19 nt, Shigella flexneri 2a str. 301
gcgacagauucaggcgcag

SEQ ID NO: 2004084 - RNA, 15 nt, Shigella flexneri 2a str. 301
gccuucuucauccag

SEQ ID NO: 2004085 - RNA, 21 nt, Shigella flexneri 2a str. 301
gccuucugcgccgccucugcg

SEQ ID NO: 2004086 - RNA, 21 nt, Shigella flexneri 2a str. 301
gccuugcgauuacgcucggca

SEQ ID NO: 2004087 - RNA, 19 nt, Shigella flexneri 2a str. 301
gccuugcgugccuuagcca

SEQ ID NO: 2004088 - RNA, 17 nt, Shigella flexneri 2a str. 301
gccuguugcgucgccgc

SEQ ID NO: 2004089 - RNA, 19 nt, Shigella flexneri 2a str. 301
gccuguugugcgagcaaag

SEQ ID NO: 2004090 - RNA, 16 nt, Shigella flexneri 2a str. 301
gccuguucgccgccgc

SEQ ID NO: 2004091 - RNA, 12 nt, Shigella flexneri 2a str. 301
gccuuaaacuca

SEQ ID NO: 2004092 - RNA, 22 nt, Shigella flexneri 2a str. 301
gccuuacccggaccgucuuuuu

SEQ ID NO: 2004093 - RNA, 18 nt, Shigella flexneri 2a str. 301
gccuuauccgaugguuua

SEQ ID NO: 2004094 - RNA, 14 nt, Shigella flexneri 2a str. 301
gccuuauccagccu

SEQ ID NO: 2004095 - RNA, 21 nt, Shigella flexneri 2a str. 301
gccuuauccggcuuaccgcuc

SEQ ID NO: 2004096 - RNA, 13 nt, Shigella flexneri 2a str. 301
gccuuauccggcu

SEQ ID NO: 2004097 - RNA, 20 nt, Shigella flexneri 2a str. 301
gccuucacgguuauuguagc

SEQ ID NO: 2004098 - RNA, 18 nt, Shigella flexneri 2a str. 301
gccuucaccgcuaaagcg

SEQ ID NO: 2004099 - RNA, 19 nt, Shigella flexneri 2a str. 301
gccuucaccgcuaaagcgg

SEQ ID NO: 2004100 - RNA, 17 nt, Shigella flexneri 2a str. 301
gccuucauucaggccaa

SEQ ID NO: 2004101 - RNA, 21 nt, Shigella flexneri 2a str. 301
gccuucagguuuuucagcugc

SEQ ID NO: 2004102 - RNA, 13 nt, Shigella flexneri 2a str. 301
gccuucagugccg

SEQ ID NO: 2004103 - RNA, 19 nt, Shigella flexneri 2a str. 301
gccuucaugcgacgacggu

SEQ ID NO: 2004104 - RNA, 15 nt, Shigella flexneri 2a str. 301
gccuuccagcgaugc

SEQ ID NO: 2004105 - RNA, 18 nt, Shigella flexneri 2a str. 301
gccuuccgcaaacaggcg

SEQ ID NO: 2004106 - RNA, 15 nt, Shigella flexneri 2a str. 301
gccuucccuuucagc

SEQ ID NO: 2004107 - RNA, 17 nt, Shigella flexneri 2a str. 301
gccuuccgucagcaaag

SEQ ID NO: 2004108 - RNA, 21 nt, Shigella flexneri 2a str. 301
gccuucgcaaaaaaccauccc

SEQ ID NO: 2004109 - RNA, 18 nt, Shigella flexneri 2a str. 301
gccuucggcgucuccacc

SEQ ID NO: 2004110 - RNA, 15 nt, Shigella flexneri 2a str. 301
gccuucgccuuucag

SEQ ID NO: 2004111 - RNA, 17 nt, Shigella flexneri 2a str. 301
gugcgguaagcugcggu

SEQ ID NO: 2004112 - RNA, 15 nt, Shigella flexneri 2a str. 301
gugcggucaggcauc

SEQ ID NO: 2004113 - RNA, 15 nt, Shigella flexneri 2a str. 301
gugcgggcacaggcg

SEQ ID NO: 2004114 - RNA, 23 nt, Shigella flexneri 2a str. 301
gugcgcgauagauagcguucuuu

SEQ ID NO: 2004115 - RNA, 21 nt, Shigella flexneri 2a str. 301
gugcgcgauagauagcguucu

SEQ ID NO: 2004116 - RNA, 16 nt, Shigella flexneri 2a str. 301
gugcgcgagcuggugc

SEQ ID NO: 2004117 - RNA, 12 nt, Shigella flexneri 2a str. 301
gugcggcagggg

SEQ ID NO: 2004118 - RNA, 19 nt, Shigella flexneri 2a str. 301
gugcgcccuguucugcaag

SEQ ID NO: 2004119 - RNA, 20 nt, Shigella flexneri 2a str. 301
gugcgaaugcgauggcaaaa

SEQ ID NO: 2004120 - RNA, 22 nt, Shigella flexneri 2a str. 301
gugccgcgauaccacccgcagu

SEQ ID NO: 2004121 - RNA, 20 nt, Shigella flexneri 2a str. 301
gugcugaaagggcaaauaau

SEQ ID NO: 2004122 - RNA, 12 nt, Shigella flexneri 2a str. 301
gugcugauuuug

SEQ ID NO: 2004123 - RNA, 18 nt, Shigella flexneri 2a str. 301
gugcugaguuucagacca

SEQ ID NO: 2004124 - RNA, 14 nt, Shigella flexneri 2a str. 301
gugcucgcuuucca

SEQ ID NO: 2004125 - RNA, 22 nt, Shigella flexneri 2a str. 301
gugcuggcaaaucaguggcugg

SEQ ID NO: 2004126 - RNA, 21 nt, Shigella flexneri 2a str. 301
gugcugggaaaccuggauauu

SEQ ID NO: 2004127 - RNA, 11 nt, Shigella flexneri 2a str. 301
gugcuggucac

SEQ ID NO: 2004128 - RNA, 17 nt, Shigella flexneri 2a str. 301
gugcucaaugagcaccu

SEQ ID NO: 2004129 - RNA, 22 nt, Shigella flexneri 2a str. 301
gugcucaaugagcaccuuuuuu

SEQ ID NO: 2004130 - RNA, 22 nt, Shigella flexneri 2a str. 301
gugcuccagucguucaaccacu

SEQ ID NO: 2004131 - RNA, 16 nt, Shigella flexneri 2a str. 301
gugcuccagugcgcuu

SEQ ID NO: 2004132 - RNA, 13 nt, Shigella flexneri 2a str. 301
gugcuccauuguu

SEQ ID NO: 2004133 - RNA, 22 nt, Shigella flexneri 2a str. 301
gugcuaguuaucuccuugcugg

SEQ ID NO: 2004134 - RNA, 12 nt, Shigella flexneri 2a str. 301
gugcgucagggc

SEQ ID NO: 2004135 - RNA, 15 nt, Shigella flexneri 2a str. 301
gugcguugucaucga

SEQ ID NO: 2004136 - RNA, 17 nt, Shigella flexneri 2a str. 301
gucgcugacgcacuguu

SEQ ID NO: 2004137 - RNA, 21 nt, Shigella flexneri 2a str. 301
gucgcuuaauugaccugccgg

SEQ ID NO: 2004138 - RNA, 21 nt, Shigella flexneri 2a str. 301
gucgcugguugcaugaugacu

SEQ ID NO: 2004139 - RNA, 22 nt, Shigella flexneri 2a str. 301
gucgcuucgcgaaucgccacaa

SEQ ID NO: 2004140 - RNA, 15 nt, Shigella flexneri 2a str. 301
gugauggcuauuaga

SEQ ID NO: 2004141 - RNA, 20 nt, Shigella flexneri 2a str. 301
gugaugcguccgcuaguggc

SEQ ID NO: 2004142 - RNA, 14 nt, Shigella flexneri 2a str. 301
gugaugccaucggg

SEQ ID NO: 2004143 - RNA, 19 nt, Shigella flexneri 2a str. 301
gugcagaaucaaucucagc

SEQ ID NO: 2004144 - RNA, 20 nt, Shigella flexneri 2a str. 301
gugcaccagaaaguuuuuca

SEQ ID NO: 2004145 - RNA, 19 nt, Shigella flexneri 2a str. 301
gugcaaucaacaccacugc

SEQ ID NO: 2004146 - RNA, 16 nt, Shigella flexneri 2a str. 301
gugcaaggaaauaaua

SEQ ID NO: 2004147 - RNA, 18 nt, Shigella flexneri 2a str. 301
gugcaagaaaugacagag

SEQ ID NO: 2004148 - RNA, 19 nt, Shigella flexneri 2a str. 301
gugauucauaguaagcaga

SEQ ID NO: 2004149 - RNA, 21 nt, Shigella flexneri 2a str. 301
gugauucauaguaagcagauu

SEQ ID NO: 2004150 - RNA, 17 nt, Shigella flexneri 2a str. 301
gugauugguuucaaaga

SEQ ID NO: 2004151 - RNA, 13 nt, Shigella flexneri 2a str. 301
gugaugguggugg

SEQ ID NO: 2004152 - RNA, 12 nt, Shigella flexneri 2a str. 301
gugaugguggug

SEQ ID NO: 2004153 - RNA, 21 nt, Shigella flexneri 2a str. 301
gugauguagucaucugcaccg

SEQ ID NO: 2004154 - RNA, 17 nt, Shigella flexneri 2a str. 301
gugccacaccagcuuuc

SEQ ID NO: 2004155 - RNA, 13 nt, Shigella flexneri 2a str. 301
gugccaaaaaaau

SEQ ID NO: 2004156 - RNA, 14 nt, Shigella flexneri 2a str. 301
gugccacauccagu

SEQ ID NO: 2004157 - RNA, 14 nt, Shigella flexneri 2a str. 301
gugccagauagcca

SEQ ID NO: 2004158 - RNA, 14 nt, Shigella flexneri 2a str. 301
gugcagccaaaaau

SEQ ID NO: 2004159 - RNA, 11 nt, Shigella flexneri 2a str. 301
gugcagcaucg

SEQ ID NO: 2004160 - RNA, 18 nt, Shigella flexneri 2a str. 301
gugcauuuucgucaacca

SEQ ID NO: 2004161 - RNA, 18 nt, Shigella flexneri 2a str. 301
gugcauuucucacuuuuc

SEQ ID NO: 2004162 - RNA, 16 nt, Shigella flexneri 2a str. 301
gugccaaaaaucgcaa

SEQ ID NO: 2004163 - RNA, 22 nt, Shigella flexneri 2a str. 301
gugcccccguuuuaccccugca

SEQ ID NO: 2004164 - RNA, 12 nt, Shigella flexneri 2a str. 301
gugccaggacca

SEQ ID NO: 2004165 - RNA, 18 nt, Shigella flexneri 2a str. 301
gugccagguaaacaccuu

SEQ ID NO: 2004166 - RNA, 17 nt, Shigella flexneri 2a str. 301
gugcccgggucagcgcc

SEQ ID NO: 2004167 - RNA, 15 nt, Shigella flexneri 2a str. 301
gugcccguaaaaaau

SEQ ID NO: 2004168 - RNA, 21 nt, Shigella flexneri 2a str. 301
gugcccguaaaaaauggcugg

SEQ ID NO: 2004169 - RNA, 16 nt, Shigella flexneri 2a str. 301
gugcccguuggcagac

SEQ ID NO: 2004170 - RNA, 20 nt, Shigella flexneri 2a str. 301
gugccgacaucgccacggca

SEQ ID NO: 2004171 - RNA, 15 nt, Shigella flexneri 2a str. 301
guggauuaucuucac

SEQ ID NO: 2004172 - RNA, 21 nt, Shigella flexneri 2a str. 301
gugcuucugccacuucuucga

SEQ ID NO: 2004173 - RNA, 21 nt, Shigella flexneri 2a str. 301
guggcgauaaucagcgccagc

SEQ ID NO: 2004174 - RNA, 19 nt, Shigella flexneri 2a str. 301
guggcgauaaucagcgcca

SEQ ID NO: 2004175 - RNA, 16 nt, Shigella flexneri 2a str. 301
guggcgcuccacuuca

SEQ ID NO: 2004176 - RNA, 21 nt, Shigella flexneri 2a str. 301
guggcgcgaagcccucaaaca

SEQ ID NO: 2004177 - RNA, 22 nt, Shigella flexneri 2a str. 301
gugggucgauuaaauucaccag

SEQ ID NO: 2004178 - RNA, 16 nt, Shigella flexneri 2a str. 301
guggguaggaucagaa

SEQ ID NO: 2004179 - RNA, 15 nt, Shigella flexneri 2a str. 301
guggcugcguuucau

SEQ ID NO: 2004180 - RNA, 11 nt, Shigella flexneri 2a str. 301
guggcuggggu

SEQ ID NO: 2004181 - RNA, 19 nt, Shigella flexneri 2a str. 301
guggucagcagcuuucuuu

SEQ ID NO: 2004182 - RNA, 13 nt, Shigella flexneri 2a str. 301
guggucagcacaa

SEQ ID NO: 2004183 - RNA, 21 nt, Shigella flexneri 2a str. 301
guggugcguaccaggcgugga

SEQ ID NO: 2004184 - RNA, 18 nt, Shigella flexneri 2a str. 301
guggugcgcgagcuggug

SEQ ID NO: 2004185 - RNA, 20 nt, Shigella flexneri 2a str. 301
guggugcuggacucccagaa

SEQ ID NO: 2004186 - RNA, 13 nt, Shigella flexneri 2a str. 301
guggugugggcgg

SEQ ID NO: 2004187 - RNA, 16 nt, Shigella flexneri 2a str. 301
guggugugggcgguga

SEQ ID NO: 2004188 - RNA, 20 nt, Shigella flexneri 2a str. 301
gugguguuuuuuuaaucuuu

SEQ ID NO: 2004189 - RNA, 16 nt, Shigella flexneri 2a str. 301
guggugggggaaggau

SEQ ID NO: 2004190 - RNA, 19 nt, Shigella flexneri 2a str. 301
gugguugucgcaggcggug

SEQ ID NO: 2004191 - RNA, 16 nt, Shigella flexneri 2a str. 301
guuaaacccgcucaaa

SEQ ID NO: 2004192 - RNA, 18 nt, Shigella flexneri 2a str. 301
guuaaacccgcucaaaca

SEQ ID NO: 2004193 - RNA, 22 nt, Shigella flexneri 2a str. 301
guguuuugacauuggcauccgu

SEQ ID NO: 2004194 - RNA, 14 nt, Shigella flexneri 2a str. 301
guguugguaaauaa

SEQ ID NO: 2004195 - RNA, 15 nt, Shigella flexneri 2a str. 301
guguugcaggaaaag

SEQ ID NO: 2004196 - RNA, 11 nt, Shigella flexneri 2a str. 301
guguugcugaa

SEQ ID NO: 2004197 - RNA, 20 nt, Shigella flexneri 2a str. 301
guguugcugaacuuaugcaa

SEQ ID NO: 2004198 - RNA, 22 nt, Shigella flexneri 2a str. 301
guguucgucacuggcgcagaca

SEQ ID NO: 2004199 - RNA, 24 nt, Shigella flexneri 2a str. 301
guguucguuguaucaacagcgguu

SEQ ID NO: 2004200 - RNA, 15 nt, Shigella flexneri 2a str. 301
gugugaaaucagcac

SEQ ID NO: 2004201 - RNA, 22 nt, Shigella flexneri 2a str. 301
gugucuuaucuggcauuugcac

SEQ ID NO: 2004202 - RNA, 18 nt, Shigella flexneri 2a str. 301
guguacuuaucuuuuaca

SEQ ID NO: 2004203 - RNA, 21 nt, Shigella flexneri 2a str. 301
gugugguuauugggugacugg

SEQ ID NO: 2004204 - RNA, 17 nt, Shigella flexneri 2a str. 301
guguguauggcauuguc

SEQ ID NO: 2004205 - RNA, 12 nt, Shigella flexneri 2a str. 301
guguguccaucc

SEQ ID NO: 2004206 - RNA, 17 nt, Shigella flexneri 2a str. 301
guguguuccucugcucc

SEQ ID NO: 2004207 - RNA, 21 nt, Shigella flexneri 2a str. 301
guuacgcaaaaccucuuccag

SEQ ID NO: 2004208 - RNA, 20 nt, Shigella flexneri 2a str. 301
guuacgcaaaaccucuucca

SEQ ID NO: 2004209 - RNA, 16 nt, Shigella flexneri 2a str. 301
guuacgcauaaaacca

SEQ ID NO: 2004210 - RNA, 19 nt, Shigella flexneri 2a str. 301
guuaccuucggccccaucg

SEQ ID NO: 2004211 - RNA, 17 nt, Shigella flexneri 2a str. 301
guuaccucauggagaua

SEQ ID NO: 2004212 - RNA, 13 nt, Shigella flexneri 2a str. 301
guuaccuucaucc

SEQ ID NO: 2004213 - RNA, 15 nt, Shigella flexneri 2a str. 301
guuacacaucauuag

SEQ ID NO: 2004214 - RNA, 16 nt, Shigella flexneri 2a str. 301
guuacagcagguguua

SEQ ID NO: 2004215 - RNA, 21 nt, Shigella flexneri 2a str. 301
guuacuuaucgauaaacggca

SEQ ID NO: 2004216 - RNA, 15 nt, Shigella flexneri 2a str. 301
guuacguucuccuga

SEQ ID NO: 2004217 - RNA, 22 nt, Shigella flexneri 2a str. 301
guuacgccggugauuaaaccaa

SEQ ID NO: 2004218 - RNA, 16 nt, Shigella flexneri 2a str. 301
guuacaacaucaacaa

SEQ ID NO: 2004219 - RNA, 22 nt, Shigella flexneri 2a str. 301
guuaaaguugagcgaaaacgaa

SEQ ID NO: 2004220 - RNA, 14 nt, Shigella flexneri 2a str. 301
guuaaguuuauccc

SEQ ID NO: 2004221 - RNA, 15 nt, Shigella flexneri 2a str. 301
guuccugcaacuucu

SEQ ID NO: 2004222 - RNA, 14 nt, Shigella flexneri 2a str. 301
guucgagcaucaca

SEQ ID NO: 2004223 - RNA, 16 nt, Shigella flexneri 2a str. 301
guucgccugcaccaug

SEQ ID NO: 2004224 - RNA, 20 nt, Shigella flexneri 2a str. 301
guucgcguaacugcugcuca

SEQ ID NO: 2004225 - RNA, 14 nt, Shigella flexneri 2a str. 301
guuccccagaagcu

SEQ ID NO: 2004226 - RNA, 22 nt, Shigella flexneri 2a str. 301
guuccguucauauggagcaaaa

SEQ ID NO: 2004227 - RNA, 20 nt, Shigella flexneri 2a str. 301
guuccacauaaaguagccaa

SEQ ID NO: 2004228 - RNA, 21 nt, Shigella flexneri 2a str. 301
guucagccugacagcacgccc

SEQ ID NO: 2004229 - RNA, 15 nt, Shigella flexneri 2a str. 301
guucagcaguucugc

SEQ ID NO: 2004230 - RNA, 22 nt, Shigella flexneri 2a str. 301
guucagcaguucugccaggcug

SEQ ID NO: 2004231 - RNA, 14 nt, Shigella flexneri 2a str. 301
guucagaaagcgcc

SEQ ID NO: 2004232 - RNA, 21 nt, Shigella flexneri 2a str. 301
guucagaauggcgcacucaaa

SEQ ID NO: 2004233 - RNA, 19 nt, Shigella flexneri 2a str. 301
guucagauggccaauaacc

SEQ ID NO: 2004234 - RNA, 15 nt, Shigella flexneri 2a str. 301
guucacugugcuggu

SEQ ID NO: 2004235 - RNA, 18 nt, Shigella flexneri 2a str. 301
guuagacgcguuuacaga

SEQ ID NO: 2004236 - RNA, 20 nt, Shigella flexneri 2a str. 301
guuagacgcguuuacagagc

SEQ ID NO: 2004237 - RNA, 14 nt, Shigella flexneri 2a str. 301
guuagaaaacgccu

SEQ ID NO: 2004238 - RNA, 14 nt, Shigella flexneri 2a str. 301
guuagagcacagau

SEQ ID NO: 2004239 - RNA, 18 nt, Shigella flexneri 2a str. 301
guucaguacgaaauaacu

SEQ ID NO: 2004240 - RNA, 11 nt, Shigella flexneri 2a str. 301
guucaguucag

SEQ ID NO: 2004241 - RNA, 16 nt, Shigella flexneri 2a str. 301
guucaggcgaaucuua

SEQ ID NO: 2004242 - RNA, 14 nt, Shigella flexneri 2a str. 301
guucagugaucgcc

SEQ ID NO: 2004243 - RNA, 21 nt, Shigella flexneri 2a str. 301
guucauuaaugccguuauaca

SEQ ID NO: 2004244 - RNA, 17 nt, Shigella flexneri 2a str. 301
guucauuggguucaucu

SEQ ID NO: 2004245 - RNA, 18 nt, Shigella flexneri 2a str. 301
guucauauggagcaaaag

SEQ ID NO: 2004246 - RNA, 17 nt, Shigella flexneri 2a str. 301
guucaucacaccagucc

SEQ ID NO: 2004247 - RNA, 22 nt, Shigella flexneri 2a str. 301
guucuucuuuauugauuaaagg

SEQ ID NO: 2004248 - RNA, 18 nt, Shigella flexneri 2a str. 301
guucuucucaaccuuucc

SEQ ID NO: 2004249 - RNA, 16 nt, Shigella flexneri 2a str. 301
guucuucgcugacagu

SEQ ID NO: 2004250 - RNA, 16 nt, Shigella flexneri 2a str. 301
guucuacaaucugccc

SEQ ID NO: 2004251 - RNA, 20 nt, Shigella flexneri 2a str. 301
guucgucgucuuuauccuga

SEQ ID NO: 2004252 - RNA, 19 nt, Shigella flexneri 2a str. 301
guugaacgguuuggugaug

SEQ ID NO: 2004253 - RNA, 19 nt, Shigella flexneri 2a str. 301
guucuuuguguugcugaac

SEQ ID NO: 2004254 - RNA, 15 nt, Shigella flexneri 2a str. 301
guucuuuucgagcag

SEQ ID NO: 2004255 - RNA, 13 nt, Shigella flexneri 2a str. 301
guugaaaaaccag

SEQ ID NO: 2004256 - RNA, 12 nt, Shigella flexneri 2a str. 301
guugaaaaacca

SEQ ID NO: 2004257 - RNA, 18 nt, Shigella flexneri 2a str. 301
guugaauuccgaauuuca

SEQ ID NO: 2004258 - RNA, 13 nt, Shigella flexneri 2a str. 301
guugaccgcccgg

SEQ ID NO: 2004259 - RNA, 14 nt, Shigella flexneri 2a str. 301
guugaggcacaucu

SEQ ID NO: 2004260 - RNA, 16 nt, Shigella flexneri 2a str. 301
guugauacaggaacag

SEQ ID NO: 2004261 - RNA, 21 nt, Shigella flexneri 2a str. 301
guugauacaggaacagccacu

SEQ ID NO: 2004262 - RNA, 19 nt, Shigella flexneri 2a str. 301
guugauccaggagcuccag

SEQ ID NO: 2004263 - RNA, 22 nt, Shigella flexneri 2a str. 301
guugagccucgguuguguggug

SEQ ID NO: 2004264 - RNA, 16 nt, Shigella flexneri 2a str. 301
guugagagaagaaacg

SEQ ID NO: 2004265 - RNA, 19 nt, Shigella flexneri 2a str. 301
guugagagguaaaaccuga

SEQ ID NO: 2004266 - RNA, 16 nt, Shigella flexneri 2a str. 301
guugacucggagucga

SEQ ID NO: 2004267 - RNA, 19 nt, Shigella flexneri 2a str. 301
guugauuuuucguuuuaau

SEQ ID NO: 2004268 - RNA, 14 nt, Shigella flexneri 2a str. 301
guugaucuguaacg

SEQ ID NO: 2004269 - RNA, 13 nt, Shigella flexneri 2a str. 301
guugaugagcgcc

SEQ ID NO: 2004270 - RNA, 14 nt, Shigella flexneri 2a str. 301
guugaugguaaaau

SEQ ID NO: 2004271 - RNA, 15 nt, Shigella flexneri 2a str. 301
guugcagacccgcca

SEQ ID NO: 2004272 - RNA, 17 nt, Shigella flexneri 2a str. 301
guugcauccggcauggc

SEQ ID NO: 2004273 - RNA, 21 nt, Shigella flexneri 2a str. 301
guugcaugauuucgucauccg

SEQ ID NO: 2004274 - RNA, 22 nt, Shigella flexneri 2a str. 301
guugcacgucaauggugagaug

SEQ ID NO: 2004275 - RNA, 16 nt, Shigella flexneri 2a str. 301
guugcagaaacaaccu

SEQ ID NO: 2004276 - RNA, 23 nt, Shigella flexneri 2a str. 301
guugcaauacaccuccggcuggg

SEQ ID NO: 2004277 - RNA, 16 nt, Shigella flexneri 2a str. 301
guugcacgccaggcac

SEQ ID NO: 2004278 - RNA, 15 nt, Shigella flexneri 2a str. 301
guugcuaacggccac

SEQ ID NO: 2004279 - RNA, 16 nt, Shigella flexneri 2a str. 301
guugcgucgccgccug

SEQ ID NO: 2004280 - RNA, 14 nt, Shigella flexneri 2a str. 301
guugcuaugcugaa

SEQ ID NO: 2004281 - RNA, 15 nt, Shigella flexneri 2a str. 301
guugcugaaauucca

SEQ ID NO: 2004282 - RNA, 22 nt, Shigella flexneri 2a str. 301
guugcuccccagaauccaggaa

SEQ ID NO: 2004283 - RNA, 18 nt, Shigella flexneri 2a str. 301
guugcggcugcccaucau

SEQ ID NO: 2004284 - RNA, 21 nt, Shigella flexneri 2a str. 301
guugcgcagaguuuccaggcu

SEQ ID NO: 2004285 - RNA, 22 nt, Shigella flexneri 2a str. 301
guugcgccaguaaauuuaucaa

SEQ ID NO: 2004286 - RNA, 21 nt, Shigella flexneri 2a str. 301
guugccuuuuuuguacuccag

SEQ ID NO: 2004287 - RNA, 13 nt, Shigella flexneri 2a str. 301
guugcgaaaaaau

SEQ ID NO: 2004288 - RNA, 15 nt, Shigella flexneri 2a str. 301
guugccauacagaca

SEQ ID NO: 2004289 - RNA, 17 nt, Shigella flexneri 2a str. 301
guugcauuuccauaaau

SEQ ID NO: 2004290 - RNA, 14 nt, Shigella flexneri 2a str. 301
guugcauuugcaga

SEQ ID NO: 2004291 - RNA, 22 nt, Shigella flexneri 2a str. 301
guugcauaauuucagcaagaca

SEQ ID NO: 2004292 - RNA, 13 nt, Shigella flexneri 2a str. 301
guugcauuccagu

SEQ ID NO: 2004293 - RNA, 21 nt, Shigella flexneri 2a str. 301
guugcccuuuucaccaugggc

SEQ ID NO: 2004294 - RNA, 12 nt, Shigella flexneri 2a str. 301
guugcccugcug

SEQ ID NO: 2004295 - RNA, 14 nt, Shigella flexneri 2a str. 301
guugccugcacuca

SEQ ID NO: 2004296 - RNA, 16 nt, Shigella flexneri 2a str. 301
guugccgcuuuuucca

SEQ ID NO: 2004297 - RNA, 14 nt, Shigella flexneri 2a str. 301
guugcuucaucuca

SEQ ID NO: 2004298 - RNA, 18 nt, Shigella flexneri 2a str. 301
guuggaaaucccgugacg

SEQ ID NO: 2004299 - RNA, 22 nt, Shigella flexneri 2a str. 301
guugcuugaggaucaacugaaa

SEQ ID NO: 2004300 - RNA, 14 nt, Shigella flexneri 2a str. 301
guugcuggaaagag

SEQ ID NO: 2004301 - RNA, 15 nt, Shigella flexneri 2a str. 301
guugcugaagugcgu

SEQ ID NO: 2004302 - RNA, 13 nt, Shigella flexneri 2a str. 301
guugcugacugua

SEQ ID NO: 2004303 - RNA, 21 nt, Shigella flexneri 2a str. 301
guugcuggcagauaaauuacu

SEQ ID NO: 2004304 - RNA, 14 nt, Shigella flexneri 2a str. 301
guuggugcgaucug

SEQ ID NO: 2004305 - RNA, 12 nt, Shigella flexneri 2a str. 301
guugguuaaucu

SEQ ID NO: 2004306 - RNA, 15 nt, Shigella flexneri 2a str. 301
guuguaaucaccacu

SEQ ID NO: 2004307 - RNA, 14 nt, Shigella flexneri 2a str. 301
guuggguuagccaa

SEQ ID NO: 2004308 - RNA, 15 nt, Shigella flexneri 2a str. 301
guuggcucaucaagc

SEQ ID NO: 2004309 - RNA, 17 nt, Shigella flexneri 2a str. 301
guuggcguguuucagcu

SEQ ID NO: 2004310 - RNA, 19 nt, Shigella flexneri 2a str. 301
guuggcggugccaucgaua

SEQ ID NO: 2004311 - RNA, 20 nt, Shigella flexneri 2a str. 301
guuggcgcguguuccagaga

SEQ ID NO: 2004312 - RNA, 14 nt, Shigella flexneri 2a str. 301
guuggcgaaaaucu

SEQ ID NO: 2004313 - RNA, 13 nt, Shigella flexneri 2a str. 301
guuuccugaugga

SEQ ID NO: 2004314 - RNA, 21 nt, Shigella flexneri 2a str. 301
guuucgaucagcaauuucucc

SEQ ID NO: 2004315 - RNA, 20 nt, Shigella flexneri 2a str. 301
guuucgaauuacacagccac

SEQ ID NO: 2004316 - RNA, 23 nt, Shigella flexneri 2a str. 301
guuucgaauuacacagccacagg

SEQ ID NO: 2004317 - RNA, 16 nt, Shigella flexneri 2a str. 301
guuuccgcuucugcuu

SEQ ID NO: 2004318 - RNA, 21 nt, Shigella flexneri 2a str. 301
guuuauccauccccagagcac

SEQ ID NO: 2004319 - RNA, 18 nt, Shigella flexneri 2a str. 301
guuuaucccaauuaucug

SEQ ID NO: 2004320 - RNA, 18 nt, Shigella flexneri 2a str. 301
guuuaucuacagcauuuc

SEQ ID NO: 2004321 - RNA, 21 nt, Shigella flexneri 2a str. 301
guuuaugacgcuugagcagga

SEQ ID NO: 2004322 - RNA, 13 nt, Shigella flexneri 2a str. 301
guuuccauucgcu

SEQ ID NO: 2004323 - RNA, 22 nt, Shigella flexneri 2a str. 301
guuucuuugccgaggaagacaa

SEQ ID NO: 2004324 - RNA, 12 nt, Shigella flexneri 2a str. 301
guuucucuucug

SEQ ID NO: 2004325 - RNA, 16 nt, Shigella flexneri 2a str. 301
guuucugauacugcuc

SEQ ID NO: 2004326 - RNA, 20 nt, Shigella flexneri 2a str. 301
guuucugacauuuuuacucc

SEQ ID NO: 2004327 - RNA, 14 nt, Shigella flexneri 2a str. 301
guuugaaauaccag

SEQ ID NO: 2004328 - RNA, 13 nt, Shigella flexneri 2a str. 301
guuugaaauuaau

SEQ ID NO: 2004329 - RNA, 21 nt, Shigella flexneri 2a str. 301
guuugacuuauaagucucaga

SEQ ID NO: 2004330 - RNA, 19 nt, Shigella flexneri 2a str. 301
guuugacauaaauuccgcu

SEQ ID NO: 2004331 - RNA, 19 nt, Shigella flexneri 2a str. 301
guuucgcuucuucagccug

SEQ ID NO: 2004332 - RNA, 14 nt, Shigella flexneri 2a str. 301
guuucgccugccag

SEQ ID NO: 2004333 - RNA, 19 nt, Shigella flexneri 2a str. 301
guuucgcagucgccagcaa

SEQ ID NO: 2004334 - RNA, 13 nt, Shigella flexneri 2a str. 301
guuucuccacgau

SEQ ID NO: 2004335 - RNA, 13 nt, Shigella flexneri 2a str. 301
guuucucuuucuu

SEQ ID NO: 2004336 - RNA, 20 nt, Shigella flexneri 2a str. 301
guuucucuuaaaugcacaau

SEQ ID NO: 2004337 - RNA, 16 nt, Shigella flexneri 2a str. 301
guuucucgccacuaaa

SEQ ID NO: 2004338 - RNA, 18 nt, Shigella flexneri 2a str. 301
guuucucuguucagccug

SEQ ID NO: 2004339 - RNA, 19 nt, Shigella flexneri 2a str. 301
guuuagccgcuucugcagc

SEQ ID NO: 2004340 - RNA, 21 nt, Shigella flexneri 2a str. 301
guuuaucaauuaacugugcca

SEQ ID NO: 2004341 - RNA, 14 nt, Shigella flexneri 2a str. 301
guuuaaccaacaca

SEQ ID NO: 2004342 - RNA, 22 nt, Shigella flexneri 2a str. 301
guuuaacgccuucccuuucagc

SEQ ID NO: 2004343 - RNA, 12 nt, Shigella flexneri 2a str. 301
guuuaccagcag

SEQ ID NO: 2004344 - RNA, 14 nt, Shigella flexneri 2a str. 301
guuuaccagcagcc

SEQ ID NO: 2004345 - RNA, 18 nt, Shigella flexneri 2a str. 301
guuuaccugaauaucgcc

SEQ ID NO: 2004346 - RNA, 14 nt, Shigella flexneri 2a str. 301
guuuaccggugcca

SEQ ID NO: 2004347 - RNA, 21 nt, Shigella flexneri 2a str. 301
guuguucugcgacgcgcggug

SEQ ID NO: 2004348 - RNA, 15 nt, Shigella flexneri 2a str. 301
guugucagcaacugu

SEQ ID NO: 2004349 - RNA, 17 nt, Shigella flexneri 2a str. 301
guugucacugcaucuuc

SEQ ID NO: 2004350 - RNA, 14 nt, Shigella flexneri 2a str. 301
guuguaaugacaac

SEQ ID NO: 2004351 - RNA, 22 nt, Shigella flexneri 2a str. 301
guuguagaccggaaaagguguu

SEQ ID NO: 2004352 - RNA, 15 nt, Shigella flexneri 2a str. 301
guuguuuucagaagc

SEQ ID NO: 2004353 - RNA, 17 nt, Shigella flexneri 2a str. 301
guuguuuacaguaugag

SEQ ID NO: 2004354 - RNA, 12 nt, Shigella flexneri 2a str. 301
guuguugcugcc

SEQ ID NO: 2004355 - RNA, 20 nt, Shigella flexneri 2a str. 301
guuguugaacggcaaacgca

SEQ ID NO: 2004356 - RNA, 13 nt, Shigella flexneri 2a str. 301
guuuaaaccugau

SEQ ID NO: 2004357 - RNA, 14 nt, Shigella flexneri 2a str. 301
guuugauugaaaaa

SEQ ID NO: 2004358 - RNA, 11 nt, Shigella flexneri 2a str. 301
uaaaaaccaga

SEQ ID NO: 2004359 - RNA, 21 nt, Shigella flexneri 2a str. 301
uaaaaaccagagaauauuaac

SEQ ID NO: 2004360 - RNA, 21 nt, Shigella flexneri 2a str. 301
guuugaugcgugagguaacaa

SEQ ID NO: 2004361 - RNA, 14 nt, Shigella flexneri 2a str. 301
uaaaaaugaagccu

SEQ ID NO: 2004362 - RNA, 13 nt, Shigella flexneri 2a str. 301
uaaaaagauaaac

SEQ ID NO: 2004363 - RNA, 19 nt, Shigella flexneri 2a str. 301
uaaaaaguaagaauugaua

SEQ ID NO: 2004364 - RNA, 20 nt, Shigella flexneri 2a str. 301
uaaaaaguaagaauugauaa

SEQ ID NO: 2004365 - RNA, 12 nt, Shigella flexneri 2a str. 301
uaaaaggaaaca

SEQ ID NO: 2004366 - RNA, 18 nt, Shigella flexneri 2a str. 301
uaaaaggaaacagcguau

SEQ ID NO: 2004367 - RNA, 19 nt, Shigella flexneri 2a str. 301
uaaaagaaggcgauguucu

SEQ ID NO: 2004368 - RNA, 14 nt, Shigella flexneri 2a str. 301
uaaaacgugccauu

SEQ ID NO: 2004369 - RNA, 16 nt, Shigella flexneri 2a str. 301
uaaaacuaaaaacagc

SEQ ID NO: 2004370 - RNA, 15 nt, Shigella flexneri 2a str. 301
uaaaacucaggcugg

SEQ ID NO: 2004371 - RNA, 16 nt, Shigella flexneri 2a str. 301
uaaaaccgacuuaaaa

SEQ ID NO: 2004372 - RNA, 14 nt, Shigella flexneri 2a str. 301
uaaaaccccaaaaa

SEQ ID NO: 2004373 - RNA, 23 nt, Shigella flexneri 2a str. 301
uaaaacgcagucuucccagcccc

SEQ ID NO: 2004374 - RNA, 16 nt, Shigella flexneri 2a str. 301
uaaaaccaucguacag

SEQ ID NO: 2004375 - RNA, 13 nt, Shigella flexneri 2a str. 301
uaaaaccaguaau

SEQ ID NO: 2004376 - RNA, 22 nt, Shigella flexneri 2a str. 301
uaaaaccaacaguaucugaauc

SEQ ID NO: 2004377 - RNA, 23 nt, Shigella flexneri 2a str. 301
uaaaacaacggaacgaaaaaaau

SEQ ID NO: 2004378 - RNA, 22 nt, Shigella flexneri 2a str. 301
uaaaacauuguugaguuuuuug

SEQ ID NO: 2004379 - RNA, 17 nt, Shigella flexneri 2a str. 301
uaaacaagguuugaaaa

SEQ ID NO: 2004380 - RNA, 23 nt, Shigella flexneri 2a str. 301
uaaacaaagugcacuuugucaau

SEQ ID NO: 2004381 - RNA, 20 nt, Shigella flexneri 2a str. 301
uaaacaaagcgcacuuuacu

SEQ ID NO: 2004382 - RNA, 15 nt, Shigella flexneri 2a str. 301
uaaacagacaguaau

SEQ ID NO: 2004383 - RNA, 18 nt, Shigella flexneri 2a str. 301
uaaacaccuucauccagc

SEQ ID NO: 2004384 - RNA, 18 nt, Shigella flexneri 2a str. 301
uaaacaccagcaauaaug

SEQ ID NO: 2004385 - RNA, 12 nt, Shigella flexneri 2a str. 301
uaaacaccuuca

SEQ ID NO: 2004386 - RNA, 19 nt, Shigella flexneri 2a str. 301
uaaacaccuucauccagca

SEQ ID NO: 2004387 - RNA, 20 nt, Shigella flexneri 2a str. 301
uaaacaauguuauccggcua

SEQ ID NO: 2004388 - RNA, 15 nt, Shigella flexneri 2a str. 301
uaaacaccaccgaaa

SEQ ID NO: 2004389 - RNA, 16 nt, Shigella flexneri 2a str. 301
uaaaauucuacagaaa

SEQ ID NO: 2004390 - RNA, 22 nt, Shigella flexneri 2a str. 301
uaaaauuggcuucguuauugaa

SEQ ID NO: 2004391 - RNA, 13 nt, Shigella flexneri 2a str. 301
uaaaauggccgua

SEQ ID NO: 2004392 - RNA, 16 nt, Shigella flexneri 2a str. 301
uaaaaucccauaagug

SEQ ID NO: 2004393 - RNA, 18 nt, Shigella flexneri 2a str. 301
uaaaaugauuucgcaacg

SEQ ID NO: 2004394 - RNA, 15 nt, Shigella flexneri 2a str. 301
uaaaaggagauaaac

SEQ ID NO: 2004395 - RNA, 15 nt, Shigella flexneri 2a str. 301
uaaaaggauguuuau

SEQ ID NO: 2004396 - RNA, 12 nt, Shigella flexneri 2a str. 301
uaaaauauugaa

SEQ ID NO: 2004397 - RNA, 21 nt, Shigella flexneri 2a str. 301
uaaaauaucuuccacuucacg

SEQ ID NO: 2004398 - RNA, 12 nt, Shigella flexneri 2a str. 301
uaaaauaucuuc

SEQ ID NO: 2004399 - RNA, 14 nt, Shigella flexneri 2a str. 301
uaaaauaucacucg

SEQ ID NO: 2004400 - RNA, 18 nt, Shigella flexneri 2a str. 301
uaaaucgguauuuccauu

SEQ ID NO: 2004401 - RNA, 16 nt, Shigella flexneri 2a str. 301
uaaaucgguauuucca

SEQ ID NO: 2004402 - RNA, 20 nt, Shigella flexneri 2a str. 301
uaaaugcacaauaauauuac

SEQ ID NO: 2004403 - RNA, 14 nt, Shigella flexneri 2a str. 301
uaaauccuuuguac

SEQ ID NO: 2004404 - RNA, 15 nt, Shigella flexneri 2a str. 301
uaaauccuuuguaca

SEQ ID NO: 2004405 - RNA, 15 nt, Shigella flexneri 2a str. 301
uaaauccugaaacca

SEQ ID NO: 2004406 - RNA, 20 nt, Shigella flexneri 2a str. 301
uaaaucccgccgcuucacca

SEQ ID NO: 2004407 - RNA, 18 nt, Shigella flexneri 2a str. 301
uaaauauuaauacaacaa

SEQ ID NO: 2004408 - RNA, 12 nt, Shigella flexneri 2a str. 301
uaaauaguggca

SEQ ID NO: 2004409 - RNA, 16 nt, Shigella flexneri 2a str. 301
uaaauccaacaacaca

SEQ ID NO: 2004410 - RNA, 21 nt, Shigella flexneri 2a str. 301
uaaauccaacaacacauucaa

SEQ ID NO: 2004411 - RNA, 16 nt, Shigella flexneri 2a str. 301
uaaaucaucggguuac

SEQ ID NO: 2004412 - RNA, 20 nt, Shigella flexneri 2a str. 301
uaaauaaggugguagcugcc

SEQ ID NO: 2004413 - RNA, 21 nt, Shigella flexneri 2a str. 301
uaaauaacuggugcuaacagc

SEQ ID NO: 2004414 - RNA, 17 nt, Shigella flexneri 2a str. 301
uaaauaacuuuuaucug

SEQ ID NO: 2004415 - RNA, 12 nt, Shigella flexneri 2a str. 301
uaaauacagagc

SEQ ID NO: 2004416 - RNA, 14 nt, Shigella flexneri 2a str. 301
uaaauaauaucccc

SEQ ID NO: 2004417 - RNA, 22 nt, Shigella flexneri 2a str. 301
uaaauacagcuuaaucaccagc

SEQ ID NO: 2004418 - RNA, 18 nt, Shigella flexneri 2a str. 301
uaaauaguggcaaauucu

SEQ ID NO: 2004419 - RNA, 19 nt, Shigella flexneri 2a str. 301
uaaauaguccggaagaugc

SEQ ID NO: 2004420 - RNA, 15 nt, Shigella flexneri 2a str. 301
uaaauaccguucauu

SEQ ID NO: 2004421 - RNA, 15 nt, Shigella flexneri 2a str. 301
uaaauaccuuacacu

SEQ ID NO: 2004422 - RNA, 17 nt, Shigella flexneri 2a str. 301
uaaauaccuuacacuca

SEQ ID NO: 2004423 - RNA, 23 nt, Shigella flexneri 2a str. 301
uaaauacgccccacagacccagg

SEQ ID NO: 2004424 - RNA, 18 nt, Shigella flexneri 2a str. 301
uaaauacgccccacagac

SEQ ID NO: 2004425 - RNA, 24 nt, Shigella flexneri 2a str. 301
uaaaguguuaccccucuauccagc

SEQ ID NO: 2004426 - RNA, 16 nt, Shigella flexneri 2a str. 301
uaaagucuuuguauuu

SEQ ID NO: 2004427 - RNA, 20 nt, Shigella flexneri 2a str. 301
uaaaguggcggggaucacuc

SEQ ID NO: 2004428 - RNA, 20 nt, Shigella flexneri 2a str. 301
uaaaguuaccuucgaagaac

SEQ ID NO: 2004429 - RNA, 19 nt, Shigella flexneri 2a str. 301
uaaagucuaaaaaugugcc

SEQ ID NO: 2004430 - RNA, 23 nt, Shigella flexneri 2a str. 301
uaaaguccgguaauggagauugu

SEQ ID NO: 2004431 - RNA, 15 nt, Shigella flexneri 2a str. 301
uaaaguagaaauuau

SEQ ID NO: 2004432 - RNA, 19 nt, Shigella flexneri 2a str. 301
uaaaguagaaauuauuucu

SEQ ID NO: 2004433 - RNA, 17 nt, Shigella flexneri 2a str. 301
uaaaggggugaaaaaaa

SEQ ID NO: 2004434 - RNA, 13 nt, Shigella flexneri 2a str. 301
uaaacgcauacau

SEQ ID NO: 2004435 - RNA, 15 nt, Shigella flexneri 2a str. 301
uaaacccuaacauca

SEQ ID NO: 2004436 - RNA, 23 nt, Shigella flexneri 2a str. 301
uaaacagguaaagaccauaaaua

SEQ ID NO: 2004437 - RNA, 17 nt, Shigella flexneri 2a str. 301
uaaacagguaaagacca

SEQ ID NO: 2004438 - RNA, 19 nt, Shigella flexneri 2a str. 301
uaaacaggaucugguauua

SEQ ID NO: 2004439 - RNA, 20 nt, Shigella flexneri 2a str. 301
uaaacaguacgagagaagag

SEQ ID NO: 2004440 - RNA, 15 nt, Shigella flexneri 2a str. 301
uaaacaguuuucgca

SEQ ID NO: 2004441 - RNA, 18 nt, Shigella flexneri 2a str. 301
uaaacaucaaaccacuua

SEQ ID NO: 2004442 - RNA, 19 nt, Shigella flexneri 2a str. 301
uaaacggcugggaaaucac

SEQ ID NO: 2004443 - RNA, 20 nt, Shigella flexneri 2a str. 301
uaaacgccuuauccggccua

SEQ ID NO: 2004444 - RNA, 20 nt, Shigella flexneri 2a str. 301
uaaacggcguaaaauucaca

SEQ ID NO: 2004445 - RNA, 12 nt, Shigella flexneri 2a str. 301
uaaacgccaggu

SEQ ID NO: 2004446 - RNA, 22 nt, Shigella flexneri 2a str. 301
uaaacgccggaugacacaucac

SEQ ID NO: 2004447 - RNA, 19 nt, Shigella flexneri 2a str. 301
uaaacgccugcuuaucgcc

SEQ ID NO: 2004448 - RNA, 12 nt, Shigella flexneri 2a str. 301
uaaacucaaagu

SEQ ID NO: 2004449 - RNA, 12 nt, Shigella flexneri 2a str. 301
uaaacuccuuuc

SEQ ID NO: 2004450 - RNA, 21 nt, Shigella flexneri 2a str. 301
uaaacucgaacauacgcugca

SEQ ID NO: 2004451 - RNA, 15 nt, Shigella flexneri 2a str. 301
uaaacucugccgcaa

SEQ ID NO: 2004452 - RNA, 13 nt, Shigella flexneri 2a str. 301
uaaacuggcugug

SEQ ID NO: 2004453 - RNA, 15 nt, Shigella flexneri 2a str. 301
uaaagcugaucacau

SEQ ID NO: 2004454 - RNA, 11 nt, Shigella flexneri 2a str. 301
uaaagcaauga

SEQ ID NO: 2004455 - RNA, 17 nt, Shigella flexneri 2a str. 301
uaaagcuaauaccguuu

SEQ ID NO: 2004456 - RNA, 16 nt, Shigella flexneri 2a str. 301
uaaaggcaaaaugcca

SEQ ID NO: 2004457 - RNA, 15 nt, Shigella flexneri 2a str. 301
uaaaggaaaguaaau

SEQ ID NO: 2004458 - RNA, 16 nt, Shigella flexneri 2a str. 301
uaaaggaaaguaaauu

SEQ ID NO: 2004459 - RNA, 23 nt, Shigella flexneri 2a str. 301
uaaagcugcggauccugagcaaa

SEQ ID NO: 2004460 - RNA, 15 nt, Shigella flexneri 2a str. 301
uaaagaguaaauugc

SEQ ID NO: 2004461 - RNA, 24 nt, Shigella flexneri 2a str. 301
uaaagaguaaauugcaaaccucag

SEQ ID NO: 2004462 - RNA, 15 nt, Shigella flexneri 2a str. 301
uaaagauaauguaaa

SEQ ID NO: 2004463 - RNA, 23 nt, Shigella flexneri 2a str. 301
uaaagaaaguaaucuauauuucu

SEQ ID NO: 2004464 - RNA, 22 nt, Shigella flexneri 2a str. 301
uaaagaacucgaggauaaauuu

SEQ ID NO: 2004465 - RNA, 14 nt, Shigella flexneri 2a str. 301
uaaacuuuuucgcg

SEQ ID NO: 2004466 - RNA, 16 nt, Shigella flexneri 2a str. 301
uaacaauacgcccacg

SEQ ID NO: 2004467 - RNA, 19 nt, Shigella flexneri 2a str. 301
uaacaauagcgaacagaca

SEQ ID NO: 2004468 - RNA, 17 nt, Shigella flexneri 2a str. 301
uaacacgcucuggcagg

SEQ ID NO: 2004469 - RNA, 18 nt, Shigella flexneri 2a str. 301
uaacacgcuucaaguuca

SEQ ID NO: 2004470 - RNA, 13 nt, Shigella flexneri 2a str. 301
uaacaaaacucag

SEQ ID NO: 2004471 - RNA, 16 nt, Shigella flexneri 2a str. 301
uaacaacgggcuaaac

SEQ ID NO: 2004472 - RNA, 22 nt, Shigella flexneri 2a str. 301
uaacaaaacaaugggaaaacag

SEQ ID NO: 2004473 - RNA, 11 nt, Shigella flexneri 2a str. 301
uaaaugccacc

SEQ ID NO: 2004474 - RNA, 20 nt, Shigella flexneri 2a str. 301
uaaaugccgcaaugugcucu

SEQ ID NO: 2004475 - RNA, 20 nt, Shigella flexneri 2a str. 301
uaacaguauccgggcaucca

SEQ ID NO: 2004476 - RNA, 17 nt, Shigella flexneri 2a str. 301
uaacagugcaccggaca

SEQ ID NO: 2004477 - RNA, 15 nt, Shigella flexneri 2a str. 301
uaacaggaagcagcu

SEQ ID NO: 2004478 - RNA, 21 nt, Shigella flexneri 2a str. 301
uaaccaacggcgagccagcgc

SEQ ID NO: 2004479 - RNA, 17 nt, Shigella flexneri 2a str. 301
uaaccaacaauaaaauu

SEQ ID NO: 2004480 - RNA, 17 nt, Shigella flexneri 2a str. 301
uaaccaacaaugcaaaa

SEQ ID NO: 2004481 - RNA, 21 nt, Shigella flexneri 2a str. 301
uaaccagaugucgcgcacugg

SEQ ID NO: 2004482 - RNA, 12 nt, Shigella flexneri 2a str. 301
uaaccagcacca

SEQ ID NO: 2004483 - RNA, 20 nt, Shigella flexneri 2a str. 301
uaaccagaugucgcgcacug

SEQ ID NO: 2004484 - RNA, 20 nt, Shigella flexneri 2a str. 301
uaaccagagagcuuauccag

SEQ ID NO: 2004485 - RNA, 18 nt, Shigella flexneri 2a str. 301
uaaccaccaguaaauugu

SEQ ID NO: 2004486 - RNA, 16 nt, Shigella flexneri 2a str. 301
uaaccacgcucagcaa

SEQ ID NO: 2004487 - RNA, 12 nt, Shigella flexneri 2a str. 301
uaaccaaucacg

SEQ ID NO: 2004488 - RNA, 15 nt, Shigella flexneri 2a str. 301
uaacuggucaucaaa

SEQ ID NO: 2004489 - RNA, 19 nt, Shigella flexneri 2a str. 301
uaacugcgcgauuaucauu

SEQ ID NO: 2004490 - RNA, 14 nt, Shigella flexneri 2a str. 301
uaacucuuucaaug

SEQ ID NO: 2004491 - RNA, 20 nt, Shigella flexneri 2a str. 301
uaacucuuucaaugcuuuuu

SEQ ID NO: 2004492 - RNA, 19 nt, Shigella flexneri 2a str. 301
uaacucuuugaugaaacau

SEQ ID NO: 2004493 - RNA, 22 nt, Shigella flexneri 2a str. 301
uaacugauggcaaaugcagcau

SEQ ID NO: 2004494 - RNA, 20 nt, Shigella flexneri 2a str. 301
uaacuauaaccguaauaguu

SEQ ID NO: 2004495 - RNA, 23 nt, Shigella flexneri 2a str. 301
uaacuccuucuaaagcaacucca

SEQ ID NO: 2004496 - RNA, 15 nt, Shigella flexneri 2a str. 301
uaacucagcauuauu

SEQ ID NO: 2004497 - RNA, 19 nt, Shigella flexneri 2a str. 301
uaacggucgguuagaacaa

SEQ ID NO: 2004498 - RNA, 17 nt, Shigella flexneri 2a str. 301
uaacgguaucuuuccag

SEQ ID NO: 2004499 - RNA, 14 nt, Shigella flexneri 2a str. 301
uaacggcaggauca

SEQ ID NO: 2004500 - RNA, 21 nt, Shigella flexneri 2a str. 301
uaacggcuggccacaaaccuu

SEQ ID NO: 2004501 - RNA, 16 nt, Shigella flexneri 2a str. 301
uaacgccccacaaacc

SEQ ID NO: 2004502 - RNA, 15 nt, Shigella flexneri 2a str. 301
uaacgccccacaaac

SEQ ID NO: 2004503 - RNA, 12 nt, Shigella flexneri 2a str. 301
uaacgccccaca

SEQ ID NO: 2004504 - RNA, 16 nt, Shigella flexneri 2a str. 301
uaacgccuucccuuuc

SEQ ID NO: 2004505 - RNA, 21 nt, Shigella flexneri 2a str. 301
uaacgccguuauuaaaaagcc

SEQ ID NO: 2004506 - RNA, 22 nt, Shigella flexneri 2a str. 301
uaaccugccugacggaaaucau

SEQ ID NO: 2004507 - RNA, 17 nt, Shigella flexneri 2a str. 301
uaaccuucuucauuaug

SEQ ID NO: 2004508 - RNA, 17 nt, Shigella flexneri 2a str. 301
uaacgccauauugcugu

SEQ ID NO: 2004509 - RNA, 14 nt, Shigella flexneri 2a str. 301
uaacgccagacucg

SEQ ID NO: 2004510 - RNA, 20 nt, Shigella flexneri 2a str. 301
uaaccuugcaauaguuucag

SEQ ID NO: 2004511 - RNA, 15 nt, Shigella flexneri 2a str. 301
uaaccagcgcagaca

SEQ ID NO: 2004512 - RNA, 20 nt, Shigella flexneri 2a str. 301
uaaccagcgcagacaccaga

SEQ ID NO: 2004513 - RNA, 18 nt, Shigella flexneri 2a str. 301
uaacccauuuuguuuuau

SEQ ID NO: 2004514 - RNA, 15 nt, Shigella flexneri 2a str. 301
uaaccccgggcugga

SEQ ID NO: 2004515 - RNA, 17 nt, Shigella flexneri 2a str. 301
uaaccccgggcuggauu

SEQ ID NO: 2004516 - RNA, 13 nt, Shigella flexneri 2a str. 301
uaaccccagacca

SEQ ID NO: 2004517 - RNA, 14 nt, Shigella flexneri 2a str. 301
uaaggaauucacgc

SEQ ID NO: 2004518 - RNA, 20 nt, Shigella flexneri 2a str. 301
uaagcuuuccggcaucacau

SEQ ID NO: 2004519 - RNA, 15 nt, Shigella flexneri 2a str. 301
uaaggaaauucagca

SEQ ID NO: 2004520 - RNA, 12 nt, Shigella flexneri 2a str. 301
uaagcugcgggu

SEQ ID NO: 2004521 - RNA, 17 nt, Shigella flexneri 2a str. 301
uaagcuggguaaaugca

SEQ ID NO: 2004522 - RNA, 22 nt, Shigella flexneri 2a str. 301
uaagcugucacguuuugugaug

SEQ ID NO: 2004523 - RNA, 20 nt, Shigella flexneri 2a str. 301
uaagcgauaaaaauaccgag

SEQ ID NO: 2004524 - RNA, 17 nt, Shigella flexneri 2a str. 301
uaagccuuucaggaaac

SEQ ID NO: 2004525 - RNA, 21 nt, Shigella flexneri 2a str. 301
uaagccgccacgaccugcaga

SEQ ID NO: 2004526 - RNA, 14 nt, Shigella flexneri 2a str. 301
uaagccgugcauag

SEQ ID NO: 2004527 - RNA, 15 nt, Shigella flexneri 2a str. 301
uaagccggaucggag

SEQ ID NO: 2004528 - RNA, 15 nt, Shigella flexneri 2a str. 301
uaagccuuccgcuga

SEQ ID NO: 2004529 - RNA, 23 nt, Shigella flexneri 2a str. 301
uaagccuuccgcugacagcgcgu

SEQ ID NO: 2004530 - RNA, 20 nt, Shigella flexneri 2a str. 301
uaagcgcagucaccagcauc

SEQ ID NO: 2004531 - RNA, 14 nt, Shigella flexneri 2a str. 301
uaagcgcaaaggcc

SEQ ID NO: 2004532 - RNA, 21 nt, Shigella flexneri 2a str. 301
uaagcguaaaaccucacgcau

SEQ ID NO: 2004533 - RNA, 22 nt, Shigella flexneri 2a str. 301
uaagcguugugcaucaggcaaa

SEQ ID NO: 2004534 - RNA, 20 nt, Shigella flexneri 2a str. 301
uaagcccagaacaaauaaau

SEQ ID NO: 2004535 - RNA, 18 nt, Shigella flexneri 2a str. 301
uaagcauuuagcgccggg

SEQ ID NO: 2004536 - RNA, 20 nt, Shigella flexneri 2a str. 301
uaagccaaauccagcgccac

SEQ ID NO: 2004537 - RNA, 23 nt, Shigella flexneri 2a str. 301
uaagcaacugacuggcucuuuuu

SEQ ID NO: 2004538 - RNA, 18 nt, Shigella flexneri 2a str. 301
uaagcaucccuuuaauua

SEQ ID NO: 2004539 - RNA, 17 nt, Shigella flexneri 2a str. 301
uaagaugcgaguaaaca

SEQ ID NO: 2004540 - RNA, 18 nt, Shigella flexneri 2a str. 301
uaagaugguuauccagcu

SEQ ID NO: 2004541 - RNA, 21 nt, Shigella flexneri 2a str. 301
uaagauuaccuuccucaauua

SEQ ID NO: 2004542 - RNA, 22 nt, Shigella flexneri 2a str. 301
uaagcaaagcggucuucuguga

SEQ ID NO: 2004543 - RNA, 14 nt, Shigella flexneri 2a str. 301
uaagcaaacagcgc

SEQ ID NO: 2004544 - RNA, 21 nt, Shigella flexneri 2a str. 301
uaagcaacugacuggcucuuu

SEQ ID NO: 2004545 - RNA, 18 nt, Shigella flexneri 2a str. 301
uaagaaaacggaagcuca

SEQ ID NO: 2004546 - RNA, 16 nt, Shigella flexneri 2a str. 301
uaacuuugaucgcguu

SEQ ID NO: 2004547 - RNA, 17 nt, Shigella flexneri 2a str. 301
uaacuuuucauccugcg

SEQ ID NO: 2004548 - RNA, 22 nt, Shigella flexneri 2a str. 301
uaacuuucguguguuuucuguu

SEQ ID NO: 2004549 - RNA, 20 nt, Shigella flexneri 2a str. 301
uaagaacuccugaaagcgaa

SEQ ID NO: 2004550 - RNA, 16 nt, Shigella flexneri 2a str. 301
uaagaagggcuggcca

SEQ ID NO: 2004551 - RNA, 15 nt, Shigella flexneri 2a str. 301
uaacuuaucuguaau

SEQ ID NO: 2004552 - RNA, 19 nt, Shigella flexneri 2a str. 301
uaacuucccgcauccagaa

SEQ ID NO: 2004553 - RNA, 17 nt, Shigella flexneri 2a str. 301
uaacuuaauaaacauca

SEQ ID NO: 2004554 - RNA, 19 nt, Shigella flexneri 2a str. 301
uaacuguggcguuauggca

SEQ ID NO: 2004555 - RNA, 15 nt, Shigella flexneri 2a str. 301
uaacuuuaauuuugu

SEQ ID NO: 2004556 - RNA, 21 nt, Shigella flexneri 2a str. 301
uaacuuuaauuuugugcagca

SEQ ID NO: 2004557 - RNA, 13 nt, Shigella flexneri 2a str. 301
uaacuuuacucuu

SEQ ID NO: 2004558 - RNA, 22 nt, Shigella flexneri 2a str. 301
uaacuucuuuacuggcuuucau

SEQ ID NO: 2004559 - RNA, 12 nt, Shigella flexneri 2a str. 301
uaacuucaucag

SEQ ID NO: 2004560 - RNA, 22 nt, Shigella flexneri 2a str. 301
uaagacgcgcagcgucgcauca

SEQ ID NO: 2004561 - RNA, 14 nt, Shigella flexneri 2a str. 301
uaagacaauugaug

SEQ ID NO: 2004562 - RNA, 23 nt, Shigella flexneri 2a str. 301
uaagacaccccacagcucuugcu

SEQ ID NO: 2004563 - RNA, 16 nt, Shigella flexneri 2a str. 301
uaagacuggcaaagca

SEQ ID NO: 2004564 - RNA, 16 nt, Shigella flexneri 2a str. 301
uaagacgcgccagcgu

SEQ ID NO: 2004565 - RNA, 17 nt, Shigella flexneri 2a str. 301
uaagaaugcgaaaacga

SEQ ID NO: 2004566 - RNA, 17 nt, Shigella flexneri 2a str. 301
uaagaauugauaaaaaa

SEQ ID NO: 2004567 - RNA, 18 nt, Shigella flexneri 2a str. 301
uaagaauugauaaaaaaa

SEQ ID NO: 2004568 - RNA, 17 nt, Shigella flexneri 2a str. 301
uaagaguucuacuccag

SEQ ID NO: 2004569 - RNA, 23 nt, Shigella flexneri 2a str. 301
uaagauaaauuccugcuuauugu

SEQ ID NO: 2004570 - RNA, 21 nt, Shigella flexneri 2a str. 301
uaagaggcuaaccuuauggug

SEQ ID NO: 2004571 - RNA, 18 nt, Shigella flexneri 2a str. 301
uaagagcgggacaacaaa

SEQ ID NO: 2004572 - RNA, 21 nt, Shigella flexneri 2a str. 301
uauagccagccucauccauac

SEQ ID NO: 2004573 - RNA, 15 nt, Shigella flexneri 2a str. 301
uauagcacccgccag

SEQ ID NO: 2004574 - RNA, 14 nt, Shigella flexneri 2a str. 301
uauagauuuacuau

SEQ ID NO: 2004575 - RNA, 15 nt, Shigella flexneri 2a str. 301
uauagagauuuuucc

SEQ ID NO: 2004576 - RNA, 15 nt, Shigella flexneri 2a str. 301
uauagaaugccugug

SEQ ID NO: 2004577 - RNA, 22 nt, Shigella flexneri 2a str. 301
uauagaaugccugugcgacaga

SEQ ID NO: 2004578 - RNA, 21 nt, Shigella flexneri 2a str. 301
uauagaagccauccagcagac

SEQ ID NO: 2004579 - RNA, 22 nt, Shigella flexneri 2a str. 301
uauacggauagcagaaaacuca

SEQ ID NO: 2004580 - RNA, 22 nt, Shigella flexneri 2a str. 301
uauacgccucacagggcucuua

SEQ ID NO: 2004581 - RNA, 15 nt, Shigella flexneri 2a str. 301
uauacccuucucagc

SEQ ID NO: 2004582 - RNA, 18 nt, Shigella flexneri 2a str. 301
uauacccuucucagcagu

SEQ ID NO: 2004583 - RNA, 18 nt, Shigella flexneri 2a str. 301
uauaccgccgccagcaac

SEQ ID NO: 2004584 - RNA, 14 nt, Shigella flexneri 2a str. 301
uauacuccugaugg

SEQ ID NO: 2004585 - RNA, 17 nt, Shigella flexneri 2a str. 301
uauacaaccagauaacc

SEQ ID NO: 2004586 - RNA, 16 nt, Shigella flexneri 2a str. 301
uauacaccuguuccau

SEQ ID NO: 2004587 - RNA, 22 nt, Shigella flexneri 2a str. 301
uauacacgaggcauauaggucu

SEQ ID NO: 2004588 - RNA, 17 nt, Shigella flexneri 2a str. 301
uauacaucgcuuuccag

SEQ ID NO: 2004589 - RNA, 18 nt, Shigella flexneri 2a str. 301
uauacaucgcuuuccagg

SEQ ID NO: 2004590 - RNA, 17 nt, Shigella flexneri 2a str. 301
uauacagacucaaacca

SEQ ID NO: 2004591 - RNA, 22 nt, Shigella flexneri 2a str. 301
uauacaggcggguaaucuuucc

SEQ ID NO: 2004592 - RNA, 15 nt, Shigella flexneri 2a str. 301
uauaauuaaaaauag

SEQ ID NO: 2004593 - RNA, 14 nt, Shigella flexneri 2a str. 301
uauaauuaaaaaua

SEQ ID NO: 2004594 - RNA, 19 nt, Shigella flexneri 2a str. 301
uauaaauuacccuuuauuu

SEQ ID NO: 2004595 - RNA, 12 nt, Shigella flexneri 2a str. 301
uauaauuaaaaa

SEQ ID NO: 2004596 - RNA, 18 nt, Shigella flexneri 2a str. 301
uauaauugaccagaucuu

SEQ ID NO: 2004597 - RNA, 12 nt, Shigella flexneri 2a str. 301
uauaauaucuuu

SEQ ID NO: 2004598 - RNA, 23 nt, Shigella flexneri 2a str. 301
uauaauaucuuuucuuaacaaaa

SEQ ID NO: 2004599 - RNA, 14 nt, Shigella flexneri 2a str. 301
uagucgcuuucauu

SEQ ID NO: 2004600 - RNA, 20 nt, Shigella flexneri 2a str. 301
uagugaaaaagcucccuaaa

SEQ ID NO: 2004601 - RNA, 17 nt, Shigella flexneri 2a str. 301
uagucugaccucuucua

SEQ ID NO: 2004602 - RNA, 14 nt, Shigella flexneri 2a str. 301
uagugucuuaucug

SEQ ID NO: 2004603 - RNA, 14 nt, Shigella flexneri 2a str. 301
uaguggcucagacu

SEQ ID NO: 2004604 - RNA, 15 nt, Shigella flexneri 2a str. 301
uaguggaacaaagaa

SEQ ID NO: 2004605 - RNA, 20 nt, Shigella flexneri 2a str. 301
uaguggauucauugagcugc

SEQ ID NO: 2004606 - RNA, 16 nt, Shigella flexneri 2a str. 301
uaguuaaacuuucaua

SEQ ID NO: 2004607 - RNA, 14 nt, Shigella flexneri 2a str. 301
uauaaauaaaaauu

SEQ ID NO: 2004608 - RNA, 19 nt, Shigella flexneri 2a str. 301
uauaaaccacgcaauaaac

SEQ ID NO: 2004609 - RNA, 21 nt, Shigella flexneri 2a str. 301
uauaaaauuuaacauuuggau

SEQ ID NO: 2004610 - RNA, 17 nt, Shigella flexneri 2a str. 301
uauaaaccugagaaccu

SEQ ID NO: 2004611 - RNA, 23 nt, Shigella flexneri 2a str. 301
uauaaauagcggcuguuaccuuu

SEQ ID NO: 2004612 - RNA, 22 nt, Shigella flexneri 2a str. 301
uauaaauguguaaucaggcaau

SEQ ID NO: 2004613 - RNA, 12 nt, Shigella flexneri 2a str. 301
uauaaaaaaacc

SEQ ID NO: 2004614 - RNA, 14 nt, Shigella flexneri 2a str. 301
uaguuugauaauuu

SEQ ID NO: 2004615 - RNA, 17 nt, Shigella flexneri 2a str. 301
uaguuugauaauuuuag

SEQ ID NO: 2004616 - RNA, 20 nt, Shigella flexneri 2a str. 301
uaguuagcguugucaauacu

SEQ ID NO: 2004617 - RNA, 14 nt, Shigella flexneri 2a str. 301
uaguucaacagauu

SEQ ID NO: 2004618 - RNA, 13 nt, Shigella flexneri 2a str. 301
uaguuucucccca

SEQ ID NO: 2004619 - RNA, 22 nt, Shigella flexneri 2a str. 301
uaucaguauacgccacaucauu

SEQ ID NO: 2004620 - RNA, 20 nt, Shigella flexneri 2a str. 301
uaucagggagucuugcugga

SEQ ID NO: 2004621 - RNA, 21 nt, Shigella flexneri 2a str. 301
uaucaggccuacaaaaucuau

SEQ ID NO: 2004622 - RNA, 14 nt, Shigella flexneri 2a str. 301
uaucaggccuacaa

SEQ ID NO: 2004623 - RNA, 18 nt, Shigella flexneri 2a str. 301
uaucaggccuacaacucc

SEQ ID NO: 2004624 - RNA, 14 nt, Shigella flexneri 2a str. 301
uaucaccaaucaca

SEQ ID NO: 2004625 - RNA, 15 nt, Shigella flexneri 2a str. 301
uaucaccaaugauaa

SEQ ID NO: 2004626 - RNA, 22 nt, Shigella flexneri 2a str. 301
uauauugggaucaaaaauguca

SEQ ID NO: 2004627 - RNA, 20 nt, Shigella flexneri 2a str. 301
uaucaauuagauuuaauaac

SEQ ID NO: 2004628 - RNA, 19 nt, Shigella flexneri 2a str. 301
uauauuccuuacucauaaa

SEQ ID NO: 2004629 - RNA, 22 nt, Shigella flexneri 2a str. 301
uauauugaauuagcaauauuuu

SEQ ID NO: 2004630 - RNA, 19 nt, Shigella flexneri 2a str. 301
uauauuacaacguauuaua

SEQ ID NO: 2004631 - RNA, 17 nt, Shigella flexneri 2a str. 301
uauagcggggaacauca

SEQ ID NO: 2004632 - RNA, 16 nt, Shigella flexneri 2a str. 301
uauagcgggaaauacu

SEQ ID NO: 2004633 - RNA, 14 nt, Shigella flexneri 2a str. 301
uauagcuuauucuu

SEQ ID NO: 2004634 - RNA, 14 nt, Shigella flexneri 2a str. 301
uauccuucacacau

SEQ ID NO: 2004635 - RNA, 19 nt, Shigella flexneri 2a str. 301
uaucgacggcguauugcau

SEQ ID NO: 2004636 - RNA, 12 nt, Shigella flexneri 2a str. 301
uaucgaacaugc

SEQ ID NO: 2004637 - RNA, 14 nt, Shigella flexneri 2a str. 301
uaucgaaccagcgg

SEQ ID NO: 2004638 - RNA, 21 nt, Shigella flexneri 2a str. 301
uaucccugacgaccaaugaca

SEQ ID NO: 2004639 - RNA, 15 nt, Shigella flexneri 2a str. 301
uauccgaaaaaggau

SEQ ID NO: 2004640 - RNA, 21 nt, Shigella flexneri 2a str. 301
uauccgccagugccaaagcca

SEQ ID NO: 2004641 - RNA, 19 nt, Shigella flexneri 2a str. 301
uauccgacauuucugcugc

SEQ ID NO: 2004642 - RNA, 16 nt, Shigella flexneri 2a str. 301
uauccgaccuacaaaa

SEQ ID NO: 2004643 - RNA, 19 nt, Shigella flexneri 2a str. 301
uaucccgccagcaccagca

SEQ ID NO: 2004644 - RNA, 13 nt, Shigella flexneri 2a str. 301
uaucaucauuauu

SEQ ID NO: 2004645 - RNA, 20 nt, Shigella flexneri 2a str. 301
uaucaucggucagcgcagug

SEQ ID NO: 2004646 - RNA, 15 nt, Shigella flexneri 2a str. 301
uaucaucauuugcau

SEQ ID NO: 2004647 - RNA, 19 nt, Shigella flexneri 2a str. 301
uaucaugcucugccagcgu

SEQ ID NO: 2004648 - RNA, 20 nt, Shigella flexneri 2a str. 301
uauccaggcuaauccagucu

SEQ ID NO: 2004649 - RNA, 13 nt, Shigella flexneri 2a str. 301
uauccaguacauu

SEQ ID NO: 2004650 - RNA, 14 nt, Shigella flexneri 2a str. 301
uauccagcuucacu

SEQ ID NO: 2004651 - RNA, 22 nt, Shigella flexneri 2a str. 301
uauccagcgcggcgaaggugcc

SEQ ID NO: 2004652 - RNA, 17 nt, Shigella flexneri 2a str. 301
uauccagcaaagcguca

SEQ ID NO: 2004653 - RNA, 15 nt, Shigella flexneri 2a str. 301
uaucuauauacaauc

SEQ ID NO: 2004654 - RNA, 18 nt, Shigella flexneri 2a str. 301
uaucuauauacaaucaca

SEQ ID NO: 2004655 - RNA, 13 nt, Shigella flexneri 2a str. 301
uaucucuuuaccu

SEQ ID NO: 2004656 - RNA, 12 nt, Shigella flexneri 2a str. 301
uaucuuauagac

SEQ ID NO: 2004657 - RNA, 19 nt, Shigella flexneri 2a str. 301
uaucuuauagacuaaauuu

SEQ ID NO: 2004658 - RNA, 17 nt, Shigella flexneri 2a str. 301
uaucuuacccuuccuua

SEQ ID NO: 2004659 - RNA, 18 nt, Shigella flexneri 2a str. 301
uaucugcagauuaugccu

SEQ ID NO: 2004660 - RNA, 14 nt, Shigella flexneri 2a str. 301
uaucuguugcugcc

SEQ ID NO: 2004661 - RNA, 16 nt, Shigella flexneri 2a str. 301
uaucuaccacugccug

SEQ ID NO: 2004662 - RNA, 19 nt, Shigella flexneri 2a str. 301
uaucuacagcauuuccuua

SEQ ID NO: 2004663 - RNA, 20 nt, Shigella flexneri 2a str. 301
uaucgcaagucauuguccag

SEQ ID NO: 2004664 - RNA, 22 nt, Shigella flexneri 2a str. 301
uagccguggcaaccuucuucuu

SEQ ID NO: 2004665 - RNA, 14 nt, Shigella flexneri 2a str. 301
uagccucucggcau

SEQ ID NO: 2004666 - RNA, 16 nt, Shigella flexneri 2a str. 301
uagccucccugccucc

SEQ ID NO: 2004667 - RNA, 12 nt, Shigella flexneri 2a str. 301
uagccugccaga

SEQ ID NO: 2004668 - RNA, 18 nt, Shigella flexneri 2a str. 301
uagccugccagaggagcc

SEQ ID NO: 2004669 - RNA, 14 nt, Shigella flexneri 2a str. 301
uagccugcucccuu

SEQ ID NO: 2004670 - RNA, 17 nt, Shigella flexneri 2a str. 301
uagccuguccacaccca

SEQ ID NO: 2004671 - RNA, 14 nt, Shigella flexneri 2a str. 301
uagccuucaucaga

SEQ ID NO: 2004672 - RNA, 19 nt, Shigella flexneri 2a str. 301
uagcgaauaaaguagaaau

SEQ ID NO: 2004673 - RNA, 14 nt, Shigella flexneri 2a str. 301
uagcgaauuuuucg

SEQ ID NO: 2004674 - RNA, 21 nt, Shigella flexneri 2a str. 301
uagcgaauuuuucgagggugc

SEQ ID NO: 2004675 - RNA, 22 nt, Shigella flexneri 2a str. 301
uagcgaagaagacugaugacaa

SEQ ID NO: 2004676 - RNA, 18 nt, Shigella flexneri 2a str. 301
uagccaaucauucccauu

SEQ ID NO: 2004677 - RNA, 16 nt, Shigella flexneri 2a str. 301
uagccacauugcugca

SEQ ID NO: 2004678 - RNA, 11 nt, Shigella flexneri 2a str. 301
uagccaauucc

SEQ ID NO: 2004679 - RNA, 12 nt, Shigella flexneri 2a str. 301
uagccagcagag

SEQ ID NO: 2004680 - RNA, 13 nt, Shigella flexneri 2a str. 301
uagccagcagagc

SEQ ID NO: 2004681 - RNA, 20 nt, Shigella flexneri 2a str. 301
uagccagaaugccgcaaaac

SEQ ID NO: 2004682 - RNA, 23 nt, Shigella flexneri 2a str. 301
uagccgccagcucuuuaaacacg

SEQ ID NO: 2004683 - RNA, 17 nt, Shigella flexneri 2a str. 301
uagccgcuucugcagcu

SEQ ID NO: 2004684 - RNA, 23 nt, Shigella flexneri 2a str. 301
uagccgcuuuuucugcgcacaca

SEQ ID NO: 2004685 - RNA, 18 nt, Shigella flexneri 2a str. 301
uagccgcuuggcaagccc

SEQ ID NO: 2004686 - RNA, 17 nt, Shigella flexneri 2a str. 301
uagccgcggaucacgcg

SEQ ID NO: 2004687 - RNA, 19 nt, Shigella flexneri 2a str. 301
uagcacuguaaaccucuuu

SEQ ID NO: 2004688 - RNA, 19 nt, Shigella flexneri 2a str. 301
uagcacuuuucgucaggau

SEQ ID NO: 2004689 - RNA, 16 nt, Shigella flexneri 2a str. 301
uagcacgucaucugca

SEQ ID NO: 2004690 - RNA, 22 nt, Shigella flexneri 2a str. 301
uagccaaagcaccacuccucaa

SEQ ID NO: 2004691 - RNA, 14 nt, Shigella flexneri 2a str. 301
uagauauucuccag

SEQ ID NO: 2004692 - RNA, 11 nt, Shigella flexneri 2a str. 301
uagcaaggcga

SEQ ID NO: 2004693 - RNA, 22 nt, Shigella flexneri 2a str. 301
uagcaauccuugaguuucgucu

SEQ ID NO: 2004694 - RNA, 21 nt, Shigella flexneri 2a str. 301
uagcuaaucaucuguugugcc

SEQ ID NO: 2004695 - RNA, 15 nt, Shigella flexneri 2a str. 301
uagcuaacgaaagaa

SEQ ID NO: 2004696 - RNA, 17 nt, Shigella flexneri 2a str. 301
uagcuaacgaaagaaca

SEQ ID NO: 2004697 - RNA, 18 nt, Shigella flexneri 2a str. 301
uagcuccguaauuucgcu

SEQ ID NO: 2004698 - RNA, 18 nt, Shigella flexneri 2a str. 301
uagcgugauggccagaua

SEQ ID NO: 2004699 - RNA, 22 nt, Shigella flexneri 2a str. 301
uagcucugccacugguuuuccu

SEQ ID NO: 2004700 - RNA, 13 nt, Shigella flexneri 2a str. 301
uagcuuggcagag

SEQ ID NO: 2004701 - RNA, 13 nt, Shigella flexneri 2a str. 301
uagguaaacaucc

SEQ ID NO: 2004702 - RNA, 19 nt, Shigella flexneri 2a str. 301
uagggugauuucaccugca

SEQ ID NO: 2004703 - RNA, 17 nt, Shigella flexneri 2a str. 301
uaggguggggaaaaaca

SEQ ID NO: 2004704 - RNA, 19 nt, Shigella flexneri 2a str. 301
uaggcggcaaacaguuucu

SEQ ID NO: 2004705 - RNA, 18 nt, Shigella flexneri 2a str. 301
uaggccugauaagcguag

SEQ ID NO: 2004706 - RNA, 17 nt, Shigella flexneri 2a str. 301
uaggagguuuccggguc

SEQ ID NO: 2004707 - RNA, 21 nt, Shigella flexneri 2a str. 301
uaggagguuuccgggucggca

SEQ ID NO: 2004708 - RNA, 14 nt, Shigella flexneri 2a str. 301
uagaccugauacau

SEQ ID NO: 2004709 - RNA, 20 nt, Shigella flexneri 2a str. 301
uagacgaacguuuaauaaaa

SEQ ID NO: 2004710 - RNA, 23 nt, Shigella flexneri 2a str. 301
uagacauuacgcauuugcgcgua

SEQ ID NO: 2004711 - RNA, 16 nt, Shigella flexneri 2a str. 301
uagacgcuuucacccg

SEQ ID NO: 2004712 - RNA, 15 nt, Shigella flexneri 2a str. 301
uagacgaugaaaaag

SEQ ID NO: 2004713 - RNA, 12 nt, Shigella flexneri 2a str. 301
uagacugcagcg

SEQ ID NO: 2004714 - RNA, 17 nt, Shigella flexneri 2a str. 301
uagagacuuuuccagcc

SEQ ID NO: 2004715 - RNA, 20 nt, Shigella flexneri 2a str. 301
uagacuuuagcgcaaucgca

SEQ ID NO: 2004716 - RNA, 16 nt, Shigella flexneri 2a str. 301
uagaggaauggcagau

SEQ ID NO: 2004717 - RNA, 22 nt, Shigella flexneri 2a str. 301
uagagccgguuuugguuuucug

SEQ ID NO: 2004718 - RNA, 21 nt, Shigella flexneri 2a str. 301
uagagcgcggcgcaggcaaua

SEQ ID NO: 2004719 - RNA, 22 nt, Shigella flexneri 2a str. 301
uagagauuuuuccccaccucau

SEQ ID NO: 2004720 - RNA, 13 nt, Shigella flexneri 2a str. 301
uagagcacaucac

SEQ ID NO: 2004721 - RNA, 19 nt, Shigella flexneri 2a str. 301
uagagcacaucacucauaa

SEQ ID NO: 2004722 - RNA, 21 nt, Shigella flexneri 2a str. 301
uagagcacaucacucauaaug

SEQ ID NO: 2004723 - RNA, 15 nt, Shigella flexneri 2a str. 301
uagagcaaccaccug

SEQ ID NO: 2004724 - RNA, 14 nt, Shigella flexneri 2a str. 301
uagagguuauaaau

SEQ ID NO: 2004725 - RNA, 17 nt, Shigella flexneri 2a str. 301
uagagguuauaaauaaa

SEQ ID NO: 2004726 - RNA, 15 nt, Shigella flexneri 2a str. 301
uagaguuugaacuca

SEQ ID NO: 2004727 - RNA, 13 nt, Shigella flexneri 2a str. 301
uagauagcguucu

SEQ ID NO: 2004728 - RNA, 13 nt, Shigella flexneri 2a str. 301
uagauaagcaagg

SEQ ID NO: 2004729 - RNA, 12 nt, Shigella flexneri 2a str. 301
uagaaagggaag

SEQ ID NO: 2004730 - RNA, 16 nt, Shigella flexneri 2a str. 301
uagaaagugacugcug

SEQ ID NO: 2004731 - RNA, 21 nt, Shigella flexneri 2a str. 301
uagaaacuggcccucgucuuu

SEQ ID NO: 2004732 - RNA, 14 nt, Shigella flexneri 2a str. 301
uagaaauuauuucu

SEQ ID NO: 2004733 - RNA, 16 nt, Shigella flexneri 2a str. 301
uagaaauuauuucuuu

SEQ ID NO: 2004734 - RNA, 15 nt, Shigella flexneri 2a str. 301
uagaacaucucuucc

SEQ ID NO: 2004735 - RNA, 18 nt, Shigella flexneri 2a str. 301
uacuagccugcucccuua

SEQ ID NO: 2004736 - RNA, 16 nt, Shigella flexneri 2a str. 301
uagaaaauggaacgcg

SEQ ID NO: 2004737 - RNA, 13 nt, Shigella flexneri 2a str. 301
uagaaacaaaaaa

SEQ ID NO: 2004738 - RNA, 21 nt, Shigella flexneri 2a str. 301
uagaaacgagguauguuucug

SEQ ID NO: 2004739 - RNA, 16 nt, Shigella flexneri 2a str. 301
uacuaugauuuuccug

SEQ ID NO: 2004740 - RNA, 11 nt, Shigella flexneri 2a str. 301
uacuaucugcu

SEQ ID NO: 2004741 - RNA, 19 nt, Shigella flexneri 2a str. 301
uagaagccauuaaacacca

SEQ ID NO: 2004742 - RNA, 20 nt, Shigella flexneri 2a str. 301
uagaagucacguacaaaacg

SEQ ID NO: 2004743 - RNA, 16 nt, Shigella flexneri 2a str. 301
uagaacggcagagaaa

SEQ ID NO: 2004744 - RNA, 22 nt, Shigella flexneri 2a str. 301
uagaacuaaugggccguuagga

SEQ ID NO: 2004745 - RNA, 15 nt, Shigella flexneri 2a str. 301
uagacaaaaauuucu

SEQ ID NO: 2004746 - RNA, 17 nt, Shigella flexneri 2a str. 301
uagaaugccaaguaaua

SEQ ID NO: 2004747 - RNA, 14 nt, Shigella flexneri 2a str. 301
uagaauauuucuau

SEQ ID NO: 2004748 - RNA, 16 nt, Shigella flexneri 2a str. 301
uacagaaaugaaaaaa

SEQ ID NO: 2004749 - RNA, 17 nt, Shigella flexneri 2a str. 301
uacagaaaugaaaaaau

SEQ ID NO: 2004750 - RNA, 18 nt, Shigella flexneri 2a str. 301
uacagaaaugaaaaaaua

SEQ ID NO: 2004751 - RNA, 15 nt, Shigella flexneri 2a str. 301
uacagaagcaccgua

SEQ ID NO: 2004752 - RNA, 23 nt, Shigella flexneri 2a str. 301
uacagaccggagccaaacaugca

SEQ ID NO: 2004753 - RNA, 23 nt, Shigella flexneri 2a str. 301
uacagacacccaccauaagcccg

SEQ ID NO: 2004754 - RNA, 23 nt, Shigella flexneri 2a str. 301
uacacaagccaggacgcagucca

SEQ ID NO: 2004755 - RNA, 22 nt, Shigella flexneri 2a str. 301
uacagauccgccauuucuccuc

SEQ ID NO: 2004756 - RNA, 20 nt, Shigella flexneri 2a str. 301
uacagaucgugcaucuccug

SEQ ID NO: 2004757 - RNA, 13 nt, Shigella flexneri 2a str. 301
uacagaugcugcu

SEQ ID NO: 2004758 - RNA, 17 nt, Shigella flexneri 2a str. 301
uacagacucaaaccaau

SEQ ID NO: 2004759 - RNA, 21 nt, Shigella flexneri 2a str. 301
uacagacucaaaccaauggca

SEQ ID NO: 2004760 - RNA, 19 nt, Shigella flexneri 2a str. 301
uacagccaugcgaaugcca

SEQ ID NO: 2004761 - RNA, 22 nt, Shigella flexneri 2a str. 301
uacagccgacaaugccacaaac

SEQ ID NO: 2004762 - RNA, 17 nt, Shigella flexneri 2a str. 301
uacagccgacaaugcca

SEQ ID NO: 2004763 - RNA, 20 nt, Shigella flexneri 2a str. 301
uacagcaauggaaaaaguuu

SEQ ID NO: 2004764 - RNA, 19 nt, Shigella flexneri 2a str. 301
uacagcgcccgccagcacc

SEQ ID NO: 2004765 - RNA, 23 nt, Shigella flexneri 2a str. 301
uacagcgcggaccccacgcucuc

SEQ ID NO: 2004766 - RNA, 14 nt, Shigella flexneri 2a str. 301
uacagcgcgggcug

SEQ ID NO: 2004767 - RNA, 22 nt, Shigella flexneri 2a str. 301
uacagcgacuucuucccaccau

SEQ ID NO: 2004768 - RNA, 17 nt, Shigella flexneri 2a str. 301
uacagccuuaacaagau

SEQ ID NO: 2004769 - RNA, 16 nt, Shigella flexneri 2a str. 301
uacagccgccagacaa

SEQ ID NO: 2004770 - RNA, 17 nt, Shigella flexneri 2a str. 301
uacagccugccagcaug

SEQ ID NO: 2004771 - RNA, 19 nt, Shigella flexneri 2a str. 301
uacagccugccagcaugca

SEQ ID NO: 2004772 - RNA, 17 nt, Shigella flexneri 2a str. 301
uacagccggacccacac

SEQ ID NO: 2004773 - RNA, 15 nt, Shigella flexneri 2a str. 301
uacagccgccagaca

SEQ ID NO: 2004774 - RNA, 19 nt, Shigella flexneri 2a str. 301
uacaaagggcuaacgugca

SEQ ID NO: 2004775 - RNA, 16 nt, Shigella flexneri 2a str. 301
uacaaaguguuguucu

SEQ ID NO: 2004776 - RNA, 19 nt, Shigella flexneri 2a str. 301
uacaaccaccccaccuuac

SEQ ID NO: 2004777 - RNA, 18 nt, Shigella flexneri 2a str. 301
uacaacaucguaucuggc

SEQ ID NO: 2004778 - RNA, 21 nt, Shigella flexneri 2a str. 301
uacaacagggcgauuugcucc

SEQ ID NO: 2004779 - RNA, 22 nt, Shigella flexneri 2a str. 301
uacaaauuugugcaaauucaau

SEQ ID NO: 2004780 - RNA, 20 nt, Shigella flexneri 2a str. 301
uacaaaugggcacaauucau

SEQ ID NO: 2004781 - RNA, 19 nt, Shigella flexneri 2a str. 301
uacaacucgcuuaagccau

SEQ ID NO: 2004782 - RNA, 13 nt, Shigella flexneri 2a str. 301
uacaacguuaccg

SEQ ID NO: 2004783 - RNA, 17 nt, Shigella flexneri 2a str. 301
uacaaccugcuggaaag

SEQ ID NO: 2004784 - RNA, 16 nt, Shigella flexneri 2a str. 301
uacaacguauugaaau

SEQ ID NO: 2004785 - RNA, 11 nt, Shigella flexneri 2a str. 301
uacaaccaucc

SEQ ID NO: 2004786 - RNA, 17 nt, Shigella flexneri 2a str. 301
uacaaccaucccuccug

SEQ ID NO: 2004787 - RNA, 11 nt, Shigella flexneri 2a str. 301
uacaacgcugu

SEQ ID NO: 2004788 - RNA, 18 nt, Shigella flexneri 2a str. 301
uacaacgcaauauccgcc

SEQ ID NO: 2004789 - RNA, 16 nt, Shigella flexneri 2a str. 301
uacaauaugaauuacu

SEQ ID NO: 2004790 - RNA, 13 nt, Shigella flexneri 2a str. 301
uacaaucacacua

SEQ ID NO: 2004791 - RNA, 19 nt, Shigella flexneri 2a str. 301
uacaaucacgauagccaga

SEQ ID NO: 2004792 - RNA, 16 nt, Shigella flexneri 2a str. 301
uacaaucugcgcugga

SEQ ID NO: 2004793 - RNA, 21 nt, Shigella flexneri 2a str. 301
uaccaaaaucaucaauugcca

SEQ ID NO: 2004794 - RNA, 20 nt, Shigella flexneri 2a str. 301
uaccaaaaugacuuaauaac

SEQ ID NO: 2004795 - RNA, 22 nt, Shigella flexneri 2a str. 301
uaccaauaaacuucaauauauu

SEQ ID NO: 2004796 - RNA, 17 nt, Shigella flexneri 2a str. 301
uaccacaaugcaauaau

SEQ ID NO: 2004797 - RNA, 11 nt, Shigella flexneri 2a str. 301
uacauuuugac

SEQ ID NO: 2004798 - RNA, 16 nt, Shigella flexneri 2a str. 301
uacauuguuuuccaga

SEQ ID NO: 2004799 - RNA, 13 nt, Shigella flexneri 2a str. 301
uacauugccgggc

SEQ ID NO: 2004800 - RNA, 22 nt, Shigella flexneri 2a str. 301
uacauuaaacgccguucuucag

SEQ ID NO: 2004801 - RNA, 19 nt, Shigella flexneri 2a str. 301
uacauuaucgcgucuaaau

SEQ ID NO: 2004802 - RNA, 20 nt, Shigella flexneri 2a str. 301
uacaugcgcgacaaaaauua

SEQ ID NO: 2004803 - RNA, 12 nt, Shigella flexneri 2a str. 301
uacaugcagggc

SEQ ID NO: 2004804 - RNA, 23 nt, Shigella flexneri 2a str. 301
uacauguaaaaggcgcuaaaaau

SEQ ID NO: 2004805 - RNA, 22 nt, Shigella flexneri 2a str. 301
uacaucuuaaucuuagguaaug

SEQ ID NO: 2004806 - RNA, 18 nt, Shigella flexneri 2a str. 301
uacaucuuccacuuugau

SEQ ID NO: 2004807 - RNA, 17 nt, Shigella flexneri 2a str. 301
uacaucgcauaaaacaa

SEQ ID NO: 2004808 - RNA, 14 nt, Shigella flexneri 2a str. 301
uacaucuacaaaaa

SEQ ID NO: 2004809 - RNA, 15 nt, Shigella flexneri 2a str. 301
uacagcggccaacca

SEQ ID NO: 2004810 - RNA, 16 nt, Shigella flexneri 2a str. 301
uacaggcagcuuagaa

SEQ ID NO: 2004811 - RNA, 19 nt, Shigella flexneri 2a str. 301
uacaggcaacgaccagaaa

SEQ ID NO: 2004812 - RNA, 17 nt, Shigella flexneri 2a str. 301
uacaggcugguuucucu

SEQ ID NO: 2004813 - RNA, 14 nt, Shigella flexneri 2a str. 301
uacaggguaaaaag

SEQ ID NO: 2004814 - RNA, 20 nt, Shigella flexneri 2a str. 301
uacauagcgccucuuuauaa

SEQ ID NO: 2004815 - RNA, 14 nt, Shigella flexneri 2a str. 301
uacauauauuacaa

SEQ ID NO: 2004816 - RNA, 14 nt, Shigella flexneri 2a str. 301
uacauauuuuucau

SEQ ID NO: 2004817 - RNA, 13 nt, Shigella flexneri 2a str. 301
uaccggcaaacuu

SEQ ID NO: 2004818 - RNA, 17 nt, Shigella flexneri 2a str. 301
uaccggcaaagaaccaa

SEQ ID NO: 2004819 - RNA, 18 nt, Shigella flexneri 2a str. 301
uaccggauuuuuuuuccg

SEQ ID NO: 2004820 - RNA, 15 nt, Shigella flexneri 2a str. 301
uaccggacacacuuc

SEQ ID NO: 2004821 - RNA, 15 nt, Shigella flexneri 2a str. 301
uaccguucucuuuaa

SEQ ID NO: 2004822 - RNA, 15 nt, Shigella flexneri 2a str. 301
uaccgugcugacuca

SEQ ID NO: 2004823 - RNA, 18 nt, Shigella flexneri 2a str. 301
uaccgaagaguaaccaaa

SEQ ID NO: 2004824 - RNA, 21 nt, Shigella flexneri 2a str. 301
uaccgcugcuggcguugucau

SEQ ID NO: 2004825 - RNA, 12 nt, Shigella flexneri 2a str. 301
uaccgagcagcc

SEQ ID NO: 2004826 - RNA, 15 nt, Shigella flexneri 2a str. 301
uaccugacagcagag

SEQ ID NO: 2004827 - RNA, 20 nt, Shigella flexneri 2a str. 301
uaccugccuggcaguggaau

SEQ ID NO: 2004828 - RNA, 11 nt, Shigella flexneri 2a str. 301
uaccugccugu

SEQ ID NO: 2004829 - RNA, 15 nt, Shigella flexneri 2a str. 301
uaccuccuucacagu

SEQ ID NO: 2004830 - RNA, 11 nt, Shigella flexneri 2a str. 301
uaccacaucaa

SEQ ID NO: 2004831 - RNA, 21 nt, Shigella flexneri 2a str. 301
uaccacagacaaaauccugcc

SEQ ID NO: 2004832 - RNA, 18 nt, Shigella flexneri 2a str. 301
uaccacagacaaaauccu

SEQ ID NO: 2004833 - RNA, 12 nt, Shigella flexneri 2a str. 301
uaccaguccuac

SEQ ID NO: 2004834 - RNA, 13 nt, Shigella flexneri 2a str. 301
uaccaguugauca

SEQ ID NO: 2004835 - RNA, 18 nt, Shigella flexneri 2a str. 301
uaccaucaauggaugaac

SEQ ID NO: 2004836 - RNA, 17 nt, Shigella flexneri 2a str. 301
uaccaugcgcaucaucg

SEQ ID NO: 2004837 - RNA, 15 nt, Shigella flexneri 2a str. 301
uacccgaugcaaaaa

SEQ ID NO: 2004838 - RNA, 22 nt, Shigella flexneri 2a str. 301
uacccgcugcugacuuugacau

SEQ ID NO: 2004839 - RNA, 18 nt, Shigella flexneri 2a str. 301
uacccgcuaacugguggc

SEQ ID NO: 2004840 - RNA, 12 nt, Shigella flexneri 2a str. 301
uaccauuuguuc

SEQ ID NO: 2004841 - RNA, 22 nt, Shigella flexneri 2a str. 301
uacccagcgaauccagcaugcu

SEQ ID NO: 2004842 - RNA, 15 nt, Shigella flexneri 2a str. 301
uaccauuaucaccaa

SEQ ID NO: 2004843 - RNA, 22 nt, Shigella flexneri 2a str. 301
uaccauuaaucgauaaaccagc

SEQ ID NO: 2004844 - RNA, 19 nt, Shigella flexneri 2a str. 301
uaccauugaagcaauccau

SEQ ID NO: 2004845 - RNA, 15 nt, Shigella flexneri 2a str. 301
uacccauauuuaauc

SEQ ID NO: 2004846 - RNA, 13 nt, Shigella flexneri 2a str. 301
uacgccacaucau

SEQ ID NO: 2004847 - RNA, 13 nt, Shigella flexneri 2a str. 301
uacgccagucacg

SEQ ID NO: 2004848 - RNA, 19 nt, Shigella flexneri 2a str. 301
uacgcucacgcgcugccuc

SEQ ID NO: 2004849 - RNA, 14 nt, Shigella flexneri 2a str. 301
uacgcgaucguccg

SEQ ID NO: 2004850 - RNA, 16 nt, Shigella flexneri 2a str. 301
uacgccucacagggcu

SEQ ID NO: 2004851 - RNA, 16 nt, Shigella flexneri 2a str. 301
uacgccgcauccaaca

SEQ ID NO: 2004852 - RNA, 15 nt, Shigella flexneri 2a str. 301
uacgccgccacagcg

SEQ ID NO: 2004853 - RNA, 14 nt, Shigella flexneri 2a str. 301
uacgcccacgccag

SEQ ID NO: 2004854 - RNA, 19 nt, Shigella flexneri 2a str. 301
uacgauuaacguaaggcgc

SEQ ID NO: 2004855 - RNA, 17 nt, Shigella flexneri 2a str. 301
uacgacuguugaagaac

SEQ ID NO: 2004856 - RNA, 18 nt, Shigella flexneri 2a str. 301
uacgaggauucgaaccuc

SEQ ID NO: 2004857 - RNA, 16 nt, Shigella flexneri 2a str. 301
uacgacauugaagaau

SEQ ID NO: 2004858 - RNA, 19 nt, Shigella flexneri 2a str. 301
uaccuuaacgguaucuuuc

SEQ ID NO: 2004859 - RNA, 15 nt, Shigella flexneri 2a str. 301
uaccuuacacucaaa

SEQ ID NO: 2004860 - RNA, 18 nt, Shigella flexneri 2a str. 301
uaccuguccguuuucagu

SEQ ID NO: 2004861 - RNA, 12 nt, Shigella flexneri 2a str. 301
uacgcuuuucuu

SEQ ID NO: 2004862 - RNA, 13 nt, Shigella flexneri 2a str. 301
uacgcuuaucagg

SEQ ID NO: 2004863 - RNA, 13 nt, Shigella flexneri 2a str. 301
uacgcuccagcag

SEQ ID NO: 2004864 - RNA, 17 nt, Shigella flexneri 2a str. 301
uacguaaugcucauucu

SEQ ID NO: 2004865 - RNA, 13 nt, Shigella flexneri 2a str. 301
uacguaauucacc

SEQ ID NO: 2004866 - RNA, 14 nt, Shigella flexneri 2a str. 301
uacguaaugcucau

SEQ ID NO: 2004867 - RNA, 15 nt, Shigella flexneri 2a str. 301
uacgugcacaggcaa

SEQ ID NO: 2004868 - RNA, 18 nt, Shigella flexneri 2a str. 301
uacgguacugaaaccuga

SEQ ID NO: 2004869 - RNA, 21 nt, Shigella flexneri 2a str. 301
uacgguguaccggauaaauuu

SEQ ID NO: 2004870 - RNA, 19 nt, Shigella flexneri 2a str. 301
uacgguguucacucaucaa

SEQ ID NO: 2004871 - RNA, 22 nt, Shigella flexneri 2a str. 301
uacguugcauuuccauaaauug

SEQ ID NO: 2004872 - RNA, 21 nt, Shigella flexneri 2a str. 301
uacuaaucucacccauagaua

SEQ ID NO: 2004873 - RNA, 14 nt, Shigella flexneri 2a str. 301
uacuaauaaaucgu

SEQ ID NO: 2004874 - RNA, 23 nt, Shigella flexneri 2a str. 301
uacuaauaaaucgugaaacaauc

SEQ ID NO: 2004875 - RNA, 22 nt, Shigella flexneri 2a str. 301
uacuaagaguucuacuccaguu

SEQ ID NO: 2004876 - RNA, 16 nt, Shigella flexneri 2a str. 301
uacuacguaauuucaa

SEQ ID NO: 2004877 - RNA, 15 nt, Shigella flexneri 2a str. 301
uaauaccugccuggu

SEQ ID NO: 2004878 - RNA, 13 nt, Shigella flexneri 2a str. 301
uaauaccaucggc

SEQ ID NO: 2004879 - RNA, 20 nt, Shigella flexneri 2a str. 301
uaauagaacuauaauugcuu

SEQ ID NO: 2004880 - RNA, 18 nt, Shigella flexneri 2a str. 301
uaauaauuucugcacauc

SEQ ID NO: 2004881 - RNA, 17 nt, Shigella flexneri 2a str. 301
uaauacacuaacagaac

SEQ ID NO: 2004882 - RNA, 13 nt, Shigella flexneri 2a str. 301
uaauacaccauca

SEQ ID NO: 2004883 - RNA, 13 nt, Shigella flexneri 2a str. 301
uaauacacacauc

SEQ ID NO: 2004884 - RNA, 21 nt, Shigella flexneri 2a str. 301
uaauacacuaacagaacaaua

SEQ ID NO: 2004885 - RNA, 22 nt, Shigella flexneri 2a str. 301
uaauaaugagcagaaaaaccgu

SEQ ID NO: 2004886 - RNA, 20 nt, Shigella flexneri 2a str. 301
uaauaauugccccuuggcau

SEQ ID NO: 2004887 - RNA, 20 nt, Shigella flexneri 2a str. 301
uaauaauauccuuuccccuc

SEQ ID NO: 2004888 - RNA, 13 nt, Shigella flexneri 2a str. 301
uaauaaucaucac

SEQ ID NO: 2004889 - RNA, 14 nt, Shigella flexneri 2a str. 301
uaauaaucagcaca

SEQ ID NO: 2004890 - RNA, 22 nt, Shigella flexneri 2a str. 301
uaauaagcgcaaggguaaacgu

SEQ ID NO: 2004891 - RNA, 15 nt, Shigella flexneri 2a str. 301
uaauaaacaucagcu

SEQ ID NO: 2004892 - RNA, 20 nt, Shigella flexneri 2a str. 301
uaauaaaauacuuuuacucu

SEQ ID NO: 2004893 - RNA, 22 nt, Shigella flexneri 2a str. 301
uaauaaagcccccuguuugucu

SEQ ID NO: 2004894 - RNA, 13 nt, Shigella flexneri 2a str. 301
uaauaaagccuau

SEQ ID NO: 2004895 - RNA, 13 nt, Shigella flexneri 2a str. 301
uaauaaauuaacu

SEQ ID NO: 2004896 - RNA, 19 nt, Shigella flexneri 2a str. 301
uaauaaaucgugaaacaau

SEQ ID NO: 2004897 - RNA, 18 nt, Shigella flexneri 2a str. 301
uaaguuucaccaaacuuc

SEQ ID NO: 2004898 - RNA, 21 nt, Shigella flexneri 2a str. 301
uaaguucaguaugaucuugcc

SEQ ID NO: 2004899 - RNA, 21 nt, Shigella flexneri 2a str. 301
uaaguuagucgcuuucauuca

SEQ ID NO: 2004900 - RNA, 20 nt, Shigella flexneri 2a str. 301
uaaguuaauucugagagcau

SEQ ID NO: 2004901 - RNA, 22 nt, Shigella flexneri 2a str. 301
uaagugauacccaucaucgcau

SEQ ID NO: 2004902 - RNA, 21 nt, Shigella flexneri 2a str. 301
uaaguguuucacuuucaucac

SEQ ID NO: 2004903 - RNA, 15 nt, Shigella flexneri 2a str. 301
uaaguguaaaauucu

SEQ ID NO: 2004904 - RNA, 18 nt, Shigella flexneri 2a str. 301
uaaguccauacugucucc

SEQ ID NO: 2004905 - RNA, 23 nt, Shigella flexneri 2a str. 301
uaaguaguguagcacuugcagcu

SEQ ID NO: 2004906 - RNA, 23 nt, Shigella flexneri 2a str. 301
uaaggucagacgaagucaacaag

SEQ ID NO: 2004907 - RNA, 14 nt, Shigella flexneri 2a str. 301
uaaggguaaaagga

SEQ ID NO: 2004908 - RNA, 17 nt, Shigella flexneri 2a str. 301
uaaggguauagaagcca

SEQ ID NO: 2004909 - RNA, 18 nt, Shigella flexneri 2a str. 301
uaaggguuuuuuuaugcc

SEQ ID NO: 2004910 - RNA, 19 nt, Shigella flexneri 2a str. 301
uaagguguuuacaccgcau

SEQ ID NO: 2004911 - RNA, 14 nt, Shigella flexneri 2a str. 301
uaaguacauuaaaa

SEQ ID NO: 2004912 - RNA, 16 nt, Shigella flexneri 2a str. 301
uaaguacauuaaaauu

SEQ ID NO: 2004913 - RNA, 15 nt, Shigella flexneri 2a str. 301
uaaguagccuuuaac

SEQ ID NO: 2004914 - RNA, 15 nt, Shigella flexneri 2a str. 301
uaaggcguuacgcag

SEQ ID NO: 2004915 - RNA, 15 nt, Shigella flexneri 2a str. 301
uaaggcuguucccac

SEQ ID NO: 2004916 - RNA, 12 nt, Shigella flexneri 2a str. 301
uaaggcguucac

SEQ ID NO: 2004917 - RNA, 22 nt, Shigella flexneri 2a str. 301
uaaggcgcgagguuuuccuuca

SEQ ID NO: 2004918 - RNA, 14 nt, Shigella flexneri 2a str. 301
uaaggcgcaauaau

SEQ ID NO: 2004919 - RNA, 15 nt, Shigella flexneri 2a str. 301
uaaggguaaaaggau

SEQ ID NO: 2004920 - RNA, 23 nt, Shigella flexneri 2a str. 301
uaagggugucuguuaaucgcauu

SEQ ID NO: 2004921 - RNA, 17 nt, Shigella flexneri 2a str. 301
uaagggaggauuucucc

SEQ ID NO: 2004922 - RNA, 21 nt, Shigella flexneri 2a str. 301
uaagggaggauuucucccccc

SEQ ID NO: 2004923 - RNA, 17 nt, Shigella flexneri 2a str. 301
uaaggcaacgccccuuc

SEQ ID NO: 2004924 - RNA, 14 nt, Shigella flexneri 2a str. 301
uaaggcaagaaaau

SEQ ID NO: 2004925 - RNA, 20 nt, Shigella flexneri 2a str. 301
uaaucaaucuuuacacacaa

SEQ ID NO: 2004926 - RNA, 12 nt, Shigella flexneri 2a str. 301
uaaucagcacaa

SEQ ID NO: 2004927 - RNA, 19 nt, Shigella flexneri 2a str. 301
uaaucacauaauccagaca

SEQ ID NO: 2004928 - RNA, 15 nt, Shigella flexneri 2a str. 301
uaaucaaaucaacaa

SEQ ID NO: 2004929 - RNA, 14 nt, Shigella flexneri 2a str. 301
uaaucaagcccugg

SEQ ID NO: 2004930 - RNA, 19 nt, Shigella flexneri 2a str. 301
uaaucaaaucaacaaccug

SEQ ID NO: 2004931 - RNA, 15 nt, Shigella flexneri 2a str. 301
uaaucaacaaaccaa

SEQ ID NO: 2004932 - RNA, 13 nt, Shigella flexneri 2a str. 301
uaaucaggcuauc

SEQ ID NO: 2004933 - RNA, 19 nt, Shigella flexneri 2a str. 301
uaaucagcgaguuaccuua

SEQ ID NO: 2004934 - RNA, 18 nt, Shigella flexneri 2a str. 301
uaaucagcuaauggcugc

SEQ ID NO: 2004935 - RNA, 13 nt, Shigella flexneri 2a str. 301
uaaucauauuaaa

SEQ ID NO: 2004936 - RNA, 17 nt, Shigella flexneri 2a str. 301
uaauccacuuucuuaaa

SEQ ID NO: 2004937 - RNA, 20 nt, Shigella flexneri 2a str. 301
uaauccacuuucuuaaagcc

SEQ ID NO: 2004938 - RNA, 17 nt, Shigella flexneri 2a str. 301
uaaucauauuaaauuuu

SEQ ID NO: 2004939 - RNA, 12 nt, Shigella flexneri 2a str. 301
uaauccacuuuc

SEQ ID NO: 2004940 - RNA, 15 nt, Shigella flexneri 2a str. 301
uaauaugcaauucac

SEQ ID NO: 2004941 - RNA, 21 nt, Shigella flexneri 2a str. 301
uaauaugcucaacaauaaacu

SEQ ID NO: 2004942 - RNA, 20 nt, Shigella flexneri 2a str. 301
uaauauuagucaauuaaaaa

SEQ ID NO: 2004943 - RNA, 20 nt, Shigella flexneri 2a str. 301
uaaucgcauugguuuuuugg

SEQ ID NO: 2004944 - RNA, 16 nt, Shigella flexneri 2a str. 301
uaaucgcacaaaauca

SEQ ID NO: 2004945 - RNA, 15 nt, Shigella flexneri 2a str. 301
uaauccagccuacaa

SEQ ID NO: 2004946 - RNA, 19 nt, Shigella flexneri 2a str. 301
uaauccaggacauaucagg

SEQ ID NO: 2004947 - RNA, 21 nt, Shigella flexneri 2a str. 301
uaauccauaguguguuccucu

SEQ ID NO: 2004948 - RNA, 20 nt, Shigella flexneri 2a str. 301
uaauccccauaucaggcaca

SEQ ID NO: 2004949 - RNA, 16 nt, Shigella flexneri 2a str. 301
uaaucgcccggauauc

SEQ ID NO: 2004950 - RNA, 19 nt, Shigella flexneri 2a str. 301
uaaucgccguauaauaucu

SEQ ID NO: 2004951 - RNA, 22 nt, Shigella flexneri 2a str. 301
uaaucgccagcaaaaucaccau

SEQ ID NO: 2004952 - RNA, 14 nt, Shigella flexneri 2a str. 301
uaaucgccuuaccc

SEQ ID NO: 2004953 - RNA, 16 nt, Shigella flexneri 2a str. 301
uaaucguaugcgcagu

SEQ ID NO: 2004954 - RNA, 14 nt, Shigella flexneri 2a str. 301
uaaucgcuuucgga

SEQ ID NO: 2004955 - RNA, 16 nt, Shigella flexneri 2a str. 301
uaaucgcucagcgcau

SEQ ID NO: 2004956 - RNA, 15 nt, Shigella flexneri 2a str. 301
uaaucgcuucuucuu

SEQ ID NO: 2004957 - RNA, 19 nt, Shigella flexneri 2a str. 301
uaaucggggauaagaauau

SEQ ID NO: 2004958 - RNA, 14 nt, Shigella flexneri 2a str. 301
uaaucuauauuucu

SEQ ID NO: 2004959 - RNA, 15 nt, Shigella flexneri 2a str. 301
uaaucuauauuucug

SEQ ID NO: 2004960 - RNA, 22 nt, Shigella flexneri 2a str. 301
uaaucguuggcagacguuuuuu

SEQ ID NO: 2004961 - RNA, 14 nt, Shigella flexneri 2a str. 301
uaaucgucaucagc

SEQ ID NO: 2004962 - RNA, 22 nt, Shigella flexneri 2a str. 301
uaaucugguaucgaguggcgca

SEQ ID NO: 2004963 - RNA, 12 nt, Shigella flexneri 2a str. 301
uaaucugccagc

SEQ ID NO: 2004964 - RNA, 23 nt, Shigella flexneri 2a str. 301
uaaucugaauggcugcauuccuu

SEQ ID NO: 2004965 - RNA, 18 nt, Shigella flexneri 2a str. 301
uaaucucugcuuucgcau

SEQ ID NO: 2004966 - RNA, 13 nt, Shigella flexneri 2a str. 301
uaaucucgccuua

SEQ ID NO: 2004967 - RNA, 23 nt, Shigella flexneri 2a str. 301
uaauggcaauacugacaucagca

SEQ ID NO: 2004968 - RNA, 20 nt, Shigella flexneri 2a str. 301
uaaugucauaagcaucccuu

SEQ ID NO: 2004969 - RNA, 14 nt, Shigella flexneri 2a str. 301
uaaucuuuucauau

SEQ ID NO: 2004970 - RNA, 22 nt, Shigella flexneri 2a str. 301
uaaugcuucuaccgucuguaac

SEQ ID NO: 2004971 - RNA, 12 nt, Shigella flexneri 2a str. 301
uaaugcuucaca

SEQ ID NO: 2004972 - RNA, 17 nt, Shigella flexneri 2a str. 301
uaauguuaaccaucuca

SEQ ID NO: 2004973 - RNA, 14 nt, Shigella flexneri 2a str. 301
uaauguguucaacu

SEQ ID NO: 2004974 - RNA, 18 nt, Shigella flexneri 2a str. 301
uaauuacugcuuaaaugc

SEQ ID NO: 2004975 - RNA, 23 nt, Shigella flexneri 2a str. 301
uaauuacugccuuaaucaagaaa

SEQ ID NO: 2004976 - RNA, 14 nt, Shigella flexneri 2a str. 301
uaauguuuaucuac

SEQ ID NO: 2004977 - RNA, 17 nt, Shigella flexneri 2a str. 301
uaauugcuccauccauu

SEQ ID NO: 2004978 - RNA, 15 nt, Shigella flexneri 2a str. 301
uaauugcuuuuacca

SEQ ID NO: 2004979 - RNA, 20 nt, Shigella flexneri 2a str. 301
uaauuggaauacauauauua

SEQ ID NO: 2004980 - RNA, 22 nt, Shigella flexneri 2a str. 301
uaauuggaauacauauauuaca

SEQ ID NO: 2004981 - RNA, 18 nt, Shigella flexneri 2a str. 301
uaauugcuuuuuuccaua

SEQ ID NO: 2004982 - RNA, 18 nt, Shigella flexneri 2a str. 301
uaauuggaguaucaccau

SEQ ID NO: 2004983 - RNA, 22 nt, Shigella flexneri 2a str. 301
uaauugcgcaacugaggcaaua

SEQ ID NO: 2004984 - RNA, 17 nt, Shigella flexneri 2a str. 301
uaauuccggugaaaggc

SEQ ID NO: 2004985 - RNA, 13 nt, Shigella flexneri 2a str. 301
uaauucauuugcu

SEQ ID NO: 2004986 - RNA, 17 nt, Shigella flexneri 2a str. 301
uaauuaggcuaaauaac

SEQ ID NO: 2004987 - RNA, 19 nt, Shigella flexneri 2a str. 301
uaauuaggauacuuaucug

SEQ ID NO: 2004988 - RNA, 15 nt, Shigella flexneri 2a str. 301
ggcucauaccuucca

SEQ ID NO: 2004989 - RNA, 23 nt, Shigella flexneri 2a str. 301
ggcucagcucuggcacaugcaua

SEQ ID NO: 2004990 - RNA, 21 nt, Shigella flexneri 2a str. 301
ggcucaucucuucgguuggca

SEQ ID NO: 2004991 - RNA, 23 nt, Shigella flexneri 2a str. 301
ggcucaucaccccgcgcucacac

SEQ ID NO: 2004992 - RNA, 21 nt, Shigella flexneri 2a str. 301
ggcucauugccauucgccagu

SEQ ID NO: 2004993 - RNA, 20 nt, Shigella flexneri 2a str. 301
ggcuauuccacgcaucaagc

SEQ ID NO: 2004994 - RNA, 21 nt, Shigella flexneri 2a str. 301
ggcuccgguuaacgccgcgcc

SEQ ID NO: 2004995 - RNA, 16 nt, Shigella flexneri 2a str. 301
ggcuccucugacugga

SEQ ID NO: 2004996 - RNA, 14 nt, Shigella flexneri 2a str. 301
ggcucgaucuggug

SEQ ID NO: 2004997 - RNA, 18 nt, Shigella flexneri 2a str. 301
ggcucgacaaaaugagca

SEQ ID NO: 2004998 - RNA, 15 nt, Shigella flexneri 2a str. 301
ggcuccacuucguuc

SEQ ID NO: 2004999 - RNA, 14 nt, Shigella flexneri 2a str. 301
ggcucccgcagcca

SEQ ID NO: 2005000 - RNA, 22 nt, Shigella flexneri 2a str. 301
ggcucccggcgguaaaucgccg

SEQ ID NO: 2005001 - RNA, 22 nt, Shigella flexneri 2a str. 301
ggcucgccuuucggcugcagca

SEQ ID NO: 2005002 - RNA, 18 nt, Shigella flexneri 2a str. 301
ggcucuucgcuccaguca

SEQ ID NO: 2005003 - RNA, 18 nt, Shigella flexneri 2a str. 301
ggcucuuuuucggggcug

SEQ ID NO: 2005004 - RNA, 19 nt, Shigella flexneri 2a str. 301
ggcucugauugccuuccac

SEQ ID NO: 2005005 - RNA, 22 nt, Shigella flexneri 2a str. 301
ggcucguuagacggcgcugccg

SEQ ID NO: 2005006 - RNA, 12 nt, Shigella flexneri 2a str. 301
ggcucucagccg

SEQ ID NO: 2005007 - RNA, 13 nt, Shigella flexneri 2a str. 301
ggcucucgccagc

SEQ ID NO: 2005008 - RNA, 21 nt, Shigella flexneri 2a str. 301
ggcugacugucgcagccagcg

SEQ ID NO: 2005009 - RNA, 19 nt, Shigella flexneri 2a str. 301
ggcugacguuaagaaaacg

SEQ ID NO: 2005010 - RNA, 22 nt, Shigella flexneri 2a str. 301
ggcugacugcuuugcacaggca

SEQ ID NO: 2005011 - RNA, 18 nt, Shigella flexneri 2a str. 301
ggcugacauuaucagaca

SEQ ID NO: 2005012 - RNA, 17 nt, Shigella flexneri 2a str. 301
ggcugcagaauacggau

SEQ ID NO: 2005013 - RNA, 20 nt, Shigella flexneri 2a str. 301
ggcugauaaaguguucucca

SEQ ID NO: 2005014 - RNA, 23 nt, Shigella flexneri 2a str. 301
ggcugaugccgguuuuacagaau

SEQ ID NO: 2005015 - RNA, 23 nt, Shigella flexneri 2a str. 301
ggcugcgggaguugcuccacugc

SEQ ID NO: 2005016 - RNA, 20 nt, Shigella flexneri 2a str. 301
ggcugccggaaggcagccuu

SEQ ID NO: 2005017 - RNA, 20 nt, Shigella flexneri 2a str. 301
ggcuggcggcaaucgccaga

SEQ ID NO: 2005018 - RNA, 20 nt, Shigella flexneri 2a str. 301
ggcuggccccgucagcaaaa

SEQ ID NO: 2005019 - RNA, 20 nt, Shigella flexneri 2a str. 301
ggcuggcucguugcgccggg

SEQ ID NO: 2005020 - RNA, 17 nt, Shigella flexneri 2a str. 301
ggcuggcaagcugcugu

SEQ ID NO: 2005021 - RNA, 21 nt, Shigella flexneri 2a str. 301
ggcuggcauuuuuuauggugg

SEQ ID NO: 2005022 - RNA, 18 nt, Shigella flexneri 2a str. 301
ggcugguuuucagcgaaa

SEQ ID NO: 2005023 - RNA, 18 nt, Shigella flexneri 2a str. 301
ggcugugggguauuucca

SEQ ID NO: 2005024 - RNA, 15 nt, Shigella flexneri 2a str. 301
ggcuguaauucagua

SEQ ID NO: 2005025 - RNA, 20 nt, Shigella flexneri 2a str. 301
ggcuguugauguccaguucc

SEQ ID NO: 2005026 - RNA, 18 nt, Shigella flexneri 2a str. 301
ggcuguuaucccagcagu

SEQ ID NO: 2005027 - RNA, 19 nt, Shigella flexneri 2a str. 301
ggcuguucaccacugaaua

SEQ ID NO: 2005028 - RNA, 20 nt, Shigella flexneri 2a str. 301
ggcuguucccacgcacagaa

SEQ ID NO: 2005029 - RNA, 16 nt, Shigella flexneri 2a str. 301
ggcuuaccaaauaaac

SEQ ID NO: 2005030 - RNA, 18 nt, Shigella flexneri 2a str. 301
ggcuucgacgauugcuuu

SEQ ID NO: 2005031 - RNA, 15 nt, Shigella flexneri 2a str. 301
ggcuucguccaugcu

SEQ ID NO: 2005032 - RNA, 12 nt, Shigella flexneri 2a str. 301
ggcuuggcuggc

SEQ ID NO: 2005033 - RNA, 19 nt, Shigella flexneri 2a str. 301
ggcuuuuuuacaucaucag

SEQ ID NO: 2005034 - RNA, 18 nt, Shigella flexneri 2a str. 301
ggcuuuuuuacaucauca

SEQ ID NO: 2005035 - RNA, 20 nt, Shigella flexneri 2a str. 301
ggcuuuaauaccugccuggu

SEQ ID NO: 2005036 - RNA, 16 nt, Shigella flexneri 2a str. 301
ggcuugugcgcccggc

SEQ ID NO: 2005037 - RNA, 18 nt, Shigella flexneri 2a str. 301
ggcuuuuuaugacgcugg

SEQ ID NO: 2005038 - RNA, 13 nt, Shigella flexneri 2a str. 301
ggcuuuaaucacc

SEQ ID NO: 2005039 - RNA, 21 nt, Shigella flexneri 2a str. 301
gggcguagacauauaacccca

SEQ ID NO: 2005040 - RNA, 21 nt, Shigella flexneri 2a str. 301
gggcuggaaacgcgaucgcca

SEQ ID NO: 2005041 - RNA, 21 nt, Shigella flexneri 2a str. 301
gggcuggcaaauucaggagca

SEQ ID NO: 2005042 - RNA, 22 nt, Shigella flexneri 2a str. 301
gggcuuuucagaaauuuggcuc

SEQ ID NO: 2005043 - RNA, 18 nt, Shigella flexneri 2a str. 301
gggcuuuauucaccagua

SEQ ID NO: 2005044 - RNA, 17 nt, Shigella flexneri 2a str. 301
gggcgacaaucaucgcc

SEQ ID NO: 2005045 - RNA, 14 nt, Shigella flexneri 2a str. 301
gggcgacauuuagu

SEQ ID NO: 2005046 - RNA, 14 nt, Shigella flexneri 2a str. 301
gggcgauuuccuuc

SEQ ID NO: 2005047 - RNA, 14 nt, Shigella flexneri 2a str. 301
gggcgauuuugcuu

SEQ ID NO: 2005048 - RNA, 13 nt, Shigella flexneri 2a str. 301
gggcgauccggca

SEQ ID NO: 2005049 - RNA, 13 nt, Shigella flexneri 2a str. 301
gggaacaucaggc

SEQ ID NO: 2005050 - RNA, 15 nt, Shigella flexneri 2a str. 301
gggaaaucaccacca

SEQ ID NO: 2005051 - RNA, 20 nt, Shigella flexneri 2a str. 301
gggaacaauugagauucaaa

SEQ ID NO: 2005052 - RNA, 13 nt, Shigella flexneri 2a str. 301
gggaacagaccag

SEQ ID NO: 2005053 - RNA, 22 nt, Shigella flexneri 2a str. 301
gggaaauuaaaugguuaacaug

SEQ ID NO: 2005054 - RNA, 13 nt, Shigella flexneri 2a str. 301
gggaguccacaac

SEQ ID NO: 2005055 - RNA, 15 nt, Shigella flexneri 2a str. 301
gggaggggcuuuccc

SEQ ID NO: 2005056 - RNA, 19 nt, Shigella flexneri 2a str. 301
gggaugccgaaaaaaguca

SEQ ID NO: 2005057 - RNA, 21 nt, Shigella flexneri 2a str. 301
gggauggcguagcagcagcga

SEQ ID NO: 2005058 - RNA, 22 nt, Shigella flexneri 2a str. 301
gggcaauuucacguucacccau

SEQ ID NO: 2005059 - RNA, 14 nt, Shigella flexneri 2a str. 301
gggcaccgccgccg

SEQ ID NO: 2005060 - RNA, 22 nt, Shigella flexneri 2a str. 301
gggaucugauucugauccugca

SEQ ID NO: 2005061 - RNA, 19 nt, Shigella flexneri 2a str. 301
gggaucucuuccagugccu

SEQ ID NO: 2005062 - RNA, 15 nt, Shigella flexneri 2a str. 301
gggaugaaaggcaag

SEQ ID NO: 2005063 - RNA, 17 nt, Shigella flexneri 2a str. 301
gggaugaaaggcaagca

SEQ ID NO: 2005064 - RNA, 15 nt, Shigella flexneri 2a str. 301
gggauaaagcccccg

SEQ ID NO: 2005065 - RNA, 19 nt, Shigella flexneri 2a str. 301
gggauaaagcccccgcaac

SEQ ID NO: 2005066 - RNA, 19 nt, Shigella flexneri 2a str. 301
gggauagaaacagucugga

SEQ ID NO: 2005067 - RNA, 13 nt, Shigella flexneri 2a str. 301
gggccaauaccug

SEQ ID NO: 2005068 - RNA, 18 nt, Shigella flexneri 2a str. 301
gggcauguguuagcccug

SEQ ID NO: 2005069 - RNA, 21 nt, Shigella flexneri 2a str. 301
gggcauuuccauuuuugacua

SEQ ID NO: 2005070 - RNA, 22 nt, Shigella flexneri 2a str. 301
gggcauuuucaagugacauacu

SEQ ID NO: 2005071 - RNA, 23 nt, Shigella flexneri 2a str. 301
gggcaggcuucaacacaggccgg

SEQ ID NO: 2005072 - RNA, 19 nt, Shigella flexneri 2a str. 301
gggcauguguuagcccugu

SEQ ID NO: 2005073 - RNA, 22 nt, Shigella flexneri 2a str. 301
gggcauucaugaacacacccgg

SEQ ID NO: 2005074 - RNA, 18 nt, Shigella flexneri 2a str. 301
gggcauggugucaccacc

SEQ ID NO: 2005075 - RNA, 14 nt, Shigella flexneri 2a str. 301
gggcaucagcagca

SEQ ID NO: 2005076 - RNA, 12 nt, Shigella flexneri 2a str. 301
gggugagcagaa

SEQ ID NO: 2005077 - RNA, 19 nt, Shigella flexneri 2a str. 301
gggucuuccagcaaaucca

SEQ ID NO: 2005078 - RNA, 13 nt, Shigella flexneri 2a str. 301
gggucaguaugga

SEQ ID NO: 2005079 - RNA, 21 nt, Shigella flexneri 2a str. 301
gggucauccaggaacuccaga

SEQ ID NO: 2005080 - RNA, 17 nt, Shigella flexneri 2a str. 301
ggguucaaaaacuaauu

SEQ ID NO: 2005081 - RNA, 17 nt, Shigella flexneri 2a str. 301
ggguucaaguccccccc

SEQ ID NO: 2005082 - RNA, 18 nt, Shigella flexneri 2a str. 301
ggguuuuucgcgcgggca

SEQ ID NO: 2005083 - RNA, 17 nt, Shigella flexneri 2a str. 301
gguaaacaacaugcuau

SEQ ID NO: 2005084 - RNA, 20 nt, Shigella flexneri 2a str. 301
gguaaacaccuucauccagc

SEQ ID NO: 2005085 - RNA, 21 nt, Shigella flexneri 2a str. 301
gguaaaauggucagccagcgg

SEQ ID NO: 2005086 - RNA, 12 nt, Shigella flexneri 2a str. 301
gguaaacaacau

SEQ ID NO: 2005087 - RNA, 21 nt, Shigella flexneri 2a str. 301
gguaaaaccugacaacaaaac

SEQ ID NO: 2005088 - RNA, 16 nt, Shigella flexneri 2a str. 301
gguaaaaccaugccau

SEQ ID NO: 2005089 - RNA, 15 nt, Shigella flexneri 2a str. 301
gguaaagcccucacc

SEQ ID NO: 2005090 - RNA, 15 nt, Shigella flexneri 2a str. 301
gguaaagccgugcug

SEQ ID NO: 2005091 - RNA, 11 nt, Shigella flexneri 2a str. 301
gguaaauuguu

SEQ ID NO: 2005092 - RNA, 20 nt, Shigella flexneri 2a str. 301
gguaagggaggauuucuccc

SEQ ID NO: 2005093 - RNA, 14 nt, Shigella flexneri 2a str. 301
gguaaggugauuag

SEQ ID NO: 2005094 - RNA, 21 nt, Shigella flexneri 2a str. 301
gguaacgauacggcccagacc

SEQ ID NO: 2005095 - RNA, 15 nt, Shigella flexneri 2a str. 301
gguagagguuauaaa

SEQ ID NO: 2005096 - RNA, 23 nt, Shigella flexneri 2a str. 301
gguagagguuauaaauaaaaauu

SEQ ID NO: 2005097 - RNA, 14 nt, Shigella flexneri 2a str. 301
gguagacgcgcuag

SEQ ID NO: 2005098 - RNA, 22 nt, Shigella flexneri 2a str. 301
gguagacgcgcuagccucaggu

SEQ ID NO: 2005099 - RNA, 22 nt, Shigella flexneri 2a str. 301
gguagacaccaaggaacugugc

SEQ ID NO: 2005100 - RNA, 17 nt, Shigella flexneri 2a str. 301
gguacgacuuccuggcu

SEQ ID NO: 2005101 - RNA, 22 nt, Shigella flexneri 2a str. 301
gguaccguugaccaguccggcu

SEQ ID NO: 2005102 - RNA, 16 nt, Shigella flexneri 2a str. 301
gguacaaagccaacag

SEQ ID NO: 2005103 - RNA, 12 nt, Shigella flexneri 2a str. 301
gguacaaccgca

SEQ ID NO: 2005104 - RNA, 14 nt, Shigella flexneri 2a str. 301
gguacaaacaucau

SEQ ID NO: 2005105 - RNA, 17 nt, Shigella flexneri 2a str. 301
gguacaaacaucaucca

SEQ ID NO: 2005106 - RNA, 15 nt, Shigella flexneri 2a str. 301
gguaauaggcaggca

SEQ ID NO: 2005107 - RNA, 17 nt, Shigella flexneri 2a str. 301
gguaauaaugcagaucu

SEQ ID NO: 2005108 - RNA, 16 nt, Shigella flexneri 2a str. 301
gguaauggcaauacug

SEQ ID NO: 2005109 - RNA, 23 nt, Shigella flexneri 2a str. 301
gguaaugcgauuuucauccugca

SEQ ID NO: 2005110 - RNA, 16 nt, Shigella flexneri 2a str. 301
gguagucgcgguccgg

SEQ ID NO: 2005111 - RNA, 18 nt, Shigella flexneri 2a str. 301
gguagugccgucagcagg

SEQ ID NO: 2005112 - RNA, 13 nt, Shigella flexneri 2a str. 301
gguaguuucuccc

SEQ ID NO: 2005113 - RNA, 17 nt, Shigella flexneri 2a str. 301
gguaucgcacagaugcg

SEQ ID NO: 2005114 - RNA, 20 nt, Shigella flexneri 2a str. 301
gguagauuauuucgcugcgg

SEQ ID NO: 2005115 - RNA, 15 nt, Shigella flexneri 2a str. 301
gguagggauaucuuc

SEQ ID NO: 2005116 - RNA, 16 nt, Shigella flexneri 2a str. 301
gguauuaaucugccag

SEQ ID NO: 2005117 - RNA, 21 nt, Shigella flexneri 2a str. 301
gguaucuucccagccaaugca

SEQ ID NO: 2005118 - RNA, 23 nt, Shigella flexneri 2a str. 301
ggucagccacaguugaucagcca

SEQ ID NO: 2005119 - RNA, 20 nt, Shigella flexneri 2a str. 301
ggugucguauucucaauaaa

SEQ ID NO: 2005120 - RNA, 22 nt, Shigella flexneri 2a str. 301
ggugcucaucagcccggcaaug

SEQ ID NO: 2005121 - RNA, 15 nt, Shigella flexneri 2a str. 301
ggugcguugaagaua

SEQ ID NO: 2005122 - RNA, 19 nt, Shigella flexneri 2a str. 301
ggugcguaccaggcgugga

SEQ ID NO: 2005123 - RNA, 13 nt, Shigella flexneri 2a str. 301
gguggcgagagcc

SEQ ID NO: 2005124 - RNA, 11 nt, Shigella flexneri 2a str. 301
gguggcggcgc

SEQ ID NO: 2005125 - RNA, 22 nt, Shigella flexneri 2a str. 301
ggugcagacaugacgcccggca

SEQ ID NO: 2005126 - RNA, 22 nt, Shigella flexneri 2a str. 301
ggugcaagaaaugacagaguuc

SEQ ID NO: 2005127 - RNA, 12 nt, Shigella flexneri 2a str. 301
ggugcaaucaaa

SEQ ID NO: 2005128 - RNA, 14 nt, Shigella flexneri 2a str. 301
ggugcagccggagc

SEQ ID NO: 2005129 - RNA, 18 nt, Shigella flexneri 2a str. 301
ggugcgaccaaacugcuc

SEQ ID NO: 2005130 - RNA, 16 nt, Shigella flexneri 2a str. 301
ggucgccagaagguga

SEQ ID NO: 2005131 - RNA, 16 nt, Shigella flexneri 2a str. 301
ggucgcaucauuuaaa

SEQ ID NO: 2005132 - RNA, 14 nt, Shigella flexneri 2a str. 301
ggucagcggccagu

SEQ ID NO: 2005133 - RNA, 21 nt, Shigella flexneri 2a str. 301
ggucagcuucaccuuccagua

SEQ ID NO: 2005134 - RNA, 12 nt, Shigella flexneri 2a str. 301
gguccuucaggc

SEQ ID NO: 2005135 - RNA, 14 nt, Shigella flexneri 2a str. 301
ggucgacagcagcc

SEQ ID NO: 2005136 - RNA, 22 nt, Shigella flexneri 2a str. 301
ggucgacgaugggucacuguga

SEQ ID NO: 2005137 - RNA, 18 nt, Shigella flexneri 2a str. 301
ggugaaaguaacaaagcc

SEQ ID NO: 2005138 - RNA, 22 nt, Shigella flexneri 2a str. 301
ggugaaaguaacaaagccugca

SEQ ID NO: 2005139 - RNA, 13 nt, Shigella flexneri 2a str. 301
ggugaaccagaga

SEQ ID NO: 2005140 - RNA, 20 nt, Shigella flexneri 2a str. 301
ggugaacucacacagcgagu

SEQ ID NO: 2005141 - RNA, 18 nt, Shigella flexneri 2a str. 301
ggugaccuguaacguugc

SEQ ID NO: 2005142 - RNA, 20 nt, Shigella flexneri 2a str. 301
ggugauaaucaucccacaug

SEQ ID NO: 2005143 - RNA, 17 nt, Shigella flexneri 2a str. 301
ggugaucaccaguaaca

SEQ ID NO: 2005144 - RNA, 17 nt, Shigella flexneri 2a str. 301
ggugaaaguaaaaaaga

SEQ ID NO: 2005145 - RNA, 12 nt, Shigella flexneri 2a str. 301
ggugaaaaaaag

SEQ ID NO: 2005146 - RNA, 20 nt, Shigella flexneri 2a str. 301
ggucuuuuaaauccugcaca

SEQ ID NO: 2005147 - RNA, 13 nt, Shigella flexneri 2a str. 301
ggucgugcagaac

SEQ ID NO: 2005148 - RNA, 23 nt, Shigella flexneri 2a str. 301
guaagcgauaaaaauaccgagca

SEQ ID NO: 2005149 - RNA, 21 nt, Shigella flexneri 2a str. 301
guaagcgcggauuuuauucag

SEQ ID NO: 2005150 - RNA, 20 nt, Shigella flexneri 2a str. 301
guaagcgcguguuacuggaa

SEQ ID NO: 2005151 - RNA, 18 nt, Shigella flexneri 2a str. 301
guaagccuuucaggaaac

SEQ ID NO: 2005152 - RNA, 20 nt, Shigella flexneri 2a str. 301
guaagcagaaaagccaauga

SEQ ID NO: 2005153 - RNA, 15 nt, Shigella flexneri 2a str. 301
guaagcaggguugca

SEQ ID NO: 2005154 - RNA, 12 nt, Shigella flexneri 2a str. 301
guaaguaaugac

SEQ ID NO: 2005155 - RNA, 13 nt, Shigella flexneri 2a str. 301
guaaggucaucaa

SEQ ID NO: 2005156 - RNA, 14 nt, Shigella flexneri 2a str. 301
guaaguaagauaaa

SEQ ID NO: 2005157 - RNA, 18 nt, Shigella flexneri 2a str. 301
guaagggaggauuucucc

SEQ ID NO: 2005158 - RNA, 14 nt, Shigella flexneri 2a str. 301
guaaggcaucuucu

SEQ ID NO: 2005159 - RNA, 17 nt, Shigella flexneri 2a str. 301
guaaggcaucuucuuca

SEQ ID NO: 2005160 - RNA, 16 nt, Shigella flexneri 2a str. 301
guaaggcuucaaucaa

SEQ ID NO: 2005161 - RNA, 22 nt, Shigella flexneri 2a str. 301
guaauauuucucggcaaauuca

SEQ ID NO: 2005162 - RNA, 22 nt, Shigella flexneri 2a str. 301
guaauaugugcgccacgcagcg

SEQ ID NO: 2005163 - RNA, 15 nt, Shigella flexneri 2a str. 301
guaaucgacaacgca

SEQ ID NO: 2005164 - RNA, 15 nt, Shigella flexneri 2a str. 301
guaauaacuuccuga

SEQ ID NO: 2005165 - RNA, 20 nt, Shigella flexneri 2a str. 301
guaauagauccuuuuuccca

SEQ ID NO: 2005166 - RNA, 13 nt, Shigella flexneri 2a str. 301
guaauaacucacc

SEQ ID NO: 2005167 - RNA, 21 nt, Shigella flexneri 2a str. 301
guaauaacucacccaugaaga

SEQ ID NO: 2005168 - RNA, 19 nt, Shigella flexneri 2a str. 301
guaauaaagcccccuguuu

SEQ ID NO: 2005169 - RNA, 16 nt, Shigella flexneri 2a str. 301
guaauaaaaucuauua

SEQ ID NO: 2005170 - RNA, 19 nt, Shigella flexneri 2a str. 301
guaauaaaaucuauuauua

SEQ ID NO: 2005171 - RNA, 13 nt, Shigella flexneri 2a str. 301
guaaguccauacu

SEQ ID NO: 2005172 - RNA, 16 nt, Shigella flexneri 2a str. 301
guaagagaacagauag

SEQ ID NO: 2005173 - RNA, 21 nt, Shigella flexneri 2a str. 301
guaagaguuucaacaucaucu

SEQ ID NO: 2005174 - RNA, 16 nt, Shigella flexneri 2a str. 301
guaacugagcggccag

SEQ ID NO: 2005175 - RNA, 17 nt, Shigella flexneri 2a str. 301
guaacuuaucuguaauu

SEQ ID NO: 2005176 - RNA, 21 nt, Shigella flexneri 2a str. 301
guaacugucuucaccauaguu

SEQ ID NO: 2005177 - RNA, 16 nt, Shigella flexneri 2a str. 301
guaacguaaucuucau

SEQ ID NO: 2005178 - RNA, 15 nt, Shigella flexneri 2a str. 301
guaacucauugccag

SEQ ID NO: 2005179 - RNA, 20 nt, Shigella flexneri 2a str. 301
guaacgccuuuuccagcgcg

SEQ ID NO: 2005180 - RNA, 13 nt, Shigella flexneri 2a str. 301
guaacgacugcgg

SEQ ID NO: 2005181 - RNA, 18 nt, Shigella flexneri 2a str. 301
guaacgagacaaugcaaa

SEQ ID NO: 2005182 - RNA, 16 nt, Shigella flexneri 2a str. 301
guaacgaugcaugaca

SEQ ID NO: 2005183 - RNA, 16 nt, Shigella flexneri 2a str. 301
guaacgaccaccaccg

SEQ ID NO: 2005184 - RNA, 12 nt, Shigella flexneri 2a str. 301
guaaccuucacc

SEQ ID NO: 2005185 - RNA, 16 nt, Shigella flexneri 2a str. 301
guaaccggaaauaaac

SEQ ID NO: 2005186 - RNA, 18 nt, Shigella flexneri 2a str. 301
guaaccggaaauaaacuu

SEQ ID NO: 2005187 - RNA, 14 nt, Shigella flexneri 2a str. 301
guaaccacgcagcg

SEQ ID NO: 2005188 - RNA, 22 nt, Shigella flexneri 2a str. 301
guaacauccagaucacgcagca

SEQ ID NO: 2005189 - RNA, 14 nt, Shigella flexneri 2a str. 301
guaacaucccugua

SEQ ID NO: 2005190 - RNA, 22 nt, Shigella flexneri 2a str. 301
guaaccaaaagcugggauggca

SEQ ID NO: 2005191 - RNA, 15 nt, Shigella flexneri 2a str. 301
guaaagcugcgcagg

SEQ ID NO: 2005192 - RNA, 22 nt, Shigella flexneri 2a str. 301
guaaagcugcgcaggaugcuaa

SEQ ID NO: 2005193 - RNA, 19 nt, Shigella flexneri 2a str. 301
guaaagcgcgucaccaccu

SEQ ID NO: 2005194 - RNA, 22 nt, Shigella flexneri 2a str. 301
guaaaggcggcagaacagaaca

SEQ ID NO: 2005195 - RNA, 14 nt, Shigella flexneri 2a str. 301
guaaaggcggcaga

SEQ ID NO: 2005196 - RNA, 18 nt, Shigella flexneri 2a str. 301
guaaaggcggcagaacag

SEQ ID NO: 2005197 - RNA, 17 nt, Shigella flexneri 2a str. 301
guaaauaaaccaccugg

SEQ ID NO: 2005198 - RNA, 18 nt, Shigella flexneri 2a str. 301
guaaauacgccccacaga

SEQ ID NO: 2005199 - RNA, 23 nt, Shigella flexneri 2a str. 301
guaaauauggcgaacuggucugc

SEQ ID NO: 2005200 - RNA, 20 nt, Shigella flexneri 2a str. 301
guaaaucugucagguaacaa

SEQ ID NO: 2005201 - RNA, 12 nt, Shigella flexneri 2a str. 301
guaaaucaccag

SEQ ID NO: 2005202 - RNA, 16 nt, Shigella flexneri 2a str. 301
guaacauacuccaccc

SEQ ID NO: 2005203 - RNA, 22 nt, Shigella flexneri 2a str. 301
guaacagugcaccggacacugc

SEQ ID NO: 2005204 - RNA, 16 nt, Shigella flexneri 2a str. 301
guaacagucaguuauc

SEQ ID NO: 2005205 - RNA, 16 nt, Shigella flexneri 2a str. 301
guaacagagcaucggu

SEQ ID NO: 2005206 - RNA, 16 nt, Shigella flexneri 2a str. 301
guaacaauauuugcag

SEQ ID NO: 2005207 - RNA, 13 nt, Shigella flexneri 2a str. 301
guaacaaaacuca

SEQ ID NO: 2005208 - RNA, 17 nt, Shigella flexneri 2a str. 301
guaacaaagccugcacc

SEQ ID NO: 2005209 - RNA, 15 nt, Shigella flexneri 2a str. 301
guaaauugcagcaca

SEQ ID NO: 2005210 - RNA, 13 nt, Shigella flexneri 2a str. 301
guaaaugaacuca

SEQ ID NO: 2005211 - RNA, 22 nt, Shigella flexneri 2a str. 301
guaaaugccgacuuuguuuuua

SEQ ID NO: 2005212 - RNA, 14 nt, Shigella flexneri 2a str. 301
guaaaugagcguuu

SEQ ID NO: 2005213 - RNA, 15 nt, Shigella flexneri 2a str. 301
guaaauggcugacca

SEQ ID NO: 2005214 - RNA, 16 nt, Shigella flexneri 2a str. 301
guaaaccgcucgucac

SEQ ID NO: 2005215 - RNA, 20 nt, Shigella flexneri 2a str. 301
guaaaccaccaguccuucua

SEQ ID NO: 2005216 - RNA, 18 nt, Shigella flexneri 2a str. 301
guaaaccacccaccagcg

SEQ ID NO: 2005217 - RNA, 17 nt, Shigella flexneri 2a str. 301
guaaacgccgagcugga

SEQ ID NO: 2005218 - RNA, 20 nt, Shigella flexneri 2a str. 301
gguuaacaaucacaauagaa

SEQ ID NO: 2005219 - RNA, 17 nt, Shigella flexneri 2a str. 301
gguuaaccuuuaaucag

SEQ ID NO: 2005220 - RNA, 17 nt, Shigella flexneri 2a str. 301
guaaaauaacagcggca

SEQ ID NO: 2005221 - RNA, 15 nt, Shigella flexneri 2a str. 301
guaaaaggauguuua

SEQ ID NO: 2005222 - RNA, 13 nt, Shigella flexneri 2a str. 301
guaaaaggucuga

SEQ ID NO: 2005223 - RNA, 18 nt, Shigella flexneri 2a str. 301
guaaaaggucugaaagau

SEQ ID NO: 2005224 - RNA, 16 nt, Shigella flexneri 2a str. 301
gguuaaaaacauuuuc

SEQ ID NO: 2005225 - RNA, 13 nt, Shigella flexneri 2a str. 301
gguuaaaaacagc

SEQ ID NO: 2005226 - RNA, 11 nt, Shigella flexneri 2a str. 301
guaaacaacau

SEQ ID NO: 2005227 - RNA, 23 nt, Shigella flexneri 2a str. 301
guaaaauuuggguguaucuucag

SEQ ID NO: 2005228 - RNA, 22 nt, Shigella flexneri 2a str. 301
guaaaauucuacagaaaugaaa

SEQ ID NO: 2005229 - RNA, 22 nt, Shigella flexneri 2a str. 301
guaaaaucuucacuaaaaucau

SEQ ID NO: 2005230 - RNA, 14 nt, Shigella flexneri 2a str. 301
guaaucgccagcaa

SEQ ID NO: 2005231 - RNA, 22 nt, Shigella flexneri 2a str. 301
guaaucgcccgcuuccagcgca

SEQ ID NO: 2005232 - RNA, 18 nt, Shigella flexneri 2a str. 301
guaccaaccgcaauugcu

SEQ ID NO: 2005233 - RNA, 15 nt, Shigella flexneri 2a str. 301
guacauuguuuucca

SEQ ID NO: 2005234 - RNA, 16 nt, Shigella flexneri 2a str. 301
guacauggugcacauu

SEQ ID NO: 2005235 - RNA, 19 nt, Shigella flexneri 2a str. 301
guaauguucccugcgccag

SEQ ID NO: 2005236 - RNA, 12 nt, Shigella flexneri 2a str. 301
guaauggucagu

SEQ ID NO: 2005237 - RNA, 15 nt, Shigella flexneri 2a str. 301
guaaugggaucgaaa

SEQ ID NO: 2005238 - RNA, 21 nt, Shigella flexneri 2a str. 301
guaaugucggugaaaguaacu

SEQ ID NO: 2005239 - RNA, 14 nt, Shigella flexneri 2a str. 301
guaccaucgccagc

SEQ ID NO: 2005240 - RNA, 17 nt, Shigella flexneri 2a str. 301
guaccaugauccugcaa

SEQ ID NO: 2005241 - RNA, 13 nt, Shigella flexneri 2a str. 301
guaccaucuucac

SEQ ID NO: 2005242 - RNA, 23 nt, Shigella flexneri 2a str. 301
guaccauuaaucgauaaaccagc

SEQ ID NO: 2005243 - RNA, 14 nt, Shigella flexneri 2a str. 301
guacccaucaacaa

SEQ ID NO: 2005244 - RNA, 18 nt, Shigella flexneri 2a str. 301
guacccggccuguuuauc

SEQ ID NO: 2005245 - RNA, 12 nt, Shigella flexneri 2a str. 301
guacccgcuggc

SEQ ID NO: 2005246 - RNA, 17 nt, Shigella flexneri 2a str. 301
guaccgccagcaggaac

SEQ ID NO: 2005247 - RNA, 20 nt, Shigella flexneri 2a str. 301
guaccgccgccauaaacagc

SEQ ID NO: 2005248 - RNA, 18 nt, Shigella flexneri 2a str. 301
guaccggacccuggucag

SEQ ID NO: 2005249 - RNA, 21 nt, Shigella flexneri 2a str. 301
guaccggacaugauuacugca

SEQ ID NO: 2005250 - RNA, 13 nt, Shigella flexneri 2a str. 301
guacuguuucacu

SEQ ID NO: 2005251 - RNA, 23 nt, Shigella flexneri 2a str. 301
guacuguuucacuguugaagccg

SEQ ID NO: 2005252 - RNA, 21 nt, Shigella flexneri 2a str. 301
guacuucaugaguuccacugg

SEQ ID NO: 2005253 - RNA, 18 nt, Shigella flexneri 2a str. 301
guacuccaucucgccauc

SEQ ID NO: 2005254 - RNA, 21 nt, Shigella flexneri 2a str. 301
guacucccgaggaucacaaug

SEQ ID NO: 2005255 - RNA, 14 nt, Shigella flexneri 2a str. 301
guacuggcagggau

SEQ ID NO: 2005256 - RNA, 19 nt, Shigella flexneri 2a str. 301
guacuggcgugggcaucga

SEQ ID NO: 2005257 - RNA, 13 nt, Shigella flexneri 2a str. 301
guagagcagcacg

SEQ ID NO: 2005258 - RNA, 19 nt, Shigella flexneri 2a str. 301
guagaccugauacauagca

SEQ ID NO: 2005259 - RNA, 20 nt, Shigella flexneri 2a str. 301
guagacgagccguuccuaac

SEQ ID NO: 2005260 - RNA, 13 nt, Shigella flexneri 2a str. 301
guagacugcagcg

SEQ ID NO: 2005261 - RNA, 14 nt, Shigella flexneri 2a str. 301
guacuccagcagac

SEQ ID NO: 2005262 - RNA, 13 nt, Shigella flexneri 2a str. 301
guacuccagcaga

SEQ ID NO: 2005263 - RNA, 20 nt, Shigella flexneri 2a str. 301
guacucaccagacaucccag

SEQ ID NO: 2005264 - RNA, 15 nt, Shigella flexneri 2a str. 301
guacucaccgcucac

SEQ ID NO: 2005265 - RNA, 19 nt, Shigella flexneri 2a str. 301
guacgguacugaaaccuga

SEQ ID NO: 2005266 - RNA, 14 nt, Shigella flexneri 2a str. 301
guacgggucgggcu

SEQ ID NO: 2005267 - RNA, 18 nt, Shigella flexneri 2a str. 301
guaccuccuucacagugg

SEQ ID NO: 2005268 - RNA, 14 nt, Shigella flexneri 2a str. 301
guaccguugcugcc

SEQ ID NO: 2005269 - RNA, 15 nt, Shigella flexneri 2a str. 301
guaccgugcagcgca

SEQ ID NO: 2005270 - RNA, 17 nt, Shigella flexneri 2a str. 301
guaccucuucgcuggca

SEQ ID NO: 2005271 - RNA, 22 nt, Shigella flexneri 2a str. 301
guaggcgcguuucugcgcuucu

SEQ ID NO: 2005272 - RNA, 17 nt, Shigella flexneri 2a str. 301
guaggucgccacaccgg

SEQ ID NO: 2005273 - RNA, 14 nt, Shigella flexneri 2a str. 301
guagcucuggguaa

SEQ ID NO: 2005274 - RNA, 20 nt, Shigella flexneri 2a str. 301
guagcucaucuucauaacuu

SEQ ID NO: 2005275 - RNA, 20 nt, Shigella flexneri 2a str. 301
guagcuaccuugcucggcgc

SEQ ID NO: 2005276 - RNA, 14 nt, Shigella flexneri 2a str. 301
guagcucagcugga

SEQ ID NO: 2005277 - RNA, 15 nt, Shigella flexneri 2a str. 301
guagcucaucuucau

SEQ ID NO: 2005278 - RNA, 17 nt, Shigella flexneri 2a str. 301
guagcucaucuucauaa

SEQ ID NO: 2005279 - RNA, 17 nt, Shigella flexneri 2a str. 301
guagcgacgcaaugcca

SEQ ID NO: 2005280 - RNA, 18 nt, Shigella flexneri 2a str. 301
guagaguuugaacucaca

SEQ ID NO: 2005281 - RNA, 22 nt, Shigella flexneri 2a str. 301
guagaucuccauacuuccacua

SEQ ID NO: 2005282 - RNA, 18 nt, Shigella flexneri 2a str. 301
guagugauuuuaauaaau

SEQ ID NO: 2005283 - RNA, 15 nt, Shigella flexneri 2a str. 301
guagugaaggcaaac

SEQ ID NO: 2005284 - RNA, 16 nt, Shigella flexneri 2a str. 301
guaguauuugaguuca

SEQ ID NO: 2005285 - RNA, 11 nt, Shigella flexneri 2a str. 301
guagguuuugg

SEQ ID NO: 2005286 - RNA, 16 nt, Shigella flexneri 2a str. 301
guaguugcccuuuuca

SEQ ID NO: 2005287 - RNA, 14 nt, Shigella flexneri 2a str. 301
guaguugcugucga

SEQ ID NO: 2005288 - RNA, 23 nt, Shigella flexneri 2a str. 301
guaguucuuucucugcaaauauu

SEQ ID NO: 2005289 - RNA, 14 nt, Shigella flexneri 2a str. 301
guaguuccagcaug

SEQ ID NO: 2005290 - RNA, 19 nt, Shigella flexneri 2a str. 301
guaguuaugaaaauaggaa

SEQ ID NO: 2005291 - RNA, 14 nt, Shigella flexneri 2a str. 301
guaguggccacaga

SEQ ID NO: 2005292 - RNA, 17 nt, Shigella flexneri 2a str. 301
guaguuuggcuucgugu

SEQ ID NO: 2005293 - RNA, 21 nt, Shigella flexneri 2a str. 301
guaguuuggugagaacaccaa

SEQ ID NO: 2005294 - RNA, 19 nt, Shigella flexneri 2a str. 301
guauaagagguuuccagcc

SEQ ID NO: 2005295 - RNA, 22 nt, Shigella flexneri 2a str. 301
gucgccccggaacgggagaaac

SEQ ID NO: 2005296 - RNA, 20 nt, Shigella flexneri 2a str. 301
gucgccgcgauaaggucaga

SEQ ID NO: 2005297 - RNA, 17 nt, Shigella flexneri 2a str. 301
gucgccgcgcaaaucca

SEQ ID NO: 2005298 - RNA, 16 nt, Shigella flexneri 2a str. 301
gucgccagucccuuuc

SEQ ID NO: 2005299 - RNA, 13 nt, Shigella flexneri 2a str. 301
gucgccauccaga

SEQ ID NO: 2005300 - RNA, 23 nt, Shigella flexneri 2a str. 301
gucgcauccggcaugaacaaagc

SEQ ID NO: 2005301 - RNA, 18 nt, Shigella flexneri 2a str. 301
gucgcaucaggcaucaug

SEQ ID NO: 2005302 - RNA, 20 nt, Shigella flexneri 2a str. 301
gucgcaucaggcauugugcu

SEQ ID NO: 2005303 - RNA, 20 nt, Shigella flexneri 2a str. 301
gucgcaucuggcauaaacaa

SEQ ID NO: 2005304 - RNA, 16 nt, Shigella flexneri 2a str. 301
gucgccguaccgggug

SEQ ID NO: 2005305 - RNA, 19 nt, Shigella flexneri 2a str. 301
gucgccgggaugcuggggc

SEQ ID NO: 2005306 - RNA, 15 nt, Shigella flexneri 2a str. 301
gucgccgcugguggu

SEQ ID NO: 2005307 - RNA, 15 nt, Shigella flexneri 2a str. 301
gucgcgaauggccug

SEQ ID NO: 2005308 - RNA, 13 nt, Shigella flexneri 2a str. 301
guccuucaggccc

SEQ ID NO: 2005309 - RNA, 21 nt, Shigella flexneri 2a str. 301
guccuucaucuucauccggcu

SEQ ID NO: 2005310 - RNA, 12 nt, Shigella flexneri 2a str. 301
guccuuccaggu

SEQ ID NO: 2005311 - RNA, 18 nt, Shigella flexneri 2a str. 301
guccuucaauaucauuac

SEQ ID NO: 2005312 - RNA, 14 nt, Shigella flexneri 2a str. 301
guccugugacucaa

SEQ ID NO: 2005313 - RNA, 18 nt, Shigella flexneri 2a str. 301
guccuguugaaaaaccag

SEQ ID NO: 2005314 - RNA, 21 nt, Shigella flexneri 2a str. 301
guccuguaaugagaauaauca

SEQ ID NO: 2005315 - RNA, 15 nt, Shigella flexneri 2a str. 301
gucgaggcaaccagc

SEQ ID NO: 2005316 - RNA, 14 nt, Shigella flexneri 2a str. 301
gucgaggcaaccag

SEQ ID NO: 2005317 - RNA, 17 nt, Shigella flexneri 2a str. 301
gucgcaagacgaaaaau

SEQ ID NO: 2005318 - RNA, 20 nt, Shigella flexneri 2a str. 301
gucgcaauacccugacccag

SEQ ID NO: 2005319 - RNA, 14 nt, Shigella flexneri 2a str. 301
gucgcagccagcgc

SEQ ID NO: 2005320 - RNA, 15 nt, Shigella flexneri 2a str. 301
gucgcagccagcgcg

SEQ ID NO: 2005321 - RNA, 13 nt, Shigella flexneri 2a str. 301
gucgcagccagcg

SEQ ID NO: 2005322 - RNA, 16 nt, Shigella flexneri 2a str. 301
gucgcaguagccaugc

SEQ ID NO: 2005323 - RNA, 22 nt, Shigella flexneri 2a str. 301
gucgcagugaagucgggcagaa

SEQ ID NO: 2005324 - RNA, 22 nt, Shigella flexneri 2a str. 301
gucgcaagacgaaaaaugaaua

SEQ ID NO: 2005325 - RNA, 16 nt, Shigella flexneri 2a str. 301
gucgcaaauccgcugu

SEQ ID NO: 2005326 - RNA, 14 nt, Shigella flexneri 2a str. 301
gucgauuucugggu

SEQ ID NO: 2005327 - RNA, 14 nt, Shigella flexneri 2a str. 301
gucgauauaauuga

SEQ ID NO: 2005328 - RNA, 19 nt, Shigella flexneri 2a str. 301
gucgauaucgcugucgcca

SEQ ID NO: 2005329 - RNA, 13 nt, Shigella flexneri 2a str. 301
gucauuaugucug

SEQ ID NO: 2005330 - RNA, 21 nt, Shigella flexneri 2a str. 301
gucauuacccugcaaugaacc

SEQ ID NO: 2005331 - RNA, 22 nt, Shigella flexneri 2a str. 301
gucauuaccugaaaaaacaaau

SEQ ID NO: 2005332 - RNA, 13 nt, Shigella flexneri 2a str. 301
gucauuccuucaa

SEQ ID NO: 2005333 - RNA, 14 nt, Shigella flexneri 2a str. 301
gucauugacgcugg

SEQ ID NO: 2005334 - RNA, 14 nt, Shigella flexneri 2a str. 301
gucauugaccagau

SEQ ID NO: 2005335 - RNA, 21 nt, Shigella flexneri 2a str. 301
gucauuucccaucucaauauu

SEQ ID NO: 2005336 - RNA, 13 nt, Shigella flexneri 2a str. 301
gucauuugagugc

SEQ ID NO: 2005337 - RNA, 14 nt, Shigella flexneri 2a str. 301
gucauuggcagcca

SEQ ID NO: 2005338 - RNA, 20 nt, Shigella flexneri 2a str. 301
guccaaaagguccuucaggc

SEQ ID NO: 2005339 - RNA, 22 nt, Shigella flexneri 2a str. 301
guccaaaagguccuucaggccc

SEQ ID NO: 2005340 - RNA, 21 nt, Shigella flexneri 2a str. 301
guccaucacaaucauccuacc

SEQ ID NO: 2005341 - RNA, 21 nt, Shigella flexneri 2a str. 301
gucauuuugcguguuucagaa

SEQ ID NO: 2005342 - RNA, 18 nt, Shigella flexneri 2a str. 301
guccaaaagguccuucag

SEQ ID NO: 2005343 - RNA, 13 nt, Shigella flexneri 2a str. 301
guccaucggcggc

SEQ ID NO: 2005344 - RNA, 17 nt, Shigella flexneri 2a str. 301
guccccgagcacaugca

SEQ ID NO: 2005345 - RNA, 13 nt, Shigella flexneri 2a str. 301
guccccgagcaca

SEQ ID NO: 2005346 - RNA, 21 nt, Shigella flexneri 2a str. 301
guccccaucaggaaacccgcc

SEQ ID NO: 2005347 - RNA, 18 nt, Shigella flexneri 2a str. 301
guccccaguaaucgggca

SEQ ID NO: 2005348 - RNA, 21 nt, Shigella flexneri 2a str. 301
guccccacaucacuccaucca

SEQ ID NO: 2005349 - RNA, 23 nt, Shigella flexneri 2a str. 301
guccccgagcacaugcagugccg

SEQ ID NO: 2005350 - RNA, 17 nt, Shigella flexneri 2a str. 301
gucccaggcagaagcgc

SEQ ID NO: 2005351 - RNA, 20 nt, Shigella flexneri 2a str. 301
gucccagccuugccagaugu

SEQ ID NO: 2005352 - RNA, 19 nt, Shigella flexneri 2a str. 301
gucccacuggucgcccugg

SEQ ID NO: 2005353 - RNA, 22 nt, Shigella flexneri 2a str. 301
guccgauuaaaaacccugcaga

SEQ ID NO: 2005354 - RNA, 21 nt, Shigella flexneri 2a str. 301
gucccggaacaggcagggcca

SEQ ID NO: 2005355 - RNA, 14 nt, Shigella flexneri 2a str. 301
guccgccauggcuu

SEQ ID NO: 2005356 - RNA, 16 nt, Shigella flexneri 2a str. 301
guccgauuuguucucu

SEQ ID NO: 2005357 - RNA, 18 nt, Shigella flexneri 2a str. 301
guccugagcacuuuucug

SEQ ID NO: 2005358 - RNA, 16 nt, Shigella flexneri 2a str. 301
guccguugaaaaugcu

SEQ ID NO: 2005359 - RNA, 20 nt, Shigella flexneri 2a str. 301
guccuaacaaccauccccaa

SEQ ID NO: 2005360 - RNA, 13 nt, Shigella flexneri 2a str. 301
guauuuuuugcuc

SEQ ID NO: 2005361 - RNA, 14 nt, Shigella flexneri 2a str. 301
guauaccauuucug

SEQ ID NO: 2005362 - RNA, 14 nt, Shigella flexneri 2a str. 301
guauauaaaaaaca

SEQ ID NO: 2005363 - RNA, 21 nt, Shigella flexneri 2a str. 301
guauauaaauguuaagacugg

SEQ ID NO: 2005364 - RNA, 21 nt, Shigella flexneri 2a str. 301
guauaucccugacgaccaaug

SEQ ID NO: 2005365 - RNA, 20 nt, Shigella flexneri 2a str. 301
gucaaugccgucaccagcau

SEQ ID NO: 2005366 - RNA, 15 nt, Shigella flexneri 2a str. 301
gucaaugauuucugc

SEQ ID NO: 2005367 - RNA, 13 nt, Shigella flexneri 2a str. 301
gucaacuccaguu

SEQ ID NO: 2005368 - RNA, 17 nt, Shigella flexneri 2a str. 301
gucaacaguucaugguu

SEQ ID NO: 2005369 - RNA, 14 nt, Shigella flexneri 2a str. 301
gucaacagggcaga

SEQ ID NO: 2005370 - RNA, 16 nt, Shigella flexneri 2a str. 301
gucaaccagccagcgc

SEQ ID NO: 2005371 - RNA, 12 nt, Shigella flexneri 2a str. 301
gucaacagggca

SEQ ID NO: 2005372 - RNA, 17 nt, Shigella flexneri 2a str. 301
gucaaaaucauccgucg

SEQ ID NO: 2005373 - RNA, 13 nt, Shigella flexneri 2a str. 301
gucagagcauuac

SEQ ID NO: 2005374 - RNA, 22 nt, Shigella flexneri 2a str. 301
gucagaucgccccggucaucaa

SEQ ID NO: 2005375 - RNA, 14 nt, Shigella flexneri 2a str. 301
gucagauuucaauc

SEQ ID NO: 2005376 - RNA, 14 nt, Shigella flexneri 2a str. 301
gucagcaacaugcc

SEQ ID NO: 2005377 - RNA, 14 nt, Shigella flexneri 2a str. 301
gucagacuuaagcc

SEQ ID NO: 2005378 - RNA, 18 nt, Shigella flexneri 2a str. 301
gucagagagccagcccca

SEQ ID NO: 2005379 - RNA, 18 nt, Shigella flexneri 2a str. 301
gucagacgaagucaacaa

SEQ ID NO: 2005380 - RNA, 23 nt, Shigella flexneri 2a str. 301
gucagaaaaaucaauauuuucaa

SEQ ID NO: 2005381 - RNA, 22 nt, Shigella flexneri 2a str. 301
gucagaaacaguuguaaaguac

SEQ ID NO: 2005382 - RNA, 16 nt, Shigella flexneri 2a str. 301
gucagaccaaaacgcg

SEQ ID NO: 2005383 - RNA, 20 nt, Shigella flexneri 2a str. 301
gucagaccaccgguuuuauc

SEQ ID NO: 2005384 - RNA, 22 nt, Shigella flexneri 2a str. 301
gucacuuuuggugcuuuugcug

SEQ ID NO: 2005385 - RNA, 13 nt, Shigella flexneri 2a str. 301
gucacuggcagga

SEQ ID NO: 2005386 - RNA, 18 nt, Shigella flexneri 2a str. 301
gucacuggcaggauaaac

SEQ ID NO: 2005387 - RNA, 15 nt, Shigella flexneri 2a str. 301
gucacuggcgcagac

SEQ ID NO: 2005388 - RNA, 18 nt, Shigella flexneri 2a str. 301
gucacugauagugcugcc

SEQ ID NO: 2005389 - RNA, 15 nt, Shigella flexneri 2a str. 301
gucacggaaucccgu

SEQ ID NO: 2005390 - RNA, 15 nt, Shigella flexneri 2a str. 301
gucacgucauccccc

SEQ ID NO: 2005391 - RNA, 13 nt, Shigella flexneri 2a str. 301
gucagcugcuguu

SEQ ID NO: 2005392 - RNA, 15 nt, Shigella flexneri 2a str. 301
gucagcucauccagc

SEQ ID NO: 2005393 - RNA, 18 nt, Shigella flexneri 2a str. 301
gucagcucacaaauacgc

SEQ ID NO: 2005394 - RNA, 14 nt, Shigella flexneri 2a str. 301
gucagcucacaaau

SEQ ID NO: 2005395 - RNA, 17 nt, Shigella flexneri 2a str. 301
gucagcuucaccuucca

SEQ ID NO: 2005396 - RNA, 15 nt, Shigella flexneri 2a str. 301
gucaggcaaccgcug

SEQ ID NO: 2005397 - RNA, 21 nt, Shigella flexneri 2a str. 301
gucaggcaaccgcugagcgau

SEQ ID NO: 2005398 - RNA, 23 nt, Shigella flexneri 2a str. 301
gucagcgccaggcuuuccgucag

SEQ ID NO: 2005399 - RNA, 16 nt, Shigella flexneri 2a str. 301
gucagcgaucagcauu

SEQ ID NO: 2005400 - RNA, 13 nt, Shigella flexneri 2a str. 301
gucagccgcccgc

SEQ ID NO: 2005401 - RNA, 18 nt, Shigella flexneri 2a str. 301
gucagccucgcuggucag

SEQ ID NO: 2005402 - RNA, 20 nt, Shigella flexneri 2a str. 301
gucagccucgcuggucagcg

SEQ ID NO: 2005403 - RNA, 19 nt, Shigella flexneri 2a str. 301
gucagcagguguccagcca

SEQ ID NO: 2005404 - RNA, 12 nt, Shigella flexneri 2a str. 301
gucagcaucaua

SEQ ID NO: 2005405 - RNA, 19 nt, Shigella flexneri 2a str. 301
gucagcaucauaccuccgc

SEQ ID NO: 2005406 - RNA, 19 nt, Shigella flexneri 2a str. 301
gucauaacuggucaucaaa

SEQ ID NO: 2005407 - RNA, 20 nt, Shigella flexneri 2a str. 301
gucauaacacagguaacuua

SEQ ID NO: 2005408 - RNA, 22 nt, Shigella flexneri 2a str. 301
gucaguuuuucacgagagauac

SEQ ID NO: 2005409 - RNA, 12 nt, Shigella flexneri 2a str. 301
gucaugcagcuc

SEQ ID NO: 2005410 - RNA, 14 nt, Shigella flexneri 2a str. 301
gucaugcagcucca

SEQ ID NO: 2005411 - RNA, 15 nt, Shigella flexneri 2a str. 301
gucaugacuacacua

SEQ ID NO: 2005412 - RNA, 23 nt, Shigella flexneri 2a str. 301
gucaucuucucuauaaaaaagag

SEQ ID NO: 2005413 - RNA, 14 nt, Shigella flexneri 2a str. 301
gucauuacaacaag

SEQ ID NO: 2005414 - RNA, 16 nt, Shigella flexneri 2a str. 301
gucaguucccagggcu

SEQ ID NO: 2005415 - RNA, 16 nt, Shigella flexneri 2a str. 301
gucaguuggcuguggu

SEQ ID NO: 2005416 - RNA, 13 nt, Shigella flexneri 2a str. 301
gucaguucaccau

SEQ ID NO: 2005417 - RNA, 14 nt, Shigella flexneri 2a str. 301
gucagucaucacuu

SEQ ID NO: 2005418 - RNA, 21 nt, Shigella flexneri 2a str. 301
gucaguggacgauaagcaccg

SEQ ID NO: 2005419 - RNA, 13 nt, Shigella flexneri 2a str. 301
gucaguggcagca

SEQ ID NO: 2005420 - RNA, 14 nt, Shigella flexneri 2a str. 301
gucaguggcagcaa

SEQ ID NO: 2005421 - RNA, 18 nt, Shigella flexneri 2a str. 301
gucaggggcauuuucaag

SEQ ID NO: 2005422 - RNA, 16 nt, Shigella flexneri 2a str. 301
gucaguacgccgccgu

SEQ ID NO: 2005423 - RNA, 12 nt, Shigella flexneri 2a str. 301
gucaguaaugac

SEQ ID NO: 2005424 - RNA, 14 nt, Shigella flexneri 2a str. 301
ggcggauggcgaau

SEQ ID NO: 2005425 - RNA, 17 nt, Shigella flexneri 2a str. 301
ggcggauggaguggggc

SEQ ID NO: 2005426 - RNA, 21 nt, Shigella flexneri 2a str. 301
ggcggcaaugaaagcgagcga

SEQ ID NO: 2005427 - RNA, 16 nt, Shigella flexneri 2a str. 301
ggcggcaaucgcugcu

SEQ ID NO: 2005428 - RNA, 20 nt, Shigella flexneri 2a str. 301
ggcggcacagccagcgcugg

SEQ ID NO: 2005429 - RNA, 14 nt, Shigella flexneri 2a str. 301
ggcggcaacauggc

SEQ ID NO: 2005430 - RNA, 21 nt, Shigella flexneri 2a str. 301
ggcggaauugguagacgcgcu

SEQ ID NO: 2005431 - RNA, 15 nt, Shigella flexneri 2a str. 301
ggcggcgcgaggcga

SEQ ID NO: 2005432 - RNA, 15 nt, Shigella flexneri 2a str. 301
ggcggcucaccugca

SEQ ID NO: 2005433 - RNA, 18 nt, Shigella flexneri 2a str. 301
ggcggcguucagucgccg

SEQ ID NO: 2005434 - RNA, 13 nt, Shigella flexneri 2a str. 301
ggcggcgcggcga

SEQ ID NO: 2005435 - RNA, 14 nt, Shigella flexneri 2a str. 301
ggcgcggcccuggg

SEQ ID NO: 2005436 - RNA, 14 nt, Shigella flexneri 2a str. 301
ggcgcggaaauggc

SEQ ID NO: 2005437 - RNA, 16 nt, Shigella flexneri 2a str. 301
ggcgcggacgcacaua

SEQ ID NO: 2005438 - RNA, 20 nt, Shigella flexneri 2a str. 301
ggcggaaaucagagauuugc

SEQ ID NO: 2005439 - RNA, 20 nt, Shigella flexneri 2a str. 301
ggcgcuugucgucccaggca

SEQ ID NO: 2005440 - RNA, 23 nt, Shigella flexneri 2a str. 301
ggcgcguguuccagagaacgacc

SEQ ID NO: 2005441 - RNA, 17 nt, Shigella flexneri 2a str. 301
ggcgcugaugagcaaau

SEQ ID NO: 2005442 - RNA, 14 nt, Shigella flexneri 2a str. 301
ggcgcucgcccagc

SEQ ID NO: 2005443 - RNA, 22 nt, Shigella flexneri 2a str. 301
ggcgcucgcgccgcauccgaca

SEQ ID NO: 2005444 - RNA, 19 nt, Shigella flexneri 2a str. 301
ggcgguaucgucgggcugg

SEQ ID NO: 2005445 - RNA, 20 nt, Shigella flexneri 2a str. 301
ggcgguaucgucgggcuggu

SEQ ID NO: 2005446 - RNA, 21 nt, Shigella flexneri 2a str. 301
ggcggcucguuagacggcgcu

SEQ ID NO: 2005447 - RNA, 14 nt, Shigella flexneri 2a str. 301
ggcggcucuccuga

SEQ ID NO: 2005448 - RNA, 12 nt, Shigella flexneri 2a str. 301
ggcgggaaaaau

SEQ ID NO: 2005449 - RNA, 20 nt, Shigella flexneri 2a str. 301
ggcgggacagcauggggcug

SEQ ID NO: 2005450 - RNA, 20 nt, Shigella flexneri 2a str. 301
ggcguacugaccgucgccuu

SEQ ID NO: 2005451 - RNA, 18 nt, Shigella flexneri 2a str. 301
ggcguaaacgccuuaucc

SEQ ID NO: 2005452 - RNA, 12 nt, Shigella flexneri 2a str. 301
ggcguaaacgcc

SEQ ID NO: 2005453 - RNA, 18 nt, Shigella flexneri 2a str. 301
ggcgugagaucgcgcggg

SEQ ID NO: 2005454 - RNA, 17 nt, Shigella flexneri 2a str. 301
ggcgugacgaucaccac

SEQ ID NO: 2005455 - RNA, 21 nt, Shigella flexneri 2a str. 301
ggcgugauucauacagcggcc

SEQ ID NO: 2005456 - RNA, 20 nt, Shigella flexneri 2a str. 301
ggcguggcccuaggcauaga

SEQ ID NO: 2005457 - RNA, 15 nt, Shigella flexneri 2a str. 301
ggcgugguccagcug

SEQ ID NO: 2005458 - RNA, 13 nt, Shigella flexneri 2a str. 301
ggcgucuccaccu

SEQ ID NO: 2005459 - RNA, 15 nt, Shigella flexneri 2a str. 301
ggcgucugaaucaac

SEQ ID NO: 2005460 - RNA, 18 nt, Shigella flexneri 2a str. 301
ggcgugaacgccuuaucc

SEQ ID NO: 2005461 - RNA, 18 nt, Shigella flexneri 2a str. 301
ggcgugaacgccuuaucu

SEQ ID NO: 2005462 - RNA, 16 nt, Shigella flexneri 2a str. 301
ggcguuauggcaaucu

SEQ ID NO: 2005463 - RNA, 20 nt, Shigella flexneri 2a str. 301
ggcguuaucggguccgggca

SEQ ID NO: 2005464 - RNA, 14 nt, Shigella flexneri 2a str. 301
ggcguuaucacguu

SEQ ID NO: 2005465 - RNA, 14 nt, Shigella flexneri 2a str. 301
ggcguuacagcugg

SEQ ID NO: 2005466 - RNA, 18 nt, Shigella flexneri 2a str. 301
ggcguuuacgccgcauca

SEQ ID NO: 2005467 - RNA, 20 nt, Shigella flexneri 2a str. 301
ggcguuuguaacccaccaug

SEQ ID NO: 2005468 - RNA, 18 nt, Shigella flexneri 2a str. 301
ggcuaaacguguaguauu

SEQ ID NO: 2005469 - RNA, 16 nt, Shigella flexneri 2a str. 301
ggcuaaugccagucag

SEQ ID NO: 2005470 - RNA, 19 nt, Shigella flexneri 2a str. 301
ggcuaaucuugaaaccaga

SEQ ID NO: 2005471 - RNA, 21 nt, Shigella flexneri 2a str. 301
ggcuaaucuugaaaccagaca

SEQ ID NO: 2005472 - RNA, 23 nt, Shigella flexneri 2a str. 301
ggcuaauucuguuuuaucagacc

SEQ ID NO: 2005473 - RNA, 12 nt, Shigella flexneri 2a str. 301
ggcuaucccaaa

SEQ ID NO: 2005474 - RNA, 13 nt, Shigella flexneri 2a str. 301
ggcuaucuggaga

SEQ ID NO: 2005475 - RNA, 23 nt, Shigella flexneri 2a str. 301
ggcuauuagaaauuccuaugcaa

SEQ ID NO: 2005476 - RNA, 15 nt, Shigella flexneri 2a str. 301
ggcuagccucccugc

SEQ ID NO: 2005477 - RNA, 23 nt, Shigella flexneri 2a str. 301
ggcgaagauacccgcgaggcgca

SEQ ID NO: 2005478 - RNA, 16 nt, Shigella flexneri 2a str. 301
ggcgaagagagcgcca

SEQ ID NO: 2005479 - RNA, 19 nt, Shigella flexneri 2a str. 301
ggcgaacucuuccggcagg

SEQ ID NO: 2005480 - RNA, 22 nt, Shigella flexneri 2a str. 301
ggcgaaccggaacaucaccaag

SEQ ID NO: 2005481 - RNA, 13 nt, Shigella flexneri 2a str. 301
ggcgaaagaaaag

SEQ ID NO: 2005482 - RNA, 13 nt, Shigella flexneri 2a str. 301
ggcgaaaggcugg

SEQ ID NO: 2005483 - RNA, 14 nt, Shigella flexneri 2a str. 301
ggcgaaaggcuggc

SEQ ID NO: 2005484 - RNA, 18 nt, Shigella flexneri 2a str. 301
ggccuuuuuggcaagcag

SEQ ID NO: 2005485 - RNA, 14 nt, Shigella flexneri 2a str. 301
ggcgaaaagcuucu

SEQ ID NO: 2005486 - RNA, 18 nt, Shigella flexneri 2a str. 301
ggcgaaaagcuucuuccu

SEQ ID NO: 2005487 - RNA, 22 nt, Shigella flexneri 2a str. 301
ggcgacaaggcguugauuggcg

SEQ ID NO: 2005488 - RNA, 19 nt, Shigella flexneri 2a str. 301
ggcgacacaucuaaugcuu

SEQ ID NO: 2005489 - RNA, 17 nt, Shigella flexneri 2a str. 301
ggcgacagcgaaauccc

SEQ ID NO: 2005490 - RNA, 21 nt, Shigella flexneri 2a str. 301
ggcgaaggcgcacugauucau

SEQ ID NO: 2005491 - RNA, 18 nt, Shigella flexneri 2a str. 301
ggcgaccguucgccaggu

SEQ ID NO: 2005492 - RNA, 17 nt, Shigella flexneri 2a str. 301
ggcgacggcuggcaaaa

SEQ ID NO: 2005493 - RNA, 13 nt, Shigella flexneri 2a str. 301
ggcgaggcggggc

SEQ ID NO: 2005494 - RNA, 15 nt, Shigella flexneri 2a str. 301
ggcgagccagcgcau

SEQ ID NO: 2005495 - RNA, 15 nt, Shigella flexneri 2a str. 301
ggcgacuucugcuuu

SEQ ID NO: 2005496 - RNA, 14 nt, Shigella flexneri 2a str. 301
ggcgagaagagagg

SEQ ID NO: 2005497 - RNA, 14 nt, Shigella flexneri 2a str. 301
ggcgacuucugcuu

SEQ ID NO: 2005498 - RNA, 19 nt, Shigella flexneri 2a str. 301
ggccugagacugaugacaa

SEQ ID NO: 2005499 - RNA, 15 nt, Shigella flexneri 2a str. 301
ggccugaguccaugu

SEQ ID NO: 2005500 - RNA, 15 nt, Shigella flexneri 2a str. 301
ggccugcgcgaccuc

SEQ ID NO: 2005501 - RNA, 14 nt, Shigella flexneri 2a str. 301
ggccugcucaagcg

SEQ ID NO: 2005502 - RNA, 22 nt, Shigella flexneri 2a str. 301
ggccuggaauuacugauugcuc

SEQ ID NO: 2005503 - RNA, 13 nt, Shigella flexneri 2a str. 301
ggccuugccguug

SEQ ID NO: 2005504 - RNA, 18 nt, Shigella flexneri 2a str. 301
ggccuugauuauuucccu

SEQ ID NO: 2005505 - RNA, 20 nt, Shigella flexneri 2a str. 301
ggccuuaaguaugcaauaac

SEQ ID NO: 2005506 - RNA, 12 nt, Shigella flexneri 2a str. 301
ggccuggcuggu

SEQ ID NO: 2005507 - RNA, 18 nt, Shigella flexneri 2a str. 301
ggccguuccauucaaacg

SEQ ID NO: 2005508 - RNA, 13 nt, Shigella flexneri 2a str. 301
ggccgugaagaag

SEQ ID NO: 2005509 - RNA, 19 nt, Shigella flexneri 2a str. 301
ggccuacaugauuucugca

SEQ ID NO: 2005510 - RNA, 20 nt, Shigella flexneri 2a str. 301
ggccuaccguucaggcacaa

SEQ ID NO: 2005511 - RNA, 19 nt, Shigella flexneri 2a str. 301
ggccuacaauguuucugca

SEQ ID NO: 2005512 - RNA, 22 nt, Shigella flexneri 2a str. 301
ggccuaguccguaggcaggacu

SEQ ID NO: 2005513 - RNA, 18 nt, Shigella flexneri 2a str. 301
ggccuauuaugacuccag

SEQ ID NO: 2005514 - RNA, 15 nt, Shigella flexneri 2a str. 301
ggccugaacaagcaa

SEQ ID NO: 2005515 - RNA, 20 nt, Shigella flexneri 2a str. 301
ggccucugccagcugcucau

SEQ ID NO: 2005516 - RNA, 18 nt, Shigella flexneri 2a str. 301
ggccucaugugaugguaa

SEQ ID NO: 2005517 - RNA, 19 nt, Shigella flexneri 2a str. 301
ggcgcgcagaaagaggcgg

SEQ ID NO: 2005518 - RNA, 16 nt, Shigella flexneri 2a str. 301
ggcgcgauucggcucc

SEQ ID NO: 2005519 - RNA, 18 nt, Shigella flexneri 2a str. 301
ggcgcaccugaaucguca

SEQ ID NO: 2005520 - RNA, 20 nt, Shigella flexneri 2a str. 301
ggcgcaauguugcgggggcu

SEQ ID NO: 2005521 - RNA, 21 nt, Shigella flexneri 2a str. 301
ggcgcaaugauaucgcuggca

SEQ ID NO: 2005522 - RNA, 16 nt, Shigella flexneri 2a str. 301
ggcgcaagggugccgg

SEQ ID NO: 2005523 - RNA, 12 nt, Shigella flexneri 2a str. 301
ggcgcagcgcgc

SEQ ID NO: 2005524 - RNA, 15 nt, Shigella flexneri 2a str. 301
ggcgcaguaugacua

SEQ ID NO: 2005525 - RNA, 13 nt, Shigella flexneri 2a str. 301
ggcgcagggugua

SEQ ID NO: 2005526 - RNA, 17 nt, Shigella flexneri 2a str. 301
ggcgcauguuggcgcgg

SEQ ID NO: 2005527 - RNA, 17 nt, Shigella flexneri 2a str. 301
ggcgauauccagcgcgg

SEQ ID NO: 2005528 - RNA, 20 nt, Shigella flexneri 2a str. 301
ggcgauauuauccccugcga

SEQ ID NO: 2005529 - RNA, 21 nt, Shigella flexneri 2a str. 301
ggcgaucgacgugggcguggg

SEQ ID NO: 2005530 - RNA, 18 nt, Shigella flexneri 2a str. 301
ggcgaggggaccgccccu

SEQ ID NO: 2005531 - RNA, 18 nt, Shigella flexneri 2a str. 301
ggcgagggaaccguccgc

SEQ ID NO: 2005532 - RNA, 17 nt, Shigella flexneri 2a str. 301
ggcgagguacgcccagc

SEQ ID NO: 2005533 - RNA, 20 nt, Shigella flexneri 2a str. 301
ggcgagguacgcccagcgcu

SEQ ID NO: 2005534 - RNA, 23 nt, Shigella flexneri 2a str. 301
ggcgaggggacgguccgugcgcu

SEQ ID NO: 2005535 - RNA, 23 nt, Shigella flexneri 2a str. 301
ggcgaguauucuugcugauacuc

SEQ ID NO: 2005536 - RNA, 16 nt, Shigella flexneri 2a str. 301
ggcgaguaauaaacuc

SEQ ID NO: 2005537 - RNA, 17 nt, Shigella flexneri 2a str. 301
ggcgaguucagaucagg

SEQ ID NO: 2005538 - RNA, 20 nt, Shigella flexneri 2a str. 301
ggcgauaaaguguugagcuu

SEQ ID NO: 2005539 - RNA, 15 nt, Shigella flexneri 2a str. 301
ggcgauacucugcca

SEQ ID NO: 2005540 - RNA, 20 nt, Shigella flexneri 2a str. 301
ggcgaugcuguauucuucag

SEQ ID NO: 2005541 - RNA, 22 nt, Shigella flexneri 2a str. 301
ggcgaugaaacaaaucggcgcg

SEQ ID NO: 2005542 - RNA, 13 nt, Shigella flexneri 2a str. 301
ggcgauuccacuc

SEQ ID NO: 2005543 - RNA, 13 nt, Shigella flexneri 2a str. 301
ggccggagccagc

SEQ ID NO: 2005544 - RNA, 16 nt, Shigella flexneri 2a str. 301
ggccggagccagccgu

SEQ ID NO: 2005545 - RNA, 22 nt, Shigella flexneri 2a str. 301
ggccggcauauaccucagcaga

SEQ ID NO: 2005546 - RNA, 16 nt, Shigella flexneri 2a str. 301
ggccggauguggcguu

SEQ ID NO: 2005547 - RNA, 19 nt, Shigella flexneri 2a str. 301
ggccgcuuucugagcggcc

SEQ ID NO: 2005548 - RNA, 20 nt, Shigella flexneri 2a str. 301
ggccgcuuucugagcggccu

SEQ ID NO: 2005549 - RNA, 17 nt, Shigella flexneri 2a str. 301
ggccguaaucacuguca

SEQ ID NO: 2005550 - RNA, 14 nt, Shigella flexneri 2a str. 301
ggccguauccggca

SEQ ID NO: 2005551 - RNA, 14 nt, Shigella flexneri 2a str. 301
ggccgagaggcuga

SEQ ID NO: 2005552 - RNA, 16 nt, Shigella flexneri 2a str. 301
ggccgccacacagcac

SEQ ID NO: 2005553 - RNA, 18 nt, Shigella flexneri 2a str. 301
ggcccgacgaugaccgca

SEQ ID NO: 2005554 - RNA, 21 nt, Shigella flexneri 2a str. 301
ggcccuuccccuucucgucgg

SEQ ID NO: 2005555 - RNA, 23 nt, Shigella flexneri 2a str. 301
ggcccgguuaucggcgcgccagc

SEQ ID NO: 2005556 - RNA, 17 nt, Shigella flexneri 2a str. 301
ggccaaucagcaauaaa

SEQ ID NO: 2005557 - RNA, 17 nt, Shigella flexneri 2a str. 301
ggccaauccagcccugc

SEQ ID NO: 2005558 - RNA, 13 nt, Shigella flexneri 2a str. 301
ggccaauuggcug

SEQ ID NO: 2005559 - RNA, 20 nt, Shigella flexneri 2a str. 301
ggccacaaacgacgggccag

SEQ ID NO: 2005560 - RNA, 16 nt, Shigella flexneri 2a str. 301
ggccaauuuggcugcc

SEQ ID NO: 2005561 - RNA, 14 nt, Shigella flexneri 2a str. 301
ggccaauuuggcug

SEQ ID NO: 2005562 - RNA, 14 nt, Shigella flexneri 2a str. 301
ggccacagccagcc

SEQ ID NO: 2005563 - RNA, 22 nt, Shigella flexneri 2a str. 301
ggccaguaagcaguccagcgcc

SEQ ID NO: 2005564 - RNA, 23 nt, Shigella flexneri 2a str. 301
ggccaguaagcaguccagcgccu

SEQ ID NO: 2005565 - RNA, 20 nt, Shigella flexneri 2a str. 301
ggccauccgcgugacgcugg

SEQ ID NO: 2005566 - RNA, 21 nt, Shigella flexneri 2a str. 301
ggccagguuuucuuucaccuc

SEQ ID NO: 2005567 - RNA, 21 nt, Shigella flexneri 2a str. 301
ggccaguaagcaguccagcgc

SEQ ID NO: 2005568 - RNA, 18 nt, Shigella flexneri 2a str. 301
ggccaaaaaacagccccu

SEQ ID NO: 2005569 - RNA, 22 nt, Shigella flexneri 2a str. 301
ggccaaaaaacagccccugagc

SEQ ID NO: 2005570 - RNA, 14 nt, Shigella flexneri 2a str. 301
ggccaaacucacca

SEQ ID NO: 2005571 - RNA, 17 nt, Shigella flexneri 2a str. 301
ggccaacaccagacauc

SEQ ID NO: 2005572 - RNA, 14 nt, Shigella flexneri 2a str. 301
ggcaucuucuucau

SEQ ID NO: 2005573 - RNA, 19 nt, Shigella flexneri 2a str. 301
ggcauccugaucguccugc

SEQ ID NO: 2005574 - RNA, 15 nt, Shigella flexneri 2a str. 301
ggcaucguguugaug

SEQ ID NO: 2005575 - RNA, 16 nt, Shigella flexneri 2a str. 301
ggcaugacgcaggucg

SEQ ID NO: 2005576 - RNA, 12 nt, Shigella flexneri 2a str. 301
ggcaugaaagcg

SEQ ID NO: 2005577 - RNA, 18 nt, Shigella flexneri 2a str. 301
ggcauucagauaauaggu

SEQ ID NO: 2005578 - RNA, 15 nt, Shigella flexneri 2a str. 301
ggcauucagugcaaa

SEQ ID NO: 2005579 - RNA, 12 nt, Shigella flexneri 2a str. 301
ggcaugauucau

SEQ ID NO: 2005580 - RNA, 23 nt, Shigella flexneri 2a str. 301
ggcauucugcuggccuggcuggu

SEQ ID NO: 2005581 - RNA, 19 nt, Shigella flexneri 2a str. 301
ggcaggugacugggcggcg

SEQ ID NO: 2005582 - RNA, 22 nt, Shigella flexneri 2a str. 301
ggcaggguggugacaccaugcc

SEQ ID NO: 2005583 - RNA, 23 nt, Shigella flexneri 2a str. 301
ggcagggucagcaucaagauaaa

SEQ ID NO: 2005584 - RNA, 19 nt, Shigella flexneri 2a str. 301
ggcagguaaugaauggacu

SEQ ID NO: 2005585 - RNA, 13 nt, Shigella flexneri 2a str. 301
ggcagaacagaac

SEQ ID NO: 2005586 - RNA, 12 nt, Shigella flexneri 2a str. 301
ggcagaacggug

SEQ ID NO: 2005587 - RNA, 19 nt, Shigella flexneri 2a str. 301
ggcaggcucugguguucuu

SEQ ID NO: 2005588 - RNA, 22 nt, Shigella flexneri 2a str. 301
ggcagaaugguaacaccagagu

SEQ ID NO: 2005589 - RNA, 22 nt, Shigella flexneri 2a str. 301
ggcaggcuucaacacaggccgg

SEQ ID NO: 2005590 - RNA, 20 nt, Shigella flexneri 2a str. 301
ggcagggaucugauuuuccu

SEQ ID NO: 2005591 - RNA, 15 nt, Shigella flexneri 2a str. 301
ggcagggccaccagc

SEQ ID NO: 2005592 - RNA, 20 nt, Shigella flexneri 2a str. 301
ggcaguucgucuuuggguuc

SEQ ID NO: 2005593 - RNA, 16 nt, Shigella flexneri 2a str. 301
ggcaguucgugcagug

SEQ ID NO: 2005594 - RNA, 16 nt, Shigella flexneri 2a str. 301
ggcaguuggcgcacaa

SEQ ID NO: 2005595 - RNA, 22 nt, Shigella flexneri 2a str. 301
ggcaguuggcgcacaaugccug

SEQ ID NO: 2005596 - RNA, 20 nt, Shigella flexneri 2a str. 301
ggcauccagguuucuuccag

SEQ ID NO: 2005597 - RNA, 16 nt, Shigella flexneri 2a str. 301
ggcauccagagaucgc

SEQ ID NO: 2005598 - RNA, 23 nt, Shigella flexneri 2a str. 301
ggcaucagacaaaugucacugcu

SEQ ID NO: 2005599 - RNA, 16 nt, Shigella flexneri 2a str. 301
ggcaucacaucgcugg

SEQ ID NO: 2005600 - RNA, 22 nt, Shigella flexneri 2a str. 301
ggcaucaaugaaaggcuuccca

SEQ ID NO: 2005601 - RNA, 13 nt, Shigella flexneri 2a str. 301
ggcaucagcagaa

SEQ ID NO: 2005602 - RNA, 13 nt, Shigella flexneri 2a str. 301
ggcaucagcaauu

SEQ ID NO: 2005603 - RNA, 18 nt, Shigella flexneri 2a str. 301
ggcaucacgaauccgcac

SEQ ID NO: 2005604 - RNA, 20 nt, Shigella flexneri 2a str. 301
ggacauuccguuugcuguau

SEQ ID NO: 2005605 - RNA, 22 nt, Shigella flexneri 2a str. 301
ggacaugauuacugcaaacuca

SEQ ID NO: 2005606 - RNA, 17 nt, Shigella flexneri 2a str. 301
ggacagcguugccagcu

SEQ ID NO: 2005607 - RNA, 20 nt, Shigella flexneri 2a str. 301
ggacagaccugcgucaccac

SEQ ID NO: 2005608 - RNA, 23 nt, Shigella flexneri 2a str. 301
ggaccgauggguucagaaucaag

SEQ ID NO: 2005609 - RNA, 20 nt, Shigella flexneri 2a str. 301
ggacccuuaaagggucaggg

SEQ ID NO: 2005610 - RNA, 17 nt, Shigella flexneri 2a str. 301
ggacccgcgaucgccug

SEQ ID NO: 2005611 - RNA, 15 nt, Shigella flexneri 2a str. 301
ggaccugcucugcca

SEQ ID NO: 2005612 - RNA, 19 nt, Shigella flexneri 2a str. 301
ggaccguaucccccagagc

SEQ ID NO: 2005613 - RNA, 17 nt, Shigella flexneri 2a str. 301
ggaccgucaucuuccac

SEQ ID NO: 2005614 - RNA, 18 nt, Shigella flexneri 2a str. 301
ggaauaagacuggcaaau

SEQ ID NO: 2005615 - RNA, 17 nt, Shigella flexneri 2a str. 301
gcucggcuccgggcgca

SEQ ID NO: 2005616 - RNA, 19 nt, Shigella flexneri 2a str. 301
ggaauagcggcaagcccag

SEQ ID NO: 2005617 - RNA, 21 nt, Shigella flexneri 2a str. 301
ggaaugagcuguacggagcgg

SEQ ID NO: 2005618 - RNA, 16 nt, Shigella flexneri 2a str. 301
ggacaaccauaaauuu

SEQ ID NO: 2005619 - RNA, 16 nt, Shigella flexneri 2a str. 301
ggacgaucgcagauga

SEQ ID NO: 2005620 - RNA, 21 nt, Shigella flexneri 2a str. 301
ggacgaucccaaccauuucau

SEQ ID NO: 2005621 - RNA, 22 nt, Shigella flexneri 2a str. 301
ggacgugcaccgucacuucuuc

SEQ ID NO: 2005622 - RNA, 18 nt, Shigella flexneri 2a str. 301
ggacugaaaguacuucac

SEQ ID NO: 2005623 - RNA, 17 nt, Shigella flexneri 2a str. 301
ggacuucaugcgcagca

SEQ ID NO: 2005624 - RNA, 13 nt, Shigella flexneri 2a str. 301
ggacuuuuuauuu

SEQ ID NO: 2005625 - RNA, 24 nt, Shigella flexneri 2a str. 301
ggagaaacccggccacagcgccag

SEQ ID NO: 2005626 - RNA, 14 nt, Shigella flexneri 2a str. 301
ggagaguugaaagc

SEQ ID NO: 2005627 - RNA, 19 nt, Shigella flexneri 2a str. 301
ggagaguugcaccagcaac

SEQ ID NO: 2005628 - RNA, 20 nt, Shigella flexneri 2a str. 301
ggagaguaugcgcgucagag

SEQ ID NO: 2005629 - RNA, 19 nt, Shigella flexneri 2a str. 301
ggagaucgagcgcgagcag

SEQ ID NO: 2005630 - RNA, 22 nt, Shigella flexneri 2a str. 301
ggaggauuucuccccccucuga

SEQ ID NO: 2005631 - RNA, 13 nt, Shigella flexneri 2a str. 301
ggagcgauuauua

SEQ ID NO: 2005632 - RNA, 14 nt, Shigella flexneri 2a str. 301
ggagguguucauaa

SEQ ID NO: 2005633 - RNA, 22 nt, Shigella flexneri 2a str. 301
ggauaggcuucuauaccaauga

SEQ ID NO: 2005634 - RNA, 15 nt, Shigella flexneri 2a str. 301
ggauagcgcugcugc

SEQ ID NO: 2005635 - RNA, 19 nt, Shigella flexneri 2a str. 301
ggauagccucucggcauuu

SEQ ID NO: 2005636 - RNA, 15 nt, Shigella flexneri 2a str. 301
ggcaccuucgccucc

SEQ ID NO: 2005637 - RNA, 22 nt, Shigella flexneri 2a str. 301
ggcacaagcauuaaggcaagaa

SEQ ID NO: 2005638 - RNA, 11 nt, Shigella flexneri 2a str. 301
ggcacaagggu

SEQ ID NO: 2005639 - RNA, 16 nt, Shigella flexneri 2a str. 301
ggcacaacucggcggc

SEQ ID NO: 2005640 - RNA, 17 nt, Shigella flexneri 2a str. 301
ggcacaacucggcggcu

SEQ ID NO: 2005641 - RNA, 20 nt, Shigella flexneri 2a str. 301
ggcaccauuuaaaucaauaa

SEQ ID NO: 2005642 - RNA, 21 nt, Shigella flexneri 2a str. 301
ggcaauuuuuaccggucagga

SEQ ID NO: 2005643 - RNA, 12 nt, Shigella flexneri 2a str. 301
ggcacaaagcug

SEQ ID NO: 2005644 - RNA, 22 nt, Shigella flexneri 2a str. 301
ggcaauucacugucgaacuggc

SEQ ID NO: 2005645 - RNA, 22 nt, Shigella flexneri 2a str. 301
ggcaaugcguagcugagcaaca

SEQ ID NO: 2005646 - RNA, 15 nt, Shigella flexneri 2a str. 301
ggcaaugcugucggu

SEQ ID NO: 2005647 - RNA, 16 nt, Shigella flexneri 2a str. 301
ggcaaguaauaauauc

SEQ ID NO: 2005648 - RNA, 22 nt, Shigella flexneri 2a str. 301
ggcaauauagauaucaugcucu

SEQ ID NO: 2005649 - RNA, 17 nt, Shigella flexneri 2a str. 301
ggcaauauucauuaaaa

SEQ ID NO: 2005650 - RNA, 16 nt, Shigella flexneri 2a str. 301
ggcaauauucauuaaa

SEQ ID NO: 2005651 - RNA, 22 nt, Shigella flexneri 2a str. 301
ggcaauacgauccugagcagcc

SEQ ID NO: 2005652 - RNA, 13 nt, Shigella flexneri 2a str. 301
ggcaauacuggca

SEQ ID NO: 2005653 - RNA, 23 nt, Shigella flexneri 2a str. 301
ggcaaucaucaccggucggccuu

SEQ ID NO: 2005654 - RNA, 17 nt, Shigella flexneri 2a str. 301
ggcaauccccgccagca

SEQ ID NO: 2005655 - RNA, 16 nt, Shigella flexneri 2a str. 301
ggcaaucaugauugaa

SEQ ID NO: 2005656 - RNA, 23 nt, Shigella flexneri 2a str. 301
ggcaaugacccguaugaugugcg

SEQ ID NO: 2005657 - RNA, 14 nt, Shigella flexneri 2a str. 301
ggcaaucugcuggc

SEQ ID NO: 2005658 - RNA, 15 nt, Shigella flexneri 2a str. 301
ggcaaucggugcaaa

SEQ ID NO: 2005659 - RNA, 13 nt, Shigella flexneri 2a str. 301
ggcaagccagcau

SEQ ID NO: 2005660 - RNA, 14 nt, Shigella flexneri 2a str. 301
ggcaagccagcaua

SEQ ID NO: 2005661 - RNA, 14 nt, Shigella flexneri 2a str. 301
ggcaagcccagcac

SEQ ID NO: 2005662 - RNA, 22 nt, Shigella flexneri 2a str. 301
ggcaagcaggucggcucagccg

SEQ ID NO: 2005663 - RNA, 12 nt, Shigella flexneri 2a str. 301
ggcaagaaaauu

SEQ ID NO: 2005664 - RNA, 23 nt, Shigella flexneri 2a str. 301
ggcaagaucgcgaugggucgccg

SEQ ID NO: 2005665 - RNA, 13 nt, Shigella flexneri 2a str. 301
ggcaaaaauaagg

SEQ ID NO: 2005666 - RNA, 20 nt, Shigella flexneri 2a str. 301
ggcaaaaacccuucuuccau

SEQ ID NO: 2005667 - RNA, 17 nt, Shigella flexneri 2a str. 301
ggcaaagugaauacaga

SEQ ID NO: 2005668 - RNA, 22 nt, Shigella flexneri 2a str. 301
ggcaaauaaucccgcgcaacaa

SEQ ID NO: 2005669 - RNA, 15 nt, Shigella flexneri 2a str. 301
ggcaaagguucaagc

SEQ ID NO: 2005670 - RNA, 24 nt, Shigella flexneri 2a str. 301
ggcaaaggcuucguucaucucaaa

SEQ ID NO: 2005671 - RNA, 15 nt, Shigella flexneri 2a str. 301
ggauuuaaugccaau

SEQ ID NO: 2005672 - RNA, 17 nt, Shigella flexneri 2a str. 301
ggauuuaccuugcucau

SEQ ID NO: 2005673 - RNA, 13 nt, Shigella flexneri 2a str. 301
ggauuugugucag

SEQ ID NO: 2005674 - RNA, 14 nt, Shigella flexneri 2a str. 301
ggauuucugauuau

SEQ ID NO: 2005675 - RNA, 12 nt, Shigella flexneri 2a str. 301
ggcaaaaaaguc

SEQ ID NO: 2005676 - RNA, 13 nt, Shigella flexneri 2a str. 301
ggauuuuuuauug

SEQ ID NO: 2005677 - RNA, 20 nt, Shigella flexneri 2a str. 301
ggcaacgacugcgagcaaaa

SEQ ID NO: 2005678 - RNA, 14 nt, Shigella flexneri 2a str. 301
ggcaaccgcugagc

SEQ ID NO: 2005679 - RNA, 20 nt, Shigella flexneri 2a str. 301
ggcaaccugcuuuaaaagcu

SEQ ID NO: 2005680 - RNA, 20 nt, Shigella flexneri 2a str. 301
ggcaaaugcaucagugacaa

SEQ ID NO: 2005681 - RNA, 16 nt, Shigella flexneri 2a str. 301
ggcaaccagcagaugu

SEQ ID NO: 2005682 - RNA, 15 nt, Shigella flexneri 2a str. 301
ggcaaccacaaccgc

SEQ ID NO: 2005683 - RNA, 15 nt, Shigella flexneri 2a str. 301
ggcaacaucaaauua

SEQ ID NO: 2005684 - RNA, 19 nt, Shigella flexneri 2a str. 301
ggcaacaugaaacagaaaa

SEQ ID NO: 2005685 - RNA, 17 nt, Shigella flexneri 2a str. 301
ggaugcccccagguugu

SEQ ID NO: 2005686 - RNA, 12 nt, Shigella flexneri 2a str. 301
ggaugccaguau

SEQ ID NO: 2005687 - RNA, 11 nt, Shigella flexneri 2a str. 301
ggaugauucac

SEQ ID NO: 2005688 - RNA, 23 nt, Shigella flexneri 2a str. 301
ggaucugcggguuagucugcauu

SEQ ID NO: 2005689 - RNA, 23 nt, Shigella flexneri 2a str. 301
ggaucugauuuuccuccagcagc

SEQ ID NO: 2005690 - RNA, 18 nt, Shigella flexneri 2a str. 301
ggaucuggcuugccagca

SEQ ID NO: 2005691 - RNA, 14 nt, Shigella flexneri 2a str. 301
ggaucacaucgccg

SEQ ID NO: 2005692 - RNA, 19 nt, Shigella flexneri 2a str. 301
ggaucaccugcacaugcaa

SEQ ID NO: 2005693 - RNA, 20 nt, Shigella flexneri 2a str. 301
ggaucacaucauaaauaaga

SEQ ID NO: 2005694 - RNA, 15 nt, Shigella flexneri 2a str. 301
ggaucacaagaccua

SEQ ID NO: 2005695 - RNA, 14 nt, Shigella flexneri 2a str. 301
ggaucuccagcucc

SEQ ID NO: 2005696 - RNA, 19 nt, Shigella flexneri 2a str. 301
ggauggcuggccgugcaga

SEQ ID NO: 2005697 - RNA, 16 nt, Shigella flexneri 2a str. 301
ggauggcguagcagca

SEQ ID NO: 2005698 - RNA, 19 nt, Shigella flexneri 2a str. 301
ggauggcgauacucugcca

SEQ ID NO: 2005699 - RNA, 19 nt, Shigella flexneri 2a str. 301
ggauggccucugccagcug

SEQ ID NO: 2005700 - RNA, 17 nt, Shigella flexneri 2a str. 301
ggauuacuccccgcaca

SEQ ID NO: 2005701 - RNA, 15 nt, Shigella flexneri 2a str. 301
ggauuacaaauaaau

SEQ ID NO: 2005702 - RNA, 13 nt, Shigella flexneri 2a str. 301
ggauguugcugca

SEQ ID NO: 2005703 - RNA, 14 nt, Shigella flexneri 2a str. 301
ggauuaaaaaguaa

SEQ ID NO: 2005704 - RNA, 19 nt, Shigella flexneri 2a str. 301
ggauugcuauuuaacaguu

SEQ ID NO: 2005705 - RNA, 16 nt, Shigella flexneri 2a str. 301
ggauugccgcuucauu

SEQ ID NO: 2005706 - RNA, 13 nt, Shigella flexneri 2a str. 301
cucuucuuccgcu

SEQ ID NO: 2005707 - RNA, 21 nt, Shigella flexneri 2a str. 301
cucuucuucgcgauaaaucag

SEQ ID NO: 2005708 - RNA, 22 nt, Shigella flexneri 2a str. 301
cucuucuucgcgauaaaucaga

SEQ ID NO: 2005709 - RNA, 14 nt, Shigella flexneri 2a str. 301
cucuucugccuguc

SEQ ID NO: 2005710 - RNA, 17 nt, Shigella flexneri 2a str. 301
cucuucgccugccugca

SEQ ID NO: 2005711 - RNA, 16 nt, Shigella flexneri 2a str. 301
cucuuccggcaccaca

SEQ ID NO: 2005712 - RNA, 21 nt, Shigella flexneri 2a str. 301
cucuuccauuucaucgccagc

SEQ ID NO: 2005713 - RNA, 19 nt, Shigella flexneri 2a str. 301
cucuguaauugaaggcuua

SEQ ID NO: 2005714 - RNA, 17 nt, Shigella flexneri 2a str. 301
cucuguaaacuccuuuc

SEQ ID NO: 2005715 - RNA, 13 nt, Shigella flexneri 2a str. 301
cucuguauauaaa

SEQ ID NO: 2005716 - RNA, 20 nt, Shigella flexneri 2a str. 301
cucugguguggagugcagca

SEQ ID NO: 2005717 - RNA, 21 nt, Shigella flexneri 2a str. 301
cucuggucugccauaauauug

SEQ ID NO: 2005718 - RNA, 21 nt, Shigella flexneri 2a str. 301
cucugguguggagugcagcau

SEQ ID NO: 2005719 - RNA, 22 nt, Shigella flexneri 2a str. 301
cucugguccaacgguuaacagu

SEQ ID NO: 2005720 - RNA, 23 nt, Shigella flexneri 2a str. 301
cucuggcggagcucccaggcucc

SEQ ID NO: 2005721 - RNA, 22 nt, Shigella flexneri 2a str. 301
cucugggcugaagaguaaaaaa

SEQ ID NO: 2005722 - RNA, 20 nt, Shigella flexneri 2a str. 301
cucugggagauuaccucgac

SEQ ID NO: 2005723 - RNA, 20 nt, Shigella flexneri 2a str. 301
cucugcuggcggaacaucgc

SEQ ID NO: 2005724 - RNA, 21 nt, Shigella flexneri 2a str. 301
cucuggauuuauauaaauaua

SEQ ID NO: 2005725 - RNA, 13 nt, Shigella flexneri 2a str. 301
cucuggcaggcuu

SEQ ID NO: 2005726 - RNA, 14 nt, Shigella flexneri 2a str. 301
cucuggcacaugca

SEQ ID NO: 2005727 - RNA, 15 nt, Shigella flexneri 2a str. 301
cucuucaauggucag

SEQ ID NO: 2005728 - RNA, 14 nt, Shigella flexneri 2a str. 301
cucuucaaugguca

SEQ ID NO: 2005729 - RNA, 16 nt, Shigella flexneri 2a str. 301
cucuucaacacggcgc

SEQ ID NO: 2005730 - RNA, 18 nt, Shigella flexneri 2a str. 301
cucuucaacuucagcagc

SEQ ID NO: 2005731 - RNA, 18 nt, Shigella flexneri 2a str. 301
cucuucacgcccgcccca

SEQ ID NO: 2005732 - RNA, 11 nt, Shigella flexneri 2a str. 301
cucuucacacc

SEQ ID NO: 2005733 - RNA, 17 nt, Shigella flexneri 2a str. 301
cucuucaccgguacgga

SEQ ID NO: 2005734 - RNA, 19 nt, Shigella flexneri 2a str. 301
cucuucauuaccuucaaca

SEQ ID NO: 2005735 - RNA, 14 nt, Shigella flexneri 2a str. 301
cucuucauuaccuu

SEQ ID NO: 2005736 - RNA, 18 nt, Shigella flexneri 2a str. 301
cucuucaucgcuaaaaua

SEQ ID NO: 2005737 - RNA, 15 nt, Shigella flexneri 2a str. 301
cucuucaugccucgu

SEQ ID NO: 2005738 - RNA, 20 nt, Shigella flexneri 2a str. 301
cucuucauuaaaccagugcc

SEQ ID NO: 2005739 - RNA, 18 nt, Shigella flexneri 2a str. 301
cucuucagcaaucucuuc

SEQ ID NO: 2005740 - RNA, 18 nt, Shigella flexneri 2a str. 301
cucuuacucuuucaauuu

SEQ ID NO: 2005741 - RNA, 18 nt, Shigella flexneri 2a str. 301
cucuucaaacugaagauu

SEQ ID NO: 2005742 - RNA, 18 nt, Shigella flexneri 2a str. 301
cucuucaaacucaccagu

SEQ ID NO: 2005743 - RNA, 20 nt, Shigella flexneri 2a str. 301
cucuucaaacucaccagugg

SEQ ID NO: 2005744 - RNA, 16 nt, Shigella flexneri 2a str. 301
cucuuaccguaggcca

SEQ ID NO: 2005745 - RNA, 19 nt, Shigella flexneri 2a str. 301
cugaaauguuugcaauaaa

SEQ ID NO: 2005746 - RNA, 21 nt, Shigella flexneri 2a str. 301
cugaaauuccugagaggauga

SEQ ID NO: 2005747 - RNA, 13 nt, Shigella flexneri 2a str. 301
cugaaauuuaucg

SEQ ID NO: 2005748 - RNA, 18 nt, Shigella flexneri 2a str. 301
cugaaauacagacuccac

SEQ ID NO: 2005749 - RNA, 14 nt, Shigella flexneri 2a str. 301
cugaaaucacagcg

SEQ ID NO: 2005750 - RNA, 14 nt, Shigella flexneri 2a str. 301
cugaacagcuuuuu

SEQ ID NO: 2005751 - RNA, 17 nt, Shigella flexneri 2a str. 301
cugaacagcuuuuuccu

SEQ ID NO: 2005752 - RNA, 11 nt, Shigella flexneri 2a str. 301
cugaacagcuu

SEQ ID NO: 2005753 - RNA, 14 nt, Shigella flexneri 2a str. 301
cugaacaagcaaga

SEQ ID NO: 2005754 - RNA, 17 nt, Shigella flexneri 2a str. 301
cugaacaagcaagagug

SEQ ID NO: 2005755 - RNA, 12 nt, Shigella flexneri 2a str. 301
cugaacaaaaaa

SEQ ID NO: 2005756 - RNA, 21 nt, Shigella flexneri 2a str. 301
cugaacaguacuggccuccac

SEQ ID NO: 2005757 - RNA, 22 nt, Shigella flexneri 2a str. 301
cugaacaauuggauagugagua

SEQ ID NO: 2005758 - RNA, 22 nt, Shigella flexneri 2a str. 301
cugaacauuuucuucugccagg

SEQ ID NO: 2005759 - RNA, 19 nt, Shigella flexneri 2a str. 301
cugaaccaucgacguccaa

SEQ ID NO: 2005760 - RNA, 24 nt, Shigella flexneri 2a str. 301
cugaaccaucgacguccaaucagc

SEQ ID NO: 2005761 - RNA, 19 nt, Shigella flexneri 2a str. 301
cugaaccagacugcacaug

SEQ ID NO: 2005762 - RNA, 20 nt, Shigella flexneri 2a str. 301
cugaacuaaagccuuuugcc

SEQ ID NO: 2005763 - RNA, 14 nt, Shigella flexneri 2a str. 301
cugaacugaacaaa

SEQ ID NO: 2005764 - RNA, 19 nt, Shigella flexneri 2a str. 301
cugaacugauugccacccu

SEQ ID NO: 2005765 - RNA, 21 nt, Shigella flexneri 2a str. 301
cugaacgacaaauucaggaaa

SEQ ID NO: 2005766 - RNA, 16 nt, Shigella flexneri 2a str. 301
cugaaccgaaauggcu

SEQ ID NO: 2005767 - RNA, 14 nt, Shigella flexneri 2a str. 301
cugaagaguaaaaa

SEQ ID NO: 2005768 - RNA, 21 nt, Shigella flexneri 2a str. 301
cugaagaaaauggccagccag

SEQ ID NO: 2005769 - RNA, 20 nt, Shigella flexneri 2a str. 301
cugaagaaguaaaacagucg

SEQ ID NO: 2005770 - RNA, 19 nt, Shigella flexneri 2a str. 301
cugaagcaguuucaccagc

SEQ ID NO: 2005771 - RNA, 14 nt, Shigella flexneri 2a str. 301
cugaagcaguuuca

SEQ ID NO: 2005772 - RNA, 17 nt, Shigella flexneri 2a str. 301
cugaagauugaacagca

SEQ ID NO: 2005773 - RNA, 21 nt, Shigella flexneri 2a str. 301
cugaagauugaacagcagaac

SEQ ID NO: 2005774 - RNA, 12 nt, Shigella flexneri 2a str. 301
cucuuuccacaa

SEQ ID NO: 2005775 - RNA, 23 nt, Shigella flexneri 2a str. 301
cucuuucccggcaaucaccgcca

SEQ ID NO: 2005776 - RNA, 21 nt, Shigella flexneri 2a str. 301
cucuuugaacagccagaagcc

SEQ ID NO: 2005777 - RNA, 15 nt, Shigella flexneri 2a str. 301
cucuuuauugcaaac

SEQ ID NO: 2005778 - RNA, 12 nt, Shigella flexneri 2a str. 301
cucuuucaacuu

SEQ ID NO: 2005779 - RNA, 18 nt, Shigella flexneri 2a str. 301
cucuuuagcauucagagu

SEQ ID NO: 2005780 - RNA, 20 nt, Shigella flexneri 2a str. 301
cucuuuugacgcccccaaac

SEQ ID NO: 2005781 - RNA, 15 nt, Shigella flexneri 2a str. 301
cucuuuuccagccau

SEQ ID NO: 2005782 - RNA, 23 nt, Shigella flexneri 2a str. 301
cucuuuuuauuuacucuccugcg

SEQ ID NO: 2005783 - RNA, 19 nt, Shigella flexneri 2a str. 301
cucuuuuauuucugcuucg

SEQ ID NO: 2005784 - RNA, 16 nt, Shigella flexneri 2a str. 301
cucuuugaugaaacau

SEQ ID NO: 2005785 - RNA, 14 nt, Shigella flexneri 2a str. 301
cugaaaauggcgcu

SEQ ID NO: 2005786 - RNA, 22 nt, Shigella flexneri 2a str. 301
cugaaaaugaaagcccuugccg

SEQ ID NO: 2005787 - RNA, 18 nt, Shigella flexneri 2a str. 301
cugaaacucgaccagcag

SEQ ID NO: 2005788 - RNA, 19 nt, Shigella flexneri 2a str. 301
cugaaacucgaccagcagc

SEQ ID NO: 2005789 - RNA, 24 nt, Shigella flexneri 2a str. 301
cugaaacgucacccaggagaugcc

SEQ ID NO: 2005790 - RNA, 17 nt, Shigella flexneri 2a str. 301
cugaaagggcaaauaau

SEQ ID NO: 2005791 - RNA, 12 nt, Shigella flexneri 2a str. 301
cugaaagcugaa

SEQ ID NO: 2005792 - RNA, 20 nt, Shigella flexneri 2a str. 301
cugaaagaagcggugaaaaa

SEQ ID NO: 2005793 - RNA, 21 nt, Shigella flexneri 2a str. 301
cugaaaaaaaauuacaaaaag

SEQ ID NO: 2005794 - RNA, 16 nt, Shigella flexneri 2a str. 301
cugaaaaggucacucc

SEQ ID NO: 2005795 - RNA, 17 nt, Shigella flexneri 2a str. 301
cugaaaaguuaauguug

SEQ ID NO: 2005796 - RNA, 14 nt, Shigella flexneri 2a str. 301
cugaaaaggucacu

SEQ ID NO: 2005797 - RNA, 23 nt, Shigella flexneri 2a str. 301
cugagacgcgcuugcauuacuac

SEQ ID NO: 2005798 - RNA, 15 nt, Shigella flexneri 2a str. 301
cugagagaaaaaaaa

SEQ ID NO: 2005799 - RNA, 18 nt, Shigella flexneri 2a str. 301
cugagaggaaaaaaauua

SEQ ID NO: 2005800 - RNA, 17 nt, Shigella flexneri 2a str. 301
cugagaucaaacucuuu

SEQ ID NO: 2005801 - RNA, 18 nt, Shigella flexneri 2a str. 301
cugagacagacagccuca

SEQ ID NO: 2005802 - RNA, 21 nt, Shigella flexneri 2a str. 301
cugagaauaaauacacuauaa

SEQ ID NO: 2005803 - RNA, 21 nt, Shigella flexneri 2a str. 301
cugagaacaagauugccugau

SEQ ID NO: 2005804 - RNA, 14 nt, Shigella flexneri 2a str. 301
cugagauggcuuca

SEQ ID NO: 2005805 - RNA, 20 nt, Shigella flexneri 2a str. 301
cugagauggcuucaucccag

SEQ ID NO: 2005806 - RNA, 16 nt, Shigella flexneri 2a str. 301
cugagcagccaccacu

SEQ ID NO: 2005807 - RNA, 16 nt, Shigella flexneri 2a str. 301
cugagcacuggggcuu

SEQ ID NO: 2005808 - RNA, 21 nt, Shigella flexneri 2a str. 301
cugagcaugaugccugaugcg

SEQ ID NO: 2005809 - RNA, 18 nt, Shigella flexneri 2a str. 301
cugagcaugaugccugau

SEQ ID NO: 2005810 - RNA, 22 nt, Shigella flexneri 2a str. 301
cugagcaucacauaaucgaaaa

SEQ ID NO: 2005811 - RNA, 17 nt, Shigella flexneri 2a str. 301
cugacugcgccacuucc

SEQ ID NO: 2005812 - RNA, 14 nt, Shigella flexneri 2a str. 301
cugagaaacucagu

SEQ ID NO: 2005813 - RNA, 16 nt, Shigella flexneri 2a str. 301
cugacugacgugauga

SEQ ID NO: 2005814 - RNA, 19 nt, Shigella flexneri 2a str. 301
cugacggcgauaaaucuca

SEQ ID NO: 2005815 - RNA, 13 nt, Shigella flexneri 2a str. 301
cugacggccuucg

SEQ ID NO: 2005816 - RNA, 21 nt, Shigella flexneri 2a str. 301
cugacggccuucggugcgaca

SEQ ID NO: 2005817 - RNA, 24 nt, Shigella flexneri 2a str. 301
cugacuagaugugcaguuccugca

SEQ ID NO: 2005818 - RNA, 19 nt, Shigella flexneri 2a str. 301
cugacgcccguuuucaccu

SEQ ID NO: 2005819 - RNA, 13 nt, Shigella flexneri 2a str. 301
cugaccuucuuca

SEQ ID NO: 2005820 - RNA, 17 nt, Shigella flexneri 2a str. 301
cugacggacgcgcggcg

SEQ ID NO: 2005821 - RNA, 19 nt, Shigella flexneri 2a str. 301
cugacgcuuaucuucugua

SEQ ID NO: 2005822 - RNA, 16 nt, Shigella flexneri 2a str. 301
cugacggaucuguucc

SEQ ID NO: 2005823 - RNA, 20 nt, Shigella flexneri 2a str. 301
cugacggaaaucaugcaaca

SEQ ID NO: 2005824 - RNA, 15 nt, Shigella flexneri 2a str. 301
cugacggauagccuu

SEQ ID NO: 2005825 - RNA, 17 nt, Shigella flexneri 2a str. 301
cugaccacggccacagc

SEQ ID NO: 2005826 - RNA, 19 nt, Shigella flexneri 2a str. 301
cugaccacggccacagcca

SEQ ID NO: 2005827 - RNA, 15 nt, Shigella flexneri 2a str. 301
cugaccacggccaca

SEQ ID NO: 2005828 - RNA, 18 nt, Shigella flexneri 2a str. 301
cugacauuuuuacuccuu

SEQ ID NO: 2005829 - RNA, 16 nt, Shigella flexneri 2a str. 301
cugaccagacuggagc

SEQ ID NO: 2005830 - RNA, 23 nt, Shigella flexneri 2a str. 301
cugaccacuucgguacccagacg

SEQ ID NO: 2005831 - RNA, 20 nt, Shigella flexneri 2a str. 301
cugaccauaacccgcuucca

SEQ ID NO: 2005832 - RNA, 22 nt, Shigella flexneri 2a str. 301
cugaccugaauuaaugccucuc

SEQ ID NO: 2005833 - RNA, 17 nt, Shigella flexneri 2a str. 301
cugaccugcccaaucau

SEQ ID NO: 2005834 - RNA, 19 nt, Shigella flexneri 2a str. 301
cugaccugcggcaccagcg

SEQ ID NO: 2005835 - RNA, 20 nt, Shigella flexneri 2a str. 301
cugaccugaauuaaugccuc

SEQ ID NO: 2005836 - RNA, 15 nt, Shigella flexneri 2a str. 301
cugaccguuaauuuc

SEQ ID NO: 2005837 - RNA, 18 nt, Shigella flexneri 2a str. 301
cugaccuucaaauccuca

SEQ ID NO: 2005838 - RNA, 16 nt, Shigella flexneri 2a str. 301
cugacacaggcagcaa

SEQ ID NO: 2005839 - RNA, 13 nt, Shigella flexneri 2a str. 301
cugacaaaucaug

SEQ ID NO: 2005840 - RNA, 19 nt, Shigella flexneri 2a str. 301
cugacaacaccaauuucug

SEQ ID NO: 2005841 - RNA, 21 nt, Shigella flexneri 2a str. 301
cugacagaaguaaucuacugc

SEQ ID NO: 2005842 - RNA, 14 nt, Shigella flexneri 2a str. 301
cugaaggcgcauug

SEQ ID NO: 2005843 - RNA, 21 nt, Shigella flexneri 2a str. 301
cugaagguugugaacccugaa

SEQ ID NO: 2005844 - RNA, 18 nt, Shigella flexneri 2a str. 301
cugaaggucuucgguaag

SEQ ID NO: 2005845 - RNA, 14 nt, Shigella flexneri 2a str. 301
cugagccagugccg

SEQ ID NO: 2005846 - RNA, 17 nt, Shigella flexneri 2a str. 301
cugagccaguuuuucuu

SEQ ID NO: 2005847 - RNA, 21 nt, Shigella flexneri 2a str. 301
cugagccaguuuuucuuuuuc

SEQ ID NO: 2005848 - RNA, 16 nt, Shigella flexneri 2a str. 301
cugaguugcagcaacu

SEQ ID NO: 2005849 - RNA, 23 nt, Shigella flexneri 2a str. 301
cugaguugcagcaacucuuuuuc

SEQ ID NO: 2005850 - RNA, 23 nt, Shigella flexneri 2a str. 301
cugagugauacguaaaccacuga

SEQ ID NO: 2005851 - RNA, 19 nt, Shigella flexneri 2a str. 301
cugagugggcgucagcagu

SEQ ID NO: 2005852 - RNA, 14 nt, Shigella flexneri 2a str. 301
cugagugacgcgcu

SEQ ID NO: 2005853 - RNA, 14 nt, Shigella flexneri 2a str. 301
cugauacauagcac

SEQ ID NO: 2005854 - RNA, 17 nt, Shigella flexneri 2a str. 301
cugauaugccagacuuc

SEQ ID NO: 2005855 - RNA, 17 nt, Shigella flexneri 2a str. 301
cugauauggugguaacu

SEQ ID NO: 2005856 - RNA, 14 nt, Shigella flexneri 2a str. 301
cugauacugaaugu

SEQ ID NO: 2005857 - RNA, 19 nt, Shigella flexneri 2a str. 301
cugauaauccagacuauuu

SEQ ID NO: 2005858 - RNA, 20 nt, Shigella flexneri 2a str. 301
cugauaaucggggauaagaa

SEQ ID NO: 2005859 - RNA, 16 nt, Shigella flexneri 2a str. 301
cugaucaauauagaua

SEQ ID NO: 2005860 - RNA, 16 nt, Shigella flexneri 2a str. 301
cugauauucgacacca

SEQ ID NO: 2005861 - RNA, 18 nt, Shigella flexneri 2a str. 301
cugauauuaagcagacgg

SEQ ID NO: 2005862 - RNA, 19 nt, Shigella flexneri 2a str. 301
cugauccagcucuucuuca

SEQ ID NO: 2005863 - RNA, 15 nt, Shigella flexneri 2a str. 301
cugauccagcucuuc

SEQ ID NO: 2005864 - RNA, 22 nt, Shigella flexneri 2a str. 301
cugauccacaguugcucaauca

SEQ ID NO: 2005865 - RNA, 12 nt, Shigella flexneri 2a str. 301
cugauccugcac

SEQ ID NO: 2005866 - RNA, 18 nt, Shigella flexneri 2a str. 301
cugauugaccgccagcgc

SEQ ID NO: 2005867 - RNA, 16 nt, Shigella flexneri 2a str. 301
cugauucgucaauauc

SEQ ID NO: 2005868 - RNA, 23 nt, Shigella flexneri 2a str. 301
cugauuuaaccaacaauaaaauu

SEQ ID NO: 2005869 - RNA, 19 nt, Shigella flexneri 2a str. 301
cugauuuauagauuuacua

SEQ ID NO: 2005870 - RNA, 20 nt, Shigella flexneri 2a str. 301
cugcaaaaagcagguuuuac

SEQ ID NO: 2005871 - RNA, 13 nt, Shigella flexneri 2a str. 301
cugaugcgacacu

SEQ ID NO: 2005872 - RNA, 15 nt, Shigella flexneri 2a str. 301
cugaugcgacacugu

SEQ ID NO: 2005873 - RNA, 18 nt, Shigella flexneri 2a str. 301
cugaugcacgauaacguc

SEQ ID NO: 2005874 - RNA, 17 nt, Shigella flexneri 2a str. 301
cugaugcaucagucacg

SEQ ID NO: 2005875 - RNA, 19 nt, Shigella flexneri 2a str. 301
cugcaaaauagccaaucau

SEQ ID NO: 2005876 - RNA, 16 nt, Shigella flexneri 2a str. 301
cugcaaaauaccaaua

SEQ ID NO: 2005877 - RNA, 11 nt, Shigella flexneri 2a str. 301
cugcaaaccau

SEQ ID NO: 2005878 - RNA, 16 nt, Shigella flexneri 2a str. 301
cugcaaagcauuuuuu

SEQ ID NO: 2005879 - RNA, 21 nt, Shigella flexneri 2a str. 301
cugcaaagucugggcuuuugu

SEQ ID NO: 2005880 - RNA, 14 nt, Shigella flexneri 2a str. 301
cugcaaauacccaa

SEQ ID NO: 2005881 - RNA, 20 nt, Shigella flexneri 2a str. 301
cugcaauaaaauaucuucca

SEQ ID NO: 2005882 - RNA, 18 nt, Shigella flexneri 2a str. 301
cugcaaggccauccgcug

SEQ ID NO: 2005883 - RNA, 18 nt, Shigella flexneri 2a str. 301
cugcaaggugaaagcaau

SEQ ID NO: 2005884 - RNA, 19 nt, Shigella flexneri 2a str. 301
cugcaagauuaaaccaguu

SEQ ID NO: 2005885 - RNA, 13 nt, Shigella flexneri 2a str. 301
cugcaacugcgcg

SEQ ID NO: 2005886 - RNA, 20 nt, Shigella flexneri 2a str. 301
cugcuuucucccaguugugg

SEQ ID NO: 2005887 - RNA, 17 nt, Shigella flexneri 2a str. 301
cugcuuuccgcuggcgu

SEQ ID NO: 2005888 - RNA, 20 nt, Shigella flexneri 2a str. 301
cugcuuaucgcccugcucca

SEQ ID NO: 2005889 - RNA, 19 nt, Shigella flexneri 2a str. 301
cugcuuaguaaaaauagug

SEQ ID NO: 2005890 - RNA, 22 nt, Shigella flexneri 2a str. 301
cugcuuaguaaaaauagugcgu

SEQ ID NO: 2005891 - RNA, 16 nt, Shigella flexneri 2a str. 301
cugcuuacaggcuggu

SEQ ID NO: 2005892 - RNA, 15 nt, Shigella flexneri 2a str. 301
cugcuuaaauuucuu

SEQ ID NO: 2005893 - RNA, 16 nt, Shigella flexneri 2a str. 301
cugcuuaacugcgcuu

SEQ ID NO: 2005894 - RNA, 19 nt, Shigella flexneri 2a str. 301
cugcuguuuuuucaggccc

SEQ ID NO: 2005895 - RNA, 18 nt, Shigella flexneri 2a str. 301
cugcugcguuccggcaug

SEQ ID NO: 2005896 - RNA, 14 nt, Shigella flexneri 2a str. 301
cuggaaaaagugcc

SEQ ID NO: 2005897 - RNA, 21 nt, Shigella flexneri 2a str. 301
cuggaaacucacgccagcagc

SEQ ID NO: 2005898 - RNA, 19 nt, Shigella flexneri 2a str. 301
cugcuuuuccggucagcaa

SEQ ID NO: 2005899 - RNA, 23 nt, Shigella flexneri 2a str. 301
cugcuuugcccacgcuuuucauc

SEQ ID NO: 2005900 - RNA, 18 nt, Shigella flexneri 2a str. 301
cuggaauuccuuucccua

SEQ ID NO: 2005901 - RNA, 17 nt, Shigella flexneri 2a str. 301
cuggaacagccggaugu

SEQ ID NO: 2005902 - RNA, 15 nt, Shigella flexneri 2a str. 301
cuggaaaucaauggu

SEQ ID NO: 2005903 - RNA, 16 nt, Shigella flexneri 2a str. 301
cuggaaaucaaugguc

SEQ ID NO: 2005904 - RNA, 24 nt, Shigella flexneri 2a str. 301
cuggaaauguccgcgaacagcagc

SEQ ID NO: 2005905 - RNA, 18 nt, Shigella flexneri 2a str. 301
cuggacaacuucugaugu

SEQ ID NO: 2005906 - RNA, 22 nt, Shigella flexneri 2a str. 301
cuggacaaagagcuuucauuuc

SEQ ID NO: 2005907 - RNA, 22 nt, Shigella flexneri 2a str. 301
cuggacaacauuccugcugacg

SEQ ID NO: 2005908 - RNA, 23 nt, Shigella flexneri 2a str. 301
cuggaucacaauccgcucuuuca

SEQ ID NO: 2005909 - RNA, 15 nt, Shigella flexneri 2a str. 301
cuggauuugugucag

SEQ ID NO: 2005910 - RNA, 23 nt, Shigella flexneri 2a str. 301
cuggauuucaauaacuccaucuu

SEQ ID NO: 2005911 - RNA, 19 nt, Shigella flexneri 2a str. 301
cuggacguuugauuuuuaa

SEQ ID NO: 2005912 - RNA, 20 nt, Shigella flexneri 2a str. 301
cuggacucccagaacaaccc

SEQ ID NO: 2005913 - RNA, 16 nt, Shigella flexneri 2a str. 301
cuggacuugaaccagc

SEQ ID NO: 2005914 - RNA, 16 nt, Shigella flexneri 2a str. 301
cuggcaugcuguccag

SEQ ID NO: 2005915 - RNA, 16 nt, Shigella flexneri 2a str. 301
cuggcaacaauggcau

SEQ ID NO: 2005916 - RNA, 21 nt, Shigella flexneri 2a str. 301
cuggccacaaaccuuaaaugg

SEQ ID NO: 2005917 - RNA, 17 nt, Shigella flexneri 2a str. 301
cuggccaaugccucuac

SEQ ID NO: 2005918 - RNA, 18 nt, Shigella flexneri 2a str. 301
cugcucggucugcugggc

SEQ ID NO: 2005919 - RNA, 15 nt, Shigella flexneri 2a str. 301
cugcucaaugucugu

SEQ ID NO: 2005920 - RNA, 12 nt, Shigella flexneri 2a str. 301
cugcucagcucc

SEQ ID NO: 2005921 - RNA, 14 nt, Shigella flexneri 2a str. 301
cugcucagcuccuc

SEQ ID NO: 2005922 - RNA, 17 nt, Shigella flexneri 2a str. 301
cugcuccguaaaacuca

SEQ ID NO: 2005923 - RNA, 17 nt, Shigella flexneri 2a str. 301
cugcuccuguugaugug

SEQ ID NO: 2005924 - RNA, 16 nt, Shigella flexneri 2a str. 301
cugcuccugcggcugc

SEQ ID NO: 2005925 - RNA, 14 nt, Shigella flexneri 2a str. 301
aaacucaaucaggc

SEQ ID NO: 2005926 - RNA, 19 nt, Shigella flexneri 2a str. 301
cugcucuuuuugcauaauu

SEQ ID NO: 2005927 - RNA, 23 nt, Shigella flexneri 2a str. 301
cugcugcacgcccugauaaauca

SEQ ID NO: 2005928 - RNA, 16 nt, Shigella flexneri 2a str. 301
cugcugcacgcccuga

SEQ ID NO: 2005929 - RNA, 11 nt, Shigella flexneri 2a str. 301
cugcugccgcu

SEQ ID NO: 2005930 - RNA, 20 nt, Shigella flexneri 2a str. 301
cugcugccacauuccucugu

SEQ ID NO: 2005931 - RNA, 16 nt, Shigella flexneri 2a str. 301
cugcggcgugggcgcu

SEQ ID NO: 2005932 - RNA, 23 nt, Shigella flexneri 2a str. 301
cugcggcgugggcgcuguugcac

SEQ ID NO: 2005933 - RNA, 21 nt, Shigella flexneri 2a str. 301
cugcggcgcgcaucuucguua

SEQ ID NO: 2005934 - RNA, 19 nt, Shigella flexneri 2a str. 301
cugcggcggcaucgccuuc

SEQ ID NO: 2005935 - RNA, 15 nt, Shigella flexneri 2a str. 301
cugcggcuggcacaa

SEQ ID NO: 2005936 - RNA, 16 nt, Shigella flexneri 2a str. 301
cugcgcuaaacaggau

SEQ ID NO: 2005937 - RNA, 15 nt, Shigella flexneri 2a str. 301
cugcgcuuccagcuc

SEQ ID NO: 2005938 - RNA, 19 nt, Shigella flexneri 2a str. 301
cugcgcuuacacacccggc

SEQ ID NO: 2005939 - RNA, 14 nt, Shigella flexneri 2a str. 301
cugcgcuggaacaa

SEQ ID NO: 2005940 - RNA, 15 nt, Shigella flexneri 2a str. 301
cugcgcucuucuggc

SEQ ID NO: 2005941 - RNA, 14 nt, Shigella flexneri 2a str. 301
cugcgcugacucua

SEQ ID NO: 2005942 - RNA, 16 nt, Shigella flexneri 2a str. 301
cugcucaaguaauaaa

SEQ ID NO: 2005943 - RNA, 23 nt, Shigella flexneri 2a str. 301
cugcgucauuccggaguuuauga

SEQ ID NO: 2005944 - RNA, 20 nt, Shigella flexneri 2a str. 301
cugcgugucguaagccaccg

SEQ ID NO: 2005945 - RNA, 11 nt, Shigella flexneri 2a str. 301
cugcguauuuc

SEQ ID NO: 2005946 - RNA, 15 nt, Shigella flexneri 2a str. 301
cugcguuccggcaug

SEQ ID NO: 2005947 - RNA, 13 nt, Shigella flexneri 2a str. 301
cugcguucugucg

SEQ ID NO: 2005948 - RNA, 16 nt, Shigella flexneri 2a str. 301
cugcgguucagcuuuu

SEQ ID NO: 2005949 - RNA, 19 nt, Shigella flexneri 2a str. 301
cugcguacugagucgggug

SEQ ID NO: 2005950 - RNA, 16 nt, Shigella flexneri 2a str. 301
cugcguauuuccugcc

SEQ ID NO: 2005951 - RNA, 13 nt, Shigella flexneri 2a str. 301
cugcguaauguuu

SEQ ID NO: 2005952 - RNA, 20 nt, Shigella flexneri 2a str. 301
cugccaaacgcucccugcca

SEQ ID NO: 2005953 - RNA, 16 nt, Shigella flexneri 2a str. 301
cugcauuugccccugu

SEQ ID NO: 2005954 - RNA, 14 nt, Shigella flexneri 2a str. 301
cugcauuugcugca

SEQ ID NO: 2005955 - RNA, 17 nt, Shigella flexneri 2a str. 301
cugcauggugccgccaa

SEQ ID NO: 2005956 - RNA, 13 nt, Shigella flexneri 2a str. 301
cugcauucaccag

SEQ ID NO: 2005957 - RNA, 14 nt, Shigella flexneri 2a str. 301
cugcauguuggcga

SEQ ID NO: 2005958 - RNA, 22 nt, Shigella flexneri 2a str. 301
cugcauuccgguguaaccauca

SEQ ID NO: 2005959 - RNA, 22 nt, Shigella flexneri 2a str. 301
cugcaucuuccguggaacaaaa

SEQ ID NO: 2005960 - RNA, 19 nt, Shigella flexneri 2a str. 301
cugcaugacggcugaaaug

SEQ ID NO: 2005961 - RNA, 19 nt, Shigella flexneri 2a str. 301
cugcauccgccauccacca

SEQ ID NO: 2005962 - RNA, 16 nt, Shigella flexneri 2a str. 301
cugcauccgccaucca

SEQ ID NO: 2005963 - RNA, 13 nt, Shigella flexneri 2a str. 301
cugcauccguucu

SEQ ID NO: 2005964 - RNA, 14 nt, Shigella flexneri 2a str. 301
cugcaaucaccacu

SEQ ID NO: 2005965 - RNA, 20 nt, Shigella flexneri 2a str. 301
cugcaaugccguuugcugca

SEQ ID NO: 2005966 - RNA, 16 nt, Shigella flexneri 2a str. 301
cugcaauugcggcagg

SEQ ID NO: 2005967 - RNA, 12 nt, Shigella flexneri 2a str. 301
cugcaaugacca

SEQ ID NO: 2005968 - RNA, 18 nt, Shigella flexneri 2a str. 301
cugcagugaaauuaaacu

SEQ ID NO: 2005969 - RNA, 15 nt, Shigella flexneri 2a str. 301
cugcagugcaaugac

SEQ ID NO: 2005970 - RNA, 20 nt, Shigella flexneri 2a str. 301
cugcauaaacgccgucauca

SEQ ID NO: 2005971 - RNA, 13 nt, Shigella flexneri 2a str. 301
cugcccgcaccca

SEQ ID NO: 2005972 - RNA, 15 nt, Shigella flexneri 2a str. 301
cugccgcaaacgaca

SEQ ID NO: 2005973 - RNA, 15 nt, Shigella flexneri 2a str. 301
cugccgauggcacaa

SEQ ID NO: 2005974 - RNA, 15 nt, Shigella flexneri 2a str. 301
cugcccgcgcugucg

SEQ ID NO: 2005975 - RNA, 20 nt, Shigella flexneri 2a str. 301
cugcccaucauaccugagug

SEQ ID NO: 2005976 - RNA, 23 nt, Shigella flexneri 2a str. 301
cugcccaguugugaugauuuugu

SEQ ID NO: 2005977 - RNA, 15 nt, Shigella flexneri 2a str. 301
cugccccagugggcu

SEQ ID NO: 2005978 - RNA, 13 nt, Shigella flexneri 2a str. 301
cugccccaguucc

SEQ ID NO: 2005979 - RNA, 21 nt, Shigella flexneri 2a str. 301
cugccauccguaauuuuuacu

SEQ ID NO: 2005980 - RNA, 14 nt, Shigella flexneri 2a str. 301
cugcccacgcgcac

SEQ ID NO: 2005981 - RNA, 18 nt, Shigella flexneri 2a str. 301
cugccagaggagccauca

SEQ ID NO: 2005982 - RNA, 23 nt, Shigella flexneri 2a str. 301
cugccagaggagccaucaccauc

SEQ ID NO: 2005983 - RNA, 17 nt, Shigella flexneri 2a str. 301
cugccagacuccaggcg

SEQ ID NO: 2005984 - RNA, 23 nt, Shigella flexneri 2a str. 301
cugccagaaggauugaucaauuc

SEQ ID NO: 2005985 - RNA, 13 nt, Shigella flexneri 2a str. 301
cugccagccaucu

SEQ ID NO: 2005986 - RNA, 21 nt, Shigella flexneri 2a str. 301
cugccaguucccccugccaga

SEQ ID NO: 2005987 - RNA, 16 nt, Shigella flexneri 2a str. 301
cugccaguuguugcug

SEQ ID NO: 2005988 - RNA, 22 nt, Shigella flexneri 2a str. 301
cugccaguuguugcugaauuug

SEQ ID NO: 2005989 - RNA, 24 nt, Shigella flexneri 2a str. 301
cugccagaucaucguuuccgaugg

SEQ ID NO: 2005990 - RNA, 18 nt, Shigella flexneri 2a str. 301
cugccagaucggccauca

SEQ ID NO: 2005991 - RNA, 23 nt, Shigella flexneri 2a str. 301
cugccagaugcagcgguaauucc

SEQ ID NO: 2005992 - RNA, 17 nt, Shigella flexneri 2a str. 301
cugccaguccugcucaa

SEQ ID NO: 2005993 - RNA, 18 nt, Shigella flexneri 2a str. 301
cugccagucaaucaucca

SEQ ID NO: 2005994 - RNA, 12 nt, Shigella flexneri 2a str. 301
cugccagccagg

SEQ ID NO: 2005995 - RNA, 13 nt, Shigella flexneri 2a str. 301
cugcgcagcggug

SEQ ID NO: 2005996 - RNA, 14 nt, Shigella flexneri 2a str. 301
cugcgcacaagccc

SEQ ID NO: 2005997 - RNA, 20 nt, Shigella flexneri 2a str. 301
cugcgcacaagcccaugcac

SEQ ID NO: 2005998 - RNA, 23 nt, Shigella flexneri 2a str. 301
cugcgcacacacgcccagcucaa

SEQ ID NO: 2005999 - RNA, 18 nt, Shigella flexneri 2a str. 301
cugccugauccugggcua

SEQ ID NO: 2006000 - RNA, 19 nt, Shigella flexneri 2a str. 301
cugccugacggaaaucaug

SEQ ID NO: 2006001 - RNA, 14 nt, Shigella flexneri 2a str. 301
cugccugauacuga

SEQ ID NO: 2006002 - RNA, 15 nt, Shigella flexneri 2a str. 301
cugccugaugcgcuc

SEQ ID NO: 2006003 - RNA, 19 nt, Shigella flexneri 2a str. 301
cugccugcggaaugagcga

SEQ ID NO: 2006004 - RNA, 16 nt, Shigella flexneri 2a str. 301
cugccugcagcugcuc

SEQ ID NO: 2006005 - RNA, 20 nt, Shigella flexneri 2a str. 301
cugcgauaguggaacaaaga

SEQ ID NO: 2006006 - RNA, 13 nt, Shigella flexneri 2a str. 301
cugcgaguccugu

SEQ ID NO: 2006007 - RNA, 17 nt, Shigella flexneri 2a str. 301
cugccuuauccagcaga

SEQ ID NO: 2006008 - RNA, 19 nt, Shigella flexneri 2a str. 301
cugccuguacggcagugaa

SEQ ID NO: 2006009 - RNA, 23 nt, Shigella flexneri 2a str. 301
cugccggggagauauuccccaga

SEQ ID NO: 2006010 - RNA, 18 nt, Shigella flexneri 2a str. 301
cugccgggcaaucgcccc

SEQ ID NO: 2006011 - RNA, 21 nt, Shigella flexneri 2a str. 301
cugccgggaagcucucuucca

SEQ ID NO: 2006012 - RNA, 15 nt, Shigella flexneri 2a str. 301
cugccgccaguucuu

SEQ ID NO: 2006013 - RNA, 20 nt, Shigella flexneri 2a str. 301
cugccgcacuuugagcagcu

SEQ ID NO: 2006014 - RNA, 15 nt, Shigella flexneri 2a str. 301
cugccgcacggacaa

SEQ ID NO: 2006015 - RNA, 15 nt, Shigella flexneri 2a str. 301
cugccguuaacccgu

SEQ ID NO: 2006016 - RNA, 18 nt, Shigella flexneri 2a str. 301
cugccguugcuugaugca

SEQ ID NO: 2006017 - RNA, 19 nt, Shigella flexneri 2a str. 301
cugccucgggauccaugca

SEQ ID NO: 2006018 - RNA, 18 nt, Shigella flexneri 2a str. 301
cugccucucuucgcugcu

SEQ ID NO: 2006019 - RNA, 15 nt, Shigella flexneri 2a str. 301
cugccucgcagaguu

SEQ ID NO: 2006020 - RNA, 17 nt, Shigella flexneri 2a str. 301
cugcgcgacuucauuca

SEQ ID NO: 2006021 - RNA, 16 nt, Shigella flexneri 2a str. 301
cugcgcgacucccuga

SEQ ID NO: 2006022 - RNA, 15 nt, Shigella flexneri 2a str. 301
cugcgccucgccgcu

SEQ ID NO: 2006023 - RNA, 22 nt, Shigella flexneri 2a str. 301
cugcgcgucuuaucaggccugu

SEQ ID NO: 2006024 - RNA, 20 nt, Shigella flexneri 2a str. 301
cugcgcauuucccagcaaga

SEQ ID NO: 2006025 - RNA, 12 nt, Shigella flexneri 2a str. 301
cugcgccagcca

SEQ ID NO: 2006026 - RNA, 15 nt, Shigella flexneri 2a str. 301
cugcgccacuuccca

SEQ ID NO: 2006027 - RNA, 18 nt, Shigella flexneri 2a str. 301
cugcgccagcggcaguaa

SEQ ID NO: 2006028 - RNA, 12 nt, Shigella flexneri 2a str. 301
cugcgccagcgc

SEQ ID NO: 2006029 - RNA, 16 nt, Shigella flexneri 2a str. 301
cugcgccagcgcgcgu

SEQ ID NO: 2006030 - RNA, 15 nt, Shigella flexneri 2a str. 301
cugcgccgccucugc

SEQ ID NO: 2006031 - RNA, 19 nt, Shigella flexneri 2a str. 301
cugcgccccacaccaccau

SEQ ID NO: 2006032 - RNA, 20 nt, Shigella flexneri 2a str. 301
cugcgcccgcccgcuguaag

SEQ ID NO: 2006033 - RNA, 14 nt, Shigella flexneri 2a str. 301
cugcgcccgcccgc

SEQ ID NO: 2006034 - RNA, 13 nt, Shigella flexneri 2a str. 301
cugcgcccgcagc

SEQ ID NO: 2006035 - RNA, 17 nt, Shigella flexneri 2a str. 301
cugcgccgagcaauaaa

SEQ ID NO: 2006036 - RNA, 13 nt, Shigella flexneri 2a str. 301
cuaccuucuuccc

SEQ ID NO: 2006037 - RNA, 19 nt, Shigella flexneri 2a str. 301
cuacgacgccaagaaagag

SEQ ID NO: 2006038 - RNA, 19 nt, Shigella flexneri 2a str. 301
cuacgcagggauauuucac

SEQ ID NO: 2006039 - RNA, 21 nt, Shigella flexneri 2a str. 301
cuacgaguaugacaacuuuca

SEQ ID NO: 2006040 - RNA, 12 nt, Shigella flexneri 2a str. 301
cuaacaucaucc

SEQ ID NO: 2006041 - RNA, 15 nt, Shigella flexneri 2a str. 301
cuaacauuuuacuua

SEQ ID NO: 2006042 - RNA, 23 nt, Shigella flexneri 2a str. 301
cuaacaucauccccguaucuuca

SEQ ID NO: 2006043 - RNA, 21 nt, Shigella flexneri 2a str. 301
cuacugauggcuacguucugc

SEQ ID NO: 2006044 - RNA, 14 nt, Shigella flexneri 2a str. 301
cuacugaaucccug

SEQ ID NO: 2006045 - RNA, 18 nt, Shigella flexneri 2a str. 301
cuacuggcaauccagcuc

SEQ ID NO: 2006046 - RNA, 21 nt, Shigella flexneri 2a str. 301
cuacuaugauuuuccugagga

SEQ ID NO: 2006047 - RNA, 20 nt, Shigella flexneri 2a str. 301
cuacuauggaacgcucaagc

SEQ ID NO: 2006048 - RNA, 16 nt, Shigella flexneri 2a str. 301
cuacuccaacccggca

SEQ ID NO: 2006049 - RNA, 14 nt, Shigella flexneri 2a str. 301
cuacucguuuauua

SEQ ID NO: 2006050 - RNA, 14 nt, Shigella flexneri 2a str. 301
cuacuuuuuuaaga

SEQ ID NO: 2006051 - RNA, 21 nt, Shigella flexneri 2a str. 301
cuacuuuuuaauucaggaaau

SEQ ID NO: 2006052 - RNA, 20 nt, Shigella flexneri 2a str. 301
cuacuucuuucaccaucgca

SEQ ID NO: 2006053 - RNA, 11 nt, Shigella flexneri 2a str. 301
cuacuucuucg

SEQ ID NO: 2006054 - RNA, 22 nt, Shigella flexneri 2a str. 301
cuagaugugcaguuccugcaac

SEQ ID NO: 2006055 - RNA, 18 nt, Shigella flexneri 2a str. 301
cuaggcgccaagggcggc

SEQ ID NO: 2006056 - RNA, 15 nt, Shigella flexneri 2a str. 301
cuagcuucagguguu

SEQ ID NO: 2006057 - RNA, 19 nt, Shigella flexneri 2a str. 301
cuagcuggcucgacaaaau

SEQ ID NO: 2006058 - RNA, 20 nt, Shigella flexneri 2a str. 301
cuagcgcuuuuucugaaacu

SEQ ID NO: 2006059 - RNA, 23 nt, Shigella flexneri 2a str. 301
cuauaauugcuuuuuuccauaag

SEQ ID NO: 2006060 - RNA, 19 nt, Shigella flexneri 2a str. 301
cuauaccagauaaacaucg

SEQ ID NO: 2006061 - RNA, 16 nt, Shigella flexneri 2a str. 301
cuauauacccuucuca

SEQ ID NO: 2006062 - RNA, 18 nt, Shigella flexneri 2a str. 301
cuauagugaggcuauucc

SEQ ID NO: 2006063 - RNA, 16 nt, Shigella flexneri 2a str. 301
cuauauuccuuuauca

SEQ ID NO: 2006064 - RNA, 20 nt, Shigella flexneri 2a str. 301
cuauuaaaaagcuucucaga

SEQ ID NO: 2006065 - RNA, 14 nt, Shigella flexneri 2a str. 301
cuaugauuuuccug

SEQ ID NO: 2006066 - RNA, 21 nt, Shigella flexneri 2a str. 301
cuaucggcagaguugagcagu

SEQ ID NO: 2006067 - RNA, 22 nt, Shigella flexneri 2a str. 301
cuaucagcgccaccacaaaagc

SEQ ID NO: 2006068 - RNA, 18 nt, Shigella flexneri 2a str. 301
cuaucagauuggcuucau

SEQ ID NO: 2006069 - RNA, 23 nt, Shigella flexneri 2a str. 301
cuaucagaccuacaaaaccugca

SEQ ID NO: 2006070 - RNA, 20 nt, Shigella flexneri 2a str. 301
cuaucagaccuacaaaaccu

SEQ ID NO: 2006071 - RNA, 20 nt, Shigella flexneri 2a str. 301
cuauccacgucgacaacucc

SEQ ID NO: 2006072 - RNA, 16 nt, Shigella flexneri 2a str. 301
cuauccagcucaucca

SEQ ID NO: 2006073 - RNA, 14 nt, Shigella flexneri 2a str. 301
cuauccggcauaca

SEQ ID NO: 2006074 - RNA, 20 nt, Shigella flexneri 2a str. 301
cuaucgaacaugcgggucuu

SEQ ID NO: 2006075 - RNA, 16 nt, Shigella flexneri 2a str. 301
cucacagaguauuucc

SEQ ID NO: 2006076 - RNA, 15 nt, Shigella flexneri 2a str. 301
cucacagcuaaucau

SEQ ID NO: 2006077 - RNA, 23 nt, Shigella flexneri 2a str. 301
cucacagaguauuuccagcucaa

SEQ ID NO: 2006078 - RNA, 19 nt, Shigella flexneri 2a str. 301
cucacaugaguugcuggac

SEQ ID NO: 2006079 - RNA, 22 nt, Shigella flexneri 2a str. 301
cucacaucaugcgucaccaaca

SEQ ID NO: 2006080 - RNA, 21 nt, Shigella flexneri 2a str. 301
cucacagggcucuuaagcacc

SEQ ID NO: 2006081 - RNA, 14 nt, Shigella flexneri 2a str. 301
cucacccggaggaa

SEQ ID NO: 2006082 - RNA, 18 nt, Shigella flexneri 2a str. 301
cucacccggaggaaagca

SEQ ID NO: 2006083 - RNA, 21 nt, Shigella flexneri 2a str. 301
cucacccggaggaaagcaccu

SEQ ID NO: 2006084 - RNA, 13 nt, Shigella flexneri 2a str. 301
cucacccguacag

SEQ ID NO: 2006085 - RNA, 19 nt, Shigella flexneri 2a str. 301
cucacccuaacccucuccc

SEQ ID NO: 2006086 - RNA, 16 nt, Shigella flexneri 2a str. 301
cucaaucaacuccauu

SEQ ID NO: 2006087 - RNA, 13 nt, Shigella flexneri 2a str. 301
cucaaucaaaaga

SEQ ID NO: 2006088 - RNA, 22 nt, Shigella flexneri 2a str. 301
cucacagaggucuuuucucguu

SEQ ID NO: 2006089 - RNA, 15 nt, Shigella flexneri 2a str. 301
cucaauaucaucauu

SEQ ID NO: 2006090 - RNA, 16 nt, Shigella flexneri 2a str. 301
cucaauaucaucauuu

SEQ ID NO: 2006091 - RNA, 15 nt, Shigella flexneri 2a str. 301
cucaauauccugacc

SEQ ID NO: 2006092 - RNA, 14 nt, Shigella flexneri 2a str. 301
cucaauaaaagaaa

SEQ ID NO: 2006093 - RNA, 21 nt, Shigella flexneri 2a str. 301
cucaaguugcgaaagcgagca

SEQ ID NO: 2006094 - RNA, 18 nt, Shigella flexneri 2a str. 301
cucacuacggcucaguaa

SEQ ID NO: 2006095 - RNA, 13 nt, Shigella flexneri 2a str. 301
cucacguuccaga

SEQ ID NO: 2006096 - RNA, 15 nt, Shigella flexneri 2a str. 301
cucacuaucgcugag

SEQ ID NO: 2006097 - RNA, 15 nt, Shigella flexneri 2a str. 301
cucacucauacucac

SEQ ID NO: 2006098 - RNA, 20 nt, Shigella flexneri 2a str. 301
cucacucaucacuccccgca

SEQ ID NO: 2006099 - RNA, 17 nt, Shigella flexneri 2a str. 301
cucacuccggccagagc

SEQ ID NO: 2006100 - RNA, 20 nt, Shigella flexneri 2a str. 301
cucacugcgaaguuuuuccg

SEQ ID NO: 2006101 - RNA, 13 nt, Shigella flexneri 2a str. 301
cucaccggauaau

SEQ ID NO: 2006102 - RNA, 20 nt, Shigella flexneri 2a str. 301
cucaccgguaaagucagcgu

SEQ ID NO: 2006103 - RNA, 20 nt, Shigella flexneri 2a str. 301
cucaccgccauauuuaaaga

SEQ ID NO: 2006104 - RNA, 13 nt, Shigella flexneri 2a str. 301
cucaccgccgccu

SEQ ID NO: 2006105 - RNA, 15 nt, Shigella flexneri 2a str. 301
cucacgaucacagca

SEQ ID NO: 2006106 - RNA, 20 nt, Shigella flexneri 2a str. 301
cucacgaucacagcagucca

SEQ ID NO: 2006107 - RNA, 13 nt, Shigella flexneri 2a str. 301
cucaccguugcca

SEQ ID NO: 2006108 - RNA, 14 nt, Shigella flexneri 2a str. 301
cucaacccuuucca

SEQ ID NO: 2006109 - RNA, 16 nt, Shigella flexneri 2a str. 301
cucaacccuuuccagc

SEQ ID NO: 2006110 - RNA, 19 nt, Shigella flexneri 2a str. 301
cucaacccuuuuuuaaaca

SEQ ID NO: 2006111 - RNA, 20 nt, Shigella flexneri 2a str. 301
cucaacacauuacugcuugc

SEQ ID NO: 2006112 - RNA, 24 nt, Shigella flexneri 2a str. 301
cuauuaagcuuuccggcaucacau

SEQ ID NO: 2006113 - RNA, 16 nt, Shigella flexneri 2a str. 301
cucaagcacccgccgc

SEQ ID NO: 2006114 - RNA, 14 nt, Shigella flexneri 2a str. 301
cucaacuuuaccuu

SEQ ID NO: 2006115 - RNA, 16 nt, Shigella flexneri 2a str. 301
cucaagaaagguugag

SEQ ID NO: 2006116 - RNA, 23 nt, Shigella flexneri 2a str. 301
cucaacugccaguucccccugcc

SEQ ID NO: 2006117 - RNA, 14 nt, Shigella flexneri 2a str. 301
cucaacuccccgca

SEQ ID NO: 2006118 - RNA, 19 nt, Shigella flexneri 2a str. 301
cucaacggcaauuuuaccu

SEQ ID NO: 2006119 - RNA, 21 nt, Shigella flexneri 2a str. 301
cucaacgccuaaugccagcga

SEQ ID NO: 2006120 - RNA, 18 nt, Shigella flexneri 2a str. 301
cucaucagugaacccaua

SEQ ID NO: 2006121 - RNA, 19 nt, Shigella flexneri 2a str. 301
cucaucagcgguaaaacgc

SEQ ID NO: 2006122 - RNA, 18 nt, Shigella flexneri 2a str. 301
cucaucaggccuacaaaa

SEQ ID NO: 2006123 - RNA, 18 nt, Shigella flexneri 2a str. 301
cucaucaagcuguucuuc

SEQ ID NO: 2006124 - RNA, 15 nt, Shigella flexneri 2a str. 301
cucaucaacguuuuu

SEQ ID NO: 2006125 - RNA, 12 nt, Shigella flexneri 2a str. 301
cucaucaccauu

SEQ ID NO: 2006126 - RNA, 9 nt, Shigella flexneri 2a str. 301
cucaucaau

SEQ ID NO: 2006127 - RNA, 21 nt, Shigella flexneri 2a str. 301
cucaucaccacagacaaacag

SEQ ID NO: 2006128 - RNA, 17 nt, Shigella flexneri 2a str. 301
cucaucuuugaaaucac

SEQ ID NO: 2006129 - RNA, 15 nt, Shigella flexneri 2a str. 301
cucaugcauaaucga

SEQ ID NO: 2006130 - RNA, 15 nt, Shigella flexneri 2a str. 301
cucaugcaucaggac

SEQ ID NO: 2006131 - RNA, 20 nt, Shigella flexneri 2a str. 301
cucaucuuugaaaucacgca

SEQ ID NO: 2006132 - RNA, 13 nt, Shigella flexneri 2a str. 301
cucaucuucauaa

SEQ ID NO: 2006133 - RNA, 15 nt, Shigella flexneri 2a str. 301
cucaucuuccaccac

SEQ ID NO: 2006134 - RNA, 21 nt, Shigella flexneri 2a str. 301
cucaucguugcgaucgaccug

SEQ ID NO: 2006135 - RNA, 14 nt, Shigella flexneri 2a str. 301
cucaucggcauaca

SEQ ID NO: 2006136 - RNA, 14 nt, Shigella flexneri 2a str. 301
cucauagaccauug

SEQ ID NO: 2006137 - RNA, 21 nt, Shigella flexneri 2a str. 301
cucauaauacaggcuacuccc

SEQ ID NO: 2006138 - RNA, 18 nt, Shigella flexneri 2a str. 301
cucauaaauucaaagugu

SEQ ID NO: 2006139 - RNA, 16 nt, Shigella flexneri 2a str. 301
cucaguugucugaauc

SEQ ID NO: 2006140 - RNA, 13 nt, Shigella flexneri 2a str. 301
cucaguacaggcc

SEQ ID NO: 2006141 - RNA, 20 nt, Shigella flexneri 2a str. 301
cucaguuccgggaucaccag

SEQ ID NO: 2006142 - RNA, 19 nt, Shigella flexneri 2a str. 301
cucaguaaaguuaccuucg

SEQ ID NO: 2006143 - RNA, 16 nt, Shigella flexneri 2a str. 301
cucaguaggcugacga

SEQ ID NO: 2006144 - RNA, 16 nt, Shigella flexneri 2a str. 301
cucagcacaccauaaa

SEQ ID NO: 2006145 - RNA, 16 nt, Shigella flexneri 2a str. 301
cucagaaucacgccaa

SEQ ID NO: 2006146 - RNA, 16 nt, Shigella flexneri 2a str. 301
cucagaccauauuccc

SEQ ID NO: 2006147 - RNA, 14 nt, Shigella flexneri 2a str. 301
cucagacucucauu

SEQ ID NO: 2006148 - RNA, 14 nt, Shigella flexneri 2a str. 301
cuccgccccggcaa

SEQ ID NO: 2006149 - RNA, 18 nt, Shigella flexneri 2a str. 301
cucccuuuuucaagcuca

SEQ ID NO: 2006150 - RNA, 13 nt, Shigella flexneri 2a str. 301
cucccuuaaaaaa

SEQ ID NO: 2006151 - RNA, 16 nt, Shigella flexneri 2a str. 301
cucccuguaucccagu

SEQ ID NO: 2006152 - RNA, 17 nt, Shigella flexneri 2a str. 301
cuccgccuuugaaaaua

SEQ ID NO: 2006153 - RNA, 19 nt, Shigella flexneri 2a str. 301
cuccgcgccgcgguacagc

SEQ ID NO: 2006154 - RNA, 20 nt, Shigella flexneri 2a str. 301
cucccgaaugaccgccccug

SEQ ID NO: 2006155 - RNA, 18 nt, Shigella flexneri 2a str. 301
cucccgaaugaccgcccc

SEQ ID NO: 2006156 - RNA, 23 nt, Shigella flexneri 2a str. 301
cucccucgucggugguggucccu

SEQ ID NO: 2006157 - RNA, 15 nt, Shigella flexneri 2a str. 301
cucccugccccaucu

SEQ ID NO: 2006158 - RNA, 18 nt, Shigella flexneri 2a str. 301
cuccccuuucuuauuuuu

SEQ ID NO: 2006159 - RNA, 19 nt, Shigella flexneri 2a str. 301
cucccacggaauagaaccu

SEQ ID NO: 2006160 - RNA, 15 nt, Shigella flexneri 2a str. 301
cucccagccucccau

SEQ ID NO: 2006161 - RNA, 23 nt, Shigella flexneri 2a str. 301
cuccagcgggcgaaucaacucca

SEQ ID NO: 2006162 - RNA, 19 nt, Shigella flexneri 2a str. 301
cuccagcgggcgaaucaac

SEQ ID NO: 2006163 - RNA, 18 nt, Shigella flexneri 2a str. 301
cuccaggagcguauucag

SEQ ID NO: 2006164 - RNA, 23 nt, Shigella flexneri 2a str. 301
cuccaggaguuccgggucaucca

SEQ ID NO: 2006165 - RNA, 16 nt, Shigella flexneri 2a str. 301
cuccagcucugauauu

SEQ ID NO: 2006166 - RNA, 18 nt, Shigella flexneri 2a str. 301
cucaugggaccgcuacca

SEQ ID NO: 2006167 - RNA, 20 nt, Shigella flexneri 2a str. 301
cucaugggaccgcuaccacg

SEQ ID NO: 2006168 - RNA, 20 nt, Shigella flexneri 2a str. 301
cuccagcgccgccagaauca

SEQ ID NO: 2006169 - RNA, 22 nt, Shigella flexneri 2a str. 301
cuccagcgccgcaucguccugc

SEQ ID NO: 2006170 - RNA, 11 nt, Shigella flexneri 2a str. 301
cuccagcgcca

SEQ ID NO: 2006171 - RNA, 21 nt, Shigella flexneri 2a str. 301
cucauguagccgcuuuuucug

SEQ ID NO: 2006172 - RNA, 20 nt, Shigella flexneri 2a str. 301
cucauguagccgcuuuuucu

SEQ ID NO: 2006173 - RNA, 17 nt, Shigella flexneri 2a str. 301
cuccauccccagcucuu

SEQ ID NO: 2006174 - RNA, 11 nt, Shigella flexneri 2a str. 301
cuccauccagc

SEQ ID NO: 2006175 - RNA, 18 nt, Shigella flexneri 2a str. 301
cuccauccagcaacaaca

SEQ ID NO: 2006176 - RNA, 22 nt, Shigella flexneri 2a str. 301
cuccauaugaacggaaccgacg

SEQ ID NO: 2006177 - RNA, 14 nt, Shigella flexneri 2a str. 301
cuccauacuuccac

SEQ ID NO: 2006178 - RNA, 16 nt, Shigella flexneri 2a str. 301
cuccagguccuccugu

SEQ ID NO: 2006179 - RNA, 23 nt, Shigella flexneri 2a str. 301
cuccaggcguuuugcagauucag

SEQ ID NO: 2006180 - RNA, 16 nt, Shigella flexneri 2a str. 301
cuccaguaccugcaaa

SEQ ID NO: 2006181 - RNA, 20 nt, Shigella flexneri 2a str. 301
cuccugcgccucuccacacg

SEQ ID NO: 2006182 - RNA, 20 nt, Shigella flexneri 2a str. 301
cuccugccaauacaaaauuu

SEQ ID NO: 2006183 - RNA, 19 nt, Shigella flexneri 2a str. 301
cuccugcaacagguugcgc

SEQ ID NO: 2006184 - RNA, 21 nt, Shigella flexneri 2a str. 301
cuccugacgcgguguuuuaac

SEQ ID NO: 2006185 - RNA, 18 nt, Shigella flexneri 2a str. 301
cuccuggcgguuaauaau

SEQ ID NO: 2006186 - RNA, 23 nt, Shigella flexneri 2a str. 301
cuccuggcgguuaauaaugauuu

SEQ ID NO: 2006187 - RNA, 22 nt, Shigella flexneri 2a str. 301
cuccuggcgguuaauaaugauu

SEQ ID NO: 2006188 - RNA, 18 nt, Shigella flexneri 2a str. 301
cuccugucuucccugcug

SEQ ID NO: 2006189 - RNA, 13 nt, Shigella flexneri 2a str. 301
cuccugucuuccc

SEQ ID NO: 2006190 - RNA, 15 nt, Shigella flexneri 2a str. 301
cuccuggaucacaau

SEQ ID NO: 2006191 - RNA, 13 nt, Shigella flexneri 2a str. 301
cuccugcucauca

SEQ ID NO: 2006192 - RNA, 14 nt, Shigella flexneri 2a str. 301
cuccugcggcugca

SEQ ID NO: 2006193 - RNA, 17 nt, Shigella flexneri 2a str. 301
cuccucgaguccuucca

SEQ ID NO: 2006194 - RNA, 18 nt, Shigella flexneri 2a str. 301
cuccucgaguccuuccag

SEQ ID NO: 2006195 - RNA, 20 nt, Shigella flexneri 2a str. 301
cuccucgaguccuuccaggu

SEQ ID NO: 2006196 - RNA, 15 nt, Shigella flexneri 2a str. 301
cuccggcagcugcuc

SEQ ID NO: 2006197 - RNA, 13 nt, Shigella flexneri 2a str. 301
cuccggccagagc

SEQ ID NO: 2006198 - RNA, 17 nt, Shigella flexneri 2a str. 301
cuccggccugcacugca

SEQ ID NO: 2006199 - RNA, 14 nt, Shigella flexneri 2a str. 301
cuccucuucacguu

SEQ ID NO: 2006200 - RNA, 17 nt, Shigella flexneri 2a str. 301
cuccugaacuuucuccc

SEQ ID NO: 2006201 - RNA, 18 nt, Shigella flexneri 2a str. 301
cuccucugacuggacucg

SEQ ID NO: 2006202 - RNA, 15 nt, Shigella flexneri 2a str. 301
cucgaaguuuuccuc

SEQ ID NO: 2006203 - RNA, 15 nt, Shigella flexneri 2a str. 301
cucgacaccaaacag

SEQ ID NO: 2006204 - RNA, 13 nt, Shigella flexneri 2a str. 301
cuccuuucggcca

SEQ ID NO: 2006205 - RNA, 20 nt, Shigella flexneri 2a str. 301
cuccuguuuaauaugcaauu

SEQ ID NO: 2006206 - RNA, 17 nt, Shigella flexneri 2a str. 301
cuccuguuaugccucaa

SEQ ID NO: 2006207 - RNA, 18 nt, Shigella flexneri 2a str. 301
cuccuguucugcgcgcca

SEQ ID NO: 2006208 - RNA, 14 nt, Shigella flexneri 2a str. 301
cuccuguucugugc

SEQ ID NO: 2006209 - RNA, 14 nt, Shigella flexneri 2a str. 301
cuccuucacucuau

SEQ ID NO: 2006210 - RNA, 23 nt, Shigella flexneri 2a str. 301
cucgacuguggcgcgaccaaugu

SEQ ID NO: 2006211 - RNA, 17 nt, Shigella flexneri 2a str. 301
cucgagagagaaaauaa

SEQ ID NO: 2006212 - RNA, 22 nt, Shigella flexneri 2a str. 301
cucgauaccagauuaauuauug

SEQ ID NO: 2006213 - RNA, 22 nt, Shigella flexneri 2a str. 301
cucgauacgacacgccuccugg

SEQ ID NO: 2006214 - RNA, 17 nt, Shigella flexneri 2a str. 301
cucgaguccuuccaggu

SEQ ID NO: 2006215 - RNA, 13 nt, Shigella flexneri 2a str. 301
cucgauaaaaccu

SEQ ID NO: 2006216 - RNA, 23 nt, Shigella flexneri 2a str. 301
cucucagcacaccauaaaacaaa

SEQ ID NO: 2006217 - RNA, 15 nt, Shigella flexneri 2a str. 301
cucucagucuuuccc

SEQ ID NO: 2006218 - RNA, 15 nt, Shigella flexneri 2a str. 301
cucucaucacuacag

SEQ ID NO: 2006219 - RNA, 21 nt, Shigella flexneri 2a str. 301
cucucaucuuugaaaucacgc

SEQ ID NO: 2006220 - RNA, 14 nt, Shigella flexneri 2a str. 301
cucuccguaggcca

SEQ ID NO: 2006221 - RNA, 18 nt, Shigella flexneri 2a str. 301
cucuccguuaucacagca

SEQ ID NO: 2006222 - RNA, 11 nt, Shigella flexneri 2a str. 301
cucuccuuucg

SEQ ID NO: 2006223 - RNA, 22 nt, Shigella flexneri 2a str. 301
cucuccucgcgagaggcuuuuu

SEQ ID NO: 2006224 - RNA, 12 nt, Shigella flexneri 2a str. 301
cucgucgcgcac

SEQ ID NO: 2006225 - RNA, 18 nt, Shigella flexneri 2a str. 301
cucuauuccaccaucauu

SEQ ID NO: 2006226 - RNA, 17 nt, Shigella flexneri 2a str. 301
cucuauucuuaaaauag

SEQ ID NO: 2006227 - RNA, 17 nt, Shigella flexneri 2a str. 301
cucucaaaacaacacaa

SEQ ID NO: 2006228 - RNA, 17 nt, Shigella flexneri 2a str. 301
cucugcaaauauuaaua

SEQ ID NO: 2006229 - RNA, 16 nt, Shigella flexneri 2a str. 301
cucugcaaucaccacu

SEQ ID NO: 2006230 - RNA, 20 nt, Shigella flexneri 2a str. 301
cucugcaaucaccacugcca

SEQ ID NO: 2006231 - RNA, 22 nt, Shigella flexneri 2a str. 301
cucugauugccuuccaccagau

SEQ ID NO: 2006232 - RNA, 15 nt, Shigella flexneri 2a str. 301
cucugaugacugaug

SEQ ID NO: 2006233 - RNA, 15 nt, Shigella flexneri 2a str. 301
cucugauuacccuuc

SEQ ID NO: 2006234 - RNA, 14 nt, Shigella flexneri 2a str. 301
cucugcaaauauua

SEQ ID NO: 2006235 - RNA, 17 nt, Shigella flexneri 2a str. 301
cucugagaauaaauaca

SEQ ID NO: 2006236 - RNA, 21 nt, Shigella flexneri 2a str. 301
cucugacgcgcauacucuccu

SEQ ID NO: 2006237 - RNA, 16 nt, Shigella flexneri 2a str. 301
cucugaccugccgcag

SEQ ID NO: 2006238 - RNA, 14 nt, Shigella flexneri 2a str. 301
cucugccagcugcu

SEQ ID NO: 2006239 - RNA, 18 nt, Shigella flexneri 2a str. 301
cucugccagcugcucaua

SEQ ID NO: 2006240 - RNA, 13 nt, Shigella flexneri 2a str. 301
cucugcugccaca

SEQ ID NO: 2006241 - RNA, 17 nt, Shigella flexneri 2a str. 301
cucugcuaauuuaucga

SEQ ID NO: 2006242 - RNA, 19 nt, Shigella flexneri 2a str. 301
cucugcggcggacaaaguu

SEQ ID NO: 2006243 - RNA, 15 nt, Shigella flexneri 2a str. 301
cucugcguaacccac

SEQ ID NO: 2006244 - RNA, 15 nt, Shigella flexneri 2a str. 301
cucugcgcgugcagu

SEQ ID NO: 2006245 - RNA, 16 nt, Shigella flexneri 2a str. 301
cucucuuucuccagcg

SEQ ID NO: 2006246 - RNA, 11 nt, Shigella flexneri 2a str. 301
cucucuuucuc

SEQ ID NO: 2006247 - RNA, 19 nt, Shigella flexneri 2a str. 301
cucucuccguuaucacagc

SEQ ID NO: 2006248 - RNA, 13 nt, Shigella flexneri 2a str. 301
cucucugagccag

SEQ ID NO: 2006249 - RNA, 23 nt, Shigella flexneri 2a str. 301
cucucugaaguagccaguaccac

SEQ ID NO: 2006250 - RNA, 13 nt, Shigella flexneri 2a str. 301
cucucugcuauuc

SEQ ID NO: 2006251 - RNA, 21 nt, Shigella flexneri 2a str. 301
cucucguuaaguaguguagca

SEQ ID NO: 2006252 - RNA, 17 nt, Shigella flexneri 2a str. 301
cucucuauuccaccauc

SEQ ID NO: 2006253 - RNA, 21 nt, Shigella flexneri 2a str. 301
cucucgggcaguaaaucaaua

SEQ ID NO: 2006254 - RNA, 14 nt, Shigella flexneri 2a str. 301
cucucgacccgaca

SEQ ID NO: 2006255 - RNA, 15 nt, Shigella flexneri 2a str. 301
cucggcaaagcgcug

SEQ ID NO: 2006256 - RNA, 13 nt, Shigella flexneri 2a str. 301
cucggcaaauuca

SEQ ID NO: 2006257 - RNA, 14 nt, Shigella flexneri 2a str. 301
cucggauaaggcuu

SEQ ID NO: 2006258 - RNA, 18 nt, Shigella flexneri 2a str. 301
cucggauaaggcuucccg

SEQ ID NO: 2006259 - RNA, 14 nt, Shigella flexneri 2a str. 301
cucgcuccagugcc

SEQ ID NO: 2006260 - RNA, 17 nt, Shigella flexneri 2a str. 301
cucguaucaccccgccc

SEQ ID NO: 2006261 - RNA, 21 nt, Shigella flexneri 2a str. 301
cucguagguuucugccagcgu

SEQ ID NO: 2006262 - RNA, 14 nt, Shigella flexneri 2a str. 301
cucguaaugcuccg

SEQ ID NO: 2006263 - RNA, 17 nt, Shigella flexneri 2a str. 301
cucguaaugcuccggcu

SEQ ID NO: 2006264 - RNA, 14 nt, Shigella flexneri 2a str. 301
cucguacuccaucu

SEQ ID NO: 2006265 - RNA, 19 nt, Shigella flexneri 2a str. 301
cucggucuggacagacugg

SEQ ID NO: 2006266 - RNA, 17 nt, Shigella flexneri 2a str. 301
cucgggaaggcccuucc

SEQ ID NO: 2006267 - RNA, 20 nt, Shigella flexneri 2a str. 301
cucggcgagcaacgcagcgg

SEQ ID NO: 2006268 - RNA, 22 nt, Shigella flexneri 2a str. 301
cgucgauuguuauaccagucca

SEQ ID NO: 2006269 - RNA, 23 nt, Shigella flexneri 2a str. 301
cgucgauuguuauaccaguccac

SEQ ID NO: 2006270 - RNA, 16 nt, Shigella flexneri 2a str. 301
cgucgagggcaaccug

SEQ ID NO: 2006271 - RNA, 17 nt, Shigella flexneri 2a str. 301
cguccauuuugagggaa

SEQ ID NO: 2006272 - RNA, 14 nt, Shigella flexneri 2a str. 301
cgucauacugcuca

SEQ ID NO: 2006273 - RNA, 18 nt, Shigella flexneri 2a str. 301
cgucaucauagacuuccc

SEQ ID NO: 2006274 - RNA, 20 nt, Shigella flexneri 2a str. 301
cguccggcaucgcaaaccag

SEQ ID NO: 2006275 - RNA, 20 nt, Shigella flexneri 2a str. 301
cguccgcucggucacugaca

SEQ ID NO: 2006276 - RNA, 15 nt, Shigella flexneri 2a str. 301
cguccggcugccagc

SEQ ID NO: 2006277 - RNA, 16 nt, Shigella flexneri 2a str. 301
cguccgguuuacuucc

SEQ ID NO: 2006278 - RNA, 23 nt, Shigella flexneri 2a str. 301
cguccucacuguuuucuaacuca

SEQ ID NO: 2006279 - RNA, 17 nt, Shigella flexneri 2a str. 301
cgucccaugaugcgcgg

SEQ ID NO: 2006280 - RNA, 15 nt, Shigella flexneri 2a str. 301
cgucccaggcaaauc

SEQ ID NO: 2006281 - RNA, 18 nt, Shigella flexneri 2a str. 301
cgucccagucgucauccc

SEQ ID NO: 2006282 - RNA, 15 nt, Shigella flexneri 2a str. 301
cguccccaucaggaa

SEQ ID NO: 2006283 - RNA, 14 nt, Shigella flexneri 2a str. 301
cguaugcagccagg

SEQ ID NO: 2006284 - RNA, 18 nt, Shigella flexneri 2a str. 301
cguauaauaucuuuucuu

SEQ ID NO: 2006285 - RNA, 15 nt, Shigella flexneri 2a str. 301
cguauacaagaacgu

SEQ ID NO: 2006286 - RNA, 17 nt, Shigella flexneri 2a str. 301
cguaguucuuucucugc

SEQ ID NO: 2006287 - RNA, 18 nt, Shigella flexneri 2a str. 301
cguagucugaccucuucu

SEQ ID NO: 2006288 - RNA, 22 nt, Shigella flexneri 2a str. 301
cgucaaaacgcgacugcaaaaa

SEQ ID NO: 2006289 - RNA, 18 nt, Shigella flexneri 2a str. 301
cguauucaacgguaaguu

SEQ ID NO: 2006290 - RNA, 14 nt, Shigella flexneri 2a str. 301
cguauuaugcacac

SEQ ID NO: 2006291 - RNA, 12 nt, Shigella flexneri 2a str. 301
cguauuaauucc

SEQ ID NO: 2006292 - RNA, 18 nt, Shigella flexneri 2a str. 301
cguaaguuagaggcacau

SEQ ID NO: 2006293 - RNA, 17 nt, Shigella flexneri 2a str. 301
cguaauacccuugcaga

SEQ ID NO: 2006294 - RNA, 21 nt, Shigella flexneri 2a str. 301
cguaauaguuucugacauuuu

SEQ ID NO: 2006295 - RNA, 18 nt, Shigella flexneri 2a str. 301
cguaaucccggauaucac

SEQ ID NO: 2006296 - RNA, 16 nt, Shigella flexneri 2a str. 301
cguaauccguaaagcc

SEQ ID NO: 2006297 - RNA, 13 nt, Shigella flexneri 2a str. 301
cguagcgcaucag

SEQ ID NO: 2006298 - RNA, 16 nt, Shigella flexneri 2a str. 301
cguagcguuuuuucau

SEQ ID NO: 2006299 - RNA, 23 nt, Shigella flexneri 2a str. 301
cgucacagcggcuuccaccgccg

SEQ ID NO: 2006300 - RNA, 19 nt, Shigella flexneri 2a str. 301
cgucacaggcacaccgccg

SEQ ID NO: 2006301 - RNA, 13 nt, Shigella flexneri 2a str. 301
cgucaccacuuca

SEQ ID NO: 2006302 - RNA, 14 nt, Shigella flexneri 2a str. 301
cgucaccacuucac

SEQ ID NO: 2006303 - RNA, 16 nt, Shigella flexneri 2a str. 301
cgucaccaccugggug

SEQ ID NO: 2006304 - RNA, 21 nt, Shigella flexneri 2a str. 301
cgucaacaccgggugcagaca

SEQ ID NO: 2006305 - RNA, 18 nt, Shigella flexneri 2a str. 301
cgucaaauaauuccugcg

SEQ ID NO: 2006306 - RNA, 20 nt, Shigella flexneri 2a str. 301
cgucaacagcguuucuucga

SEQ ID NO: 2006307 - RNA, 22 nt, Shigella flexneri 2a str. 301
cgucaagcgguaaccauccaua

SEQ ID NO: 2006308 - RNA, 20 nt, Shigella flexneri 2a str. 301
cgucaaucugcccgaccaga

SEQ ID NO: 2006309 - RNA, 14 nt, Shigella flexneri 2a str. 301
cgucagccgcccgc

SEQ ID NO: 2006310 - RNA, 17 nt, Shigella flexneri 2a str. 301
cgucagcgaguugauca

SEQ ID NO: 2006311 - RNA, 18 nt, Shigella flexneri 2a str. 301
cgucaguagcgcaaucac

SEQ ID NO: 2006312 - RNA, 20 nt, Shigella flexneri 2a str. 301
cgucagugucuuaucuggca

SEQ ID NO: 2006313 - RNA, 15 nt, Shigella flexneri 2a str. 301
cgucagccagaaaga

SEQ ID NO: 2006314 - RNA, 16 nt, Shigella flexneri 2a str. 301
cgucagcauguuuaua

SEQ ID NO: 2006315 - RNA, 23 nt, Shigella flexneri 2a str. 301
cgguggcaguagcgccucuucca

SEQ ID NO: 2006316 - RNA, 13 nt, Shigella flexneri 2a str. 301
cggugcuggucug

SEQ ID NO: 2006317 - RNA, 23 nt, Shigella flexneri 2a str. 301
cggugucgauacgacaacggcag

SEQ ID NO: 2006318 - RNA, 21 nt, Shigella flexneri 2a str. 301
cggugugcagcguacuucaug

SEQ ID NO: 2006319 - RNA, 18 nt, Shigella flexneri 2a str. 301
cgguguugccgaagcagc

SEQ ID NO: 2006320 - RNA, 19 nt, Shigella flexneri 2a str. 301
cgguguucaagccaaaacg

SEQ ID NO: 2006321 - RNA, 22 nt, Shigella flexneri 2a str. 301
cgguguuguuggucaggaaacu

SEQ ID NO: 2006322 - RNA, 15 nt, Shigella flexneri 2a str. 301
cgguggucauaauau

SEQ ID NO: 2006323 - RNA, 14 nt, Shigella flexneri 2a str. 301
cgguguacccugcu

SEQ ID NO: 2006324 - RNA, 17 nt, Shigella flexneri 2a str. 301
cgguguauuaccuccgc

SEQ ID NO: 2006325 - RNA, 16 nt, Shigella flexneri 2a str. 301
cgguguaggccugaua

SEQ ID NO: 2006326 - RNA, 21 nt, Shigella flexneri 2a str. 301
cggugguugccggucuggugu

SEQ ID NO: 2006327 - RNA, 15 nt, Shigella flexneri 2a str. 301
cggugguguuaucac

SEQ ID NO: 2006328 - RNA, 15 nt, Shigella flexneri 2a str. 301
cggugcuccagugcg

SEQ ID NO: 2006329 - RNA, 15 nt, Shigella flexneri 2a str. 301
cggugcguugucauc

SEQ ID NO: 2006330 - RNA, 23 nt, Shigella flexneri 2a str. 301
cggugccgcgauaccacccgcag

SEQ ID NO: 2006331 - RNA, 13 nt, Shigella flexneri 2a str. 301
cggugcgagcgcc

SEQ ID NO: 2006332 - RNA, 20 nt, Shigella flexneri 2a str. 301
cggugcgaauugccaccauc

SEQ ID NO: 2006333 - RNA, 23 nt, Shigella flexneri 2a str. 301
cggugcgaauugccaccauccgc

SEQ ID NO: 2006334 - RNA, 16 nt, Shigella flexneri 2a str. 301
cggugcaucuucacac

SEQ ID NO: 2006335 - RNA, 19 nt, Shigella flexneri 2a str. 301
cggugccauugaccagcug

SEQ ID NO: 2006336 - RNA, 17 nt, Shigella flexneri 2a str. 301
cggugccaucauacagc

SEQ ID NO: 2006337 - RNA, 22 nt, Shigella flexneri 2a str. 301
cggugauuuccgccgccagcag

SEQ ID NO: 2006338 - RNA, 22 nt, Shigella flexneri 2a str. 301
cggugcaacccgccagguuuca

SEQ ID NO: 2006339 - RNA, 15 nt, Shigella flexneri 2a str. 301
cggugauuuccgccg

SEQ ID NO: 2006340 - RNA, 14 nt, Shigella flexneri 2a str. 301
cggugcacuccgcc

SEQ ID NO: 2006341 - RNA, 13 nt, Shigella flexneri 2a str. 301
cggugaugaugcu

SEQ ID NO: 2006342 - RNA, 22 nt, Shigella flexneri 2a str. 301
cguaacgccacgauagagagca

SEQ ID NO: 2006343 - RNA, 16 nt, Shigella flexneri 2a str. 301
cguaacgacugcggau

SEQ ID NO: 2006344 - RNA, 12 nt, Shigella flexneri 2a str. 301
cguaacgacugc

SEQ ID NO: 2006345 - RNA, 20 nt, Shigella flexneri 2a str. 301
cguaacgaccaccaccgcag

SEQ ID NO: 2006346 - RNA, 17 nt, Shigella flexneri 2a str. 301
cguaacgaccaccaccg

SEQ ID NO: 2006347 - RNA, 14 nt, Shigella flexneri 2a str. 301
cguaacgaccacca

SEQ ID NO: 2006348 - RNA, 18 nt, Shigella flexneri 2a str. 301
cguaacccacugacuucu

SEQ ID NO: 2006349 - RNA, 19 nt, Shigella flexneri 2a str. 301
cguaaaggcggcagaacag

SEQ ID NO: 2006350 - RNA, 14 nt, Shigella flexneri 2a str. 301
cguaaaucccgcca

SEQ ID NO: 2006351 - RNA, 18 nt, Shigella flexneri 2a str. 301
cguaaaucgucaguagcg

SEQ ID NO: 2006352 - RNA, 15 nt, Shigella flexneri 2a str. 301
cguaaaucuuuacca

SEQ ID NO: 2006353 - RNA, 11 nt, Shigella flexneri 2a str. 301
cguaaaaaaug

SEQ ID NO: 2006354 - RNA, 13 nt, Shigella flexneri 2a str. 301
cgguuuuuugcuc

SEQ ID NO: 2006355 - RNA, 19 nt, Shigella flexneri 2a str. 301
cgguuuuguugccgcccgu

SEQ ID NO: 2006356 - RNA, 23 nt, Shigella flexneri 2a str. 301
cgguuuugcaggaaaaacugccc

SEQ ID NO: 2006357 - RNA, 16 nt, Shigella flexneri 2a str. 301
cgguuuugcuauccag

SEQ ID NO: 2006358 - RNA, 14 nt, Shigella flexneri 2a str. 301
cgguuuucacgccu

SEQ ID NO: 2006359 - RNA, 14 nt, Shigella flexneri 2a str. 301
cgguuuucaucauc

SEQ ID NO: 2006360 - RNA, 14 nt, Shigella flexneri 2a str. 301
cgguuugcggcagg

SEQ ID NO: 2006361 - RNA, 18 nt, Shigella flexneri 2a str. 301
cgguuugcggcaggacag

SEQ ID NO: 2006362 - RNA, 21 nt, Shigella flexneri 2a str. 301
cguaaacgccuuauccggccu

SEQ ID NO: 2006363 - RNA, 17 nt, Shigella flexneri 2a str. 301
cguaaagaaccucuuca

SEQ ID NO: 2006364 - RNA, 15 nt, Shigella flexneri 2a str. 301
cguaaacaacuggcg

SEQ ID NO: 2006365 - RNA, 14 nt, Shigella flexneri 2a str. 301
cguaaacaacuggc

SEQ ID NO: 2006366 - RNA, 13 nt, Shigella flexneri 2a str. 301
cguaaaacucagg

SEQ ID NO: 2006367 - RNA, 18 nt, Shigella flexneri 2a str. 301
cgguuucaguggggcagg

SEQ ID NO: 2006368 - RNA, 15 nt, Shigella flexneri 2a str. 301
cgguuucaauccagg

SEQ ID NO: 2006369 - RNA, 16 nt, Shigella flexneri 2a str. 301
cgguuucacuauuacc

SEQ ID NO: 2006370 - RNA, 18 nt, Shigella flexneri 2a str. 301
cgguuuaaaccugauuuu

SEQ ID NO: 2006371 - RNA, 17 nt, Shigella flexneri 2a str. 301
cgguuuauccccaagga

SEQ ID NO: 2006372 - RNA, 23 nt, Shigella flexneri 2a str. 301
cgguuuauccauccccagagcac

SEQ ID NO: 2006373 - RNA, 15 nt, Shigella flexneri 2a str. 301
cgguugccagcgcca

SEQ ID NO: 2006374 - RNA, 14 nt, Shigella flexneri 2a str. 301
cgguugacugcuga

SEQ ID NO: 2006375 - RNA, 22 nt, Shigella flexneri 2a str. 301
cgguugcugaacagcuuuuucc

SEQ ID NO: 2006376 - RNA, 18 nt, Shigella flexneri 2a str. 301
cgguuguagcucggcgca

SEQ ID NO: 2006377 - RNA, 17 nt, Shigella flexneri 2a str. 301
cgguucaauaucuuccu

SEQ ID NO: 2006378 - RNA, 19 nt, Shigella flexneri 2a str. 301
cgguuaucggcgcgccagc

SEQ ID NO: 2006379 - RNA, 14 nt, Shigella flexneri 2a str. 301
cgguucccucaucu

SEQ ID NO: 2006380 - RNA, 14 nt, Shigella flexneri 2a str. 301
cgguucccucgccc

SEQ ID NO: 2006381 - RNA, 19 nt, Shigella flexneri 2a str. 301
cgguuagaauaccugccug

SEQ ID NO: 2006382 - RNA, 17 nt, Shigella flexneri 2a str. 301
cgguuaucacucuugac

SEQ ID NO: 2006383 - RNA, 14 nt, Shigella flexneri 2a str. 301
cgguuaauaaugau

SEQ ID NO: 2006384 - RNA, 23 nt, Shigella flexneri 2a str. 301
cgguuaauugcgccagcacauca

SEQ ID NO: 2006385 - RNA, 15 nt, Shigella flexneri 2a str. 301
cgguuacgccgcauc

SEQ ID NO: 2006386 - RNA, 22 nt, Shigella flexneri 2a str. 301
cgguugaugccguuccacccag

SEQ ID NO: 2006387 - RNA, 16 nt, Shigella flexneri 2a str. 301
cgguucgccugcacca

SEQ ID NO: 2006388 - RNA, 14 nt, Shigella flexneri 2a str. 301
cgucuucccgcagc

SEQ ID NO: 2006389 - RNA, 15 nt, Shigella flexneri 2a str. 301
cgucuucccgcagcc

SEQ ID NO: 2006390 - RNA, 17 nt, Shigella flexneri 2a str. 301
cgucuuccgugccugac

SEQ ID NO: 2006391 - RNA, 14 nt, Shigella flexneri 2a str. 301
cgucuuuuacagcg

SEQ ID NO: 2006392 - RNA, 13 nt, Shigella flexneri 2a str. 301
cgucuuuuuucac

SEQ ID NO: 2006393 - RNA, 13 nt, Shigella flexneri 2a str. 301
cgugaaaggaaaa

SEQ ID NO: 2006394 - RNA, 20 nt, Shigella flexneri 2a str. 301
cgugaacgccuaauccagcc

SEQ ID NO: 2006395 - RNA, 14 nt, Shigella flexneri 2a str. 301
cgugagguaacaau

SEQ ID NO: 2006396 - RNA, 23 nt, Shigella flexneri 2a str. 301
cgugacgucucaaucaccaccag

SEQ ID NO: 2006397 - RNA, 23 nt, Shigella flexneri 2a str. 301
cgugaacggcuucgccuccuguu

SEQ ID NO: 2006398 - RNA, 18 nt, Shigella flexneri 2a str. 301
cgugaacgugggucuguc

SEQ ID NO: 2006399 - RNA, 21 nt, Shigella flexneri 2a str. 301
cgugaacugggccugcauauc

SEQ ID NO: 2006400 - RNA, 18 nt, Shigella flexneri 2a str. 301
cgucugcgccaccacaac

SEQ ID NO: 2006401 - RNA, 20 nt, Shigella flexneri 2a str. 301
cgucucugguuuuacaacgu

SEQ ID NO: 2006402 - RNA, 16 nt, Shigella flexneri 2a str. 301
cgucgcgcccuccugc

SEQ ID NO: 2006403 - RNA, 20 nt, Shigella flexneri 2a str. 301
cgucgcaauacccugaccca

SEQ ID NO: 2006404 - RNA, 23 nt, Shigella flexneri 2a str. 301
cgugccagauguuugaacugggc

SEQ ID NO: 2006405 - RNA, 13 nt, Shigella flexneri 2a str. 301
cgugccagagcau

SEQ ID NO: 2006406 - RNA, 19 nt, Shigella flexneri 2a str. 301
cgugcggccguuccauuca

SEQ ID NO: 2006407 - RNA, 14 nt, Shigella flexneri 2a str. 301
cgugcgcuuuuuag

SEQ ID NO: 2006408 - RNA, 14 nt, Shigella flexneri 2a str. 301
cgugcggcugugcg

SEQ ID NO: 2006409 - RNA, 14 nt, Shigella flexneri 2a str. 301
cgugcguuuguagg

SEQ ID NO: 2006410 - RNA, 17 nt, Shigella flexneri 2a str. 301
cgugcgggcaucaucuu

SEQ ID NO: 2006411 - RNA, 17 nt, Shigella flexneri 2a str. 301
cgugccagagcaucuac

SEQ ID NO: 2006412 - RNA, 12 nt, Shigella flexneri 2a str. 301
cgugccagaacu

SEQ ID NO: 2006413 - RNA, 16 nt, Shigella flexneri 2a str. 301
cgugcauuucucacuu

SEQ ID NO: 2006414 - RNA, 16 nt, Shigella flexneri 2a str. 301
cgugccaccagugcag

SEQ ID NO: 2006415 - RNA, 20 nt, Shigella flexneri 2a str. 301
cgugcacgaacgguccccuc

SEQ ID NO: 2006416 - RNA, 20 nt, Shigella flexneri 2a str. 301
cgugauccaccccugauuaa

SEQ ID NO: 2006417 - RNA, 20 nt, Shigella flexneri 2a str. 301
cgugguaagaaggcccauga

SEQ ID NO: 2006418 - RNA, 17 nt, Shigella flexneri 2a str. 301
cguggguaggaucagaa

SEQ ID NO: 2006419 - RNA, 17 nt, Shigella flexneri 2a str. 301
cgugggcaucgcgacag

SEQ ID NO: 2006420 - RNA, 22 nt, Shigella flexneri 2a str. 301
cguggcggaaaucuuucauuuc

SEQ ID NO: 2006421 - RNA, 19 nt, Shigella flexneri 2a str. 301
cgugggauugccgcuucau

SEQ ID NO: 2006422 - RNA, 20 nt, Shigella flexneri 2a str. 301
cguggcccuaggcauagaaa

SEQ ID NO: 2006423 - RNA, 13 nt, Shigella flexneri 2a str. 301
cguggcgcagugc

SEQ ID NO: 2006424 - RNA, 17 nt, Shigella flexneri 2a str. 301
cguggcgcagccgucau

SEQ ID NO: 2006425 - RNA, 19 nt, Shigella flexneri 2a str. 301
cguggcgagcgauaaccca

SEQ ID NO: 2006426 - RNA, 16 nt, Shigella flexneri 2a str. 301
cgugcuaacguuuagu

SEQ ID NO: 2006427 - RNA, 22 nt, Shigella flexneri 2a str. 301
cgugcuacgguugacugaaaag

SEQ ID NO: 2006428 - RNA, 19 nt, Shigella flexneri 2a str. 301
cgugcuuuuauuauuacuu

SEQ ID NO: 2006429 - RNA, 16 nt, Shigella flexneri 2a str. 301
cguggaauaauuccgg

SEQ ID NO: 2006430 - RNA, 19 nt, Shigella flexneri 2a str. 301
cguggaauuuguccaccaa

SEQ ID NO: 2006431 - RNA, 13 nt, Shigella flexneri 2a str. 301
cgugcguuuuuug

SEQ ID NO: 2006432 - RNA, 19 nt, Shigella flexneri 2a str. 301
cguggagcaacacgccagc

SEQ ID NO: 2006433 - RNA, 17 nt, Shigella flexneri 2a str. 301
cguggagcaacugcgcu

SEQ ID NO: 2006434 - RNA, 20 nt, Shigella flexneri 2a str. 301
cguggaucaagccccagcag

SEQ ID NO: 2006435 - RNA, 21 nt, Shigella flexneri 2a str. 301
cgugucauaacuggucaucaa

SEQ ID NO: 2006436 - RNA, 21 nt, Shigella flexneri 2a str. 301
cgugguuuucgccggaaccug

SEQ ID NO: 2006437 - RNA, 16 nt, Shigella flexneri 2a str. 301
cgugguuuuugcugac

SEQ ID NO: 2006438 - RNA, 18 nt, Shigella flexneri 2a str. 301
cguggugauaccagacca

SEQ ID NO: 2006439 - RNA, 21 nt, Shigella flexneri 2a str. 301
cgugucggacggaauuugaaa

SEQ ID NO: 2006440 - RNA, 14 nt, Shigella flexneri 2a str. 301
cguguuaauuaccu

SEQ ID NO: 2006441 - RNA, 23 nt, Shigella flexneri 2a str. 301
cguguucacgaaaacagcgcagc

SEQ ID NO: 2006442 - RNA, 17 nt, Shigella flexneri 2a str. 301
cguguuuccgggccgaa

SEQ ID NO: 2006443 - RNA, 15 nt, Shigella flexneri 2a str. 301
cguguucugaauaaa

SEQ ID NO: 2006444 - RNA, 16 nt, Shigella flexneri 2a str. 301
cguguucucaucgcca

SEQ ID NO: 2006445 - RNA, 22 nt, Shigella flexneri 2a str. 301
cguguugcaccgaguucuucac

SEQ ID NO: 2006446 - RNA, 21 nt, Shigella flexneri 2a str. 301
cguguugucagcucauccagc

SEQ ID NO: 2006447 - RNA, 21 nt, Shigella flexneri 2a str. 301
cguucucugcaaucaccacug

SEQ ID NO: 2006448 - RNA, 20 nt, Shigella flexneri 2a str. 301
cguucggaucgcgugcggca

SEQ ID NO: 2006449 - RNA, 21 nt, Shigella flexneri 2a str. 301
cguucuuaggggguaucuuug

SEQ ID NO: 2006450 - RNA, 12 nt, Shigella flexneri 2a str. 301
cguucuuccugu

SEQ ID NO: 2006451 - RNA, 16 nt, Shigella flexneri 2a str. 301
cguugaccagcauccc

SEQ ID NO: 2006452 - RNA, 13 nt, Shigella flexneri 2a str. 301
cguugaccagcau

SEQ ID NO: 2006453 - RNA, 15 nt, Shigella flexneri 2a str. 301
cguugaauuucaggu

SEQ ID NO: 2006454 - RNA, 14 nt, Shigella flexneri 2a str. 301
cguugaccaccaua

SEQ ID NO: 2006455 - RNA, 20 nt, Shigella flexneri 2a str. 301
cguugagaauggccaaucac

SEQ ID NO: 2006456 - RNA, 17 nt, Shigella flexneri 2a str. 301
cguugcccggagcagca

SEQ ID NO: 2006457 - RNA, 18 nt, Shigella flexneri 2a str. 301
cguugcccggagcagcag

SEQ ID NO: 2006458 - RNA, 20 nt, Shigella flexneri 2a str. 301
cguuccacggggacuccaca

SEQ ID NO: 2006459 - RNA, 14 nt, Shigella flexneri 2a str. 301
cguuccagcaacuc

SEQ ID NO: 2006460 - RNA, 24 nt, Shigella flexneri 2a str. 301
cguucgcggggcuaccgccagacc

SEQ ID NO: 2006461 - RNA, 20 nt, Shigella flexneri 2a str. 301
cguuaaauucuaauguuaaa

SEQ ID NO: 2006462 - RNA, 12 nt, Shigella flexneri 2a str. 301
cguuaaauaacu

SEQ ID NO: 2006463 - RNA, 13 nt, Shigella flexneri 2a str. 301
cguuaacugcuga

SEQ ID NO: 2006464 - RNA, 22 nt, Shigella flexneri 2a str. 301
cguuaacuuucguguguuuucu

SEQ ID NO: 2006465 - RNA, 21 nt, Shigella flexneri 2a str. 301
cguuaagacuuuuuucauggg

SEQ ID NO: 2006466 - RNA, 18 nt, Shigella flexneri 2a str. 301
cguuaagcuggaaaucaa

SEQ ID NO: 2006467 - RNA, 20 nt, Shigella flexneri 2a str. 301
cguuccaccacguuuuucaa

SEQ ID NO: 2006468 - RNA, 16 nt, Shigella flexneri 2a str. 301
cguucauuaacgcccc

SEQ ID NO: 2006469 - RNA, 12 nt, Shigella flexneri 2a str. 301
cguugcucagaa

SEQ ID NO: 2006470 - RNA, 13 nt, Shigella flexneri 2a str. 301
cguugcuggaaaa

SEQ ID NO: 2006471 - RNA, 17 nt, Shigella flexneri 2a str. 301
cguugcguugcagcagg

SEQ ID NO: 2006472 - RNA, 16 nt, Shigella flexneri 2a str. 301
cguuuaaucacaccau

SEQ ID NO: 2006473 - RNA, 12 nt, Shigella flexneri 2a str. 301
cguuuauuuccc

SEQ ID NO: 2006474 - RNA, 18 nt, Shigella flexneri 2a str. 301
cguugguguccacgccgc

SEQ ID NO: 2006475 - RNA, 19 nt, Shigella flexneri 2a str. 301
cguuggcucgcuccagugc

SEQ ID NO: 2006476 - RNA, 20 nt, Shigella flexneri 2a str. 301
cguuucagauuguugacaaa

SEQ ID NO: 2006477 - RNA, 20 nt, Shigella flexneri 2a str. 301
cguuucacugccggacguuc

SEQ ID NO: 2006478 - RNA, 18 nt, Shigella flexneri 2a str. 301
cguuucagcgguuugaaa

SEQ ID NO: 2006479 - RNA, 14 nt, Shigella flexneri 2a str. 301
cguuucauucaggc

SEQ ID NO: 2006480 - RNA, 17 nt, Shigella flexneri 2a str. 301
cguuuccagcaccaguu

SEQ ID NO: 2006481 - RNA, 19 nt, Shigella flexneri 2a str. 301
cguuuccagcaccaguuca

SEQ ID NO: 2006482 - RNA, 17 nt, Shigella flexneri 2a str. 301
cguuuccagcaguucca

SEQ ID NO: 2006483 - RNA, 12 nt, Shigella flexneri 2a str. 301
cguuucuuuuuc

SEQ ID NO: 2006484 - RNA, 22 nt, Shigella flexneri 2a str. 301
cguuucuucgacacguuccuca

SEQ ID NO: 2006485 - RNA, 17 nt, Shigella flexneri 2a str. 301
cguuucuucuacaggcu

SEQ ID NO: 2006486 - RNA, 18 nt, Shigella flexneri 2a str. 301
cguuugcgcccagccagu

SEQ ID NO: 2006487 - RNA, 18 nt, Shigella flexneri 2a str. 301
cuaaacguuuaaaaacuu

SEQ ID NO: 2006488 - RNA, 14 nt, Shigella flexneri 2a str. 301
cuaaaguaaaggca

SEQ ID NO: 2006489 - RNA, 17 nt, Shigella flexneri 2a str. 301
cuaaaguaaaggcacaa

SEQ ID NO: 2006490 - RNA, 20 nt, Shigella flexneri 2a str. 301
cuaaaguaaaggcacaaggg

SEQ ID NO: 2006491 - RNA, 18 nt, Shigella flexneri 2a str. 301
cuaaaguacguaaaacaa

SEQ ID NO: 2006492 - RNA, 18 nt, Shigella flexneri 2a str. 301
cuaaagccuuuugccagu

SEQ ID NO: 2006493 - RNA, 14 nt, Shigella flexneri 2a str. 301
cuaaagccugcuuu

SEQ ID NO: 2006494 - RNA, 18 nt, Shigella flexneri 2a str. 301
cuaaagcgguuacacaug

SEQ ID NO: 2006495 - RNA, 17 nt, Shigella flexneri 2a str. 301
cuaaauguucaauaagc

SEQ ID NO: 2006496 - RNA, 21 nt, Shigella flexneri 2a str. 301
cuaaaucuggugcuuuuucaa

SEQ ID NO: 2006497 - RNA, 17 nt, Shigella flexneri 2a str. 301
cuaaaucuuccgccggg

SEQ ID NO: 2006498 - RNA, 19 nt, Shigella flexneri 2a str. 301
cuaaauccgccaucaacac

SEQ ID NO: 2006499 - RNA, 14 nt, Shigella flexneri 2a str. 301
cggcugccagccag

SEQ ID NO: 2006500 - RNA, 21 nt, Shigella flexneri 2a str. 301
cggcugggaaaucaccaccag

SEQ ID NO: 2006501 - RNA, 13 nt, Shigella flexneri 2a str. 301
cggcugaccacca

SEQ ID NO: 2006502 - RNA, 18 nt, Shigella flexneri 2a str. 301
cggcugaacgugcucugc

SEQ ID NO: 2006503 - RNA, 23 nt, Shigella flexneri 2a str. 301
cggcugauaacaauaucaaaugc

SEQ ID NO: 2006504 - RNA, 17 nt, Shigella flexneri 2a str. 301
cggcucggcuccgggcg

SEQ ID NO: 2006505 - RNA, 23 nt, Shigella flexneri 2a str. 301
cggcuuauugcuucaagaugcca

SEQ ID NO: 2006506 - RNA, 17 nt, Shigella flexneri 2a str. 301
cggcuuagcguuacguu

SEQ ID NO: 2006507 - RNA, 22 nt, Shigella flexneri 2a str. 301
cggcuguugauguccaguuccc

SEQ ID NO: 2006508 - RNA, 17 nt, Shigella flexneri 2a str. 301
cggcuguuucuggauga

SEQ ID NO: 2006509 - RNA, 23 nt, Shigella flexneri 2a str. 301
cggcuguuucuggaugauccugg

SEQ ID NO: 2006510 - RNA, 23 nt, Shigella flexneri 2a str. 301
cggcuguagagcuaccggcagga

SEQ ID NO: 2006511 - RNA, 19 nt, Shigella flexneri 2a str. 301
cggcuucgccuccuguucu

SEQ ID NO: 2006512 - RNA, 15 nt, Shigella flexneri 2a str. 301
cggcuucgccuccug

SEQ ID NO: 2006513 - RNA, 20 nt, Shigella flexneri 2a str. 301
cggcuucgcaucccgguauc

SEQ ID NO: 2006514 - RNA, 22 nt, Shigella flexneri 2a str. 301
cggcuucucggcaaacagcugc

SEQ ID NO: 2006515 - RNA, 20 nt, Shigella flexneri 2a str. 301
cgggaacuggcaacaauggc

SEQ ID NO: 2006516 - RNA, 18 nt, Shigella flexneri 2a str. 301
cggcuuguacgccgccgc

SEQ ID NO: 2006517 - RNA, 22 nt, Shigella flexneri 2a str. 301
cggcuugcgcgcaaucagcacc

SEQ ID NO: 2006518 - RNA, 18 nt, Shigella flexneri 2a str. 301
cggcuuuuuacuucucag

SEQ ID NO: 2006519 - RNA, 20 nt, Shigella flexneri 2a str. 301
cggcuuugaauaucuccucu

SEQ ID NO: 2006520 - RNA, 21 nt, Shigella flexneri 2a str. 301
cggcgucauaauccggcaaca

SEQ ID NO: 2006521 - RNA, 15 nt, Shigella flexneri 2a str. 301
cggcguauccggcuc

SEQ ID NO: 2006522 - RNA, 22 nt, Shigella flexneri 2a str. 301
cggcguacuggcaaucgccagc

SEQ ID NO: 2006523 - RNA, 22 nt, Shigella flexneri 2a str. 301
cggcgugaacgccuuauccggc

SEQ ID NO: 2006524 - RNA, 16 nt, Shigella flexneri 2a str. 301
cggcgugaccucuucg

SEQ ID NO: 2006525 - RNA, 18 nt, Shigella flexneri 2a str. 301
cggcgugcgcgcccauac

SEQ ID NO: 2006526 - RNA, 13 nt, Shigella flexneri 2a str. 301
cggcgugggcgcu

SEQ ID NO: 2006527 - RNA, 22 nt, Shigella flexneri 2a str. 301
cggcguuuuguagagcagcacg

SEQ ID NO: 2006528 - RNA, 14 nt, Shigella flexneri 2a str. 301
cggcguuuucaggu

SEQ ID NO: 2006529 - RNA, 22 nt, Shigella flexneri 2a str. 301
cggcguuguaagguuaagccuc

SEQ ID NO: 2006530 - RNA, 14 nt, Shigella flexneri 2a str. 301
cggcguuccccagu

SEQ ID NO: 2006531 - RNA, 19 nt, Shigella flexneri 2a str. 301
cggcguucauccugcuggu

SEQ ID NO: 2006532 - RNA, 13 nt, Shigella flexneri 2a str. 301
cggcuccgcccca

SEQ ID NO: 2006533 - RNA, 18 nt, Shigella flexneri 2a str. 301
cggcuccgccccaaugcg

SEQ ID NO: 2006534 - RNA, 23 nt, Shigella flexneri 2a str. 301
cggcucccgcagccacuccuuau

SEQ ID NO: 2006535 - RNA, 14 nt, Shigella flexneri 2a str. 301
cggcuccagcaaug

SEQ ID NO: 2006536 - RNA, 22 nt, Shigella flexneri 2a str. 301
cggcuccagcaaugucauaaac

SEQ ID NO: 2006537 - RNA, 11 nt, Shigella flexneri 2a str. 301
cggcuccagau

SEQ ID NO: 2006538 - RNA, 14 nt, Shigella flexneri 2a str. 301
cggcucaccugcac

SEQ ID NO: 2006539 - RNA, 18 nt, Shigella flexneri 2a str. 301
cgggccaguuucauagug

SEQ ID NO: 2006540 - RNA, 20 nt, Shigella flexneri 2a str. 301
cgggccauaaaaggaagagg

SEQ ID NO: 2006541 - RNA, 20 nt, Shigella flexneri 2a str. 301
cgggcccauaacgccugcuc

SEQ ID NO: 2006542 - RNA, 15 nt, Shigella flexneri 2a str. 301
cgggccuccccggau

SEQ ID NO: 2006543 - RNA, 21 nt, Shigella flexneri 2a str. 301
cgggccuccccggauucaucc

SEQ ID NO: 2006544 - RNA, 16 nt, Shigella flexneri 2a str. 301
cgggccugaacaagca

SEQ ID NO: 2006545 - RNA, 14 nt, Shigella flexneri 2a str. 301
cgggcuaaucguca

SEQ ID NO: 2006546 - RNA, 20 nt, Shigella flexneri 2a str. 301
cgggcgacgcugcgccgacc

SEQ ID NO: 2006547 - RNA, 22 nt, Shigella flexneri 2a str. 301
cgggaucugauucugauccugc

SEQ ID NO: 2006548 - RNA, 13 nt, Shigella flexneri 2a str. 301
cgggaucaccaga

SEQ ID NO: 2006549 - RNA, 11 nt, Shigella flexneri 2a str. 301
cgggauaaacg

SEQ ID NO: 2006550 - RNA, 18 nt, Shigella flexneri 2a str. 301
cgggagguaaugacucca

SEQ ID NO: 2006551 - RNA, 16 nt, Shigella flexneri 2a str. 301
cgggagagauaagaua

SEQ ID NO: 2006552 - RNA, 18 nt, Shigella flexneri 2a str. 301
cgggauucgaaccuguga

SEQ ID NO: 2006553 - RNA, 18 nt, Shigella flexneri 2a str. 301
cgggcaaagcgacgcgca

SEQ ID NO: 2006554 - RNA, 14 nt, Shigella flexneri 2a str. 301
cgggcaacugcugc

SEQ ID NO: 2006555 - RNA, 13 nt, Shigella flexneri 2a str. 301
cgggcaacuucaa

SEQ ID NO: 2006556 - RNA, 16 nt, Shigella flexneri 2a str. 301
cgggcaagcaccaggg

SEQ ID NO: 2006557 - RNA, 15 nt, Shigella flexneri 2a str. 301
cgggcaucagcagca

SEQ ID NO: 2006558 - RNA, 14 nt, Shigella flexneri 2a str. 301
cgggcaugauagcc

SEQ ID NO: 2006559 - RNA, 20 nt, Shigella flexneri 2a str. 301
cgggcaggcuucaacacagg

SEQ ID NO: 2006560 - RNA, 20 nt, Shigella flexneri 2a str. 301
cgggcagaaugcccugcggc

SEQ ID NO: 2006561 - RNA, 18 nt, Shigella flexneri 2a str. 301
cggucguaaucgcccgcu

SEQ ID NO: 2006562 - RNA, 20 nt, Shigella flexneri 2a str. 301
cggucuaccgauccggcacc

SEQ ID NO: 2006563 - RNA, 20 nt, Shigella flexneri 2a str. 301
cggucuaaaucuuccgccgg

SEQ ID NO: 2006564 - RNA, 15 nt, Shigella flexneri 2a str. 301
cggucggcuucccug

SEQ ID NO: 2006565 - RNA, 24 nt, Shigella flexneri 2a str. 301
cggugaaaaaccaaucucccagcc

SEQ ID NO: 2006566 - RNA, 14 nt, Shigella flexneri 2a str. 301
cggucuuuucucau

SEQ ID NO: 2006567 - RNA, 13 nt, Shigella flexneri 2a str. 301
cggugaccagcag

SEQ ID NO: 2006568 - RNA, 18 nt, Shigella flexneri 2a str. 301
cggugaaggcaaacuguc

SEQ ID NO: 2006569 - RNA, 18 nt, Shigella flexneri 2a str. 301
cggugauaaucaucccac

SEQ ID NO: 2006570 - RNA, 20 nt, Shigella flexneri 2a str. 301
cggugauauacgucacuuca

SEQ ID NO: 2006571 - RNA, 22 nt, Shigella flexneri 2a str. 301
cggugacgcacaguacgcgccc

SEQ ID NO: 2006572 - RNA, 18 nt, Shigella flexneri 2a str. 301
cggugacgcaaccgcaaa

SEQ ID NO: 2006573 - RNA, 23 nt, Shigella flexneri 2a str. 301
cggucgaugccaauccccagacc

SEQ ID NO: 2006574 - RNA, 11 nt, Shigella flexneri 2a str. 301
cgguccuggcg

SEQ ID NO: 2006575 - RNA, 18 nt, Shigella flexneri 2a str. 301
cgguccgguugcagagua

SEQ ID NO: 2006576 - RNA, 15 nt, Shigella flexneri 2a str. 301
cggucgcugacgcca

SEQ ID NO: 2006577 - RNA, 22 nt, Shigella flexneri 2a str. 301
cggucggaaaauuauuuuaaau

SEQ ID NO: 2006578 - RNA, 13 nt, Shigella flexneri 2a str. 301
cggucgcggaaca

SEQ ID NO: 2006579 - RNA, 15 nt, Shigella flexneri 2a str. 301
cggucaucaguucag

SEQ ID NO: 2006580 - RNA, 15 nt, Shigella flexneri 2a str. 301
aaacuacaggcaacg

SEQ ID NO: 2006581 - RNA, 13 nt, Shigella flexneri 2a str. 301
cgguaacauccag

SEQ ID NO: 2006582 - RNA, 13 nt, Shigella flexneri 2a str. 301
cgguaacccuuca

SEQ ID NO: 2006583 - RNA, 22 nt, Shigella flexneri 2a str. 301
cgguaacgauacggcccagacc

SEQ ID NO: 2006584 - RNA, 23 nt, Shigella flexneri 2a str. 301
cgguaacgauuucaucgcccagg

SEQ ID NO: 2006585 - RNA, 17 nt, Shigella flexneri 2a str. 301
cgguaacgccaguuuaa

SEQ ID NO: 2006586 - RNA, 21 nt, Shigella flexneri 2a str. 301
cgguaaguucacgcagguuag

SEQ ID NO: 2006587 - RNA, 22 nt, Shigella flexneri 2a str. 301
cgguaauaaaugccggaagcug

SEQ ID NO: 2006588 - RNA, 15 nt, Shigella flexneri 2a str. 301
cgguaagcugaugac

SEQ ID NO: 2006589 - RNA, 16 nt, Shigella flexneri 2a str. 301
cgguaagaacaagcaa

SEQ ID NO: 2006590 - RNA, 23 nt, Shigella flexneri 2a str. 301
cgguaagaguaaagcccgccauc

SEQ ID NO: 2006591 - RNA, 24 nt, Shigella flexneri 2a str. 301
cgguaccaguacgcccacgccagc

SEQ ID NO: 2006592 - RNA, 19 nt, Shigella flexneri 2a str. 301
cgguaauuauugaugaagu

SEQ ID NO: 2006593 - RNA, 23 nt, Shigella flexneri 2a str. 301
cgguacaaacaucauccagugcc

SEQ ID NO: 2006594 - RNA, 17 nt, Shigella flexneri 2a str. 301
cgguagcaugaaccauu

SEQ ID NO: 2006595 - RNA, 15 nt, Shigella flexneri 2a str. 301
cgguagcagcuuuca

SEQ ID NO: 2006596 - RNA, 20 nt, Shigella flexneri 2a str. 301
cgguagccccgcgaacgggg

SEQ ID NO: 2006597 - RNA, 16 nt, Shigella flexneri 2a str. 301
cgguagaauuguaauc

SEQ ID NO: 2006598 - RNA, 20 nt, Shigella flexneri 2a str. 301
cgguaccuuugaacugcuga

SEQ ID NO: 2006599 - RNA, 14 nt, Shigella flexneri 2a str. 301
cgguaucaccaccc

SEQ ID NO: 2006600 - RNA, 17 nt, Shigella flexneri 2a str. 301
cgguaucaccacccagc

SEQ ID NO: 2006601 - RNA, 13 nt, Shigella flexneri 2a str. 301
cgguaucaaacac

SEQ ID NO: 2006602 - RNA, 18 nt, Shigella flexneri 2a str. 301
cgguauuaaucugccagc

SEQ ID NO: 2006603 - RNA, 17 nt, Shigella flexneri 2a str. 301
cggucacaucgcugaca

SEQ ID NO: 2006604 - RNA, 23 nt, Shigella flexneri 2a str. 301
cggucaagcgcagcgcccccggc

SEQ ID NO: 2006605 - RNA, 16 nt, Shigella flexneri 2a str. 301
cggucaacgcgcggcu

SEQ ID NO: 2006606 - RNA, 12 nt, Shigella flexneri 2a str. 301
aaacuaaaaaca

SEQ ID NO: 2006607 - RNA, 16 nt, Shigella flexneri 2a str. 301
cggucagcagcaccac

SEQ ID NO: 2006608 - RNA, 12 nt, Shigella flexneri 2a str. 301
cggucagccauu

SEQ ID NO: 2006609 - RNA, 14 nt, Shigella flexneri 2a str. 301
cgggguuugcagau

SEQ ID NO: 2006610 - RNA, 14 nt, Shigella flexneri 2a str. 301
cggguaccagaauc

SEQ ID NO: 2006611 - RNA, 21 nt, Shigella flexneri 2a str. 301
cggguaacuaauaauugcccc

SEQ ID NO: 2006612 - RNA, 20 nt, Shigella flexneri 2a str. 301
cggguaagaauauccggcuc

SEQ ID NO: 2006613 - RNA, 15 nt, Shigella flexneri 2a str. 301
cggggguaaaaccgg

SEQ ID NO: 2006614 - RNA, 20 nt, Shigella flexneri 2a str. 301
cggggcuguuuuccagcacc

SEQ ID NO: 2006615 - RNA, 21 nt, Shigella flexneri 2a str. 301
cggggcuguuuuccagcacca

SEQ ID NO: 2006616 - RNA, 17 nt, Shigella flexneri 2a str. 301
cggggcuauaccagaua

SEQ ID NO: 2006617 - RNA, 18 nt, Shigella flexneri 2a str. 301
cggggaacaucaggcauu

SEQ ID NO: 2006618 - RNA, 19 nt, Shigella flexneri 2a str. 301
cgggcuggcguacccauca

SEQ ID NO: 2006619 - RNA, 13 nt, Shigella flexneri 2a str. 301
cggggaucacucc

SEQ ID NO: 2006620 - RNA, 18 nt, Shigella flexneri 2a str. 301
cggggagagucauuaugc

SEQ ID NO: 2006621 - RNA, 19 nt, Shigella flexneri 2a str. 301
cggggagauauuccccaga

SEQ ID NO: 2006622 - RNA, 14 nt, Shigella flexneri 2a str. 301
cggggacaggcggg

SEQ ID NO: 2006623 - RNA, 20 nt, Shigella flexneri 2a str. 301
cggguuaaccagcaccagcu

SEQ ID NO: 2006624 - RNA, 14 nt, Shigella flexneri 2a str. 301
cggguuaaauccug

SEQ ID NO: 2006625 - RNA, 20 nt, Shigella flexneri 2a str. 301
cggguuagguggcaccugac

SEQ ID NO: 2006626 - RNA, 19 nt, Shigella flexneri 2a str. 301
cgggugguaauaccacccg

SEQ ID NO: 2006627 - RNA, 19 nt, Shigella flexneri 2a str. 301
cggguggcucucgccagca

SEQ ID NO: 2006628 - RNA, 13 nt, Shigella flexneri 2a str. 301
cgguaaaaucauc

SEQ ID NO: 2006629 - RNA, 18 nt, Shigella flexneri 2a str. 301
cgguaaaaccuuugcgaa

SEQ ID NO: 2006630 - RNA, 20 nt, Shigella flexneri 2a str. 301
cgguaaaaucauccugcugc

SEQ ID NO: 2006631 - RNA, 22 nt, Shigella flexneri 2a str. 301
cggguuuucgcugccacaccau

SEQ ID NO: 2006632 - RNA, 15 nt, Shigella flexneri 2a str. 301
cggguuuucaacggc

SEQ ID NO: 2006633 - RNA, 14 nt, Shigella flexneri 2a str. 301
cggguuuucaauga

SEQ ID NO: 2006634 - RNA, 22 nt, Shigella flexneri 2a str. 301
cgguaaagccgugcugcugcca

SEQ ID NO: 2006635 - RNA, 14 nt, Shigella flexneri 2a str. 301
cgguaaauugcccc

SEQ ID NO: 2006636 - RNA, 19 nt, Shigella flexneri 2a str. 301
cggguuuaagcccggcauu

SEQ ID NO: 2006637 - RNA, 13 nt, Shigella flexneri 2a str. 301
cggguuuccugga

SEQ ID NO: 2006638 - RNA, 18 nt, Shigella flexneri 2a str. 301
cggguuuacuuccccggc

SEQ ID NO: 2006639 - RNA, 15 nt, Shigella flexneri 2a str. 301
cggguuggagcgcgu

SEQ ID NO: 2006640 - RNA, 20 nt, Shigella flexneri 2a str. 301
cggguugcgguuucaacugc

SEQ ID NO: 2006641 - RNA, 21 nt, Shigella flexneri 2a str. 301
cgggugcaaucaacaccacug

SEQ ID NO: 2006642 - RNA, 20 nt, Shigella flexneri 2a str. 301
cgggugaagagauccaccag

SEQ ID NO: 2006643 - RNA, 15 nt, Shigella flexneri 2a str. 301
cgggugaucuucaua

SEQ ID NO: 2006644 - RNA, 14 nt, Shigella flexneri 2a str. 301
cgggucaccgccga

SEQ ID NO: 2006645 - RNA, 16 nt, Shigella flexneri 2a str. 301
cgggucaccgcggugu

SEQ ID NO: 2006646 - RNA, 23 nt, Shigella flexneri 2a str. 301
cgggucauccaggaacuccagau

SEQ ID NO: 2006647 - RNA, 20 nt, Shigella flexneri 2a str. 301
cgggucaguauuccaaucgg

SEQ ID NO: 2006648 - RNA, 15 nt, Shigella flexneri 2a str. 301
cuucugauguuguuu

SEQ ID NO: 2006649 - RNA, 19 nt, Shigella flexneri 2a str. 301
cuucugcaacgucuccggu

SEQ ID NO: 2006650 - RNA, 21 nt, Shigella flexneri 2a str. 301
cuucugacauaaccacucacc

SEQ ID NO: 2006651 - RNA, 23 nt, Shigella flexneri 2a str. 301
cuucugacuauauaaauuacccu

SEQ ID NO: 2006652 - RNA, 15 nt, Shigella flexneri 2a str. 301
cuucugaguucggca

SEQ ID NO: 2006653 - RNA, 17 nt, Shigella flexneri 2a str. 301
cuucugaucuacagccu

SEQ ID NO: 2006654 - RNA, 16 nt, Shigella flexneri 2a str. 301
cuucucugaaaauuaa

SEQ ID NO: 2006655 - RNA, 13 nt, Shigella flexneri 2a str. 301
cuucugccgcuuc

SEQ ID NO: 2006656 - RNA, 22 nt, Shigella flexneri 2a str. 301
cuucuggcgacccguuuuucuu

SEQ ID NO: 2006657 - RNA, 20 nt, Shigella flexneri 2a str. 301
cuucucgucaaucugcucca

SEQ ID NO: 2006658 - RNA, 20 nt, Shigella flexneri 2a str. 301
cuucucgugaaacucacgca

SEQ ID NO: 2006659 - RNA, 16 nt, Shigella flexneri 2a str. 301
cuucucgccagccucc

SEQ ID NO: 2006660 - RNA, 22 nt, Shigella flexneri 2a str. 301
cuucucgauaaaaccuuccuca

SEQ ID NO: 2006661 - RNA, 20 nt, Shigella flexneri 2a str. 301
cuucuccccggccaaaaugu

SEQ ID NO: 2006662 - RNA, 17 nt, Shigella flexneri 2a str. 301
cuucuccggcauccuua

SEQ ID NO: 2006663 - RNA, 15 nt, Shigella flexneri 2a str. 301
cuucucauccuuccc

SEQ ID NO: 2006664 - RNA, 17 nt, Shigella flexneri 2a str. 301
cuucucaggccuacaaa

SEQ ID NO: 2006665 - RNA, 19 nt, Shigella flexneri 2a str. 301
cuucucagcgguaaugguc

SEQ ID NO: 2006666 - RNA, 13 nt, Shigella flexneri 2a str. 301
cuucucaacacau

SEQ ID NO: 2006667 - RNA, 21 nt, Shigella flexneri 2a str. 301
cuucucaaucccuuucucuuc

SEQ ID NO: 2006668 - RNA, 15 nt, Shigella flexneri 2a str. 301
cuucucagauauaaa

SEQ ID NO: 2006669 - RNA, 15 nt, Shigella flexneri 2a str. 301
cuucguagacgcuuu

SEQ ID NO: 2006670 - RNA, 20 nt, Shigella flexneri 2a str. 301
cuucgucguaguaguucauc

SEQ ID NO: 2006671 - RNA, 16 nt, Shigella flexneri 2a str. 301
cuucgucgucuucguc

SEQ ID NO: 2006672 - RNA, 22 nt, Shigella flexneri 2a str. 301
cuucguuauccucugcaagaua

SEQ ID NO: 2006673 - RNA, 14 nt, Shigella flexneri 2a str. 301
cuucgugcaggcau

SEQ ID NO: 2006674 - RNA, 18 nt, Shigella flexneri 2a str. 301
cuucgugcggcugcaucu

SEQ ID NO: 2006675 - RNA, 19 nt, Shigella flexneri 2a str. 301
cuucgugcguuuguaggcc

SEQ ID NO: 2006676 - RNA, 16 nt, Shigella flexneri 2a str. 301
cuucguugccccagug

SEQ ID NO: 2006677 - RNA, 12 nt, Shigella flexneri 2a str. 301
cuucguucaucu

SEQ ID NO: 2006678 - RNA, 19 nt, Shigella flexneri 2a str. 301
cuucguucaucucaaacac

SEQ ID NO: 2006679 - RNA, 18 nt, Shigella flexneri 2a str. 301
cuucuacaggcugcaucu

SEQ ID NO: 2006680 - RNA, 18 nt, Shigella flexneri 2a str. 301
cuucuaauuuuuccagca

SEQ ID NO: 2006681 - RNA, 14 nt, Shigella flexneri 2a str. 301
cuucuauaccaaug

SEQ ID NO: 2006682 - RNA, 23 nt, Shigella flexneri 2a str. 301
cuucuaccuuaacgguaucuuuc

SEQ ID NO: 2006683 - RNA, 13 nt, Shigella flexneri 2a str. 301
cuucucaaucccu

SEQ ID NO: 2006684 - RNA, 14 nt, Shigella flexneri 2a str. 301
cuucuucucagcca

SEQ ID NO: 2006685 - RNA, 15 nt, Shigella flexneri 2a str. 301
cuucuucuacugcgc

SEQ ID NO: 2006686 - RNA, 23 nt, Shigella flexneri 2a str. 301
cuucuucgugggccgcugaacug

SEQ ID NO: 2006687 - RNA, 19 nt, Shigella flexneri 2a str. 301
cuucuucgucgucuucguc

SEQ ID NO: 2006688 - RNA, 23 nt, Shigella flexneri 2a str. 301
cuucuucguagggucacguucca

SEQ ID NO: 2006689 - RNA, 17 nt, Shigella flexneri 2a str. 301
cuucuucauucauccgc

SEQ ID NO: 2006690 - RNA, 16 nt, Shigella flexneri 2a str. 301
cuucuucccaccauac

SEQ ID NO: 2006691 - RNA, 20 nt, Shigella flexneri 2a str. 301
cuucuuccauaccgaccaug

SEQ ID NO: 2006692 - RNA, 16 nt, Shigella flexneri 2a str. 301
cuucuguuuuaccugc

SEQ ID NO: 2006693 - RNA, 15 nt, Shigella flexneri 2a str. 301
cuucuucacuucuuc

SEQ ID NO: 2006694 - RNA, 15 nt, Shigella flexneri 2a str. 301
cuucugguaacagcg

SEQ ID NO: 2006695 - RNA, 23 nt, Shigella flexneri 2a str. 301
cuucuggugauaggcguugcggg

SEQ ID NO: 2006696 - RNA, 20 nt, Shigella flexneri 2a str. 301
cuucugguaacagcggacgg

SEQ ID NO: 2006697 - RNA, 15 nt, Shigella flexneri 2a str. 301
cuucuggcggcggca

SEQ ID NO: 2006698 - RNA, 18 nt, Shigella flexneri 2a str. 301
cuucugguuauauuuccc

SEQ ID NO: 2006699 - RNA, 21 nt, Shigella flexneri 2a str. 301
cuucugguugcgaaaaaauca

SEQ ID NO: 2006700 - RNA, 15 nt, Shigella flexneri 2a str. 301
cuucugguuuuucug

SEQ ID NO: 2006701 - RNA, 23 nt, Shigella flexneri 2a str. 301
cuucugguuuuucugaaaacugu

SEQ ID NO: 2006702 - RNA, 15 nt, Shigella flexneri 2a str. 301
cuucuguaacuggaa

SEQ ID NO: 2006703 - RNA, 18 nt, Shigella flexneri 2a str. 301
cuucugugauuccgccag

SEQ ID NO: 2006704 - RNA, 17 nt, Shigella flexneri 2a str. 301
cuucugguuauauuucc

SEQ ID NO: 2006705 - RNA, 13 nt, Shigella flexneri 2a str. 301
cuucugucgcuuc

SEQ ID NO: 2006706 - RNA, 12 nt, Shigella flexneri 2a str. 301
cuucuuuauuga

SEQ ID NO: 2006707 - RNA, 20 nt, Shigella flexneri 2a str. 301
cuucuuuuuaccuucauuug

SEQ ID NO: 2006708 - RNA, 16 nt, Shigella flexneri 2a str. 301
cuugaacuuaucauca

SEQ ID NO: 2006709 - RNA, 20 nt, Shigella flexneri 2a str. 301
cuugaauaaauuggcugggg

SEQ ID NO: 2006710 - RNA, 21 nt, Shigella flexneri 2a str. 301
cuugaauaaauuggcuggggu

SEQ ID NO: 2006711 - RNA, 19 nt, Shigella flexneri 2a str. 301
cuugauaacgagcaauaga

SEQ ID NO: 2006712 - RNA, 18 nt, Shigella flexneri 2a str. 301
cuugauagaacaaaagac

SEQ ID NO: 2006713 - RNA, 18 nt, Shigella flexneri 2a str. 301
cuugauauaaaucccagg

SEQ ID NO: 2006714 - RNA, 14 nt, Shigella flexneri 2a str. 301
cuugaggugguagu

SEQ ID NO: 2006715 - RNA, 23 nt, Shigella flexneri 2a str. 301
cuugaguuuuucaucccucucau

SEQ ID NO: 2006716 - RNA, 20 nt, Shigella flexneri 2a str. 301
cuugagcccuggccacaaac

SEQ ID NO: 2006717 - RNA, 21 nt, Shigella flexneri 2a str. 301
cuugagcgcagucuggcggcu

SEQ ID NO: 2006718 - RNA, 21 nt, Shigella flexneri 2a str. 301
cuugacgugucuuaucaggcc

SEQ ID NO: 2006719 - RNA, 22 nt, Shigella flexneri 2a str. 301
cuugacgcugauuuuuuuucaa

SEQ ID NO: 2006720 - RNA, 13 nt, Shigella flexneri 2a str. 301
cuugauuauuucc

SEQ ID NO: 2006721 - RNA, 17 nt, Shigella flexneri 2a str. 301
cuugauucuguucagua

SEQ ID NO: 2006722 - RNA, 21 nt, Shigella flexneri 2a str. 301
cuugauuauuucccucguuuu

SEQ ID NO: 2006723 - RNA, 16 nt, Shigella flexneri 2a str. 301
cuugcaaucuuuagca

SEQ ID NO: 2006724 - RNA, 16 nt, Shigella flexneri 2a str. 301
cuugcaauaguuucag

SEQ ID NO: 2006725 - RNA, 15 nt, Shigella flexneri 2a str. 301
cuugcaaaaucaaua

SEQ ID NO: 2006726 - RNA, 20 nt, Shigella flexneri 2a str. 301
cuugccauuccacaaaaacc

SEQ ID NO: 2006727 - RNA, 17 nt, Shigella flexneri 2a str. 301
cuugccagaugccagga

SEQ ID NO: 2006728 - RNA, 15 nt, Shigella flexneri 2a str. 301
cuugccagagcagca

SEQ ID NO: 2006729 - RNA, 17 nt, Shigella flexneri 2a str. 301
cuugcaucguguaauuc

SEQ ID NO: 2006730 - RNA, 23 nt, Shigella flexneri 2a str. 301
cuugcauagcuucgaaguuuuca

SEQ ID NO: 2006731 - RNA, 12 nt, Shigella flexneri 2a str. 301
cuugcagcuccu

SEQ ID NO: 2006732 - RNA, 20 nt, Shigella flexneri 2a str. 301
cuugcaccggcgacauccca

SEQ ID NO: 2006733 - RNA, 18 nt, Shigella flexneri 2a str. 301
cuugcacucgcagaagca

SEQ ID NO: 2006734 - RNA, 20 nt, Shigella flexneri 2a str. 301
cuugcacucgcagaagcagu

SEQ ID NO: 2006735 - RNA, 15 nt, Shigella flexneri 2a str. 301
cuugccgcgucuuau

SEQ ID NO: 2006736 - RNA, 23 nt, Shigella flexneri 2a str. 301
cuugccgcgucuuaucaggccua

SEQ ID NO: 2006737 - RNA, 13 nt, Shigella flexneri 2a str. 301
cuugccgcaaaac

SEQ ID NO: 2006738 - RNA, 18 nt, Shigella flexneri 2a str. 301
cuugccgcaaaacccagg

SEQ ID NO: 2006739 - RNA, 22 nt, Shigella flexneri 2a str. 301
cuugccgcaaaacccaggcuua

SEQ ID NO: 2006740 - RNA, 13 nt, Shigella flexneri 2a str. 301
cuugccuuuccuc

SEQ ID NO: 2006741 - RNA, 17 nt, Shigella flexneri 2a str. 301
cuugccuuuccuccugu

SEQ ID NO: 2006742 - RNA, 14 nt, Shigella flexneri 2a str. 301
cuugcgacucagcc

SEQ ID NO: 2006743 - RNA, 17 nt, Shigella flexneri 2a str. 301
aaacuugauagaacaaa

SEQ ID NO: 2006744 - RNA, 18 nt, Shigella flexneri 2a str. 301
aaacuugaacgcgagaaa

SEQ ID NO: 2006745 - RNA, 16 nt, Shigella flexneri 2a str. 301
aaacuuucauaaacac

SEQ ID NO: 2006746 - RNA, 13 nt, Shigella flexneri 2a str. 301
aaacuuuuaaauu

SEQ ID NO: 2006747 - RNA, 12 nt, Shigella flexneri 2a str. 301
aaacuuuuaaau

SEQ ID NO: 2006748 - RNA, 12 nt, Shigella flexneri 2a str. 301
cuugcugauaac

SEQ ID NO: 2006749 - RNA, 19 nt, Shigella flexneri 2a str. 301
cuugcuccacaagcuccgg

SEQ ID NO: 2006750 - RNA, 18 nt, Shigella flexneri 2a str. 301
cuugcugauacuccucau

SEQ ID NO: 2006751 - RNA, 19 nt, Shigella flexneri 2a str. 301
cuugcuccacguucagaga

SEQ ID NO: 2006752 - RNA, 20 nt, Shigella flexneri 2a str. 301
cuugcuccacguucagagag

SEQ ID NO: 2006753 - RNA, 22 nt, Shigella flexneri 2a str. 301
cuugcucgcgcaccuacagcca

SEQ ID NO: 2006754 - RNA, 15 nt, Shigella flexneri 2a str. 301
cuugcuggucacuga

SEQ ID NO: 2006755 - RNA, 17 nt, Shigella flexneri 2a str. 301
cuugcuggacuugaacc

SEQ ID NO: 2006756 - RNA, 15 nt, Shigella flexneri 2a str. 301
cuugcuuaaaauccc

SEQ ID NO: 2006757 - RNA, 15 nt, Shigella flexneri 2a str. 301
cuugcggacccggcg

SEQ ID NO: 2006758 - RNA, 12 nt, Shigella flexneri 2a str. 301
cuugcgucacau

SEQ ID NO: 2006759 - RNA, 20 nt, Shigella flexneri 2a str. 301
cuugcgucauccagcacuug

SEQ ID NO: 2006760 - RNA, 16 nt, Shigella flexneri 2a str. 301
cuugcgucgccaguuu

SEQ ID NO: 2006761 - RNA, 20 nt, Shigella flexneri 2a str. 301
cuugcgcgcaaucagcaccg

SEQ ID NO: 2006762 - RNA, 22 nt, Shigella flexneri 2a str. 301
cuugcgcggauggccucugcca

SEQ ID NO: 2006763 - RNA, 18 nt, Shigella flexneri 2a str. 301
cuguuucaggaacaccgc

SEQ ID NO: 2006764 - RNA, 18 nt, Shigella flexneri 2a str. 301
cuguuucgcuucuucagc

SEQ ID NO: 2006765 - RNA, 14 nt, Shigella flexneri 2a str. 301
cuguuucuggauga

SEQ ID NO: 2006766 - RNA, 21 nt, Shigella flexneri 2a str. 301
cuguuucuggaugauccuggc

SEQ ID NO: 2006767 - RNA, 15 nt, Shigella flexneri 2a str. 301
cuguuuaucuuccca

SEQ ID NO: 2006768 - RNA, 20 nt, Shigella flexneri 2a str. 301
cuguuuagcgacucgauggc

SEQ ID NO: 2006769 - RNA, 18 nt, Shigella flexneri 2a str. 301
cuguuuaauaugcaauuc

SEQ ID NO: 2006770 - RNA, 18 nt, Shigella flexneri 2a str. 301
cuguucgccgccgcuuuc

SEQ ID NO: 2006771 - RNA, 14 nt, Shigella flexneri 2a str. 301
cuguucgccgccgc

SEQ ID NO: 2006772 - RNA, 19 nt, Shigella flexneri 2a str. 301
cuguugucugaaugauaac

SEQ ID NO: 2006773 - RNA, 16 nt, Shigella flexneri 2a str. 301
cuguuuaaccgcuuca

SEQ ID NO: 2006774 - RNA, 16 nt, Shigella flexneri 2a str. 301
cuguuguucaacacuc

SEQ ID NO: 2006775 - RNA, 13 nt, Shigella flexneri 2a str. 301
cuguucaaacauu

SEQ ID NO: 2006776 - RNA, 15 nt, Shigella flexneri 2a str. 301
cuguuccgccagagc

SEQ ID NO: 2006777 - RNA, 12 nt, Shigella flexneri 2a str. 301
cuguuccccuca

SEQ ID NO: 2006778 - RNA, 20 nt, Shigella flexneri 2a str. 301
cuguuacgccagaacagcua

SEQ ID NO: 2006779 - RNA, 17 nt, Shigella flexneri 2a str. 301
cuguuacgccagaacag

SEQ ID NO: 2006780 - RNA, 20 nt, Shigella flexneri 2a str. 301
cuguuaucacuuaacccauu

SEQ ID NO: 2006781 - RNA, 22 nt, Shigella flexneri 2a str. 301
cuggcccaguugauucgcgcgu

SEQ ID NO: 2006782 - RNA, 15 nt, Shigella flexneri 2a str. 301
cuggcccauagacag

SEQ ID NO: 2006783 - RNA, 17 nt, Shigella flexneri 2a str. 301
cuuaaucaucaaugcca

SEQ ID NO: 2006784 - RNA, 22 nt, Shigella flexneri 2a str. 301
cuuaaucaucaaugccagcaua

SEQ ID NO: 2006785 - RNA, 15 nt, Shigella flexneri 2a str. 301
cuuaaucagacuggc

SEQ ID NO: 2006786 - RNA, 17 nt, Shigella flexneri 2a str. 301
cuuaaucagaauuuuuc

SEQ ID NO: 2006787 - RNA, 18 nt, Shigella flexneri 2a str. 301
cuuaaucaauugcaggaa

SEQ ID NO: 2006788 - RNA, 14 nt, Shigella flexneri 2a str. 301
cuuaaucaacucac

SEQ ID NO: 2006789 - RNA, 20 nt, Shigella flexneri 2a str. 301
cuuaacgcgggcuucuucuu

SEQ ID NO: 2006790 - RNA, 22 nt, Shigella flexneri 2a str. 301
aaacuggaaaaauaauuuuaaa

SEQ ID NO: 2006791 - RNA, 15 nt, Shigella flexneri 2a str. 301
aaacuggauggcucu

SEQ ID NO: 2006792 - RNA, 15 nt, Shigella flexneri 2a str. 301
cuuaaauuaagaagu

SEQ ID NO: 2006793 - RNA, 21 nt, Shigella flexneri 2a str. 301
cuuaaaugcacccgccagaga

SEQ ID NO: 2006794 - RNA, 17 nt, Shigella flexneri 2a str. 301
aaacuggcguuuuucca

SEQ ID NO: 2006795 - RNA, 21 nt, Shigella flexneri 2a str. 301
aaacuggcguuuuuccaaaac

SEQ ID NO: 2006796 - RNA, 20 nt, Shigella flexneri 2a str. 301
aaacuggccucuuggcaucu

SEQ ID NO: 2006797 - RNA, 12 nt, Shigella flexneri 2a str. 301
cuuaacacugag

SEQ ID NO: 2006798 - RNA, 19 nt, Shigella flexneri 2a str. 301
cuuaaaggggugaaaaaaa

SEQ ID NO: 2006799 - RNA, 15 nt, Shigella flexneri 2a str. 301
cuuaaagucuuugua

SEQ ID NO: 2006800 - RNA, 20 nt, Shigella flexneri 2a str. 301
cuuaaagucuuuguauuuau

SEQ ID NO: 2006801 - RNA, 23 nt, Shigella flexneri 2a str. 301
cuuaaauaagguuaauuaccuua

SEQ ID NO: 2006802 - RNA, 19 nt, Shigella flexneri 2a str. 301
cuguuuuucguuuggggca

SEQ ID NO: 2006803 - RNA, 14 nt, Shigella flexneri 2a str. 301
cuguuuuuuauacu

SEQ ID NO: 2006804 - RNA, 16 nt, Shigella flexneri 2a str. 301
cuuacccuaaauccgc

SEQ ID NO: 2006805 - RNA, 13 nt, Shigella flexneri 2a str. 301
cuuaccacugccg

SEQ ID NO: 2006806 - RNA, 16 nt, Shigella flexneri 2a str. 301
cuuaauggaaaacugu

SEQ ID NO: 2006807 - RNA, 17 nt, Shigella flexneri 2a str. 301
cuuaauguaaugcuuug

SEQ ID NO: 2006808 - RNA, 22 nt, Shigella flexneri 2a str. 301
cuuaaugaaucaucguucauau

SEQ ID NO: 2006809 - RNA, 12 nt, Shigella flexneri 2a str. 301
cuuaaucugcca

SEQ ID NO: 2006810 - RNA, 20 nt, Shigella flexneri 2a str. 301
cuuaaugcaggcagcacugc

SEQ ID NO: 2006811 - RNA, 22 nt, Shigella flexneri 2a str. 301
cuuaaugcauggcagauaaaca

SEQ ID NO: 2006812 - RNA, 19 nt, Shigella flexneri 2a str. 301
cuuaaugcccaucucuucu

SEQ ID NO: 2006813 - RNA, 16 nt, Shigella flexneri 2a str. 301
cuuagcaacaggccag

SEQ ID NO: 2006814 - RNA, 18 nt, Shigella flexneri 2a str. 301
cuuacugaugcacacacg

SEQ ID NO: 2006815 - RNA, 15 nt, Shigella flexneri 2a str. 301
cuuacugauaguguu

SEQ ID NO: 2006816 - RNA, 16 nt, Shigella flexneri 2a str. 301
cuuacucaugauguca

SEQ ID NO: 2006817 - RNA, 22 nt, Shigella flexneri 2a str. 301
cuuacucauuaaugcacuucca

SEQ ID NO: 2006818 - RNA, 20 nt, Shigella flexneri 2a str. 301
cuuacgagugcgcucuucaa

SEQ ID NO: 2006819 - RNA, 17 nt, Shigella flexneri 2a str. 301
cuuacgcaacugccagu

SEQ ID NO: 2006820 - RNA, 15 nt, Shigella flexneri 2a str. 301
cuuaccuacuugcuc

SEQ ID NO: 2006821 - RNA, 23 nt, Shigella flexneri 2a str. 301
cuuaccguuuacgcuuuccagca

SEQ ID NO: 2006822 - RNA, 20 nt, Shigella flexneri 2a str. 301
cuuaccggucccuucaaucu

SEQ ID NO: 2006823 - RNA, 14 nt, Shigella flexneri 2a str. 301
cuuagccuguguca

SEQ ID NO: 2006824 - RNA, 14 nt, Shigella flexneri 2a str. 301
cuuagcgcaaguuu

SEQ ID NO: 2006825 - RNA, 17 nt, Shigella flexneri 2a str. 301
cuuaucaaucucagcaa

SEQ ID NO: 2006826 - RNA, 13 nt, Shigella flexneri 2a str. 301
cuuaucaaucuca

SEQ ID NO: 2006827 - RNA, 23 nt, Shigella flexneri 2a str. 301
cuuauccggcccacaucaacucu

SEQ ID NO: 2006828 - RNA, 18 nt, Shigella flexneri 2a str. 301
cuuaugccacgugagcuu

SEQ ID NO: 2006829 - RNA, 23 nt, Shigella flexneri 2a str. 301
cuuaucgugccuacacauuaucu

SEQ ID NO: 2006830 - RNA, 18 nt, Shigella flexneri 2a str. 301
cuuaugcccggcacguuu

SEQ ID NO: 2006831 - RNA, 18 nt, Shigella flexneri 2a str. 301
cuuaugcgccguuuuuuu

SEQ ID NO: 2006832 - RNA, 15 nt, Shigella flexneri 2a str. 301
cuuaucgggaagcgg

SEQ ID NO: 2006833 - RNA, 20 nt, Shigella flexneri 2a str. 301
cuuaucgccagcgccacgca

SEQ ID NO: 2006834 - RNA, 11 nt, Shigella flexneri 2a str. 301
cuuauuuacau

SEQ ID NO: 2006835 - RNA, 18 nt, Shigella flexneri 2a str. 301
cuuccaggucaaccuagc

SEQ ID NO: 2006836 - RNA, 22 nt, Shigella flexneri 2a str. 301
cuuccaggcucauaccuuccac

SEQ ID NO: 2006837 - RNA, 17 nt, Shigella flexneri 2a str. 301
cuuccaguugcacgcca

SEQ ID NO: 2006838 - RNA, 12 nt, Shigella flexneri 2a str. 301
cuuccagugccu

SEQ ID NO: 2006839 - RNA, 19 nt, Shigella flexneri 2a str. 301
cuuccaguuugcucaaauc

SEQ ID NO: 2006840 - RNA, 17 nt, Shigella flexneri 2a str. 301
cuucccgcauccagaaa

SEQ ID NO: 2006841 - RNA, 15 nt, Shigella flexneri 2a str. 301
cuucccgcagccacg

SEQ ID NO: 2006842 - RNA, 13 nt, Shigella flexneri 2a str. 301
cuucccgccuguc

SEQ ID NO: 2006843 - RNA, 21 nt, Shigella flexneri 2a str. 301
cuucccgggucgcgacugcca

SEQ ID NO: 2006844 - RNA, 16 nt, Shigella flexneri 2a str. 301
cuucccucuacaggaa

SEQ ID NO: 2006845 - RNA, 13 nt, Shigella flexneri 2a str. 301
cuuccggcagacc

SEQ ID NO: 2006846 - RNA, 15 nt, Shigella flexneri 2a str. 301
cuuccggcguggcgu

SEQ ID NO: 2006847 - RNA, 17 nt, Shigella flexneri 2a str. 301
cuuccgcugacagcgcg

SEQ ID NO: 2006848 - RNA, 15 nt, Shigella flexneri 2a str. 301
cuuccaccacgucca

SEQ ID NO: 2006849 - RNA, 15 nt, Shigella flexneri 2a str. 301
aaacuucacuucccc

SEQ ID NO: 2006850 - RNA, 16 nt, Shigella flexneri 2a str. 301
aaacuucacuuccccg

SEQ ID NO: 2006851 - RNA, 15 nt, Shigella flexneri 2a str. 301
aaacuucgucacagc

SEQ ID NO: 2006852 - RNA, 13 nt, Shigella flexneri 2a str. 301
cuuccagcuccag

SEQ ID NO: 2006853 - RNA, 12 nt, Shigella flexneri 2a str. 301
cuuccagcucca

SEQ ID NO: 2006854 - RNA, 18 nt, Shigella flexneri 2a str. 301
cuuccagcguucgccaaa

SEQ ID NO: 2006855 - RNA, 17 nt, Shigella flexneri 2a str. 301
cuuccagcggcaggccg

SEQ ID NO: 2006856 - RNA, 12 nt, Shigella flexneri 2a str. 301
cuuccacuuccu

SEQ ID NO: 2006857 - RNA, 21 nt, Shigella flexneri 2a str. 301
cuuccagacucugaaacucga

SEQ ID NO: 2006858 - RNA, 13 nt, Shigella flexneri 2a str. 301
cuuccacgccugc

SEQ ID NO: 2006859 - RNA, 15 nt, Shigella flexneri 2a str. 301
cuuccacgccugcau

SEQ ID NO: 2006860 - RNA, 19 nt, Shigella flexneri 2a str. 301
cuuccaccguuucuuuuuc

SEQ ID NO: 2006861 - RNA, 17 nt, Shigella flexneri 2a str. 301
cuuccaccacuuccugc

SEQ ID NO: 2006862 - RNA, 13 nt, Shigella flexneri 2a str. 301
cuuccaccacuuc

SEQ ID NO: 2006863 - RNA, 22 nt, Shigella flexneri 2a str. 301
cuucgcggacaucguccagcuu

SEQ ID NO: 2006864 - RNA, 16 nt, Shigella flexneri 2a str. 301
cuucggcgucuccacc

SEQ ID NO: 2006865 - RNA, 17 nt, Shigella flexneri 2a str. 301
cuucggugcgacaaaca

SEQ ID NO: 2006866 - RNA, 19 nt, Shigella flexneri 2a str. 301
cuucggucaccgucaugcc

SEQ ID NO: 2006867 - RNA, 15 nt, Shigella flexneri 2a str. 301
cuucgguauccguuu

SEQ ID NO: 2006868 - RNA, 22 nt, Shigella flexneri 2a str. 301
cuucgguagcagcuuucagcag

SEQ ID NO: 2006869 - RNA, 12 nt, Shigella flexneri 2a str. 301
cuucgccugccu

SEQ ID NO: 2006870 - RNA, 23 nt, Shigella flexneri 2a str. 301
cuucgcgacggcaucaacaucau

SEQ ID NO: 2006871 - RNA, 17 nt, Shigella flexneri 2a str. 301
cuucgacguuauuuacc

SEQ ID NO: 2006872 - RNA, 19 nt, Shigella flexneri 2a str. 301
cuucgaguacauccacugc

SEQ ID NO: 2006873 - RNA, 15 nt, Shigella flexneri 2a str. 301
cuucgaaugccgcag

SEQ ID NO: 2006874 - RNA, 16 nt, Shigella flexneri 2a str. 301
cuuccuuaagccgcug

SEQ ID NO: 2006875 - RNA, 17 nt, Shigella flexneri 2a str. 301
cuuccuuaaucccugga

SEQ ID NO: 2006876 - RNA, 15 nt, Shigella flexneri 2a str. 301
cuuccuggcgcuggc

SEQ ID NO: 2006877 - RNA, 16 nt, Shigella flexneri 2a str. 301
cuuccuggcgcuggcg

SEQ ID NO: 2006878 - RNA, 15 nt, Shigella flexneri 2a str. 301
cuuccugcagcuuca

SEQ ID NO: 2006879 - RNA, 19 nt, Shigella flexneri 2a str. 301
cuuccugccagauccagug

SEQ ID NO: 2006880 - RNA, 20 nt, Shigella flexneri 2a str. 301
cuuccgguuacgccaccagc

SEQ ID NO: 2006881 - RNA, 14 nt, Shigella flexneri 2a str. 301
cuuccggugcaauc

SEQ ID NO: 2006882 - RNA, 17 nt, Shigella flexneri 2a str. 301
cuuccgguuacgccacc

SEQ ID NO: 2006883 - RNA, 19 nt, Shigella flexneri 2a str. 301
cuuccgucagaccaccggu

SEQ ID NO: 2006884 - RNA, 16 nt, Shigella flexneri 2a str. 301
cuuccucaaccacuuu

SEQ ID NO: 2006885 - RNA, 21 nt, Shigella flexneri 2a str. 301
cuuccguuuaaagagcaaccc

SEQ ID NO: 2006886 - RNA, 11 nt, Shigella flexneri 2a str. 301
cuucaggcaca

SEQ ID NO: 2006887 - RNA, 22 nt, Shigella flexneri 2a str. 301
cuucaggacccuuaaaggguca

SEQ ID NO: 2006888 - RNA, 13 nt, Shigella flexneri 2a str. 301
cuucacucucuuu

SEQ ID NO: 2006889 - RNA, 17 nt, Shigella flexneri 2a str. 301
cuucagauucagcgucg

SEQ ID NO: 2006890 - RNA, 15 nt, Shigella flexneri 2a str. 301
cuucagcaacaaaau

SEQ ID NO: 2006891 - RNA, 17 nt, Shigella flexneri 2a str. 301
cuucagcaacaaaaugg

SEQ ID NO: 2006892 - RNA, 14 nt, Shigella flexneri 2a str. 301
cuucagcaagcgau

SEQ ID NO: 2006893 - RNA, 14 nt, Shigella flexneri 2a str. 301
cuucagcaguucag

SEQ ID NO: 2006894 - RNA, 18 nt, Shigella flexneri 2a str. 301
cuucagucgccagcgcca

SEQ ID NO: 2006895 - RNA, 20 nt, Shigella flexneri 2a str. 301
cuucaguugcgccugauaau

SEQ ID NO: 2006896 - RNA, 16 nt, Shigella flexneri 2a str. 301
cuucagucaggcgauu

SEQ ID NO: 2006897 - RNA, 15 nt, Shigella flexneri 2a str. 301
cuucauccaccgauu

SEQ ID NO: 2006898 - RNA, 14 nt, Shigella flexneri 2a str. 301
cuucauccagcagu

SEQ ID NO: 2006899 - RNA, 16 nt, Shigella flexneri 2a str. 301
cuucauccagcaucau

SEQ ID NO: 2006900 - RNA, 17 nt, Shigella flexneri 2a str. 301
cuucauuaccuuuuuuc

SEQ ID NO: 2006901 - RNA, 21 nt, Shigella flexneri 2a str. 301
cuucauugcucucuucuccuu

SEQ ID NO: 2006902 - RNA, 13 nt, Shigella flexneri 2a str. 301
cuucauuauccuu

SEQ ID NO: 2006903 - RNA, 16 nt, Shigella flexneri 2a str. 301
cuucauuugccagcuu

SEQ ID NO: 2006904 - RNA, 17 nt, Shigella flexneri 2a str. 301
cuucauuugccagcuuc

SEQ ID NO: 2006905 - RNA, 12 nt, Shigella flexneri 2a str. 301
cuucauuggcgc

SEQ ID NO: 2006906 - RNA, 12 nt, Shigella flexneri 2a str. 301
cuucauugcucu

SEQ ID NO: 2006907 - RNA, 14 nt, Shigella flexneri 2a str. 301
cuucaaaaaaguca

SEQ ID NO: 2006908 - RNA, 17 nt, Shigella flexneri 2a str. 301
cuucaagaauuaaaaua

SEQ ID NO: 2006909 - RNA, 15 nt, Shigella flexneri 2a str. 301
cuucaagaauuaaaa

SEQ ID NO: 2006910 - RNA, 12 nt, Shigella flexneri 2a str. 301
cuucaaucaaua

SEQ ID NO: 2006911 - RNA, 13 nt, Shigella flexneri 2a str. 301
cuucaaucaauaa

SEQ ID NO: 2006912 - RNA, 16 nt, Shigella flexneri 2a str. 301
cuucaaucgccaccac

SEQ ID NO: 2006913 - RNA, 11 nt, Shigella flexneri 2a str. 301
cuucaaucgcc

SEQ ID NO: 2006914 - RNA, 17 nt, Shigella flexneri 2a str. 301
cuucacgcuuugcaggc

SEQ ID NO: 2006915 - RNA, 20 nt, Shigella flexneri 2a str. 301
cuucacgcuuugcaggcugg

SEQ ID NO: 2006916 - RNA, 21 nt, Shigella flexneri 2a str. 301
cuucacgcuuugcaggcuggu

SEQ ID NO: 2006917 - RNA, 21 nt, Shigella flexneri 2a str. 301
cuucacggcugcuaauauuuu

SEQ ID NO: 2006918 - RNA, 16 nt, Shigella flexneri 2a str. 301
cuucacccgcagcacg

SEQ ID NO: 2006919 - RNA, 23 nt, Shigella flexneri 2a str. 301
cuucacccauugccgccucugcc

SEQ ID NO: 2006920 - RNA, 23 nt, Shigella flexneri 2a str. 301
cuucacggcugcuaauauuuucg

SEQ ID NO: 2006921 - RNA, 13 nt, Shigella flexneri 2a str. 301
cuucacguuuuuc

SEQ ID NO: 2006922 - RNA, 23 nt, Shigella flexneri 2a str. 301
cuucacguuuuucgaaaaucuca

SEQ ID NO: 2006923 - RNA, 20 nt, Shigella flexneri 2a str. 301
cuucacucuauagucuuuuc

SEQ ID NO: 2006924 - RNA, 21 nt, Shigella flexneri 2a str. 301
cuucacucucaccacgcucca

SEQ ID NO: 2006925 - RNA, 18 nt, Shigella flexneri 2a str. 301
cuucacuaaucaauuuuu

SEQ ID NO: 2006926 - RNA, 19 nt, Shigella flexneri 2a str. 301
cuucacuaaucaauuuuuc

SEQ ID NO: 2006927 - RNA, 17 nt, Shigella flexneri 2a str. 301
cuucaaucgccaccaca

SEQ ID NO: 2006928 - RNA, 14 nt, Shigella flexneri 2a str. 301
cuucaauggucagc

SEQ ID NO: 2006929 - RNA, 14 nt, Shigella flexneri 2a str. 301
cuucaccaaucaga

SEQ ID NO: 2006930 - RNA, 13 nt, Shigella flexneri 2a str. 301
cuucaccagccug

SEQ ID NO: 2006931 - RNA, 12 nt, Shigella flexneri 2a str. 301
cuucaccagcag

SEQ ID NO: 2006932 - RNA, 20 nt, Shigella flexneri 2a str. 301
cuuuaaacacgcgaccaaag

SEQ ID NO: 2006933 - RNA, 11 nt, Shigella flexneri 2a str. 301
cuuuaaacaga

SEQ ID NO: 2006934 - RNA, 14 nt, Shigella flexneri 2a str. 301
cuuuaaaaaguaaa

SEQ ID NO: 2006935 - RNA, 17 nt, Shigella flexneri 2a str. 301
cuuguuucugagcauga

SEQ ID NO: 2006936 - RNA, 11 nt, Shigella flexneri 2a str. 301
aaagaaaagau

SEQ ID NO: 2006937 - RNA, 15 nt, Shigella flexneri 2a str. 301
cuugucugagccgaa

SEQ ID NO: 2006938 - RNA, 22 nt, Shigella flexneri 2a str. 301
cuugucugagccgaaaaagaga

SEQ ID NO: 2006939 - RNA, 16 nt, Shigella flexneri 2a str. 301
cuugugcaaaaagucc

SEQ ID NO: 2006940 - RNA, 17 nt, Shigella flexneri 2a str. 301
cuugugccaguucaggu

SEQ ID NO: 2006941 - RNA, 22 nt, Shigella flexneri 2a str. 301
cuuguucacgccaucaucggca

SEQ ID NO: 2006942 - RNA, 13 nt, Shigella flexneri 2a str. 301
cuuguuaugagau

SEQ ID NO: 2006943 - RNA, 20 nt, Shigella flexneri 2a str. 301
cuuguuauuguguagccaga

SEQ ID NO: 2006944 - RNA, 13 nt, Shigella flexneri 2a str. 301
cuuguucaucacc

SEQ ID NO: 2006945 - RNA, 20 nt, Shigella flexneri 2a str. 301
cuuguucaucaccauugcau

SEQ ID NO: 2006946 - RNA, 18 nt, Shigella flexneri 2a str. 301
cuuguuaccugaugcagc

SEQ ID NO: 2006947 - RNA, 18 nt, Shigella flexneri 2a str. 301
cuuggcagagcaacauac

SEQ ID NO: 2006948 - RNA, 19 nt, Shigella flexneri 2a str. 301
cuuggcauuaaacagccaa

SEQ ID NO: 2006949 - RNA, 14 nt, Shigella flexneri 2a str. 301
cuuggcaagcccag

SEQ ID NO: 2006950 - RNA, 15 nt, Shigella flexneri 2a str. 301
cuuggcuauaaccug

SEQ ID NO: 2006951 - RNA, 17 nt, Shigella flexneri 2a str. 301
cuugucaugcagcucca

SEQ ID NO: 2006952 - RNA, 23 nt, Shigella flexneri 2a str. 301
aaacuuuucccuacugcugacau

SEQ ID NO: 2006953 - RNA, 16 nt, Shigella flexneri 2a str. 301
cuugucaugcagcucc

SEQ ID NO: 2006954 - RNA, 20 nt, Shigella flexneri 2a str. 301
cuugucaccguaaccaccag

SEQ ID NO: 2006955 - RNA, 22 nt, Shigella flexneri 2a str. 301
cuugucaaacgggcuucuaauc

SEQ ID NO: 2006956 - RNA, 13 nt, Shigella flexneri 2a str. 301
cuuguaggaauca

SEQ ID NO: 2006957 - RNA, 17 nt, Shigella flexneri 2a str. 301
cuuguauaucaaaccac

SEQ ID NO: 2006958 - RNA, 22 nt, Shigella flexneri 2a str. 301
cuuguacccuuaacucuuccug

SEQ ID NO: 2006959 - RNA, 19 nt, Shigella flexneri 2a str. 301
cuuguaacgcaucaaucaa

SEQ ID NO: 2006960 - RNA, 18 nt, Shigella flexneri 2a str. 301
cuuguaaauuucccacuc

SEQ ID NO: 2006961 - RNA, 18 nt, Shigella flexneri 2a str. 301
cuuguaacagaguaucca

SEQ ID NO: 2006962 - RNA, 19 nt, Shigella flexneri 2a str. 301
cuuguaacagaguauccaa

SEQ ID NO: 2006963 - RNA, 16 nt, Shigella flexneri 2a str. 301
cuugguaaugacucca

SEQ ID NO: 2006964 - RNA, 17 nt, Shigella flexneri 2a str. 301
cuuuggguugccgccaa

SEQ ID NO: 2006965 - RNA, 18 nt, Shigella flexneri 2a str. 301
cuuuggcaaacuacaaau

SEQ ID NO: 2006966 - RNA, 14 nt, Shigella flexneri 2a str. 301
cuuuggcaaacuac

SEQ ID NO: 2006967 - RNA, 13 nt, Shigella flexneri 2a str. 301
cuuuggcaucaau

SEQ ID NO: 2006968 - RNA, 22 nt, Shigella flexneri 2a str. 301
cuuuuaauaauucaaaaaccug

SEQ ID NO: 2006969 - RNA, 16 nt, Shigella flexneri 2a str. 301
cuuuuaaugcuuuaaa

SEQ ID NO: 2006970 - RNA, 21 nt, Shigella flexneri 2a str. 301
cuuugccacgguauuugccaa

SEQ ID NO: 2006971 - RNA, 17 nt, Shigella flexneri 2a str. 301
cuuugccaaaaugcugg

SEQ ID NO: 2006972 - RNA, 15 nt, Shigella flexneri 2a str. 301
cuuugccgucagcca

SEQ ID NO: 2006973 - RNA, 23 nt, Shigella flexneri 2a str. 301
cuuugcgaacgcguucacugccg

SEQ ID NO: 2006974 - RNA, 14 nt, Shigella flexneri 2a str. 301
cuuugccuccccaa

SEQ ID NO: 2006975 - RNA, 11 nt, Shigella flexneri 2a str. 301
cuuugccuggc

SEQ ID NO: 2006976 - RNA, 16 nt, Shigella flexneri 2a str. 301
cuuugccuggcggcag

SEQ ID NO: 2006977 - RNA, 21 nt, Shigella flexneri 2a str. 301
cuuugcgagucugcuccagaa

SEQ ID NO: 2006978 - RNA, 14 nt, Shigella flexneri 2a str. 301
cuuugcuuccugag

SEQ ID NO: 2006979 - RNA, 16 nt, Shigella flexneri 2a str. 301
cuuugcuuccugagua

SEQ ID NO: 2006980 - RNA, 18 nt, Shigella flexneri 2a str. 301
cuuuccuuaacuccucgc

SEQ ID NO: 2006981 - RNA, 18 nt, Shigella flexneri 2a str. 301
cuuuccuggucggcaaac

SEQ ID NO: 2006982 - RNA, 20 nt, Shigella flexneri 2a str. 301
cuuucgaaaucauucgcagu

SEQ ID NO: 2006983 - RNA, 21 nt, Shigella flexneri 2a str. 301
cuuucgaaaucauucgcaguu

SEQ ID NO: 2006984 - RNA, 19 nt, Shigella flexneri 2a str. 301
cuuuccuccugucuucccu

SEQ ID NO: 2006985 - RNA, 20 nt, Shigella flexneri 2a str. 301
cuuuccaggcgugcuccuuc

SEQ ID NO: 2006986 - RNA, 18 nt, Shigella flexneri 2a str. 301
cuuuccagguggugcagg

SEQ ID NO: 2006987 - RNA, 16 nt, Shigella flexneri 2a str. 301
cuuucgcuuucucuuc

SEQ ID NO: 2006988 - RNA, 15 nt, Shigella flexneri 2a str. 301
cuuucgcuucaagua

SEQ ID NO: 2006989 - RNA, 14 nt, Shigella flexneri 2a str. 301
cuuucgcuucaagu

SEQ ID NO: 2006990 - RNA, 19 nt, Shigella flexneri 2a str. 301
cuuucgcggcaaccugauc

SEQ ID NO: 2006991 - RNA, 18 nt, Shigella flexneri 2a str. 301
cuuucgcccagcguugca

SEQ ID NO: 2006992 - RNA, 22 nt, Shigella flexneri 2a str. 301
cuuucgauuucggcgugcgcgc

SEQ ID NO: 2006993 - RNA, 20 nt, Shigella flexneri 2a str. 301
cuuucgacagcgauuccagu

SEQ ID NO: 2006994 - RNA, 23 nt, Shigella flexneri 2a str. 301
cuuucgacagcgauuccaguucg

SEQ ID NO: 2006995 - RNA, 18 nt, Shigella flexneri 2a str. 301
cuuucgagcaauuuuccu

SEQ ID NO: 2006996 - RNA, 12 nt, Shigella flexneri 2a str. 301
cuuugaauaucu

SEQ ID NO: 2006997 - RNA, 18 nt, Shigella flexneri 2a str. 301
cuuugaauaucuccucug

SEQ ID NO: 2006998 - RNA, 22 nt, Shigella flexneri 2a str. 301
cuuucuuaccccugauuuuguu

SEQ ID NO: 2006999 - RNA, 21 nt, Shigella flexneri 2a str. 301
cuuucuuaaacuucacuuccc

SEQ ID NO: 2007000 - RNA, 14 nt, Shigella flexneri 2a str. 301
cuuucuuaaauuaa

SEQ ID NO: 2007001 - RNA, 16 nt, Shigella flexneri 2a str. 301
cuuucuuaaauuaaga

SEQ ID NO: 2007002 - RNA, 14 nt, Shigella flexneri 2a str. 301
cuuucuucagccgu

SEQ ID NO: 2007003 - RNA, 16 nt, Shigella flexneri 2a str. 301
cuuucuggcacgaccu

SEQ ID NO: 2007004 - RNA, 18 nt, Shigella flexneri 2a str. 301
cuuucuggcaucacuucu

SEQ ID NO: 2007005 - RNA, 18 nt, Shigella flexneri 2a str. 301
cuuucugcauccguucuu

SEQ ID NO: 2007006 - RNA, 19 nt, Shigella flexneri 2a str. 301
aaagaagcggugaaaaaau

SEQ ID NO: 2007007 - RNA, 16 nt, Shigella flexneri 2a str. 301
aaagaaggcauaacuc

SEQ ID NO: 2007008 - RNA, 13 nt, Shigella flexneri 2a str. 301
aaagaaggaaaau

SEQ ID NO: 2007009 - RNA, 12 nt, Shigella flexneri 2a str. 301
aaagaauugcag

SEQ ID NO: 2007010 - RNA, 16 nt, Shigella flexneri 2a str. 301
cuuuaauuauccccuc

SEQ ID NO: 2007011 - RNA, 22 nt, Shigella flexneri 2a str. 301
cuuuaacugccgcacauuuccc

SEQ ID NO: 2007012 - RNA, 21 nt, Shigella flexneri 2a str. 301
cuuuaacgaaagcgccucaag

SEQ ID NO: 2007013 - RNA, 14 nt, Shigella flexneri 2a str. 301
cuuuacucaacucc

SEQ ID NO: 2007014 - RNA, 14 nt, Shigella flexneri 2a str. 301
cuuuacgcuuaucc

SEQ ID NO: 2007015 - RNA, 15 nt, Shigella flexneri 2a str. 301
cuuuacugacugucc

SEQ ID NO: 2007016 - RNA, 16 nt, Shigella flexneri 2a str. 301
cuuuaccaccgucaaa

SEQ ID NO: 2007017 - RNA, 18 nt, Shigella flexneri 2a str. 301
cuuuaauuuugugcagca

SEQ ID NO: 2007018 - RNA, 16 nt, Shigella flexneri 2a str. 301
cuuuaugugcuucuac

SEQ ID NO: 2007019 - RNA, 13 nt, Shigella flexneri 2a str. 301
cuuuaugcagcuc

SEQ ID NO: 2007020 - RNA, 18 nt, Shigella flexneri 2a str. 301
cuuuauagguggcaaaga

SEQ ID NO: 2007021 - RNA, 21 nt, Shigella flexneri 2a str. 301
cuuuauagggugccauuuuuu

SEQ ID NO: 2007022 - RNA, 23 nt, Shigella flexneri 2a str. 301
cuuuacuguuccgauaaguucag

SEQ ID NO: 2007023 - RNA, 16 nt, Shigella flexneri 2a str. 301
cuuucaacagucgcca

SEQ ID NO: 2007024 - RNA, 16 nt, Shigella flexneri 2a str. 301
cuuucacgcgcugacc

SEQ ID NO: 2007025 - RNA, 22 nt, Shigella flexneri 2a str. 301
cuuucacgcgcugaccuucuuc

SEQ ID NO: 2007026 - RNA, 15 nt, Shigella flexneri 2a str. 301
cuuucacgccgccaa

SEQ ID NO: 2007027 - RNA, 18 nt, Shigella flexneri 2a str. 301
cuuucacucaguguugga

SEQ ID NO: 2007028 - RNA, 12 nt, Shigella flexneri 2a str. 301
cuuucacugccc

SEQ ID NO: 2007029 - RNA, 20 nt, Shigella flexneri 2a str. 301
cuuucacgcccaguccgcuc

SEQ ID NO: 2007030 - RNA, 18 nt, Shigella flexneri 2a str. 301
cuuucacgaacacagugg

SEQ ID NO: 2007031 - RNA, 14 nt, Shigella flexneri 2a str. 301
cuuucaccucuuca

SEQ ID NO: 2007032 - RNA, 19 nt, Shigella flexneri 2a str. 301
cuuucaacguagccugcca

SEQ ID NO: 2007033 - RNA, 21 nt, Shigella flexneri 2a str. 301
cuuucacuucagcaacgugcu

SEQ ID NO: 2007034 - RNA, 23 nt, Shigella flexneri 2a str. 301
cuuucagaccgccaauagaagca

SEQ ID NO: 2007035 - RNA, 18 nt, Shigella flexneri 2a str. 301
cuuuccaacuguaccagc

SEQ ID NO: 2007036 - RNA, 20 nt, Shigella flexneri 2a str. 301
cuuuccaacuguaccagcaa

SEQ ID NO: 2007037 - RNA, 15 nt, Shigella flexneri 2a str. 301
cuuuccagcgucagu

SEQ ID NO: 2007038 - RNA, 17 nt, Shigella flexneri 2a str. 301
gaaaauaugcccauguu

SEQ ID NO: 2007039 - RNA, 17 nt, Shigella flexneri 2a str. 301
gaaaauaaaauguacau

SEQ ID NO: 2007040 - RNA, 16 nt, Shigella flexneri 2a str. 301
gaaaauaaaaaacauu

SEQ ID NO: 2007041 - RNA, 21 nt, Shigella flexneri 2a str. 301
gaaaagguucgggagcaggcc

SEQ ID NO: 2007042 - RNA, 22 nt, Shigella flexneri 2a str. 301
gaaaagcugcaaggugaaagca

SEQ ID NO: 2007043 - RNA, 14 nt, Shigella flexneri 2a str. 301
gaaaagccaaugaa

SEQ ID NO: 2007044 - RNA, 17 nt, Shigella flexneri 2a str. 301
gaaaagccaaugaaauu

SEQ ID NO: 2007045 - RNA, 13 nt, Shigella flexneri 2a str. 301
gaaaaauagcauu

SEQ ID NO: 2007046 - RNA, 17 nt, Shigella flexneri 2a str. 301
gaaaaaucaaaaaacug

SEQ ID NO: 2007047 - RNA, 23 nt, Shigella flexneri 2a str. 301
gaaaaaugaauaccaagucucaa

SEQ ID NO: 2007048 - RNA, 15 nt, Shigella flexneri 2a str. 301
gaaacaggggcugga

SEQ ID NO: 2007049 - RNA, 19 nt, Shigella flexneri 2a str. 301
gaaacaggggcuggaagau

SEQ ID NO: 2007050 - RNA, 23 nt, Shigella flexneri 2a str. 301
gaaacaaaucacuauuaaagaaa

SEQ ID NO: 2007051 - RNA, 19 nt, Shigella flexneri 2a str. 301
gaaacccgcugccaucgca

SEQ ID NO: 2007052 - RNA, 16 nt, Shigella flexneri 2a str. 301
gaaaccuuuaugcagc

SEQ ID NO: 2007053 - RNA, 20 nt, Shigella flexneri 2a str. 301
gaaaccuugcauagcuucga

SEQ ID NO: 2007054 - RNA, 13 nt, Shigella flexneri 2a str. 301
gaaaccgaaguug

SEQ ID NO: 2007055 - RNA, 14 nt, Shigella flexneri 2a str. 301
gaaaccgaaguugu

SEQ ID NO: 2007056 - RNA, 13 nt, Shigella flexneri 2a str. 301
cuuuuucaugcua

SEQ ID NO: 2007057 - RNA, 20 nt, Shigella flexneri 2a str. 301
cuuuuuccacuuccaccagc

SEQ ID NO: 2007058 - RNA, 20 nt, Shigella flexneri 2a str. 301
cuuuuucccugguaaaaaau

SEQ ID NO: 2007059 - RNA, 20 nt, Shigella flexneri 2a str. 301
cuuuuuccaguccacguuca

SEQ ID NO: 2007060 - RNA, 17 nt, Shigella flexneri 2a str. 301
cuuuuugcauuuccgcu

SEQ ID NO: 2007061 - RNA, 12 nt, Shigella flexneri 2a str. 301
cuuuuugcucuc

SEQ ID NO: 2007062 - RNA, 15 nt, Shigella flexneri 2a str. 301
cuuuuugguucaucg

SEQ ID NO: 2007063 - RNA, 16 nt, Shigella flexneri 2a str. 301
cuuuuuuccugccgcu

SEQ ID NO: 2007064 - RNA, 20 nt, Shigella flexneri 2a str. 301
cuuuuuuccagcacacccau

SEQ ID NO: 2007065 - RNA, 14 nt, Shigella flexneri 2a str. 301
gaaaaaaucccacu

SEQ ID NO: 2007066 - RNA, 14 nt, Shigella flexneri 2a str. 301
gaaaaaaugaugau

SEQ ID NO: 2007067 - RNA, 21 nt, Shigella flexneri 2a str. 301
cuuuuuugguuauccagcaac

SEQ ID NO: 2007068 - RNA, 13 nt, Shigella flexneri 2a str. 301
cuuuuuuccgcuu

SEQ ID NO: 2007069 - RNA, 18 nt, Shigella flexneri 2a str. 301
cuuuuuugguaaugacuc

SEQ ID NO: 2007070 - RNA, 18 nt, Shigella flexneri 2a str. 301
gaaaaacacaaaguaaac

SEQ ID NO: 2007071 - RNA, 20 nt, Shigella flexneri 2a str. 301
gaaaaaaugaccggccagca

SEQ ID NO: 2007072 - RNA, 19 nt, Shigella flexneri 2a str. 301
gaaaaaccguguuuaugaa

SEQ ID NO: 2007073 - RNA, 18 nt, Shigella flexneri 2a str. 301
gaaaaaccaaucucccag

SEQ ID NO: 2007074 - RNA, 16 nt, Shigella flexneri 2a str. 301
gaaaaacccaucaacu

SEQ ID NO: 2007075 - RNA, 20 nt, Shigella flexneri 2a str. 301
gaaaaacuggcgcagcuuga

SEQ ID NO: 2007076 - RNA, 22 nt, Shigella flexneri 2a str. 301
cuuuuggcgcguuccccuguug

SEQ ID NO: 2007077 - RNA, 20 nt, Shigella flexneri 2a str. 301
cuuuugucacuuuuggugcu

SEQ ID NO: 2007078 - RNA, 18 nt, Shigella flexneri 2a str. 301
cuuuuuaccaacauacug

SEQ ID NO: 2007079 - RNA, 20 nt, Shigella flexneri 2a str. 301
cuuuuuacccauggucaucu

SEQ ID NO: 2007080 - RNA, 18 nt, Shigella flexneri 2a str. 301
cuuuuuaugucauuaacc

SEQ ID NO: 2007081 - RNA, 19 nt, Shigella flexneri 2a str. 301
cuuuuucaauuccauuucc

SEQ ID NO: 2007082 - RNA, 21 nt, Shigella flexneri 2a str. 301
cuuuuucaauuccauuucccu

SEQ ID NO: 2007083 - RNA, 19 nt, Shigella flexneri 2a str. 301
cuuuuuacuagccugcucc

SEQ ID NO: 2007084 - RNA, 16 nt, Shigella flexneri 2a str. 301
cuuuugacuuugccga

SEQ ID NO: 2007085 - RNA, 14 nt, Shigella flexneri 2a str. 301
cuuuugauacuucc

SEQ ID NO: 2007086 - RNA, 14 nt, Shigella flexneri 2a str. 301
cuuuuggcaggaac

SEQ ID NO: 2007087 - RNA, 14 nt, Shigella flexneri 2a str. 301
cuuuugcuuuuaac

SEQ ID NO: 2007088 - RNA, 15 nt, Shigella flexneri 2a str. 301
cuuuuacaagcaacu

SEQ ID NO: 2007089 - RNA, 16 nt, Shigella flexneri 2a str. 301
cuuuuagcaucuuauc

SEQ ID NO: 2007090 - RNA, 17 nt, Shigella flexneri 2a str. 301
gaaaucugaucguguaa

SEQ ID NO: 2007091 - RNA, 19 nt, Shigella flexneri 2a str. 301
gaaaucugacucuuguaac

SEQ ID NO: 2007092 - RNA, 21 nt, Shigella flexneri 2a str. 301
gaaaucuacgguggaacauuu

SEQ ID NO: 2007093 - RNA, 15 nt, Shigella flexneri 2a str. 301
gaaaugguaaagaag

SEQ ID NO: 2007094 - RNA, 21 nt, Shigella flexneri 2a str. 301
gaaauggugugcaugguguuc

SEQ ID NO: 2007095 - RNA, 13 nt, Shigella flexneri 2a str. 301
gaaauggcccggu

SEQ ID NO: 2007096 - RNA, 21 nt, Shigella flexneri 2a str. 301
gaaauggcguuagucaugaaa

SEQ ID NO: 2007097 - RNA, 23 nt, Shigella flexneri 2a str. 301
gaaauggcguuagucaugaaaua

SEQ ID NO: 2007098 - RNA, 15 nt, Shigella flexneri 2a str. 301
gaaauugugauggag

SEQ ID NO: 2007099 - RNA, 21 nt, Shigella flexneri 2a str. 301
gaaauuguaaacgaguuaagc

SEQ ID NO: 2007100 - RNA, 16 nt, Shigella flexneri 2a str. 301
gaaauuucuuccucgu

SEQ ID NO: 2007101 - RNA, 15 nt, Shigella flexneri 2a str. 301
gaaauuuccugagca

SEQ ID NO: 2007102 - RNA, 22 nt, Shigella flexneri 2a str. 301
gaaauuaccgcaccaccagcag

SEQ ID NO: 2007103 - RNA, 20 nt, Shigella flexneri 2a str. 301
aaagagccgguuuguaggcc

SEQ ID NO: 2007104 - RNA, 14 nt, Shigella flexneri 2a str. 301
gaacaccaccugcc

SEQ ID NO: 2007105 - RNA, 17 nt, Shigella flexneri 2a str. 301
gaacaacagaucaacau

SEQ ID NO: 2007106 - RNA, 12 nt, Shigella flexneri 2a str. 301
gaacaaccagaa

SEQ ID NO: 2007107 - RNA, 15 nt, Shigella flexneri 2a str. 301
gaacaacaagaagcg

SEQ ID NO: 2007108 - RNA, 23 nt, Shigella flexneri 2a str. 301
gaacaacccuaaagcacccagca

SEQ ID NO: 2007109 - RNA, 23 nt, Shigella flexneri 2a str. 301
gaacacccgacgugcagcaucga

SEQ ID NO: 2007110 - RNA, 22 nt, Shigella flexneri 2a str. 301
gaacacccgacgugcagcaucg

SEQ ID NO: 2007111 - RNA, 13 nt, Shigella flexneri 2a str. 301
gaacaccauaaug

SEQ ID NO: 2007112 - RNA, 18 nt, Shigella flexneri 2a str. 301
gaacagaauguuugccau

SEQ ID NO: 2007113 - RNA, 19 nt, Shigella flexneri 2a str. 301
gaacagaggcagcuugauu

SEQ ID NO: 2007114 - RNA, 17 nt, Shigella flexneri 2a str. 301
gaacacuucuucugucg

SEQ ID NO: 2007115 - RNA, 22 nt, Shigella flexneri 2a str. 301
gaacacuucuucugucgggcau

SEQ ID NO: 2007116 - RNA, 16 nt, Shigella flexneri 2a str. 301
gaacauccuuuccuua

SEQ ID NO: 2007117 - RNA, 14 nt, Shigella flexneri 2a str. 301
gaacaguucaacgc

SEQ ID NO: 2007118 - RNA, 14 nt, Shigella flexneri 2a str. 301
gaacagugccaugc

SEQ ID NO: 2007119 - RNA, 15 nt, Shigella flexneri 2a str. 301
gaacaguaaagcgca

SEQ ID NO: 2007120 - RNA, 20 nt, Shigella flexneri 2a str. 301
gaacagccugugccugagcc

SEQ ID NO: 2007121 - RNA, 17 nt, Shigella flexneri 2a str. 301
gaacagccggaugucug

SEQ ID NO: 2007122 - RNA, 16 nt, Shigella flexneri 2a str. 301
gaaagcgaucuuucug

SEQ ID NO: 2007123 - RNA, 18 nt, Shigella flexneri 2a str. 301
gaaagcgagcaguacagc

SEQ ID NO: 2007124 - RNA, 17 nt, Shigella flexneri 2a str. 301
gaaagcccuugccgaug

SEQ ID NO: 2007125 - RNA, 14 nt, Shigella flexneri 2a str. 301
gaaagccgacugca

SEQ ID NO: 2007126 - RNA, 15 nt, Shigella flexneri 2a str. 301
gaaagccccaccagc

SEQ ID NO: 2007127 - RNA, 16 nt, Shigella flexneri 2a str. 301
gaaagccccaccagca

SEQ ID NO: 2007128 - RNA, 16 nt, Shigella flexneri 2a str. 301
gaaagaggcgcagaug

SEQ ID NO: 2007129 - RNA, 14 nt, Shigella flexneri 2a str. 301
gaaagaggcggaua

SEQ ID NO: 2007130 - RNA, 16 nt, Shigella flexneri 2a str. 301
gaaagagcgucuggaa

SEQ ID NO: 2007131 - RNA, 17 nt, Shigella flexneri 2a str. 301
gaaagagcgucuggaag

SEQ ID NO: 2007132 - RNA, 22 nt, Shigella flexneri 2a str. 301
gaaagacgguuaaugcguuuug

SEQ ID NO: 2007133 - RNA, 24 nt, Shigella flexneri 2a str. 301
gaaagaaaaucaauccaguguaaa

SEQ ID NO: 2007134 - RNA, 19 nt, Shigella flexneri 2a str. 301
gaaacgggcugauuucacc

SEQ ID NO: 2007135 - RNA, 18 nt, Shigella flexneri 2a str. 301
gaaacgcucauaaauugc

SEQ ID NO: 2007136 - RNA, 21 nt, Shigella flexneri 2a str. 301
gaaacgcucauaaauugcagc

SEQ ID NO: 2007137 - RNA, 15 nt, Shigella flexneri 2a str. 301
gaaacgucaaauaau

SEQ ID NO: 2007138 - RNA, 24 nt, Shigella flexneri 2a str. 301
gaaacgaaccauaaaaucacaggu

SEQ ID NO: 2007139 - RNA, 15 nt, Shigella flexneri 2a str. 301
gaaacgccaucugaa

SEQ ID NO: 2007140 - RNA, 19 nt, Shigella flexneri 2a str. 301
gaaacgcgaucgccaaaua

SEQ ID NO: 2007141 - RNA, 22 nt, Shigella flexneri 2a str. 301
gaaaucagagauuugcuccagc

SEQ ID NO: 2007142 - RNA, 21 nt, Shigella flexneri 2a str. 301
gaaauauggcucugcggcgga

SEQ ID NO: 2007143 - RNA, 20 nt, Shigella flexneri 2a str. 301
gaaauaucggcgucguugua

SEQ ID NO: 2007144 - RNA, 18 nt, Shigella flexneri 2a str. 301
gaaaucagcuuuggugaa

SEQ ID NO: 2007145 - RNA, 20 nt, Shigella flexneri 2a str. 301
gaaaucagcagcuuugcccg

SEQ ID NO: 2007146 - RNA, 20 nt, Shigella flexneri 2a str. 301
gaaaucaucaauaccagccc

SEQ ID NO: 2007147 - RNA, 16 nt, Shigella flexneri 2a str. 301
gaaauccaggucagca

SEQ ID NO: 2007148 - RNA, 19 nt, Shigella flexneri 2a str. 301
gaaauccauugauuuaucg

SEQ ID NO: 2007149 - RNA, 12 nt, Shigella flexneri 2a str. 301
gaaauauauccu

SEQ ID NO: 2007150 - RNA, 14 nt, Shigella flexneri 2a str. 301
gaaauauauucccc

SEQ ID NO: 2007151 - RNA, 23 nt, Shigella flexneri 2a str. 301
gaaauaguugcauuccaguccac

SEQ ID NO: 2007152 - RNA, 20 nt, Shigella flexneri 2a str. 301
gaaauaaaaaaaguauuuuu

SEQ ID NO: 2007153 - RNA, 20 nt, Shigella flexneri 2a str. 301
gaaaggcguuguccuuacca

SEQ ID NO: 2007154 - RNA, 16 nt, Shigella flexneri 2a str. 301
gaaaggcaagcacggc

SEQ ID NO: 2007155 - RNA, 12 nt, Shigella flexneri 2a str. 301
gaaagggaagaa

SEQ ID NO: 2007156 - RNA, 22 nt, Shigella flexneri 2a str. 301
gaaaggaaaaaauacagucacu

SEQ ID NO: 2007157 - RNA, 20 nt, Shigella flexneri 2a str. 301
gaaaguggaaaaauaacaaa

SEQ ID NO: 2007158 - RNA, 18 nt, Shigella flexneri 2a str. 301
gaaaguggaaacacgcuc

SEQ ID NO: 2007159 - RNA, 22 nt, Shigella flexneri 2a str. 301
gaaagugccggauguuugcauc

SEQ ID NO: 2007160 - RNA, 21 nt, Shigella flexneri 2a str. 301
gaaagugauggugguggggga

SEQ ID NO: 2007161 - RNA, 15 nt, Shigella flexneri 2a str. 301
gaaagugaguuuugc

SEQ ID NO: 2007162 - RNA, 15 nt, Shigella flexneri 2a str. 301
gaaagucauggcaaa

SEQ ID NO: 2007163 - RNA, 15 nt, Shigella flexneri 2a str. 301
gaaaguuguuuuuug

SEQ ID NO: 2007164 - RNA, 14 nt, Shigella flexneri 2a str. 301
gaagagacaaaaaa

SEQ ID NO: 2007165 - RNA, 16 nt, Shigella flexneri 2a str. 301
gaagagacaaaaaagg

SEQ ID NO: 2007166 - RNA, 23 nt, Shigella flexneri 2a str. 301
gaagaucagaaauuuccugagca

SEQ ID NO: 2007167 - RNA, 13 nt, Shigella flexneri 2a str. 301
gaagaaguaaaac

SEQ ID NO: 2007168 - RNA, 22 nt, Shigella flexneri 2a str. 301
gaagacaaccaaaaucaggccg

SEQ ID NO: 2007169 - RNA, 18 nt, Shigella flexneri 2a str. 301
gaacaucgccugccgcag

SEQ ID NO: 2007170 - RNA, 12 nt, Shigella flexneri 2a str. 301
gaacaucgccau

SEQ ID NO: 2007171 - RNA, 16 nt, Shigella flexneri 2a str. 301
gaacaucucuucccau

SEQ ID NO: 2007172 - RNA, 13 nt, Shigella flexneri 2a str. 301
gaagccugcgaug

SEQ ID NO: 2007173 - RNA, 15 nt, Shigella flexneri 2a str. 301
gaagccucuacccgu

SEQ ID NO: 2007174 - RNA, 21 nt, Shigella flexneri 2a str. 301
gaagccuuccgcaaacaggcg

SEQ ID NO: 2007175 - RNA, 15 nt, Shigella flexneri 2a str. 301
gaagcgaugguggug

SEQ ID NO: 2007176 - RNA, 19 nt, Shigella flexneri 2a str. 301
gaagccaccgcgccacgac

SEQ ID NO: 2007177 - RNA, 18 nt, Shigella flexneri 2a str. 301
gaagccaccgcgccacga

SEQ ID NO: 2007178 - RNA, 16 nt, Shigella flexneri 2a str. 301
gaagcccucaaacaac

SEQ ID NO: 2007179 - RNA, 19 nt, Shigella flexneri 2a str. 301
gaagcaguuucaccagcag

SEQ ID NO: 2007180 - RNA, 23 nt, Shigella flexneri 2a str. 301
gaagcaguuuugccuuccccgag

SEQ ID NO: 2007181 - RNA, 20 nt, Shigella flexneri 2a str. 301
gaagcaguuucaccagcagu

SEQ ID NO: 2007182 - RNA, 15 nt, Shigella flexneri 2a str. 301
gaagauuugcagauc

SEQ ID NO: 2007183 - RNA, 14 nt, Shigella flexneri 2a str. 301
gaagauuuugcugu

SEQ ID NO: 2007184 - RNA, 16 nt, Shigella flexneri 2a str. 301
gaagcagcuugcuguu

SEQ ID NO: 2007185 - RNA, 16 nt, Shigella flexneri 2a str. 301
gaagcaaaauaaccgg

SEQ ID NO: 2007186 - RNA, 18 nt, Shigella flexneri 2a str. 301
gaagcuggucagcaucgu

SEQ ID NO: 2007187 - RNA, 22 nt, Shigella flexneri 2a str. 301
gaagcuggauuaacgcugggga

SEQ ID NO: 2007188 - RNA, 12 nt, Shigella flexneri 2a str. 301
gaagcucuuucg

SEQ ID NO: 2007189 - RNA, 16 nt, Shigella flexneri 2a str. 301
gaagcugcaaguauuc

SEQ ID NO: 2007190 - RNA, 14 nt, Shigella flexneri 2a str. 301
gaaggucagguuug

SEQ ID NO: 2007191 - RNA, 20 nt, Shigella flexneri 2a str. 301
gaagggauugugcaggcgcu

SEQ ID NO: 2007192 - RNA, 11 nt, Shigella flexneri 2a str. 301
gaaggcugccg

SEQ ID NO: 2007193 - RNA, 23 nt, Shigella flexneri 2a str. 301
gaagugauccgccgcgcgguggg

SEQ ID NO: 2007194 - RNA, 23 nt, Shigella flexneri 2a str. 301
gaagguugcgccuugucuuuauu

SEQ ID NO: 2007195 - RNA, 18 nt, Shigella flexneri 2a str. 301
gaaguauuggugaguccu

SEQ ID NO: 2007196 - RNA, 18 nt, Shigella flexneri 2a str. 301
gaaguaucguuaauuccu

SEQ ID NO: 2007197 - RNA, 19 nt, Shigella flexneri 2a str. 301
gaaguaucguuaauuccuc

SEQ ID NO: 2007198 - RNA, 14 nt, Shigella flexneri 2a str. 301
gaaguaguugcugu

SEQ ID NO: 2007199 - RNA, 20 nt, Shigella flexneri 2a str. 301
gaaggugccucccguuuugc

SEQ ID NO: 2007200 - RNA, 18 nt, Shigella flexneri 2a str. 301
gaauacagaacagugcca

SEQ ID NO: 2007201 - RNA, 12 nt, Shigella flexneri 2a str. 301
gaauacagaaca

SEQ ID NO: 2007202 - RNA, 17 nt, Shigella flexneri 2a str. 301
gaauaauuucauuuacu

SEQ ID NO: 2007203 - RNA, 13 nt, Shigella flexneri 2a str. 301
gaauaaccagcga

SEQ ID NO: 2007204 - RNA, 21 nt, Shigella flexneri 2a str. 301
gaauaaccucuuucuuugcau

SEQ ID NO: 2007205 - RNA, 15 nt, Shigella flexneri 2a str. 301
aaagauagaacaucu

SEQ ID NO: 2007206 - RNA, 11 nt, Shigella flexneri 2a str. 301
gaaguugcguc

SEQ ID NO: 2007207 - RNA, 16 nt, Shigella flexneri 2a str. 301
gaaguugcucaagcug

SEQ ID NO: 2007208 - RNA, 16 nt, Shigella flexneri 2a str. 301
gaaguuguagcuggcu

SEQ ID NO: 2007209 - RNA, 18 nt, Shigella flexneri 2a str. 301
gaaguuguccaugugcug

SEQ ID NO: 2007210 - RNA, 22 nt, Shigella flexneri 2a str. 301
gaaguuuaaccgccuaauuaca

SEQ ID NO: 2007211 - RNA, 14 nt, Shigella flexneri 2a str. 301
gaaugcaggcgcgc

SEQ ID NO: 2007212 - RNA, 20 nt, Shigella flexneri 2a str. 301
gaaugcucaguaggcugacg

SEQ ID NO: 2007213 - RNA, 18 nt, Shigella flexneri 2a str. 301
gaaugccacgcaaacuuc

SEQ ID NO: 2007214 - RNA, 16 nt, Shigella flexneri 2a str. 301
gaaugccaauuucccg

SEQ ID NO: 2007215 - RNA, 17 nt, Shigella flexneri 2a str. 301
gaaugccaaauccggca

SEQ ID NO: 2007216 - RNA, 14 nt, Shigella flexneri 2a str. 301
gaaucuaagauccc

SEQ ID NO: 2007217 - RNA, 15 nt, Shigella flexneri 2a str. 301
gaaucugcguaaaua

SEQ ID NO: 2007218 - RNA, 21 nt, Shigella flexneri 2a str. 301
gaaucucugcgcuauccagcg

SEQ ID NO: 2007219 - RNA, 13 nt, Shigella flexneri 2a str. 301
gaaucucuucuuc

SEQ ID NO: 2007220 - RNA, 15 nt, Shigella flexneri 2a str. 301
gaaucugaaggaugu

SEQ ID NO: 2007221 - RNA, 15 nt, Shigella flexneri 2a str. 301
gaaucgcuucauuua

SEQ ID NO: 2007222 - RNA, 14 nt, Shigella flexneri 2a str. 301
gaaucgggaccagc

SEQ ID NO: 2007223 - RNA, 21 nt, Shigella flexneri 2a str. 301
gaaucgguccaccacguacca

SEQ ID NO: 2007224 - RNA, 18 nt, Shigella flexneri 2a str. 301
gaauccgcaccaacucca

SEQ ID NO: 2007225 - RNA, 17 nt, Shigella flexneri 2a str. 301
gaauccgcaccaacucc

SEQ ID NO: 2007226 - RNA, 17 nt, Shigella flexneri 2a str. 301
gaaucagauucaaauua

SEQ ID NO: 2007227 - RNA, 20 nt, Shigella flexneri 2a str. 301
gaauaucgcuggccuccagu

SEQ ID NO: 2007228 - RNA, 20 nt, Shigella flexneri 2a str. 301
gaauaucaagaucaucaaac

SEQ ID NO: 2007229 - RNA, 21 nt, Shigella flexneri 2a str. 301
gaauaucaagaucaucaaacu

SEQ ID NO: 2007230 - RNA, 20 nt, Shigella flexneri 2a str. 301
gaauaucguucaagagacug

SEQ ID NO: 2007231 - RNA, 23 nt, Shigella flexneri 2a str. 301
gaauaucugcuccguaaaacuca

SEQ ID NO: 2007232 - RNA, 21 nt, Shigella flexneri 2a str. 301
gaauaucuucaaccgucacca

SEQ ID NO: 2007233 - RNA, 17 nt, Shigella flexneri 2a str. 301
gaaucacucaucaugca

SEQ ID NO: 2007234 - RNA, 21 nt, Shigella flexneri 2a str. 301
gaaucacuccauccccagcuc

SEQ ID NO: 2007235 - RNA, 18 nt, Shigella flexneri 2a str. 301
gaaucacgccaacaaaca

SEQ ID NO: 2007236 - RNA, 23 nt, Shigella flexneri 2a str. 301
gaaucacgccgcccauaaauucc

SEQ ID NO: 2007237 - RNA, 14 nt, Shigella flexneri 2a str. 301
gaaucaccucuuuu

SEQ ID NO: 2007238 - RNA, 20 nt, Shigella flexneri 2a str. 301
gaaucaccgccacgcccucc

SEQ ID NO: 2007239 - RNA, 19 nt, Shigella flexneri 2a str. 301
gaauauucugaagcaaacu

SEQ ID NO: 2007240 - RNA, 19 nt, Shigella flexneri 2a str. 301
gaauaugacagcgccgacu

SEQ ID NO: 2007241 - RNA, 22 nt, Shigella flexneri 2a str. 301
gaauauaucagccugaaugcuu

SEQ ID NO: 2007242 - RNA, 14 nt, Shigella flexneri 2a str. 301
gaauauaucagccu

SEQ ID NO: 2007243 - RNA, 14 nt, Shigella flexneri 2a str. 301
gaauauacgccaga

SEQ ID NO: 2007244 - RNA, 23 nt, Shigella flexneri 2a str. 301
aaagauggauugcugaaauacag

SEQ ID NO: 2007245 - RNA, 14 nt, Shigella flexneri 2a str. 301
gaauaguuucagcc

SEQ ID NO: 2007246 - RNA, 15 nt, Shigella flexneri 2a str. 301
gaauaguuucagccu

SEQ ID NO: 2007247 - RNA, 23 nt, Shigella flexneri 2a str. 301
gaauaguuucagccucugccgcg

SEQ ID NO: 2007248 - RNA, 22 nt, Shigella flexneri 2a str. 301
gaauaguuuccgcuucugcuuu

SEQ ID NO: 2007249 - RNA, 22 nt, Shigella flexneri 2a str. 301
aaagaucugcgugaguuuuugu

SEQ ID NO: 2007250 - RNA, 21 nt, Shigella flexneri 2a str. 301
gaauuuuccuucggauuuccg

SEQ ID NO: 2007251 - RNA, 12 nt, Shigella flexneri 2a str. 301
gacaaagcauga

SEQ ID NO: 2007252 - RNA, 15 nt, Shigella flexneri 2a str. 301
gacaaaguacaacgc

SEQ ID NO: 2007253 - RNA, 13 nt, Shigella flexneri 2a str. 301
gacaacaacauca

SEQ ID NO: 2007254 - RNA, 20 nt, Shigella flexneri 2a str. 301
gacaacaacaucacaccugc

SEQ ID NO: 2007255 - RNA, 23 nt, Shigella flexneri 2a str. 301
gacaacaaacgcaaacaccagcg

SEQ ID NO: 2007256 - RNA, 10 nt, Shigella flexneri 2a str. 301
gacaaaucau

SEQ ID NO: 2007257 - RNA, 17 nt, Shigella flexneri 2a str. 301
gacaaauuccgaacaaa

SEQ ID NO: 2007258 - RNA, 18 nt, Shigella flexneri 2a str. 301
gacaacaaaacgggggcu

SEQ ID NO: 2007259 - RNA, 15 nt, Shigella flexneri 2a str. 301
gacacaaucaaaucc

SEQ ID NO: 2007260 - RNA, 23 nt, Shigella flexneri 2a str. 301
gacaaucaccaggucaccagaca

SEQ ID NO: 2007261 - RNA, 15 nt, Shigella flexneri 2a str. 301
gacaaucacaucacu

SEQ ID NO: 2007262 - RNA, 17 nt, Shigella flexneri 2a str. 301
gacaaucaccaggucac

SEQ ID NO: 2007263 - RNA, 23 nt, Shigella flexneri 2a str. 301
gacaauaucggcaccagcgcaga

SEQ ID NO: 2007264 - RNA, 14 nt, Shigella flexneri 2a str. 301
gacaaucgccacuu

SEQ ID NO: 2007265 - RNA, 20 nt, Shigella flexneri 2a str. 301
gacaaucgccagugauugcu

SEQ ID NO: 2007266 - RNA, 21 nt, Shigella flexneri 2a str. 301
gacaagcuuacguuacccagc

SEQ ID NO: 2007267 - RNA, 18 nt, Shigella flexneri 2a str. 301
gacaacuucugauguugu

SEQ ID NO: 2007268 - RNA, 17 nt, Shigella flexneri 2a str. 301
gacaacuuucaucagca

SEQ ID NO: 2007269 - RNA, 19 nt, Shigella flexneri 2a str. 301
gacaacuuucaucagcaca

SEQ ID NO: 2007270 - RNA, 13 nt, Shigella flexneri 2a str. 301
gaauucagaaaaa

SEQ ID NO: 2007271 - RNA, 18 nt, Shigella flexneri 2a str. 301
gaauucaaauccuucaga

SEQ ID NO: 2007272 - RNA, 22 nt, Shigella flexneri 2a str. 301
gaauggucaaugguggcaaucu

SEQ ID NO: 2007273 - RNA, 14 nt, Shigella flexneri 2a str. 301
gaauggugaccugc

SEQ ID NO: 2007274 - RNA, 18 nt, Shigella flexneri 2a str. 301
gaauggcaucuacgcucu

SEQ ID NO: 2007275 - RNA, 20 nt, Shigella flexneri 2a str. 301
gaauggcaucuacgcucucu

SEQ ID NO: 2007276 - RNA, 13 nt, Shigella flexneri 2a str. 301
gaauggcaucuga

SEQ ID NO: 2007277 - RNA, 21 nt, Shigella flexneri 2a str. 301
gaauggacaccagcucaguga

SEQ ID NO: 2007278 - RNA, 15 nt, Shigella flexneri 2a str. 301
gaauggacuccaccg

SEQ ID NO: 2007279 - RNA, 15 nt, Shigella flexneri 2a str. 301
gaauggaaacagcac

SEQ ID NO: 2007280 - RNA, 18 nt, Shigella flexneri 2a str. 301
gaauggguucgauuucau

SEQ ID NO: 2007281 - RNA, 19 nt, Shigella flexneri 2a str. 301
gaauggcgguuuuuugcuc

SEQ ID NO: 2007282 - RNA, 18 nt, Shigella flexneri 2a str. 301
gaauuccggcagagaaag

SEQ ID NO: 2007283 - RNA, 22 nt, Shigella flexneri 2a str. 301
gaauuccggcagagaaagcaaa

SEQ ID NO: 2007284 - RNA, 19 nt, Shigella flexneri 2a str. 301
gaauuccggggcuuuugaa

SEQ ID NO: 2007285 - RNA, 20 nt, Shigella flexneri 2a str. 301
gaauuccguaagcgacuuug

SEQ ID NO: 2007286 - RNA, 15 nt, Shigella flexneri 2a str. 301
gaauucgacuuucuc

SEQ ID NO: 2007287 - RNA, 20 nt, Shigella flexneri 2a str. 301
gaauuuccuucgcuuccugu

SEQ ID NO: 2007288 - RNA, 14 nt, Shigella flexneri 2a str. 301
gaauuugaggaagc

SEQ ID NO: 2007289 - RNA, 16 nt, Shigella flexneri 2a str. 301
gaauuugcuccagaaa

SEQ ID NO: 2007290 - RNA, 13 nt, Shigella flexneri 2a str. 301
gaccaguaccacc

SEQ ID NO: 2007291 - RNA, 16 nt, Shigella flexneri 2a str. 301
gacccagccagacgcc

SEQ ID NO: 2007292 - RNA, 20 nt, Shigella flexneri 2a str. 301
gacccagcaccaguaccauu

SEQ ID NO: 2007293 - RNA, 16 nt, Shigella flexneri 2a str. 301
gacccugcucuuucag

SEQ ID NO: 2007294 - RNA, 19 nt, Shigella flexneri 2a str. 301
gacccguuuacggcuaaaa

SEQ ID NO: 2007295 - RNA, 15 nt, Shigella flexneri 2a str. 301
gacccggaauaaaug

SEQ ID NO: 2007296 - RNA, 16 nt, Shigella flexneri 2a str. 301
gaccaggccaucagca

SEQ ID NO: 2007297 - RNA, 17 nt, Shigella flexneri 2a str. 301
gaccagccgcuaccagc

SEQ ID NO: 2007298 - RNA, 23 nt, Shigella flexneri 2a str. 301
gaccagccgauuuuaaugcggca

SEQ ID NO: 2007299 - RNA, 16 nt, Shigella flexneri 2a str. 301
gaccagcagcauuuca

SEQ ID NO: 2007300 - RNA, 16 nt, Shigella flexneri 2a str. 301
gaccagcaacaaauaa

SEQ ID NO: 2007301 - RNA, 17 nt, Shigella flexneri 2a str. 301
gaccagcaacaaauaac

SEQ ID NO: 2007302 - RNA, 20 nt, Shigella flexneri 2a str. 301
gaccagaucggucagugcca

SEQ ID NO: 2007303 - RNA, 18 nt, Shigella flexneri 2a str. 301
gaccagcauuccagauac

SEQ ID NO: 2007304 - RNA, 16 nt, Shigella flexneri 2a str. 301
gaccagcaucccggca

SEQ ID NO: 2007305 - RNA, 18 nt, Shigella flexneri 2a str. 301
gaccacggccacagccag

SEQ ID NO: 2007306 - RNA, 14 nt, Shigella flexneri 2a str. 301
gaccacgggcuuau

SEQ ID NO: 2007307 - RNA, 16 nt, Shigella flexneri 2a str. 301
gaccagaaacgccacc

SEQ ID NO: 2007308 - RNA, 15 nt, Shigella flexneri 2a str. 301
gaccacuucaugccc

SEQ ID NO: 2007309 - RNA, 22 nt, Shigella flexneri 2a str. 301
gaccagaccggcaaucgcgcca

SEQ ID NO: 2007310 - RNA, 20 nt, Shigella flexneri 2a str. 301
gacauugcguuuaguuacac

SEQ ID NO: 2007311 - RNA, 22 nt, Shigella flexneri 2a str. 301
gacauugaguuuacgcagcaga

SEQ ID NO: 2007312 - RNA, 13 nt, Shigella flexneri 2a str. 301
gacauugaagaau

SEQ ID NO: 2007313 - RNA, 20 nt, Shigella flexneri 2a str. 301
gaccaaaugaaacaggggcu

SEQ ID NO: 2007314 - RNA, 23 nt, Shigella flexneri 2a str. 301
gaccaaaugaaacaggggcugga

SEQ ID NO: 2007315 - RNA, 14 nt, Shigella flexneri 2a str. 301
gacacuucaagaau

SEQ ID NO: 2007316 - RNA, 16 nt, Shigella flexneri 2a str. 301
gacacugcugauaauc

SEQ ID NO: 2007317 - RNA, 22 nt, Shigella flexneri 2a str. 301
gacacuguuagguccggauggc

SEQ ID NO: 2007318 - RNA, 22 nt, Shigella flexneri 2a str. 301
gacacugacgcgucuuaucugg

SEQ ID NO: 2007319 - RNA, 16 nt, Shigella flexneri 2a str. 301
gacagaaucaggccau

SEQ ID NO: 2007320 - RNA, 19 nt, Shigella flexneri 2a str. 301
gacagauuuugccagcaug

SEQ ID NO: 2007321 - RNA, 12 nt, Shigella flexneri 2a str. 301
gacagaauauaa

SEQ ID NO: 2007322 - RNA, 19 nt, Shigella flexneri 2a str. 301
gacagcgauuaccauuuca

SEQ ID NO: 2007323 - RNA, 15 nt, Shigella flexneri 2a str. 301
gacagcaggcucaga

SEQ ID NO: 2007324 - RNA, 15 nt, Shigella flexneri 2a str. 301
gacagccucaagcac

SEQ ID NO: 2007325 - RNA, 14 nt, Shigella flexneri 2a str. 301
gacacaggcagcaa

SEQ ID NO: 2007326 - RNA, 18 nt, Shigella flexneri 2a str. 301
gacacgccuccuggcuca

SEQ ID NO: 2007327 - RNA, 16 nt, Shigella flexneri 2a str. 301
gacacgcgcgcauggu

SEQ ID NO: 2007328 - RNA, 20 nt, Shigella flexneri 2a str. 301
gacacggcguauacaagaac

SEQ ID NO: 2007329 - RNA, 18 nt, Shigella flexneri 2a str. 301
gacacugaaugacgacgu

SEQ ID NO: 2007330 - RNA, 22 nt, Shigella flexneri 2a str. 301
gacacgggaaaccaacuccagc

SEQ ID NO: 2007331 - RNA, 21 nt, Shigella flexneri 2a str. 301
gacauaagcgcaugaucguuc

SEQ ID NO: 2007332 - RNA, 22 nt, Shigella flexneri 2a str. 301
gacaguugcugcgugaccgcca

SEQ ID NO: 2007333 - RNA, 17 nt, Shigella flexneri 2a str. 301
gacaguuucaccugcug

SEQ ID NO: 2007334 - RNA, 15 nt, Shigella flexneri 2a str. 301
gacaguuugccuuca

SEQ ID NO: 2007335 - RNA, 15 nt, Shigella flexneri 2a str. 301
gacauuaucuggauc

SEQ ID NO: 2007336 - RNA, 21 nt, Shigella flexneri 2a str. 301
gacauuauaaauucuggccac

SEQ ID NO: 2007337 - RNA, 19 nt, Shigella flexneri 2a str. 301
gacauucgcgcacggugca

SEQ ID NO: 2007338 - RNA, 18 nt, Shigella flexneri 2a str. 301
gacauuacggauuaaaua

SEQ ID NO: 2007339 - RNA, 22 nt, Shigella flexneri 2a str. 301
gacauuaaguguccgccaauuu

SEQ ID NO: 2007340 - RNA, 17 nt, Shigella flexneri 2a str. 301
gacaucugcaauuugug

SEQ ID NO: 2007341 - RNA, 16 nt, Shigella flexneri 2a str. 301
gacaucaagaaaugca

SEQ ID NO: 2007342 - RNA, 18 nt, Shigella flexneri 2a str. 301
gacaucaauaaacaauga

SEQ ID NO: 2007343 - RNA, 22 nt, Shigella flexneri 2a str. 301
gacaucaauaaacaaugagaua

SEQ ID NO: 2007344 - RNA, 15 nt, Shigella flexneri 2a str. 301
gacauaguagccagc

SEQ ID NO: 2007345 - RNA, 16 nt, Shigella flexneri 2a str. 301
gacauaguagccagcc

SEQ ID NO: 2007346 - RNA, 20 nt, Shigella flexneri 2a str. 301
gacguaaugauguaaaaaua

SEQ ID NO: 2007347 - RNA, 21 nt, Shigella flexneri 2a str. 301
gacgguuuaucucaucuucca

SEQ ID NO: 2007348 - RNA, 18 nt, Shigella flexneri 2a str. 301
gacgucucaaucaccacc

SEQ ID NO: 2007349 - RNA, 21 nt, Shigella flexneri 2a str. 301
gacgggcuaaucgucaucagc

SEQ ID NO: 2007350 - RNA, 17 nt, Shigella flexneri 2a str. 301
gacgggcugguagggcu

SEQ ID NO: 2007351 - RNA, 12 nt, Shigella flexneri 2a str. 301
gacgggcggcuu

SEQ ID NO: 2007352 - RNA, 19 nt, Shigella flexneri 2a str. 301
gacggaucuguuccgccag

SEQ ID NO: 2007353 - RNA, 19 nt, Shigella flexneri 2a str. 301
gacgcaaugccaguuccgc

SEQ ID NO: 2007354 - RNA, 22 nt, Shigella flexneri 2a str. 301
gacgcaaaacgcgcucacugca

SEQ ID NO: 2007355 - RNA, 22 nt, Shigella flexneri 2a str. 301
gacgauuguagaaaaucucaau

SEQ ID NO: 2007356 - RNA, 14 nt, Shigella flexneri 2a str. 301
gacgauugugcugg

SEQ ID NO: 2007357 - RNA, 16 nt, Shigella flexneri 2a str. 301
gacgcgccaacaaaug

SEQ ID NO: 2007358 - RNA, 14 nt, Shigella flexneri 2a str. 301
gacgcgccagcacc

SEQ ID NO: 2007359 - RNA, 22 nt, Shigella flexneri 2a str. 301
gacgcggcauuuuuacugcgcg

SEQ ID NO: 2007360 - RNA, 12 nt, Shigella flexneri 2a str. 301
gacgcgucagug

SEQ ID NO: 2007361 - RNA, 19 nt, Shigella flexneri 2a str. 301
gacgcgucuuaucuggccu

SEQ ID NO: 2007362 - RNA, 23 nt, Shigella flexneri 2a str. 301
gacgcgugccuaacaauucgcca

SEQ ID NO: 2007363 - RNA, 18 nt, Shigella flexneri 2a str. 301
gacgcgugcgccaaguuu

SEQ ID NO: 2007364 - RNA, 20 nt, Shigella flexneri 2a str. 301
gacgcuccaguguggccaga

SEQ ID NO: 2007365 - RNA, 16 nt, Shigella flexneri 2a str. 301
gacgcuggcagaaagu

SEQ ID NO: 2007366 - RNA, 15 nt, Shigella flexneri 2a str. 301
gacgcugcgccgacc

SEQ ID NO: 2007367 - RNA, 23 nt, Shigella flexneri 2a str. 301
gacgcucggcuguuucuggauga

SEQ ID NO: 2007368 - RNA, 14 nt, Shigella flexneri 2a str. 301
gacgaggcgcuggc

SEQ ID NO: 2007369 - RNA, 22 nt, Shigella flexneri 2a str. 301
gaccucuucugccuguccacca

SEQ ID NO: 2007370 - RNA, 18 nt, Shigella flexneri 2a str. 301
gaccuguugcccaugcuu

SEQ ID NO: 2007371 - RNA, 18 nt, Shigella flexneri 2a str. 301
gacgaauaccuucuuccu

SEQ ID NO: 2007372 - RNA, 15 nt, Shigella flexneri 2a str. 301
gacgacaggcaagca

SEQ ID NO: 2007373 - RNA, 17 nt, Shigella flexneri 2a str. 301
gaccuucuucagcaaua

SEQ ID NO: 2007374 - RNA, 15 nt, Shigella flexneri 2a str. 301
gaccuucugccagac

SEQ ID NO: 2007375 - RNA, 13 nt, Shigella flexneri 2a str. 301
gaccgucuuucau

SEQ ID NO: 2007376 - RNA, 22 nt, Shigella flexneri 2a str. 301
gaccgugcgggcgaaagcagaa

SEQ ID NO: 2007377 - RNA, 18 nt, Shigella flexneri 2a str. 301
gaccuaaacguuuaaaaa

SEQ ID NO: 2007378 - RNA, 15 nt, Shigella flexneri 2a str. 301
gaccucaaaggccga

SEQ ID NO: 2007379 - RNA, 18 nt, Shigella flexneri 2a str. 301
gaccucaagcucgccacc

SEQ ID NO: 2007380 - RNA, 14 nt, Shigella flexneri 2a str. 301
gaccucaacaaaau

SEQ ID NO: 2007381 - RNA, 14 nt, Shigella flexneri 2a str. 301
gaccuaccaucucc

SEQ ID NO: 2007382 - RNA, 18 nt, Shigella flexneri 2a str. 301
gaccuacgcgcccgcgca

SEQ ID NO: 2007383 - RNA, 18 nt, Shigella flexneri 2a str. 301
gaccuacugcuaucacaa

SEQ ID NO: 2007384 - RNA, 19 nt, Shigella flexneri 2a str. 301
gaccuacaaaaccugcacg

SEQ ID NO: 2007385 - RNA, 20 nt, Shigella flexneri 2a str. 301
gaccuacaaaaccugcacgu

SEQ ID NO: 2007386 - RNA, 14 nt, Shigella flexneri 2a str. 301
gaccuagcaaacua

SEQ ID NO: 2007387 - RNA, 19 nt, Shigella flexneri 2a str. 301
gaccgcacaccccggcggc

SEQ ID NO: 2007388 - RNA, 20 nt, Shigella flexneri 2a str. 301
gaccggcgucgcauccggca

SEQ ID NO: 2007389 - RNA, 18 nt, Shigella flexneri 2a str. 301
gaccgauggguucagaau

SEQ ID NO: 2007390 - RNA, 17 nt, Shigella flexneri 2a str. 301
gaccgauugauucccaa

SEQ ID NO: 2007391 - RNA, 15 nt, Shigella flexneri 2a str. 301
gaccgggcgcggcug

SEQ ID NO: 2007392 - RNA, 22 nt, Shigella flexneri 2a str. 301
gacuggaauaagccaaauccag

SEQ ID NO: 2007393 - RNA, 17 nt, Shigella flexneri 2a str. 301
gacuggaauaagccaaa

SEQ ID NO: 2007394 - RNA, 18 nt, Shigella flexneri 2a str. 301
gacuggaaaucaaaaaca

SEQ ID NO: 2007395 - RNA, 15 nt, Shigella flexneri 2a str. 301
gacuggcggugauug

SEQ ID NO: 2007396 - RNA, 19 nt, Shigella flexneri 2a str. 301
gacuggcaugcuguccagc

SEQ ID NO: 2007397 - RNA, 17 nt, Shigella flexneri 2a str. 301
gacugcucagcuccucu

SEQ ID NO: 2007398 - RNA, 21 nt, Shigella flexneri 2a str. 301
gacuggaaacucacgccagca

SEQ ID NO: 2007399 - RNA, 21 nt, Shigella flexneri 2a str. 301
gacugggucaguauggaucaa

SEQ ID NO: 2007400 - RNA, 16 nt, Shigella flexneri 2a str. 301
gacuguacagauccgc

SEQ ID NO: 2007401 - RNA, 16 nt, Shigella flexneri 2a str. 301
gacugucgcagccagc

SEQ ID NO: 2007402 - RNA, 17 nt, Shigella flexneri 2a str. 301
gacugaauacgcuggcg

SEQ ID NO: 2007403 - RNA, 19 nt, Shigella flexneri 2a str. 301
gacugaauacgcuggcgcg

SEQ ID NO: 2007404 - RNA, 18 nt, Shigella flexneri 2a str. 301
gacugaaaguacuucaca

SEQ ID NO: 2007405 - RNA, 12 nt, Shigella flexneri 2a str. 301
gacugaauacgc

SEQ ID NO: 2007406 - RNA, 15 nt, Shigella flexneri 2a str. 301
gacugaggccgccac

SEQ ID NO: 2007407 - RNA, 17 nt, Shigella flexneri 2a str. 301
gacugaugacaaacgca

SEQ ID NO: 2007408 - RNA, 15 nt, Shigella flexneri 2a str. 301
gacugaugcuuuccg

SEQ ID NO: 2007409 - RNA, 13 nt, Shigella flexneri 2a str. 301
gacugaugcuuuc

SEQ ID NO: 2007410 - RNA, 21 nt, Shigella flexneri 2a str. 301
gacugaugugauccaucaggu

SEQ ID NO: 2007411 - RNA, 14 nt, Shigella flexneri 2a str. 301
gacugcaaaaagca

SEQ ID NO: 2007412 - RNA, 19 nt, Shigella flexneri 2a str. 301
gacugauaucugcccgcac

SEQ ID NO: 2007413 - RNA, 17 nt, Shigella flexneri 2a str. 301
gacugaugacaaacaca

SEQ ID NO: 2007414 - RNA, 14 nt, Shigella flexneri 2a str. 301
gacugccgcucacc

SEQ ID NO: 2007415 - RNA, 20 nt, Shigella flexneri 2a str. 301
gacugcggcgugggcgcugu

SEQ ID NO: 2007416 - RNA, 15 nt, Shigella flexneri 2a str. 301
gacugcgccgugucg

SEQ ID NO: 2007417 - RNA, 22 nt, Shigella flexneri 2a str. 301
gacugcgagaaguucugcagcc

SEQ ID NO: 2007418 - RNA, 19 nt, Shigella flexneri 2a str. 301
gacuccaggcguuuugcag

SEQ ID NO: 2007419 - RNA, 15 nt, Shigella flexneri 2a str. 301
gacuccagcgccagc

SEQ ID NO: 2007420 - RNA, 17 nt, Shigella flexneri 2a str. 301
gacguuugcgcccagcc

SEQ ID NO: 2007421 - RNA, 19 nt, Shigella flexneri 2a str. 301
gacguugauaaccacggcg

SEQ ID NO: 2007422 - RNA, 13 nt, Shigella flexneri 2a str. 301
gacguucugccaa

SEQ ID NO: 2007423 - RNA, 14 nt, Shigella flexneri 2a str. 301
gacguucuuccugu

SEQ ID NO: 2007424 - RNA, 23 nt, Shigella flexneri 2a str. 301
gacgugcguaccauuaucaccaa

SEQ ID NO: 2007425 - RNA, 21 nt, Shigella flexneri 2a str. 301
gacgugcgcaaacuucuucag

SEQ ID NO: 2007426 - RNA, 17 nt, Shigella flexneri 2a str. 301
gacucuuacucuuucaa

SEQ ID NO: 2007427 - RNA, 19 nt, Shigella flexneri 2a str. 301
gacucgccauuaacauuaa

SEQ ID NO: 2007428 - RNA, 20 nt, Shigella flexneri 2a str. 301
gacuccugacuugccagaua

SEQ ID NO: 2007429 - RNA, 12 nt, Shigella flexneri 2a str. 301
gacuucugcuuu

SEQ ID NO: 2007430 - RNA, 14 nt, Shigella flexneri 2a str. 301
gacuugaaccagcg

SEQ ID NO: 2007431 - RNA, 24 nt, Shigella flexneri 2a str. 301
gacuuucuggcacgaccuggcagc

SEQ ID NO: 2007432 - RNA, 20 nt, Shigella flexneri 2a str. 301
gacuuucguuugaaaacugg

SEQ ID NO: 2007433 - RNA, 22 nt, Shigella flexneri 2a str. 301
gacuuugauccagccauugcca

SEQ ID NO: 2007434 - RNA, 18 nt, Shigella flexneri 2a str. 301
gacuuugccuggcggcag

SEQ ID NO: 2007435 - RNA, 23 nt, Shigella flexneri 2a str. 301
gacuuuaaucaccugccagggag

SEQ ID NO: 2007436 - RNA, 20 nt, Shigella flexneri 2a str. 301
gacuuaaaaggaaaaucaca

SEQ ID NO: 2007437 - RNA, 12 nt, Shigella flexneri 2a str. 301
gacuguuccagc

SEQ ID NO: 2007438 - RNA, 16 nt, Shigella flexneri 2a str. 301
gacuuccacuuccugc

SEQ ID NO: 2007439 - RNA, 17 nt, Shigella flexneri 2a str. 301
gacuucaugcgcagcau

SEQ ID NO: 2007440 - RNA, 14 nt, Shigella flexneri 2a str. 301
gagaaaaauagcau

SEQ ID NO: 2007441 - RNA, 15 nt, Shigella flexneri 2a str. 301
gacuuuugcccggca

SEQ ID NO: 2007442 - RNA, 14 nt, Shigella flexneri 2a str. 301
gagaaauaccaccc

SEQ ID NO: 2007443 - RNA, 22 nt, Shigella flexneri 2a str. 301
gagaaaguaaaccaccaguccu

SEQ ID NO: 2007444 - RNA, 16 nt, Shigella flexneri 2a str. 301
gagaaagcaaaaauaa

SEQ ID NO: 2007445 - RNA, 11 nt, Shigella flexneri 2a str. 301
gagaacagaua

SEQ ID NO: 2007446 - RNA, 18 nt, Shigella flexneri 2a str. 301
gagaacaucaauccaaac

SEQ ID NO: 2007447 - RNA, 18 nt, Shigella flexneri 2a str. 301
gagaaccacaaugaagaa

SEQ ID NO: 2007448 - RNA, 22 nt, Shigella flexneri 2a str. 301
gagaacggacccgcgaucgccu

SEQ ID NO: 2007449 - RNA, 12 nt, Shigella flexneri 2a str. 301
gagaacgaugcu

SEQ ID NO: 2007450 - RNA, 17 nt, Shigella flexneri 2a str. 301
gagaacggcgcaccaga

SEQ ID NO: 2007451 - RNA, 20 nt, Shigella flexneri 2a str. 301
gagaacgaccaucagcugcc

SEQ ID NO: 2007452 - RNA, 13 nt, Shigella flexneri 2a str. 301
aaagcaaaaauaa

SEQ ID NO: 2007453 - RNA, 14 nt, Shigella flexneri 2a str. 301
aaagcaagccaggu

SEQ ID NO: 2007454 - RNA, 17 nt, Shigella flexneri 2a str. 301
aaagcaauuccagcgcc

SEQ ID NO: 2007455 - RNA, 19 nt, Shigella flexneri 2a str. 301
gagaacaagauugccugau

SEQ ID NO: 2007456 - RNA, 17 nt, Shigella flexneri 2a str. 301
gagaacaaggcuuuaau

SEQ ID NO: 2007457 - RNA, 18 nt, Shigella flexneri 2a str. 301
gagacgagcauaaaaguu

SEQ ID NO: 2007458 - RNA, 20 nt, Shigella flexneri 2a str. 301
gagacagcuuagacagcgcc

SEQ ID NO: 2007459 - RNA, 21 nt, Shigella flexneri 2a str. 301
gagacauuccuuuacuuagaa

SEQ ID NO: 2007460 - RNA, 14 nt, Shigella flexneri 2a str. 301
gagacaaucgccac

SEQ ID NO: 2007461 - RNA, 17 nt, Shigella flexneri 2a str. 301
gagaagcugcugccgcu

SEQ ID NO: 2007462 - RNA, 14 nt, Shigella flexneri 2a str. 301
gagaagcgguuaaa

SEQ ID NO: 2007463 - RNA, 21 nt, Shigella flexneri 2a str. 301
gagaagcacguucaucccacu

SEQ ID NO: 2007464 - RNA, 15 nt, Shigella flexneri 2a str. 301
gagaagaccgccgcu

SEQ ID NO: 2007465 - RNA, 19 nt, Shigella flexneri 2a str. 301
gagaauggggucagcaggu

SEQ ID NO: 2007466 - RNA, 18 nt, Shigella flexneri 2a str. 301
gagaaucguacucaccag

SEQ ID NO: 2007467 - RNA, 14 nt, Shigella flexneri 2a str. 301
gagaaugaaagguc

SEQ ID NO: 2007468 - RNA, 14 nt, Shigella flexneri 2a str. 301
gagaaucagcgaga

SEQ ID NO: 2007469 - RNA, 16 nt, Shigella flexneri 2a str. 301
gagaaucaguuuuuuc

SEQ ID NO: 2007470 - RNA, 15 nt, Shigella flexneri 2a str. 301
gagagcaugaaauga

SEQ ID NO: 2007471 - RNA, 16 nt, Shigella flexneri 2a str. 301
gagagcaugaaaugaa

SEQ ID NO: 2007472 - RNA, 15 nt, Shigella flexneri 2a str. 301
gagacuuuuccagcc

SEQ ID NO: 2007473 - RNA, 20 nt, Shigella flexneri 2a str. 301
gagagaagcacguucauccc

SEQ ID NO: 2007474 - RNA, 12 nt, Shigella flexneri 2a str. 301
gagauauucccc

SEQ ID NO: 2007475 - RNA, 15 nt, Shigella flexneri 2a str. 301
gagauauuccccaga

SEQ ID NO: 2007476 - RNA, 14 nt, Shigella flexneri 2a str. 301
gagauaucgccagg

SEQ ID NO: 2007477 - RNA, 15 nt, Shigella flexneri 2a str. 301
gagaucacgccacaa

SEQ ID NO: 2007478 - RNA, 19 nt, Shigella flexneri 2a str. 301
gagaucauccaugauaauu

SEQ ID NO: 2007479 - RNA, 20 nt, Shigella flexneri 2a str. 301
gagaugacgccacuggcugg

SEQ ID NO: 2007480 - RNA, 20 nt, Shigella flexneri 2a str. 301
gagauagaaugccaaguaau

SEQ ID NO: 2007481 - RNA, 14 nt, Shigella flexneri 2a str. 301
gagauacaggccac

SEQ ID NO: 2007482 - RNA, 18 nt, Shigella flexneri 2a str. 301
gagauacaggccaccgcc

SEQ ID NO: 2007483 - RNA, 15 nt, Shigella flexneri 2a str. 301
gagauaacguuuugc

SEQ ID NO: 2007484 - RNA, 16 nt, Shigella flexneri 2a str. 301
gagauaaccacguuca

SEQ ID NO: 2007485 - RNA, 22 nt, Shigella flexneri 2a str. 301
gagauaaccacguucauuucau

SEQ ID NO: 2007486 - RNA, 19 nt, Shigella flexneri 2a str. 301
gagcaccaucgcugauugc

SEQ ID NO: 2007487 - RNA, 12 nt, Shigella flexneri 2a str. 301
gagcacaugcag

SEQ ID NO: 2007488 - RNA, 17 nt, Shigella flexneri 2a str. 301
gagauggcuucauccca

SEQ ID NO: 2007489 - RNA, 16 nt, Shigella flexneri 2a str. 301
gagauguccccugcgg

SEQ ID NO: 2007490 - RNA, 18 nt, Shigella flexneri 2a str. 301
gagaugcggaaauaucgg

SEQ ID NO: 2007491 - RNA, 21 nt, Shigella flexneri 2a str. 301
gagcaguagcgucgccagcag

SEQ ID NO: 2007492 - RNA, 16 nt, Shigella flexneri 2a str. 301
aaagcagcauguagau

SEQ ID NO: 2007493 - RNA, 12 nt, Shigella flexneri 2a str. 301
aaagcagcgaag

SEQ ID NO: 2007494 - RNA, 20 nt, Shigella flexneri 2a str. 301
aaagcagauaacccagcagc

SEQ ID NO: 2007495 - RNA, 18 nt, Shigella flexneri 2a str. 301
gagccggauggcauacca

SEQ ID NO: 2007496 - RNA, 17 nt, Shigella flexneri 2a str. 301
gagccggaugccucucc

SEQ ID NO: 2007497 - RNA, 22 nt, Shigella flexneri 2a str. 301
gagccgcuacggaagaugaaaa

SEQ ID NO: 2007498 - RNA, 22 nt, Shigella flexneri 2a str. 301
gagcaugguaacgccccacaaa

SEQ ID NO: 2007499 - RNA, 16 nt, Shigella flexneri 2a str. 301
gagccagccccacagc

SEQ ID NO: 2007500 - RNA, 15 nt, Shigella flexneri 2a str. 301
gagccagcuucccaa

SEQ ID NO: 2007501 - RNA, 22 nt, Shigella flexneri 2a str. 301
gagcauuacuuucggugacuuc

SEQ ID NO: 2007502 - RNA, 15 nt, Shigella flexneri 2a str. 301
gagccauccaguuua

SEQ ID NO: 2007503 - RNA, 16 nt, Shigella flexneri 2a str. 301
gagcaugaugccugau

SEQ ID NO: 2007504 - RNA, 17 nt, Shigella flexneri 2a str. 301
gagcaucgguaucuucc

SEQ ID NO: 2007505 - RNA, 13 nt, Shigella flexneri 2a str. 301
aaagccaacagca

SEQ ID NO: 2007506 - RNA, 20 nt, Shigella flexneri 2a str. 301
gauacacaccgagcguggcg

SEQ ID NO: 2007507 - RNA, 16 nt, Shigella flexneri 2a str. 301
gauaauuucacugccu

SEQ ID NO: 2007508 - RNA, 18 nt, Shigella flexneri 2a str. 301
gauaauuucacugccuuu

SEQ ID NO: 2007509 - RNA, 16 nt, Shigella flexneri 2a str. 301
gauaauuuuuucuucc

SEQ ID NO: 2007510 - RNA, 17 nt, Shigella flexneri 2a str. 301
gauaauuuuuucuucca

SEQ ID NO: 2007511 - RNA, 14 nt, Shigella flexneri 2a str. 301
aaagcagguuuuac

SEQ ID NO: 2007512 - RNA, 22 nt, Shigella flexneri 2a str. 301
gauacaacucgcuuaagccauc

SEQ ID NO: 2007513 - RNA, 23 nt, Shigella flexneri 2a str. 301
gauacaacugccgcgccugaauc

SEQ ID NO: 2007514 - RNA, 22 nt, Shigella flexneri 2a str. 301
gauaccgcacgcucaaagacgc

SEQ ID NO: 2007515 - RNA, 18 nt, Shigella flexneri 2a str. 301
gauaccgccgcacaauac

SEQ ID NO: 2007516 - RNA, 16 nt, Shigella flexneri 2a str. 301
gauaccgaacauacca

SEQ ID NO: 2007517 - RNA, 17 nt, Shigella flexneri 2a str. 301
gauaccagauuaauuau

SEQ ID NO: 2007518 - RNA, 19 nt, Shigella flexneri 2a str. 301
gauaccaucgcuucaugcc

SEQ ID NO: 2007519 - RNA, 16 nt, Shigella flexneri 2a str. 301
gauaccaccagugcca

SEQ ID NO: 2007520 - RNA, 13 nt, Shigella flexneri 2a str. 301
gauacaucaucac

SEQ ID NO: 2007521 - RNA, 13 nt, Shigella flexneri 2a str. 301
gauacaugaauga

SEQ ID NO: 2007522 - RNA, 17 nt, Shigella flexneri 2a str. 301
gauacaugaaugaugau

SEQ ID NO: 2007523 - RNA, 17 nt, Shigella flexneri 2a str. 301
gauaaggaauucacgcc

SEQ ID NO: 2007524 - RNA, 19 nt, Shigella flexneri 2a str. 301
gauaaccacguucauuuca

SEQ ID NO: 2007525 - RNA, 22 nt, Shigella flexneri 2a str. 301
gauaagugagcgauucaaauuc

SEQ ID NO: 2007526 - RNA, 15 nt, Shigella flexneri 2a str. 301
gauaauaauguguuc

SEQ ID NO: 2007527 - RNA, 14 nt, Shigella flexneri 2a str. 301
gauaaguuaacccc

SEQ ID NO: 2007528 - RNA, 15 nt, Shigella flexneri 2a str. 301
gauaaguucaaguuu

SEQ ID NO: 2007529 - RNA, 20 nt, Shigella flexneri 2a str. 301
gauaauaggaaucauuguua

SEQ ID NO: 2007530 - RNA, 22 nt, Shigella flexneri 2a str. 301
gauaauacacuaacagaacaau

SEQ ID NO: 2007531 - RNA, 22 nt, Shigella flexneri 2a str. 301
gauaaugccguuuggcaaauac

SEQ ID NO: 2007532 - RNA, 14 nt, Shigella flexneri 2a str. 301
gauaaugcccagca

SEQ ID NO: 2007533 - RNA, 20 nt, Shigella flexneri 2a str. 301
gauaaugguuuccagcaucg

SEQ ID NO: 2007534 - RNA, 12 nt, Shigella flexneri 2a str. 301
gauaauggcugu

SEQ ID NO: 2007535 - RNA, 13 nt, Shigella flexneri 2a str. 301
gauaauggcuguu

SEQ ID NO: 2007536 - RNA, 20 nt, Shigella flexneri 2a str. 301
gauaauuaggauacuuaucu

SEQ ID NO: 2007537 - RNA, 11 nt, Shigella flexneri 2a str. 301
gauaaucucaa

SEQ ID NO: 2007538 - RNA, 13 nt, Shigella flexneri 2a str. 301
gauaauccaggac

SEQ ID NO: 2007539 - RNA, 21 nt, Shigella flexneri 2a str. 301
gauaaucguauucuggcuucg

SEQ ID NO: 2007540 - RNA, 17 nt, Shigella flexneri 2a str. 301
gauaauauuuaucuucc

SEQ ID NO: 2007541 - RNA, 21 nt, Shigella flexneri 2a str. 301
gauaauauugaugcacaccau

SEQ ID NO: 2007542 - RNA, 22 nt, Shigella flexneri 2a str. 301
gauaauauuuuugcguccuggc

SEQ ID NO: 2007543 - RNA, 16 nt, Shigella flexneri 2a str. 301
gauaaucagcgccagc

SEQ ID NO: 2007544 - RNA, 18 nt, Shigella flexneri 2a str. 301
gauacuacguucaaucac

SEQ ID NO: 2007545 - RNA, 15 nt, Shigella flexneri 2a str. 301
gauacguugccguau

SEQ ID NO: 2007546 - RNA, 20 nt, Shigella flexneri 2a str. 301
gauacguccaccccagcaga

SEQ ID NO: 2007547 - RNA, 19 nt, Shigella flexneri 2a str. 301
gauaccgguaaucaggcaa

SEQ ID NO: 2007548 - RNA, 22 nt, Shigella flexneri 2a str. 301
gauaccggugcaccuucaagua

SEQ ID NO: 2007549 - RNA, 18 nt, Shigella flexneri 2a str. 301
gauacguaauucaucguc

SEQ ID NO: 2007550 - RNA, 18 nt, Shigella flexneri 2a str. 301
gauacggcgcaucuguuu

SEQ ID NO: 2007551 - RNA, 18 nt, Shigella flexneri 2a str. 301
gauagcacgucacggacu

SEQ ID NO: 2007552 - RNA, 18 nt, Shigella flexneri 2a str. 301
gauagcagaaaacucacg

SEQ ID NO: 2007553 - RNA, 14 nt, Shigella flexneri 2a str. 301
gauagcagcagaua

SEQ ID NO: 2007554 - RNA, 19 nt, Shigella flexneri 2a str. 301
gauagcacgacguuucuuu

SEQ ID NO: 2007555 - RNA, 21 nt, Shigella flexneri 2a str. 301
gauagccagguuuaccagcag

SEQ ID NO: 2007556 - RNA, 20 nt, Shigella flexneri 2a str. 301
gauagccaauuacgcaggca

SEQ ID NO: 2007557 - RNA, 12 nt, Shigella flexneri 2a str. 301
gauagccaggcg

SEQ ID NO: 2007558 - RNA, 23 nt, Shigella flexneri 2a str. 301
gauaucaaaacgcucugagcugc

SEQ ID NO: 2007559 - RNA, 19 nt, Shigella flexneri 2a str. 301
gauagcguagcgccucagg

SEQ ID NO: 2007560 - RNA, 15 nt, Shigella flexneri 2a str. 301
gauaguuaaaauuca

SEQ ID NO: 2007561 - RNA, 17 nt, Shigella flexneri 2a str. 301
gauaguuaaaauucaag

SEQ ID NO: 2007562 - RNA, 13 nt, Shigella flexneri 2a str. 301
gaucaauuucaca

SEQ ID NO: 2007563 - RNA, 14 nt, Shigella flexneri 2a str. 301
gaucaaauuauuac

SEQ ID NO: 2007564 - RNA, 16 nt, Shigella flexneri 2a str. 301
gaucaacacauccagu

SEQ ID NO: 2007565 - RNA, 14 nt, Shigella flexneri 2a str. 301
gaucaacacaucca

SEQ ID NO: 2007566 - RNA, 14 nt, Shigella flexneri 2a str. 301
gaucaaucugcucu

SEQ ID NO: 2007567 - RNA, 21 nt, Shigella flexneri 2a str. 301
gauauuuuucccugaaggcug

SEQ ID NO: 2007568 - RNA, 14 nt, Shigella flexneri 2a str. 301
gaucaaauaaccgg

SEQ ID NO: 2007569 - RNA, 16 nt, Shigella flexneri 2a str. 301
gaucaaauacuucaau

SEQ ID NO: 2007570 - RNA, 18 nt, Shigella flexneri 2a str. 301
gauauuuuuauggcaggu

SEQ ID NO: 2007571 - RNA, 13 nt, Shigella flexneri 2a str. 301
gauauugccaccu

SEQ ID NO: 2007572 - RNA, 21 nt, Shigella flexneri 2a str. 301
gauauugccgcgauagcaagc

SEQ ID NO: 2007573 - RNA, 15 nt, Shigella flexneri 2a str. 301
gauauucuccagcuu

SEQ ID NO: 2007574 - RNA, 16 nt, Shigella flexneri 2a str. 301
gauauucuccagcuuc

SEQ ID NO: 2007575 - RNA, 23 nt, Shigella flexneri 2a str. 301
gauauuccccagacgagagugac

SEQ ID NO: 2007576 - RNA, 22 nt, Shigella flexneri 2a str. 301
gauauucaggcguugaaaaauc

SEQ ID NO: 2007577 - RNA, 16 nt, Shigella flexneri 2a str. 301
gauauucaucuccagc

SEQ ID NO: 2007578 - RNA, 16 nt, Shigella flexneri 2a str. 301
gauaucucaccagauu

SEQ ID NO: 2007579 - RNA, 18 nt, Shigella flexneri 2a str. 301
gauauucaucuccagcac

SEQ ID NO: 2007580 - RNA, 13 nt, Shigella flexneri 2a str. 301
gauauucaugcag

SEQ ID NO: 2007581 - RNA, 16 nt, Shigella flexneri 2a str. 301
gauaucuacaaaacca

SEQ ID NO: 2007582 - RNA, 14 nt, Shigella flexneri 2a str. 301
gauauuaucuucau

SEQ ID NO: 2007583 - RNA, 23 nt, Shigella flexneri 2a str. 301
gauaucccgccagcaccagcaac

SEQ ID NO: 2007584 - RNA, 19 nt, Shigella flexneri 2a str. 301
gauauccacccgcagccau

SEQ ID NO: 2007585 - RNA, 15 nt, Shigella flexneri 2a str. 301
gauauccaccuccag

SEQ ID NO: 2007586 - RNA, 19 nt, Shigella flexneri 2a str. 301
gauauccacugucaaaucc

SEQ ID NO: 2007587 - RNA, 13 nt, Shigella flexneri 2a str. 301
gauauccagcgcc

SEQ ID NO: 2007588 - RNA, 21 nt, Shigella flexneri 2a str. 301
gauaucgaccacuuuaaccag

SEQ ID NO: 2007589 - RNA, 14 nt, Shigella flexneri 2a str. 301
gauauccgccaaua

SEQ ID NO: 2007590 - RNA, 23 nt, Shigella flexneri 2a str. 301
gauaucccagcugccgccaggcu

SEQ ID NO: 2007591 - RNA, 18 nt, Shigella flexneri 2a str. 301
gauaucgccaggccagcc

SEQ ID NO: 2007592 - RNA, 16 nt, Shigella flexneri 2a str. 301
gagucagcccaacaaa

SEQ ID NO: 2007593 - RNA, 19 nt, Shigella flexneri 2a str. 301
gagucauucuccagaucuu

SEQ ID NO: 2007594 - RNA, 22 nt, Shigella flexneri 2a str. 301
gagucauucuccagaucuuccg

SEQ ID NO: 2007595 - RNA, 22 nt, Shigella flexneri 2a str. 301
gagucgucgauaucgaugacgc

SEQ ID NO: 2007596 - RNA, 23 nt, Shigella flexneri 2a str. 301
gagucugaccgucgaugaaagcg

SEQ ID NO: 2007597 - RNA, 12 nt, Shigella flexneri 2a str. 301
gagucuugcugg

SEQ ID NO: 2007598 - RNA, 22 nt, Shigella flexneri 2a str. 301
gagguuggcucaucaagcacaa

SEQ ID NO: 2007599 - RNA, 14 nt, Shigella flexneri 2a str. 301
gagguuaaugaucg

SEQ ID NO: 2007600 - RNA, 16 nt, Shigella flexneri 2a str. 301
gagguuaaaaagugcu

SEQ ID NO: 2007601 - RNA, 17 nt, Shigella flexneri 2a str. 301
gaguaaaaaaacaucau

SEQ ID NO: 2007602 - RNA, 16 nt, Shigella flexneri 2a str. 301
gaguaaaaaaacauca

SEQ ID NO: 2007603 - RNA, 15 nt, Shigella flexneri 2a str. 301
gaguaguuauauucc

SEQ ID NO: 2007604 - RNA, 21 nt, Shigella flexneri 2a str. 301
gaguauccaaaucgcaguagc

SEQ ID NO: 2007605 - RNA, 14 nt, Shigella flexneri 2a str. 301
gaguugaaaaccuc

SEQ ID NO: 2007606 - RNA, 18 nt, Shigella flexneri 2a str. 301
gaguucaauuggccugau

SEQ ID NO: 2007607 - RNA, 23 nt, Shigella flexneri 2a str. 301
gaguuccaacgcagcacguaauu

SEQ ID NO: 2007608 - RNA, 15 nt, Shigella flexneri 2a str. 301
gaguugcaccagcaa

SEQ ID NO: 2007609 - RNA, 12 nt, Shigella flexneri 2a str. 301
gaguugcagauu

SEQ ID NO: 2007610 - RNA, 20 nt, Shigella flexneri 2a str. 301
gaguggaacaauacaggacg

SEQ ID NO: 2007611 - RNA, 21 nt, Shigella flexneri 2a str. 301
gagugcguuccccgaagacgu

SEQ ID NO: 2007612 - RNA, 21 nt, Shigella flexneri 2a str. 301
gaguucauauaauuccacgcc

SEQ ID NO: 2007613 - RNA, 20 nt, Shigella flexneri 2a str. 301
gaguucaucacaccagucca

SEQ ID NO: 2007614 - RNA, 15 nt, Shigella flexneri 2a str. 301
gauaaaucuccauuu

SEQ ID NO: 2007615 - RNA, 15 nt, Shigella flexneri 2a str. 301
gauaaauuuaaaacu

SEQ ID NO: 2007616 - RNA, 14 nt, Shigella flexneri 2a str. 301
gauaaauauuauug

SEQ ID NO: 2007617 - RNA, 20 nt, Shigella flexneri 2a str. 301
gauaaauaacuuuuaucugu

SEQ ID NO: 2007618 - RNA, 15 nt, Shigella flexneri 2a str. 301
gauaaauccaucggg

SEQ ID NO: 2007619 - RNA, 16 nt, Shigella flexneri 2a str. 301
gauaaaggucaucaca

SEQ ID NO: 2007620 - RNA, 18 nt, Shigella flexneri 2a str. 301
gauaaaguuagagccagg

SEQ ID NO: 2007621 - RNA, 20 nt, Shigella flexneri 2a str. 301
gauaaaguuagagccaggga

SEQ ID NO: 2007622 - RNA, 13 nt, Shigella flexneri 2a str. 301
gauaaagcugggu

SEQ ID NO: 2007623 - RNA, 20 nt, Shigella flexneri 2a str. 301
gauaaagcacugucuaacaa

SEQ ID NO: 2007624 - RNA, 16 nt, Shigella flexneri 2a str. 301
gaguuuuucaguccac

SEQ ID NO: 2007625 - RNA, 19 nt, Shigella flexneri 2a str. 301
gagggcgauuauccgccag

SEQ ID NO: 2007626 - RNA, 12 nt, Shigella flexneri 2a str. 301
gaggucacgucc

SEQ ID NO: 2007627 - RNA, 14 nt, Shigella flexneri 2a str. 301
gaggucgcuggcgu

SEQ ID NO: 2007628 - RNA, 20 nt, Shigella flexneri 2a str. 301
gaggcgucagcguuccacgu

SEQ ID NO: 2007629 - RNA, 19 nt, Shigella flexneri 2a str. 301
gaggcguaauuuccacgcc

SEQ ID NO: 2007630 - RNA, 18 nt, Shigella flexneri 2a str. 301
gaggcuagcggcuuuuua

SEQ ID NO: 2007631 - RNA, 15 nt, Shigella flexneri 2a str. 301
gaggcguuucaacuc

SEQ ID NO: 2007632 - RNA, 15 nt, Shigella flexneri 2a str. 301
gaggcagcaaggaaa

SEQ ID NO: 2007633 - RNA, 17 nt, Shigella flexneri 2a str. 301
gaggcagcaaggaaaac

SEQ ID NO: 2007634 - RNA, 16 nt, Shigella flexneri 2a str. 301
gaggcaauaguucugu

SEQ ID NO: 2007635 - RNA, 16 nt, Shigella flexneri 2a str. 301
gaggcaaccagcacgc

SEQ ID NO: 2007636 - RNA, 18 nt, Shigella flexneri 2a str. 301
gaggcuuuaauaccugcc

SEQ ID NO: 2007637 - RNA, 17 nt, Shigella flexneri 2a str. 301
gagggaggauuucuccc

SEQ ID NO: 2007638 - RNA, 22 nt, Shigella flexneri 2a str. 301
gagggauaucuucccgccguug

SEQ ID NO: 2007639 - RNA, 15 nt, Shigella flexneri 2a str. 301
gaggcuuauccggca

SEQ ID NO: 2007640 - RNA, 17 nt, Shigella flexneri 2a str. 301
gaggcuuauccggcaug

SEQ ID NO: 2007641 - RNA, 16 nt, Shigella flexneri 2a str. 301
gaggcugaccccaacc

SEQ ID NO: 2007642 - RNA, 12 nt, Shigella flexneri 2a str. 301
gaggaucaccag

SEQ ID NO: 2007643 - RNA, 18 nt, Shigella flexneri 2a str. 301
gaggcaaaccuuaaagca

SEQ ID NO: 2007644 - RNA, 15 nt, Shigella flexneri 2a str. 301
gaggauuucuccccc

SEQ ID NO: 2007645 - RNA, 19 nt, Shigella flexneri 2a str. 301
gaggauuucuccccccucu

SEQ ID NO: 2007646 - RNA, 18 nt, Shigella flexneri 2a str. 301
gaggauucgaaccucgga

SEQ ID NO: 2007647 - RNA, 22 nt, Shigella flexneri 2a str. 301
gagcuuugacgaccuucuucca

SEQ ID NO: 2007648 - RNA, 22 nt, Shigella flexneri 2a str. 301
gaggaaggcacguacaugcagg

SEQ ID NO: 2007649 - RNA, 16 nt, Shigella flexneri 2a str. 301
gaggaagugaguauca

SEQ ID NO: 2007650 - RNA, 22 nt, Shigella flexneri 2a str. 301
gaggaauugauucaucaagcau

SEQ ID NO: 2007651 - RNA, 21 nt, Shigella flexneri 2a str. 301
gaggacgcguuuaauggcggu

SEQ ID NO: 2007652 - RNA, 15 nt, Shigella flexneri 2a str. 301
gagcugcucgucagc

SEQ ID NO: 2007653 - RNA, 17 nt, Shigella flexneri 2a str. 301
gagcgaauacuccccuu

SEQ ID NO: 2007654 - RNA, 17 nt, Shigella flexneri 2a str. 301
gagcgacaucuuccuua

SEQ ID NO: 2007655 - RNA, 14 nt, Shigella flexneri 2a str. 301
gagcuucggcggcg

SEQ ID NO: 2007656 - RNA, 18 nt, Shigella flexneri 2a str. 301
gagcuucacccgcagcac

SEQ ID NO: 2007657 - RNA, 18 nt, Shigella flexneri 2a str. 301
ggccgggcaaacaaggca

SEQ ID NO: 2007658 - RNA, 16 nt, Shigella flexneri 2a str. 301
ggccggauaaggcgcu

SEQ ID NO: 2007659 - RNA, 15 nt, Shigella flexneri 2a str. 301
ggccggaugacagac

SEQ ID NO: 2007660 - RNA, 22 nt, Shigella flexneri 2a str. 301
aaaguugccagauaaauauuau

SEQ ID NO: 2007661 - RNA, 19 nt, Shigella flexneri 2a str. 301
ggccgcgccgacugcgcca

SEQ ID NO: 2007662 - RNA, 17 nt, Shigella flexneri 2a str. 301
aaaguugcucucaaaga

SEQ ID NO: 2007663 - RNA, 15 nt, Shigella flexneri 2a str. 301
aaaguuuaauugcca

SEQ ID NO: 2007664 - RNA, 22 nt, Shigella flexneri 2a str. 301
ggccgcugaacuggcgaagccu

SEQ ID NO: 2007665 - RNA, 16 nt, Shigella flexneri 2a str. 301
ggccgcguaccgcagc

SEQ ID NO: 2007666 - RNA, 16 nt, Shigella flexneri 2a str. 301
aaagugcccccaacuu

SEQ ID NO: 2007667 - RNA, 23 nt, Shigella flexneri 2a str. 301
ggccgauaauaaagccuauccag

SEQ ID NO: 2007668 - RNA, 16 nt, Shigella flexneri 2a str. 301
ggccgaggcacagcag

SEQ ID NO: 2007669 - RNA, 23 nt, Shigella flexneri 2a str. 301
ggcccaacuguugauccaggagc

SEQ ID NO: 2007670 - RNA, 14 nt, Shigella flexneri 2a str. 301
aaaguggaaaaaua

SEQ ID NO: 2007671 - RNA, 17 nt, Shigella flexneri 2a str. 301
aaaguggcguuguguuc

SEQ ID NO: 2007672 - RNA, 21 nt, Shigella flexneri 2a str. 301
ggccgauuaaagacagcgagg

SEQ ID NO: 2007673 - RNA, 21 nt, Shigella flexneri 2a str. 301
ggccgcaggcuguuaccccug

SEQ ID NO: 2007674 - RNA, 15 nt, Shigella flexneri 2a str. 301
ggccgcaguaaagcg

SEQ ID NO: 2007675 - RNA, 16 nt, Shigella flexneri 2a str. 301
ggccgcaucguacugg

SEQ ID NO: 2007676 - RNA, 16 nt, Shigella flexneri 2a str. 301
aaaguuagagccaggg

SEQ ID NO: 2007677 - RNA, 14 nt, Shigella flexneri 2a str. 301
aaaguguugcagga

SEQ ID NO: 2007678 - RNA, 15 nt, Shigella flexneri 2a str. 301
ggccguacccagcug

SEQ ID NO: 2007679 - RNA, 18 nt, Shigella flexneri 2a str. 301
ggccgugcagaccgcuga

SEQ ID NO: 2007680 - RNA, 18 nt, Shigella flexneri 2a str. 301
ggccggguuuucucccuc

SEQ ID NO: 2007681 - RNA, 20 nt, Shigella flexneri 2a str. 301
ggccggguuuucucccucgc

SEQ ID NO: 2007682 - RNA, 22 nt, Shigella flexneri 2a str. 301
ggccgguaacgcuuucucacca

SEQ ID NO: 2007683 - RNA, 18 nt, Shigella flexneri 2a str. 301
aaaguuuuucaacaccau

SEQ ID NO: 2007684 - RNA, 14 nt, Shigella flexneri 2a str. 301
aaaguuugcaacuu

SEQ ID NO: 2007685 - RNA, 13 nt, Shigella flexneri 2a str. 301
ggccguuccggca

SEQ ID NO: 2007686 - RNA, 14 nt, Shigella flexneri 2a str. 301
ggccguuguucucg

SEQ ID NO: 2007687 - RNA, 17 nt, Shigella flexneri 2a str. 301
ggccucgcuacgccagc

SEQ ID NO: 2007688 - RNA, 14 nt, Shigella flexneri 2a str. 301
ggccuccugcagcg

SEQ ID NO: 2007689 - RNA, 20 nt, Shigella flexneri 2a str. 301
ggccucggguugaugguaaa

SEQ ID NO: 2007690 - RNA, 16 nt, Shigella flexneri 2a str. 301
ggccucuccucgcgag

SEQ ID NO: 2007691 - RNA, 15 nt, Shigella flexneri 2a str. 301
ggccugaaagcucau

SEQ ID NO: 2007692 - RNA, 13 nt, Shigella flexneri 2a str. 301
ggccugaacaagc

SEQ ID NO: 2007693 - RNA, 12 nt, Shigella flexneri 2a str. 301
ggccugaaagcu

SEQ ID NO: 2007694 - RNA, 20 nt, Shigella flexneri 2a str. 301
aaauaaaaaacauucaagua

SEQ ID NO: 2007695 - RNA, 23 nt, Shigella flexneri 2a str. 301
ggccugauaaacauagcgcauca

SEQ ID NO: 2007696 - RNA, 21 nt, Shigella flexneri 2a str. 301
ggccugauaagcgcagcgcau

SEQ ID NO: 2007697 - RNA, 23 nt, Shigella flexneri 2a str. 301
ggccugauaagcguagcgcauca

SEQ ID NO: 2007698 - RNA, 11 nt, Shigella flexneri 2a str. 301
ggccugccgcu

SEQ ID NO: 2007699 - RNA, 19 nt, Shigella flexneri 2a str. 301
aaauaaauaccguucauua

SEQ ID NO: 2007700 - RNA, 23 nt, Shigella flexneri 2a str. 301
aaauaaacucucuauuccaccau

SEQ ID NO: 2007701 - RNA, 18 nt, Shigella flexneri 2a str. 301
aaauaaacuuacugacau

SEQ ID NO: 2007702 - RNA, 21 nt, Shigella flexneri 2a str. 301
ggcgaauagaaagcaagccag

SEQ ID NO: 2007703 - RNA, 15 nt, Shigella flexneri 2a str. 301
ggcgaagagaaagaa

SEQ ID NO: 2007704 - RNA, 16 nt, Shigella flexneri 2a str. 301
aaauacugauguuugu

SEQ ID NO: 2007705 - RNA, 16 nt, Shigella flexneri 2a str. 301
aaauacuggcuaagaa

SEQ ID NO: 2007706 - RNA, 21 nt, Shigella flexneri 2a str. 301
aaauacuguuuaucuucccag

SEQ ID NO: 2007707 - RNA, 22 nt, Shigella flexneri 2a str. 301
aaauacuguuuaucuucccagc

SEQ ID NO: 2007708 - RNA, 20 nt, Shigella flexneri 2a str. 301
aaauacuguuuaucuuccca

SEQ ID NO: 2007709 - RNA, 19 nt, Shigella flexneri 2a str. 301
ggcgcuccugcgggagcgc

SEQ ID NO: 2007710 - RNA, 17 nt, Shigella flexneri 2a str. 301
ggcgcugaaggcacaga

SEQ ID NO: 2007711 - RNA, 19 nt, Shigella flexneri 2a str. 301
ggcgcugaaggcacagaaa

SEQ ID NO: 2007712 - RNA, 16 nt, Shigella flexneri 2a str. 301
ggcgcugauaaauccc

SEQ ID NO: 2007713 - RNA, 19 nt, Shigella flexneri 2a str. 301
ggcgcugcuuuccugcugc

SEQ ID NO: 2007714 - RNA, 21 nt, Shigella flexneri 2a str. 301
ggcgcugcuguacuuuuuccu

SEQ ID NO: 2007715 - RNA, 22 nt, Shigella flexneri 2a str. 301
ggcgcaucuguuucgaucagca

SEQ ID NO: 2007716 - RNA, 20 nt, Shigella flexneri 2a str. 301
ggcgcauguuggcgcgguga

SEQ ID NO: 2007717 - RNA, 22 nt, Shigella flexneri 2a str. 301
ggcgcaucggucgaugaaagcg

SEQ ID NO: 2007718 - RNA, 16 nt, Shigella flexneri 2a str. 301
aaauacguucucaccu

SEQ ID NO: 2007719 - RNA, 14 nt, Shigella flexneri 2a str. 301
ggcgagggcaaacc

SEQ ID NO: 2007720 - RNA, 17 nt, Shigella flexneri 2a str. 301
ggcgaggcggggccaau

SEQ ID NO: 2007721 - RNA, 14 nt, Shigella flexneri 2a str. 301
aaauacacuuuaau

SEQ ID NO: 2007722 - RNA, 14 nt, Shigella flexneri 2a str. 301
aaauacaauucuca

SEQ ID NO: 2007723 - RNA, 21 nt, Shigella flexneri 2a str. 301
ggcgaggggacuguccgggca

SEQ ID NO: 2007724 - RNA, 18 nt, Shigella flexneri 2a str. 301
ggcgagguaggcagucau

SEQ ID NO: 2007725 - RNA, 18 nt, Shigella flexneri 2a str. 301
ggcgaguuuccaucaggc

SEQ ID NO: 2007726 - RNA, 16 nt, Shigella flexneri 2a str. 301
ggcgcaauggcgcaau

SEQ ID NO: 2007727 - RNA, 13 nt, Shigella flexneri 2a str. 301
ggcgcaauucccg

SEQ ID NO: 2007728 - RNA, 17 nt, Shigella flexneri 2a str. 301
ggcgauccggacgcuaa

SEQ ID NO: 2007729 - RNA, 21 nt, Shigella flexneri 2a str. 301
ggcgaugcuuugaccucccgc

SEQ ID NO: 2007730 - RNA, 14 nt, Shigella flexneri 2a str. 301
ggcgaugcggggug

SEQ ID NO: 2007731 - RNA, 16 nt, Shigella flexneri 2a str. 301
ggcguggcgcucgccc

SEQ ID NO: 2007732 - RNA, 21 nt, Shigella flexneri 2a str. 301
ggcgugaucuccuuggagaaa

SEQ ID NO: 2007733 - RNA, 14 nt, Shigella flexneri 2a str. 301
ggcguuacgcagca

SEQ ID NO: 2007734 - RNA, 16 nt, Shigella flexneri 2a str. 301
ggcguucgcggcggca

SEQ ID NO: 2007735 - RNA, 20 nt, Shigella flexneri 2a str. 301
ggcgugauucauacagcggc

SEQ ID NO: 2007736 - RNA, 21 nt, Shigella flexneri 2a str. 301
ggcgugagcugccucgcugaa

SEQ ID NO: 2007737 - RNA, 22 nt, Shigella flexneri 2a str. 301
ggcgugagaucgcgcgggagca

SEQ ID NO: 2007738 - RNA, 19 nt, Shigella flexneri 2a str. 301
ggcgucgcauccggcacua

SEQ ID NO: 2007739 - RNA, 15 nt, Shigella flexneri 2a str. 301
ggcguucugccuggc

SEQ ID NO: 2007740 - RNA, 12 nt, Shigella flexneri 2a str. 301
ggcuaaaaaaag

SEQ ID NO: 2007741 - RNA, 14 nt, Shigella flexneri 2a str. 301
ggcguuuccagcuc

SEQ ID NO: 2007742 - RNA, 23 nt, Shigella flexneri 2a str. 301
ggcguuuugauuuucaccagcau

SEQ ID NO: 2007743 - RNA, 17 nt, Shigella flexneri 2a str. 301
ggcguuucacuucugag

SEQ ID NO: 2007744 - RNA, 18 nt, Shigella flexneri 2a str. 301
ggcuaaucgucaucgaca

SEQ ID NO: 2007745 - RNA, 21 nt, Shigella flexneri 2a str. 301
ggcuaaccuuaugguguucag

SEQ ID NO: 2007746 - RNA, 17 nt, Shigella flexneri 2a str. 301
ggcuaaccgcuuuucca

SEQ ID NO: 2007747 - RNA, 20 nt, Shigella flexneri 2a str. 301
ggcuaaccgucugugugccu

SEQ ID NO: 2007748 - RNA, 14 nt, Shigella flexneri 2a str. 301
ggcuaccgcaguga

SEQ ID NO: 2007749 - RNA, 17 nt, Shigella flexneri 2a str. 301
ggcuauuccaguugaag

SEQ ID NO: 2007750 - RNA, 14 nt, Shigella flexneri 2a str. 301
ggcuauauucaaac

SEQ ID NO: 2007751 - RNA, 22 nt, Shigella flexneri 2a str. 301
ggcuauaaucacucaaaauauc

SEQ ID NO: 2007752 - RNA, 15 nt, Shigella flexneri 2a str. 301
ggcucaaucgccacc

SEQ ID NO: 2007753 - RNA, 14 nt, Shigella flexneri 2a str. 301
ggcucaaucgccac

SEQ ID NO: 2007754 - RNA, 18 nt, Shigella flexneri 2a str. 301
ggcucaaagacugugcca

SEQ ID NO: 2007755 - RNA, 12 nt, Shigella flexneri 2a str. 301
ggcuaugcugga

SEQ ID NO: 2007756 - RNA, 14 nt, Shigella flexneri 2a str. 301
ggcucagccgauga

SEQ ID NO: 2007757 - RNA, 12 nt, Shigella flexneri 2a str. 301
ggcucagcucug

SEQ ID NO: 2007758 - RNA, 19 nt, Shigella flexneri 2a str. 301
ggcggaaaucuuucauuuc

SEQ ID NO: 2007759 - RNA, 18 nt, Shigella flexneri 2a str. 301
ggcgcuggguaaagagcg

SEQ ID NO: 2007760 - RNA, 15 nt, Shigella flexneri 2a str. 301
ggcgcuggcuccuga

SEQ ID NO: 2007761 - RNA, 14 nt, Shigella flexneri 2a str. 301
ggcggcucaccugc

SEQ ID NO: 2007762 - RNA, 24 nt, Shigella flexneri 2a str. 301
ggcggccggaugacagacuccgcu

SEQ ID NO: 2007763 - RNA, 12 nt, Shigella flexneri 2a str. 301
ggcggcgcgcca

SEQ ID NO: 2007764 - RNA, 15 nt, Shigella flexneri 2a str. 301
ggcggcgcgccaggc

SEQ ID NO: 2007765 - RNA, 19 nt, Shigella flexneri 2a str. 301
ggcggcuuaccugaucgac

SEQ ID NO: 2007766 - RNA, 13 nt, Shigella flexneri 2a str. 301
ggcggcuggcugg

SEQ ID NO: 2007767 - RNA, 14 nt, Shigella flexneri 2a str. 301
ggcggcuggcugga

SEQ ID NO: 2007768 - RNA, 15 nt, Shigella flexneri 2a str. 301
ggcggcuggguuggg

SEQ ID NO: 2007769 - RNA, 17 nt, Shigella flexneri 2a str. 301
ggcggugaccagcagca

SEQ ID NO: 2007770 - RNA, 15 nt, Shigella flexneri 2a str. 301
ggcguaaugccuggg

SEQ ID NO: 2007771 - RNA, 12 nt, Shigella flexneri 2a str. 301
ggcgguggauaa

SEQ ID NO: 2007772 - RNA, 19 nt, Shigella flexneri 2a str. 301
ggcgguggauaaagcacug

SEQ ID NO: 2007773 - RNA, 14 nt, Shigella flexneri 2a str. 301
ggcguccaccugcg

SEQ ID NO: 2007774 - RNA, 24 nt, Shigella flexneri 2a str. 301
ggcgucagcguuccacgugcggcc

SEQ ID NO: 2007775 - RNA, 17 nt, Shigella flexneri 2a str. 301
ggccauugaauauuuuu

SEQ ID NO: 2007776 - RNA, 14 nt, Shigella flexneri 2a str. 301
ggccauuccagcac

SEQ ID NO: 2007777 - RNA, 19 nt, Shigella flexneri 2a str. 301
ggccauuccagcacccggc

SEQ ID NO: 2007778 - RNA, 15 nt, Shigella flexneri 2a str. 301
ggccauuacuacccu

SEQ ID NO: 2007779 - RNA, 13 nt, Shigella flexneri 2a str. 301
ggccaguccaggu

SEQ ID NO: 2007780 - RNA, 17 nt, Shigella flexneri 2a str. 301
ggccagguuuucuuuca

SEQ ID NO: 2007781 - RNA, 18 nt, Shigella flexneri 2a str. 301
ggccagguuuucuuucac

SEQ ID NO: 2007782 - RNA, 17 nt, Shigella flexneri 2a str. 301
ggccacgucauccggaa

SEQ ID NO: 2007783 - RNA, 19 nt, Shigella flexneri 2a str. 301
ggccaccgaagagacauug

SEQ ID NO: 2007784 - RNA, 17 nt, Shigella flexneri 2a str. 301
ggccagcaugugguuac

SEQ ID NO: 2007785 - RNA, 14 nt, Shigella flexneri 2a str. 301
ggccagccagcaga

SEQ ID NO: 2007786 - RNA, 15 nt, Shigella flexneri 2a str. 301
ggccagccagcagag

SEQ ID NO: 2007787 - RNA, 18 nt, Shigella flexneri 2a str. 301
ggccagccauccgucauc

SEQ ID NO: 2007788 - RNA, 12 nt, Shigella flexneri 2a str. 301
ggccagccgccg

SEQ ID NO: 2007789 - RNA, 17 nt, Shigella flexneri 2a str. 301
ggccagcgccaccacca

SEQ ID NO: 2007790 - RNA, 15 nt, Shigella flexneri 2a str. 301
ggcauggggucaggu

SEQ ID NO: 2007791 - RNA, 17 nt, Shigella flexneri 2a str. 301
ggcauggggucaggugg

SEQ ID NO: 2007792 - RNA, 23 nt, Shigella flexneri 2a str. 301
ggcaugucgguuguacaaaaaau

SEQ ID NO: 2007793 - RNA, 15 nt, Shigella flexneri 2a str. 301
ggcauguggcggcgc

SEQ ID NO: 2007794 - RNA, 15 nt, Shigella flexneri 2a str. 301
ggccaaagaccagga

SEQ ID NO: 2007795 - RNA, 17 nt, Shigella flexneri 2a str. 301
ggccaaagccgccgagc

SEQ ID NO: 2007796 - RNA, 21 nt, Shigella flexneri 2a str. 301
ggccaaagguuuccucaugca

SEQ ID NO: 2007797 - RNA, 12 nt, Shigella flexneri 2a str. 301
ggcauuaaacau

SEQ ID NO: 2007798 - RNA, 22 nt, Shigella flexneri 2a str. 301
ggccaaaaccacagugacccgc

SEQ ID NO: 2007799 - RNA, 16 nt, Shigella flexneri 2a str. 301
ggcauuuugugcacga

SEQ ID NO: 2007800 - RNA, 18 nt, Shigella flexneri 2a str. 301
ggccaaccauccgucauc

SEQ ID NO: 2007801 - RNA, 14 nt, Shigella flexneri 2a str. 301
ggccacagcgccag

SEQ ID NO: 2007802 - RNA, 14 nt, Shigella flexneri 2a str. 301
ggccaccaggccac

SEQ ID NO: 2007803 - RNA, 14 nt, Shigella flexneri 2a str. 301
ggcagucuggacaa

SEQ ID NO: 2007804 - RNA, 13 nt, Shigella flexneri 2a str. 301
ggcagcguuaugu

SEQ ID NO: 2007805 - RNA, 16 nt, Shigella flexneri 2a str. 301
ggcaguacgcggcggu

SEQ ID NO: 2007806 - RNA, 18 nt, Shigella flexneri 2a str. 301
ggcauccuugcuaaccaa

SEQ ID NO: 2007807 - RNA, 14 nt, Shigella flexneri 2a str. 301
ggcaugaaugguca

SEQ ID NO: 2007808 - RNA, 16 nt, Shigella flexneri 2a str. 301
ggcaucugcccccgca

SEQ ID NO: 2007809 - RNA, 16 nt, Shigella flexneri 2a str. 301
ggcauaaucauuacaa

SEQ ID NO: 2007810 - RNA, 19 nt, Shigella flexneri 2a str. 301
ggcauacaacgccaugaag

SEQ ID NO: 2007811 - RNA, 13 nt, Shigella flexneri 2a str. 301
ggcaccuuuucau

SEQ ID NO: 2007812 - RNA, 19 nt, Shigella flexneri 2a str. 301
ggcacgaaagguuccaaua

SEQ ID NO: 2007813 - RNA, 19 nt, Shigella flexneri 2a str. 301
ggcaccuguaccagcccgc

SEQ ID NO: 2007814 - RNA, 16 nt, Shigella flexneri 2a str. 301
ggcacggcaaucauga

SEQ ID NO: 2007815 - RNA, 23 nt, Shigella flexneri 2a str. 301
ggcacgcaggaucugacuggcga

SEQ ID NO: 2007816 - RNA, 13 nt, Shigella flexneri 2a str. 301
ggcaccgcagauc

SEQ ID NO: 2007817 - RNA, 20 nt, Shigella flexneri 2a str. 301
ggcaccgccaaagauaaaau

SEQ ID NO: 2007818 - RNA, 20 nt, Shigella flexneri 2a str. 301
ggcagcaauugucgcagaag

SEQ ID NO: 2007819 - RNA, 17 nt, Shigella flexneri 2a str. 301
ggcagcaaucacugcca

SEQ ID NO: 2007820 - RNA, 16 nt, Shigella flexneri 2a str. 301
ggcagcaaucacugcc

SEQ ID NO: 2007821 - RNA, 22 nt, Shigella flexneri 2a str. 301
ggcagcaaggcuauucagcagu

SEQ ID NO: 2007822 - RNA, 14 nt, Shigella flexneri 2a str. 301
ggcacuuuuauccu

SEQ ID NO: 2007823 - RNA, 22 nt, Shigella flexneri 2a str. 301
ggcacuuucaucgcggucagcu

SEQ ID NO: 2007824 - RNA, 19 nt, Shigella flexneri 2a str. 301
ggcagaaacggaccuggga

SEQ ID NO: 2007825 - RNA, 17 nt, Shigella flexneri 2a str. 301
ggcacguugcugcggcg

SEQ ID NO: 2007826 - RNA, 16 nt, Shigella flexneri 2a str. 301
ggcacugguacucaac

SEQ ID NO: 2007827 - RNA, 18 nt, Shigella flexneri 2a str. 301
aaaguagaaauuauuucu

SEQ ID NO: 2007828 - RNA, 17 nt, Shigella flexneri 2a str. 301
aaaguagaaauuauuuc

SEQ ID NO: 2007829 - RNA, 18 nt, Shigella flexneri 2a str. 301
aaaguacuucacaaucag

SEQ ID NO: 2007830 - RNA, 20 nt, Shigella flexneri 2a str. 301
ggcagccaccgccagcgggu

SEQ ID NO: 2007831 - RNA, 14 nt, Shigella flexneri 2a str. 301
ggcagcauguguaa

SEQ ID NO: 2007832 - RNA, 12 nt, Shigella flexneri 2a str. 301
ggcagcaggugc

SEQ ID NO: 2007833 - RNA, 17 nt, Shigella flexneri 2a str. 301
ggcaauuuuuaccgguc

SEQ ID NO: 2007834 - RNA, 13 nt, Shigella flexneri 2a str. 301
ggcacagccagcg

SEQ ID NO: 2007835 - RNA, 15 nt, Shigella flexneri 2a str. 301
ggcacagccagcgcu

SEQ ID NO: 2007836 - RNA, 20 nt, Shigella flexneri 2a str. 301
ggcacauuuuguaggccuga

SEQ ID NO: 2007837 - RNA, 21 nt, Shigella flexneri 2a str. 301
ggcaccaccuggcuugccggg

SEQ ID NO: 2007838 - RNA, 15 nt, Shigella flexneri 2a str. 301
ggcaccagccccugg

SEQ ID NO: 2007839 - RNA, 12 nt, Shigella flexneri 2a str. 301
ggcaccagcgca

SEQ ID NO: 2007840 - RNA, 21 nt, Shigella flexneri 2a str. 301
ggcaccagcgcacaguuauaa

SEQ ID NO: 2007841 - RNA, 16 nt, Shigella flexneri 2a str. 301
ggcacaucgacgguga

SEQ ID NO: 2007842 - RNA, 16 nt, Shigella flexneri 2a str. 301
ggcaccaaucaccgcc

SEQ ID NO: 2007843 - RNA, 14 nt, Shigella flexneri 2a str. 301
ggcacauagccacc

SEQ ID NO: 2007844 - RNA, 23 nt, Shigella flexneri 2a str. 301
ggcaaugacuagcgccauaauaa

SEQ ID NO: 2007845 - RNA, 23 nt, Shigella flexneri 2a str. 301
ggcaaucucacuccggccagagc

SEQ ID NO: 2007846 - RNA, 17 nt, Shigella flexneri 2a str. 301
ggcaaugucgagugaau

SEQ ID NO: 2007847 - RNA, 13 nt, Shigella flexneri 2a str. 301
ggcaaugcccggu

SEQ ID NO: 2007848 - RNA, 20 nt, Shigella flexneri 2a str. 301
ggcaaugcgggugcaaucaa

SEQ ID NO: 2007849 - RNA, 16 nt, Shigella flexneri 2a str. 301
ggcaauccacugcuug

SEQ ID NO: 2007850 - RNA, 17 nt, Shigella flexneri 2a str. 301
ggcaaucauucccagac

SEQ ID NO: 2007851 - RNA, 20 nt, Shigella flexneri 2a str. 301
ggcaauagcggacacuacca

SEQ ID NO: 2007852 - RNA, 22 nt, Shigella flexneri 2a str. 301
ggcaauagcggacacuaccauu

SEQ ID NO: 2007853 - RNA, 16 nt, Shigella flexneri 2a str. 301
ggcaaacagacuggca

SEQ ID NO: 2007854 - RNA, 12 nt, Shigella flexneri 2a str. 301
ggcaaaauaugu

SEQ ID NO: 2007855 - RNA, 14 nt, Shigella flexneri 2a str. 301
ggauuucauauccg

SEQ ID NO: 2007856 - RNA, 16 nt, Shigella flexneri 2a str. 301
ggauugcugaaauaca

SEQ ID NO: 2007857 - RNA, 15 nt, Shigella flexneri 2a str. 301
ggauugcuucugcuu

SEQ ID NO: 2007858 - RNA, 15 nt, Shigella flexneri 2a str. 301
ggauugaucggucca

SEQ ID NO: 2007859 - RNA, 12 nt, Shigella flexneri 2a str. 301
ggaucgccaggu

SEQ ID NO: 2007860 - RNA, 20 nt, Shigella flexneri 2a str. 301
ggcaaagcugucaccaauca

SEQ ID NO: 2007861 - RNA, 16 nt, Shigella flexneri 2a str. 301
ggcaaacuacaaaucc

SEQ ID NO: 2007862 - RNA, 19 nt, Shigella flexneri 2a str. 301
ggcaaagaaccaacgcugc

SEQ ID NO: 2007863 - RNA, 19 nt, Shigella flexneri 2a str. 301
ggcaaagugaauacagaac

SEQ ID NO: 2007864 - RNA, 18 nt, Shigella flexneri 2a str. 301
ggcaaaucaguggcugga

SEQ ID NO: 2007865 - RNA, 12 nt, Shigella flexneri 2a str. 301
ggcaacguucca

SEQ ID NO: 2007866 - RNA, 13 nt, Shigella flexneri 2a str. 301
ggcaacguuccag

SEQ ID NO: 2007867 - RNA, 18 nt, Shigella flexneri 2a str. 301
ggcaaauucaggagcagg

SEQ ID NO: 2007868 - RNA, 12 nt, Shigella flexneri 2a str. 301
ggcaaccugcuu

SEQ ID NO: 2007869 - RNA, 15 nt, Shigella flexneri 2a str. 301
ggcaacgacugcgag

SEQ ID NO: 2007870 - RNA, 18 nt, Shigella flexneri 2a str. 301
ggcaacgacugcgagcaa

SEQ ID NO: 2007871 - RNA, 11 nt, Shigella flexneri 2a str. 301
aaagggaugcc

SEQ ID NO: 2007872 - RNA, 14 nt, Shigella flexneri 2a str. 301
aaagggagcuaucu

SEQ ID NO: 2007873 - RNA, 18 nt, Shigella flexneri 2a str. 301
ggacccgcgaucgccugc

SEQ ID NO: 2007874 - RNA, 10 nt, Shigella flexneri 2a str. 301
ggaccacgga

SEQ ID NO: 2007875 - RNA, 13 nt, Shigella flexneri 2a str. 301
ggaccagcaacaa

SEQ ID NO: 2007876 - RNA, 22 nt, Shigella flexneri 2a str. 301
ggaccauucacacuccaguccc

SEQ ID NO: 2007877 - RNA, 15 nt, Shigella flexneri 2a str. 301
ggacaugauucauaa

SEQ ID NO: 2007878 - RNA, 16 nt, Shigella flexneri 2a str. 301
ggacaucguccagcuu

SEQ ID NO: 2007879 - RNA, 17 nt, Shigella flexneri 2a str. 301
ggacaucccggcagaga

SEQ ID NO: 2007880 - RNA, 18 nt, Shigella flexneri 2a str. 301
ggaccaaagaaugacacu

SEQ ID NO: 2007881 - RNA, 14 nt, Shigella flexneri 2a str. 301
ggacauguuuucca

SEQ ID NO: 2007882 - RNA, 21 nt, Shigella flexneri 2a str. 301
ggacauuccguuugcuguauc

SEQ ID NO: 2007883 - RNA, 20 nt, Shigella flexneri 2a str. 301
ggacaguaaaguuuuauccc

SEQ ID NO: 2007884 - RNA, 20 nt, Shigella flexneri 2a str. 301
ggacaguaucgauauggacu

SEQ ID NO: 2007885 - RNA, 16 nt, Shigella flexneri 2a str. 301
ggaauccgggucugua

SEQ ID NO: 2007886 - RNA, 12 nt, Shigella flexneri 2a str. 301
ggacgggcaauu

SEQ ID NO: 2007887 - RNA, 20 nt, Shigella flexneri 2a str. 301
ggacgcacaucgcugugcug

SEQ ID NO: 2007888 - RNA, 18 nt, Shigella flexneri 2a str. 301
ggacgccaguuacugcug

SEQ ID NO: 2007889 - RNA, 19 nt, Shigella flexneri 2a str. 301
ggacuauuuuaagaauaga

SEQ ID NO: 2007890 - RNA, 21 nt, Shigella flexneri 2a str. 301
aaaguaaaggcacaaggguga

SEQ ID NO: 2007891 - RNA, 14 nt, Shigella flexneri 2a str. 301
aaaguaaacaauaa

SEQ ID NO: 2007892 - RNA, 12 nt, Shigella flexneri 2a str. 301
aaaguaaaaaag

SEQ ID NO: 2007893 - RNA, 19 nt, Shigella flexneri 2a str. 301
ggagcuccagguccuccug

SEQ ID NO: 2007894 - RNA, 13 nt, Shigella flexneri 2a str. 301
ggagcuaaacagc

SEQ ID NO: 2007895 - RNA, 17 nt, Shigella flexneri 2a str. 301
ggagcugcaagauuaaa

SEQ ID NO: 2007896 - RNA, 14 nt, Shigella flexneri 2a str. 301
ggagcugccaggcc

SEQ ID NO: 2007897 - RNA, 16 nt, Shigella flexneri 2a str. 301
ggagcugugggguauu

SEQ ID NO: 2007898 - RNA, 21 nt, Shigella flexneri 2a str. 301
ggaggagagugcaaugaaaaa

SEQ ID NO: 2007899 - RNA, 19 nt, Shigella flexneri 2a str. 301
ggagggguuuuugccagca

SEQ ID NO: 2007900 - RNA, 20 nt, Shigella flexneri 2a str. 301
ggagggauguggcccagccu

SEQ ID NO: 2007901 - RNA, 14 nt, Shigella flexneri 2a str. 301
ggaggauuucuccc

SEQ ID NO: 2007902 - RNA, 17 nt, Shigella flexneri 2a str. 301
ggagcgauuaugaaaca

SEQ ID NO: 2007903 - RNA, 21 nt, Shigella flexneri 2a str. 301
ggagcgauuaugaaacaagaa

SEQ ID NO: 2007904 - RNA, 17 nt, Shigella flexneri 2a str. 301
ggagcgaauacuccccu

SEQ ID NO: 2007905 - RNA, 20 nt, Shigella flexneri 2a str. 301
ggagcgcuuuuuuccugccg

SEQ ID NO: 2007906 - RNA, 20 nt, Shigella flexneri 2a str. 301
ggagacagcuuagacagcgc

SEQ ID NO: 2007907 - RNA, 21 nt, Shigella flexneri 2a str. 301
ggagaguugcaccagcaacaa

SEQ ID NO: 2007908 - RNA, 13 nt, Shigella flexneri 2a str. 301
ggagaguugaaag

SEQ ID NO: 2007909 - RNA, 19 nt, Shigella flexneri 2a str. 301
ggagauaucgccaggccag

SEQ ID NO: 2007910 - RNA, 13 nt, Shigella flexneri 2a str. 301
ggauccccugccc

SEQ ID NO: 2007911 - RNA, 14 nt, Shigella flexneri 2a str. 301
ggauccccugcccg

SEQ ID NO: 2007912 - RNA, 20 nt, Shigella flexneri 2a str. 301
ggaucagcaaauccaucgcc

SEQ ID NO: 2007913 - RNA, 21 nt, Shigella flexneri 2a str. 301
ggaucaccagaccaauggcuu

SEQ ID NO: 2007914 - RNA, 17 nt, Shigella flexneri 2a str. 301
ggaucacuccccgccgu

SEQ ID NO: 2007915 - RNA, 21 nt, Shigella flexneri 2a str. 301
ggauaucaacguuauucgcuu

SEQ ID NO: 2007916 - RNA, 20 nt, Shigella flexneri 2a str. 301
ggauauccacugucaaaucc

SEQ ID NO: 2007917 - RNA, 18 nt, Shigella flexneri 2a str. 301
ggauauccacccgcagcc

SEQ ID NO: 2007918 - RNA, 21 nt, Shigella flexneri 2a str. 301
ggaucaauuaauccuuucgaa

SEQ ID NO: 2007919 - RNA, 16 nt, Shigella flexneri 2a str. 301
ggaguaagaauaaaac

SEQ ID NO: 2007920 - RNA, 12 nt, Shigella flexneri 2a str. 301
ggaguaauaauu

SEQ ID NO: 2007921 - RNA, 13 nt, Shigella flexneri 2a str. 301
ggaguaaccugcc

SEQ ID NO: 2007922 - RNA, 11 nt, Shigella flexneri 2a str. 301
ggagugcagca

SEQ ID NO: 2007923 - RNA, 15 nt, Shigella flexneri 2a str. 301
ggagugaaaauucuc

SEQ ID NO: 2007924 - RNA, 21 nt, Shigella flexneri 2a str. 301
ggauagccucucggcauuuau

SEQ ID NO: 2007925 - RNA, 16 nt, Shigella flexneri 2a str. 301
ggaguggcgaaauugg

SEQ ID NO: 2007926 - RNA, 13 nt, Shigella flexneri 2a str. 301
ggaaacagugcug

SEQ ID NO: 2007927 - RNA, 21 nt, Shigella flexneri 2a str. 301
ggaaacacgcucaggcgauga

SEQ ID NO: 2007928 - RNA, 18 nt, Shigella flexneri 2a str. 301
ggaaaaucaucaggggca

SEQ ID NO: 2007929 - RNA, 14 nt, Shigella flexneri 2a str. 301
ggaaacccaacgca

SEQ ID NO: 2007930 - RNA, 19 nt, Shigella flexneri 2a str. 301
ggaaaccaucaucuacgaa

SEQ ID NO: 2007931 - RNA, 21 nt, Shigella flexneri 2a str. 301
ggaaacucucaaaacaacaca

SEQ ID NO: 2007932 - RNA, 15 nt, Shigella flexneri 2a str. 301
ggaaacggagcaaaa

SEQ ID NO: 2007933 - RNA, 15 nt, Shigella flexneri 2a str. 301
ggaaagcaccugcgc

SEQ ID NO: 2007934 - RNA, 14 nt, Shigella flexneri 2a str. 301
ggaaagcacaaaau

SEQ ID NO: 2007935 - RNA, 18 nt, Shigella flexneri 2a str. 301
ggaaagggccgcagugga

SEQ ID NO: 2007936 - RNA, 16 nt, Shigella flexneri 2a str. 301
ggaaaguguguauacg

SEQ ID NO: 2007937 - RNA, 22 nt, Shigella flexneri 2a str. 301
ggaaaguuuaauugccauuucu

SEQ ID NO: 2007938 - RNA, 22 nt, Shigella flexneri 2a str. 301
ggaaauaaucgggaauacagaa

SEQ ID NO: 2007939 - RNA, 14 nt, Shigella flexneri 2a str. 301
ggaaauucagcagu

SEQ ID NO: 2007940 - RNA, 21 nt, Shigella flexneri 2a str. 301
ggaaauucagcaguuuuugca

SEQ ID NO: 2007941 - RNA, 22 nt, Shigella flexneri 2a str. 301
ggaaauuaccgcaccaccagca

SEQ ID NO: 2007942 - RNA, 17 nt, Shigella flexneri 2a str. 301
ggaaaucgacgcugcug

SEQ ID NO: 2007943 - RNA, 14 nt, Shigella flexneri 2a str. 301
ggaaauccaacaga

SEQ ID NO: 2007944 - RNA, 16 nt, Shigella flexneri 2a str. 301
ggaaauccaggucagc

SEQ ID NO: 2007945 - RNA, 17 nt, Shigella flexneri 2a str. 301
ggaaauccaggucagca

SEQ ID NO: 2007946 - RNA, 22 nt, Shigella flexneri 2a str. 301
ggaaucaacggcaacaauuccc

SEQ ID NO: 2007947 - RNA, 16 nt, Shigella flexneri 2a str. 301
ggaaggcccuuucccu

SEQ ID NO: 2007948 - RNA, 20 nt, Shigella flexneri 2a str. 301
ggaauagcuuuacccaaauc

SEQ ID NO: 2007949 - RNA, 21 nt, Shigella flexneri 2a str. 301
ggaagcuggauuaacgcuggg

SEQ ID NO: 2007950 - RNA, 17 nt, Shigella flexneri 2a str. 301
ggaaggaagacgcagca

SEQ ID NO: 2007951 - RNA, 20 nt, Shigella flexneri 2a str. 301
ggaaggauuacucagcgcug

SEQ ID NO: 2007952 - RNA, 11 nt, Shigella flexneri 2a str. 301
ggaaggauucg

SEQ ID NO: 2007953 - RNA, 17 nt, Shigella flexneri 2a str. 301
ggaagagacuauuucuu

SEQ ID NO: 2007954 - RNA, 20 nt, Shigella flexneri 2a str. 301
ggaagaauuugcuaccccug

SEQ ID NO: 2007955 - RNA, 19 nt, Shigella flexneri 2a str. 301
ggaacgauguaggccugau

SEQ ID NO: 2007956 - RNA, 20 nt, Shigella flexneri 2a str. 301
ggaacuggcaacaauggcau

SEQ ID NO: 2007957 - RNA, 17 nt, Shigella flexneri 2a str. 301
ggaacuggcugccagcg

SEQ ID NO: 2007958 - RNA, 15 nt, Shigella flexneri 2a str. 301
ggaaccggauuuuca

SEQ ID NO: 2007959 - RNA, 18 nt, Shigella flexneri 2a str. 301
gcuuugguggucaccaug

SEQ ID NO: 2007960 - RNA, 17 nt, Shigella flexneri 2a str. 301
gcuuuguguaaguuuaa

SEQ ID NO: 2007961 - RNA, 22 nt, Shigella flexneri 2a str. 301
gcuuuuacauuauccagcgacu

SEQ ID NO: 2007962 - RNA, 20 nt, Shigella flexneri 2a str. 301
gcuuugaauaucuccucugc

SEQ ID NO: 2007963 - RNA, 23 nt, Shigella flexneri 2a str. 301
gcuuugacgaccuucuuccagcu

SEQ ID NO: 2007964 - RNA, 17 nt, Shigella flexneri 2a str. 301
gcuuugcuguuuccagu

SEQ ID NO: 2007965 - RNA, 14 nt, Shigella flexneri 2a str. 301
gcuuugcaggcugg

SEQ ID NO: 2007966 - RNA, 15 nt, Shigella flexneri 2a str. 301
gcuuugcaucccaga

SEQ ID NO: 2007967 - RNA, 14 nt, Shigella flexneri 2a str. 301
gcuuucucuuccag

SEQ ID NO: 2007968 - RNA, 14 nt, Shigella flexneri 2a str. 301
gcuuucucaccaug

SEQ ID NO: 2007969 - RNA, 13 nt, Shigella flexneri 2a str. 301
gcuuucugggaug

SEQ ID NO: 2007970 - RNA, 15 nt, Shigella flexneri 2a str. 301
gcuuucgugaagcug

SEQ ID NO: 2007971 - RNA, 23 nt, Shigella flexneri 2a str. 301
gcuuucuucucagauauaaacgg

SEQ ID NO: 2007972 - RNA, 14 nt, Shigella flexneri 2a str. 301
gcugugcggucuga

SEQ ID NO: 2007973 - RNA, 12 nt, Shigella flexneri 2a str. 301
gcugugcucugg

SEQ ID NO: 2007974 - RNA, 23 nt, Shigella flexneri 2a str. 301
gcugugauguccguuuaccacag

SEQ ID NO: 2007975 - RNA, 14 nt, Shigella flexneri 2a str. 301
gcugugccaggacu

SEQ ID NO: 2007976 - RNA, 18 nt, Shigella flexneri 2a str. 301
gcugugggguauuuccag

SEQ ID NO: 2007977 - RNA, 17 nt, Shigella flexneri 2a str. 301
gcuuuuucugcuucugc

SEQ ID NO: 2007978 - RNA, 13 nt, Shigella flexneri 2a str. 301
gcuuuuuuaaccg

SEQ ID NO: 2007979 - RNA, 15 nt, Shigella flexneri 2a str. 301
ggaaaaacagaggcc

SEQ ID NO: 2007980 - RNA, 15 nt, Shigella flexneri 2a str. 301
ggaaaaaagaaagaa

SEQ ID NO: 2007981 - RNA, 14 nt, Shigella flexneri 2a str. 301
gcuuuuuauagcaa

SEQ ID NO: 2007982 - RNA, 18 nt, Shigella flexneri 2a str. 301
gcuuuuuaguaucuauuc

SEQ ID NO: 2007983 - RNA, 20 nt, Shigella flexneri 2a str. 301
gcuuuuuaaucucccgccag

SEQ ID NO: 2007984 - RNA, 19 nt, Shigella flexneri 2a str. 301
gcuuuuccauaucaagcau

SEQ ID NO: 2007985 - RNA, 14 nt, Shigella flexneri 2a str. 301
gcuuuucccuccac

SEQ ID NO: 2007986 - RNA, 15 nt, Shigella flexneri 2a str. 301
gcuuuucccuccacu

SEQ ID NO: 2007987 - RNA, 13 nt, Shigella flexneri 2a str. 301
gcuuuucauguac

SEQ ID NO: 2007988 - RNA, 23 nt, Shigella flexneri 2a str. 301
gcuuuuagcgacaaauccuucac

SEQ ID NO: 2007989 - RNA, 15 nt, Shigella flexneri 2a str. 301
gcuuuuagcugguga

SEQ ID NO: 2007990 - RNA, 18 nt, Shigella flexneri 2a str. 301
gcuaaagacuuugcugcc

SEQ ID NO: 2007991 - RNA, 19 nt, Shigella flexneri 2a str. 301
gcuaaaguacguaaaacaa

SEQ ID NO: 2007992 - RNA, 20 nt, Shigella flexneri 2a str. 301
gcuaaaaauagcgacuuggg

SEQ ID NO: 2007993 - RNA, 15 nt, Shigella flexneri 2a str. 301
gcuaacugguggcag

SEQ ID NO: 2007994 - RNA, 21 nt, Shigella flexneri 2a str. 301
gcuaacugguggcaggaaaac

SEQ ID NO: 2007995 - RNA, 15 nt, Shigella flexneri 2a str. 301
gcuaagauaccccag

SEQ ID NO: 2007996 - RNA, 20 nt, Shigella flexneri 2a str. 301
gcuaacuuccugcuggcugu

SEQ ID NO: 2007997 - RNA, 21 nt, Shigella flexneri 2a str. 301
gcuaacuuccugcuggcugua

SEQ ID NO: 2007998 - RNA, 13 nt, Shigella flexneri 2a str. 301
gcuaauaaucagc

SEQ ID NO: 2007999 - RNA, 19 nt, Shigella flexneri 2a str. 301
gcuaaguacguaacgaccc

SEQ ID NO: 2008000 - RNA, 13 nt, Shigella flexneri 2a str. 301
gcuaaucagugcc

SEQ ID NO: 2008001 - RNA, 14 nt, Shigella flexneri 2a str. 301
gcuaaucagugccu

SEQ ID NO: 2008002 - RNA, 20 nt, Shigella flexneri 2a str. 301
gcuaauaccaaucgcaauac

SEQ ID NO: 2008003 - RNA, 23 nt, Shigella flexneri 2a str. 301
gcuacgaucgauaaccaucuucu

SEQ ID NO: 2008004 - RNA, 17 nt, Shigella flexneri 2a str. 301
gcuacuggcaauccagc

SEQ ID NO: 2008005 - RNA, 19 nt, Shigella flexneri 2a str. 301
gcuacuggcaauccagcuc

SEQ ID NO: 2008006 - RNA, 13 nt, Shigella flexneri 2a str. 301
gcuacugauaaua

SEQ ID NO: 2008007 - RNA, 17 nt, Shigella flexneri 2a str. 301
gcuacaaaaaugcccga

SEQ ID NO: 2008008 - RNA, 15 nt, Shigella flexneri 2a str. 301
gcuacagccugguga

SEQ ID NO: 2008009 - RNA, 13 nt, Shigella flexneri 2a str. 301
gcuaauucaacgc

SEQ ID NO: 2008010 - RNA, 20 nt, Shigella flexneri 2a str. 301
gcuaauugcgaacugugcac

SEQ ID NO: 2008011 - RNA, 12 nt, Shigella flexneri 2a str. 301
gcuaauuuaucg

SEQ ID NO: 2008012 - RNA, 23 nt, Shigella flexneri 2a str. 301
gcuaccaaaaaaucaaugcccau

SEQ ID NO: 2008013 - RNA, 15 nt, Shigella flexneri 2a str. 301
gcuacauaacgcagc

SEQ ID NO: 2008014 - RNA, 17 nt, Shigella flexneri 2a str. 301
gcuacauacuuaaauaa

SEQ ID NO: 2008015 - RNA, 20 nt, Shigella flexneri 2a str. 301
gcguugcgccuguucccuuc

SEQ ID NO: 2008016 - RNA, 16 nt, Shigella flexneri 2a str. 301
gcguugucgccaucca

SEQ ID NO: 2008017 - RNA, 19 nt, Shigella flexneri 2a str. 301
gcguucuguggcagggcag

SEQ ID NO: 2008018 - RNA, 22 nt, Shigella flexneri 2a str. 301
gcguucugucgauaaacucaug

SEQ ID NO: 2008019 - RNA, 23 nt, Shigella flexneri 2a str. 301
gcguugccaguaguucauccagu

SEQ ID NO: 2008020 - RNA, 23 nt, Shigella flexneri 2a str. 301
gcguuuuuucgauaucaagccau

SEQ ID NO: 2008021 - RNA, 11 nt, Shigella flexneri 2a str. 301
gcguuuuccag

SEQ ID NO: 2008022 - RNA, 19 nt, Shigella flexneri 2a str. 301
gcguuuuauaccaacaaaa

SEQ ID NO: 2008023 - RNA, 14 nt, Shigella flexneri 2a str. 301
gcguuugcuccugc

SEQ ID NO: 2008024 - RNA, 16 nt, Shigella flexneri 2a str. 301
gcguuugcuccugcuu

SEQ ID NO: 2008025 - RNA, 19 nt, Shigella flexneri 2a str. 301
gcguuuugccaguucguug

SEQ ID NO: 2008026 - RNA, 18 nt, Shigella flexneri 2a str. 301
gcguuuuccggcacgcag

SEQ ID NO: 2008027 - RNA, 23 nt, Shigella flexneri 2a str. 301
gcguuugaaauaccagguugccu

SEQ ID NO: 2008028 - RNA, 20 nt, Shigella flexneri 2a str. 301
gcguuucugcgcuucugcca

SEQ ID NO: 2008029 - RNA, 18 nt, Shigella flexneri 2a str. 301
gcguuucaaaaacaaaga

SEQ ID NO: 2008030 - RNA, 14 nt, Shigella flexneri 2a str. 301
gcgugguccagcug

SEQ ID NO: 2008031 - RNA, 13 nt, Shigella flexneri 2a str. 301
gcgugucccacug

SEQ ID NO: 2008032 - RNA, 23 nt, Shigella flexneri 2a str. 301
gcguguuccagagaacgaccauc

SEQ ID NO: 2008033 - RNA, 20 nt, Shigella flexneri 2a str. 301
gcguuaagccaucccagaca

SEQ ID NO: 2008034 - RNA, 22 nt, Shigella flexneri 2a str. 301
gcguuaaugucgauauggggau

SEQ ID NO: 2008035 - RNA, 19 nt, Shigella flexneri 2a str. 301
gcguucagcaguucugcca

SEQ ID NO: 2008036 - RNA, 21 nt, Shigella flexneri 2a str. 301
gcguucaucaguuccaguuca

SEQ ID NO: 2008037 - RNA, 21 nt, Shigella flexneri 2a str. 301
gcguuaugucccgcuggugcg

SEQ ID NO: 2008038 - RNA, 14 nt, Shigella flexneri 2a str. 301
gcguuaugacgcgc

SEQ ID NO: 2008039 - RNA, 22 nt, Shigella flexneri 2a str. 301
gcguuagauagcggcugacggu

SEQ ID NO: 2008040 - RNA, 17 nt, Shigella flexneri 2a str. 301
gcguuauccgcuuuuuc

SEQ ID NO: 2008041 - RNA, 20 nt, Shigella flexneri 2a str. 301
gcguuacccauucaagauca

SEQ ID NO: 2008042 - RNA, 16 nt, Shigella flexneri 2a str. 301
gcguuacagcuggagu

SEQ ID NO: 2008043 - RNA, 11 nt, Shigella flexneri 2a str. 301
gcguuccccag

SEQ ID NO: 2008044 - RNA, 13 nt, Shigella flexneri 2a str. 301
gcguuccccagaa

SEQ ID NO: 2008045 - RNA, 22 nt, Shigella flexneri 2a str. 301
gcguuccccuguugugccagac

SEQ ID NO: 2008046 - RNA, 21 nt, Shigella flexneri 2a str. 301
gcucagaagacgcuccagugu

SEQ ID NO: 2008047 - RNA, 21 nt, Shigella flexneri 2a str. 301
gcucacuucgauccagugauu

SEQ ID NO: 2008048 - RNA, 16 nt, Shigella flexneri 2a str. 301
gcucacugcaaaacag

SEQ ID NO: 2008049 - RNA, 19 nt, Shigella flexneri 2a str. 301
gcucacugcaaaacagguc

SEQ ID NO: 2008050 - RNA, 16 nt, Shigella flexneri 2a str. 301
gcucacucaucacucc

SEQ ID NO: 2008051 - RNA, 15 nt, Shigella flexneri 2a str. 301
gcucagcgccacauc

SEQ ID NO: 2008052 - RNA, 21 nt, Shigella flexneri 2a str. 301
gcucagcuccucuuucauuuc

SEQ ID NO: 2008053 - RNA, 16 nt, Shigella flexneri 2a str. 301
gcucaauacaacccac

SEQ ID NO: 2008054 - RNA, 17 nt, Shigella flexneri 2a str. 301
gcucaauaaaagaaauc

SEQ ID NO: 2008055 - RNA, 16 nt, Shigella flexneri 2a str. 301
gcucaaucgcauggcu

SEQ ID NO: 2008056 - RNA, 17 nt, Shigella flexneri 2a str. 301
gcucaauauccugaccu

SEQ ID NO: 2008057 - RNA, 12 nt, Shigella flexneri 2a str. 301
gcucaaucugcg

SEQ ID NO: 2008058 - RNA, 14 nt, Shigella flexneri 2a str. 301
gcucaauuccccua

SEQ ID NO: 2008059 - RNA, 15 nt, Shigella flexneri 2a str. 301
gcucaaugucuguca

SEQ ID NO: 2008060 - RNA, 13 nt, Shigella flexneri 2a str. 301
gcucaccagcagc

SEQ ID NO: 2008061 - RNA, 14 nt, Shigella flexneri 2a str. 301
gcucacgcccauca

SEQ ID NO: 2008062 - RNA, 18 nt, Shigella flexneri 2a str. 301
gcucacgcagcggcggca

SEQ ID NO: 2008063 - RNA, 21 nt, Shigella flexneri 2a str. 301
gcucacgcgcugccucucuuc

SEQ ID NO: 2008064 - RNA, 17 nt, Shigella flexneri 2a str. 301
gcucacgcagcggcggc

SEQ ID NO: 2008065 - RNA, 17 nt, Shigella flexneri 2a str. 301
gcucaccgccagcaucg

SEQ ID NO: 2008066 - RNA, 13 nt, Shigella flexneri 2a str. 301
gcucaccgccagc

SEQ ID NO: 2008067 - RNA, 13 nt, Shigella flexneri 2a str. 301
gcuccagaaacca

SEQ ID NO: 2008068 - RNA, 15 nt, Shigella flexneri 2a str. 301
gcuccagacgccaga

SEQ ID NO: 2008069 - RNA, 22 nt, Shigella flexneri 2a str. 301
gcuccagugccugugacaacac

SEQ ID NO: 2008070 - RNA, 10 nt, Shigella flexneri 2a str. 301
gcuccagugc

SEQ ID NO: 2008071 - RNA, 18 nt, Shigella flexneri 2a str. 301
gcuccagugcauccagca

SEQ ID NO: 2008072 - RNA, 15 nt, Shigella flexneri 2a str. 301
gcuccaguguggcca

SEQ ID NO: 2008073 - RNA, 15 nt, Shigella flexneri 2a str. 301
gcuccagguccuccu

SEQ ID NO: 2008074 - RNA, 12 nt, Shigella flexneri 2a str. 301
gcuccccagaau

SEQ ID NO: 2008075 - RNA, 20 nt, Shigella flexneri 2a str. 301
gcucauugguccaucuuuuu

SEQ ID NO: 2008076 - RNA, 17 nt, Shigella flexneri 2a str. 301
gcucaguugcaucgucu

SEQ ID NO: 2008077 - RNA, 13 nt, Shigella flexneri 2a str. 301
gcucaggguuuuc

SEQ ID NO: 2008078 - RNA, 21 nt, Shigella flexneri 2a str. 301
gcuaugcuggagaagauauug

SEQ ID NO: 2008079 - RNA, 14 nt, Shigella flexneri 2a str. 301
gcuauucagcaguu

SEQ ID NO: 2008080 - RNA, 18 nt, Shigella flexneri 2a str. 301
gcuauucuuauaaagaaa

SEQ ID NO: 2008081 - RNA, 13 nt, Shigella flexneri 2a str. 301
gcuauuuuuugca

SEQ ID NO: 2008082 - RNA, 18 nt, Shigella flexneri 2a str. 301
gcuauuuuuugcagugcu

SEQ ID NO: 2008083 - RNA, 12 nt, Shigella flexneri 2a str. 301
gcuauuugcgcc

SEQ ID NO: 2008084 - RNA, 23 nt, Shigella flexneri 2a str. 301
gcucaaaaauccagauuuauaaa

SEQ ID NO: 2008085 - RNA, 22 nt, Shigella flexneri 2a str. 301
gcucaaacuucgucacagcggc

SEQ ID NO: 2008086 - RNA, 16 nt, Shigella flexneri 2a str. 301
gcucaaaccagcgacg

SEQ ID NO: 2008087 - RNA, 19 nt, Shigella flexneri 2a str. 301
gcucaaacggcguuuucuc

SEQ ID NO: 2008088 - RNA, 18 nt, Shigella flexneri 2a str. 301
gcucaaauccaucagacc

SEQ ID NO: 2008089 - RNA, 17 nt, Shigella flexneri 2a str. 301
gcucaacaauaaacugg

SEQ ID NO: 2008090 - RNA, 22 nt, Shigella flexneri 2a str. 301
gcucaacaauaaacuggcugug

SEQ ID NO: 2008091 - RNA, 16 nt, Shigella flexneri 2a str. 301
gcuauacagcagccau

SEQ ID NO: 2008092 - RNA, 17 nt, Shigella flexneri 2a str. 301
gcuauaaccugguggug

SEQ ID NO: 2008093 - RNA, 21 nt, Shigella flexneri 2a str. 301
gcuauagacaccuugcaacuc

SEQ ID NO: 2008094 - RNA, 13 nt, Shigella flexneri 2a str. 301
gcuauccugguua

SEQ ID NO: 2008095 - RNA, 21 nt, Shigella flexneri 2a str. 301
gcuaucguccacgucaucaaa

SEQ ID NO: 2008096 - RNA, 15 nt, Shigella flexneri 2a str. 301
gcuacuucaaacaaa

SEQ ID NO: 2008097 - RNA, 16 nt, Shigella flexneri 2a str. 301
gcuacuucaaacaaaa

SEQ ID NO: 2008098 - RNA, 18 nt, Shigella flexneri 2a str. 301
gcuagcggcuuuuuacgc

SEQ ID NO: 2008099 - RNA, 20 nt, Shigella flexneri 2a str. 301
gcuagcggguuaagcgcgcu

SEQ ID NO: 2008100 - RNA, 21 nt, Shigella flexneri 2a str. 301
gcuaguuaucuccuugcuggu

SEQ ID NO: 2008101 - RNA, 22 nt, Shigella flexneri 2a str. 301
gcuaguuaucuccuugcuggug

SEQ ID NO: 2008102 - RNA, 13 nt, Shigella flexneri 2a str. 301
gcuagcuucaggu

SEQ ID NO: 2008103 - RNA, 17 nt, Shigella flexneri 2a str. 301
gcucccgcagccacucc

SEQ ID NO: 2008104 - RNA, 15 nt, Shigella flexneri 2a str. 301
gcucccgcagccacu

SEQ ID NO: 2008105 - RNA, 22 nt, Shigella flexneri 2a str. 301
gcucuaacccuuccagauucag

SEQ ID NO: 2008106 - RNA, 23 nt, Shigella flexneri 2a str. 301
gcucguugccugcgaagcucuuu

SEQ ID NO: 2008107 - RNA, 23 nt, Shigella flexneri 2a str. 301
gcucguugcagaaugauggcuga

SEQ ID NO: 2008108 - RNA, 20 nt, Shigella flexneri 2a str. 301
gcucguuacuuuccuucagc

SEQ ID NO: 2008109 - RNA, 16 nt, Shigella flexneri 2a str. 301
gcucgucauccgccag

SEQ ID NO: 2008110 - RNA, 22 nt, Shigella flexneri 2a str. 301
gcucguauaaugacugcccuga

SEQ ID NO: 2008111 - RNA, 21 nt, Shigella flexneri 2a str. 301
gcucugccacugguuuuccug

SEQ ID NO: 2008112 - RNA, 15 nt, Shigella flexneri 2a str. 301
gcucugccagcaaau

SEQ ID NO: 2008113 - RNA, 19 nt, Shigella flexneri 2a str. 301
gcucugcugucaccgaagc

SEQ ID NO: 2008114 - RNA, 15 nt, Shigella flexneri 2a str. 301
gcucugcgccgccuu

SEQ ID NO: 2008115 - RNA, 13 nt, Shigella flexneri 2a str. 301
gcucucuuccagu

SEQ ID NO: 2008116 - RNA, 14 nt, Shigella flexneri 2a str. 301
gcucucuuucucca

SEQ ID NO: 2008117 - RNA, 20 nt, Shigella flexneri 2a str. 301
gcucugcacuaaugcaucug

SEQ ID NO: 2008118 - RNA, 21 nt, Shigella flexneri 2a str. 301
gcucugauugccuuccaccag

SEQ ID NO: 2008119 - RNA, 16 nt, Shigella flexneri 2a str. 301
gcucucaaauaucugc

SEQ ID NO: 2008120 - RNA, 14 nt, Shigella flexneri 2a str. 301
gcucucauuuuuca

SEQ ID NO: 2008121 - RNA, 15 nt, Shigella flexneri 2a str. 301
gcucucacuuauuug

SEQ ID NO: 2008122 - RNA, 18 nt, Shigella flexneri 2a str. 301
gcucuccacgcuauacag

SEQ ID NO: 2008123 - RNA, 21 nt, Shigella flexneri 2a str. 301
gcucucauuuuucagcguucc

SEQ ID NO: 2008124 - RNA, 13 nt, Shigella flexneri 2a str. 301
gcucucccauggc

SEQ ID NO: 2008125 - RNA, 23 nt, Shigella flexneri 2a str. 301
gcucuucuucgcgauaaaucaga

SEQ ID NO: 2008126 - RNA, 22 nt, Shigella flexneri 2a str. 301
gcucuucuucacucucaccacg

SEQ ID NO: 2008127 - RNA, 15 nt, Shigella flexneri 2a str. 301
gcucuucucaacgug

SEQ ID NO: 2008128 - RNA, 21 nt, Shigella flexneri 2a str. 301
gcucuuguucgaagacaucca

SEQ ID NO: 2008129 - RNA, 19 nt, Shigella flexneri 2a str. 301
gcucuucaauggucagcca

SEQ ID NO: 2008130 - RNA, 20 nt, Shigella flexneri 2a str. 301
gcucuucaauggucagccac

SEQ ID NO: 2008131 - RNA, 22 nt, Shigella flexneri 2a str. 301
gcucuuccaggcauuaaauccu

SEQ ID NO: 2008132 - RNA, 14 nt, Shigella flexneri 2a str. 301
gcucuucaugcagc

SEQ ID NO: 2008133 - RNA, 17 nt, Shigella flexneri 2a str. 301
gcucugguugugguggg

SEQ ID NO: 2008134 - RNA, 20 nt, Shigella flexneri 2a str. 301
gcucugguucaccauucugc

SEQ ID NO: 2008135 - RNA, 14 nt, Shigella flexneri 2a str. 301
gcucuguauauaaa

SEQ ID NO: 2008136 - RNA, 16 nt, Shigella flexneri 2a str. 301
gcucuguucugcgcuu

SEQ ID NO: 2008137 - RNA, 20 nt, Shigella flexneri 2a str. 301
gcucuggcaggcuucaauuu

SEQ ID NO: 2008138 - RNA, 20 nt, Shigella flexneri 2a str. 301
gcucugcuuucucagcaaau

SEQ ID NO: 2008139 - RNA, 22 nt, Shigella flexneri 2a str. 301
gcucugcuuucucagcaaauag

SEQ ID NO: 2008140 - RNA, 17 nt, Shigella flexneri 2a str. 301
gcucugguguucuuuua

SEQ ID NO: 2008141 - RNA, 16 nt, Shigella flexneri 2a str. 301
gcucuggcaagcgacu

SEQ ID NO: 2008142 - RNA, 22 nt, Shigella flexneri 2a str. 301
gcugacggugauaaucauccca

SEQ ID NO: 2008143 - RNA, 23 nt, Shigella flexneri 2a str. 301
gcugacgucuuuauugaguacca

SEQ ID NO: 2008144 - RNA, 18 nt, Shigella flexneri 2a str. 301
gcugacguuaagaaaacg

SEQ ID NO: 2008145 - RNA, 21 nt, Shigella flexneri 2a str. 301
gcugacuuugacauguugcug

SEQ ID NO: 2008146 - RNA, 19 nt, Shigella flexneri 2a str. 301
gcugagggauccccagaaa

SEQ ID NO: 2008147 - RNA, 14 nt, Shigella flexneri 2a str. 301
gcugauaagacgca

SEQ ID NO: 2008148 - RNA, 15 nt, Shigella flexneri 2a str. 301
gcugauaacaauauc

SEQ ID NO: 2008149 - RNA, 21 nt, Shigella flexneri 2a str. 301
gcugaguguaacgcuugcuga

SEQ ID NO: 2008150 - RNA, 12 nt, Shigella flexneri 2a str. 301
gcucuuuauaau

SEQ ID NO: 2008151 - RNA, 20 nt, Shigella flexneri 2a str. 301
gcucuuugauguacgcugcc

SEQ ID NO: 2008152 - RNA, 14 nt, Shigella flexneri 2a str. 301
gcucuuuuccagcc

SEQ ID NO: 2008153 - RNA, 16 nt, Shigella flexneri 2a str. 301
gcugaccaccagcacg

SEQ ID NO: 2008154 - RNA, 14 nt, Shigella flexneri 2a str. 301
gcugaccaccaccg

SEQ ID NO: 2008155 - RNA, 20 nt, Shigella flexneri 2a str. 301
gcugaccccaaccgcccugc

SEQ ID NO: 2008156 - RNA, 20 nt, Shigella flexneri 2a str. 301
gcugaccgcccgcuaugagc

SEQ ID NO: 2008157 - RNA, 18 nt, Shigella flexneri 2a str. 301
gcugaugccgcguuggug

SEQ ID NO: 2008158 - RNA, 12 nt, Shigella flexneri 2a str. 301
gcugaugagcaa

SEQ ID NO: 2008159 - RNA, 15 nt, Shigella flexneri 2a str. 301
gcugcacauccggua

SEQ ID NO: 2008160 - RNA, 18 nt, Shigella flexneri 2a str. 301
gcugcaccaacaucaugc

SEQ ID NO: 2008161 - RNA, 19 nt, Shigella flexneri 2a str. 301
gcugcacgccaucuggcug

SEQ ID NO: 2008162 - RNA, 20 nt, Shigella flexneri 2a str. 301
gcugcacgccaucuggcuga

SEQ ID NO: 2008163 - RNA, 22 nt, Shigella flexneri 2a str. 301
gcugcacgucauacugcucaga

SEQ ID NO: 2008164 - RNA, 17 nt, Shigella flexneri 2a str. 301
gcugcagugcaaugacu

SEQ ID NO: 2008165 - RNA, 17 nt, Shigella flexneri 2a str. 301
gcugccaggucgugcca

SEQ ID NO: 2008166 - RNA, 12 nt, Shigella flexneri 2a str. 301
gcugcauugccc

SEQ ID NO: 2008167 - RNA, 12 nt, Shigella flexneri 2a str. 301
gcugcaucugaa

SEQ ID NO: 2008168 - RNA, 14 nt, Shigella flexneri 2a str. 301
gcugcccaucaucg

SEQ ID NO: 2008169 - RNA, 23 nt, Shigella flexneri 2a str. 301
gcugucguccggcagcagaaagc

SEQ ID NO: 2008170 - RNA, 14 nt, Shigella flexneri 2a str. 301
gcugucggcacuga

SEQ ID NO: 2008171 - RNA, 13 nt, Shigella flexneri 2a str. 301
gcugucggcggcg

SEQ ID NO: 2008172 - RNA, 16 nt, Shigella flexneri 2a str. 301
gcugucuaccagcacc

SEQ ID NO: 2008173 - RNA, 20 nt, Shigella flexneri 2a str. 301
gcugugacagauuuugccag

SEQ ID NO: 2008174 - RNA, 19 nt, Shigella flexneri 2a str. 301
gcugugaaccgcacagguu

SEQ ID NO: 2008175 - RNA, 19 nt, Shigella flexneri 2a str. 301
gcuguccggcaccaucgga

SEQ ID NO: 2008176 - RNA, 20 nt, Shigella flexneri 2a str. 301
gcuguacgguaauggcaaag

SEQ ID NO: 2008177 - RNA, 14 nt, Shigella flexneri 2a str. 301
gcuguacagcagua

SEQ ID NO: 2008178 - RNA, 16 nt, Shigella flexneri 2a str. 301
gcuguacauauccagu

SEQ ID NO: 2008179 - RNA, 20 nt, Shigella flexneri 2a str. 301
gcuguaauuucacaccauca

SEQ ID NO: 2008180 - RNA, 15 nt, Shigella flexneri 2a str. 301
gcuguccuaaaaaau

SEQ ID NO: 2008181 - RNA, 19 nt, Shigella flexneri 2a str. 301
gcuguccggcgcacuggug

SEQ ID NO: 2008182 - RNA, 18 nt, Shigella flexneri 2a str. 301
aaagcuucucagagaacu

SEQ ID NO: 2008183 - RNA, 21 nt, Shigella flexneri 2a str. 301
gcuguaaaaggcgccauuuuc

SEQ ID NO: 2008184 - RNA, 23 nt, Shigella flexneri 2a str. 301
gcuguaaaaggcgccauuuucau

SEQ ID NO: 2008185 - RNA, 15 nt, Shigella flexneri 2a str. 301
gcugggauggcaaaa

SEQ ID NO: 2008186 - RNA, 16 nt, Shigella flexneri 2a str. 301
gcugggaaaucaccac

SEQ ID NO: 2008187 - RNA, 20 nt, Shigella flexneri 2a str. 301
gcugggaaaucaccaccagc

SEQ ID NO: 2008188 - RNA, 20 nt, Shigella flexneri 2a str. 301
gcuggcuuugcccuggcgcg

SEQ ID NO: 2008189 - RNA, 14 nt, Shigella flexneri 2a str. 301
gcuggcugaacauu

SEQ ID NO: 2008190 - RNA, 11 nt, Shigella flexneri 2a str. 301
gcuggcugacc

SEQ ID NO: 2008191 - RNA, 22 nt, Shigella flexneri 2a str. 301
gcuggguuucgccugccagaug

SEQ ID NO: 2008192 - RNA, 16 nt, Shigella flexneri 2a str. 301
aaagcuguaucccagc

SEQ ID NO: 2008193 - RNA, 17 nt, Shigella flexneri 2a str. 301
aaagcugucaccaauca

SEQ ID NO: 2008194 - RNA, 16 nt, Shigella flexneri 2a str. 301
gcuggguaaagacauc

SEQ ID NO: 2008195 - RNA, 16 nt, Shigella flexneri 2a str. 301
gcuggggcugagcgau

SEQ ID NO: 2008196 - RNA, 18 nt, Shigella flexneri 2a str. 301
gcugcgugaggcggucug

SEQ ID NO: 2008197 - RNA, 12 nt, Shigella flexneri 2a str. 301
gcugcgucaguu

SEQ ID NO: 2008198 - RNA, 19 nt, Shigella flexneri 2a str. 301
gcugcggcguuccccaguu

SEQ ID NO: 2008199 - RNA, 19 nt, Shigella flexneri 2a str. 301
gcugcgggaguugcuccac

SEQ ID NO: 2008200 - RNA, 18 nt, Shigella flexneri 2a str. 301
gcugcuguagcaguucca

SEQ ID NO: 2008201 - RNA, 16 nt, Shigella flexneri 2a str. 301
gcugcuguuaacuaag

SEQ ID NO: 2008202 - RNA, 17 nt, Shigella flexneri 2a str. 301
gcugcuucggucagcac

SEQ ID NO: 2008203 - RNA, 16 nt, Shigella flexneri 2a str. 301
gcugcugauccagcuu

SEQ ID NO: 2008204 - RNA, 14 nt, Shigella flexneri 2a str. 301
gcugcugauccagc

SEQ ID NO: 2008205 - RNA, 23 nt, Shigella flexneri 2a str. 301
gcugcugacuuugauccagccau

SEQ ID NO: 2008206 - RNA, 22 nt, Shigella flexneri 2a str. 301
gcuggacgcgccaacaaaugga

SEQ ID NO: 2008207 - RNA, 21 nt, Shigella flexneri 2a str. 301
gcuggacguugcguugcagca

SEQ ID NO: 2008208 - RNA, 18 nt, Shigella flexneri 2a str. 301
gcugcuuguuccacuuca

SEQ ID NO: 2008209 - RNA, 15 nt, Shigella flexneri 2a str. 301
gcugcuuuccugcug

SEQ ID NO: 2008210 - RNA, 18 nt, Shigella flexneri 2a str. 301
gcuggccgcgucuuaucc

SEQ ID NO: 2008211 - RNA, 20 nt, Shigella flexneri 2a str. 301
gcuggccccgucagcaaaau

SEQ ID NO: 2008212 - RNA, 15 nt, Shigella flexneri 2a str. 301
gcuggcccaucagaa

SEQ ID NO: 2008213 - RNA, 20 nt, Shigella flexneri 2a str. 301
gcuggcagaugcgucuucug

SEQ ID NO: 2008214 - RNA, 22 nt, Shigella flexneri 2a str. 301
gcuggcagugggccagaaaaaa

SEQ ID NO: 2008215 - RNA, 14 nt, Shigella flexneri 2a str. 301
gcuggcaggccgcg

SEQ ID NO: 2008216 - RNA, 13 nt, Shigella flexneri 2a str. 301
gcuggcagugggc

SEQ ID NO: 2008217 - RNA, 18 nt, Shigella flexneri 2a str. 301
gcuggcgaacgugcagga

SEQ ID NO: 2008218 - RNA, 17 nt, Shigella flexneri 2a str. 301
gcuggcgaacgugcagg

SEQ ID NO: 2008219 - RNA, 15 nt, Shigella flexneri 2a str. 301
gcuggcgauuccacu

SEQ ID NO: 2008220 - RNA, 13 nt, Shigella flexneri 2a str. 301
gcuggccuccagu

SEQ ID NO: 2008221 - RNA, 22 nt, Shigella flexneri 2a str. 301
gcuggccuauuaugacuccagc

SEQ ID NO: 2008222 - RNA, 15 nt, Shigella flexneri 2a str. 301
gcuggccuggcuggu

SEQ ID NO: 2008223 - RNA, 16 nt, Shigella flexneri 2a str. 301
gcuggccuggcuggug

SEQ ID NO: 2008224 - RNA, 18 nt, Shigella flexneri 2a str. 301
gcuggccuggcuggugac

SEQ ID NO: 2008225 - RNA, 23 nt, Shigella flexneri 2a str. 301
gcuggccuggcuggugacgcgcu

SEQ ID NO: 2008226 - RNA, 14 nt, Shigella flexneri 2a str. 301
gcgucccaguaacg

SEQ ID NO: 2008227 - RNA, 13 nt, Shigella flexneri 2a str. 301
gcgucccaucggc

SEQ ID NO: 2008228 - RNA, 21 nt, Shigella flexneri 2a str. 301
gcguccgcucggucacugaca

SEQ ID NO: 2008229 - RNA, 18 nt, Shigella flexneri 2a str. 301
gcgucauugacgcuggcu

SEQ ID NO: 2008230 - RNA, 21 nt, Shigella flexneri 2a str. 301
gcguccacagccaacacauuu

SEQ ID NO: 2008231 - RNA, 16 nt, Shigella flexneri 2a str. 301
gcgucgauugcucaac

SEQ ID NO: 2008232 - RNA, 20 nt, Shigella flexneri 2a str. 301
gcgucgacauagccaucccu

SEQ ID NO: 2008233 - RNA, 18 nt, Shigella flexneri 2a str. 301
gcguccggcgucgcuucu

SEQ ID NO: 2008234 - RNA, 17 nt, Shigella flexneri 2a str. 301
gcguaugcccggugcgg

SEQ ID NO: 2008235 - RNA, 14 nt, Shigella flexneri 2a str. 301
gcguaugcccagcg

SEQ ID NO: 2008236 - RNA, 15 nt, Shigella flexneri 2a str. 301
gcguaucgcccugcc

SEQ ID NO: 2008237 - RNA, 19 nt, Shigella flexneri 2a str. 301
gcguaugcagccaggccau

SEQ ID NO: 2008238 - RNA, 16 nt, Shigella flexneri 2a str. 301
gcguagugcccgcagu

SEQ ID NO: 2008239 - RNA, 16 nt, Shigella flexneri 2a str. 301
gcguagugaaggcaaa

SEQ ID NO: 2008240 - RNA, 14 nt, Shigella flexneri 2a str. 301
gcguaucacggggg

SEQ ID NO: 2008241 - RNA, 17 nt, Shigella flexneri 2a str. 301
gcguagcagcguuaaug

SEQ ID NO: 2008242 - RNA, 15 nt, Shigella flexneri 2a str. 301
gcguagccggugccg

SEQ ID NO: 2008243 - RNA, 16 nt, Shigella flexneri 2a str. 301
gcgucaacagggcaga

SEQ ID NO: 2008244 - RNA, 22 nt, Shigella flexneri 2a str. 301
gcgucaaugccgcuucgagcug

SEQ ID NO: 2008245 - RNA, 16 nt, Shigella flexneri 2a str. 301
gcgucagcaccagaga

SEQ ID NO: 2008246 - RNA, 16 nt, Shigella flexneri 2a str. 301
gcgucagcaacaugcc

SEQ ID NO: 2008247 - RNA, 14 nt, Shigella flexneri 2a str. 301
gcgucaguuuuugc

SEQ ID NO: 2008248 - RNA, 17 nt, Shigella flexneri 2a str. 301
gcgucagcuuucagaga

SEQ ID NO: 2008249 - RNA, 16 nt, Shigella flexneri 2a str. 301
gcgucagcucacaaau

SEQ ID NO: 2008250 - RNA, 13 nt, Shigella flexneri 2a str. 301
gcguggaaaccuu

SEQ ID NO: 2008251 - RNA, 20 nt, Shigella flexneri 2a str. 301
gcgugccuaauuccgcgcga

SEQ ID NO: 2008252 - RNA, 10 nt, Shigella flexneri 2a str. 301
gcgugcuaac

SEQ ID NO: 2008253 - RNA, 15 nt, Shigella flexneri 2a str. 301
gcgugcggcggugga

SEQ ID NO: 2008254 - RNA, 23 nt, Shigella flexneri 2a str. 301
gcgugaacgccuuauccggccug

SEQ ID NO: 2008255 - RNA, 15 nt, Shigella flexneri 2a str. 301
gcgugaaucaacacc

SEQ ID NO: 2008256 - RNA, 14 nt, Shigella flexneri 2a str. 301
gcgugaaucaacac

SEQ ID NO: 2008257 - RNA, 14 nt, Shigella flexneri 2a str. 301
gcgugacaccagca

SEQ ID NO: 2008258 - RNA, 12 nt, Shigella flexneri 2a str. 301
gcgugauuccag

SEQ ID NO: 2008259 - RNA, 22 nt, Shigella flexneri 2a str. 301
gcgugauucauacagcggccag

SEQ ID NO: 2008260 - RNA, 16 nt, Shigella flexneri 2a str. 301
gcgugauuguggcaau

SEQ ID NO: 2008261 - RNA, 20 nt, Shigella flexneri 2a str. 301
gcgugccacguaccaaaaca

SEQ ID NO: 2008262 - RNA, 16 nt, Shigella flexneri 2a str. 301
gcgucucauaccggau

SEQ ID NO: 2008263 - RNA, 20 nt, Shigella flexneri 2a str. 301
gcgucguucgcgccaacagc

SEQ ID NO: 2008264 - RNA, 11 nt, Shigella flexneri 2a str. 301
gcgucugggcg

SEQ ID NO: 2008265 - RNA, 18 nt, Shigella flexneri 2a str. 301
gcgucuggcccaugccag

SEQ ID NO: 2008266 - RNA, 15 nt, Shigella flexneri 2a str. 301
gcgucuuaucuggcc

SEQ ID NO: 2008267 - RNA, 17 nt, Shigella flexneri 2a str. 301
gcgucuuaucuggccua

SEQ ID NO: 2008268 - RNA, 15 nt, Shigella flexneri 2a str. 301
gcgucuuaucaggcc

SEQ ID NO: 2008269 - RNA, 11 nt, Shigella flexneri 2a str. 301
gcgucuggaag

SEQ ID NO: 2008270 - RNA, 13 nt, Shigella flexneri 2a str. 301
gcgucuggaagaa

SEQ ID NO: 2008271 - RNA, 14 nt, Shigella flexneri 2a str. 301
gcgucggaaccaca

SEQ ID NO: 2008272 - RNA, 19 nt, Shigella flexneri 2a str. 301
gcgucggcuuucagcgcga

SEQ ID NO: 2008273 - RNA, 17 nt, Shigella flexneri 2a str. 301
gcgggcaaucggcugca

SEQ ID NO: 2008274 - RNA, 14 nt, Shigella flexneri 2a str. 301
gcgggcaguaaacg

SEQ ID NO: 2008275 - RNA, 17 nt, Shigella flexneri 2a str. 301
gcgggcaucaucuuccg

SEQ ID NO: 2008276 - RNA, 21 nt, Shigella flexneri 2a str. 301
gcgggaucgccgcguagagaa

SEQ ID NO: 2008277 - RNA, 18 nt, Shigella flexneri 2a str. 301
gcggcuuauucauuacuc

SEQ ID NO: 2008278 - RNA, 22 nt, Shigella flexneri 2a str. 301
gcggcuuaccugaucgacaaaa

SEQ ID NO: 2008279 - RNA, 15 nt, Shigella flexneri 2a str. 301
gcggcuuccaccgcc

SEQ ID NO: 2008280 - RNA, 13 nt, Shigella flexneri 2a str. 301
gcggcugguuaaa

SEQ ID NO: 2008281 - RNA, 15 nt, Shigella flexneri 2a str. 301
gcggcuggcugaccu

SEQ ID NO: 2008282 - RNA, 17 nt, Shigella flexneri 2a str. 301
gcggguuaaccagcacc

SEQ ID NO: 2008283 - RNA, 17 nt, Shigella flexneri 2a str. 301
gcggguuaagcgcgcua

SEQ ID NO: 2008284 - RNA, 20 nt, Shigella flexneri 2a str. 301
gcggguaauugcuccaucca

SEQ ID NO: 2008285 - RNA, 17 nt, Shigella flexneri 2a str. 301
gcgguagcacgucaucu

SEQ ID NO: 2008286 - RNA, 14 nt, Shigella flexneri 2a str. 301
gcggguaaccagcc

SEQ ID NO: 2008287 - RNA, 21 nt, Shigella flexneri 2a str. 301
gcgggguuuuuuuaugggcac

SEQ ID NO: 2008288 - RNA, 22 nt, Shigella flexneri 2a str. 301
gcgggguuuuuuuaugggcacg

SEQ ID NO: 2008289 - RNA, 20 nt, Shigella flexneri 2a str. 301
gcggggcuaccgccagacca

SEQ ID NO: 2008290 - RNA, 18 nt, Shigella flexneri 2a str. 301
gcgggggagucgcugguu

SEQ ID NO: 2008291 - RNA, 19 nt, Shigella flexneri 2a str. 301
gcggucguaaucgcccgcu

SEQ ID NO: 2008292 - RNA, 17 nt, Shigella flexneri 2a str. 301
gcggucguaaucgcccg

SEQ ID NO: 2008293 - RNA, 21 nt, Shigella flexneri 2a str. 301
gcggugccauuaaaccaacaa

SEQ ID NO: 2008294 - RNA, 14 nt, Shigella flexneri 2a str. 301
gcggugaccagcag

SEQ ID NO: 2008295 - RNA, 16 nt, Shigella flexneri 2a str. 301
gcgguggauaaagcac

SEQ ID NO: 2008296 - RNA, 20 nt, Shigella flexneri 2a str. 301
gcggugucaauucccgagcu

SEQ ID NO: 2008297 - RNA, 16 nt, Shigella flexneri 2a str. 301
gcgguggcuucgccuu

SEQ ID NO: 2008298 - RNA, 16 nt, Shigella flexneri 2a str. 301
gcgguggucgaugccc

SEQ ID NO: 2008299 - RNA, 13 nt, Shigella flexneri 2a str. 301
gcgguugauccuc

SEQ ID NO: 2008300 - RNA, 23 nt, Shigella flexneri 2a str. 301
gcgguuggcaaucaguuuuuguu

SEQ ID NO: 2008301 - RNA, 17 nt, Shigella flexneri 2a str. 301
gcgguugacggaaagca

SEQ ID NO: 2008302 - RNA, 17 nt, Shigella flexneri 2a str. 301
gcgguuuucucuuguuc

SEQ ID NO: 2008303 - RNA, 16 nt, Shigella flexneri 2a str. 301
gcguaaauccagcggc

SEQ ID NO: 2008304 - RNA, 22 nt, Shigella flexneri 2a str. 301
gcguaagcgcauccggcaccag

SEQ ID NO: 2008305 - RNA, 21 nt, Shigella flexneri 2a str. 301
gcguacaauagccacauugcu

SEQ ID NO: 2008306 - RNA, 13 nt, Shigella flexneri 2a str. 301
gcguacagcgagg

SEQ ID NO: 2008307 - RNA, 14 nt, Shigella flexneri 2a str. 301
gcggcgacaauaau

SEQ ID NO: 2008308 - RNA, 18 nt, Shigella flexneri 2a str. 301
gcggcgaaccagccguug

SEQ ID NO: 2008309 - RNA, 20 nt, Shigella flexneri 2a str. 301
gcggcgauauccagcgcggc

SEQ ID NO: 2008310 - RNA, 17 nt, Shigella flexneri 2a str. 301
gcggcgauauccagcgc

SEQ ID NO: 2008311 - RNA, 18 nt, Shigella flexneri 2a str. 301
gcggcgaacuuaaucauc

SEQ ID NO: 2008312 - RNA, 23 nt, Shigella flexneri 2a str. 301
gcggcgaaaacgccacauccggc

SEQ ID NO: 2008313 - RNA, 14 nt, Shigella flexneri 2a str. 301
gcggcagguugaug

SEQ ID NO: 2008314 - RNA, 18 nt, Shigella flexneri 2a str. 301
gcggcaguaagcgcggcu

SEQ ID NO: 2008315 - RNA, 19 nt, Shigella flexneri 2a str. 301
gcggcaguaaauauugucu

SEQ ID NO: 2008316 - RNA, 24 nt, Shigella flexneri 2a str. 301
gcggcacugcucuuuaacaauuua

SEQ ID NO: 2008317 - RNA, 19 nt, Shigella flexneri 2a str. 301
gcggcaauuagcggcuggc

SEQ ID NO: 2008318 - RNA, 21 nt, Shigella flexneri 2a str. 301
gcggcaauuagcggcuggcug

SEQ ID NO: 2008319 - RNA, 23 nt, Shigella flexneri 2a str. 301
gcggcaauuagcggccagcgggc

SEQ ID NO: 2008320 - RNA, 18 nt, Shigella flexneri 2a str. 301
gcggcaauuagcggcugg

SEQ ID NO: 2008321 - RNA, 16 nt, Shigella flexneri 2a str. 301
gcggcacagaaacgcc

SEQ ID NO: 2008322 - RNA, 21 nt, Shigella flexneri 2a str. 301
gcggcacacagcacggcagca

SEQ ID NO: 2008323 - RNA, 19 nt, Shigella flexneri 2a str. 301
gcggcaauucuuucucgcu

SEQ ID NO: 2008324 - RNA, 19 nt, Shigella flexneri 2a str. 301
gcggcaauccccgccagca

SEQ ID NO: 2008325 - RNA, 13 nt, Shigella flexneri 2a str. 301
gcggcaaucgcca

SEQ ID NO: 2008326 - RNA, 17 nt, Shigella flexneri 2a str. 301
gcggcaaucgccagaau

SEQ ID NO: 2008327 - RNA, 14 nt, Shigella flexneri 2a str. 301
gcggcaaucgccag

SEQ ID NO: 2008328 - RNA, 15 nt, Shigella flexneri 2a str. 301
gcggcaaucgcugcu

SEQ ID NO: 2008329 - RNA, 12 nt, Shigella flexneri 2a str. 301
gcggcaauggcu

SEQ ID NO: 2008330 - RNA, 13 nt, Shigella flexneri 2a str. 301
gcggcaagaucgc

SEQ ID NO: 2008331 - RNA, 16 nt, Shigella flexneri 2a str. 301
gcggauggccucugcc

SEQ ID NO: 2008332 - RNA, 22 nt, Shigella flexneri 2a str. 301
gcggauaucuacaaaaccacac

SEQ ID NO: 2008333 - RNA, 14 nt, Shigella flexneri 2a str. 301
gcggauauaaaauu

SEQ ID NO: 2008334 - RNA, 19 nt, Shigella flexneri 2a str. 301
gcggaucaguuccagcagc

SEQ ID NO: 2008335 - RNA, 15 nt, Shigella flexneri 2a str. 301
gcggaugacccagcg

SEQ ID NO: 2008336 - RNA, 15 nt, Shigella flexneri 2a str. 301
gcggaggggcggcuc

SEQ ID NO: 2008337 - RNA, 21 nt, Shigella flexneri 2a str. 301
gcggaguaaucgccagcaaaa

SEQ ID NO: 2008338 - RNA, 15 nt, Shigella flexneri 2a str. 301
gcggaguaaucgcca

SEQ ID NO: 2008339 - RNA, 13 nt, Shigella flexneri 2a str. 301
gcggauaaagcag

SEQ ID NO: 2008340 - RNA, 19 nt, Shigella flexneri 2a str. 301
gcggauaaagcagagcagg

SEQ ID NO: 2008341 - RNA, 23 nt, Shigella flexneri 2a str. 301
gcggacagccauccgucauccau

SEQ ID NO: 2008342 - RNA, 14 nt, Shigella flexneri 2a str. 301
gcggacugaauacg

SEQ ID NO: 2008343 - RNA, 20 nt, Shigella flexneri 2a str. 301
gcggacugaauacgcuggcg

SEQ ID NO: 2008344 - RNA, 19 nt, Shigella flexneri 2a str. 301
gcgcuuucauggugagccu

SEQ ID NO: 2008345 - RNA, 20 nt, Shigella flexneri 2a str. 301
gcgcuuucagcacgacauaa

SEQ ID NO: 2008346 - RNA, 19 nt, Shigella flexneri 2a str. 301
gcggaauugguagacgcgc

SEQ ID NO: 2008347 - RNA, 22 nt, Shigella flexneri 2a str. 301
gcgcuuuuggcaggaacugcuc

SEQ ID NO: 2008348 - RNA, 17 nt, Shigella flexneri 2a str. 301
gcgcuugcucuaacggu

SEQ ID NO: 2008349 - RNA, 16 nt, Shigella flexneri 2a str. 301
gcgcuuccagcuccau

SEQ ID NO: 2008350 - RNA, 13 nt, Shigella flexneri 2a str. 301
gcgcuuccagcuc

SEQ ID NO: 2008351 - RNA, 14 nt, Shigella flexneri 2a str. 301
gcgcuuccagcucc

SEQ ID NO: 2008352 - RNA, 12 nt, Shigella flexneri 2a str. 301
gcgcuuccugca

SEQ ID NO: 2008353 - RNA, 20 nt, Shigella flexneri 2a str. 301
gcgcugaagaaaauggccag

SEQ ID NO: 2008354 - RNA, 22 nt, Shigella flexneri 2a str. 301
gcgcugaagaaaauggccagcc

SEQ ID NO: 2008355 - RNA, 15 nt, Shigella flexneri 2a str. 301
gcgcugaaagaagcg

SEQ ID NO: 2008356 - RNA, 22 nt, Shigella flexneri 2a str. 301
gcgcggaaagcaccugcgcagg

SEQ ID NO: 2008357 - RNA, 18 nt, Shigella flexneri 2a str. 301
gcgcggauccacaccuga

SEQ ID NO: 2008358 - RNA, 12 nt, Shigella flexneri 2a str. 301
gcgcgcccgccg

SEQ ID NO: 2008359 - RNA, 21 nt, Shigella flexneri 2a str. 301
gcgcgcccgauuaacuggggc

SEQ ID NO: 2008360 - RNA, 20 nt, Shigella flexneri 2a str. 301
gcgcgaauggaaagcccgcc

SEQ ID NO: 2008361 - RNA, 19 nt, Shigella flexneri 2a str. 301
gcgcgaauggaaagcccgc

SEQ ID NO: 2008362 - RNA, 13 nt, Shigella flexneri 2a str. 301
gcgcgagcaggcc

SEQ ID NO: 2008363 - RNA, 15 nt, Shigella flexneri 2a str. 301
gcgcgcaggcgcuga

SEQ ID NO: 2008364 - RNA, 15 nt, Shigella flexneri 2a str. 301
gcgcgaacugucggu

SEQ ID NO: 2008365 - RNA, 13 nt, Shigella flexneri 2a str. 301
gcgaucauuagcc

SEQ ID NO: 2008366 - RNA, 17 nt, Shigella flexneri 2a str. 301
gcgcguccgcagacacu

SEQ ID NO: 2008367 - RNA, 19 nt, Shigella flexneri 2a str. 301
gcgcgguaucaccacccag

SEQ ID NO: 2008368 - RNA, 20 nt, Shigella flexneri 2a str. 301
gcgcgguaaaguuuggcugu

SEQ ID NO: 2008369 - RNA, 18 nt, Shigella flexneri 2a str. 301
gcgcgggcgauaaucuca

SEQ ID NO: 2008370 - RNA, 12 nt, Shigella flexneri 2a str. 301
gcgcgugaagug

SEQ ID NO: 2008371 - RNA, 22 nt, Shigella flexneri 2a str. 301
gcgcguuuuucuucagccccuc

SEQ ID NO: 2008372 - RNA, 14 nt, Shigella flexneri 2a str. 301
gcgcuaaccgccug

SEQ ID NO: 2008373 - RNA, 14 nt, Shigella flexneri 2a str. 301
gcgcucagccagcc

SEQ ID NO: 2008374 - RNA, 23 nt, Shigella flexneri 2a str. 301
gcgcucccgcaggagcgccgaau

SEQ ID NO: 2008375 - RNA, 14 nt, Shigella flexneri 2a str. 301
gcgcucccgcagga

SEQ ID NO: 2008376 - RNA, 16 nt, Shigella flexneri 2a str. 301
gcgcucauuuucucuu

SEQ ID NO: 2008377 - RNA, 23 nt, Shigella flexneri 2a str. 301
gcgcuagcuucagguguuagugu

SEQ ID NO: 2008378 - RNA, 23 nt, Shigella flexneri 2a str. 301
gcgcuacggcugauggcgccagu

SEQ ID NO: 2008379 - RNA, 19 nt, Shigella flexneri 2a str. 301
gcgcuacgcuaucagaccu

SEQ ID NO: 2008380 - RNA, 14 nt, Shigella flexneri 2a str. 301
gcgcuagccucagg

SEQ ID NO: 2008381 - RNA, 23 nt, Shigella flexneri 2a str. 301
gcgcuagccucagguguuagugu

SEQ ID NO: 2008382 - RNA, 22 nt, Shigella flexneri 2a str. 301
gcaacuuaaucaucaaugccag

SEQ ID NO: 2008383 - RNA, 23 nt, Shigella flexneri 2a str. 301
gcaacuucucuuucggcagugcc

SEQ ID NO: 2008384 - RNA, 15 nt, Shigella flexneri 2a str. 301
gcaagaccgcgacca

SEQ ID NO: 2008385 - RNA, 18 nt, Shigella flexneri 2a str. 301
aaagcgcugaagaaaaug

SEQ ID NO: 2008386 - RNA, 21 nt, Shigella flexneri 2a str. 301
aaagcggcccuuuuuuuacuu

SEQ ID NO: 2008387 - RNA, 16 nt, Shigella flexneri 2a str. 301
aaagcggcccuuuuuu

SEQ ID NO: 2008388 - RNA, 22 nt, Shigella flexneri 2a str. 301
gcaacuguaacgcagaagguua

SEQ ID NO: 2008389 - RNA, 15 nt, Shigella flexneri 2a str. 301
gcaacuguaacgcag

SEQ ID NO: 2008390 - RNA, 16 nt, Shigella flexneri 2a str. 301
gcaacuggagcaggaa

SEQ ID NO: 2008391 - RNA, 17 nt, Shigella flexneri 2a str. 301
gcaacugacuggcucuu

SEQ ID NO: 2008392 - RNA, 18 nt, Shigella flexneri 2a str. 301
gcaacugacugacuucaa

SEQ ID NO: 2008393 - RNA, 20 nt, Shigella flexneri 2a str. 301
gcaacucauuuacagaaacu

SEQ ID NO: 2008394 - RNA, 21 nt, Shigella flexneri 2a str. 301
aaagcgagcaguacagccgcc

SEQ ID NO: 2008395 - RNA, 15 nt, Shigella flexneri 2a str. 301
aaagcgcaccugauc

SEQ ID NO: 2008396 - RNA, 21 nt, Shigella flexneri 2a str. 301
aaagcgcacuuugucaaaaau

SEQ ID NO: 2008397 - RNA, 23 nt, Shigella flexneri 2a str. 301
aaagcgcaggccaacagucuuaa

SEQ ID NO: 2008398 - RNA, 23 nt, Shigella flexneri 2a str. 301
aaagcgcggcagugacugcccca

SEQ ID NO: 2008399 - RNA, 20 nt, Shigella flexneri 2a str. 301
aaagcgcgguuucaauuucc

SEQ ID NO: 2008400 - RNA, 23 nt, Shigella flexneri 2a str. 301
aaagcgcaaaauaccagcaauuu

SEQ ID NO: 2008401 - RNA, 19 nt, Shigella flexneri 2a str. 301
aaagcgacuuugccuggcg

SEQ ID NO: 2008402 - RNA, 13 nt, Shigella flexneri 2a str. 301
gcaacgcggcggu

SEQ ID NO: 2008403 - RNA, 23 nt, Shigella flexneri 2a str. 301
gcaacgccuaaacuaaucgacag

SEQ ID NO: 2008404 - RNA, 22 nt, Shigella flexneri 2a str. 301
gcaacgccuuugucgggcaggc

SEQ ID NO: 2008405 - RNA, 20 nt, Shigella flexneri 2a str. 301
gcaacgccguaagcgcggag

SEQ ID NO: 2008406 - RNA, 20 nt, Shigella flexneri 2a str. 301
gcaacgccccuucugccgca

SEQ ID NO: 2008407 - RNA, 20 nt, Shigella flexneri 2a str. 301
gcaacgguugcggaacccag

SEQ ID NO: 2008408 - RNA, 14 nt, Shigella flexneri 2a str. 301
gcaacggugcggcu

SEQ ID NO: 2008409 - RNA, 15 nt, Shigella flexneri 2a str. 301
gcaacgucaguaacc

SEQ ID NO: 2008410 - RNA, 18 nt, Shigella flexneri 2a str. 301
gcaacguccugagcauuu

SEQ ID NO: 2008411 - RNA, 15 nt, Shigella flexneri 2a str. 301
gcaacguccugcaac

SEQ ID NO: 2008412 - RNA, 13 nt, Shigella flexneri 2a str. 301
gcaacguuccagc

SEQ ID NO: 2008413 - RNA, 14 nt, Shigella flexneri 2a str. 301
gcaacguuccagca

SEQ ID NO: 2008414 - RNA, 15 nt, Shigella flexneri 2a str. 301
gcaaccuuuugcgcu

SEQ ID NO: 2008415 - RNA, 19 nt, Shigella flexneri 2a str. 301
gcaacgaacuaaccgcgcu

SEQ ID NO: 2008416 - RNA, 21 nt, Shigella flexneri 2a str. 301
gcaacgacaccguuaaauaac

SEQ ID NO: 2008417 - RNA, 22 nt, Shigella flexneri 2a str. 301
gcaacgagacgguuaaaaacag

SEQ ID NO: 2008418 - RNA, 22 nt, Shigella flexneri 2a str. 301
gcaaccggggcauucaugaaca

SEQ ID NO: 2008419 - RNA, 17 nt, Shigella flexneri 2a str. 301
gcaaccgguaaagaaga

SEQ ID NO: 2008420 - RNA, 19 nt, Shigella flexneri 2a str. 301
gcaaccgguaaagaagagc

SEQ ID NO: 2008421 - RNA, 14 nt, Shigella flexneri 2a str. 301
gcaaccggcgcggc

SEQ ID NO: 2008422 - RNA, 19 nt, Shigella flexneri 2a str. 301
gcaauacccugacccagac

SEQ ID NO: 2008423 - RNA, 14 nt, Shigella flexneri 2a str. 301
gcaauaccaucacc

SEQ ID NO: 2008424 - RNA, 18 nt, Shigella flexneri 2a str. 301
gcaauaccauuuacaagc

SEQ ID NO: 2008425 - RNA, 14 nt, Shigella flexneri 2a str. 301
gcaauacguuucau

SEQ ID NO: 2008426 - RNA, 19 nt, Shigella flexneri 2a str. 301
gcaauagacaguucuuccu

SEQ ID NO: 2008427 - RNA, 15 nt, Shigella flexneri 2a str. 301
gcaauaaucucuaca

SEQ ID NO: 2008428 - RNA, 20 nt, Shigella flexneri 2a str. 301
gcaauacagguuucaaugca

SEQ ID NO: 2008429 - RNA, 22 nt, Shigella flexneri 2a str. 301
gcaauaacucuuugaugaaaca

SEQ ID NO: 2008430 - RNA, 14 nt, Shigella flexneri 2a str. 301
gcaauauuacuuca

SEQ ID NO: 2008431 - RNA, 18 nt, Shigella flexneri 2a str. 301
gcaauauucuuuugcagc

SEQ ID NO: 2008432 - RNA, 16 nt, Shigella flexneri 2a str. 301
gcaauauucuuuugca

SEQ ID NO: 2008433 - RNA, 19 nt, Shigella flexneri 2a str. 301
gcaauauauugaauuugca

SEQ ID NO: 2008434 - RNA, 20 nt, Shigella flexneri 2a str. 301
gcaauauauugaauuugcau

SEQ ID NO: 2008435 - RNA, 20 nt, Shigella flexneri 2a str. 301
gcaauagauugaauuagcaa

SEQ ID NO: 2008436 - RNA, 22 nt, Shigella flexneri 2a str. 301
gcaauagcggacacuaccauuu

SEQ ID NO: 2008437 - RNA, 23 nt, Shigella flexneri 2a str. 301
gcaaguaauaauaucuccagcua

SEQ ID NO: 2008438 - RNA, 15 nt, Shigella flexneri 2a str. 301
gcaaguaauaauauc

SEQ ID NO: 2008439 - RNA, 16 nt, Shigella flexneri 2a str. 301
gcaaguagcgccauac

SEQ ID NO: 2008440 - RNA, 24 nt, Shigella flexneri 2a str. 301
gcaagguggucagacggaacaucu

SEQ ID NO: 2008441 - RNA, 12 nt, Shigella flexneri 2a str. 301
gcaagguugaag

SEQ ID NO: 2008442 - RNA, 16 nt, Shigella flexneri 2a str. 301
gcaaguccccaguaau

SEQ ID NO: 2008443 - RNA, 18 nt, Shigella flexneri 2a str. 301
gcaagucggcaucgccac

SEQ ID NO: 2008444 - RNA, 14 nt, Shigella flexneri 2a str. 301
gcaauaaaacaggg

SEQ ID NO: 2008445 - RNA, 22 nt, Shigella flexneri 2a str. 301
gcaagugcggcgcaccagcagg

SEQ ID NO: 2008446 - RNA, 13 nt, Shigella flexneri 2a str. 301
gcaauaacacgcg

SEQ ID NO: 2008447 - RNA, 18 nt, Shigella flexneri 2a str. 301
gcaauaaaauaucuucca

SEQ ID NO: 2008448 - RNA, 19 nt, Shigella flexneri 2a str. 301
gcaauaaaauaucuuccac

SEQ ID NO: 2008449 - RNA, 17 nt, Shigella flexneri 2a str. 301
gcaauaaacaugaugau

SEQ ID NO: 2008450 - RNA, 17 nt, Shigella flexneri 2a str. 301
gcaaggcaaucugcucu

SEQ ID NO: 2008451 - RNA, 14 nt, Shigella flexneri 2a str. 301
gcaaggccauccgc

SEQ ID NO: 2008452 - RNA, 22 nt, Shigella flexneri 2a str. 301
gcaaggaaacuaaacgccgcgc

SEQ ID NO: 2008453 - RNA, 13 nt, Shigella flexneri 2a str. 301
gcaaggaaauaau

SEQ ID NO: 2008454 - RNA, 16 nt, Shigella flexneri 2a str. 301
gcaagggccgcagcuu

SEQ ID NO: 2008455 - RNA, 23 nt, Shigella flexneri 2a str. 301
gcaaggugaaagcaauuaacagu

SEQ ID NO: 2008456 - RNA, 13 nt, Shigella flexneri 2a str. 301
gcaaggcgcgggu

SEQ ID NO: 2008457 - RNA, 21 nt, Shigella flexneri 2a str. 301
gcaaggcgagcgcggcuggcu

SEQ ID NO: 2008458 - RNA, 20 nt, Shigella flexneri 2a str. 301
gcaaggcuuucacgucagga

SEQ ID NO: 2008459 - RNA, 19 nt, Shigella flexneri 2a str. 301
gcaaggcuauucagcaguu

SEQ ID NO: 2008460 - RNA, 18 nt, Shigella flexneri 2a str. 301
gcaaggcuggcgucacua

SEQ ID NO: 2008461 - RNA, 14 nt, Shigella flexneri 2a str. 301
gcaagagcaaauaa

SEQ ID NO: 2008462 - RNA, 17 nt, Shigella flexneri 2a str. 301
gcaagacgaaaaaugaa

SEQ ID NO: 2008463 - RNA, 21 nt, Shigella flexneri 2a str. 301
gcaagacgaugacauuaucug

SEQ ID NO: 2008464 - RNA, 16 nt, Shigella flexneri 2a str. 301
gcaagaucgcucauca

SEQ ID NO: 2008465 - RNA, 19 nt, Shigella flexneri 2a str. 301
gcaagaucgcucaucagcu

SEQ ID NO: 2008466 - RNA, 21 nt, Shigella flexneri 2a str. 301
gcaagaggguuauuuguucag

SEQ ID NO: 2008467 - RNA, 20 nt, Shigella flexneri 2a str. 301
gcaagauuuuguaggucgga

SEQ ID NO: 2008468 - RNA, 11 nt, Shigella flexneri 2a str. 301
gcaagcaaaug

SEQ ID NO: 2008469 - RNA, 15 nt, Shigella flexneri 2a str. 301
gcaagaugaauaaug

SEQ ID NO: 2008470 - RNA, 15 nt, Shigella flexneri 2a str. 301
gcaagccacaauaaa

SEQ ID NO: 2008471 - RNA, 17 nt, Shigella flexneri 2a str. 301
gcaagcgacucgguugc

SEQ ID NO: 2008472 - RNA, 21 nt, Shigella flexneri 2a str. 301
gcaaucagauaaaauacacuu

SEQ ID NO: 2008473 - RNA, 15 nt, Shigella flexneri 2a str. 301
gcaaucacuuccuca

SEQ ID NO: 2008474 - RNA, 14 nt, Shigella flexneri 2a str. 301
gcaaucacuuccuc

SEQ ID NO: 2008475 - RNA, 12 nt, Shigella flexneri 2a str. 301
gcaaucaccacc

SEQ ID NO: 2008476 - RNA, 20 nt, Shigella flexneri 2a str. 301
gcaaucacugccagaauagc

SEQ ID NO: 2008477 - RNA, 22 nt, Shigella flexneri 2a str. 301
gcaauccgccgucgggucagcu

SEQ ID NO: 2008478 - RNA, 14 nt, Shigella flexneri 2a str. 301
gcaaucgaccaggc

SEQ ID NO: 2008479 - RNA, 14 nt, Shigella flexneri 2a str. 301
gcaauccagcucuu

SEQ ID NO: 2008480 - RNA, 17 nt, Shigella flexneri 2a str. 301
gcaaucauucccagacc

SEQ ID NO: 2008481 - RNA, 18 nt, Shigella flexneri 2a str. 301
gcaaucauauucaccacg

SEQ ID NO: 2008482 - RNA, 17 nt, Shigella flexneri 2a str. 301
gcaaucauauucaccac

SEQ ID NO: 2008483 - RNA, 14 nt, Shigella flexneri 2a str. 301
gcaaucaucccagu

SEQ ID NO: 2008484 - RNA, 22 nt, Shigella flexneri 2a str. 301
gcaaugagagggcgauaaaucu

SEQ ID NO: 2008485 - RNA, 18 nt, Shigella flexneri 2a str. 301
gcaaugaguggugaaaaa

SEQ ID NO: 2008486 - RNA, 14 nt, Shigella flexneri 2a str. 301
gcaaugaucucaau

SEQ ID NO: 2008487 - RNA, 16 nt, Shigella flexneri 2a str. 301
gcaaugccauccagcu

SEQ ID NO: 2008488 - RNA, 13 nt, Shigella flexneri 2a str. 301
gcaaugcaggcac

SEQ ID NO: 2008489 - RNA, 22 nt, Shigella flexneri 2a str. 301
gcaaucgaccaggccaucagca

SEQ ID NO: 2008490 - RNA, 20 nt, Shigella flexneri 2a str. 301
gcaaucgagcccagaugccg

SEQ ID NO: 2008491 - RNA, 18 nt, Shigella flexneri 2a str. 301
gcaaucgaguuugccgcu

SEQ ID NO: 2008492 - RNA, 16 nt, Shigella flexneri 2a str. 301
gcaaucgcauagccag

SEQ ID NO: 2008493 - RNA, 22 nt, Shigella flexneri 2a str. 301
gcaaucgcccagcgcguaaaua

SEQ ID NO: 2008494 - RNA, 15 nt, Shigella flexneri 2a str. 301
gcaaucgccccuucg

SEQ ID NO: 2008495 - RNA, 13 nt, Shigella flexneri 2a str. 301
gcaaucgccucca

SEQ ID NO: 2008496 - RNA, 20 nt, Shigella flexneri 2a str. 301
gcaaucggugcaaaugccag

SEQ ID NO: 2008497 - RNA, 18 nt, Shigella flexneri 2a str. 301
gcaaucguagcccagcuc

SEQ ID NO: 2008498 - RNA, 14 nt, Shigella flexneri 2a str. 301
gcaaucugcuggca

SEQ ID NO: 2008499 - RNA, 17 nt, Shigella flexneri 2a str. 301
gcaaucuuaggggacau

SEQ ID NO: 2008500 - RNA, 21 nt, Shigella flexneri 2a str. 301
gcaaucuuuagcauaaaaacu

SEQ ID NO: 2008501 - RNA, 18 nt, Shigella flexneri 2a str. 301
gcaaugcguagcugagca

SEQ ID NO: 2008502 - RNA, 18 nt, Shigella flexneri 2a str. 301
gcaaugcggagguuucuu

SEQ ID NO: 2008503 - RNA, 18 nt, Shigella flexneri 2a str. 301
gcaauggaaaaaguuuua

SEQ ID NO: 2008504 - RNA, 15 nt, Shigella flexneri 2a str. 301
gcaauggaaaaaguu

SEQ ID NO: 2008505 - RNA, 20 nt, Shigella flexneri 2a str. 301
gcaauggucgcaucauuuaa

SEQ ID NO: 2008506 - RNA, 17 nt, Shigella flexneri 2a str. 301
gcaauguguggaugccu

SEQ ID NO: 2008507 - RNA, 17 nt, Shigella flexneri 2a str. 301
gcaauggcuggccccgu

SEQ ID NO: 2008508 - RNA, 15 nt, Shigella flexneri 2a str. 301
gcaaugucaucagca

SEQ ID NO: 2008509 - RNA, 13 nt, Shigella flexneri 2a str. 301
gcaauucaauuaa

SEQ ID NO: 2008510 - RNA, 16 nt, Shigella flexneri 2a str. 301
gcaauuccagcgccag

SEQ ID NO: 2008511 - RNA, 17 nt, Shigella flexneri 2a str. 301
gcaauuccagcgccagu

SEQ ID NO: 2008512 - RNA, 14 nt, Shigella flexneri 2a str. 301
gcaauuccaucaua

SEQ ID NO: 2008513 - RNA, 16 nt, Shigella flexneri 2a str. 301
gcaauuagcggcuggc

SEQ ID NO: 2008514 - RNA, 17 nt, Shigella flexneri 2a str. 301
gcaauugccagacaaca

SEQ ID NO: 2008515 - RNA, 17 nt, Shigella flexneri 2a str. 301
gcaauuggcgcaucaug

SEQ ID NO: 2008516 - RNA, 18 nt, Shigella flexneri 2a str. 301
gcaauuggugcacgaugc

SEQ ID NO: 2008517 - RNA, 19 nt, Shigella flexneri 2a str. 301
gcaauuucacguucaccca

SEQ ID NO: 2008518 - RNA, 14 nt, Shigella flexneri 2a str. 301
gcaauucccagaau

SEQ ID NO: 2008519 - RNA, 13 nt, Shigella flexneri 2a str. 301
gcaauucuuucuc

SEQ ID NO: 2008520 - RNA, 17 nt, Shigella flexneri 2a str. 301
gcaauugucgcagaagc

SEQ ID NO: 2008521 - RNA, 13 nt, Shigella flexneri 2a str. 301
gcaauuuccauug

SEQ ID NO: 2008522 - RNA, 21 nt, Shigella flexneri 2a str. 301
gcacaaacauccaucugcuuu

SEQ ID NO: 2008523 - RNA, 20 nt, Shigella flexneri 2a str. 301
gcacaaacauccaucugcuu

SEQ ID NO: 2008524 - RNA, 13 nt, Shigella flexneri 2a str. 301
gcaauuuuuugcg

SEQ ID NO: 2008525 - RNA, 14 nt, Shigella flexneri 2a str. 301
gcacaaaacagguc

SEQ ID NO: 2008526 - RNA, 14 nt, Shigella flexneri 2a str. 301
gcacaaaaccugcc

SEQ ID NO: 2008527 - RNA, 23 nt, Shigella flexneri 2a str. 301
gcacaggcgcuggguaaagagcg

SEQ ID NO: 2008528 - RNA, 15 nt, Shigella flexneri 2a str. 301
gcacaggcugcccag

SEQ ID NO: 2008529 - RNA, 15 nt, Shigella flexneri 2a str. 301
gcacaguacgcgccc

SEQ ID NO: 2008530 - RNA, 16 nt, Shigella flexneri 2a str. 301
gcacagccagcgcugg

SEQ ID NO: 2008531 - RNA, 22 nt, Shigella flexneri 2a str. 301
gcacauugccguaauggucugc

SEQ ID NO: 2008532 - RNA, 16 nt, Shigella flexneri 2a str. 301
gcacauugugcgccau

SEQ ID NO: 2008533 - RNA, 12 nt, Shigella flexneri 2a str. 301
gcaccaaaagca

SEQ ID NO: 2008534 - RNA, 17 nt, Shigella flexneri 2a str. 301
gcacaugaugauggcua

SEQ ID NO: 2008535 - RNA, 14 nt, Shigella flexneri 2a str. 301
gcacauagcaacuu

SEQ ID NO: 2008536 - RNA, 17 nt, Shigella flexneri 2a str. 301
gcacauaagucagcccg

SEQ ID NO: 2008537 - RNA, 22 nt, Shigella flexneri 2a str. 301
gcacaucaauuugcccaccggu

SEQ ID NO: 2008538 - RNA, 15 nt, Shigella flexneri 2a str. 301
gcacauagcaccacc

SEQ ID NO: 2008539 - RNA, 16 nt, Shigella flexneri 2a str. 301
gcacaucaucaaagcc

SEQ ID NO: 2008540 - RNA, 17 nt, Shigella flexneri 2a str. 301
gcacaucaucaaagcca

SEQ ID NO: 2008541 - RNA, 18 nt, Shigella flexneri 2a str. 301
gcacacaagcguaagaga

SEQ ID NO: 2008542 - RNA, 23 nt, Shigella flexneri 2a str. 301
gcacaaugcuuaaucgcggcggg

SEQ ID NO: 2008543 - RNA, 14 nt, Shigella flexneri 2a str. 301
gcacaaugccugau

SEQ ID NO: 2008544 - RNA, 11 nt, Shigella flexneri 2a str. 301
gcacacacugc

SEQ ID NO: 2008545 - RNA, 17 nt, Shigella flexneri 2a str. 301
gcacaauacauagaaac

SEQ ID NO: 2008546 - RNA, 18 nt, Shigella flexneri 2a str. 301
gcacaauacauagaaacu

SEQ ID NO: 2008547 - RNA, 16 nt, Shigella flexneri 2a str. 301
gcacaaguuguuuaca

SEQ ID NO: 2008548 - RNA, 16 nt, Shigella flexneri 2a str. 301
gcacaagcuaccagcc

SEQ ID NO: 2008549 - RNA, 19 nt, Shigella flexneri 2a str. 301
gcacaagggugagggagga

SEQ ID NO: 2008550 - RNA, 23 nt, Shigella flexneri 2a str. 301
gcacaaguuuuuaggcaugauaa

SEQ ID NO: 2008551 - RNA, 14 nt, Shigella flexneri 2a str. 301
gcacaaucacguca

SEQ ID NO: 2008552 - RNA, 16 nt, Shigella flexneri 2a str. 301
gcacaaaguggcggcu

SEQ ID NO: 2008553 - RNA, 21 nt, Shigella flexneri 2a str. 301
gcacaaagcgaugaugcugua

SEQ ID NO: 2008554 - RNA, 18 nt, Shigella flexneri 2a str. 301
gcacaaauagccagcaga

SEQ ID NO: 2008555 - RNA, 16 nt, Shigella flexneri 2a str. 301
gcacaaauagccagca

SEQ ID NO: 2008556 - RNA, 22 nt, Shigella flexneri 2a str. 301
gcacaaauagccagcagagcaa

SEQ ID NO: 2008557 - RNA, 15 nt, Shigella flexneri 2a str. 301
gcacaaauuugccgu

SEQ ID NO: 2008558 - RNA, 15 nt, Shigella flexneri 2a str. 301
gcacaacucggcggc

SEQ ID NO: 2008559 - RNA, 16 nt, Shigella flexneri 2a str. 301
gcacaagcccaugcac

SEQ ID NO: 2008560 - RNA, 21 nt, Shigella flexneri 2a str. 301
gcacagacuuaauauugccgu

SEQ ID NO: 2008561 - RNA, 12 nt, Shigella flexneri 2a str. 301
gcacacuuagcc

SEQ ID NO: 2008562 - RNA, 19 nt, Shigella flexneri 2a str. 301
gcacacuuagccuguguca

SEQ ID NO: 2008563 - RNA, 21 nt, Shigella flexneri 2a str. 301
gcacacuguucauuaaagccg

SEQ ID NO: 2008564 - RNA, 22 nt, Shigella flexneri 2a str. 301
gcacacugguucccaacaacag

SEQ ID NO: 2008565 - RNA, 21 nt, Shigella flexneri 2a str. 301
gcacacugguucccaacaaca

SEQ ID NO: 2008566 - RNA, 21 nt, Shigella flexneri 2a str. 301
gcacagaacaaaauguuuaug

SEQ ID NO: 2008567 - RNA, 18 nt, Shigella flexneri 2a str. 301
gcacacuuuucuuuagcg

SEQ ID NO: 2008568 - RNA, 17 nt, Shigella flexneri 2a str. 301
gcacacugguucccaac

SEQ ID NO: 2008569 - RNA, 16 nt, Shigella flexneri 2a str. 301
gcacacggauauugcu

SEQ ID NO: 2008570 - RNA, 16 nt, Shigella flexneri 2a str. 301
gcacacguaggccaac

SEQ ID NO: 2008571 - RNA, 16 nt, Shigella flexneri 2a str. 301
gcacaccccggcggcc

SEQ ID NO: 2008572 - RNA, 20 nt, Shigella flexneri 2a str. 301
gcacaccccgcgcagcugag

SEQ ID NO: 2008573 - RNA, 22 nt, Shigella flexneri 2a str. 301
gcacaccaggcucuuuaaacag

SEQ ID NO: 2008574 - RNA, 17 nt, Shigella flexneri 2a str. 301
gcacaccaaccgcuucc

SEQ ID NO: 2008575 - RNA, 16 nt, Shigella flexneri 2a str. 301
gcaccgccaaccagcg

SEQ ID NO: 2008576 - RNA, 18 nt, Shigella flexneri 2a str. 301
gcaccgcgacaaucaggu

SEQ ID NO: 2008577 - RNA, 14 nt, Shigella flexneri 2a str. 301
gcaccgaagcccau

SEQ ID NO: 2008578 - RNA, 16 nt, Shigella flexneri 2a str. 301
gcaccgacaauccggu

SEQ ID NO: 2008579 - RNA, 13 nt, Shigella flexneri 2a str. 301
gcaccgcagagau

SEQ ID NO: 2008580 - RNA, 20 nt, Shigella flexneri 2a str. 301
gcaccgaggccaaaaccaca

SEQ ID NO: 2008581 - RNA, 17 nt, Shigella flexneri 2a str. 301
gcaccgaccaucggcac

SEQ ID NO: 2008582 - RNA, 15 nt, Shigella flexneri 2a str. 301
gcaccggacacugcu

SEQ ID NO: 2008583 - RNA, 20 nt, Shigella flexneri 2a str. 301
gcaccggugcgaacaaucac

SEQ ID NO: 2008584 - RNA, 17 nt, Shigella flexneri 2a str. 301
gcaccgggcuuccggca

SEQ ID NO: 2008585 - RNA, 20 nt, Shigella flexneri 2a str. 301
gcaccguaucuucauugugc

SEQ ID NO: 2008586 - RNA, 21 nt, Shigella flexneri 2a str. 301
gcaccgucaccgguucggaca

SEQ ID NO: 2008587 - RNA, 16 nt, Shigella flexneri 2a str. 301
gcaccugauccagcuc

SEQ ID NO: 2008588 - RNA, 14 nt, Shigella flexneri 2a str. 301
gcaccuaaagcgcg

SEQ ID NO: 2008589 - RNA, 23 nt, Shigella flexneri 2a str. 301
gcaccacuuccggcaacaaugcc

SEQ ID NO: 2008590 - RNA, 22 nt, Shigella flexneri 2a str. 301
gcaccagaaaguuuuucaacac

SEQ ID NO: 2008591 - RNA, 16 nt, Shigella flexneri 2a str. 301
gcaccagcggaaugca

SEQ ID NO: 2008592 - RNA, 15 nt, Shigella flexneri 2a str. 301
gcaccagcuccggca

SEQ ID NO: 2008593 - RNA, 15 nt, Shigella flexneri 2a str. 301
gcaccaauucaugag

SEQ ID NO: 2008594 - RNA, 14 nt, Shigella flexneri 2a str. 301
gcaccaacaaauag

SEQ ID NO: 2008595 - RNA, 21 nt, Shigella flexneri 2a str. 301
gcaccaacaaauagagauaga

SEQ ID NO: 2008596 - RNA, 20 nt, Shigella flexneri 2a str. 301
gcaccaaucaccgccagcaa

SEQ ID NO: 2008597 - RNA, 19 nt, Shigella flexneri 2a str. 301
gcaccaaucaccgccagca

SEQ ID NO: 2008598 - RNA, 16 nt, Shigella flexneri 2a str. 301
gcaccaauauugacug

SEQ ID NO: 2008599 - RNA, 18 nt, Shigella flexneri 2a str. 301
gcaccaaucaccgccagc

SEQ ID NO: 2008600 - RNA, 22 nt, Shigella flexneri 2a str. 301
gcaccaauagccgcgccgagcg

SEQ ID NO: 2008601 - RNA, 14 nt, Shigella flexneri 2a str. 301
gcaccaccagcagc

SEQ ID NO: 2008602 - RNA, 14 nt, Shigella flexneri 2a str. 301
gcaccaccgcccgu

SEQ ID NO: 2008603 - RNA, 19 nt, Shigella flexneri 2a str. 301
gcaccacgccggaugaaau

SEQ ID NO: 2008604 - RNA, 15 nt, Shigella flexneri 2a str. 301
gcaccauaaauccaa

SEQ ID NO: 2008605 - RNA, 17 nt, Shigella flexneri 2a str. 301
gcaccauugcugccgcc

SEQ ID NO: 2008606 - RNA, 22 nt, Shigella flexneri 2a str. 301
gcaccauguaggaguugcggcu

SEQ ID NO: 2008607 - RNA, 23 nt, Shigella flexneri 2a str. 301
gcaccaugucccggaacaggcag

SEQ ID NO: 2008608 - RNA, 12 nt, Shigella flexneri 2a str. 301
gcacccagcaau

SEQ ID NO: 2008609 - RNA, 15 nt, Shigella flexneri 2a str. 301
gcacccgccagcgcg

SEQ ID NO: 2008610 - RNA, 21 nt, Shigella flexneri 2a str. 301
gcacccgccguuagccagcgc

SEQ ID NO: 2008611 - RNA, 16 nt, Shigella flexneri 2a str. 301
gcacccgcgcuggcag

SEQ ID NO: 2008612 - RNA, 17 nt, Shigella flexneri 2a str. 301
gcaccccugauaaccgc

SEQ ID NO: 2008613 - RNA, 22 nt, Shigella flexneri 2a str. 301
gcacccauuuauccagcggcag

SEQ ID NO: 2008614 - RNA, 20 nt, Shigella flexneri 2a str. 301
gcacccauuuauccagcggc

SEQ ID NO: 2008615 - RNA, 23 nt, Shigella flexneri 2a str. 301
gcacgaguguuacgccugccgca

SEQ ID NO: 2008616 - RNA, 15 nt, Shigella flexneri 2a str. 301
gcacgccaucuggcu

SEQ ID NO: 2008617 - RNA, 16 nt, Shigella flexneri 2a str. 301
gcacgccccggcggcc

SEQ ID NO: 2008618 - RNA, 16 nt, Shigella flexneri 2a str. 301
gcaccuuuaccacucc

SEQ ID NO: 2008619 - RNA, 21 nt, Shigella flexneri 2a str. 301
gcaccuuuaaugcaucagcca

SEQ ID NO: 2008620 - RNA, 14 nt, Shigella flexneri 2a str. 301
gcaccuguaccagc

SEQ ID NO: 2008621 - RNA, 17 nt, Shigella flexneri 2a str. 301
gcaccuguaccagcccg

SEQ ID NO: 2008622 - RNA, 14 nt, Shigella flexneri 2a str. 301
gcacgcuggcguca

SEQ ID NO: 2008623 - RNA, 18 nt, Shigella flexneri 2a str. 301
gcacgcuuuucagugcca

SEQ ID NO: 2008624 - RNA, 22 nt, Shigella flexneri 2a str. 301
gcacggaaagcagcauacccac

SEQ ID NO: 2008625 - RNA, 16 nt, Shigella flexneri 2a str. 301
gcacgcuggagaacaa

SEQ ID NO: 2008626 - RNA, 20 nt, Shigella flexneri 2a str. 301
gcacgcguagagaauccagu

SEQ ID NO: 2008627 - RNA, 17 nt, Shigella flexneri 2a str. 301
gcacguacaugcagggc

SEQ ID NO: 2008628 - RNA, 18 nt, Shigella flexneri 2a str. 301
gcacgguuuuuccagcuc

SEQ ID NO: 2008629 - RNA, 15 nt, Shigella flexneri 2a str. 301
gcacggugaagaagc

SEQ ID NO: 2008630 - RNA, 16 nt, Shigella flexneri 2a str. 301
gcacgguacuggcagg

SEQ ID NO: 2008631 - RNA, 16 nt, Shigella flexneri 2a str. 301
gcacucgcuggcacuc

SEQ ID NO: 2008632 - RNA, 23 nt, Shigella flexneri 2a str. 301
gcacucuccuccguuaaccugga

SEQ ID NO: 2008633 - RNA, 16 nt, Shigella flexneri 2a str. 301
gcacugaaagccgcag

SEQ ID NO: 2008634 - RNA, 18 nt, Shigella flexneri 2a str. 301
gcacugaaagccgcaggc

SEQ ID NO: 2008635 - RNA, 22 nt, Shigella flexneri 2a str. 301
gcacuccuguuaugccucaacc

SEQ ID NO: 2008636 - RNA, 13 nt, Shigella flexneri 2a str. 301
gcacucgcagaca

SEQ ID NO: 2008637 - RNA, 16 nt, Shigella flexneri 2a str. 301
gcacucgcagacaaua

SEQ ID NO: 2008638 - RNA, 16 nt, Shigella flexneri 2a str. 301
gcacuccugccaccac

SEQ ID NO: 2008639 - RNA, 17 nt, Shigella flexneri 2a str. 301
gcacucaacaaccagaa

SEQ ID NO: 2008640 - RNA, 13 nt, Shigella flexneri 2a str. 301
gcacuaugugcca

SEQ ID NO: 2008641 - RNA, 21 nt, Shigella flexneri 2a str. 301
gcacgucuuugccgcgcucuu

SEQ ID NO: 2008642 - RNA, 15 nt, Shigella flexneri 2a str. 301
gcacgucaucugcac

SEQ ID NO: 2008643 - RNA, 19 nt, Shigella flexneri 2a str. 301
gcacgucaccgcagcaucg

SEQ ID NO: 2008644 - RNA, 17 nt, Shigella flexneri 2a str. 301
gcacuacgcagggauau

SEQ ID NO: 2008645 - RNA, 15 nt, Shigella flexneri 2a str. 301
gcacuacccaguaug

SEQ ID NO: 2008646 - RNA, 13 nt, Shigella flexneri 2a str. 301
gcacguuccugca

SEQ ID NO: 2008647 - RNA, 16 nt, Shigella flexneri 2a str. 301
gcacguucaucccacu

SEQ ID NO: 2008648 - RNA, 23 nt, Shigella flexneri 2a str. 301
gcacguuuugcggaugcagcgga

SEQ ID NO: 2008649 - RNA, 16 nt, Shigella flexneri 2a str. 301
gcacguuuagcuuugg

SEQ ID NO: 2008650 - RNA, 20 nt, Shigella flexneri 2a str. 301
gcacuucacccaucgccaga

SEQ ID NO: 2008651 - RNA, 19 nt, Shigella flexneri 2a str. 301
gcacuucacccaucgccag

SEQ ID NO: 2008652 - RNA, 14 nt, Shigella flexneri 2a str. 301
gcacuuccgcccau

SEQ ID NO: 2008653 - RNA, 12 nt, Shigella flexneri 2a str. 301
gcacuucuuccu

SEQ ID NO: 2008654 - RNA, 19 nt, Shigella flexneri 2a str. 301
gcacuucuuccuugaaaug

SEQ ID NO: 2008655 - RNA, 21 nt, Shigella flexneri 2a str. 301
gcacugccagaaucaagguga

SEQ ID NO: 2008656 - RNA, 17 nt, Shigella flexneri 2a str. 301
gcacugcaggcugaugg

SEQ ID NO: 2008657 - RNA, 14 nt, Shigella flexneri 2a str. 301
gcacuggcgagcgc

SEQ ID NO: 2008658 - RNA, 23 nt, Shigella flexneri 2a str. 301
gcacuggcuuuccagcgucaguu

SEQ ID NO: 2008659 - RNA, 22 nt, Shigella flexneri 2a str. 301
gcacugcgcccgccagcaucgg

SEQ ID NO: 2008660 - RNA, 17 nt, Shigella flexneri 2a str. 301
gcacuggcggcagcagg

SEQ ID NO: 2008661 - RNA, 15 nt, Shigella flexneri 2a str. 301
gcacuguuucgccag

SEQ ID NO: 2008662 - RNA, 14 nt, Shigella flexneri 2a str. 301
gcacuuaauaccac

SEQ ID NO: 2008663 - RNA, 23 nt, Shigella flexneri 2a str. 301
gcacuuacagcaacgccuaaacu

SEQ ID NO: 2008664 - RNA, 14 nt, Shigella flexneri 2a str. 301
gcacuuaccuucac

SEQ ID NO: 2008665 - RNA, 12 nt, Shigella flexneri 2a str. 301
gcacuucaacuu

SEQ ID NO: 2008666 - RNA, 23 nt, Shigella flexneri 2a str. 301
gcagauaucccgccagcaccagc

SEQ ID NO: 2008667 - RNA, 23 nt, Shigella flexneri 2a str. 301
gcagauaaucguauucuggcuuc

SEQ ID NO: 2008668 - RNA, 21 nt, Shigella flexneri 2a str. 301
gcagauacagccucuuuuuuc

SEQ ID NO: 2008669 - RNA, 18 nt, Shigella flexneri 2a str. 301
gcagauacauugccacca

SEQ ID NO: 2008670 - RNA, 16 nt, Shigella flexneri 2a str. 301
gcagauaacccagcag

SEQ ID NO: 2008671 - RNA, 23 nt, Shigella flexneri 2a str. 301
gcagauaacccagcagcccgagu

SEQ ID NO: 2008672 - RNA, 15 nt, Shigella flexneri 2a str. 301
gcagauaacccagca

SEQ ID NO: 2008673 - RNA, 19 nt, Shigella flexneri 2a str. 301
gcagagugaagguuucugc

SEQ ID NO: 2008674 - RNA, 17 nt, Shigella flexneri 2a str. 301
gcagagucucuggcuuc

SEQ ID NO: 2008675 - RNA, 16 nt, Shigella flexneri 2a str. 301
gcagaguuuccaggcu

SEQ ID NO: 2008676 - RNA, 18 nt, Shigella flexneri 2a str. 301
gcagaguuuccaggcugg

SEQ ID NO: 2008677 - RNA, 20 nt, Shigella flexneri 2a str. 301
gcagagauacaggccaccgc

SEQ ID NO: 2008678 - RNA, 20 nt, Shigella flexneri 2a str. 301
gcagagcauccuuguacucu

SEQ ID NO: 2008679 - RNA, 12 nt, Shigella flexneri 2a str. 301
gcagagcuucac

SEQ ID NO: 2008680 - RNA, 23 nt, Shigella flexneri 2a str. 301
gcagaugcgucuucugcagucac

SEQ ID NO: 2008681 - RNA, 20 nt, Shigella flexneri 2a str. 301
gcagaugaagcuggcaaagu

SEQ ID NO: 2008682 - RNA, 19 nt, Shigella flexneri 2a str. 301
gcagaugaagcuggcaaag

SEQ ID NO: 2008683 - RNA, 22 nt, Shigella flexneri 2a str. 301
gcagaugacuugccgcaaaacc

SEQ ID NO: 2008684 - RNA, 21 nt, Shigella flexneri 2a str. 301
gcagauucguuugagaauucc

SEQ ID NO: 2008685 - RNA, 14 nt, Shigella flexneri 2a str. 301
gcagauauugcacc

SEQ ID NO: 2008686 - RNA, 18 nt, Shigella flexneri 2a str. 301
gcagauauucaugcaggc

SEQ ID NO: 2008687 - RNA, 15 nt, Shigella flexneri 2a str. 301
gcagauccagugcuc

SEQ ID NO: 2008688 - RNA, 15 nt, Shigella flexneri 2a str. 301
gcagauccugauuua

SEQ ID NO: 2008689 - RNA, 12 nt, Shigella flexneri 2a str. 301
gcagaucgccaa

SEQ ID NO: 2008690 - RNA, 16 nt, Shigella flexneri 2a str. 301
gcagaucgaacacggu

SEQ ID NO: 2008691 - RNA, 23 nt, Shigella flexneri 2a str. 301
gcagaucgcggcccaccuggcug

SEQ ID NO: 2008692 - RNA, 14 nt, Shigella flexneri 2a str. 301
gcagaucuggaagc

SEQ ID NO: 2008693 - RNA, 16 nt, Shigella flexneri 2a str. 301
gcagaccgccaaccac

SEQ ID NO: 2008694 - RNA, 19 nt, Shigella flexneri 2a str. 301
gcagacgccacaaucucac

SEQ ID NO: 2008695 - RNA, 17 nt, Shigella flexneri 2a str. 301
gcagacuggauugccag

SEQ ID NO: 2008696 - RNA, 19 nt, Shigella flexneri 2a str. 301
gcagagaaacgccagcagc

SEQ ID NO: 2008697 - RNA, 20 nt, Shigella flexneri 2a str. 301
gcagagaaacgccagcagca

SEQ ID NO: 2008698 - RNA, 17 nt, Shigella flexneri 2a str. 301
gcagagauacaggccac

SEQ ID NO: 2008699 - RNA, 16 nt, Shigella flexneri 2a str. 301
gcagagauacaggcca

SEQ ID NO: 2008700 - RNA, 23 nt, Shigella flexneri 2a str. 301
gcagagaaaaugccgcacaucac

SEQ ID NO: 2008701 - RNA, 20 nt, Shigella flexneri 2a str. 301
gcagagaaaauaucccguca

SEQ ID NO: 2008702 - RNA, 21 nt, Shigella flexneri 2a str. 301
gcagacuuuuugcggcagcaa

SEQ ID NO: 2008703 - RNA, 20 nt, Shigella flexneri 2a str. 301
gcagaaguuguccaugugcu

SEQ ID NO: 2008704 - RNA, 18 nt, Shigella flexneri 2a str. 301
gcagaaucgcaaccagcg

SEQ ID NO: 2008705 - RNA, 15 nt, Shigella flexneri 2a str. 301
gcagacaaagugagc

SEQ ID NO: 2008706 - RNA, 20 nt, Shigella flexneri 2a str. 301
gcagaaugguaacaccagag

SEQ ID NO: 2008707 - RNA, 14 nt, Shigella flexneri 2a str. 301
gcagacacuuuccc

SEQ ID NO: 2008708 - RNA, 20 nt, Shigella flexneri 2a str. 301
gcagaagcaaucaucccagu

SEQ ID NO: 2008709 - RNA, 23 nt, Shigella flexneri 2a str. 301
gcagaagcauuuuacauccugau

SEQ ID NO: 2008710 - RNA, 18 nt, Shigella flexneri 2a str. 301
gcagaagcaaucauccca

SEQ ID NO: 2008711 - RNA, 15 nt, Shigella flexneri 2a str. 301
gcagaagcugcagga

SEQ ID NO: 2008712 - RNA, 23 nt, Shigella flexneri 2a str. 301
gcagaagcgauaaccuucaccgu

SEQ ID NO: 2008713 - RNA, 13 nt, Shigella flexneri 2a str. 301
gcagaacagaaca

SEQ ID NO: 2008714 - RNA, 22 nt, Shigella flexneri 2a str. 301
gcagaaauaccccgccagcaga

SEQ ID NO: 2008715 - RNA, 14 nt, Shigella flexneri 2a str. 301
gcagaacaucagcu

SEQ ID NO: 2008716 - RNA, 19 nt, Shigella flexneri 2a str. 301
gcagaaauaccccgccagc

SEQ ID NO: 2008717 - RNA, 16 nt, Shigella flexneri 2a str. 301
gcagcaucgccaggau

SEQ ID NO: 2008718 - RNA, 22 nt, Shigella flexneri 2a str. 301
gcagcaucaucauaauggcugc

SEQ ID NO: 2008719 - RNA, 16 nt, Shigella flexneri 2a str. 301
gcagcaucaugccgcu

SEQ ID NO: 2008720 - RNA, 11 nt, Shigella flexneri 2a str. 301
gcagcaugcac

SEQ ID NO: 2008721 - RNA, 13 nt, Shigella flexneri 2a str. 301
gcagcaugcaccc

SEQ ID NO: 2008722 - RNA, 19 nt, Shigella flexneri 2a str. 301
gcagcaggugcgccagcga

SEQ ID NO: 2008723 - RNA, 20 nt, Shigella flexneri 2a str. 301
gcagcagucaggcgcgcggu

SEQ ID NO: 2008724 - RNA, 14 nt, Shigella flexneri 2a str. 301
gcagcagucgcaac

SEQ ID NO: 2008725 - RNA, 21 nt, Shigella flexneri 2a str. 301
gcagcauaugcaaaaggcugg

SEQ ID NO: 2008726 - RNA, 22 nt, Shigella flexneri 2a str. 301
gcagcagcguuucgaacaggcc

SEQ ID NO: 2008727 - RNA, 18 nt, Shigella flexneri 2a str. 301
gcagccaguuaaccugcu

SEQ ID NO: 2008728 - RNA, 20 nt, Shigella flexneri 2a str. 301
gcagccagcgucacccagac

SEQ ID NO: 2008729 - RNA, 21 nt, Shigella flexneri 2a str. 301
gcagccaggcaaucccacagc

SEQ ID NO: 2008730 - RNA, 15 nt, Shigella flexneri 2a str. 301
gcagccaccgccagc

SEQ ID NO: 2008731 - RNA, 22 nt, Shigella flexneri 2a str. 301
gcagccaccacuugcagcucau

SEQ ID NO: 2008732 - RNA, 12 nt, Shigella flexneri 2a str. 301
gcagccaaaaau

SEQ ID NO: 2008733 - RNA, 21 nt, Shigella flexneri 2a str. 301
gcagcauuucaaaacggucac

SEQ ID NO: 2008734 - RNA, 18 nt, Shigella flexneri 2a str. 301
gcagcaugcaucccgccg

SEQ ID NO: 2008735 - RNA, 15 nt, Shigella flexneri 2a str. 301
gcagcaugcacccuc

SEQ ID NO: 2008736 - RNA, 17 nt, Shigella flexneri 2a str. 301
gcagcagagaaaauauc

SEQ ID NO: 2008737 - RNA, 13 nt, Shigella flexneri 2a str. 301
gcagcagccaagc

SEQ ID NO: 2008738 - RNA, 14 nt, Shigella flexneri 2a str. 301
gcagcaccgauccu

SEQ ID NO: 2008739 - RNA, 16 nt, Shigella flexneri 2a str. 301
gcagcaauggcacugu

SEQ ID NO: 2008740 - RNA, 21 nt, Shigella flexneri 2a str. 301
gcagcaaggcuauucagcagu

SEQ ID NO: 2008741 - RNA, 21 nt, Shigella flexneri 2a str. 301
gcagcaacgaugacaucgcag

SEQ ID NO: 2008742 - RNA, 16 nt, Shigella flexneri 2a str. 301
gcagcaaacgaaagca

SEQ ID NO: 2008743 - RNA, 13 nt, Shigella flexneri 2a str. 301
gcagauuugccag

SEQ ID NO: 2008744 - RNA, 16 nt, Shigella flexneri 2a str. 301
gcagcaaacgauucaa

SEQ ID NO: 2008745 - RNA, 20 nt, Shigella flexneri 2a str. 301
gcagcgauucaacaguagcc

SEQ ID NO: 2008746 - RNA, 15 nt, Shigella flexneri 2a str. 301
gcagccgucauugaa

SEQ ID NO: 2008747 - RNA, 12 nt, Shigella flexneri 2a str. 301
gcagcgccgcgc

SEQ ID NO: 2008748 - RNA, 14 nt, Shigella flexneri 2a str. 301
gcagcgccagcgaa

SEQ ID NO: 2008749 - RNA, 19 nt, Shigella flexneri 2a str. 301
gcagcguuaaugauauccc

SEQ ID NO: 2008750 - RNA, 19 nt, Shigella flexneri 2a str. 301
gcagcgugccaggcgcgcu

SEQ ID NO: 2008751 - RNA, 16 nt, Shigella flexneri 2a str. 301
gcagcgugccaggcgc

SEQ ID NO: 2008752 - RNA, 17 nt, Shigella flexneri 2a str. 301
gcagcgucgcaucaggc

SEQ ID NO: 2008753 - RNA, 23 nt, Shigella flexneri 2a str. 301
gcagcgucgcauccgacauugaa

SEQ ID NO: 2008754 - RNA, 13 nt, Shigella flexneri 2a str. 301
gcagcgucuucug

SEQ ID NO: 2008755 - RNA, 15 nt, Shigella flexneri 2a str. 301
gcagcggcggcaccg

SEQ ID NO: 2008756 - RNA, 19 nt, Shigella flexneri 2a str. 301
gcagcggaucgccgccgga

SEQ ID NO: 2008757 - RNA, 23 nt, Shigella flexneri 2a str. 301
gcaggaucugacuggcgagaucc

SEQ ID NO: 2008758 - RNA, 18 nt, Shigella flexneri 2a str. 301
gcaggaugcagaaaccaa

SEQ ID NO: 2008759 - RNA, 23 nt, Shigella flexneri 2a str. 301
gcagcucuggcauaacgccacgc

SEQ ID NO: 2008760 - RNA, 14 nt, Shigella flexneri 2a str. 301
gcagcugacuucca

SEQ ID NO: 2008761 - RNA, 19 nt, Shigella flexneri 2a str. 301
gcaggcaacagggaaauga

SEQ ID NO: 2008762 - RNA, 18 nt, Shigella flexneri 2a str. 301
gcaggcacaaaaccugcc

SEQ ID NO: 2008763 - RNA, 16 nt, Shigella flexneri 2a str. 301
gcaggauguuccggca

SEQ ID NO: 2008764 - RNA, 19 nt, Shigella flexneri 2a str. 301
gcaggauguuccggcaaag

SEQ ID NO: 2008765 - RNA, 12 nt, Shigella flexneri 2a str. 301
gcaggauuaaua

SEQ ID NO: 2008766 - RNA, 18 nt, Shigella flexneri 2a str. 301
gcaggcaccagccccugg

SEQ ID NO: 2008767 - RNA, 18 nt, Shigella flexneri 2a str. 301
gcaggcgcuuggcuucca

SEQ ID NO: 2008768 - RNA, 18 nt, Shigella flexneri 2a str. 301
gcaggcggauugcuucug

SEQ ID NO: 2008769 - RNA, 23 nt, Shigella flexneri 2a str. 301
gcaggccaauagcaccguuggcg

SEQ ID NO: 2008770 - RNA, 16 nt, Shigella flexneri 2a str. 301
gcaggcaucaaugaaa

SEQ ID NO: 2008771 - RNA, 14 nt, Shigella flexneri 2a str. 301
gcaggcuucaauuu

SEQ ID NO: 2008772 - RNA, 18 nt, Shigella flexneri 2a str. 301
gcagguacgguacugaaa

SEQ ID NO: 2008773 - RNA, 14 nt, Shigella flexneri 2a str. 301
gcagguacuggaaa

SEQ ID NO: 2008774 - RNA, 19 nt, Shigella flexneri 2a str. 301
gcaggucauccggcacgcu

SEQ ID NO: 2008775 - RNA, 23 nt, Shigella flexneri 2a str. 301
gcaggucgcccggauuacagcuc

SEQ ID NO: 2008776 - RNA, 12 nt, Shigella flexneri 2a str. 301
gcaguaccagau

SEQ ID NO: 2008777 - RNA, 19 nt, Shigella flexneri 2a str. 301
gcaguaccuccuucacagu

SEQ ID NO: 2008778 - RNA, 20 nt, Shigella flexneri 2a str. 301
gcaggugggcgcuggcuccu

SEQ ID NO: 2008779 - RNA, 10 nt, Shigella flexneri 2a str. 301
gcaugauaag

SEQ ID NO: 2008780 - RNA, 15 nt, Shigella flexneri 2a str. 301
gcaugaucagcgcau

SEQ ID NO: 2008781 - RNA, 12 nt, Shigella flexneri 2a str. 301
gcauggggagac

SEQ ID NO: 2008782 - RNA, 14 nt, Shigella flexneri 2a str. 301
gcaugguacccaau

SEQ ID NO: 2008783 - RNA, 21 nt, Shigella flexneri 2a str. 301
gcaucguccgucgaaagccca

SEQ ID NO: 2008784 - RNA, 22 nt, Shigella flexneri 2a str. 301
gcaucggugaggaucaccaguc

SEQ ID NO: 2008785 - RNA, 21 nt, Shigella flexneri 2a str. 301
gcaucggucgaugaaagcgcc

SEQ ID NO: 2008786 - RNA, 18 nt, Shigella flexneri 2a str. 301
gcaucguauuucagaccu

SEQ ID NO: 2008787 - RNA, 23 nt, Shigella flexneri 2a str. 301
gcaucguauugguacauaacaca

SEQ ID NO: 2008788 - RNA, 22 nt, Shigella flexneri 2a str. 301
gcaucguauugguacauaacac

SEQ ID NO: 2008789 - RNA, 16 nt, Shigella flexneri 2a str. 301
gcaugaaagcgaugcu

SEQ ID NO: 2008790 - RNA, 13 nt, Shigella flexneri 2a str. 301
gcaugaaaugaaa

SEQ ID NO: 2008791 - RNA, 14 nt, Shigella flexneri 2a str. 301
gcaugacaggcaac

SEQ ID NO: 2008792 - RNA, 18 nt, Shigella flexneri 2a str. 301
gcauucugcuggccuggc

SEQ ID NO: 2008793 - RNA, 22 nt, Shigella flexneri 2a str. 301
gcauucugcuggccuggcuggu

SEQ ID NO: 2008794 - RNA, 18 nt, Shigella flexneri 2a str. 301
gcauucucacuccagcca

SEQ ID NO: 2008795 - RNA, 12 nt, Shigella flexneri 2a str. 301
gcauucucauca

SEQ ID NO: 2008796 - RNA, 20 nt, Shigella flexneri 2a str. 301
gcauucagcaaggggcugau

SEQ ID NO: 2008797 - RNA, 14 nt, Shigella flexneri 2a str. 301
gcauuauccagcga

SEQ ID NO: 2008798 - RNA, 14 nt, Shigella flexneri 2a str. 301
gcauguggcggcgc

SEQ ID NO: 2008799 - RNA, 14 nt, Shigella flexneri 2a str. 301
gcauguucagcuuu

SEQ ID NO: 2008800 - RNA, 13 nt, Shigella flexneri 2a str. 301
gcauuaaauugug

SEQ ID NO: 2008801 - RNA, 14 nt, Shigella flexneri 2a str. 301
gcauuaacagccag

SEQ ID NO: 2008802 - RNA, 19 nt, Shigella flexneri 2a str. 301
gcauuaaaaacccgccaug

SEQ ID NO: 2008803 - RNA, 14 nt, Shigella flexneri 2a str. 301
gcauuaaccagucg

SEQ ID NO: 2008804 - RNA, 13 nt, Shigella flexneri 2a str. 301
gcauuacugcuau

SEQ ID NO: 2008805 - RNA, 13 nt, Shigella flexneri 2a str. 301
gcauuuugcugau

SEQ ID NO: 2008806 - RNA, 19 nt, Shigella flexneri 2a str. 301
gcauuguuugcaaaaucaa

SEQ ID NO: 2008807 - RNA, 22 nt, Shigella flexneri 2a str. 301
gccaaaaaucgcaaauugacua

SEQ ID NO: 2008808 - RNA, 23 nt, Shigella flexneri 2a str. 301
gcauuuuuuccagguacuuuuga

SEQ ID NO: 2008809 - RNA, 21 nt, Shigella flexneri 2a str. 301
gcauuggguuacuuaaugcug

SEQ ID NO: 2008810 - RNA, 15 nt, Shigella flexneri 2a str. 301
gcauugacaagcuca

SEQ ID NO: 2008811 - RNA, 19 nt, Shigella flexneri 2a str. 301
gcauugacgccaaaauaac

SEQ ID NO: 2008812 - RNA, 16 nt, Shigella flexneri 2a str. 301
gcauucuuuuucauua

SEQ ID NO: 2008813 - RNA, 15 nt, Shigella flexneri 2a str. 301
gcaucggcauggcga

SEQ ID NO: 2008814 - RNA, 22 nt, Shigella flexneri 2a str. 301
gcaucggcaaucacaucaccau

SEQ ID NO: 2008815 - RNA, 18 nt, Shigella flexneri 2a str. 301
gcaucgcgaccaaucaca

SEQ ID NO: 2008816 - RNA, 16 nt, Shigella flexneri 2a str. 301
gcaucgcgauggcaag

SEQ ID NO: 2008817 - RNA, 18 nt, Shigella flexneri 2a str. 301
gcauccggucagacaacu

SEQ ID NO: 2008818 - RNA, 21 nt, Shigella flexneri 2a str. 301
gcauccggucagacaacuucc

SEQ ID NO: 2008819 - RNA, 17 nt, Shigella flexneri 2a str. 301
gcauccgggccagcggc

SEQ ID NO: 2008820 - RNA, 19 nt, Shigella flexneri 2a str. 301
gcaucgccgggaacagaau

SEQ ID NO: 2008821 - RNA, 19 nt, Shigella flexneri 2a str. 301
gcaucagcccaaagcagag

SEQ ID NO: 2008822 - RNA, 16 nt, Shigella flexneri 2a str. 301
gcaucagccaacggcu

SEQ ID NO: 2008823 - RNA, 14 nt, Shigella flexneri 2a str. 301
gcaucagcgccacc

SEQ ID NO: 2008824 - RNA, 17 nt, Shigella flexneri 2a str. 301
gcaucagcgccaccagc

SEQ ID NO: 2008825 - RNA, 22 nt, Shigella flexneri 2a str. 301
gcaucagcaacacgcugcucau

SEQ ID NO: 2008826 - RNA, 22 nt, Shigella flexneri 2a str. 301
gcaucagcagaaucgcaaccag

SEQ ID NO: 2008827 - RNA, 15 nt, Shigella flexneri 2a str. 301
gcaucccagaaaaaa

SEQ ID NO: 2008828 - RNA, 19 nt, Shigella flexneri 2a str. 301
gcaucaggaccugcucugc

SEQ ID NO: 2008829 - RNA, 14 nt, Shigella flexneri 2a str. 301
gcauccggcaucaa

SEQ ID NO: 2008830 - RNA, 19 nt, Shigella flexneri 2a str. 301
gcauccggcaucaacaaag

SEQ ID NO: 2008831 - RNA, 13 nt, Shigella flexneri 2a str. 301
gcauccggcagga

SEQ ID NO: 2008832 - RNA, 18 nt, Shigella flexneri 2a str. 301
gcauccggcaaucggugc

SEQ ID NO: 2008833 - RNA, 21 nt, Shigella flexneri 2a str. 301
gcaucccgguaucaaagcgcc

SEQ ID NO: 2008834 - RNA, 22 nt, Shigella flexneri 2a str. 301
gcaucccgguaucaaagcgcca

SEQ ID NO: 2008835 - RNA, 23 nt, Shigella flexneri 2a str. 301
gcaucccgguaucaaagcgccag

SEQ ID NO: 2008836 - RNA, 15 nt, Shigella flexneri 2a str. 301
gcauccgacauugaa

SEQ ID NO: 2008837 - RNA, 16 nt, Shigella flexneri 2a str. 301
gcauccccgcccuucc

SEQ ID NO: 2008838 - RNA, 19 nt, Shigella flexneri 2a str. 301
gcauaccuucacagaaggc

SEQ ID NO: 2008839 - RNA, 13 nt, Shigella flexneri 2a str. 301
gcauacccagaac

SEQ ID NO: 2008840 - RNA, 20 nt, Shigella flexneri 2a str. 301
gcauacgcugccagccaucu

SEQ ID NO: 2008841 - RNA, 23 nt, Shigella flexneri 2a str. 301
gcauaccuucacagaaggccagg

SEQ ID NO: 2008842 - RNA, 15 nt, Shigella flexneri 2a str. 301
gcauacucuccucca

SEQ ID NO: 2008843 - RNA, 14 nt, Shigella flexneri 2a str. 301
gcauacaacgccau

SEQ ID NO: 2008844 - RNA, 19 nt, Shigella flexneri 2a str. 301
gcauacaacgccaugaaga

SEQ ID NO: 2008845 - RNA, 15 nt, Shigella flexneri 2a str. 301
gcauaauuuccagca

SEQ ID NO: 2008846 - RNA, 14 nt, Shigella flexneri 2a str. 301
gcauacagccaggu

SEQ ID NO: 2008847 - RNA, 12 nt, Shigella flexneri 2a str. 301
gcaguagcugca

SEQ ID NO: 2008848 - RNA, 20 nt, Shigella flexneri 2a str. 301
gcaguagcgucgccagcagu

SEQ ID NO: 2008849 - RNA, 16 nt, Shigella flexneri 2a str. 301
gcauauaguuuugcau

SEQ ID NO: 2008850 - RNA, 19 nt, Shigella flexneri 2a str. 301
gcauauagccaaagcacca

SEQ ID NO: 2008851 - RNA, 17 nt, Shigella flexneri 2a str. 301
gcauauaggcgaacggc

SEQ ID NO: 2008852 - RNA, 14 nt, Shigella flexneri 2a str. 301
gcauauccaccacc

SEQ ID NO: 2008853 - RNA, 19 nt, Shigella flexneri 2a str. 301
gcauauccaccacccagcg

SEQ ID NO: 2008854 - RNA, 18 nt, Shigella flexneri 2a str. 301
gcauauaccucagcagac

SEQ ID NO: 2008855 - RNA, 18 nt, Shigella flexneri 2a str. 301
gcauacuuucaucaaacg

SEQ ID NO: 2008856 - RNA, 14 nt, Shigella flexneri 2a str. 301
gcauagaaaaagaa

SEQ ID NO: 2008857 - RNA, 23 nt, Shigella flexneri 2a str. 301
gcauaggcggcaaacaguuucug

SEQ ID NO: 2008858 - RNA, 23 nt, Shigella flexneri 2a str. 301
gcauacugcgugucguaagccac

SEQ ID NO: 2008859 - RNA, 14 nt, Shigella flexneri 2a str. 301
gcauacuuucauca

SEQ ID NO: 2008860 - RNA, 23 nt, Shigella flexneri 2a str. 301
gcaucacuuucggugacagaaac

SEQ ID NO: 2008861 - RNA, 15 nt, Shigella flexneri 2a str. 301
gcaucacuuccagua

SEQ ID NO: 2008862 - RNA, 23 nt, Shigella flexneri 2a str. 301
gcaucagacaaaugucacugcuu

SEQ ID NO: 2008863 - RNA, 19 nt, Shigella flexneri 2a str. 301
gcaucacuacaaccgggau

SEQ ID NO: 2008864 - RNA, 17 nt, Shigella flexneri 2a str. 301
gcaucacaucgcuggug

SEQ ID NO: 2008865 - RNA, 16 nt, Shigella flexneri 2a str. 301
gccaaaauaacuuaau

SEQ ID NO: 2008866 - RNA, 20 nt, Shigella flexneri 2a str. 301
gccaaaauaacuuaauguca

SEQ ID NO: 2008867 - RNA, 12 nt, Shigella flexneri 2a str. 301
gccaaaaucucu

SEQ ID NO: 2008868 - RNA, 17 nt, Shigella flexneri 2a str. 301
gccaaacagaccaaugg

SEQ ID NO: 2008869 - RNA, 17 nt, Shigella flexneri 2a str. 301
gccaacaaucucuucca

SEQ ID NO: 2008870 - RNA, 14 nt, Shigella flexneri 2a str. 301
gccaacaaaaucuu

SEQ ID NO: 2008871 - RNA, 21 nt, Shigella flexneri 2a str. 301
gccaaacccaccagcugauga

SEQ ID NO: 2008872 - RNA, 12 nt, Shigella flexneri 2a str. 301
gccaaacaugca

SEQ ID NO: 2008873 - RNA, 12 nt, Shigella flexneri 2a str. 301
gccaaaccacgg

SEQ ID NO: 2008874 - RNA, 16 nt, Shigella flexneri 2a str. 301
gccaaccaugccgccc

SEQ ID NO: 2008875 - RNA, 14 nt, Shigella flexneri 2a str. 301
gccaaccacaugau

SEQ ID NO: 2008876 - RNA, 11 nt, Shigella flexneri 2a str. 301
gccaaccugcg

SEQ ID NO: 2008877 - RNA, 16 nt, Shigella flexneri 2a str. 301
gccaaccugcugguca

SEQ ID NO: 2008878 - RNA, 21 nt, Shigella flexneri 2a str. 301
gccaaccuugcggaagcguca

SEQ ID NO: 2008879 - RNA, 13 nt, Shigella flexneri 2a str. 301
gccaaccgcggca

SEQ ID NO: 2008880 - RNA, 12 nt, Shigella flexneri 2a str. 301
gccaacuggcau

SEQ ID NO: 2008881 - RNA, 14 nt, Shigella flexneri 2a str. 301
gccaacguuucugg

SEQ ID NO: 2008882 - RNA, 13 nt, Shigella flexneri 2a str. 301
gccaagaaacacc

SEQ ID NO: 2008883 - RNA, 23 nt, Shigella flexneri 2a str. 301
gccaagaaagagcgucuggaaga

SEQ ID NO: 2008884 - RNA, 19 nt, Shigella flexneri 2a str. 301
gccaaucccggaagccacc

SEQ ID NO: 2008885 - RNA, 18 nt, Shigella flexneri 2a str. 301
gccaauccccagaccugc

SEQ ID NO: 2008886 - RNA, 21 nt, Shigella flexneri 2a str. 301
gccaauccccagaccugcugu

SEQ ID NO: 2008887 - RNA, 12 nt, Shigella flexneri 2a str. 301
gccaaugaaauu

SEQ ID NO: 2008888 - RNA, 12 nt, Shigella flexneri 2a str. 301
gccaaucggcaa

SEQ ID NO: 2008889 - RNA, 19 nt, Shigella flexneri 2a str. 301
gccaaucuucacaucauca

SEQ ID NO: 2008890 - RNA, 20 nt, Shigella flexneri 2a str. 301
gccaaucuucacaucaucau

SEQ ID NO: 2008891 - RNA, 18 nt, Shigella flexneri 2a str. 301
gccaaugcaggcaucggu

SEQ ID NO: 2008892 - RNA, 22 nt, Shigella flexneri 2a str. 301
gccaauuaaugcaccaacaaau

SEQ ID NO: 2008893 - RNA, 11 nt, Shigella flexneri 2a str. 301
gccaauuccca

SEQ ID NO: 2008894 - RNA, 16 nt, Shigella flexneri 2a str. 301
gccaauguguuuauaa

SEQ ID NO: 2008895 - RNA, 17 nt, Shigella flexneri 2a str. 301
gccacaaagcagggcug

SEQ ID NO: 2008896 - RNA, 23 nt, Shigella flexneri 2a str. 301
gccacaaaccuuaaauggcccuu

SEQ ID NO: 2008897 - RNA, 12 nt, Shigella flexneri 2a str. 301
gccaauugcugu

SEQ ID NO: 2008898 - RNA, 12 nt, Shigella flexneri 2a str. 301
gccaauuucugg

SEQ ID NO: 2008899 - RNA, 16 nt, Shigella flexneri 2a str. 301
gccaauaaaugccacc

SEQ ID NO: 2008900 - RNA, 17 nt, Shigella flexneri 2a str. 301
gccaauaaaugccacca

SEQ ID NO: 2008901 - RNA, 13 nt, Shigella flexneri 2a str. 301
gccaagcgccgcc

SEQ ID NO: 2008902 - RNA, 20 nt, Shigella flexneri 2a str. 301
gccaagcgccgccucagcca

SEQ ID NO: 2008903 - RNA, 15 nt, Shigella flexneri 2a str. 301
gccacgguaaaaccg

SEQ ID NO: 2008904 - RNA, 14 nt, Shigella flexneri 2a str. 301
gccacggcuccagc

SEQ ID NO: 2008905 - RNA, 22 nt, Shigella flexneri 2a str. 301
gccaccuuucuguuccauaauc

SEQ ID NO: 2008906 - RNA, 17 nt, Shigella flexneri 2a str. 301
gccacggcaugaaagcg

SEQ ID NO: 2008907 - RNA, 20 nt, Shigella flexneri 2a str. 301
gccacugcccgagaacagca

SEQ ID NO: 2008908 - RNA, 12 nt, Shigella flexneri 2a str. 301
gccacuggcgcg

SEQ ID NO: 2008909 - RNA, 13 nt, Shigella flexneri 2a str. 301
gccacgucauccg

SEQ ID NO: 2008910 - RNA, 13 nt, Shigella flexneri 2a str. 301
gccacuaacgcau

SEQ ID NO: 2008911 - RNA, 19 nt, Shigella flexneri 2a str. 301
gccacguacauuaaacgcc

SEQ ID NO: 2008912 - RNA, 13 nt, Shigella flexneri 2a str. 301
gccacgucaucag

SEQ ID NO: 2008913 - RNA, 14 nt, Shigella flexneri 2a str. 301
gccacuaucgccau

SEQ ID NO: 2008914 - RNA, 17 nt, Shigella flexneri 2a str. 301
gccacucgauaccagau

SEQ ID NO: 2008915 - RNA, 19 nt, Shigella flexneri 2a str. 301
gccacagccgagcgccacc

SEQ ID NO: 2008916 - RNA, 21 nt, Shigella flexneri 2a str. 301
gccacagauaauaauguguuc

SEQ ID NO: 2008917 - RNA, 21 nt, Shigella flexneri 2a str. 301
gccacagcaauuuugcccagc

SEQ ID NO: 2008918 - RNA, 15 nt, Shigella flexneri 2a str. 301
gccaccccacaccag

SEQ ID NO: 2008919 - RNA, 17 nt, Shigella flexneri 2a str. 301
gccaccgcacgcaggcc

SEQ ID NO: 2008920 - RNA, 15 nt, Shigella flexneri 2a str. 301
gccaccgcccagaga

SEQ ID NO: 2008921 - RNA, 21 nt, Shigella flexneri 2a str. 301
gccaccgaacaaaacagcgag

SEQ ID NO: 2008922 - RNA, 18 nt, Shigella flexneri 2a str. 301
gccaccgaccaggcaaac

SEQ ID NO: 2008923 - RNA, 13 nt, Shigella flexneri 2a str. 301
gccacccugcggc

SEQ ID NO: 2008924 - RNA, 20 nt, Shigella flexneri 2a str. 301
gccacccugcggcugcugag

SEQ ID NO: 2008925 - RNA, 18 nt, Shigella flexneri 2a str. 301
gccaccggcaaucugcug

SEQ ID NO: 2008926 - RNA, 15 nt, Shigella flexneri 2a str. 301
gccccugaauaaucg

SEQ ID NO: 2008927 - RNA, 15 nt, Shigella flexneri 2a str. 301
gccccggcacuuaau

SEQ ID NO: 2008928 - RNA, 14 nt, Shigella flexneri 2a str. 301
gccccugcgccagc

SEQ ID NO: 2008929 - RNA, 16 nt, Shigella flexneri 2a str. 301
gccccugcgccagcgc

SEQ ID NO: 2008930 - RNA, 21 nt, Shigella flexneri 2a str. 301
gccccuggaaaaagugcccca

SEQ ID NO: 2008931 - RNA, 20 nt, Shigella flexneri 2a str. 301
gccccuggugagagucacca

SEQ ID NO: 2008932 - RNA, 18 nt, Shigella flexneri 2a str. 301
gccccugguuaucuucca

SEQ ID NO: 2008933 - RNA, 19 nt, Shigella flexneri 2a str. 301
gcccgcacaaagcacgcug

SEQ ID NO: 2008934 - RNA, 23 nt, Shigella flexneri 2a str. 301
gcccgauggugaugccaucgggc

SEQ ID NO: 2008935 - RNA, 18 nt, Shigella flexneri 2a str. 301
gcccgauggugaugccau

SEQ ID NO: 2008936 - RNA, 13 nt, Shigella flexneri 2a str. 301
gcccgauucacau

SEQ ID NO: 2008937 - RNA, 13 nt, Shigella flexneri 2a str. 301
gcccccgauccag

SEQ ID NO: 2008938 - RNA, 13 nt, Shigella flexneri 2a str. 301
gccccgcgcggcg

SEQ ID NO: 2008939 - RNA, 21 nt, Shigella flexneri 2a str. 301
gccccgaugccaucauggcga

SEQ ID NO: 2008940 - RNA, 16 nt, Shigella flexneri 2a str. 301
gccccagucuuccugc

SEQ ID NO: 2008941 - RNA, 22 nt, Shigella flexneri 2a str. 301
gccccauagguucaacgaccag

SEQ ID NO: 2008942 - RNA, 16 nt, Shigella flexneri 2a str. 301
gccccaucaacgccau

SEQ ID NO: 2008943 - RNA, 22 nt, Shigella flexneri 2a str. 301
gccccaucaacgccaucgccag

SEQ ID NO: 2008944 - RNA, 20 nt, Shigella flexneri 2a str. 301
gccccagcgcucgguagugc

SEQ ID NO: 2008945 - RNA, 14 nt, Shigella flexneri 2a str. 301
gccccagccuacag

SEQ ID NO: 2008946 - RNA, 22 nt, Shigella flexneri 2a str. 301
gcccaauauccauagugaagug

SEQ ID NO: 2008947 - RNA, 23 nt, Shigella flexneri 2a str. 301
gcccaauacagcgcggaccccac

SEQ ID NO: 2008948 - RNA, 17 nt, Shigella flexneri 2a str. 301
gcccagaccccagcucu

SEQ ID NO: 2008949 - RNA, 16 nt, Shigella flexneri 2a str. 301
gcccagaggaugcacu

SEQ ID NO: 2008950 - RNA, 21 nt, Shigella flexneri 2a str. 301
gcccagcaaaaagcgggcgac

SEQ ID NO: 2008951 - RNA, 13 nt, Shigella flexneri 2a str. 301
gcccagcgcagga

SEQ ID NO: 2008952 - RNA, 16 nt, Shigella flexneri 2a str. 301
gcccagccuuuccugc

SEQ ID NO: 2008953 - RNA, 17 nt, Shigella flexneri 2a str. 301
gcccagccuuuccugca

SEQ ID NO: 2008954 - RNA, 15 nt, Shigella flexneri 2a str. 301
gcccagcgcaucagg

SEQ ID NO: 2008955 - RNA, 19 nt, Shigella flexneri 2a str. 301
gcccagcgcaucaggcaau

SEQ ID NO: 2008956 - RNA, 22 nt, Shigella flexneri 2a str. 301
gcccagccgaagggaaagagcg

SEQ ID NO: 2008957 - RNA, 15 nt, Shigella flexneri 2a str. 301
gcccagcgcgccgcc

SEQ ID NO: 2008958 - RNA, 22 nt, Shigella flexneri 2a str. 301
gcccagcgcguaaauaucggca

SEQ ID NO: 2008959 - RNA, 15 nt, Shigella flexneri 2a str. 301
gcccagucacggcuu

SEQ ID NO: 2008960 - RNA, 14 nt, Shigella flexneri 2a str. 301
gcccagugccagca

SEQ ID NO: 2008961 - RNA, 16 nt, Shigella flexneri 2a str. 301
gcccagugaccaaagg

SEQ ID NO: 2008962 - RNA, 17 nt, Shigella flexneri 2a str. 301
gcccagugaccaaaggc

SEQ ID NO: 2008963 - RNA, 19 nt, Shigella flexneri 2a str. 301
gcccagugccgagaguaac

SEQ ID NO: 2008964 - RNA, 15 nt, Shigella flexneri 2a str. 301
gcccagugccagcac

SEQ ID NO: 2008965 - RNA, 20 nt, Shigella flexneri 2a str. 301
gcccaucgcgcccgccgcca

SEQ ID NO: 2008966 - RNA, 17 nt, Shigella flexneri 2a str. 301
gccccacaaacccgcca

SEQ ID NO: 2008967 - RNA, 16 nt, Shigella flexneri 2a str. 301
gccccacagacccagg

SEQ ID NO: 2008968 - RNA, 21 nt, Shigella flexneri 2a str. 301
gccccaaccgaacccagcagg

SEQ ID NO: 2008969 - RNA, 14 nt, Shigella flexneri 2a str. 301
gccccaccagcaaa

SEQ ID NO: 2008970 - RNA, 16 nt, Shigella flexneri 2a str. 301
gccccaccagcaaaua

SEQ ID NO: 2008971 - RNA, 17 nt, Shigella flexneri 2a str. 301
gccccagaauuuucucu

SEQ ID NO: 2008972 - RNA, 13 nt, Shigella flexneri 2a str. 301
gccccagacacag

SEQ ID NO: 2008973 - RNA, 22 nt, Shigella flexneri 2a str. 301
gccccagaauucacgcacuucc

SEQ ID NO: 2008974 - RNA, 16 nt, Shigella flexneri 2a str. 301
gccccagauugccgau

SEQ ID NO: 2008975 - RNA, 16 nt, Shigella flexneri 2a str. 301
gccccagaauucacgc

SEQ ID NO: 2008976 - RNA, 17 nt, Shigella flexneri 2a str. 301
gccccagaauucacgca

SEQ ID NO: 2008977 - RNA, 13 nt, Shigella flexneri 2a str. 301
gccaguccagguu

SEQ ID NO: 2008978 - RNA, 16 nt, Shigella flexneri 2a str. 301
gccagucccuuucagg

SEQ ID NO: 2008979 - RNA, 13 nt, Shigella flexneri 2a str. 301
gccagucaguuaa

SEQ ID NO: 2008980 - RNA, 23 nt, Shigella flexneri 2a str. 301
gccaguaacagaacgcauaacag

SEQ ID NO: 2008981 - RNA, 20 nt, Shigella flexneri 2a str. 301
gccaguaaucggcugaacgu

SEQ ID NO: 2008982 - RNA, 16 nt, Shigella flexneri 2a str. 301
gccaguaaucuggcca

SEQ ID NO: 2008983 - RNA, 22 nt, Shigella flexneri 2a str. 301
gccaguacccaugugauuuaaa

SEQ ID NO: 2008984 - RNA, 16 nt, Shigella flexneri 2a str. 301
gccaguacgcgcccgu

SEQ ID NO: 2008985 - RNA, 14 nt, Shigella flexneri 2a str. 301
gccaguacgcgccc

SEQ ID NO: 2008986 - RNA, 20 nt, Shigella flexneri 2a str. 301
gccaguuacugccaccaucc

SEQ ID NO: 2008987 - RNA, 16 nt, Shigella flexneri 2a str. 301
gccaguuacugcugac

SEQ ID NO: 2008988 - RNA, 19 nt, Shigella flexneri 2a str. 301
gccaguuacugcugacgcu

SEQ ID NO: 2008989 - RNA, 21 nt, Shigella flexneri 2a str. 301
gccaguguuucgacaauaauc

SEQ ID NO: 2008990 - RNA, 20 nt, Shigella flexneri 2a str. 301
gccaguguuucgacaauaau

SEQ ID NO: 2008991 - RNA, 12 nt, Shigella flexneri 2a str. 301
gccaguuauugg

SEQ ID NO: 2008992 - RNA, 21 nt, Shigella flexneri 2a str. 301
gccaguucauuugaacuggcu

SEQ ID NO: 2008993 - RNA, 23 nt, Shigella flexneri 2a str. 301
gccaguucguuguaguguuccug

SEQ ID NO: 2008994 - RNA, 15 nt, Shigella flexneri 2a str. 301
gccagugcugaaggu

SEQ ID NO: 2008995 - RNA, 22 nt, Shigella flexneri 2a str. 301
gccaguguuaaccagauaagcc

SEQ ID NO: 2008996 - RNA, 15 nt, Shigella flexneri 2a str. 301
gccagucuggcuucg

SEQ ID NO: 2008997 - RNA, 16 nt, Shigella flexneri 2a str. 301
gccagucuuccgccgg

SEQ ID NO: 2008998 - RNA, 15 nt, Shigella flexneri 2a str. 301
gccagugccaaagcc

SEQ ID NO: 2008999 - RNA, 17 nt, Shigella flexneri 2a str. 301
gccagugccacacgcuc

SEQ ID NO: 2009000 - RNA, 14 nt, Shigella flexneri 2a str. 301
gccacuucuuccag

SEQ ID NO: 2009001 - RNA, 15 nt, Shigella flexneri 2a str. 301
gccacuucuuccagc

SEQ ID NO: 2009002 - RNA, 14 nt, Shigella flexneri 2a str. 301
gccacuucugccag

SEQ ID NO: 2009003 - RNA, 19 nt, Shigella flexneri 2a str. 301
gccacuguuccggagaagc

SEQ ID NO: 2009004 - RNA, 16 nt, Shigella flexneri 2a str. 301
gccaggucagagagcc

SEQ ID NO: 2009005 - RNA, 22 nt, Shigella flexneri 2a str. 301
gccaguaagacaccccacagcu

SEQ ID NO: 2009006 - RNA, 20 nt, Shigella flexneri 2a str. 301
gccagguuuucuuucaccuc

SEQ ID NO: 2009007 - RNA, 17 nt, Shigella flexneri 2a str. 301
gccagguuuaccagcag

SEQ ID NO: 2009008 - RNA, 18 nt, Shigella flexneri 2a str. 301
gccagguuuaccagcagc

SEQ ID NO: 2009009 - RNA, 16 nt, Shigella flexneri 2a str. 301
gccagguuaaccagca

SEQ ID NO: 2009010 - RNA, 21 nt, Shigella flexneri 2a str. 301
gccauccgcgugacgcuggca

SEQ ID NO: 2009011 - RNA, 21 nt, Shigella flexneri 2a str. 301
gccaucgcgguuaaucggcag

SEQ ID NO: 2009012 - RNA, 17 nt, Shigella flexneri 2a str. 301
gccauccaccagugacu

SEQ ID NO: 2009013 - RNA, 21 nt, Shigella flexneri 2a str. 301
gccaucaccaucguugcuaac

SEQ ID NO: 2009014 - RNA, 15 nt, Shigella flexneri 2a str. 301
gccaucacugacugc

SEQ ID NO: 2009015 - RNA, 24 nt, Shigella flexneri 2a str. 301
gccaucaaauagccccugacuggu

SEQ ID NO: 2009016 - RNA, 18 nt, Shigella flexneri 2a str. 301
gccaucaaauagccccug

SEQ ID NO: 2009017 - RNA, 13 nt, Shigella flexneri 2a str. 301
gccauauaaauuu

SEQ ID NO: 2009018 - RNA, 20 nt, Shigella flexneri 2a str. 301
gccaucaaucacuuugcgcu

SEQ ID NO: 2009019 - RNA, 15 nt, Shigella flexneri 2a str. 301
gccaucaaugugcug

SEQ ID NO: 2009020 - RNA, 21 nt, Shigella flexneri 2a str. 301
gccaucaauugcucacucccg

SEQ ID NO: 2009021 - RNA, 16 nt, Shigella flexneri 2a str. 301
gccaucaaucccaucu

SEQ ID NO: 2009022 - RNA, 16 nt, Shigella flexneri 2a str. 301
gccaucaauaaccagc

SEQ ID NO: 2009023 - RNA, 21 nt, Shigella flexneri 2a str. 301
gccauacccgccagugcugaa

SEQ ID NO: 2009024 - RNA, 22 nt, Shigella flexneri 2a str. 301
gccauaacggcuguccauacgu

SEQ ID NO: 2009025 - RNA, 16 nt, Shigella flexneri 2a str. 301
gccauaauaaucauca

SEQ ID NO: 2009026 - RNA, 21 nt, Shigella flexneri 2a str. 301
gccauaaccccaccagcauga

SEQ ID NO: 2009027 - RNA, 18 nt, Shigella flexneri 2a str. 301
gccauaauauugauaaua

SEQ ID NO: 2009028 - RNA, 19 nt, Shigella flexneri 2a str. 301
gccauaaagaaaucaccug

SEQ ID NO: 2009029 - RNA, 17 nt, Shigella flexneri 2a str. 301
gccauaaauguugccgu

SEQ ID NO: 2009030 - RNA, 20 nt, Shigella flexneri 2a str. 301
gccauaaacugagccaaacg

SEQ ID NO: 2009031 - RNA, 22 nt, Shigella flexneri 2a str. 301
gccauaaaacacagcaucugga

SEQ ID NO: 2009032 - RNA, 22 nt, Shigella flexneri 2a str. 301
gccaguuuuucagcgccagcgc

SEQ ID NO: 2009033 - RNA, 17 nt, Shigella flexneri 2a str. 301
gccaguuugcgcgugcu

SEQ ID NO: 2009034 - RNA, 22 nt, Shigella flexneri 2a str. 301
gccaguuuggucuggcaaaaau

SEQ ID NO: 2009035 - RNA, 16 nt, Shigella flexneri 2a str. 301
gccauaaacagcaggc

SEQ ID NO: 2009036 - RNA, 19 nt, Shigella flexneri 2a str. 301
gccaguuucggacgcggca

SEQ ID NO: 2009037 - RNA, 18 nt, Shigella flexneri 2a str. 301
gccaguuugacaucguca

SEQ ID NO: 2009038 - RNA, 20 nt, Shigella flexneri 2a str. 301
gccaguuugacaucgucagg

SEQ ID NO: 2009039 - RNA, 23 nt, Shigella flexneri 2a str. 301
gccaguuguugauaagccccagu

SEQ ID NO: 2009040 - RNA, 22 nt, Shigella flexneri 2a str. 301
gccaguuuacugucugcuucug

SEQ ID NO: 2009041 - RNA, 16 nt, Shigella flexneri 2a str. 301
gccauuuuuuugucug

SEQ ID NO: 2009042 - RNA, 15 nt, Shigella flexneri 2a str. 301
gccauuuuucagacg

SEQ ID NO: 2009043 - RNA, 15 nt, Shigella flexneri 2a str. 301
gcccaaaaggcagcg

SEQ ID NO: 2009044 - RNA, 20 nt, Shigella flexneri 2a str. 301
gcccaacuguugauccagga

SEQ ID NO: 2009045 - RNA, 13 nt, Shigella flexneri 2a str. 301
gcccaacuguuga

SEQ ID NO: 2009046 - RNA, 16 nt, Shigella flexneri 2a str. 301
gccauuuugcgcggca

SEQ ID NO: 2009047 - RNA, 18 nt, Shigella flexneri 2a str. 301
gccauuuugcacauucca

SEQ ID NO: 2009048 - RNA, 12 nt, Shigella flexneri 2a str. 301
gccauuugccag

SEQ ID NO: 2009049 - RNA, 14 nt, Shigella flexneri 2a str. 301
gccauuugauucac

SEQ ID NO: 2009050 - RNA, 15 nt, Shigella flexneri 2a str. 301
gccauugaccagcug

SEQ ID NO: 2009051 - RNA, 15 nt, Shigella flexneri 2a str. 301
gccaugacuuucugg

SEQ ID NO: 2009052 - RNA, 23 nt, Shigella flexneri 2a str. 301
gccaucgggaugccauuugccag

SEQ ID NO: 2009053 - RNA, 22 nt, Shigella flexneri 2a str. 301
gccaugguuugggcguuacagc

SEQ ID NO: 2009054 - RNA, 20 nt, Shigella flexneri 2a str. 301
gccaugcaugauuacuggcg

SEQ ID NO: 2009055 - RNA, 21 nt, Shigella flexneri 2a str. 301
gccaugcaccugcuuccugaa

SEQ ID NO: 2009056 - RNA, 23 nt, Shigella flexneri 2a str. 301
gccaugcaccugcuuccugaacu

SEQ ID NO: 2009057 - RNA, 16 nt, Shigella flexneri 2a str. 301
gccaugcacgcaagaa

SEQ ID NO: 2009058 - RNA, 17 nt, Shigella flexneri 2a str. 301
gcccgucaugccgucgc

SEQ ID NO: 2009059 - RNA, 16 nt, Shigella flexneri 2a str. 301
gcccguacgcuguggu

SEQ ID NO: 2009060 - RNA, 23 nt, Shigella flexneri 2a str. 301
gcccguaacucacugaugccguu

SEQ ID NO: 2009061 - RNA, 20 nt, Shigella flexneri 2a str. 301
gcccguaaaaaauggcuggc

SEQ ID NO: 2009062 - RNA, 14 nt, Shigella flexneri 2a str. 301
gcccgguugcaguu

SEQ ID NO: 2009063 - RNA, 12 nt, Shigella flexneri 2a str. 301
gcccgguaucaa

SEQ ID NO: 2009064 - RNA, 18 nt, Shigella flexneri 2a str. 301
gcccggucgggugcucau

SEQ ID NO: 2009065 - RNA, 18 nt, Shigella flexneri 2a str. 301
gcccgguuaucggcgcgc

SEQ ID NO: 2009066 - RNA, 14 nt, Shigella flexneri 2a str. 301
gcccgccgcugguu

SEQ ID NO: 2009067 - RNA, 18 nt, Shigella flexneri 2a str. 301
gcccgccagcaccggagg

SEQ ID NO: 2009068 - RNA, 18 nt, Shigella flexneri 2a str. 301
gcccggggagcaacagag

SEQ ID NO: 2009069 - RNA, 21 nt, Shigella flexneri 2a str. 301
gcccuccgguccgccguagcc

SEQ ID NO: 2009070 - RNA, 22 nt, Shigella flexneri 2a str. 301
gcccuccugauaacacagaggc

SEQ ID NO: 2009071 - RNA, 12 nt, Shigella flexneri 2a str. 301
gcccucgacggc

SEQ ID NO: 2009072 - RNA, 21 nt, Shigella flexneri 2a str. 301
gcccucgaucggcucuuccgc

SEQ ID NO: 2009073 - RNA, 20 nt, Shigella flexneri 2a str. 301
gcccuacuccgccuuugaaa

SEQ ID NO: 2009074 - RNA, 21 nt, Shigella flexneri 2a str. 301
gcccucaaacaacacagcgau

SEQ ID NO: 2009075 - RNA, 20 nt, Shigella flexneri 2a str. 301
gcccuaggcauagaaaaaga

SEQ ID NO: 2009076 - RNA, 17 nt, Shigella flexneri 2a str. 301
gcccucauuccuccccg

SEQ ID NO: 2009077 - RNA, 20 nt, Shigella flexneri 2a str. 301
gcccucauuccuccccgaaa

SEQ ID NO: 2009078 - RNA, 15 nt, Shigella flexneri 2a str. 301
gcccgugacucccac

SEQ ID NO: 2009079 - RNA, 18 nt, Shigella flexneri 2a str. 301
gcccguuuucuccagcgc

SEQ ID NO: 2009080 - RNA, 21 nt, Shigella flexneri 2a str. 301
gcccguuuucuccagcgccgc

SEQ ID NO: 2009081 - RNA, 19 nt, Shigella flexneri 2a str. 301
gcccguuaaccgcucugcg

SEQ ID NO: 2009082 - RNA, 15 nt, Shigella flexneri 2a str. 301
gcccguugccaggac

SEQ ID NO: 2009083 - RNA, 14 nt, Shigella flexneri 2a str. 301
gcccuggcucugca

SEQ ID NO: 2009084 - RNA, 17 nt, Shigella flexneri 2a str. 301
gcccuggcucguggcug

SEQ ID NO: 2009085 - RNA, 22 nt, Shigella flexneri 2a str. 301
gcccugggcuucauccagcagu

SEQ ID NO: 2009086 - RNA, 22 nt, Shigella flexneri 2a str. 301
gcccuguuugguugccagccac

SEQ ID NO: 2009087 - RNA, 20 nt, Shigella flexneri 2a str. 301
gcccuucacccauugccgcc

SEQ ID NO: 2009088 - RNA, 22 nt, Shigella flexneri 2a str. 301
gcccuucggggcuaaugccagu

SEQ ID NO: 2009089 - RNA, 21 nt, Shigella flexneri 2a str. 301
gcccuucgggucguugccugc

SEQ ID NO: 2009090 - RNA, 12 nt, Shigella flexneri 2a str. 301
gcccuuccccuu

SEQ ID NO: 2009091 - RNA, 22 nt, Shigella flexneri 2a str. 301
gcccuuucugcauccguucuuc

SEQ ID NO: 2009092 - RNA, 17 nt, Shigella flexneri 2a str. 301
gcccuuuccugacucag

SEQ ID NO: 2009093 - RNA, 14 nt, Shigella flexneri 2a str. 301
gcccuuuucaccau

SEQ ID NO: 2009094 - RNA, 17 nt, Shigella flexneri 2a str. 301
gcccugcaaugucauca

SEQ ID NO: 2009095 - RNA, 16 nt, Shigella flexneri 2a str. 301
gcccugauggcgcgcc

SEQ ID NO: 2009096 - RNA, 15 nt, Shigella flexneri 2a str. 301
gcccugaucgcugug

SEQ ID NO: 2009097 - RNA, 12 nt, Shigella flexneri 2a str. 301
gccgacagcagc

SEQ ID NO: 2009098 - RNA, 17 nt, Shigella flexneri 2a str. 301
gccgacagcaggcucag

SEQ ID NO: 2009099 - RNA, 13 nt, Shigella flexneri 2a str. 301
aaagcuaacagag

SEQ ID NO: 2009100 - RNA, 21 nt, Shigella flexneri 2a str. 301
aaagcguuuaucaauuaacug

SEQ ID NO: 2009101 - RNA, 16 nt, Shigella flexneri 2a str. 301
aaagcguuuaugcgca

SEQ ID NO: 2009102 - RNA, 18 nt, Shigella flexneri 2a str. 301
aaagcggcgcuaauggca

SEQ ID NO: 2009103 - RNA, 16 nt, Shigella flexneri 2a str. 301
aaagcggcucggagag

SEQ ID NO: 2009104 - RNA, 18 nt, Shigella flexneri 2a str. 301
gccgaagcgcaguuuaau

SEQ ID NO: 2009105 - RNA, 16 nt, Shigella flexneri 2a str. 301
gccgaagcgagcuuuu

SEQ ID NO: 2009106 - RNA, 23 nt, Shigella flexneri 2a str. 301
gccgaagccguuagucaucauca

SEQ ID NO: 2009107 - RNA, 21 nt, Shigella flexneri 2a str. 301
gcccuuuuuuugucuguuugc

SEQ ID NO: 2009108 - RNA, 23 nt, Shigella flexneri 2a str. 301
gcccuuuuuucguaaguaagcaa

SEQ ID NO: 2009109 - RNA, 16 nt, Shigella flexneri 2a str. 301
gccgaucaucauccag

SEQ ID NO: 2009110 - RNA, 16 nt, Shigella flexneri 2a str. 301
gccgauuaaucuucca

SEQ ID NO: 2009111 - RNA, 20 nt, Shigella flexneri 2a str. 301
gccgauuaaagacagcgagg

SEQ ID NO: 2009112 - RNA, 21 nt, Shigella flexneri 2a str. 301
gccgauuucaugaagcugaca

SEQ ID NO: 2009113 - RNA, 21 nt, Shigella flexneri 2a str. 301
gccgaucaauuucacaguaau

SEQ ID NO: 2009114 - RNA, 18 nt, Shigella flexneri 2a str. 301
gccgaucaauuucacagu

SEQ ID NO: 2009115 - RNA, 19 nt, Shigella flexneri 2a str. 301
gccgacgccaguucucuuc

SEQ ID NO: 2009116 - RNA, 16 nt, Shigella flexneri 2a str. 301
gccgccaguucuucca

SEQ ID NO: 2009117 - RNA, 15 nt, Shigella flexneri 2a str. 301
gccgccauaaacagc

SEQ ID NO: 2009118 - RNA, 15 nt, Shigella flexneri 2a str. 301
gccgccagcaucuca

SEQ ID NO: 2009119 - RNA, 19 nt, Shigella flexneri 2a str. 301
gccgccaccgauuguaauc

SEQ ID NO: 2009120 - RNA, 19 nt, Shigella flexneri 2a str. 301
gccgccagcucuuuaaaca

SEQ ID NO: 2009121 - RNA, 15 nt, Shigella flexneri 2a str. 301
gccgcaggcggacug

SEQ ID NO: 2009122 - RNA, 21 nt, Shigella flexneri 2a str. 301
gccgcaccaggaucuuuuguc

SEQ ID NO: 2009123 - RNA, 21 nt, Shigella flexneri 2a str. 301
gccgcaauggccguuccggca

SEQ ID NO: 2009124 - RNA, 19 nt, Shigella flexneri 2a str. 301
gccgccgcuucuggcggcg

SEQ ID NO: 2009125 - RNA, 21 nt, Shigella flexneri 2a str. 301
gccgccgcuucuggcggcggc

SEQ ID NO: 2009126 - RNA, 19 nt, Shigella flexneri 2a str. 301
gccgccgcaaacaucggcu

SEQ ID NO: 2009127 - RNA, 22 nt, Shigella flexneri 2a str. 301
gccgccgagcaaaccacaggcc

SEQ ID NO: 2009128 - RNA, 18 nt, Shigella flexneri 2a str. 301
gccgcgcaguuucuuacc

SEQ ID NO: 2009129 - RNA, 14 nt, Shigella flexneri 2a str. 301
gccgcgcagcgugc

SEQ ID NO: 2009130 - RNA, 20 nt, Shigella flexneri 2a str. 301
gccgccucccuucgcugcug

SEQ ID NO: 2009131 - RNA, 20 nt, Shigella flexneri 2a str. 301
gccgccuaacgacaaaucau

SEQ ID NO: 2009132 - RNA, 13 nt, Shigella flexneri 2a str. 301
gcgacauaucauu

SEQ ID NO: 2009133 - RNA, 17 nt, Shigella flexneri 2a str. 301
gcgacagggaucucuuc

SEQ ID NO: 2009134 - RNA, 19 nt, Shigella flexneri 2a str. 301
gcgacagacgacgacgcgc

SEQ ID NO: 2009135 - RNA, 22 nt, Shigella flexneri 2a str. 301
gcgacaccucccagcgcgguga

SEQ ID NO: 2009136 - RNA, 12 nt, Shigella flexneri 2a str. 301
gcgacaccagcc

SEQ ID NO: 2009137 - RNA, 14 nt, Shigella flexneri 2a str. 301
gcgacaaucccugc

SEQ ID NO: 2009138 - RNA, 23 nt, Shigella flexneri 2a str. 301
gcgaaaauugguagaccagagcu

SEQ ID NO: 2009139 - RNA, 17 nt, Shigella flexneri 2a str. 301
gcgaaucacguugccgu

SEQ ID NO: 2009140 - RNA, 21 nt, Shigella flexneri 2a str. 301
gcgaauaugccguaaaaguac

SEQ ID NO: 2009141 - RNA, 19 nt, Shigella flexneri 2a str. 301
gcgaauguuccaucaccag

SEQ ID NO: 2009142 - RNA, 12 nt, Shigella flexneri 2a str. 301
gcgaauuuuuuc

SEQ ID NO: 2009143 - RNA, 15 nt, Shigella flexneri 2a str. 301
gcgaaugaggcagca

SEQ ID NO: 2009144 - RNA, 20 nt, Shigella flexneri 2a str. 301
gcgaaucgcuucauuuacau

SEQ ID NO: 2009145 - RNA, 18 nt, Shigella flexneri 2a str. 301
gcgaccgaacagaucacg

SEQ ID NO: 2009146 - RNA, 20 nt, Shigella flexneri 2a str. 301
gcgacccguuuacggcuaaa

SEQ ID NO: 2009147 - RNA, 16 nt, Shigella flexneri 2a str. 301
gcgaccauacagcagc

SEQ ID NO: 2009148 - RNA, 18 nt, Shigella flexneri 2a str. 301
gcgaccauacagcagcaa

SEQ ID NO: 2009149 - RNA, 12 nt, Shigella flexneri 2a str. 301
gcgacaugaucg

SEQ ID NO: 2009150 - RNA, 16 nt, Shigella flexneri 2a str. 301
gcgacaucuucuccag

SEQ ID NO: 2009151 - RNA, 13 nt, Shigella flexneri 2a str. 301
gcgaccaccacca

SEQ ID NO: 2009152 - RNA, 15 nt, Shigella flexneri 2a str. 301
gcgaccaaucaaaua

SEQ ID NO: 2009153 - RNA, 16 nt, Shigella flexneri 2a str. 301
gcgaccguucgccagg

SEQ ID NO: 2009154 - RNA, 15 nt, Shigella flexneri 2a str. 301
gcgaccguucgccag

SEQ ID NO: 2009155 - RNA, 18 nt, Shigella flexneri 2a str. 301
gcgaccucaagcucgcca

SEQ ID NO: 2009156 - RNA, 18 nt, Shigella flexneri 2a str. 301
gcgaccggaauguuccau

SEQ ID NO: 2009157 - RNA, 21 nt, Shigella flexneri 2a str. 301
gcgacgaccacccaccgcagc

SEQ ID NO: 2009158 - RNA, 22 nt, Shigella flexneri 2a str. 301
gcgacgaccacccaccgcagcc

SEQ ID NO: 2009159 - RNA, 16 nt, Shigella flexneri 2a str. 301
gcgacucucugagcca

SEQ ID NO: 2009160 - RNA, 15 nt, Shigella flexneri 2a str. 301
gcgacugccagcauc

SEQ ID NO: 2009161 - RNA, 16 nt, Shigella flexneri 2a str. 301
gcgacuugcucaggag

SEQ ID NO: 2009162 - RNA, 19 nt, Shigella flexneri 2a str. 301
gcgagauuccgccgccauu

SEQ ID NO: 2009163 - RNA, 23 nt, Shigella flexneri 2a str. 301
gcgagcaaaaucguaagcaggag

SEQ ID NO: 2009164 - RNA, 14 nt, Shigella flexneri 2a str. 301
gcgacuugucauca

SEQ ID NO: 2009165 - RNA, 19 nt, Shigella flexneri 2a str. 301
gcgaggcggggccaauugc

SEQ ID NO: 2009166 - RNA, 19 nt, Shigella flexneri 2a str. 301
gcgagggagaaaacccggc

SEQ ID NO: 2009167 - RNA, 17 nt, Shigella flexneri 2a str. 301
gcgagguacgcccagcg

SEQ ID NO: 2009168 - RNA, 12 nt, Shigella flexneri 2a str. 301
gcgaggaugcgu

SEQ ID NO: 2009169 - RNA, 20 nt, Shigella flexneri 2a str. 301
gcgagcgauaacccagcgca

SEQ ID NO: 2009170 - RNA, 16 nt, Shigella flexneri 2a str. 301
gcgagcgcggcuggcu

SEQ ID NO: 2009171 - RNA, 15 nt, Shigella flexneri 2a str. 301
gcgagucgagauccc

SEQ ID NO: 2009172 - RNA, 19 nt, Shigella flexneri 2a str. 301
gcgagguuauccgccagcg

SEQ ID NO: 2009173 - RNA, 16 nt, Shigella flexneri 2a str. 301
gcgagguaggcaguca

SEQ ID NO: 2009174 - RNA, 16 nt, Shigella flexneri 2a str. 301
gcgauaaugcccagca

SEQ ID NO: 2009175 - RNA, 11 nt, Shigella flexneri 2a str. 301
gcgauaauauu

SEQ ID NO: 2009176 - RNA, 17 nt, Shigella flexneri 2a str. 301
gcgauaaucagcgccag

SEQ ID NO: 2009177 - RNA, 18 nt, Shigella flexneri 2a str. 301
gcgauagauuagcuggcc

SEQ ID NO: 2009178 - RNA, 15 nt, Shigella flexneri 2a str. 301
gcgauacuuuuucaa

SEQ ID NO: 2009179 - RNA, 19 nt, Shigella flexneri 2a str. 301
gcgauacccccaguaaaug

SEQ ID NO: 2009180 - RNA, 13 nt, Shigella flexneri 2a str. 301
gcgauacacugaa

SEQ ID NO: 2009181 - RNA, 17 nt, Shigella flexneri 2a str. 301
gccugaaauaaugcagc

SEQ ID NO: 2009182 - RNA, 22 nt, Shigella flexneri 2a str. 301
gccucacagggcucuuaagcac

SEQ ID NO: 2009183 - RNA, 22 nt, Shigella flexneri 2a str. 301
gccucuuuuaaccucagcgaac

SEQ ID NO: 2009184 - RNA, 21 nt, Shigella flexneri 2a str. 301
gccugacagggaagggagcgc

SEQ ID NO: 2009185 - RNA, 13 nt, Shigella flexneri 2a str. 301
gccugaccgcaca

SEQ ID NO: 2009186 - RNA, 17 nt, Shigella flexneri 2a str. 301
gccugaccgcacacccc

SEQ ID NO: 2009187 - RNA, 20 nt, Shigella flexneri 2a str. 301
gccugaccgcacaccccggc

SEQ ID NO: 2009188 - RNA, 23 nt, Shigella flexneri 2a str. 301
gccugaaucgggaucaccuguuc

SEQ ID NO: 2009189 - RNA, 20 nt, Shigella flexneri 2a str. 301
gccucaagcacccgccgcua

SEQ ID NO: 2009190 - RNA, 19 nt, Shigella flexneri 2a str. 301
gccucaacccuuuuuuaaa

SEQ ID NO: 2009191 - RNA, 15 nt, Shigella flexneri 2a str. 301
gccuauugacgcugu

SEQ ID NO: 2009192 - RNA, 18 nt, Shigella flexneri 2a str. 301
gccucaagaaugacgcca

SEQ ID NO: 2009193 - RNA, 24 nt, Shigella flexneri 2a str. 301
gccugacggaaaucaugcaacacg

SEQ ID NO: 2009194 - RNA, 16 nt, Shigella flexneri 2a str. 301
gccugaccauuaucaa

SEQ ID NO: 2009195 - RNA, 16 nt, Shigella flexneri 2a str. 301
gccugauaagacgcgc

SEQ ID NO: 2009196 - RNA, 22 nt, Shigella flexneri 2a str. 301
gccugauucaaugaguuauaca

SEQ ID NO: 2009197 - RNA, 12 nt, Shigella flexneri 2a str. 301
gccugaugcgcu

SEQ ID NO: 2009198 - RNA, 19 nt, Shigella flexneri 2a str. 301
gccugaugcgacgcuggcg

SEQ ID NO: 2009199 - RNA, 13 nt, Shigella flexneri 2a str. 301
gccugcacugcag

SEQ ID NO: 2009200 - RNA, 17 nt, Shigella flexneri 2a str. 301
gccugcacugcaggccg

SEQ ID NO: 2009201 - RNA, 22 nt, Shigella flexneri 2a str. 301
gccugcagcugcucauuacagu

SEQ ID NO: 2009202 - RNA, 12 nt, Shigella flexneri 2a str. 301
gccugcaucacc

SEQ ID NO: 2009203 - RNA, 19 nt, Shigella flexneri 2a str. 301
gccugccaucuggcaggcu

SEQ ID NO: 2009204 - RNA, 14 nt, Shigella flexneri 2a str. 301
gccugccagcucuu

SEQ ID NO: 2009205 - RNA, 13 nt, Shigella flexneri 2a str. 301
gccugccagcaug

SEQ ID NO: 2009206 - RNA, 13 nt, Shigella flexneri 2a str. 301
gccugccugcagc

SEQ ID NO: 2009207 - RNA, 23 nt, Shigella flexneri 2a str. 301
gccugcccagccgguaaggccga

SEQ ID NO: 2009208 - RNA, 21 nt, Shigella flexneri 2a str. 301
gccugcuccagugcauccagc

SEQ ID NO: 2009209 - RNA, 18 nt, Shigella flexneri 2a str. 301
gccugcuaaaccagcccu

SEQ ID NO: 2009210 - RNA, 21 nt, Shigella flexneri 2a str. 301
gccuuccgcaaacaggcgcag

SEQ ID NO: 2009211 - RNA, 22 nt, Shigella flexneri 2a str. 301
gccuucuucgcccacuuucugc

SEQ ID NO: 2009212 - RNA, 14 nt, Shigella flexneri 2a str. 301
gccuucuucaucca

SEQ ID NO: 2009213 - RNA, 21 nt, Shigella flexneri 2a str. 301
gccuucuucgcccacuuucug

SEQ ID NO: 2009214 - RNA, 16 nt, Shigella flexneri 2a str. 301
gccuucuucauccagc

SEQ ID NO: 2009215 - RNA, 20 nt, Shigella flexneri 2a str. 301
gccuucuccggcuuacaaca

SEQ ID NO: 2009216 - RNA, 12 nt, Shigella flexneri 2a str. 301
gccuucugcggu

SEQ ID NO: 2009217 - RNA, 20 nt, Shigella flexneri 2a str. 301
gccuugcgauuacgcucggc

SEQ ID NO: 2009218 - RNA, 22 nt, Shigella flexneri 2a str. 301
gccuugcggaaauuccagcggc

SEQ ID NO: 2009219 - RNA, 19 nt, Shigella flexneri 2a str. 301
gccuugugaguuccgcugc

SEQ ID NO: 2009220 - RNA, 22 nt, Shigella flexneri 2a str. 301
gccuuuuuuguacuccagcaga

SEQ ID NO: 2009221 - RNA, 16 nt, Shigella flexneri 2a str. 301
gccuuuaccgccacag

SEQ ID NO: 2009222 - RNA, 21 nt, Shigella flexneri 2a str. 301
gccuuuaccgcgcucgaagcg

SEQ ID NO: 2009223 - RNA, 17 nt, Shigella flexneri 2a str. 301
gccuucagguuuuucag

SEQ ID NO: 2009224 - RNA, 14 nt, Shigella flexneri 2a str. 301
gccuuauccugccu

SEQ ID NO: 2009225 - RNA, 15 nt, Shigella flexneri 2a str. 301
gccuuauccagcaga

SEQ ID NO: 2009226 - RNA, 13 nt, Shigella flexneri 2a str. 301
gccuuauccggcc

SEQ ID NO: 2009227 - RNA, 14 nt, Shigella flexneri 2a str. 301
gccuuauccggccu

SEQ ID NO: 2009228 - RNA, 22 nt, Shigella flexneri 2a str. 301
gccuuccaccagauggcuuucc

SEQ ID NO: 2009229 - RNA, 21 nt, Shigella flexneri 2a str. 301
gccuucauucaggccaaagcc

SEQ ID NO: 2009230 - RNA, 16 nt, Shigella flexneri 2a str. 301
gccuguggugauucau

SEQ ID NO: 2009231 - RNA, 16 nt, Shigella flexneri 2a str. 301
gccugugccacggcuu

SEQ ID NO: 2009232 - RNA, 16 nt, Shigella flexneri 2a str. 301
gccuguaccagcggcu

SEQ ID NO: 2009233 - RNA, 18 nt, Shigella flexneri 2a str. 301
gccuguacggcagugaac

SEQ ID NO: 2009234 - RNA, 15 nt, Shigella flexneri 2a str. 301
gccugugcagcgacg

SEQ ID NO: 2009235 - RNA, 14 nt, Shigella flexneri 2a str. 301
gccugugcagcgac

SEQ ID NO: 2009236 - RNA, 13 nt, Shigella flexneri 2a str. 301
gccugugcaaccu

SEQ ID NO: 2009237 - RNA, 19 nt, Shigella flexneri 2a str. 301
gccuguaccacaaccugca

SEQ ID NO: 2009238 - RNA, 20 nt, Shigella flexneri 2a str. 301
gccugguuauagcaguaauu

SEQ ID NO: 2009239 - RNA, 15 nt, Shigella flexneri 2a str. 301
gccuggaauuacuga

SEQ ID NO: 2009240 - RNA, 14 nt, Shigella flexneri 2a str. 301
gccuggauuuucuc

SEQ ID NO: 2009241 - RNA, 23 nt, Shigella flexneri 2a str. 301
gccuggauuuuuauuccgcugga

SEQ ID NO: 2009242 - RNA, 18 nt, Shigella flexneri 2a str. 301
gccggaacuauuggucug

SEQ ID NO: 2009243 - RNA, 19 nt, Shigella flexneri 2a str. 301
gccggaaggaagacgcagc

SEQ ID NO: 2009244 - RNA, 15 nt, Shigella flexneri 2a str. 301
gccgcgcuuucuucu

SEQ ID NO: 2009245 - RNA, 21 nt, Shigella flexneri 2a str. 301
gccggaaggaagacgcagcau

SEQ ID NO: 2009246 - RNA, 16 nt, Shigella flexneri 2a str. 301
gccggaaguauuucaa

SEQ ID NO: 2009247 - RNA, 15 nt, Shigella flexneri 2a str. 301
gccggaaucagaauc

SEQ ID NO: 2009248 - RNA, 18 nt, Shigella flexneri 2a str. 301
gccggaauuucuuucagc

SEQ ID NO: 2009249 - RNA, 14 nt, Shigella flexneri 2a str. 301
gccggaccccgcgc

SEQ ID NO: 2009250 - RNA, 19 nt, Shigella flexneri 2a str. 301
gccggaugcggugcaagca

SEQ ID NO: 2009251 - RNA, 23 nt, Shigella flexneri 2a str. 301
gccggaugcggugcaagcaccuu

SEQ ID NO: 2009252 - RNA, 23 nt, Shigella flexneri 2a str. 301
gccggaugcggcguaaaugccuu

SEQ ID NO: 2009253 - RNA, 18 nt, Shigella flexneri 2a str. 301
gccggaugcgaugcugac

SEQ ID NO: 2009254 - RNA, 20 nt, Shigella flexneri 2a str. 301
gccggaugacagacuccgcu

SEQ ID NO: 2009255 - RNA, 18 nt, Shigella flexneri 2a str. 301
gccggaugaucauccggc

SEQ ID NO: 2009256 - RNA, 17 nt, Shigella flexneri 2a str. 301
gccggaugacagacucc

SEQ ID NO: 2009257 - RNA, 21 nt, Shigella flexneri 2a str. 301
gccggaugacacaucaccucc

SEQ ID NO: 2009258 - RNA, 23 nt, Shigella flexneri 2a str. 301
gccggaugccucuccuguucuca

SEQ ID NO: 2009259 - RNA, 15 nt, Shigella flexneri 2a str. 301
gccggaugcaucaca

SEQ ID NO: 2009260 - RNA, 14 nt, Shigella flexneri 2a str. 301
gccggauagacaug

SEQ ID NO: 2009261 - RNA, 13 nt, Shigella flexneri 2a str. 301
gccggagccagcc

SEQ ID NO: 2009262 - RNA, 23 nt, Shigella flexneri 2a str. 301
gccggaggcaaguuuccuccggc

SEQ ID NO: 2009263 - RNA, 16 nt, Shigella flexneri 2a str. 301
gccggaugucgcugcu

SEQ ID NO: 2009264 - RNA, 16 nt, Shigella flexneri 2a str. 301
gccggaugucuggaac

SEQ ID NO: 2009265 - RNA, 22 nt, Shigella flexneri 2a str. 301
gccggccagcgccaccaccagc

SEQ ID NO: 2009266 - RNA, 23 nt, Shigella flexneri 2a str. 301
gccggccccgucucccgaugcca

SEQ ID NO: 2009267 - RNA, 20 nt, Shigella flexneri 2a str. 301
gccgugcacuucugcgguga

SEQ ID NO: 2009268 - RNA, 22 nt, Shigella flexneri 2a str. 301
gccgucguuaccggucacuggc

SEQ ID NO: 2009269 - RNA, 21 nt, Shigella flexneri 2a str. 301
gccgugucggugcucaucagc

SEQ ID NO: 2009270 - RNA, 12 nt, Shigella flexneri 2a str. 301
gccgugcgaaua

SEQ ID NO: 2009271 - RNA, 19 nt, Shigella flexneri 2a str. 301
gccuaacaauucgccaggg

SEQ ID NO: 2009272 - RNA, 15 nt, Shigella flexneri 2a str. 301
gccuaacaccaucag

SEQ ID NO: 2009273 - RNA, 18 nt, Shigella flexneri 2a str. 301
gccuaacgacaaaucaua

SEQ ID NO: 2009274 - RNA, 15 nt, Shigella flexneri 2a str. 301
gccuaccaaaccugc

SEQ ID NO: 2009275 - RNA, 22 nt, Shigella flexneri 2a str. 301
gccuaagcgaacuguugagagu

SEQ ID NO: 2009276 - RNA, 13 nt, Shigella flexneri 2a str. 301
gccguucuucccg

SEQ ID NO: 2009277 - RNA, 14 nt, Shigella flexneri 2a str. 301
gccguuuucgucaa

SEQ ID NO: 2009278 - RNA, 17 nt, Shigella flexneri 2a str. 301
gccguuuuuuugacggu

SEQ ID NO: 2009279 - RNA, 22 nt, Shigella flexneri 2a str. 301
gccguacggcguaccgccgcga

SEQ ID NO: 2009280 - RNA, 15 nt, Shigella flexneri 2a str. 301
gccguacaggcagcu

SEQ ID NO: 2009281 - RNA, 18 nt, Shigella flexneri 2a str. 301
gccguagagcaccggcgg

SEQ ID NO: 2009282 - RNA, 22 nt, Shigella flexneri 2a str. 301
gccgucauuguuaacgccgcgc

SEQ ID NO: 2009283 - RNA, 22 nt, Shigella flexneri 2a str. 301
gccgucagccacuucuuccagc

SEQ ID NO: 2009284 - RNA, 22 nt, Shigella flexneri 2a str. 301
gccgucgaugucuggcugagca

SEQ ID NO: 2009285 - RNA, 13 nt, Shigella flexneri 2a str. 301
gccgguggccuug

SEQ ID NO: 2009286 - RNA, 16 nt, Shigella flexneri 2a str. 301
gccgguggugaccugu

SEQ ID NO: 2009287 - RNA, 20 nt, Shigella flexneri 2a str. 301
gccggucugguguaucugcu

SEQ ID NO: 2009288 - RNA, 21 nt, Shigella flexneri 2a str. 301
gccgguagucaccgcccagug

SEQ ID NO: 2009289 - RNA, 13 nt, Shigella flexneri 2a str. 301
gccgguauccagc

SEQ ID NO: 2009290 - RNA, 18 nt, Shigella flexneri 2a str. 301
gccggucaacgcgcggcu

SEQ ID NO: 2009291 - RNA, 22 nt, Shigella flexneri 2a str. 301
gccgguaacgcuuucucaccau

SEQ ID NO: 2009292 - RNA, 17 nt, Shigella flexneri 2a str. 301
gccgguaaaucaccagc

SEQ ID NO: 2009293 - RNA, 19 nt, Shigella flexneri 2a str. 301
gccgggcuucgguuaguaa

SEQ ID NO: 2009294 - RNA, 21 nt, Shigella flexneri 2a str. 301
gccggggagauauuccccaga

SEQ ID NO: 2009295 - RNA, 15 nt, Shigella flexneri 2a str. 301
gccggggcgcggcgg

SEQ ID NO: 2009296 - RNA, 20 nt, Shigella flexneri 2a str. 301
gguucauuggguucaucuga

SEQ ID NO: 2009297 - RNA, 20 nt, Shigella flexneri 2a str. 301
gguuccacuucugcggguga

SEQ ID NO: 2009298 - RNA, 22 nt, Shigella flexneri 2a str. 301
gguucgggaaauugcagagcug

SEQ ID NO: 2009299 - RNA, 21 nt, Shigella flexneri 2a str. 301
gguucguaagcgauaaccgca

SEQ ID NO: 2009300 - RNA, 14 nt, Shigella flexneri 2a str. 301
gguuaguaugaaga

SEQ ID NO: 2009301 - RNA, 17 nt, Shigella flexneri 2a str. 301
gguuagucugcauuuuc

SEQ ID NO: 2009302 - RNA, 13 nt, Shigella flexneri 2a str. 301
gguuauauuuccc

SEQ ID NO: 2009303 - RNA, 11 nt, Shigella flexneri 2a str. 301
gguuagccugu

SEQ ID NO: 2009304 - RNA, 16 nt, Shigella flexneri 2a str. 301
gguuaaucggcaggga

SEQ ID NO: 2009305 - RNA, 19 nt, Shigella flexneri 2a str. 301
gguuaauaccgagcguuca

SEQ ID NO: 2009306 - RNA, 18 nt, Shigella flexneri 2a str. 301
gguuaccgacugcggccu

SEQ ID NO: 2009307 - RNA, 11 nt, Shigella flexneri 2a str. 301
gguuauugguu

SEQ ID NO: 2009308 - RNA, 16 nt, Shigella flexneri 2a str. 301
gguuauccagcaacca

SEQ ID NO: 2009309 - RNA, 14 nt, Shigella flexneri 2a str. 301
gguucaaaguaaua

SEQ ID NO: 2009310 - RNA, 13 nt, Shigella flexneri 2a str. 301
gguucaccgguga

SEQ ID NO: 2009311 - RNA, 19 nt, Shigella flexneri 2a str. 301
gguucaaguccccccccuc

SEQ ID NO: 2009312 - RNA, 17 nt, Shigella flexneri 2a str. 301
gguguggcauggcgaau

SEQ ID NO: 2009313 - RNA, 19 nt, Shigella flexneri 2a str. 301
ggugucguuacgccgcaga

SEQ ID NO: 2009314 - RNA, 20 nt, Shigella flexneri 2a str. 301
gguguucagauggccaauaa

SEQ ID NO: 2009315 - RNA, 22 nt, Shigella flexneri 2a str. 301
gguguucauccuggcacagcag

SEQ ID NO: 2009316 - RNA, 12 nt, Shigella flexneri 2a str. 301
gguuaaccagca

SEQ ID NO: 2009317 - RNA, 21 nt, Shigella flexneri 2a str. 301
ggugucgccuuccacuucugc

SEQ ID NO: 2009318 - RNA, 16 nt, Shigella flexneri 2a str. 301
ggugucaaccagccag

SEQ ID NO: 2009319 - RNA, 17 nt, Shigella flexneri 2a str. 301
ggugucaaccagccagc

SEQ ID NO: 2009320 - RNA, 15 nt, Shigella flexneri 2a str. 301
ggugucacaugcagc

SEQ ID NO: 2009321 - RNA, 13 nt, Shigella flexneri 2a str. 301
gguuggcgugcgg

SEQ ID NO: 2009322 - RNA, 14 nt, Shigella flexneri 2a str. 301
gguuggcucaucaa

SEQ ID NO: 2009323 - RNA, 13 nt, Shigella flexneri 2a str. 301
gguuggagcgcgu

SEQ ID NO: 2009324 - RNA, 18 nt, Shigella flexneri 2a str. 301
gguugcuggaaagagaaa

SEQ ID NO: 2009325 - RNA, 16 nt, Shigella flexneri 2a str. 301
gguugcucauaaaaug

SEQ ID NO: 2009326 - RNA, 23 nt, Shigella flexneri 2a str. 301
gguuuaagacaauuuaauaagaa

SEQ ID NO: 2009327 - RNA, 17 nt, Shigella flexneri 2a str. 301
gguugugagcauaacgu

SEQ ID NO: 2009328 - RNA, 13 nt, Shigella flexneri 2a str. 301
gguugauggcagu

SEQ ID NO: 2009329 - RNA, 14 nt, Shigella flexneri 2a str. 301
gguugacgccccug

SEQ ID NO: 2009330 - RNA, 21 nt, Shigella flexneri 2a str. 301
gguucuuuggucaggcgcuga

SEQ ID NO: 2009331 - RNA, 20 nt, Shigella flexneri 2a str. 301
gguucugcggguuagucugc

SEQ ID NO: 2009332 - RNA, 16 nt, Shigella flexneri 2a str. 301
guaaaaacgcauuuau

SEQ ID NO: 2009333 - RNA, 18 nt, Shigella flexneri 2a str. 301
guaaaaacgcauuuaucu

SEQ ID NO: 2009334 - RNA, 20 nt, Shigella flexneri 2a str. 301
gguuuugcccacagagcuga

SEQ ID NO: 2009335 - RNA, 21 nt, Shigella flexneri 2a str. 301
gguuuugaaacucgcugccag

SEQ ID NO: 2009336 - RNA, 15 nt, Shigella flexneri 2a str. 301
gguuuuguuuaaaua

SEQ ID NO: 2009337 - RNA, 14 nt, Shigella flexneri 2a str. 301
gguuuuugcugacg

SEQ ID NO: 2009338 - RNA, 16 nt, Shigella flexneri 2a str. 301
guaaaaccgauauguu

SEQ ID NO: 2009339 - RNA, 21 nt, Shigella flexneri 2a str. 301
guaaaaccgacuuaaaaggaa

SEQ ID NO: 2009340 - RNA, 18 nt, Shigella flexneri 2a str. 301
guaaaaccugacaacaaa

SEQ ID NO: 2009341 - RNA, 19 nt, Shigella flexneri 2a str. 301
guaaaaacgcauuuaucuu

SEQ ID NO: 2009342 - RNA, 12 nt, Shigella flexneri 2a str. 301
guaaaaagaaag

SEQ ID NO: 2009343 - RNA, 11 nt, Shigella flexneri 2a str. 301
gguuuuaucca

SEQ ID NO: 2009344 - RNA, 23 nt, Shigella flexneri 2a str. 301
gguuuuauuauuccauccugcuc

SEQ ID NO: 2009345 - RNA, 17 nt, Shigella flexneri 2a str. 301
gguuuucaaucgacuuu

SEQ ID NO: 2009346 - RNA, 12 nt, Shigella flexneri 2a str. 301
gguuuucaaucg

SEQ ID NO: 2009347 - RNA, 23 nt, Shigella flexneri 2a str. 301
gguuuucaucccgagucgcugag

SEQ ID NO: 2009348 - RNA, 19 nt, Shigella flexneri 2a str. 301
gguuucaagauuagccccc

SEQ ID NO: 2009349 - RNA, 14 nt, Shigella flexneri 2a str. 301
gguuucaauuuccc

SEQ ID NO: 2009350 - RNA, 18 nt, Shigella flexneri 2a str. 301
gguuucacguaccagaug

SEQ ID NO: 2009351 - RNA, 14 nt, Shigella flexneri 2a str. 301
gguuucacccacgg

SEQ ID NO: 2009352 - RNA, 18 nt, Shigella flexneri 2a str. 301
gguuucgccacggcgcag

SEQ ID NO: 2009353 - RNA, 16 nt, Shigella flexneri 2a str. 301
gguuuccucaugcaua

SEQ ID NO: 2009354 - RNA, 23 nt, Shigella flexneri 2a str. 301
ggugauaaucaucccacaugaau

SEQ ID NO: 2009355 - RNA, 22 nt, Shigella flexneri 2a str. 301
ggugauacguccaccccagcag

SEQ ID NO: 2009356 - RNA, 15 nt, Shigella flexneri 2a str. 301
ggugaucagccccgg

SEQ ID NO: 2009357 - RNA, 14 nt, Shigella flexneri 2a str. 301
ggugaugaucgcgc

SEQ ID NO: 2009358 - RNA, 12 nt, Shigella flexneri 2a str. 301
ggugauuacauc

SEQ ID NO: 2009359 - RNA, 19 nt, Shigella flexneri 2a str. 301
ggugauguuuaucgucugg

SEQ ID NO: 2009360 - RNA, 17 nt, Shigella flexneri 2a str. 301
ggugcaacccgccaggu

SEQ ID NO: 2009361 - RNA, 20 nt, Shigella flexneri 2a str. 301
ggugcaguggcuccagcgca

SEQ ID NO: 2009362 - RNA, 15 nt, Shigella flexneri 2a str. 301
ggugcagaaucaauc

SEQ ID NO: 2009363 - RNA, 13 nt, Shigella flexneri 2a str. 301
ggugagggaggau

SEQ ID NO: 2009364 - RNA, 20 nt, Shigella flexneri 2a str. 301
ggugagggaggauuucuccc

SEQ ID NO: 2009365 - RNA, 15 nt, Shigella flexneri 2a str. 301
ggugagcgaugcugc

SEQ ID NO: 2009366 - RNA, 14 nt, Shigella flexneri 2a str. 301
ggugagcgugcggu

SEQ ID NO: 2009367 - RNA, 17 nt, Shigella flexneri 2a str. 301
ggugagcuaaugcaaau

SEQ ID NO: 2009368 - RNA, 17 nt, Shigella flexneri 2a str. 301
ggugacgcgggcagcag

SEQ ID NO: 2009369 - RNA, 19 nt, Shigella flexneri 2a str. 301
ggugacgcaaccgcaaaug

SEQ ID NO: 2009370 - RNA, 18 nt, Shigella flexneri 2a str. 301
ggugaccgaucgcccgcc

SEQ ID NO: 2009371 - RNA, 21 nt, Shigella flexneri 2a str. 301
ggugacaaucaccaggucacc

SEQ ID NO: 2009372 - RNA, 17 nt, Shigella flexneri 2a str. 301
ggugacaaagugccugu

SEQ ID NO: 2009373 - RNA, 18 nt, Shigella flexneri 2a str. 301
ggcuccgggcgcaccagu

SEQ ID NO: 2009374 - RNA, 21 nt, Shigella flexneri 2a str. 301
ggcuccgggaaaacgcuggca

SEQ ID NO: 2009375 - RNA, 13 nt, Shigella flexneri 2a str. 301
ggcucaucaaaca

SEQ ID NO: 2009376 - RNA, 16 nt, Shigella flexneri 2a str. 301
ggcucauaccuuccac

SEQ ID NO: 2009377 - RNA, 18 nt, Shigella flexneri 2a str. 301
ggcuccgcugacgccugc

SEQ ID NO: 2009378 - RNA, 15 nt, Shigella flexneri 2a str. 301
gguggccauccgcgu

SEQ ID NO: 2009379 - RNA, 14 nt, Shigella flexneri 2a str. 301
gguggcaaagaaau

SEQ ID NO: 2009380 - RNA, 13 nt, Shigella flexneri 2a str. 301
ggugcuuuugcug

SEQ ID NO: 2009381 - RNA, 22 nt, Shigella flexneri 2a str. 301
ggugcuuuaacgaaagcgccuc

SEQ ID NO: 2009382 - RNA, 18 nt, Shigella flexneri 2a str. 301
gguggcggaauugguaga

SEQ ID NO: 2009383 - RNA, 12 nt, Shigella flexneri 2a str. 301
ggugggcggcgu

SEQ ID NO: 2009384 - RNA, 13 nt, Shigella flexneri 2a str. 301
ggugggggaagga

SEQ ID NO: 2009385 - RNA, 14 nt, Shigella flexneri 2a str. 301
ggugcggcaaaaac

SEQ ID NO: 2009386 - RNA, 20 nt, Shigella flexneri 2a str. 301
ggugcgacaaacauugcugc

SEQ ID NO: 2009387 - RNA, 23 nt, Shigella flexneri 2a str. 301
ggugccuugugaguuccgcugcu

SEQ ID NO: 2009388 - RNA, 16 nt, Shigella flexneri 2a str. 301
ggugcgaugaacgccu

SEQ ID NO: 2009389 - RNA, 16 nt, Shigella flexneri 2a str. 301
ggugccgugaagaaac

SEQ ID NO: 2009390 - RNA, 13 nt, Shigella flexneri 2a str. 301
ggugccgcgcagc

SEQ ID NO: 2009391 - RNA, 18 nt, Shigella flexneri 2a str. 301
guacgcguucaaucaaau

SEQ ID NO: 2009392 - RNA, 16 nt, Shigella flexneri 2a str. 301
guacgcgccccacugg

SEQ ID NO: 2009393 - RNA, 13 nt, Shigella flexneri 2a str. 301
guacgacaagucu

SEQ ID NO: 2009394 - RNA, 15 nt, Shigella flexneri 2a str. 301
guacgacaaaagaau

SEQ ID NO: 2009395 - RNA, 13 nt, Shigella flexneri 2a str. 301
guacgaaauaacu

SEQ ID NO: 2009396 - RNA, 14 nt, Shigella flexneri 2a str. 301
guacgacuuccugg

SEQ ID NO: 2009397 - RNA, 15 nt, Shigella flexneri 2a str. 301
guacgcaggcggcug

SEQ ID NO: 2009398 - RNA, 14 nt, Shigella flexneri 2a str. 301
guacgcccagcgcu

SEQ ID NO: 2009399 - RNA, 12 nt, Shigella flexneri 2a str. 301
guaccgcagcaa

SEQ ID NO: 2009400 - RNA, 22 nt, Shigella flexneri 2a str. 301
guaccgccgccauaaacagcag

SEQ ID NO: 2009401 - RNA, 12 nt, Shigella flexneri 2a str. 301
guaccuccuuca

SEQ ID NO: 2009402 - RNA, 20 nt, Shigella flexneri 2a str. 301
guaccacgguacgccagagu

SEQ ID NO: 2009403 - RNA, 20 nt, Shigella flexneri 2a str. 301
guaccacgcaaagcacgcca

SEQ ID NO: 2009404 - RNA, 18 nt, Shigella flexneri 2a str. 301
guaccaccggacgcacac

SEQ ID NO: 2009405 - RNA, 17 nt, Shigella flexneri 2a str. 301
guaccaugcgcaucauc

SEQ ID NO: 2009406 - RNA, 18 nt, Shigella flexneri 2a str. 301
guaccaugcgcaucaucg

SEQ ID NO: 2009407 - RNA, 19 nt, Shigella flexneri 2a str. 301
guaccaucguccagcagca

SEQ ID NO: 2009408 - RNA, 16 nt, Shigella flexneri 2a str. 301
guaccaugauccugca

SEQ ID NO: 2009409 - RNA, 15 nt, Shigella flexneri 2a str. 301
guacauuaaaauugg

SEQ ID NO: 2009410 - RNA, 18 nt, Shigella flexneri 2a str. 301
guacauuguuuuccagac

SEQ ID NO: 2009411 - RNA, 20 nt, Shigella flexneri 2a str. 301
guaccaccagaaucgccagc

SEQ ID NO: 2009412 - RNA, 19 nt, Shigella flexneri 2a str. 301
guaccaccagaaucgccag

SEQ ID NO: 2009413 - RNA, 23 nt, Shigella flexneri 2a str. 301
guacagagguaagauguucuauc

SEQ ID NO: 2009414 - RNA, 19 nt, Shigella flexneri 2a str. 301
guacagacagauaaaaugc

SEQ ID NO: 2009415 - RNA, 16 nt, Shigella flexneri 2a str. 301
guacagaugccaauca

SEQ ID NO: 2009416 - RNA, 14 nt, Shigella flexneri 2a str. 301
guacacuuuccugg

SEQ ID NO: 2009417 - RNA, 12 nt, Shigella flexneri 2a str. 301
guacaggcacau

SEQ ID NO: 2009418 - RNA, 12 nt, Shigella flexneri 2a str. 301
guacaggcagcu

SEQ ID NO: 2009419 - RNA, 19 nt, Shigella flexneri 2a str. 301
guacaucguagugaugcca

SEQ ID NO: 2009420 - RNA, 15 nt, Shigella flexneri 2a str. 301
guacaucaauaccau

SEQ ID NO: 2009421 - RNA, 17 nt, Shigella flexneri 2a str. 301
guacaugaagcacugca

SEQ ID NO: 2009422 - RNA, 19 nt, Shigella flexneri 2a str. 301
aaauagaauggcaucagaa

SEQ ID NO: 2009423 - RNA, 15 nt, Shigella flexneri 2a str. 301
guaaucauauuaaau

SEQ ID NO: 2009424 - RNA, 16 nt, Shigella flexneri 2a str. 301
guaaucauauugcucu

SEQ ID NO: 2009425 - RNA, 12 nt, Shigella flexneri 2a str. 301
guaaucaccaca

SEQ ID NO: 2009426 - RNA, 14 nt, Shigella flexneri 2a str. 301
guaaucaccacaug

SEQ ID NO: 2009427 - RNA, 18 nt, Shigella flexneri 2a str. 301
guaaucaccacccauuuu

SEQ ID NO: 2009428 - RNA, 20 nt, Shigella flexneri 2a str. 301
guaaucaacauauuccccug

SEQ ID NO: 2009429 - RNA, 20 nt, Shigella flexneri 2a str. 301
guaaucaacuccgccagcaa

SEQ ID NO: 2009430 - RNA, 19 nt, Shigella flexneri 2a str. 301
guaaucgccagcaaaauca

SEQ ID NO: 2009431 - RNA, 17 nt, Shigella flexneri 2a str. 301
guaaugcuuauuucacc

SEQ ID NO: 2009432 - RNA, 22 nt, Shigella flexneri 2a str. 301
guaaugccguuuuggguguaca

SEQ ID NO: 2009433 - RNA, 21 nt, Shigella flexneri 2a str. 301
guaaugccugggcgauuuccu

SEQ ID NO: 2009434 - RNA, 14 nt, Shigella flexneri 2a str. 301
guaaugcucaauuc

SEQ ID NO: 2009435 - RNA, 22 nt, Shigella flexneri 2a str. 301
guaaugcucgacgagaauuucc

SEQ ID NO: 2009436 - RNA, 14 nt, Shigella flexneri 2a str. 301
guaaugauguaaaa

SEQ ID NO: 2009437 - RNA, 13 nt, Shigella flexneri 2a str. 301
guaaugauuuaau

SEQ ID NO: 2009438 - RNA, 15 nt, Shigella flexneri 2a str. 301
guaaugacuccaacu

SEQ ID NO: 2009439 - RNA, 14 nt, Shigella flexneri 2a str. 301
guaaugauacuaua

SEQ ID NO: 2009440 - RNA, 16 nt, Shigella flexneri 2a str. 301
guaaugacaacaucuu

SEQ ID NO: 2009441 - RNA, 17 nt, Shigella flexneri 2a str. 301
guaaucguauucaacgg

SEQ ID NO: 2009442 - RNA, 12 nt, Shigella flexneri 2a str. 301
aaauagcaaagu

SEQ ID NO: 2009443 - RNA, 17 nt, Shigella flexneri 2a str. 301
guaaucggcgaaaccgc

SEQ ID NO: 2009444 - RNA, 19 nt, Shigella flexneri 2a str. 301
guacaaucguuucaugcca

SEQ ID NO: 2009445 - RNA, 20 nt, Shigella flexneri 2a str. 301
guacaaagccaacagcagcc

SEQ ID NO: 2009446 - RNA, 13 nt, Shigella flexneri 2a str. 301
guacaaacaucau

SEQ ID NO: 2009447 - RNA, 12 nt, Shigella flexneri 2a str. 301
guacaaccgcaa

SEQ ID NO: 2009448 - RNA, 12 nt, Shigella flexneri 2a str. 301
guaauuuuuaua

SEQ ID NO: 2009449 - RNA, 16 nt, Shigella flexneri 2a str. 301
guaauuugaucgaugg

SEQ ID NO: 2009450 - RNA, 14 nt, Shigella flexneri 2a str. 301
guaauuaagcccgg

SEQ ID NO: 2009451 - RNA, 19 nt, Shigella flexneri 2a str. 301
guaauuaacuuuucauccu

SEQ ID NO: 2009452 - RNA, 22 nt, Shigella flexneri 2a str. 301
guaauuaagcgcaaaggccagc

SEQ ID NO: 2009453 - RNA, 21 nt, Shigella flexneri 2a str. 301
guaauuauaugccagccccag

SEQ ID NO: 2009454 - RNA, 15 nt, Shigella flexneri 2a str. 301
guaauuucacaaguu

SEQ ID NO: 2009455 - RNA, 14 nt, Shigella flexneri 2a str. 301
guaauuucacaagu

SEQ ID NO: 2009456 - RNA, 18 nt, Shigella flexneri 2a str. 301
guaauuggccugacaggu

SEQ ID NO: 2009457 - RNA, 20 nt, Shigella flexneri 2a str. 301
guaauugcuuuuaccauacu

SEQ ID NO: 2009458 - RNA, 22 nt, Shigella flexneri 2a str. 301
guaauugcuuuuaccauacugg

SEQ ID NO: 2009459 - RNA, 21 nt, Shigella flexneri 2a str. 301
guaauugagaaccacaaugaa

SEQ ID NO: 2009460 - RNA, 18 nt, Shigella flexneri 2a str. 301
guaaccguugaccagcau

SEQ ID NO: 2009461 - RNA, 17 nt, Shigella flexneri 2a str. 301
guaaccgcggcuaagcu

SEQ ID NO: 2009462 - RNA, 18 nt, Shigella flexneri 2a str. 301
guaacccccaaauaaccc

SEQ ID NO: 2009463 - RNA, 22 nt, Shigella flexneri 2a str. 301
guaaccuuuaucgcgcagcaga

SEQ ID NO: 2009464 - RNA, 22 nt, Shigella flexneri 2a str. 301
guaacgcacacauccacaaugc

SEQ ID NO: 2009465 - RNA, 19 nt, Shigella flexneri 2a str. 301
guaacgauggcaauuuuca

SEQ ID NO: 2009466 - RNA, 14 nt, Shigella flexneri 2a str. 301
guaacggcagauga

SEQ ID NO: 2009467 - RNA, 18 nt, Shigella flexneri 2a str. 301
guaacgcacugguggugc

SEQ ID NO: 2009468 - RNA, 22 nt, Shigella flexneri 2a str. 301
guaacgccagcggucauaacgc

SEQ ID NO: 2009469 - RNA, 16 nt, Shigella flexneri 2a str. 301
guaacucacugaugcc

SEQ ID NO: 2009470 - RNA, 21 nt, Shigella flexneri 2a str. 301
guaacguagcgggaagugaaa

SEQ ID NO: 2009471 - RNA, 15 nt, Shigella flexneri 2a str. 301
guaagagaacagaua

SEQ ID NO: 2009472 - RNA, 14 nt, Shigella flexneri 2a str. 301
guaagaacguaaau

SEQ ID NO: 2009473 - RNA, 15 nt, Shigella flexneri 2a str. 301
guaagaacaagcaaa

SEQ ID NO: 2009474 - RNA, 17 nt, Shigella flexneri 2a str. 301
guaagaacaagcaaacc

SEQ ID NO: 2009475 - RNA, 17 nt, Shigella flexneri 2a str. 301
guaacugucuucaccau

SEQ ID NO: 2009476 - RNA, 15 nt, Shigella flexneri 2a str. 301
guaacugaagcauug

SEQ ID NO: 2009477 - RNA, 22 nt, Shigella flexneri 2a str. 301
guaacugcugcucaaucugcgc

SEQ ID NO: 2009478 - RNA, 13 nt, Shigella flexneri 2a str. 301
guaaguggaugcc

SEQ ID NO: 2009479 - RNA, 13 nt, Shigella flexneri 2a str. 301
guaaguuuaaccu

SEQ ID NO: 2009480 - RNA, 17 nt, Shigella flexneri 2a str. 301
guaaguuagaggcacau

SEQ ID NO: 2009481 - RNA, 22 nt, Shigella flexneri 2a str. 301
guaaguacauuaaaauuggcuu

SEQ ID NO: 2009482 - RNA, 15 nt, Shigella flexneri 2a str. 301
guaaguccauacugu

SEQ ID NO: 2009483 - RNA, 14 nt, Shigella flexneri 2a str. 301
guaagcgauaacgc

SEQ ID NO: 2009484 - RNA, 15 nt, Shigella flexneri 2a str. 301
guaagcgccagggca

SEQ ID NO: 2009485 - RNA, 16 nt, Shigella flexneri 2a str. 301
guaagcgccagggcau

SEQ ID NO: 2009486 - RNA, 15 nt, Shigella flexneri 2a str. 301
guaagcguacagcga

SEQ ID NO: 2009487 - RNA, 22 nt, Shigella flexneri 2a str. 301
guaagcugugcgauagcaacga

SEQ ID NO: 2009488 - RNA, 19 nt, Shigella flexneri 2a str. 301
guaagggaggauuucuccc

SEQ ID NO: 2009489 - RNA, 18 nt, Shigella flexneri 2a str. 301
guaauaaugcccaucgug

SEQ ID NO: 2009490 - RNA, 17 nt, Shigella flexneri 2a str. 301
guaauaauuacuuacau

SEQ ID NO: 2009491 - RNA, 17 nt, Shigella flexneri 2a str. 301
guaauaccagccuucuu

SEQ ID NO: 2009492 - RNA, 20 nt, Shigella flexneri 2a str. 301
guaauaggcaggcaucauca

SEQ ID NO: 2009493 - RNA, 16 nt, Shigella flexneri 2a str. 301
guaacaguuaccuuua

SEQ ID NO: 2009494 - RNA, 13 nt, Shigella flexneri 2a str. 301
guaacagagcauc

SEQ ID NO: 2009495 - RNA, 23 nt, Shigella flexneri 2a str. 301
guaaccaaacguggucgccagca

SEQ ID NO: 2009496 - RNA, 15 nt, Shigella flexneri 2a str. 301
guaaauugccccaga

SEQ ID NO: 2009497 - RNA, 19 nt, Shigella flexneri 2a str. 301
guaacaauauuugcagagg

SEQ ID NO: 2009498 - RNA, 20 nt, Shigella flexneri 2a str. 301
guaacagaacgcauaacagc

SEQ ID NO: 2009499 - RNA, 15 nt, Shigella flexneri 2a str. 301
guaacagcggacggc

SEQ ID NO: 2009500 - RNA, 14 nt, Shigella flexneri 2a str. 301
guaaaucaaaccaa

SEQ ID NO: 2009501 - RNA, 15 nt, Shigella flexneri 2a str. 301
guaaauaucggcauu

SEQ ID NO: 2009502 - RNA, 18 nt, Shigella flexneri 2a str. 301
guaaauaaaccaccuggg

SEQ ID NO: 2009503 - RNA, 14 nt, Shigella flexneri 2a str. 301
guaaaugcagauaa

SEQ ID NO: 2009504 - RNA, 19 nt, Shigella flexneri 2a str. 301
guaaauucucaauaucauc

SEQ ID NO: 2009505 - RNA, 17 nt, Shigella flexneri 2a str. 301
guaaauugcaaaccuca

SEQ ID NO: 2009506 - RNA, 20 nt, Shigella flexneri 2a str. 301
guaaauugcaaaccucagga

SEQ ID NO: 2009507 - RNA, 22 nt, Shigella flexneri 2a str. 301
guaaauugcaaaccucaggaau

SEQ ID NO: 2009508 - RNA, 15 nt, Shigella flexneri 2a str. 301
guaaauucaauaaau

SEQ ID NO: 2009509 - RNA, 20 nt, Shigella flexneri 2a str. 301
guaaagcccauaccacagca

SEQ ID NO: 2009510 - RNA, 13 nt, Shigella flexneri 2a str. 301
guaaagccgauua

SEQ ID NO: 2009511 - RNA, 20 nt, Shigella flexneri 2a str. 301
guaaagcggcgaguauucuu

SEQ ID NO: 2009512 - RNA, 22 nt, Shigella flexneri 2a str. 301
guaaaguacaauaucccugugu

SEQ ID NO: 2009513 - RNA, 23 nt, Shigella flexneri 2a str. 301
guaaaguuaccuucgaagaacuc

SEQ ID NO: 2009514 - RNA, 22 nt, Shigella flexneri 2a str. 301
guaaagugcgagucgucaguuc

SEQ ID NO: 2009515 - RNA, 14 nt, Shigella flexneri 2a str. 301
guaaacucaaaguc

SEQ ID NO: 2009516 - RNA, 13 nt, Shigella flexneri 2a str. 301
guaaagaagguaa

SEQ ID NO: 2009517 - RNA, 14 nt, Shigella flexneri 2a str. 301
guaaaccucuuucg

SEQ ID NO: 2009518 - RNA, 17 nt, Shigella flexneri 2a str. 301
guaaaccgucagcacca

SEQ ID NO: 2009519 - RNA, 17 nt, Shigella flexneri 2a str. 301
guaaaccguuaucaccu

SEQ ID NO: 2009520 - RNA, 16 nt, Shigella flexneri 2a str. 301
guaaacgcagcaucau

SEQ ID NO: 2009521 - RNA, 14 nt, Shigella flexneri 2a str. 301
guaaacgccuuauc

SEQ ID NO: 2009522 - RNA, 19 nt, Shigella flexneri 2a str. 301
guaaacgccuuauccgacu

SEQ ID NO: 2009523 - RNA, 17 nt, Shigella flexneri 2a str. 301
guaaacgugcggcugug

SEQ ID NO: 2009524 - RNA, 15 nt, Shigella flexneri 2a str. 301
guaaacaaacaacgc

SEQ ID NO: 2009525 - RNA, 15 nt, Shigella flexneri 2a str. 301
guaaacaacuggcgc

SEQ ID NO: 2009526 - RNA, 21 nt, Shigella flexneri 2a str. 301
guaaacagauaggcaucagca

SEQ ID NO: 2009527 - RNA, 19 nt, Shigella flexneri 2a str. 301
guaaaccgcucgucacauc

SEQ ID NO: 2009528 - RNA, 19 nt, Shigella flexneri 2a str. 301
guaaacccuaacaucaucc

SEQ ID NO: 2009529 - RNA, 16 nt, Shigella flexneri 2a str. 301
guaaacccagccgcgu

SEQ ID NO: 2009530 - RNA, 18 nt, Shigella flexneri 2a str. 301
guaaaccagagagaagcu

SEQ ID NO: 2009531 - RNA, 20 nt, Shigella flexneri 2a str. 301
guaaaaggcgccauuuucau

SEQ ID NO: 2009532 - RNA, 21 nt, Shigella flexneri 2a str. 301
guaaaacggauaugauuuaaa

SEQ ID NO: 2009533 - RNA, 22 nt, Shigella flexneri 2a str. 301
guaaaacggauaugauuuaaaa

SEQ ID NO: 2009534 - RNA, 22 nt, Shigella flexneri 2a str. 301
guaaaaugagugccaaaaaaau

SEQ ID NO: 2009535 - RNA, 18 nt, Shigella flexneri 2a str. 301
guacuggcaaucgccagc

SEQ ID NO: 2009536 - RNA, 14 nt, Shigella flexneri 2a str. 301
guacuggccuccac

SEQ ID NO: 2009537 - RNA, 19 nt, Shigella flexneri 2a str. 301
guacugccgaacagaaugc

SEQ ID NO: 2009538 - RNA, 22 nt, Shigella flexneri 2a str. 301
guacugcauaaaggaagccccu

SEQ ID NO: 2009539 - RNA, 13 nt, Shigella flexneri 2a str. 301
guacgucgagaau

SEQ ID NO: 2009540 - RNA, 15 nt, Shigella flexneri 2a str. 301
guacguggaggaugg

SEQ ID NO: 2009541 - RNA, 15 nt, Shigella flexneri 2a str. 301
guagaaaaucucaau

SEQ ID NO: 2009542 - RNA, 13 nt, Shigella flexneri 2a str. 301
guacuuuugaaug

SEQ ID NO: 2009543 - RNA, 23 nt, Shigella flexneri 2a str. 301
guacuuuuuccuuaaacaccugg

SEQ ID NO: 2009544 - RNA, 22 nt, Shigella flexneri 2a str. 301
guagaagcugacgacgaagaaa

SEQ ID NO: 2009545 - RNA, 21 nt, Shigella flexneri 2a str. 301
guagacugcagcggucacaug

SEQ ID NO: 2009546 - RNA, 15 nt, Shigella flexneri 2a str. 301
guagacucaagcagu

SEQ ID NO: 2009547 - RNA, 18 nt, Shigella flexneri 2a str. 301
guagacugcagcggucac

SEQ ID NO: 2009548 - RNA, 19 nt, Shigella flexneri 2a str. 301
guagagguuauaaauaaaa

SEQ ID NO: 2009549 - RNA, 14 nt, Shigella flexneri 2a str. 301
guagagaauccagu

SEQ ID NO: 2009550 - RNA, 13 nt, Shigella flexneri 2a str. 301
guagaugauuuuu

SEQ ID NO: 2009551 - RNA, 15 nt, Shigella flexneri 2a str. 301
guagaucuugauuua

SEQ ID NO: 2009552 - RNA, 19 nt, Shigella flexneri 2a str. 301
guagcagcuuucagcagcg

SEQ ID NO: 2009553 - RNA, 15 nt, Shigella flexneri 2a str. 301
guagcaggccggaga

SEQ ID NO: 2009554 - RNA, 13 nt, Shigella flexneri 2a str. 301
guagcaggcaggc

SEQ ID NO: 2009555 - RNA, 19 nt, Shigella flexneri 2a str. 301
guagcagguaaucugccau

SEQ ID NO: 2009556 - RNA, 14 nt, Shigella flexneri 2a str. 301
guagccagacaaug

SEQ ID NO: 2009557 - RNA, 23 nt, Shigella flexneri 2a str. 301
guagccaaucccggaagccacca

SEQ ID NO: 2009558 - RNA, 23 nt, Shigella flexneri 2a str. 301
guagccaauaaaugccaccacac

SEQ ID NO: 2009559 - RNA, 14 nt, Shigella flexneri 2a str. 301
guagccauucccuc

SEQ ID NO: 2009560 - RNA, 15 nt, Shigella flexneri 2a str. 301
guagugcccgcagua

SEQ ID NO: 2009561 - RNA, 16 nt, Shigella flexneri 2a str. 301
guaguggaucagcaaa

SEQ ID NO: 2009562 - RNA, 15 nt, Shigella flexneri 2a str. 301
guagugccgucagca

SEQ ID NO: 2009563 - RNA, 16 nt, Shigella flexneri 2a str. 301
guaguauagaaagaua

SEQ ID NO: 2009564 - RNA, 15 nt, Shigella flexneri 2a str. 301
guaguauccacacca

SEQ ID NO: 2009565 - RNA, 22 nt, Shigella flexneri 2a str. 301
guaguauccgugccgagguggu

SEQ ID NO: 2009566 - RNA, 22 nt, Shigella flexneri 2a str. 301
guaguauuugaguucacugccg

SEQ ID NO: 2009567 - RNA, 18 nt, Shigella flexneri 2a str. 301
guaggccggauaaggcgc

SEQ ID NO: 2009568 - RNA, 22 nt, Shigella flexneri 2a str. 301
guaggccuaguccguaggcagg

SEQ ID NO: 2009569 - RNA, 17 nt, Shigella flexneri 2a str. 301
guaggccugagaagcgc

SEQ ID NO: 2009570 - RNA, 14 nt, Shigella flexneri 2a str. 301
guaggucacucccg

SEQ ID NO: 2009571 - RNA, 17 nt, Shigella flexneri 2a str. 301
guagccuuuuucagccg

SEQ ID NO: 2009572 - RNA, 15 nt, Shigella flexneri 2a str. 301
guagccucgccgagc

SEQ ID NO: 2009573 - RNA, 20 nt, Shigella flexneri 2a str. 301
guagcguuuuauaccaacaa

SEQ ID NO: 2009574 - RNA, 15 nt, Shigella flexneri 2a str. 301
guagcgucgccagca

SEQ ID NO: 2009575 - RNA, 17 nt, Shigella flexneri 2a str. 301
guagcguuaccagcaaa

SEQ ID NO: 2009576 - RNA, 23 nt, Shigella flexneri 2a str. 301
guagcugaaaaucagauccgcac

SEQ ID NO: 2009577 - RNA, 17 nt, Shigella flexneri 2a str. 301
guaggcagcauccggca

SEQ ID NO: 2009578 - RNA, 18 nt, Shigella flexneri 2a str. 301
guaggaucacaagaccua

SEQ ID NO: 2009579 - RNA, 16 nt, Shigella flexneri 2a str. 301
guauaaguccauaacu

SEQ ID NO: 2009580 - RNA, 15 nt, Shigella flexneri 2a str. 301
guauaacgcaaaaau

SEQ ID NO: 2009581 - RNA, 23 nt, Shigella flexneri 2a str. 301
guauaaacgugugugccagguuc

SEQ ID NO: 2009582 - RNA, 14 nt, Shigella flexneri 2a str. 301
guaguugaucgccc

SEQ ID NO: 2009583 - RNA, 12 nt, Shigella flexneri 2a str. 301
guaguuucuccc

SEQ ID NO: 2009584 - RNA, 21 nt, Shigella flexneri 2a str. 301
guaucaaacacaggcaaaaca

SEQ ID NO: 2009585 - RNA, 15 nt, Shigella flexneri 2a str. 301
guauacgccacauca

SEQ ID NO: 2009586 - RNA, 13 nt, Shigella flexneri 2a str. 301
guauacgcuggcg

SEQ ID NO: 2009587 - RNA, 17 nt, Shigella flexneri 2a str. 301
guauacgggcuuuuuaa

SEQ ID NO: 2009588 - RNA, 23 nt, Shigella flexneri 2a str. 301
guauacgucccggugaagcgccc

SEQ ID NO: 2009589 - RNA, 19 nt, Shigella flexneri 2a str. 301
guaucuucaugcuccagca

SEQ ID NO: 2009590 - RNA, 20 nt, Shigella flexneri 2a str. 301
guaucuguggcgcuaugcug

SEQ ID NO: 2009591 - RNA, 14 nt, Shigella flexneri 2a str. 301
guaucugaaucaaa

SEQ ID NO: 2009592 - RNA, 15 nt, Shigella flexneri 2a str. 301
guaucucguccaguu

SEQ ID NO: 2009593 - RNA, 13 nt, Shigella flexneri 2a str. 301
guaucuuugacua

SEQ ID NO: 2009594 - RNA, 15 nt, Shigella flexneri 2a str. 301
guaugaaauuuagcg

SEQ ID NO: 2009595 - RNA, 22 nt, Shigella flexneri 2a str. 301
guaugacaacuuucaucagcac

SEQ ID NO: 2009596 - RNA, 15 nt, Shigella flexneri 2a str. 301
guauccuguuuuuaa

SEQ ID NO: 2009597 - RNA, 20 nt, Shigella flexneri 2a str. 301
guauccggcaugucacaaau

SEQ ID NO: 2009598 - RNA, 13 nt, Shigella flexneri 2a str. 301
guauccaugcgca

SEQ ID NO: 2009599 - RNA, 17 nt, Shigella flexneri 2a str. 301
guaucaacagcgguuuu

SEQ ID NO: 2009600 - RNA, 16 nt, Shigella flexneri 2a str. 301
guaucaucauuauuaa

SEQ ID NO: 2009601 - RNA, 14 nt, Shigella flexneri 2a str. 301
guaucaggcugugu

SEQ ID NO: 2009602 - RNA, 14 nt, Shigella flexneri 2a str. 301
guaugccuggcauu

SEQ ID NO: 2009603 - RNA, 15 nt, Shigella flexneri 2a str. 301
guauggaaaucaccc

SEQ ID NO: 2009604 - RNA, 18 nt, Shigella flexneri 2a str. 301
guaugcgucagcaacaug

SEQ ID NO: 2009605 - RNA, 23 nt, Shigella flexneri 2a str. 301
guauuaguggcaaccacaaccgc

SEQ ID NO: 2009606 - RNA, 16 nt, Shigella flexneri 2a str. 301
guauuacaacgugcuc

SEQ ID NO: 2009607 - RNA, 22 nt, Shigella flexneri 2a str. 301
guauucacuuucaaauccggcc

SEQ ID NO: 2009608 - RNA, 21 nt, Shigella flexneri 2a str. 301
guauugccguuucgcagguuc

SEQ ID NO: 2009609 - RNA, 14 nt, Shigella flexneri 2a str. 301
guauuguccugcaa

SEQ ID NO: 2009610 - RNA, 13 nt, Shigella flexneri 2a str. 301
guauuuccagggc

SEQ ID NO: 2009611 - RNA, 17 nt, Shigella flexneri 2a str. 301
guauuuccaguccagcu

SEQ ID NO: 2009612 - RNA, 20 nt, Shigella flexneri 2a str. 301
guauuuauuuuccaaaauaa

SEQ ID NO: 2009613 - RNA, 22 nt, Shigella flexneri 2a str. 301
guauuuauuuuccaaaauaaaa

SEQ ID NO: 2009614 - RNA, 18 nt, Shigella flexneri 2a str. 301
gucaaacgggcuucuaau

SEQ ID NO: 2009615 - RNA, 16 nt, Shigella flexneri 2a str. 301
gucaacagggcagaca

SEQ ID NO: 2009616 - RNA, 18 nt, Shigella flexneri 2a str. 301
gucaaaugcgacaacugg

SEQ ID NO: 2009617 - RNA, 12 nt, Shigella flexneri 2a str. 301
gucaaaaaaacg

SEQ ID NO: 2009618 - RNA, 20 nt, Shigella flexneri 2a str. 301
gucaaaauccauuuucuauu

SEQ ID NO: 2009619 - RNA, 13 nt, Shigella flexneri 2a str. 301
guauuuuggcuua

SEQ ID NO: 2009620 - RNA, 18 nt, Shigella flexneri 2a str. 301
gucgcauccggcaauuac

SEQ ID NO: 2009621 - RNA, 20 nt, Shigella flexneri 2a str. 301
gucgcauccggcaugaacaa

SEQ ID NO: 2009622 - RNA, 14 nt, Shigella flexneri 2a str. 301
gucgccaacuucau

SEQ ID NO: 2009623 - RNA, 15 nt, Shigella flexneri 2a str. 301
gucgcagcugccugc

SEQ ID NO: 2009624 - RNA, 14 nt, Shigella flexneri 2a str. 301
gucgaugugccgga

SEQ ID NO: 2009625 - RNA, 12 nt, Shigella flexneri 2a str. 301
gucgacagcagc

SEQ ID NO: 2009626 - RNA, 13 nt, Shigella flexneri 2a str. 301
gucgacagcagcc

SEQ ID NO: 2009627 - RNA, 18 nt, Shigella flexneri 2a str. 301
gucgaauggcaucuacgc

SEQ ID NO: 2009628 - RNA, 16 nt, Shigella flexneri 2a str. 301
gucgagaauaucgaua

SEQ ID NO: 2009629 - RNA, 15 nt, Shigella flexneri 2a str. 301
gucgagaucgcggca

SEQ ID NO: 2009630 - RNA, 20 nt, Shigella flexneri 2a str. 301
gucgaggccaauuuggcugc

SEQ ID NO: 2009631 - RNA, 21 nt, Shigella flexneri 2a str. 301
gucgagguacgcuccagcagg

SEQ ID NO: 2009632 - RNA, 18 nt, Shigella flexneri 2a str. 301
gucgaaagcccaucaucc

SEQ ID NO: 2009633 - RNA, 13 nt, Shigella flexneri 2a str. 301
guccuuaccaugc

SEQ ID NO: 2009634 - RNA, 16 nt, Shigella flexneri 2a str. 301
gucgaacgcuaugacg

SEQ ID NO: 2009635 - RNA, 16 nt, Shigella flexneri 2a str. 301
guccuguaaugagaau

SEQ ID NO: 2009636 - RNA, 16 nt, Shigella flexneri 2a str. 301
guccuggcggcacggc

SEQ ID NO: 2009637 - RNA, 15 nt, Shigella flexneri 2a str. 301
guccucuucccagac

SEQ ID NO: 2009638 - RNA, 15 nt, Shigella flexneri 2a str. 301
guccugaccaaagcc

SEQ ID NO: 2009639 - RNA, 18 nt, Shigella flexneri 2a str. 301
guccugacgcccgaaggc

SEQ ID NO: 2009640 - RNA, 20 nt, Shigella flexneri 2a str. 301
guccgcaauacaucaaagcg

SEQ ID NO: 2009641 - RNA, 15 nt, Shigella flexneri 2a str. 301
guccgguuuacuucc

SEQ ID NO: 2009642 - RNA, 22 nt, Shigella flexneri 2a str. 301
guccgguuucgugaaacucagc

SEQ ID NO: 2009643 - RNA, 14 nt, Shigella flexneri 2a str. 301
guccguaggcagga

SEQ ID NO: 2009644 - RNA, 22 nt, Shigella flexneri 2a str. 301
guccguaggcaggacuuuucaa

SEQ ID NO: 2009645 - RNA, 12 nt, Shigella flexneri 2a str. 301
guccguugaaaa

SEQ ID NO: 2009646 - RNA, 22 nt, Shigella flexneri 2a str. 301
gucggaucgcugaacgcaccuu

SEQ ID NO: 2009647 - RNA, 15 nt, Shigella flexneri 2a str. 301
gucggcaaagcgggc

SEQ ID NO: 2009648 - RNA, 21 nt, Shigella flexneri 2a str. 301
gucggacgcuguuccggcggc

SEQ ID NO: 2009649 - RNA, 20 nt, Shigella flexneri 2a str. 301
gucgcuauuacgcacacuuu

SEQ ID NO: 2009650 - RNA, 18 nt, Shigella flexneri 2a str. 301
gucgcuaggaaggcaaga

SEQ ID NO: 2009651 - RNA, 15 nt, Shigella flexneri 2a str. 301
gucgccagcaacaca

SEQ ID NO: 2009652 - RNA, 12 nt, Shigella flexneri 2a str. 301
gucgccagcgcc

SEQ ID NO: 2009653 - RNA, 15 nt, Shigella flexneri 2a str. 301
gucgccacaccggug

SEQ ID NO: 2009654 - RNA, 18 nt, Shigella flexneri 2a str. 301
gucgcgcaauugccagac

SEQ ID NO: 2009655 - RNA, 13 nt, Shigella flexneri 2a str. 301
gucgcgcagcacu

SEQ ID NO: 2009656 - RNA, 15 nt, Shigella flexneri 2a str. 301
gucgcgcccuccugc

SEQ ID NO: 2009657 - RNA, 22 nt, Shigella flexneri 2a str. 301
gucguauuuauuuuccaaaaua

SEQ ID NO: 2009658 - RNA, 14 nt, Shigella flexneri 2a str. 301
gucguaucaccacg

SEQ ID NO: 2009659 - RNA, 14 nt, Shigella flexneri 2a str. 301
gucguagaaguuca

SEQ ID NO: 2009660 - RNA, 14 nt, Shigella flexneri 2a str. 301
gucgguacagagca

SEQ ID NO: 2009661 - RNA, 15 nt, Shigella flexneri 2a str. 301
gucgguaauuucaca

SEQ ID NO: 2009662 - RNA, 19 nt, Shigella flexneri 2a str. 301
gucuaauggugaacugaca

SEQ ID NO: 2009663 - RNA, 19 nt, Shigella flexneri 2a str. 301
gucuacgccuuguuucuuc

SEQ ID NO: 2009664 - RNA, 14 nt, Shigella flexneri 2a str. 301
gucuaaaucuuccg

SEQ ID NO: 2009665 - RNA, 23 nt, Shigella flexneri 2a str. 301
gucuaacaugagguccagcgagc

SEQ ID NO: 2009666 - RNA, 14 nt, Shigella flexneri 2a str. 301
gucguuuagacguu

SEQ ID NO: 2009667 - RNA, 17 nt, Shigella flexneri 2a str. 301
gucacaucaccaacacc

SEQ ID NO: 2009668 - RNA, 16 nt, Shigella flexneri 2a str. 301
gucacagccgcaggcc

SEQ ID NO: 2009669 - RNA, 16 nt, Shigella flexneri 2a str. 301
gucacaaaucucccuu

SEQ ID NO: 2009670 - RNA, 19 nt, Shigella flexneri 2a str. 301
gucaauauuaucgauuuuc

SEQ ID NO: 2009671 - RNA, 19 nt, Shigella flexneri 2a str. 301
gucaagggugucggcacac

SEQ ID NO: 2009672 - RNA, 17 nt, Shigella flexneri 2a str. 301
gucaacgucauuaucug

SEQ ID NO: 2009673 - RNA, 19 nt, Shigella flexneri 2a str. 301
gucaauaagugcuuuagcc

SEQ ID NO: 2009674 - RNA, 15 nt, Shigella flexneri 2a str. 301
gucaccacuucaccc

SEQ ID NO: 2009675 - RNA, 17 nt, Shigella flexneri 2a str. 301
gucacaugcagcgccug

SEQ ID NO: 2009676 - RNA, 16 nt, Shigella flexneri 2a str. 301
gucacauguuccaggg

SEQ ID NO: 2009677 - RNA, 23 nt, Shigella flexneri 2a str. 301
gucacuggugugucaucugcgac

SEQ ID NO: 2009678 - RNA, 17 nt, Shigella flexneri 2a str. 301
gucacuuaauccggagc

SEQ ID NO: 2009679 - RNA, 15 nt, Shigella flexneri 2a str. 301
gucagugucuuaucu

SEQ ID NO: 2009680 - RNA, 17 nt, Shigella flexneri 2a str. 301
gucagugucuuaucugg

SEQ ID NO: 2009681 - RNA, 19 nt, Shigella flexneri 2a str. 301
gucagugucuuaucuggca

SEQ ID NO: 2009682 - RNA, 22 nt, Shigella flexneri 2a str. 301
gucagugucuuaucuggcauuu

SEQ ID NO: 2009683 - RNA, 13 nt, Shigella flexneri 2a str. 301
gucaguucagaau

SEQ ID NO: 2009684 - RNA, 14 nt, Shigella flexneri 2a str. 301
gucaguuccauaau

SEQ ID NO: 2009685 - RNA, 21 nt, Shigella flexneri 2a str. 301
gucaguagcgcaaucaccacc

SEQ ID NO: 2009686 - RNA, 12 nt, Shigella flexneri 2a str. 301
gucaggaagccc

SEQ ID NO: 2009687 - RNA, 13 nt, Shigella flexneri 2a str. 301
gucaggaucgugc

SEQ ID NO: 2009688 - RNA, 15 nt, Shigella flexneri 2a str. 301
gucaggauggccggg

SEQ ID NO: 2009689 - RNA, 16 nt, Shigella flexneri 2a str. 301
gucagguuuuaccucu

SEQ ID NO: 2009690 - RNA, 18 nt, Shigella flexneri 2a str. 301
gucaguaaccgcuuuuuc

SEQ ID NO: 2009691 - RNA, 20 nt, Shigella flexneri 2a str. 301
gucaguaaccgcuuuuucaa

SEQ ID NO: 2009692 - RNA, 13 nt, Shigella flexneri 2a str. 301
gucacuuugcccu

SEQ ID NO: 2009693 - RNA, 13 nt, Shigella flexneri 2a str. 301
gucagacagcgau

SEQ ID NO: 2009694 - RNA, 20 nt, Shigella flexneri 2a str. 301
gucagaccggcaaccagcac

SEQ ID NO: 2009695 - RNA, 17 nt, Shigella flexneri 2a str. 301
gucagcacaaacaauuu

SEQ ID NO: 2009696 - RNA, 21 nt, Shigella flexneri 2a str. 301
gucagcaaaauacugaacagg

SEQ ID NO: 2009697 - RNA, 13 nt, Shigella flexneri 2a str. 301
gucagauccgcca

SEQ ID NO: 2009698 - RNA, 17 nt, Shigella flexneri 2a str. 301
gucagcguuucaacaaa

SEQ ID NO: 2009699 - RNA, 17 nt, Shigella flexneri 2a str. 301
gucagcguuccacgugc

SEQ ID NO: 2009700 - RNA, 15 nt, Shigella flexneri 2a str. 301
gucagcguuucaaca

SEQ ID NO: 2009701 - RNA, 22 nt, Shigella flexneri 2a str. 301
gucagcgucgcaucuggcauaa

SEQ ID NO: 2009702 - RNA, 18 nt, Shigella flexneri 2a str. 301
gucagcaccagagaacug

SEQ ID NO: 2009703 - RNA, 22 nt, Shigella flexneri 2a str. 301
gucccuucgguagcagcuuuca

SEQ ID NO: 2009704 - RNA, 14 nt, Shigella flexneri 2a str. 301
gucccguccuucau

SEQ ID NO: 2009705 - RNA, 19 nt, Shigella flexneri 2a str. 301
guccccgagcacaugcagu

SEQ ID NO: 2009706 - RNA, 23 nt, Shigella flexneri 2a str. 301
guccaguugcccgguaauuaacu

SEQ ID NO: 2009707 - RNA, 16 nt, Shigella flexneri 2a str. 301
guccaguuugccuuca

SEQ ID NO: 2009708 - RNA, 22 nt, Shigella flexneri 2a str. 301
guccaggcugcaaagucugggc

SEQ ID NO: 2009709 - RNA, 12 nt, Shigella flexneri 2a str. 301
guccagcaggcg

SEQ ID NO: 2009710 - RNA, 14 nt, Shigella flexneri 2a str. 301
guccauaaaaugca

SEQ ID NO: 2009711 - RNA, 14 nt, Shigella flexneri 2a str. 301
guccauuaccgaua

SEQ ID NO: 2009712 - RNA, 18 nt, Shigella flexneri 2a str. 301
gucccauuuuaaacguca

SEQ ID NO: 2009713 - RNA, 21 nt, Shigella flexneri 2a str. 301
gucccaaccuuguuucugagc

SEQ ID NO: 2009714 - RNA, 22 nt, Shigella flexneri 2a str. 301
gucauuacgggcaaucaucacc

SEQ ID NO: 2009715 - RNA, 13 nt, Shigella flexneri 2a str. 301
gucauuaccagcg

SEQ ID NO: 2009716 - RNA, 19 nt, Shigella flexneri 2a str. 301
gucaugacgacaaggcagg

SEQ ID NO: 2009717 - RNA, 17 nt, Shigella flexneri 2a str. 301
gucauaauaugaccuga

SEQ ID NO: 2009718 - RNA, 13 nt, Shigella flexneri 2a str. 301
gucaguuggcugu

SEQ ID NO: 2009719 - RNA, 21 nt, Shigella flexneri 2a str. 301
gucauacuccagucgcugcug

SEQ ID NO: 2009720 - RNA, 19 nt, Shigella flexneri 2a str. 301
gucauuggggauuaucuga

SEQ ID NO: 2009721 - RNA, 21 nt, Shigella flexneri 2a str. 301
gucauuccagucugcuggcga

SEQ ID NO: 2009722 - RNA, 15 nt, Shigella flexneri 2a str. 301
gucauugaccagauc

SEQ ID NO: 2009723 - RNA, 21 nt, Shigella flexneri 2a str. 301
gucauuggcagccagcaucug

SEQ ID NO: 2009724 - RNA, 16 nt, Shigella flexneri 2a str. 301
guccaccgugauucac

SEQ ID NO: 2009725 - RNA, 16 nt, Shigella flexneri 2a str. 301
guccagauaauaauca

SEQ ID NO: 2009726 - RNA, 21 nt, Shigella flexneri 2a str. 301
guccagacggagcugccaggc

SEQ ID NO: 2009727 - RNA, 23 nt, Shigella flexneri 2a str. 301
guccacuugaaaauuauaucuua

SEQ ID NO: 2009728 - RNA, 19 nt, Shigella flexneri 2a str. 301
guccagacgcgcagcuuca

SEQ ID NO: 2009729 - RNA, 14 nt, Shigella flexneri 2a str. 301
guccagacggagcu

SEQ ID NO: 2009730 - RNA, 18 nt, Shigella flexneri 2a str. 301
guccagacggagcugcca

SEQ ID NO: 2009731 - RNA, 13 nt, Shigella flexneri 2a str. 301
guccacggugcga

SEQ ID NO: 2009732 - RNA, 19 nt, Shigella flexneri 2a str. 301
guccacgguugguuuuauc

SEQ ID NO: 2009733 - RNA, 16 nt, Shigella flexneri 2a str. 301
guccacugcgagaaaa

SEQ ID NO: 2009734 - RNA, 20 nt, Shigella flexneri 2a str. 301
gugccucguucacauauugc

SEQ ID NO: 2009735 - RNA, 13 nt, Shigella flexneri 2a str. 301
gugccucaagaau

SEQ ID NO: 2009736 - RNA, 14 nt, Shigella flexneri 2a str. 301
gugccugucgggac

SEQ ID NO: 2009737 - RNA, 14 nt, Shigella flexneri 2a str. 301
gugccuuagccaca

SEQ ID NO: 2009738 - RNA, 22 nt, Shigella flexneri 2a str. 301
gugccuuagccacaaagcaggg

SEQ ID NO: 2009739 - RNA, 19 nt, Shigella flexneri 2a str. 301
gugccuuuuuuauuuaugc

SEQ ID NO: 2009740 - RNA, 19 nt, Shigella flexneri 2a str. 301
gugcgaauugccaccaucc

SEQ ID NO: 2009741 - RNA, 22 nt, Shigella flexneri 2a str. 301
gugccuuuaauaccaucggcag

SEQ ID NO: 2009742 - RNA, 16 nt, Shigella flexneri 2a str. 301
gugccgguggaagggc

SEQ ID NO: 2009743 - RNA, 19 nt, Shigella flexneri 2a str. 301
gugccggucugaauacgcc

SEQ ID NO: 2009744 - RNA, 19 nt, Shigella flexneri 2a str. 301
gugccgggguagaccgcgc

SEQ ID NO: 2009745 - RNA, 16 nt, Shigella flexneri 2a str. 301
gugccggaagucucuu

SEQ ID NO: 2009746 - RNA, 18 nt, Shigella flexneri 2a str. 301
gugccggaaggaagacgc

SEQ ID NO: 2009747 - RNA, 20 nt, Shigella flexneri 2a str. 301
gugccgcgauaccacccgca

SEQ ID NO: 2009748 - RNA, 14 nt, Shigella flexneri 2a str. 301
gugccgcgacagau

SEQ ID NO: 2009749 - RNA, 15 nt, Shigella flexneri 2a str. 301
gugccaagcuccagc

SEQ ID NO: 2009750 - RNA, 21 nt, Shigella flexneri 2a str. 301
gugcauuucucacuuuucacc

SEQ ID NO: 2009751 - RNA, 19 nt, Shigella flexneri 2a str. 301
gugccaccagugcaggcac

SEQ ID NO: 2009752 - RNA, 19 nt, Shigella flexneri 2a str. 301
gugccacaggcggucgaac

SEQ ID NO: 2009753 - RNA, 17 nt, Shigella flexneri 2a str. 301
gugccagaccaaacagc

SEQ ID NO: 2009754 - RNA, 23 nt, Shigella flexneri 2a str. 301
gugccagcgauuuugccagccgc

SEQ ID NO: 2009755 - RNA, 16 nt, Shigella flexneri 2a str. 301
gugccaggaccauuca

SEQ ID NO: 2009756 - RNA, 12 nt, Shigella flexneri 2a str. 301
gugccauugacc

SEQ ID NO: 2009757 - RNA, 18 nt, Shigella flexneri 2a str. 301
gugccauugaccagcugc

SEQ ID NO: 2009758 - RNA, 16 nt, Shigella flexneri 2a str. 301
gugccgaugauuuaca

SEQ ID NO: 2009759 - RNA, 15 nt, Shigella flexneri 2a str. 301
gugcccgaccacuuc

SEQ ID NO: 2009760 - RNA, 22 nt, Shigella flexneri 2a str. 301
gugcaccggguaccagaaucac

SEQ ID NO: 2009761 - RNA, 16 nt, Shigella flexneri 2a str. 301
gugcacgaaccagaga

SEQ ID NO: 2009762 - RNA, 17 nt, Shigella flexneri 2a str. 301
gugcagcaugcacccuc

SEQ ID NO: 2009763 - RNA, 23 nt, Shigella flexneri 2a str. 301
gugcagccggagcuucacccgca

SEQ ID NO: 2009764 - RNA, 16 nt, Shigella flexneri 2a str. 301
gugcacccgcuucagu

SEQ ID NO: 2009765 - RNA, 23 nt, Shigella flexneri 2a str. 301
gugcaaaugccagauaagacacu

SEQ ID NO: 2009766 - RNA, 15 nt, Shigella flexneri 2a str. 301
gugcaaaugccagau

SEQ ID NO: 2009767 - RNA, 16 nt, Shigella flexneri 2a str. 301
gugcaaccuuuuccau

SEQ ID NO: 2009768 - RNA, 11 nt, Shigella flexneri 2a str. 301
gugcaaaugcc

SEQ ID NO: 2009769 - RNA, 16 nt, Shigella flexneri 2a str. 301
gugcaguuccugcaac

SEQ ID NO: 2009770 - RNA, 15 nt, Shigella flexneri 2a str. 301
gugcauccagcagcc

SEQ ID NO: 2009771 - RNA, 22 nt, Shigella flexneri 2a str. 301
gugcaucggugcgcugugugug

SEQ ID NO: 2009772 - RNA, 19 nt, Shigella flexneri 2a str. 301
gugcaucuccugacacaac

SEQ ID NO: 2009773 - RNA, 14 nt, Shigella flexneri 2a str. 301
gugcauugaguccc

SEQ ID NO: 2009774 - RNA, 13 nt, Shigella flexneri 2a str. 301
gugauuuuuaaua

SEQ ID NO: 2009775 - RNA, 14 nt, Shigella flexneri 2a str. 301
gugauacagcaaaa

SEQ ID NO: 2009776 - RNA, 22 nt, Shigella flexneri 2a str. 301
gucucaagggaggagucauccu

SEQ ID NO: 2009777 - RNA, 12 nt, Shigella flexneri 2a str. 301
gucucaaaccgg

SEQ ID NO: 2009778 - RNA, 18 nt, Shigella flexneri 2a str. 301
gugauauuucgaauuuuc

SEQ ID NO: 2009779 - RNA, 19 nt, Shigella flexneri 2a str. 301
gugcgguuucagcucacgg

SEQ ID NO: 2009780 - RNA, 14 nt, Shigella flexneri 2a str. 301
gugcgguaagcugc

SEQ ID NO: 2009781 - RNA, 16 nt, Shigella flexneri 2a str. 301
gugcggguaaccagcc

SEQ ID NO: 2009782 - RNA, 15 nt, Shigella flexneri 2a str. 301
gugcggcaucgcugu

SEQ ID NO: 2009783 - RNA, 23 nt, Shigella flexneri 2a str. 301
gugcggcgguaucgucgggcugg

SEQ ID NO: 2009784 - RNA, 18 nt, Shigella flexneri 2a str. 301
gugcgcgugagcugggau

SEQ ID NO: 2009785 - RNA, 14 nt, Shigella flexneri 2a str. 301
gugcgcggcagcca

SEQ ID NO: 2009786 - RNA, 13 nt, Shigella flexneri 2a str. 301
gugcgcgccagga

SEQ ID NO: 2009787 - RNA, 18 nt, Shigella flexneri 2a str. 301
gugcugacagaaguaauc

SEQ ID NO: 2009788 - RNA, 20 nt, Shigella flexneri 2a str. 301
gugcugcgucaguugggauu

SEQ ID NO: 2009789 - RNA, 13 nt, Shigella flexneri 2a str. 301
gugcuucacucaa

SEQ ID NO: 2009790 - RNA, 11 nt, Shigella flexneri 2a str. 301
gugcuuauaaa

SEQ ID NO: 2009791 - RNA, 21 nt, Shigella flexneri 2a str. 301
gugcuuaucgcgaugauuuuc

SEQ ID NO: 2009792 - RNA, 13 nt, Shigella flexneri 2a str. 301
gugcuccaggagc

SEQ ID NO: 2009793 - RNA, 16 nt, Shigella flexneri 2a str. 301
gugcugaaaucacagc

SEQ ID NO: 2009794 - RNA, 14 nt, Shigella flexneri 2a str. 301
gugcucauagacca

SEQ ID NO: 2009795 - RNA, 18 nt, Shigella flexneri 2a str. 301
gugcucaucagcccggca

SEQ ID NO: 2009796 - RNA, 15 nt, Shigella flexneri 2a str. 301
gugcucauccuucag

SEQ ID NO: 2009797 - RNA, 16 nt, Shigella flexneri 2a str. 301
gugcucaaugagcacc

SEQ ID NO: 2009798 - RNA, 20 nt, Shigella flexneri 2a str. 301
gugcucaccacgcagcagcc

SEQ ID NO: 2009799 - RNA, 17 nt, Shigella flexneri 2a str. 301
guguauggcauugucug

SEQ ID NO: 2009800 - RNA, 21 nt, Shigella flexneri 2a str. 301
guguaucugggcgaaacagag

SEQ ID NO: 2009801 - RNA, 12 nt, Shigella flexneri 2a str. 301
guguagggcagg

SEQ ID NO: 2009802 - RNA, 19 nt, Shigella flexneri 2a str. 301
guguacaaacccagccgcc

SEQ ID NO: 2009803 - RNA, 21 nt, Shigella flexneri 2a str. 301
guguaacgcguacccagcagc

SEQ ID NO: 2009804 - RNA, 14 nt, Shigella flexneri 2a str. 301
guguaaaacagcac

SEQ ID NO: 2009805 - RNA, 13 nt, Shigella flexneri 2a str. 301
gugguagcggcuc

SEQ ID NO: 2009806 - RNA, 18 nt, Shigella flexneri 2a str. 301
guggugagauugcugcgu

SEQ ID NO: 2009807 - RNA, 23 nt, Shigella flexneri 2a str. 301
guggcuuuuuuauugcuucacca

SEQ ID NO: 2009808 - RNA, 18 nt, Shigella flexneri 2a str. 301
guggcugggguacgagga

SEQ ID NO: 2009809 - RNA, 19 nt, Shigella flexneri 2a str. 301
gugggcuaacacccgucgu

SEQ ID NO: 2009810 - RNA, 15 nt, Shigella flexneri 2a str. 301
guggcggaauuggua

SEQ ID NO: 2009811 - RNA, 16 nt, Shigella flexneri 2a str. 301
guggacugauuuagcu

SEQ ID NO: 2009812 - RNA, 24 nt, Shigella flexneri 2a str. 301
guggacauagcucugccacugguu

SEQ ID NO: 2009813 - RNA, 19 nt, Shigella flexneri 2a str. 301
guuauacaucgcuuuccag

SEQ ID NO: 2009814 - RNA, 20 nt, Shigella flexneri 2a str. 301
guuauccgacuuauucuuca

SEQ ID NO: 2009815 - RNA, 22 nt, Shigella flexneri 2a str. 301
guuauccagcuucacuuucagu

SEQ ID NO: 2009816 - RNA, 23 nt, Shigella flexneri 2a str. 301
guuauccugaccaccauauaagc

SEQ ID NO: 2009817 - RNA, 19 nt, Shigella flexneri 2a str. 301
guuauccugauaaaaacca

SEQ ID NO: 2009818 - RNA, 21 nt, Shigella flexneri 2a str. 301
guuauccugaucaagcacaug

SEQ ID NO: 2009819 - RNA, 18 nt, Shigella flexneri 2a str. 301
guuaucguaccaggcgac

SEQ ID NO: 2009820 - RNA, 17 nt, Shigella flexneri 2a str. 301
guucaaaaacuaauuca

SEQ ID NO: 2009821 - RNA, 15 nt, Shigella flexneri 2a str. 301
guuauucgcuuccuc

SEQ ID NO: 2009822 - RNA, 16 nt, Shigella flexneri 2a str. 301
guuauuauucauaaau

SEQ ID NO: 2009823 - RNA, 19 nt, Shigella flexneri 2a str. 301
guuagugucuuaucuggca

SEQ ID NO: 2009824 - RNA, 15 nt, Shigella flexneri 2a str. 301
guuagugucuuaucu

SEQ ID NO: 2009825 - RNA, 17 nt, Shigella flexneri 2a str. 301
guuacgugaagucucaa

SEQ ID NO: 2009826 - RNA, 21 nt, Shigella flexneri 2a str. 301
guuacggacuuuuuauuuaug

SEQ ID NO: 2009827 - RNA, 18 nt, Shigella flexneri 2a str. 301
guuacggcuggaagguga

SEQ ID NO: 2009828 - RNA, 21 nt, Shigella flexneri 2a str. 301
guuagaauaccugccugucac

SEQ ID NO: 2009829 - RNA, 13 nt, Shigella flexneri 2a str. 301
guuagagaacaac

SEQ ID NO: 2009830 - RNA, 23 nt, Shigella flexneri 2a str. 301
guuagagccagggaucgggucac

SEQ ID NO: 2009831 - RNA, 20 nt, Shigella flexneri 2a str. 301
guuacgcagauauucguuca

SEQ ID NO: 2009832 - RNA, 22 nt, Shigella flexneri 2a str. 301
guuacgcauaaaaccagcaaac

SEQ ID NO: 2009833 - RNA, 17 nt, Shigella flexneri 2a str. 301
guuacgcgcauaaugca

SEQ ID NO: 2009834 - RNA, 17 nt, Shigella flexneri 2a str. 301
guuacgccccaacacaa

SEQ ID NO: 2009835 - RNA, 12 nt, Shigella flexneri 2a str. 301
guuaccagcggc

SEQ ID NO: 2009836 - RNA, 16 nt, Shigella flexneri 2a str. 301
guuacaaccuccuccg

SEQ ID NO: 2009837 - RNA, 21 nt, Shigella flexneri 2a str. 301
guuaaauugaucgaugguugc

SEQ ID NO: 2009838 - RNA, 16 nt, Shigella flexneri 2a str. 301
guuaauaaugauuuug

SEQ ID NO: 2009839 - RNA, 19 nt, Shigella flexneri 2a str. 301
guuaauccgcaaauaacgu

SEQ ID NO: 2009840 - RNA, 14 nt, Shigella flexneri 2a str. 301
guuaaaccgccagu

SEQ ID NO: 2009841 - RNA, 19 nt, Shigella flexneri 2a str. 301
guuaaauuccguugcuguu

SEQ ID NO: 2009842 - RNA, 19 nt, Shigella flexneri 2a str. 301
guuaaacuuucauaaacac

SEQ ID NO: 2009843 - RNA, 19 nt, Shigella flexneri 2a str. 301
guuaaagagccgguuugua

SEQ ID NO: 2009844 - RNA, 19 nt, Shigella flexneri 2a str. 301
gugucgccagcaacacaaa

SEQ ID NO: 2009845 - RNA, 17 nt, Shigella flexneri 2a str. 301
guguccguuuguggugc

SEQ ID NO: 2009846 - RNA, 15 nt, Shigella flexneri 2a str. 301
guucgauauccaguc

SEQ ID NO: 2009847 - RNA, 15 nt, Shigella flexneri 2a str. 301
guucgauuucauuca

SEQ ID NO: 2009848 - RNA, 14 nt, Shigella flexneri 2a str. 301
guucgauuucccag

SEQ ID NO: 2009849 - RNA, 16 nt, Shigella flexneri 2a str. 301
guucgcuaaagacuuu

SEQ ID NO: 2009850 - RNA, 19 nt, Shigella flexneri 2a str. 301
guucgcguaacugcugcuc

SEQ ID NO: 2009851 - RNA, 17 nt, Shigella flexneri 2a str. 301
guucgcaccaaauccaa

SEQ ID NO: 2009852 - RNA, 23 nt, Shigella flexneri 2a str. 301
guucgcggcguacgacguucagg

SEQ ID NO: 2009853 - RNA, 14 nt, Shigella flexneri 2a str. 301
guucggaguggcag

SEQ ID NO: 2009854 - RNA, 21 nt, Shigella flexneri 2a str. 301
guucggacauguuuuccagca

SEQ ID NO: 2009855 - RNA, 16 nt, Shigella flexneri 2a str. 301
guucgucauacuccag

SEQ ID NO: 2009856 - RNA, 11 nt, Shigella flexneri 2a str. 301
guucguccauu

SEQ ID NO: 2009857 - RNA, 16 nt, Shigella flexneri 2a str. 301
guuccgggaucaccag

SEQ ID NO: 2009858 - RNA, 17 nt, Shigella flexneri 2a str. 301
guuccggcguacgggca

SEQ ID NO: 2009859 - RNA, 16 nt, Shigella flexneri 2a str. 301
guuccuaacaugccac

SEQ ID NO: 2009860 - RNA, 15 nt, Shigella flexneri 2a str. 301
guuccgugagcggaa

SEQ ID NO: 2009861 - RNA, 18 nt, Shigella flexneri 2a str. 301
guuccguucauauggagc

SEQ ID NO: 2009862 - RNA, 20 nt, Shigella flexneri 2a str. 301
guuccccccacaaucagcca

SEQ ID NO: 2009863 - RNA, 13 nt, Shigella flexneri 2a str. 301
guuccccucaccc

SEQ ID NO: 2009864 - RNA, 16 nt, Shigella flexneri 2a str. 301
guuccagccaguguua

SEQ ID NO: 2009865 - RNA, 21 nt, Shigella flexneri 2a str. 301
guuccagccaguguuaaccag

SEQ ID NO: 2009866 - RNA, 12 nt, Shigella flexneri 2a str. 301
guuccagcagaa

SEQ ID NO: 2009867 - RNA, 17 nt, Shigella flexneri 2a str. 301
guuccagcaucuccugc

SEQ ID NO: 2009868 - RNA, 20 nt, Shigella flexneri 2a str. 301
guucauuggguucaucugau

SEQ ID NO: 2009869 - RNA, 16 nt, Shigella flexneri 2a str. 301
guucaugguuagccug

SEQ ID NO: 2009870 - RNA, 16 nt, Shigella flexneri 2a str. 301
guucagauuguugauu

SEQ ID NO: 2009871 - RNA, 15 nt, Shigella flexneri 2a str. 301
guucaguucagaaag

SEQ ID NO: 2009872 - RNA, 22 nt, Shigella flexneri 2a str. 301
guucauauauuccuuacucaua

SEQ ID NO: 2009873 - RNA, 17 nt, Shigella flexneri 2a str. 301
guucaaaguaauauuca

SEQ ID NO: 2009874 - RNA, 17 nt, Shigella flexneri 2a str. 301
guucaauacccacugcg

SEQ ID NO: 2009875 - RNA, 19 nt, Shigella flexneri 2a str. 301
guucaauacccacugcgca

SEQ ID NO: 2009876 - RNA, 22 nt, Shigella flexneri 2a str. 301
guucaauacgcaguuuugucuu

SEQ ID NO: 2009877 - RNA, 19 nt, Shigella flexneri 2a str. 301
guucacuuuugcugcaaaa

SEQ ID NO: 2009878 - RNA, 18 nt, Shigella flexneri 2a str. 301
guucacucaucaacguuu

SEQ ID NO: 2009879 - RNA, 19 nt, Shigella flexneri 2a str. 301
guucacugccguacaggca

SEQ ID NO: 2009880 - RNA, 22 nt, Shigella flexneri 2a str. 301
guucacugccguacaggcagcu

SEQ ID NO: 2009881 - RNA, 14 nt, Shigella flexneri 2a str. 301
guucacugugcugg

SEQ ID NO: 2009882 - RNA, 13 nt, Shigella flexneri 2a str. 301
guucaauuuccag

SEQ ID NO: 2009883 - RNA, 21 nt, Shigella flexneri 2a str. 301
guucuguggcagggcagcgau

SEQ ID NO: 2009884 - RNA, 23 nt, Shigella flexneri 2a str. 301
guucuggccuuuaauaugccacg

SEQ ID NO: 2009885 - RNA, 23 nt, Shigella flexneri 2a str. 301
guucugcgccguccacaaaccgu

SEQ ID NO: 2009886 - RNA, 16 nt, Shigella flexneri 2a str. 301
guucugccguccagcc

SEQ ID NO: 2009887 - RNA, 21 nt, Shigella flexneri 2a str. 301
guucugccuggcgcagcaaag

SEQ ID NO: 2009888 - RNA, 14 nt, Shigella flexneri 2a str. 301
guucucuggcccgc

SEQ ID NO: 2009889 - RNA, 16 nt, Shigella flexneri 2a str. 301
guucugaucuuucuuc

SEQ ID NO: 2009890 - RNA, 16 nt, Shigella flexneri 2a str. 301
guucugaaucacgccg

SEQ ID NO: 2009891 - RNA, 14 nt, Shigella flexneri 2a str. 301
guucucucagucuu

SEQ ID NO: 2009892 - RNA, 21 nt, Shigella flexneri 2a str. 301
guucguugaucacuuucaccg

SEQ ID NO: 2009893 - RNA, 16 nt, Shigella flexneri 2a str. 301
guucguugauaauaaa

SEQ ID NO: 2009894 - RNA, 17 nt, Shigella flexneri 2a str. 301
guucguugaucacuuuc

SEQ ID NO: 2009895 - RNA, 22 nt, Shigella flexneri 2a str. 301
guugaaaaaucaaaaaacugga

SEQ ID NO: 2009896 - RNA, 14 nt, Shigella flexneri 2a str. 301
guugaaaaaccaga

SEQ ID NO: 2009897 - RNA, 13 nt, Shigella flexneri 2a str. 301
guucuuuuuuuaa

SEQ ID NO: 2009898 - RNA, 11 nt, Shigella flexneri 2a str. 301
guucuucccuc

SEQ ID NO: 2009899 - RNA, 21 nt, Shigella flexneri 2a str. 301
guugaucauaaaaauuaaauc

SEQ ID NO: 2009900 - RNA, 14 nt, Shigella flexneri 2a str. 301
guugaucauaaaaa

SEQ ID NO: 2009901 - RNA, 15 nt, Shigella flexneri 2a str. 301
guugaucauaaaaau

SEQ ID NO: 2009902 - RNA, 12 nt, Shigella flexneri 2a str. 301
guugauccagga

SEQ ID NO: 2009903 - RNA, 14 nt, Shigella flexneri 2a str. 301
guugauccaggagc

SEQ ID NO: 2009904 - RNA, 19 nt, Shigella flexneri 2a str. 301
guugaucuucucgucaauc

SEQ ID NO: 2009905 - RNA, 15 nt, Shigella flexneri 2a str. 301
guugaucuauaccac

SEQ ID NO: 2009906 - RNA, 16 nt, Shigella flexneri 2a str. 301
guugauuggcgcaggu

SEQ ID NO: 2009907 - RNA, 16 nt, Shigella flexneri 2a str. 301
guugauuuuauaauca

SEQ ID NO: 2009908 - RNA, 19 nt, Shigella flexneri 2a str. 301
guugaugcgcccuugcagg

SEQ ID NO: 2009909 - RNA, 16 nt, Shigella flexneri 2a str. 301
guugcaguucugccau

SEQ ID NO: 2009910 - RNA, 14 nt, Shigella flexneri 2a str. 301
guugcaucgccugc

SEQ ID NO: 2009911 - RNA, 12 nt, Shigella flexneri 2a str. 301
guugaagucagg

SEQ ID NO: 2009912 - RNA, 16 nt, Shigella flexneri 2a str. 301
guugaagcguucuucu

SEQ ID NO: 2009913 - RNA, 17 nt, Shigella flexneri 2a str. 301
guugaagcguucuucug

SEQ ID NO: 2009914 - RNA, 23 nt, Shigella flexneri 2a str. 301
guugaagucagggucuuccagca

SEQ ID NO: 2009915 - RNA, 13 nt, Shigella flexneri 2a str. 301
guugacaaagugc

SEQ ID NO: 2009916 - RNA, 13 nt, Shigella flexneri 2a str. 301
guuguugcugaau

SEQ ID NO: 2009917 - RNA, 14 nt, Shigella flexneri 2a str. 301
guuguuucagaaau

SEQ ID NO: 2009918 - RNA, 13 nt, Shigella flexneri 2a str. 301
guuguuuuuucaa

SEQ ID NO: 2009919 - RNA, 17 nt, Shigella flexneri 2a str. 301
guuguugauaagcccca

SEQ ID NO: 2009920 - RNA, 14 nt, Shigella flexneri 2a str. 301
guuguuccuuccag

SEQ ID NO: 2009921 - RNA, 14 nt, Shigella flexneri 2a str. 301
guuguucgcgcaca

SEQ ID NO: 2009922 - RNA, 20 nt, Shigella flexneri 2a str. 301
guuguuaaccaccaguaaau

SEQ ID NO: 2009923 - RNA, 22 nt, Shigella flexneri 2a str. 301
guuuagagacgcauugauaaug

SEQ ID NO: 2009924 - RNA, 20 nt, Shigella flexneri 2a str. 301
guuuagccgcuucugcagcu

SEQ ID NO: 2009925 - RNA, 13 nt, Shigella flexneri 2a str. 301
guuuacaaccuga

SEQ ID NO: 2009926 - RNA, 18 nt, Shigella flexneri 2a str. 301
guuuaccccgucaccacu

SEQ ID NO: 2009927 - RNA, 16 nt, Shigella flexneri 2a str. 301
guuuauaacggugcug

SEQ ID NO: 2009928 - RNA, 20 nt, Shigella flexneri 2a str. 301
guuuauaacggugcugcaca

SEQ ID NO: 2009929 - RNA, 23 nt, Shigella flexneri 2a str. 301
guuuagcgcggcaauuagcggcu

SEQ ID NO: 2009930 - RNA, 13 nt, Shigella flexneri 2a str. 301
guuuaugccuggu

SEQ ID NO: 2009931 - RNA, 15 nt, Shigella flexneri 2a str. 301
guuuauuucccagau

SEQ ID NO: 2009932 - RNA, 18 nt, Shigella flexneri 2a str. 301
guugcccagcgcaucagg

SEQ ID NO: 2009933 - RNA, 23 nt, Shigella flexneri 2a str. 301
guugcccagcgcgccgccaauaa

SEQ ID NO: 2009934 - RNA, 17 nt, Shigella flexneri 2a str. 301
guugccccucuaacucu

SEQ ID NO: 2009935 - RNA, 22 nt, Shigella flexneri 2a str. 301
guugccauuguuggcaggccaa

SEQ ID NO: 2009936 - RNA, 21 nt, Shigella flexneri 2a str. 301
guugccauuucugcugccacu

SEQ ID NO: 2009937 - RNA, 15 nt, Shigella flexneri 2a str. 301
guugcccgcauuauu

SEQ ID NO: 2009938 - RNA, 17 nt, Shigella flexneri 2a str. 301
guugccauacagacacc

SEQ ID NO: 2009939 - RNA, 21 nt, Shigella flexneri 2a str. 301
guuggcaugcguauccuccug

SEQ ID NO: 2009940 - RNA, 13 nt, Shigella flexneri 2a str. 301
guuggcaggccaa

SEQ ID NO: 2009941 - RNA, 22 nt, Shigella flexneri 2a str. 301
guuggcaagauaggcaucccgc

SEQ ID NO: 2009942 - RNA, 11 nt, Shigella flexneri 2a str. 301
guugccgcagc

SEQ ID NO: 2009943 - RNA, 12 nt, Shigella flexneri 2a str. 301
guugccgcccgu

SEQ ID NO: 2009944 - RNA, 23 nt, Shigella flexneri 2a str. 301
guuggauaaggcgguuacgccgc

SEQ ID NO: 2009945 - RNA, 18 nt, Shigella flexneri 2a str. 301
guuguaaucauauuaaau

SEQ ID NO: 2009946 - RNA, 22 nt, Shigella flexneri 2a str. 301
guuguaaugauuuaauggaugu

SEQ ID NO: 2009947 - RNA, 21 nt, Shigella flexneri 2a str. 301
guuguacagcgaaacauacag

SEQ ID NO: 2009948 - RNA, 14 nt, Shigella flexneri 2a str. 301
guuguacauuacca

SEQ ID NO: 2009949 - RNA, 18 nt, Shigella flexneri 2a str. 301
guugugccuuccaucccu

SEQ ID NO: 2009950 - RNA, 11 nt, Shigella flexneri 2a str. 301
guugugccaga

SEQ ID NO: 2009951 - RNA, 22 nt, Shigella flexneri 2a str. 301
guugugccagaccaaacagcau

SEQ ID NO: 2009952 - RNA, 19 nt, Shigella flexneri 2a str. 301
guugucugaauccaucugu

SEQ ID NO: 2009953 - RNA, 12 nt, Shigella flexneri 2a str. 301
uaaaaagaaagu

SEQ ID NO: 2009954 - RNA, 13 nt, Shigella flexneri 2a str. 301
uaaaaagaaaaaa

SEQ ID NO: 2009955 - RNA, 15 nt, Shigella flexneri 2a str. 301
uaaaaagccuaacaa

SEQ ID NO: 2009956 - RNA, 18 nt, Shigella flexneri 2a str. 301
uaaaaaguaagaauugau

SEQ ID NO: 2009957 - RNA, 14 nt, Shigella flexneri 2a str. 301
uaaaaacagccagc

SEQ ID NO: 2009958 - RNA, 23 nt, Shigella flexneri 2a str. 301
uaaaaacaguaccagaccaacau

SEQ ID NO: 2009959 - RNA, 18 nt, Shigella flexneri 2a str. 301
uaaaaaaagcauuuaaua

SEQ ID NO: 2009960 - RNA, 23 nt, Shigella flexneri 2a str. 301
guuuuuuuauaucucagauaaau

SEQ ID NO: 2009961 - RNA, 21 nt, Shigella flexneri 2a str. 301
uaaaaaagaaggaaaauacag

SEQ ID NO: 2009962 - RNA, 17 nt, Shigella flexneri 2a str. 301
uaaaaaagaaggaaaau

SEQ ID NO: 2009963 - RNA, 18 nt, Shigella flexneri 2a str. 301
uaaaaaagaaggaaaaua

SEQ ID NO: 2009964 - RNA, 19 nt, Shigella flexneri 2a str. 301
uaaaaaagaaggaaaauac

SEQ ID NO: 2009965 - RNA, 22 nt, Shigella flexneri 2a str. 301
uaaaaaaguaaugccugcacuu

SEQ ID NO: 2009966 - RNA, 21 nt, Shigella flexneri 2a str. 301
uaaaaaaggugcucaaugagc

SEQ ID NO: 2009967 - RNA, 15 nt, Shigella flexneri 2a str. 301
guuuuuuaucuucaa

SEQ ID NO: 2009968 - RNA, 14 nt, Shigella flexneri 2a str. 301
guuuuuuauuucag

SEQ ID NO: 2009969 - RNA, 15 nt, Shigella flexneri 2a str. 301
guuuuuucaaccuaa

SEQ ID NO: 2009970 - RNA, 12 nt, Shigella flexneri 2a str. 301
guuuuuugcucc

SEQ ID NO: 2009971 - RNA, 16 nt, Shigella flexneri 2a str. 301
guuuuuacgaaacaga

SEQ ID NO: 2009972 - RNA, 16 nt, Shigella flexneri 2a str. 301
guuuuuacccagcagc

SEQ ID NO: 2009973 - RNA, 15 nt, Shigella flexneri 2a str. 301
guuuuucuuuuucaa

SEQ ID NO: 2009974 - RNA, 22 nt, Shigella flexneri 2a str. 301
guuuggccgcgccaaugccuga

SEQ ID NO: 2009975 - RNA, 18 nt, Shigella flexneri 2a str. 301
guuuggugaaauauagaa

SEQ ID NO: 2009976 - RNA, 17 nt, Shigella flexneri 2a str. 301
guuugguaaugaagccu

SEQ ID NO: 2009977 - RNA, 19 nt, Shigella flexneri 2a str. 301
guuuuaaucacuucuucuu

SEQ ID NO: 2009978 - RNA, 15 nt, Shigella flexneri 2a str. 301
guuuuacaacgcugu

SEQ ID NO: 2009979 - RNA, 22 nt, Shigella flexneri 2a str. 301
aaaucagcuuuggugaaaaaau

SEQ ID NO: 2009980 - RNA, 14 nt, Shigella flexneri 2a str. 301
guuucaaacaggcu

SEQ ID NO: 2009981 - RNA, 16 nt, Shigella flexneri 2a str. 301
guuugaaaaaaccugc

SEQ ID NO: 2009982 - RNA, 16 nt, Shigella flexneri 2a str. 301
guuugccaccugugca

SEQ ID NO: 2009983 - RNA, 16 nt, Shigella flexneri 2a str. 301
guuugccccggcugcg

SEQ ID NO: 2009984 - RNA, 22 nt, Shigella flexneri 2a str. 301
guuugccagugccguuccagcc

SEQ ID NO: 2009985 - RNA, 23 nt, Shigella flexneri 2a str. 301
guuugccaugacuuucuggcacg

SEQ ID NO: 2009986 - RNA, 22 nt, Shigella flexneri 2a str. 301
guuugccaugcauauccaggcu

SEQ ID NO: 2009987 - RNA, 21 nt, Shigella flexneri 2a str. 301
guuuuguagaucuccauacuu

SEQ ID NO: 2009988 - RNA, 13 nt, Shigella flexneri 2a str. 301
guuuugucaucuu

SEQ ID NO: 2009989 - RNA, 20 nt, Shigella flexneri 2a str. 301
guuuucuaacucauuuuuua

SEQ ID NO: 2009990 - RNA, 15 nt, Shigella flexneri 2a str. 301
guuuucuggcugaca

SEQ ID NO: 2009991 - RNA, 19 nt, Shigella flexneri 2a str. 301
guuuucgccggaaccugau

SEQ ID NO: 2009992 - RNA, 20 nt, Shigella flexneri 2a str. 301
guuuucgucaacguagcuau

SEQ ID NO: 2009993 - RNA, 14 nt, Shigella flexneri 2a str. 301
guuuucucaucgcu

SEQ ID NO: 2009994 - RNA, 13 nt, Shigella flexneri 2a str. 301
guuuuccuucagg

SEQ ID NO: 2009995 - RNA, 17 nt, Shigella flexneri 2a str. 301
guuuucgauuuuuucca

SEQ ID NO: 2009996 - RNA, 20 nt, Shigella flexneri 2a str. 301
guuuucgauuuuuuccagcg

SEQ ID NO: 2009997 - RNA, 21 nt, Shigella flexneri 2a str. 301
guuuuccggcacgcaggaucu

SEQ ID NO: 2009998 - RNA, 14 nt, Shigella flexneri 2a str. 301
guuuuaucccgcuc

SEQ ID NO: 2009999 - RNA, 16 nt, Shigella flexneri 2a str. 301
guuuuauuauuccauc

SEQ ID NO: 2010000 - RNA, 22 nt, Shigella flexneri 2a str. 301
guuuuauuauuccauccugcuc

SEQ ID NO: 2010001 - RNA, 11 nt, Shigella flexneri 2a str. 301
guuuucaucau

SEQ ID NO: 2010002 - RNA, 16 nt, Shigella flexneri 2a str. 301
guuuuaucuccauccg

SEQ ID NO: 2010003 - RNA, 16 nt, Shigella flexneri 2a str. 301
aaaucaucaucuuuau

SEQ ID NO: 2010004 - RNA, 22 nt, Shigella flexneri 2a str. 301
aaaucaucauugcuguuuuaca

SEQ ID NO: 2010005 - RNA, 14 nt, Shigella flexneri 2a str. 301
aaaucauccauccg

SEQ ID NO: 2010006 - RNA, 21 nt, Shigella flexneri 2a str. 301
aaaucauccagaccgcucagc

SEQ ID NO: 2010007 - RNA, 16 nt, Shigella flexneri 2a str. 301
aaaucauccugcugca

SEQ ID NO: 2010008 - RNA, 22 nt, Shigella flexneri 2a str. 301
aaaucaguggcuggaacaacgu

SEQ ID NO: 2010009 - RNA, 17 nt, Shigella flexneri 2a str. 301
uaaaaauccuguuccau

SEQ ID NO: 2010010 - RNA, 17 nt, Shigella flexneri 2a str. 301
uaaaaaucgaugcuguu

SEQ ID NO: 2010011 - RNA, 18 nt, Shigella flexneri 2a str. 301
uaaaaaucgaugcuguug

SEQ ID NO: 2010012 - RNA, 22 nt, Shigella flexneri 2a str. 301
uaaaaauugaaucacgacaaac

SEQ ID NO: 2010013 - RNA, 21 nt, Shigella flexneri 2a str. 301
uaaaacaacggaacgaaaaaa

SEQ ID NO: 2010014 - RNA, 22 nt, Shigella flexneri 2a str. 301
uaaaacaacggaacgaaaaaaa

SEQ ID NO: 2010015 - RNA, 19 nt, Shigella flexneri 2a str. 301
uaaaacaacggaacgaaaa

SEQ ID NO: 2010016 - RNA, 23 nt, Shigella flexneri 2a str. 301
uaaaaccaacaguaucugaauca

SEQ ID NO: 2010017 - RNA, 19 nt, Shigella flexneri 2a str. 301
uaaaacccuugugcucaau

SEQ ID NO: 2010018 - RNA, 15 nt, Shigella flexneri 2a str. 301
uaaaaccgacuuaaa

SEQ ID NO: 2010019 - RNA, 22 nt, Shigella flexneri 2a str. 301
uaaaacagcacuccugccacca

SEQ ID NO: 2010020 - RNA, 21 nt, Shigella flexneri 2a str. 301
uaaaacagacgagggaaaaua

SEQ ID NO: 2010021 - RNA, 16 nt, Shigella flexneri 2a str. 301
uaaaacagccagcgcu

SEQ ID NO: 2010022 - RNA, 13 nt, Shigella flexneri 2a str. 301
uaaaagccaggag

SEQ ID NO: 2010023 - RNA, 21 nt, Shigella flexneri 2a str. 301
uaaaagcauagccccagcgca

SEQ ID NO: 2010024 - RNA, 15 nt, Shigella flexneri 2a str. 301
uaaaagcgugaaaca

SEQ ID NO: 2010025 - RNA, 22 nt, Shigella flexneri 2a str. 301
uaaaagcgugaaacaaaucacu

SEQ ID NO: 2010026 - RNA, 14 nt, Shigella flexneri 2a str. 301
uaaaagccccuucg

SEQ ID NO: 2010027 - RNA, 12 nt, Shigella flexneri 2a str. 301
uaaaacuuucca

SEQ ID NO: 2010028 - RNA, 17 nt, Shigella flexneri 2a str. 301
uaaaacuuuauucagug

SEQ ID NO: 2010029 - RNA, 19 nt, Shigella flexneri 2a str. 301
uaaaacuuuuagcaucuua

SEQ ID NO: 2010030 - RNA, 15 nt, Shigella flexneri 2a str. 301
uaaaagaaaucagac

SEQ ID NO: 2010031 - RNA, 16 nt, Shigella flexneri 2a str. 301
uaaaacuuuauucagu

SEQ ID NO: 2010032 - RNA, 12 nt, Shigella flexneri 2a str. 301
uaaaagaaaaaa

SEQ ID NO: 2010033 - RNA, 18 nt, Shigella flexneri 2a str. 301
uaaaacuaacgccaggaa

SEQ ID NO: 2010034 - RNA, 17 nt, Shigella flexneri 2a str. 301
uaaaacgugccauuaau

SEQ ID NO: 2010035 - RNA, 20 nt, Shigella flexneri 2a str. 301
uaaaacgguuuauccccaag

SEQ ID NO: 2010036 - RNA, 16 nt, Shigella flexneri 2a str. 301
uaaaaccugacaacaa

SEQ ID NO: 2010037 - RNA, 13 nt, Shigella flexneri 2a str. 301
uaaaaccugacaa

SEQ ID NO: 2010038 - RNA, 16 nt, Shigella flexneri 2a str. 301
uaaaacgagauagcgu

SEQ ID NO: 2010039 - RNA, 23 nt, Shigella flexneri 2a str. 301
uaaaacgcgcuacugaaucccug

SEQ ID NO: 2010040 - RNA, 22 nt, Shigella flexneri 2a str. 301
uaaaacgcgcccucagcccaca

SEQ ID NO: 2010041 - RNA, 23 nt, Shigella flexneri 2a str. 301
uaaaacgcacgcugucaccagug

SEQ ID NO: 2010042 - RNA, 18 nt, Shigella flexneri 2a str. 301
uaaaaggcgccauuuuca

SEQ ID NO: 2010043 - RNA, 20 nt, Shigella flexneri 2a str. 301
uaaaaggcgccauuuucaua

SEQ ID NO: 2010044 - RNA, 14 nt, Shigella flexneri 2a str. 301
uaaaaggagauaaa

SEQ ID NO: 2010045 - RNA, 14 nt, Shigella flexneri 2a str. 301
uaaaaugcgaaaaa

SEQ ID NO: 2010046 - RNA, 14 nt, Shigella flexneri 2a str. 301
uaaaauguacaugu

SEQ ID NO: 2010047 - RNA, 13 nt, Shigella flexneri 2a str. 301
uaaaauguacaug

SEQ ID NO: 2010048 - RNA, 17 nt, Shigella flexneri 2a str. 301
uaaaaugauacgcuccc

SEQ ID NO: 2010049 - RNA, 20 nt, Shigella flexneri 2a str. 301
uaaaaugagugccaaaaaaa

SEQ ID NO: 2010050 - RNA, 22 nt, Shigella flexneri 2a str. 301
uaaaaugagugccaaaaaaaua

SEQ ID NO: 2010051 - RNA, 21 nt, Shigella flexneri 2a str. 301
uaaaaugacucgccgcugugg

SEQ ID NO: 2010052 - RNA, 23 nt, Shigella flexneri 2a str. 301
uaaaaucuucacuaaaaucauuc

SEQ ID NO: 2010053 - RNA, 23 nt, Shigella flexneri 2a str. 301
uaaaaucuauuauuauuuuugug

SEQ ID NO: 2010054 - RNA, 18 nt, Shigella flexneri 2a str. 301
uaaaaucgacaucugcaa

SEQ ID NO: 2010055 - RNA, 15 nt, Shigella flexneri 2a str. 301
uaaaauaucuuccac

SEQ ID NO: 2010056 - RNA, 18 nt, Shigella flexneri 2a str. 301
uaaaaucagaaaucacca

SEQ ID NO: 2010057 - RNA, 21 nt, Shigella flexneri 2a str. 301
uaaaaucaucacgcgguuacg

SEQ ID NO: 2010058 - RNA, 12 nt, Shigella flexneri 2a str. 301
uaaaaucacagg

SEQ ID NO: 2010059 - RNA, 21 nt, Shigella flexneri 2a str. 301
uaaaggagaaggguuaugaug

SEQ ID NO: 2010060 - RNA, 19 nt, Shigella flexneri 2a str. 301
uaaagcgcgaucgcuaccu

SEQ ID NO: 2010061 - RNA, 14 nt, Shigella flexneri 2a str. 301
uaaagccuuuuacc

SEQ ID NO: 2010062 - RNA, 18 nt, Shigella flexneri 2a str. 301
uaaaggggugaaaaaaac

SEQ ID NO: 2010063 - RNA, 18 nt, Shigella flexneri 2a str. 301
uaaaggucgacagcagcc

SEQ ID NO: 2010064 - RNA, 22 nt, Shigella flexneri 2a str. 301
uaaaggcggcagaacagaacau

SEQ ID NO: 2010065 - RNA, 17 nt, Shigella flexneri 2a str. 301
uaaaggcggcagaacag

SEQ ID NO: 2010066 - RNA, 20 nt, Shigella flexneri 2a str. 301
uaaagggaucaauaaugaug

SEQ ID NO: 2010067 - RNA, 16 nt, Shigella flexneri 2a str. 301
uaaagccugcuggcag

SEQ ID NO: 2010068 - RNA, 19 nt, Shigella flexneri 2a str. 301
uaaagccuauccagaagcc

SEQ ID NO: 2010069 - RNA, 23 nt, Shigella flexneri 2a str. 301
uaaagccguggguauauuucagg

SEQ ID NO: 2010070 - RNA, 20 nt, Shigella flexneri 2a str. 301
uaaagagaacucuuuuuucc

SEQ ID NO: 2010071 - RNA, 23 nt, Shigella flexneri 2a str. 301
uaaagagcgccucccuuuuucaa

SEQ ID NO: 2010072 - RNA, 22 nt, Shigella flexneri 2a str. 301
uaaagagcauuacacgcggcug

SEQ ID NO: 2010073 - RNA, 10 nt, Shigella flexneri 2a str. 301
uaaagaagag

SEQ ID NO: 2010074 - RNA, 11 nt, Shigella flexneri 2a str. 301
uaaauacagag

SEQ ID NO: 2010075 - RNA, 13 nt, Shigella flexneri 2a str. 301
uaaauacagagca

SEQ ID NO: 2010076 - RNA, 14 nt, Shigella flexneri 2a str. 301
uaaauauuauuggc

SEQ ID NO: 2010077 - RNA, 22 nt, Shigella flexneri 2a str. 301
uaaauaccguucauuaacgccc

SEQ ID NO: 2010078 - RNA, 22 nt, Shigella flexneri 2a str. 301
uaaauaccuuacacucaaauau

SEQ ID NO: 2010079 - RNA, 23 nt, Shigella flexneri 2a str. 301
uaaauaccuuacacucaaauauc

SEQ ID NO: 2010080 - RNA, 21 nt, Shigella flexneri 2a str. 301
uaaauacgccucuucauacau

SEQ ID NO: 2010081 - RNA, 16 nt, Shigella flexneri 2a str. 301
uaaauacuccauaacu

SEQ ID NO: 2010082 - RNA, 21 nt, Shigella flexneri 2a str. 301
uaaacaccugggcaaugguga

SEQ ID NO: 2010083 - RNA, 17 nt, Shigella flexneri 2a str. 301
uaaacaccuucauccag

SEQ ID NO: 2010084 - RNA, 12 nt, Shigella flexneri 2a str. 301
uaaacaccagca

SEQ ID NO: 2010085 - RNA, 16 nt, Shigella flexneri 2a str. 301
uaaacaguuucgccag

SEQ ID NO: 2010086 - RNA, 21 nt, Shigella flexneri 2a str. 301
uaaacaucgggacaugauaug

SEQ ID NO: 2010087 - RNA, 21 nt, Shigella flexneri 2a str. 301
uaaacaaugagauauuuaaau

SEQ ID NO: 2010088 - RNA, 22 nt, Shigella flexneri 2a str. 301
uaaaauuauccagcuuuuccca

SEQ ID NO: 2010089 - RNA, 15 nt, Shigella flexneri 2a str. 301
uaaaauucaucaaau

SEQ ID NO: 2010090 - RNA, 22 nt, Shigella flexneri 2a str. 301
uaaaauucuuacguaauuuaua

SEQ ID NO: 2010091 - RNA, 17 nt, Shigella flexneri 2a str. 301
uaaaauucauucaauua

SEQ ID NO: 2010092 - RNA, 20 nt, Shigella flexneri 2a str. 301
uaaaauucuacagaaaugaa

SEQ ID NO: 2010093 - RNA, 13 nt, Shigella flexneri 2a str. 301
uaaaauuuaacau

SEQ ID NO: 2010094 - RNA, 22 nt, Shigella flexneri 2a str. 301
uaaacgcagagacaucaccaau

SEQ ID NO: 2010095 - RNA, 12 nt, Shigella flexneri 2a str. 301
uaaaccuucauc

SEQ ID NO: 2010096 - RNA, 18 nt, Shigella flexneri 2a str. 301
uaaacccuaacaucaucc

SEQ ID NO: 2010097 - RNA, 16 nt, Shigella flexneri 2a str. 301
uaaaccugauuuugcc

SEQ ID NO: 2010098 - RNA, 19 nt, Shigella flexneri 2a str. 301
uaaacccgaccacuuccac

SEQ ID NO: 2010099 - RNA, 16 nt, Shigella flexneri 2a str. 301
uaaacauuaaaauucu

SEQ ID NO: 2010100 - RNA, 13 nt, Shigella flexneri 2a str. 301
uaaaccagcuguc

SEQ ID NO: 2010101 - RNA, 13 nt, Shigella flexneri 2a str. 301
uaaaccaggccaa

SEQ ID NO: 2010102 - RNA, 15 nt, Shigella flexneri 2a str. 301
uaaagaaccucuuca

SEQ ID NO: 2010103 - RNA, 13 nt, Shigella flexneri 2a str. 301
uaaagaaaguaau

SEQ ID NO: 2010104 - RNA, 12 nt, Shigella flexneri 2a str. 301
uaaacuuggcua

SEQ ID NO: 2010105 - RNA, 18 nt, Shigella flexneri 2a str. 301
uaacgaacucuuugccca

SEQ ID NO: 2010106 - RNA, 13 nt, Shigella flexneri 2a str. 301
uaacgaccaccac

SEQ ID NO: 2010107 - RNA, 15 nt, Shigella flexneri 2a str. 301
uaacgacauuuucug

SEQ ID NO: 2010108 - RNA, 14 nt, Shigella flexneri 2a str. 301
uaacgaacgcagug

SEQ ID NO: 2010109 - RNA, 23 nt, Shigella flexneri 2a str. 301
uaaccuuguccaccgugauucac

SEQ ID NO: 2010110 - RNA, 22 nt, Shigella flexneri 2a str. 301
uaaccugaaaccggaaagcuuc

SEQ ID NO: 2010111 - RNA, 16 nt, Shigella flexneri 2a str. 301
uaaccgcuuuuucaau

SEQ ID NO: 2010112 - RNA, 12 nt, Shigella flexneri 2a str. 301
uaaccgcuuuuu

SEQ ID NO: 2010113 - RNA, 15 nt, Shigella flexneri 2a str. 301
uaaccgcuuuuccag

SEQ ID NO: 2010114 - RNA, 21 nt, Shigella flexneri 2a str. 301
uaaccaacaaugcaaaauagg

SEQ ID NO: 2010115 - RNA, 22 nt, Shigella flexneri 2a str. 301
uaaccaacaauugucgccacaa

SEQ ID NO: 2010116 - RNA, 16 nt, Shigella flexneri 2a str. 301
uaaccaacaauaaaau

SEQ ID NO: 2010117 - RNA, 20 nt, Shigella flexneri 2a str. 301
uaacccaggggucaguuccc

SEQ ID NO: 2010118 - RNA, 19 nt, Shigella flexneri 2a str. 301
uaacccacugacuucucug

SEQ ID NO: 2010119 - RNA, 20 nt, Shigella flexneri 2a str. 301
uaacccacugacuucucugg

SEQ ID NO: 2010120 - RNA, 19 nt, Shigella flexneri 2a str. 301
uaacccccaaauaaccccu

SEQ ID NO: 2010121 - RNA, 20 nt, Shigella flexneri 2a str. 301
uaaccccacagggugagcag

SEQ ID NO: 2010122 - RNA, 14 nt, Shigella flexneri 2a str. 301
uaaccccaccagca

SEQ ID NO: 2010123 - RNA, 16 nt, Shigella flexneri 2a str. 301
uaaccccaccagcaug

SEQ ID NO: 2010124 - RNA, 21 nt, Shigella flexneri 2a str. 301
uaacccauccagcagagauac

SEQ ID NO: 2010125 - RNA, 22 nt, Shigella flexneri 2a str. 301
uaaccgccaguaaucuggccaa

SEQ ID NO: 2010126 - RNA, 17 nt, Shigella flexneri 2a str. 301
uaaccgcugcaaaaaau

SEQ ID NO: 2010127 - RNA, 19 nt, Shigella flexneri 2a str. 301
uaaccgcccagugccagca

SEQ ID NO: 2010128 - RNA, 17 nt, Shigella flexneri 2a str. 301
uaacauaccuaaaagca

SEQ ID NO: 2010129 - RNA, 18 nt, Shigella flexneri 2a str. 301
uaaccaaaagcugggaug

SEQ ID NO: 2010130 - RNA, 14 nt, Shigella flexneri 2a str. 301
uaacauuaacucca

SEQ ID NO: 2010131 - RNA, 17 nt, Shigella flexneri 2a str. 301
uaacagcguccacagcc

SEQ ID NO: 2010132 - RNA, 21 nt, Shigella flexneri 2a str. 301
uaacagcguccacagccaaca

SEQ ID NO: 2010133 - RNA, 15 nt, Shigella flexneri 2a str. 301
uaacagguuuaaaca

SEQ ID NO: 2010134 - RNA, 16 nt, Shigella flexneri 2a str. 301
uaacagguuuaaacag

SEQ ID NO: 2010135 - RNA, 17 nt, Shigella flexneri 2a str. 301
uaacagguuuaaacaga

SEQ ID NO: 2010136 - RNA, 21 nt, Shigella flexneri 2a str. 301
uaacagguuuugauuauucaa

SEQ ID NO: 2010137 - RNA, 20 nt, Shigella flexneri 2a str. 301
uaacaauccgauaaucccuu

SEQ ID NO: 2010138 - RNA, 16 nt, Shigella flexneri 2a str. 301
uaacagcgaaaucgcc

SEQ ID NO: 2010139 - RNA, 21 nt, Shigella flexneri 2a str. 301
uaacagcaacauaggcugcua

SEQ ID NO: 2010140 - RNA, 17 nt, Shigella flexneri 2a str. 301
uaaauugcgauucaccg

SEQ ID NO: 2010141 - RNA, 22 nt, Shigella flexneri 2a str. 301
uaaauugcaggguuuuguuuaa

SEQ ID NO: 2010142 - RNA, 15 nt, Shigella flexneri 2a str. 301
uaaauugcagcacac

SEQ ID NO: 2010143 - RNA, 22 nt, Shigella flexneri 2a str. 301
uaaauugcaggacuuauucauu

SEQ ID NO: 2010144 - RNA, 18 nt, Shigella flexneri 2a str. 301
uaaauuacugccgcuguu

SEQ ID NO: 2010145 - RNA, 19 nt, Shigella flexneri 2a str. 301
uaaauuugccaucucugca

SEQ ID NO: 2010146 - RNA, 22 nt, Shigella flexneri 2a str. 301
uaaauuucuuaccacugccgca

SEQ ID NO: 2010147 - RNA, 23 nt, Shigella flexneri 2a str. 301
uaacaauagcgaacagacaaaaa

SEQ ID NO: 2010148 - RNA, 16 nt, Shigella flexneri 2a str. 301
uaacaaaugugccauu

SEQ ID NO: 2010149 - RNA, 20 nt, Shigella flexneri 2a str. 301
uaacaaaugcgcuuuauuca

SEQ ID NO: 2010150 - RNA, 15 nt, Shigella flexneri 2a str. 301
uaacaaagccugcac

SEQ ID NO: 2010151 - RNA, 19 nt, Shigella flexneri 2a str. 301
uaaaugccacugaauaaag

SEQ ID NO: 2010152 - RNA, 16 nt, Shigella flexneri 2a str. 301
uaaaugacagcgaaug

SEQ ID NO: 2010153 - RNA, 14 nt, Shigella flexneri 2a str. 301
uaaauguuaagacu

SEQ ID NO: 2010154 - RNA, 21 nt, Shigella flexneri 2a str. 301
uaaauguguuuuuauuugauu

SEQ ID NO: 2010155 - RNA, 18 nt, Shigella flexneri 2a str. 301
uaaaugccggaagcugca

SEQ ID NO: 2010156 - RNA, 14 nt, Shigella flexneri 2a str. 301
uaaaucacaccauu

SEQ ID NO: 2010157 - RNA, 11 nt, Shigella flexneri 2a str. 301
uaaaucaaacc

SEQ ID NO: 2010158 - RNA, 12 nt, Shigella flexneri 2a str. 301
uaggccggauaa

SEQ ID NO: 2010159 - RNA, 18 nt, Shigella flexneri 2a str. 301
uaggccgcugaugccagg

SEQ ID NO: 2010160 - RNA, 19 nt, Shigella flexneri 2a str. 301
uaggcaucccgcaccagcg

SEQ ID NO: 2010161 - RNA, 18 nt, Shigella flexneri 2a str. 301
uaggcaauuggcgcauca

SEQ ID NO: 2010162 - RNA, 14 nt, Shigella flexneri 2a str. 301
uaggcaucagcaau

SEQ ID NO: 2010163 - RNA, 14 nt, Shigella flexneri 2a str. 301
uagggaucaucuua

SEQ ID NO: 2010164 - RNA, 14 nt, Shigella flexneri 2a str. 301
uagggaguuuaauc

SEQ ID NO: 2010165 - RNA, 20 nt, Shigella flexneri 2a str. 301
uagggcacgccgagcgcauc

SEQ ID NO: 2010166 - RNA, 21 nt, Shigella flexneri 2a str. 301
uagggcgcggaggacguuaaa

SEQ ID NO: 2010167 - RNA, 21 nt, Shigella flexneri 2a str. 301
uaggcuucuauaccaaugauu

SEQ ID NO: 2010168 - RNA, 14 nt, Shigella flexneri 2a str. 301
uaggcuggaucaga

SEQ ID NO: 2010169 - RNA, 19 nt, Shigella flexneri 2a str. 301
uaguaaacgcguagaucuc

SEQ ID NO: 2010170 - RNA, 18 nt, Shigella flexneri 2a str. 301
uaguaaauucacugccug

SEQ ID NO: 2010171 - RNA, 16 nt, Shigella flexneri 2a str. 301
uaguaucuauucauca

SEQ ID NO: 2010172 - RNA, 12 nt, Shigella flexneri 2a str. 301
uaguaucuauuc

SEQ ID NO: 2010173 - RNA, 23 nt, Shigella flexneri 2a str. 301
uaguauuuauuugcaaaguuccu

SEQ ID NO: 2010174 - RNA, 13 nt, Shigella flexneri 2a str. 301
uaguauuaagcca

SEQ ID NO: 2010175 - RNA, 16 nt, Shigella flexneri 2a str. 301
uaguaguucauccccu

SEQ ID NO: 2010176 - RNA, 21 nt, Shigella flexneri 2a str. 301
uaguaguucauccccucuucc

SEQ ID NO: 2010177 - RNA, 21 nt, Shigella flexneri 2a str. 301
uaguagguccugaccaaagcc

SEQ ID NO: 2010178 - RNA, 23 nt, Shigella flexneri 2a str. 301
uaggucuuugacgucgaaacuga

SEQ ID NO: 2010179 - RNA, 16 nt, Shigella flexneri 2a str. 301
uaggucggauaagacg

SEQ ID NO: 2010180 - RNA, 15 nt, Shigella flexneri 2a str. 301
uaggucacaucaccg

SEQ ID NO: 2010181 - RNA, 16 nt, Shigella flexneri 2a str. 301
uagguaaacaucacau

SEQ ID NO: 2010182 - RNA, 14 nt, Shigella flexneri 2a str. 301
uagguacaaagcca

SEQ ID NO: 2010183 - RNA, 20 nt, Shigella flexneri 2a str. 301
uagguacaaagccaacagca

SEQ ID NO: 2010184 - RNA, 14 nt, Shigella flexneri 2a str. 301
uagguaaucauauu

SEQ ID NO: 2010185 - RNA, 17 nt, Shigella flexneri 2a str. 301
uaguguuuguauuagau

SEQ ID NO: 2010186 - RNA, 23 nt, Shigella flexneri 2a str. 301
uaguguuggaucugauccaacaa

SEQ ID NO: 2010187 - RNA, 13 nt, Shigella flexneri 2a str. 301
uaguguuccugcg

SEQ ID NO: 2010188 - RNA, 15 nt, Shigella flexneri 2a str. 301
uagugugcaaucacu

SEQ ID NO: 2010189 - RNA, 13 nt, Shigella flexneri 2a str. 301
uagugugaucagc

SEQ ID NO: 2010190 - RNA, 16 nt, Shigella flexneri 2a str. 301
uaguuguaaucauauu

SEQ ID NO: 2010191 - RNA, 19 nt, Shigella flexneri 2a str. 301
uaguucauccccucuucca

SEQ ID NO: 2010192 - RNA, 22 nt, Shigella flexneri 2a str. 301
uaguucauccccucuuccauuu

SEQ ID NO: 2010193 - RNA, 13 nt, Shigella flexneri 2a str. 301
uagucauuuuuug

SEQ ID NO: 2010194 - RNA, 20 nt, Shigella flexneri 2a str. 301
uaguccacacgccaggccac

SEQ ID NO: 2010195 - RNA, 16 nt, Shigella flexneri 2a str. 301
uaguccggaagaugcg

SEQ ID NO: 2010196 - RNA, 21 nt, Shigella flexneri 2a str. 301
uagugaugccauacuucauaa

SEQ ID NO: 2010197 - RNA, 16 nt, Shigella flexneri 2a str. 301
uagugccgucagcagg

SEQ ID NO: 2010198 - RNA, 17 nt, Shigella flexneri 2a str. 301
uagugccgcacuugcca

SEQ ID NO: 2010199 - RNA, 12 nt, Shigella flexneri 2a str. 301
uagugucuuauc

SEQ ID NO: 2010200 - RNA, 15 nt, Shigella flexneri 2a str. 301
uauaaaccugagaac

SEQ ID NO: 2010201 - RNA, 14 nt, Shigella flexneri 2a str. 301
uauaaaaaaacaau

SEQ ID NO: 2010202 - RNA, 11 nt, Shigella flexneri 2a str. 301
uauaaaaaccg

SEQ ID NO: 2010203 - RNA, 19 nt, Shigella flexneri 2a str. 301
uaguuugauaauuuuagau

SEQ ID NO: 2010204 - RNA, 19 nt, Shigella flexneri 2a str. 301
uaguuuuauacucagucag

SEQ ID NO: 2010205 - RNA, 22 nt, Shigella flexneri 2a str. 301
uauccaccgcguucagcagcuc

SEQ ID NO: 2010206 - RNA, 20 nt, Shigella flexneri 2a str. 301
uauccaccgggguaaaucca

SEQ ID NO: 2010207 - RNA, 21 nt, Shigella flexneri 2a str. 301
uauccacgcgauacuuuuuca

SEQ ID NO: 2010208 - RNA, 13 nt, Shigella flexneri 2a str. 301
uauccaguuucug

SEQ ID NO: 2010209 - RNA, 19 nt, Shigella flexneri 2a str. 301
uauccauauggcugcauuc

SEQ ID NO: 2010210 - RNA, 20 nt, Shigella flexneri 2a str. 301
uauccaucaaagguuuuuca

SEQ ID NO: 2010211 - RNA, 15 nt, Shigella flexneri 2a str. 301
uaucauuuugcugcc

SEQ ID NO: 2010212 - RNA, 16 nt, Shigella flexneri 2a str. 301
uaucauucgacaacug

SEQ ID NO: 2010213 - RNA, 17 nt, Shigella flexneri 2a str. 301
uaucaggccuacaaugu

SEQ ID NO: 2010214 - RNA, 22 nt, Shigella flexneri 2a str. 301
uaucaggccuacauuuucuccg

SEQ ID NO: 2010215 - RNA, 20 nt, Shigella flexneri 2a str. 301
uaucagugauauauuuuuaa

SEQ ID NO: 2010216 - RNA, 20 nt, Shigella flexneri 2a str. 301
uaucaggccaauugaacucu

SEQ ID NO: 2010217 - RNA, 21 nt, Shigella flexneri 2a str. 301
uaucaggcauucuuuuucauu

SEQ ID NO: 2010218 - RNA, 21 nt, Shigella flexneri 2a str. 301
uaucacucggggcuuuucucu

SEQ ID NO: 2010219 - RNA, 13 nt, Shigella flexneri 2a str. 301
uaucacucugccg

SEQ ID NO: 2010220 - RNA, 17 nt, Shigella flexneri 2a str. 301
uaucaucggucagcguu

SEQ ID NO: 2010221 - RNA, 22 nt, Shigella flexneri 2a str. 301
uaucaguucagaagcugaagca

SEQ ID NO: 2010222 - RNA, 14 nt, Shigella flexneri 2a str. 301
uaucaguucagaag

SEQ ID NO: 2010223 - RNA, 22 nt, Shigella flexneri 2a str. 301
uaucacgaugcuaaaaacauca

SEQ ID NO: 2010224 - RNA, 15 nt, Shigella flexneri 2a str. 301
uaucacgccaccagc

SEQ ID NO: 2010225 - RNA, 19 nt, Shigella flexneri 2a str. 301
uaucacgaugcuaaaaaca

SEQ ID NO: 2010226 - RNA, 18 nt, Shigella flexneri 2a str. 301
uaucaaucucagcaagag

SEQ ID NO: 2010227 - RNA, 17 nt, Shigella flexneri 2a str. 301
uaucaaucuucucuucc

SEQ ID NO: 2010228 - RNA, 22 nt, Shigella flexneri 2a str. 301
uaucaauuaacugugccagcgu

SEQ ID NO: 2010229 - RNA, 23 nt, Shigella flexneri 2a str. 301
uaucaacagcgguuuugcuaucc

SEQ ID NO: 2010230 - RNA, 21 nt, Shigella flexneri 2a str. 301
uaucaaaacgcucugagcugc

SEQ ID NO: 2010231 - RNA, 16 nt, Shigella flexneri 2a str. 301
uauauugaauuugcau

SEQ ID NO: 2010232 - RNA, 21 nt, Shigella flexneri 2a str. 301
uauauuccccggucagcagca

SEQ ID NO: 2010233 - RNA, 14 nt, Shigella flexneri 2a str. 301
uauauaauuaaaaa

SEQ ID NO: 2010234 - RNA, 15 nt, Shigella flexneri 2a str. 301
uauauaauuaaaaau

SEQ ID NO: 2010235 - RNA, 23 nt, Shigella flexneri 2a str. 301
uauauauucucugagaauaaaua

SEQ ID NO: 2010236 - RNA, 20 nt, Shigella flexneri 2a str. 301
uauauauugggaucaaaaau

SEQ ID NO: 2010237 - RNA, 22 nt, Shigella flexneri 2a str. 301
uauauauugggaucaaaaaugu

SEQ ID NO: 2010238 - RNA, 13 nt, Shigella flexneri 2a str. 301
uauagcauagcgu

SEQ ID NO: 2010239 - RNA, 19 nt, Shigella flexneri 2a str. 301
uauagauuuacuauuauuu

SEQ ID NO: 2010240 - RNA, 20 nt, Shigella flexneri 2a str. 301
uauagcgcugaauuaguguu

SEQ ID NO: 2010241 - RNA, 22 nt, Shigella flexneri 2a str. 301
uauagcguugcccgauugguuc

SEQ ID NO: 2010242 - RNA, 16 nt, Shigella flexneri 2a str. 301
uauacuccugaugguc

SEQ ID NO: 2010243 - RNA, 20 nt, Shigella flexneri 2a str. 301
uauacggcguuuccagcucg

SEQ ID NO: 2010244 - RNA, 14 nt, Shigella flexneri 2a str. 301
uauacucagucagg

SEQ ID NO: 2010245 - RNA, 23 nt, Shigella flexneri 2a str. 301
uauacggauagcagaaaacucac

SEQ ID NO: 2010246 - RNA, 22 nt, Shigella flexneri 2a str. 301
uauaccggaccaauaacgcuuu

SEQ ID NO: 2010247 - RNA, 19 nt, Shigella flexneri 2a str. 301
uauacauaaagucuuucuu

SEQ ID NO: 2010248 - RNA, 15 nt, Shigella flexneri 2a str. 301
uauacagccuuaaca

SEQ ID NO: 2010249 - RNA, 19 nt, Shigella flexneri 2a str. 301
uauacagccuuaacaagau

SEQ ID NO: 2010250 - RNA, 16 nt, Shigella flexneri 2a str. 301
uauacagacucaaacc

SEQ ID NO: 2010251 - RNA, 13 nt, Shigella flexneri 2a str. 301
uauaacugcgguc

SEQ ID NO: 2010252 - RNA, 22 nt, Shigella flexneri 2a str. 301
uagcgucaacuuuagcgaugug

SEQ ID NO: 2010253 - RNA, 15 nt, Shigella flexneri 2a str. 301
uagcguaaggauuau

SEQ ID NO: 2010254 - RNA, 19 nt, Shigella flexneri 2a str. 301
uagcggcaggaaaaaagcg

SEQ ID NO: 2010255 - RNA, 16 nt, Shigella flexneri 2a str. 301
uagcggcaagagaauu

SEQ ID NO: 2010256 - RNA, 13 nt, Shigella flexneri 2a str. 301
uagcggagcaauu

SEQ ID NO: 2010257 - RNA, 15 nt, Shigella flexneri 2a str. 301
uagcggcugcgcagc

SEQ ID NO: 2010258 - RNA, 23 nt, Shigella flexneri 2a str. 301
uagcggcgacuugcucaggagua

SEQ ID NO: 2010259 - RNA, 12 nt, Shigella flexneri 2a str. 301
uagcgccugcug

SEQ ID NO: 2010260 - RNA, 18 nt, Shigella flexneri 2a str. 301
uagcgccucuuuauaaau

SEQ ID NO: 2010261 - RNA, 15 nt, Shigella flexneri 2a str. 301
uagcgccguuuuuau

SEQ ID NO: 2010262 - RNA, 22 nt, Shigella flexneri 2a str. 301
uagcgcccuuucagcgccuuca

SEQ ID NO: 2010263 - RNA, 22 nt, Shigella flexneri 2a str. 301
uagcgccggguuuuuuauuaau

SEQ ID NO: 2010264 - RNA, 21 nt, Shigella flexneri 2a str. 301
uagcggaaaucuccagauaau

SEQ ID NO: 2010265 - RNA, 19 nt, Shigella flexneri 2a str. 301
uagcgcaugaccagugagg

SEQ ID NO: 2010266 - RNA, 16 nt, Shigella flexneri 2a str. 301
uagcgcaucacuucca

SEQ ID NO: 2010267 - RNA, 16 nt, Shigella flexneri 2a str. 301
uagcgcauaagccacc

SEQ ID NO: 2010268 - RNA, 19 nt, Shigella flexneri 2a str. 301
uagcgcaauaacccugaac

SEQ ID NO: 2010269 - RNA, 11 nt, Shigella flexneri 2a str. 301
uagccugccag

SEQ ID NO: 2010270 - RNA, 19 nt, Shigella flexneri 2a str. 301
uagccuucaucagaugaag

SEQ ID NO: 2010271 - RNA, 16 nt, Shigella flexneri 2a str. 301
uagccuguuuucgauu

SEQ ID NO: 2010272 - RNA, 22 nt, Shigella flexneri 2a str. 301
uagccuguuuucgauuuuuucc

SEQ ID NO: 2010273 - RNA, 21 nt, Shigella flexneri 2a str. 301
uagcgaauaaucccggcacca

SEQ ID NO: 2010274 - RNA, 19 nt, Shigella flexneri 2a str. 301
uagcgaccauacagcagca

SEQ ID NO: 2010275 - RNA, 18 nt, Shigella flexneri 2a str. 301
uagcgaccgaacagauca

SEQ ID NO: 2010276 - RNA, 12 nt, Shigella flexneri 2a str. 301
uagccccagucu

SEQ ID NO: 2010277 - RNA, 20 nt, Shigella flexneri 2a str. 301
uagccacaaagcagggcugg

SEQ ID NO: 2010278 - RNA, 14 nt, Shigella flexneri 2a str. 301
uagccagcaacuga

SEQ ID NO: 2010279 - RNA, 16 nt, Shigella flexneri 2a str. 301
uagccaguaccacccc

SEQ ID NO: 2010280 - RNA, 12 nt, Shigella flexneri 2a str. 301
uagccaucugcc

SEQ ID NO: 2010281 - RNA, 23 nt, Shigella flexneri 2a str. 301
uagccucacuuuguacugacccc

SEQ ID NO: 2010282 - RNA, 15 nt, Shigella flexneri 2a str. 301
uagccgguuuuucaa

SEQ ID NO: 2010283 - RNA, 15 nt, Shigella flexneri 2a str. 301
uagccgcuucugcag

SEQ ID NO: 2010284 - RNA, 20 nt, Shigella flexneri 2a str. 301
uagccgcuuggcaagcccag

SEQ ID NO: 2010285 - RNA, 18 nt, Shigella flexneri 2a str. 301
uagccgcagccaucagcg

SEQ ID NO: 2010286 - RNA, 17 nt, Shigella flexneri 2a str. 301
uagccgaugccgcugca

SEQ ID NO: 2010287 - RNA, 19 nt, Shigella flexneri 2a str. 301
uagcccuuuguaggccaga

SEQ ID NO: 2010288 - RNA, 20 nt, Shigella flexneri 2a str. 301
uagcccugucgaggccaauu

SEQ ID NO: 2010289 - RNA, 14 nt, Shigella flexneri 2a str. 301
uagcguuaccagca

SEQ ID NO: 2010290 - RNA, 17 nt, Shigella flexneri 2a str. 301
uagcguuaauggcagau

SEQ ID NO: 2010291 - RNA, 18 nt, Shigella flexneri 2a str. 301
uagcguguugauuauaau

SEQ ID NO: 2010292 - RNA, 18 nt, Shigella flexneri 2a str. 301
uagcguuaaucaucaacu

SEQ ID NO: 2010293 - RNA, 19 nt, Shigella flexneri 2a str. 301
uagcucaaaguaaucaagc

SEQ ID NO: 2010294 - RNA, 23 nt, Shigella flexneri 2a str. 301
uagcuucaccgcaucgucacuga

SEQ ID NO: 2010295 - RNA, 21 nt, Shigella flexneri 2a str. 301
uagcuggcuucgguuuuuauu

SEQ ID NO: 2010296 - RNA, 21 nt, Shigella flexneri 2a str. 301
uagcuguuguaaugauuuaau

SEQ ID NO: 2010297 - RNA, 18 nt, Shigella flexneri 2a str. 301
uagcucgcuucaucugcc

SEQ ID NO: 2010298 - RNA, 13 nt, Shigella flexneri 2a str. 301
uagcuuuggugcc

SEQ ID NO: 2010299 - RNA, 20 nt, Shigella flexneri 2a str. 301
uaggaauccgggucuguaaa

SEQ ID NO: 2010300 - RNA, 22 nt, Shigella flexneri 2a str. 301
uaggaagccggaauuuuccuuc

SEQ ID NO: 2010301 - RNA, 18 nt, Shigella flexneri 2a str. 301
uaggcaaaaaaaaugccc

SEQ ID NO: 2010302 - RNA, 12 nt, Shigella flexneri 2a str. 301
uaggaucagaau

SEQ ID NO: 2010303 - RNA, 15 nt, Shigella flexneri 2a str. 301
uaggauacuuaucug

SEQ ID NO: 2010304 - RNA, 15 nt, Shigella flexneri 2a str. 301
uaggacgaaaaauca

SEQ ID NO: 2010305 - RNA, 17 nt, Shigella flexneri 2a str. 301
uaggacgaaaaaucaau

SEQ ID NO: 2010306 - RNA, 20 nt, Shigella flexneri 2a str. 301
uagccaauuacgcaggcaau

SEQ ID NO: 2010307 - RNA, 16 nt, Shigella flexneri 2a str. 301
uagccaauaaaugcca

SEQ ID NO: 2010308 - RNA, 21 nt, Shigella flexneri 2a str. 301
uagcauugaugcguuagauga

SEQ ID NO: 2010309 - RNA, 18 nt, Shigella flexneri 2a str. 301
uagccaaagcaccacucc

SEQ ID NO: 2010310 - RNA, 12 nt, Shigella flexneri 2a str. 301
uagcauuaagua

SEQ ID NO: 2010311 - RNA, 21 nt, Shigella flexneri 2a str. 301
uagcaucuuaucacgaugcua

SEQ ID NO: 2010312 - RNA, 13 nt, Shigella flexneri 2a str. 301
uagcaucccaaua

SEQ ID NO: 2010313 - RNA, 14 nt, Shigella flexneri 2a str. 301
uagcaucagcgcca

SEQ ID NO: 2010314 - RNA, 15 nt, Shigella flexneri 2a str. 301
uagcagcuccgccag

SEQ ID NO: 2010315 - RNA, 18 nt, Shigella flexneri 2a str. 301
uagcagcuuucagcagcg

SEQ ID NO: 2010316 - RNA, 14 nt, Shigella flexneri 2a str. 301
uagcagaaaacuca

SEQ ID NO: 2010317 - RNA, 14 nt, Shigella flexneri 2a str. 301
uagcacugcuuucc

SEQ ID NO: 2010318 - RNA, 20 nt, Shigella flexneri 2a str. 301
uagcaguaauugcagcagcu

SEQ ID NO: 2010319 - RNA, 15 nt, Shigella flexneri 2a str. 301
uagcauaaaaacucg

SEQ ID NO: 2010320 - RNA, 13 nt, Shigella flexneri 2a str. 301
uagcaguuccagc

SEQ ID NO: 2010321 - RNA, 17 nt, Shigella flexneri 2a str. 301
uagcaguuccagcaucu

SEQ ID NO: 2010322 - RNA, 20 nt, Shigella flexneri 2a str. 301
uagauuuugcagaucgccaa

SEQ ID NO: 2010323 - RNA, 17 nt, Shigella flexneri 2a str. 301
uagauuugguggggcuu

SEQ ID NO: 2010324 - RNA, 13 nt, Shigella flexneri 2a str. 301
uagcaaaguaaua

SEQ ID NO: 2010325 - RNA, 19 nt, Shigella flexneri 2a str. 301
uagcaaccaaaaaaagaau

SEQ ID NO: 2010326 - RNA, 14 nt, Shigella flexneri 2a str. 301
uagcaacaggccag

SEQ ID NO: 2010327 - RNA, 12 nt, Shigella flexneri 2a str. 301
uagcaaaacaau

SEQ ID NO: 2010328 - RNA, 13 nt, Shigella flexneri 2a str. 301
uagcaaaacaauu

SEQ ID NO: 2010329 - RNA, 21 nt, Shigella flexneri 2a str. 301
uagcaauauuuuuaugccgga

SEQ ID NO: 2010330 - RNA, 14 nt, Shigella flexneri 2a str. 301
uagcaauauuuugu

SEQ ID NO: 2010331 - RNA, 18 nt, Shigella flexneri 2a str. 301
uagcaauauuuuuaugcc

SEQ ID NO: 2010332 - RNA, 18 nt, Shigella flexneri 2a str. 301
uagcacgacguuucuuuc

SEQ ID NO: 2010333 - RNA, 21 nt, Shigella flexneri 2a str. 301
uagcacuguaaaccucuuucg

SEQ ID NO: 2010334 - RNA, 14 nt, Shigella flexneri 2a str. 301
uagcacgucaucug

SEQ ID NO: 2010335 - RNA, 19 nt, Shigella flexneri 2a str. 301
uagcacaaaaauagcccca

SEQ ID NO: 2010336 - RNA, 18 nt, Shigella flexneri 2a str. 301
uagcacacggauauugcu

SEQ ID NO: 2010337 - RNA, 12 nt, Shigella flexneri 2a str. 301
uagauccaggaa

SEQ ID NO: 2010338 - RNA, 15 nt, Shigella flexneri 2a str. 301
uagaucuaaaugcca

SEQ ID NO: 2010339 - RNA, 21 nt, Shigella flexneri 2a str. 301
uagaucuaaaugccacugaau

SEQ ID NO: 2010340 - RNA, 19 nt, Shigella flexneri 2a str. 301
uagaucuccauacuuccac

SEQ ID NO: 2010341 - RNA, 14 nt, Shigella flexneri 2a str. 301
uagauaucaugcuc

SEQ ID NO: 2010342 - RNA, 16 nt, Shigella flexneri 2a str. 301
uagauagcguucuuua

SEQ ID NO: 2010343 - RNA, 19 nt, Shigella flexneri 2a str. 301
uagaugugggcaaucucac

SEQ ID NO: 2010344 - RNA, 20 nt, Shigella flexneri 2a str. 301
uagauggggccaugauuuga

SEQ ID NO: 2010345 - RNA, 18 nt, Shigella flexneri 2a str. 301
uagaggcguuccugcaac

SEQ ID NO: 2010346 - RNA, 15 nt, Shigella flexneri 2a str. 301
uagaggaauggcaga

SEQ ID NO: 2010347 - RNA, 19 nt, Shigella flexneri 2a str. 301
uagagcuugugcaccagcu

SEQ ID NO: 2010348 - RNA, 21 nt, Shigella flexneri 2a str. 301
uagagaucucucuugcuauca

SEQ ID NO: 2010349 - RNA, 15 nt, Shigella flexneri 2a str. 301
uagauaaaacacucu

SEQ ID NO: 2010350 - RNA, 15 nt, Shigella flexneri 2a str. 301
uagauaaaaaugaag

SEQ ID NO: 2010351 - RNA, 15 nt, Shigella flexneri 2a str. 301
uagauaaucgcuuuc

SEQ ID NO: 2010352 - RNA, 18 nt, Shigella flexneri 2a str. 301
uagauaaucgcuuucgga

SEQ ID NO: 2010353 - RNA, 22 nt, Shigella flexneri 2a str. 301
uagauacccggauacaacucgc

SEQ ID NO: 2010354 - RNA, 20 nt, Shigella flexneri 2a str. 301
uaccaccugcucgucauccg

SEQ ID NO: 2010355 - RNA, 17 nt, Shigella flexneri 2a str. 301
uaccacgcaaagcacgc

SEQ ID NO: 2010356 - RNA, 22 nt, Shigella flexneri 2a str. 301
uaccacgcacagcccgccgcca

SEQ ID NO: 2010357 - RNA, 18 nt, Shigella flexneri 2a str. 301
uaccacggcauuuccgcc

SEQ ID NO: 2010358 - RNA, 19 nt, Shigella flexneri 2a str. 301
uaccacggguuucccaugc

SEQ ID NO: 2010359 - RNA, 20 nt, Shigella flexneri 2a str. 301
uaccacgguacgccagagug

SEQ ID NO: 2010360 - RNA, 19 nt, Shigella flexneri 2a str. 301
uaccacggaaaggcaacau

SEQ ID NO: 2010361 - RNA, 21 nt, Shigella flexneri 2a str. 301
uaccgccaucaauugcucacu

SEQ ID NO: 2010362 - RNA, 13 nt, Shigella flexneri 2a str. 301
uaccgccauggcc

SEQ ID NO: 2010363 - RNA, 18 nt, Shigella flexneri 2a str. 301
uaccgcccaccaccagcg

SEQ ID NO: 2010364 - RNA, 13 nt, Shigella flexneri 2a str. 301
uaccgccgcacaa

SEQ ID NO: 2010365 - RNA, 19 nt, Shigella flexneri 2a str. 301
uaccacuuccagcagacca

SEQ ID NO: 2010366 - RNA, 16 nt, Shigella flexneri 2a str. 301
uaccgccagcaggaac

SEQ ID NO: 2010367 - RNA, 13 nt, Shigella flexneri 2a str. 301
uaccacuucaucc

SEQ ID NO: 2010368 - RNA, 13 nt, Shigella flexneri 2a str. 301
uaccacuacauca

SEQ ID NO: 2010369 - RNA, 16 nt, Shigella flexneri 2a str. 301
uaccgggucgcacugg

SEQ ID NO: 2010370 - RNA, 17 nt, Shigella flexneri 2a str. 301
uaccggugacagcggug

SEQ ID NO: 2010371 - RNA, 20 nt, Shigella flexneri 2a str. 301
uaccgggcuguucacugugc

SEQ ID NO: 2010372 - RNA, 21 nt, Shigella flexneri 2a str. 301
uaccuaaaagcacgccagaca

SEQ ID NO: 2010373 - RNA, 20 nt, Shigella flexneri 2a str. 301
uaccgggccugaacaagcaa

SEQ ID NO: 2010374 - RNA, 19 nt, Shigella flexneri 2a str. 301
uaccggcuggcgcauacca

SEQ ID NO: 2010375 - RNA, 14 nt, Shigella flexneri 2a str. 301
uaccucauggagau

SEQ ID NO: 2010376 - RNA, 15 nt, Shigella flexneri 2a str. 301
uaccucauggagaua

SEQ ID NO: 2010377 - RNA, 22 nt, Shigella flexneri 2a str. 301
uaccuuaucaaucucagcaaga

SEQ ID NO: 2010378 - RNA, 20 nt, Shigella flexneri 2a str. 301
uaccuuaucaaucucagcaa

SEQ ID NO: 2010379 - RNA, 14 nt, Shigella flexneri 2a str. 301
uaccugucauggca

SEQ ID NO: 2010380 - RNA, 17 nt, Shigella flexneri 2a str. 301
uaccugguccuucaucu

SEQ ID NO: 2010381 - RNA, 13 nt, Shigella flexneri 2a str. 301
uaccuggauucga

SEQ ID NO: 2010382 - RNA, 23 nt, Shigella flexneri 2a str. 301
uaccugaggcgcuacgcuaucag

SEQ ID NO: 2010383 - RNA, 14 nt, Shigella flexneri 2a str. 301
uaccugacagcaga

SEQ ID NO: 2010384 - RNA, 21 nt, Shigella flexneri 2a str. 301
uaccucuuguucgucgucuuu

SEQ ID NO: 2010385 - RNA, 22 nt, Shigella flexneri 2a str. 301
uaccuugcuuauccucuguaaa

SEQ ID NO: 2010386 - RNA, 13 nt, Shigella flexneri 2a str. 301
uaccuucauuugc

SEQ ID NO: 2010387 - RNA, 15 nt, Shigella flexneri 2a str. 301
uaccuucauuugcca

SEQ ID NO: 2010388 - RNA, 23 nt, Shigella flexneri 2a str. 301
uaccuuccggcguaccuuugccu

SEQ ID NO: 2010389 - RNA, 17 nt, Shigella flexneri 2a str. 301
uaccuucaacacuggca

SEQ ID NO: 2010390 - RNA, 22 nt, Shigella flexneri 2a str. 301
uacgaaacauccugccagagcc

SEQ ID NO: 2010391 - RNA, 18 nt, Shigella flexneri 2a str. 301
uacucagcgccugcugca

SEQ ID NO: 2010392 - RNA, 17 nt, Shigella flexneri 2a str. 301
uacuccccuuucuuauu

SEQ ID NO: 2010393 - RNA, 13 nt, Shigella flexneri 2a str. 301
uacuccaguuccg

SEQ ID NO: 2010394 - RNA, 14 nt, Shigella flexneri 2a str. 301
uacucagcgccugc

SEQ ID NO: 2010395 - RNA, 16 nt, Shigella flexneri 2a str. 301
uacucaccagacaucc

SEQ ID NO: 2010396 - RNA, 12 nt, Shigella flexneri 2a str. 301
uacucaacuccc

SEQ ID NO: 2010397 - RNA, 14 nt, Shigella flexneri 2a str. 301
uacucaagcagcca

SEQ ID NO: 2010398 - RNA, 21 nt, Shigella flexneri 2a str. 301
uacuaugauuuuccugaggag

SEQ ID NO: 2010399 - RNA, 12 nt, Shigella flexneri 2a str. 301
uacguucuuaca

SEQ ID NO: 2010400 - RNA, 22 nt, Shigella flexneri 2a str. 301
uacguucauggcgcgacauggc

SEQ ID NO: 2010401 - RNA, 21 nt, Shigella flexneri 2a str. 301
uacuauaaguguaaaauucua

SEQ ID NO: 2010402 - RNA, 13 nt, Shigella flexneri 2a str. 301
uacgcuuuccagc

SEQ ID NO: 2010403 - RNA, 23 nt, Shigella flexneri 2a str. 301
uacgcuuaucaggccuacaaaau

SEQ ID NO: 2010404 - RNA, 16 nt, Shigella flexneri 2a str. 301
uacgcucaucaggccu

SEQ ID NO: 2010405 - RNA, 23 nt, Shigella flexneri 2a str. 301
uacgcucaucaggccuacaaaau

SEQ ID NO: 2010406 - RNA, 15 nt, Shigella flexneri 2a str. 301
uacgcucacugcaaa

SEQ ID NO: 2010407 - RNA, 18 nt, Shigella flexneri 2a str. 301
uacgauagaauauuucua

SEQ ID NO: 2010408 - RNA, 22 nt, Shigella flexneri 2a str. 301
uacgaucaagauugauccccgc

SEQ ID NO: 2010409 - RNA, 19 nt, Shigella flexneri 2a str. 301
uacgaauucuaucaugcaa

SEQ ID NO: 2010410 - RNA, 20 nt, Shigella flexneri 2a str. 301
uacgauaaugccguuuggca

SEQ ID NO: 2010411 - RNA, 18 nt, Shigella flexneri 2a str. 301
uacgaauucuaucaugca

SEQ ID NO: 2010412 - RNA, 18 nt, Shigella flexneri 2a str. 301
uacgaaguuuaauucuuu

SEQ ID NO: 2010413 - RNA, 15 nt, Shigella flexneri 2a str. 301
uacguguuguuccag

SEQ ID NO: 2010414 - RNA, 20 nt, Shigella flexneri 2a str. 301
uacgguuuucucgccaccgg

SEQ ID NO: 2010415 - RNA, 13 nt, Shigella flexneri 2a str. 301
uacgguggaacau

SEQ ID NO: 2010416 - RNA, 14 nt, Shigella flexneri 2a str. 301
uacggaucuuuucu

SEQ ID NO: 2010417 - RNA, 23 nt, Shigella flexneri 2a str. 301
uacggcaaaagaauaucagagcc

SEQ ID NO: 2010418 - RNA, 19 nt, Shigella flexneri 2a str. 301
uacggguucaagucccguc

SEQ ID NO: 2010419 - RNA, 19 nt, Shigella flexneri 2a str. 301
uacggauauguuuacuucu

SEQ ID NO: 2010420 - RNA, 23 nt, Shigella flexneri 2a str. 301
uagaaugccaaguaauagaacua

SEQ ID NO: 2010421 - RNA, 15 nt, Shigella flexneri 2a str. 301
uagaauaaggcuuuc

SEQ ID NO: 2010422 - RNA, 16 nt, Shigella flexneri 2a str. 301
uagaauaccugccugu

SEQ ID NO: 2010423 - RNA, 22 nt, Shigella flexneri 2a str. 301
uagaaauuccuaugcaacaacu

SEQ ID NO: 2010424 - RNA, 15 nt, Shigella flexneri 2a str. 301
uagaaauuauuucuu

SEQ ID NO: 2010425 - RNA, 15 nt, Shigella flexneri 2a str. 301
uagaacaucuuaccu

SEQ ID NO: 2010426 - RNA, 17 nt, Shigella flexneri 2a str. 301
uagaacguaacaguaca

SEQ ID NO: 2010427 - RNA, 16 nt, Shigella flexneri 2a str. 301
uagaaccuaagaacca

SEQ ID NO: 2010428 - RNA, 23 nt, Shigella flexneri 2a str. 301
uagaagccauuaaacaccaguac

SEQ ID NO: 2010429 - RNA, 22 nt, Shigella flexneri 2a str. 301
uagaagccauuaaacaccagua

SEQ ID NO: 2010430 - RNA, 18 nt, Shigella flexneri 2a str. 301
uagaacuauaauugcuuu

SEQ ID NO: 2010431 - RNA, 18 nt, Shigella flexneri 2a str. 301
uagacaguucuuccuggc

SEQ ID NO: 2010432 - RNA, 17 nt, Shigella flexneri 2a str. 301
uagacaguuugccuuca

SEQ ID NO: 2010433 - RNA, 15 nt, Shigella flexneri 2a str. 301
uagacaguucuuccu

SEQ ID NO: 2010434 - RNA, 23 nt, Shigella flexneri 2a str. 301
uagacaugcccggaaguaccaau

SEQ ID NO: 2010435 - RNA, 12 nt, Shigella flexneri 2a str. 301
uagaccagagcu

SEQ ID NO: 2010436 - RNA, 14 nt, Shigella flexneri 2a str. 301
uagacauuacgcau

SEQ ID NO: 2010437 - RNA, 16 nt, Shigella flexneri 2a str. 301
uagaccggaccugucg

SEQ ID NO: 2010438 - RNA, 13 nt, Shigella flexneri 2a str. 301
uagaauuguaauc

SEQ ID NO: 2010439 - RNA, 20 nt, Shigella flexneri 2a str. 301
uagaauuguaaucuauugaa

SEQ ID NO: 2010440 - RNA, 15 nt, Shigella flexneri 2a str. 301
uagaccugauacaua

SEQ ID NO: 2010441 - RNA, 16 nt, Shigella flexneri 2a str. 301
uagaccugauacauag

SEQ ID NO: 2010442 - RNA, 14 nt, Shigella flexneri 2a str. 301
uagacggcgcugcc

SEQ ID NO: 2010443 - RNA, 16 nt, Shigella flexneri 2a str. 301
uagacguucaguuccg

SEQ ID NO: 2010444 - RNA, 17 nt, Shigella flexneri 2a str. 301
uagacuuuagucaucag

SEQ ID NO: 2010445 - RNA, 22 nt, Shigella flexneri 2a str. 301
uagagaaaguaaaccaccaguc

SEQ ID NO: 2010446 - RNA, 13 nt, Shigella flexneri 2a str. 301
uagagaauuaauc

SEQ ID NO: 2010447 - RNA, 18 nt, Shigella flexneri 2a str. 301
uagaaacagucuggagca

SEQ ID NO: 2010448 - RNA, 14 nt, Shigella flexneri 2a str. 301
uagaaacuggcccu

SEQ ID NO: 2010449 - RNA, 13 nt, Shigella flexneri 2a str. 301
uagaaaucauuca

SEQ ID NO: 2010450 - RNA, 16 nt, Shigella flexneri 2a str. 301
uacuuuuuucacccac

SEQ ID NO: 2010451 - RNA, 17 nt, Shigella flexneri 2a str. 301
uacuuuuuucacccaca

SEQ ID NO: 2010452 - RNA, 19 nt, Shigella flexneri 2a str. 301
uagaaaauaaaaaacauuc

SEQ ID NO: 2010453 - RNA, 14 nt, Shigella flexneri 2a str. 301
uacuuuuuccagua

SEQ ID NO: 2010454 - RNA, 23 nt, Shigella flexneri 2a str. 301
uacuuuugccgaauucauaagaa

SEQ ID NO: 2010455 - RNA, 17 nt, Shigella flexneri 2a str. 301
uacuuuucaggauggua

SEQ ID NO: 2010456 - RNA, 15 nt, Shigella flexneri 2a str. 301
uacuuuguuauucaa

SEQ ID NO: 2010457 - RNA, 15 nt, Shigella flexneri 2a str. 301
uacuuugccuuucau

SEQ ID NO: 2010458 - RNA, 21 nt, Shigella flexneri 2a str. 301
uacuucucaccgguaaaguca

SEQ ID NO: 2010459 - RNA, 16 nt, Shigella flexneri 2a str. 301
uacuuccgggaaaacc

SEQ ID NO: 2010460 - RNA, 16 nt, Shigella flexneri 2a str. 301
uacuuuccagccacag

SEQ ID NO: 2010461 - RNA, 14 nt, Shigella flexneri 2a str. 301
uacuccggcagcca

SEQ ID NO: 2010462 - RNA, 15 nt, Shigella flexneri 2a str. 301
uacuccggcagccag

SEQ ID NO: 2010463 - RNA, 20 nt, Shigella flexneri 2a str. 301
uacuccuuagcaacaggcca

SEQ ID NO: 2010464 - RNA, 19 nt, Shigella flexneri 2a str. 301
uacuccugguaucuuuaca

SEQ ID NO: 2010465 - RNA, 15 nt, Shigella flexneri 2a str. 301
uacuggcuuucauuu

SEQ ID NO: 2010466 - RNA, 16 nt, Shigella flexneri 2a str. 301
uacugggcggcaaaau

SEQ ID NO: 2010467 - RNA, 16 nt, Shigella flexneri 2a str. 301
uacuggugcaaaaccu

SEQ ID NO: 2010468 - RNA, 20 nt, Shigella flexneri 2a str. 301
uacuuaaacaguacgagaga

SEQ ID NO: 2010469 - RNA, 22 nt, Shigella flexneri 2a str. 301
uacuguccauagcgauguauuu

SEQ ID NO: 2010470 - RNA, 23 nt, Shigella flexneri 2a str. 301
uacugucacggugcgcguugcuu

SEQ ID NO: 2010471 - RNA, 14 nt, Shigella flexneri 2a str. 301
uacuuaaugcuguc

SEQ ID NO: 2010472 - RNA, 20 nt, Shigella flexneri 2a str. 301
uaauuguuaucguuugcauu

SEQ ID NO: 2010473 - RNA, 16 nt, Shigella flexneri 2a str. 301
uaauuggaauacauau

SEQ ID NO: 2010474 - RNA, 23 nt, Shigella flexneri 2a str. 301
uaauugcuuuuaccauacuggau

SEQ ID NO: 2010475 - RNA, 19 nt, Shigella flexneri 2a str. 301
uaauuggaguaucaccauc

SEQ ID NO: 2010476 - RNA, 14 nt, Shigella flexneri 2a str. 301
uaauugaaggcuua

SEQ ID NO: 2010477 - RNA, 13 nt, Shigella flexneri 2a str. 301
uaauugcuuuuac

SEQ ID NO: 2010478 - RNA, 10 nt, Shigella flexneri 2a str. 301
uaauugcucc

SEQ ID NO: 2010479 - RNA, 18 nt, Shigella flexneri 2a str. 301
uaauuucuucguucgcug

SEQ ID NO: 2010480 - RNA, 19 nt, Shigella flexneri 2a str. 301
uaauuucauuuugauauuu

SEQ ID NO: 2010481 - RNA, 15 nt, Shigella flexneri 2a str. 301
uaauuucauuuacug

SEQ ID NO: 2010482 - RNA, 15 nt, Shigella flexneri 2a str. 301
uaauuuccagcagug

SEQ ID NO: 2010483 - RNA, 15 nt, Shigella flexneri 2a str. 301
uaauuagugcugcug

SEQ ID NO: 2010484 - RNA, 12 nt, Shigella flexneri 2a str. 301
uaauuagcuguu

SEQ ID NO: 2010485 - RNA, 22 nt, Shigella flexneri 2a str. 301
uaauggcugcgggcgaccaauc

SEQ ID NO: 2010486 - RNA, 22 nt, Shigella flexneri 2a str. 301
uaaugacuccaacuuacugaua

SEQ ID NO: 2010487 - RNA, 17 nt, Shigella flexneri 2a str. 301
uaaugcccgaugaccuu

SEQ ID NO: 2010488 - RNA, 23 nt, Shigella flexneri 2a str. 301
uaaugcccgaugaccuugucaug

SEQ ID NO: 2010489 - RNA, 21 nt, Shigella flexneri 2a str. 301
uaaugccagucaguuaagcaa

SEQ ID NO: 2010490 - RNA, 13 nt, Shigella flexneri 2a str. 301
uaaugccaguccc

SEQ ID NO: 2010491 - RNA, 22 nt, Shigella flexneri 2a str. 301
uaaugccaaucuucacaucauc

SEQ ID NO: 2010492 - RNA, 13 nt, Shigella flexneri 2a str. 301
uaaugccacauua

SEQ ID NO: 2010493 - RNA, 12 nt, Shigella flexneri 2a str. 301
uaauggaaaacu

SEQ ID NO: 2010494 - RNA, 23 nt, Shigella flexneri 2a str. 301
uaaugccgacauaggccagccgc

SEQ ID NO: 2010495 - RNA, 15 nt, Shigella flexneri 2a str. 301
uaaugcugacaaaac

SEQ ID NO: 2010496 - RNA, 18 nt, Shigella flexneri 2a str. 301
uaaugcuguuccagacca

SEQ ID NO: 2010497 - RNA, 18 nt, Shigella flexneri 2a str. 301
uaaugcugugaagauggc

SEQ ID NO: 2010498 - RNA, 21 nt, Shigella flexneri 2a str. 301
uaaucuuuuugggguuuuaau

SEQ ID NO: 2010499 - RNA, 11 nt, Shigella flexneri 2a str. 301
uaaugaaucau

SEQ ID NO: 2010500 - RNA, 21 nt, Shigella flexneri 2a str. 301
uaaugaaucgucggaauggca

SEQ ID NO: 2010501 - RNA, 22 nt, Shigella flexneri 2a str. 301
uaaucuuccagaucaccgcaga

SEQ ID NO: 2010502 - RNA, 19 nt, Shigella flexneri 2a str. 301
uaaucuuagguaaugacuc

SEQ ID NO: 2010503 - RNA, 17 nt, Shigella flexneri 2a str. 301
uaaucuguuucaucucu

SEQ ID NO: 2010504 - RNA, 14 nt, Shigella flexneri 2a str. 301
uaaucuguacugug

SEQ ID NO: 2010505 - RNA, 22 nt, Shigella flexneri 2a str. 301
uaaucuggauguucggcgucuu

SEQ ID NO: 2010506 - RNA, 13 nt, Shigella flexneri 2a str. 301
uaaucuuuaaaaa

SEQ ID NO: 2010507 - RNA, 20 nt, Shigella flexneri 2a str. 301
uaaucuuuaaaaaaagcauu

SEQ ID NO: 2010508 - RNA, 16 nt, Shigella flexneri 2a str. 301
uaaucucgccuuauca

SEQ ID NO: 2010509 - RNA, 15 nt, Shigella flexneri 2a str. 301
uaaucucuacaccaa

SEQ ID NO: 2010510 - RNA, 23 nt, Shigella flexneri 2a str. 301
uaaucguccgauuaaaaacccug

SEQ ID NO: 2010511 - RNA, 14 nt, Shigella flexneri 2a str. 301
uaaucguugucuua

SEQ ID NO: 2010512 - RNA, 14 nt, Shigella flexneri 2a str. 301
uaaucgcuuuauag

SEQ ID NO: 2010513 - RNA, 18 nt, Shigella flexneri 2a str. 301
uaaucgucaguuuuucac

SEQ ID NO: 2010514 - RNA, 18 nt, Shigella flexneri 2a str. 301
uaauccucuuugcuuccu

SEQ ID NO: 2010515 - RNA, 15 nt, Shigella flexneri 2a str. 301
uaauccuuucucaau

SEQ ID NO: 2010516 - RNA, 13 nt, Shigella flexneri 2a str. 301
uaaucgaaccaaa

SEQ ID NO: 2010517 - RNA, 16 nt, Shigella flexneri 2a str. 301
uaaucgcccucgccuu

SEQ ID NO: 2010518 - RNA, 18 nt, Shigella flexneri 2a str. 301
uaaucgccuuaauaaccc

SEQ ID NO: 2010519 - RNA, 15 nt, Shigella flexneri 2a str. 301
uaauccguaaagccc

SEQ ID NO: 2010520 - RNA, 20 nt, Shigella flexneri 2a str. 301
uaauccgcuguaauugccgc

SEQ ID NO: 2010521 - RNA, 15 nt, Shigella flexneri 2a str. 301
uaccaauaaucaauu

SEQ ID NO: 2010522 - RNA, 12 nt, Shigella flexneri 2a str. 301
uaccaaaccugc

SEQ ID NO: 2010523 - RNA, 14 nt, Shigella flexneri 2a str. 301
uaccaaaccugcac

SEQ ID NO: 2010524 - RNA, 13 nt, Shigella flexneri 2a str. 301
uaccaaaaugacu

SEQ ID NO: 2010525 - RNA, 18 nt, Shigella flexneri 2a str. 301
uaccaaaaugacuuaaua

SEQ ID NO: 2010526 - RNA, 15 nt, Shigella flexneri 2a str. 301
uacauggugcacauu

SEQ ID NO: 2010527 - RNA, 17 nt, Shigella flexneri 2a str. 301
uacaugcgcgacaaaaa

SEQ ID NO: 2010528 - RNA, 17 nt, Shigella flexneri 2a str. 301
uacauguucaaaaaaau

SEQ ID NO: 2010529 - RNA, 19 nt, Shigella flexneri 2a str. 301
uacauguucaaaaaaauca

SEQ ID NO: 2010530 - RNA, 16 nt, Shigella flexneri 2a str. 301
uacaugaagcacugca

SEQ ID NO: 2010531 - RNA, 17 nt, Shigella flexneri 2a str. 301
uacauaaagucuuucuu

SEQ ID NO: 2010532 - RNA, 13 nt, Shigella flexneri 2a str. 301
uacagccaaauca

SEQ ID NO: 2010533 - RNA, 23 nt, Shigella flexneri 2a str. 301
uacagccagccgcuaacuuccug

SEQ ID NO: 2010534 - RNA, 13 nt, Shigella flexneri 2a str. 301
uacagccagguga

SEQ ID NO: 2010535 - RNA, 18 nt, Shigella flexneri 2a str. 301
uacagcccagacaaauga

SEQ ID NO: 2010536 - RNA, 19 nt, Shigella flexneri 2a str. 301
uacagccgacaaugccaca

SEQ ID NO: 2010537 - RNA, 18 nt, Shigella flexneri 2a str. 301
uacagccgacaaugccac

SEQ ID NO: 2010538 - RNA, 16 nt, Shigella flexneri 2a str. 301
uacagcggacagccau

SEQ ID NO: 2010539 - RNA, 13 nt, Shigella flexneri 2a str. 301
uacagccggaacg

SEQ ID NO: 2010540 - RNA, 16 nt, Shigella flexneri 2a str. 301
uacagccggacccaca

SEQ ID NO: 2010541 - RNA, 15 nt, Shigella flexneri 2a str. 301
uacagcgaaacauac

SEQ ID NO: 2010542 - RNA, 14 nt, Shigella flexneri 2a str. 301
uacagcauuuccuu

SEQ ID NO: 2010543 - RNA, 19 nt, Shigella flexneri 2a str. 301
uacagcaguacgccgagaa

SEQ ID NO: 2010544 - RNA, 16 nt, Shigella flexneri 2a str. 301
uacagcagguguuacc

SEQ ID NO: 2010545 - RNA, 13 nt, Shigella flexneri 2a str. 301
uacagcuggagua

SEQ ID NO: 2010546 - RNA, 16 nt, Shigella flexneri 2a str. 301
uacagcucucacuuau

SEQ ID NO: 2010547 - RNA, 13 nt, Shigella flexneri 2a str. 301
uacagcucgguau

SEQ ID NO: 2010548 - RNA, 14 nt, Shigella flexneri 2a str. 301
uacaggauauauuu

SEQ ID NO: 2010549 - RNA, 15 nt, Shigella flexneri 2a str. 301
uacaggcagcuuaga

SEQ ID NO: 2010550 - RNA, 15 nt, Shigella flexneri 2a str. 301
uacagcguuaaaaag

SEQ ID NO: 2010551 - RNA, 13 nt, Shigella flexneri 2a str. 301
uacaguuuuacaa

SEQ ID NO: 2010552 - RNA, 18 nt, Shigella flexneri 2a str. 301
uacaggcucaaagacugu

SEQ ID NO: 2010553 - RNA, 21 nt, Shigella flexneri 2a str. 301
uacaggcuacucccaguagug

SEQ ID NO: 2010554 - RNA, 16 nt, Shigella flexneri 2a str. 301
uacaggcaguaaccaa

SEQ ID NO: 2010555 - RNA, 14 nt, Shigella flexneri 2a str. 301
uacacauuaucuca

SEQ ID NO: 2010556 - RNA, 13 nt, Shigella flexneri 2a str. 301
uacacaugcugcc

SEQ ID NO: 2010557 - RNA, 21 nt, Shigella flexneri 2a str. 301
uacacaagccaggacgcaguc

SEQ ID NO: 2010558 - RNA, 16 nt, Shigella flexneri 2a str. 301
uacacaacaugcagcc

SEQ ID NO: 2010559 - RNA, 17 nt, Shigella flexneri 2a str. 301
uacacacuuuccaggcg

SEQ ID NO: 2010560 - RNA, 16 nt, Shigella flexneri 2a str. 301
uacacagacgguuuuu

SEQ ID NO: 2010561 - RNA, 18 nt, Shigella flexneri 2a str. 301
uacaaucguuucaugcca

SEQ ID NO: 2010562 - RNA, 16 nt, Shigella flexneri 2a str. 301
uacaaucaggccaauc

SEQ ID NO: 2010563 - RNA, 13 nt, Shigella flexneri 2a str. 301
uacaauauccagc

SEQ ID NO: 2010564 - RNA, 21 nt, Shigella flexneri 2a str. 301
uacaaccaaaucugauuaaua

SEQ ID NO: 2010565 - RNA, 22 nt, Shigella flexneri 2a str. 301
uaauuuuaaauaucaucaaaau

SEQ ID NO: 2010566 - RNA, 14 nt, Shigella flexneri 2a str. 301
uacaacgcuuuauc

SEQ ID NO: 2010567 - RNA, 20 nt, Shigella flexneri 2a str. 301
uacaacgccguuuaauauua

SEQ ID NO: 2010568 - RNA, 19 nt, Shigella flexneri 2a str. 301
uacaacgccguuuaauauu

SEQ ID NO: 2010569 - RNA, 23 nt, Shigella flexneri 2a str. 301
uacaaccgcaaagguugcugcgc

SEQ ID NO: 2010570 - RNA, 13 nt, Shigella flexneri 2a str. 301
uacagaagcaccg

SEQ ID NO: 2010571 - RNA, 14 nt, Shigella flexneri 2a str. 301
uacagaaaugaaaa

SEQ ID NO: 2010572 - RNA, 20 nt, Shigella flexneri 2a str. 301
uacacuucacacacuuuuau

SEQ ID NO: 2010573 - RNA, 21 nt, Shigella flexneri 2a str. 301
uacacuucacacacuuuuauu

SEQ ID NO: 2010574 - RNA, 15 nt, Shigella flexneri 2a str. 301
uacagacucaaacca

SEQ ID NO: 2010575 - RNA, 16 nt, Shigella flexneri 2a str. 301
uacagacagauaaaau

SEQ ID NO: 2010576 - RNA, 16 nt, Shigella flexneri 2a str. 301
uacagagggcaggcaa

SEQ ID NO: 2010577 - RNA, 15 nt, Shigella flexneri 2a str. 301
uacacucaaauaucu

SEQ ID NO: 2010578 - RNA, 20 nt, Shigella flexneri 2a str. 301
uacacgauaaucucugcuuu

SEQ ID NO: 2010579 - RNA, 12 nt, Shigella flexneri 2a str. 301
uacacccagccc

SEQ ID NO: 2010580 - RNA, 14 nt, Shigella flexneri 2a str. 301
uacacccagccccg

SEQ ID NO: 2010581 - RNA, 23 nt, Shigella flexneri 2a str. 301
uacacccagccccgguuuuucug

SEQ ID NO: 2010582 - RNA, 22 nt, Shigella flexneri 2a str. 301
uauuugacccgcaguaaaucag

SEQ ID NO: 2010583 - RNA, 23 nt, Shigella flexneri 2a str. 301
uauuugccuaauaaaucuaaaac

SEQ ID NO: 2010584 - RNA, 22 nt, Shigella flexneri 2a str. 301
uauuugccgugcguguucggua

SEQ ID NO: 2010585 - RNA, 14 nt, Shigella flexneri 2a str. 301
uauuucuugugcau

SEQ ID NO: 2010586 - RNA, 19 nt, Shigella flexneri 2a str. 301
uauuucuucauacuaccug

SEQ ID NO: 2010587 - RNA, 16 nt, Shigella flexneri 2a str. 301
uauuucucacuuuucc

SEQ ID NO: 2010588 - RNA, 20 nt, Shigella flexneri 2a str. 301
uauuuccagcucaaccagau

SEQ ID NO: 2010589 - RNA, 11 nt, Shigella flexneri 2a str. 301
uauuuccaggg

SEQ ID NO: 2010590 - RNA, 17 nt, Shigella flexneri 2a str. 301
uauuuccagggccucuc

SEQ ID NO: 2010591 - RNA, 24 nt, Shigella flexneri 2a str. 301
uauuucccggccaacgauaauuca

SEQ ID NO: 2010592 - RNA, 19 nt, Shigella flexneri 2a str. 301
uauuuccuucgcuuuaauu

SEQ ID NO: 2010593 - RNA, 16 nt, Shigella flexneri 2a str. 301
uauuucgaauuuucca

SEQ ID NO: 2010594 - RNA, 14 nt, Shigella flexneri 2a str. 301
uauuucgucagcau

SEQ ID NO: 2010595 - RNA, 18 nt, Shigella flexneri 2a str. 301
uauuugucauacugccca

SEQ ID NO: 2010596 - RNA, 14 nt, Shigella flexneri 2a str. 301
uauuuguucagcaa

SEQ ID NO: 2010597 - RNA, 15 nt, Shigella flexneri 2a str. 301
uauuuugcuuuaagu

SEQ ID NO: 2010598 - RNA, 20 nt, Shigella flexneri 2a str. 301
uauuuugcccugcuaugcaa

SEQ ID NO: 2010599 - RNA, 17 nt, Shigella flexneri 2a str. 301
uauuuugcuuccggcaa

SEQ ID NO: 2010600 - RNA, 15 nt, Shigella flexneri 2a str. 301
uauuuugaauuugca

SEQ ID NO: 2010601 - RNA, 12 nt, Shigella flexneri 2a str. 301
uauuuuuaaaua

SEQ ID NO: 2010602 - RNA, 17 nt, Shigella flexneri 2a str. 301
uauuuuuaaacaucaaa

SEQ ID NO: 2010603 - RNA, 20 nt, Shigella flexneri 2a str. 301
uauuuuuaaccguauuuugg

SEQ ID NO: 2010604 - RNA, 20 nt, Shigella flexneri 2a str. 301
uauuuuuaaauauaaaacaa

SEQ ID NO: 2010605 - RNA, 12 nt, Shigella flexneri 2a str. 301
uauuuucugaaa

SEQ ID NO: 2010606 - RNA, 21 nt, Shigella flexneri 2a str. 301
uauuuuccgagguuaauauuu

SEQ ID NO: 2010607 - RNA, 17 nt, Shigella flexneri 2a str. 301
ucaaacgguugauaaau

SEQ ID NO: 2010608 - RNA, 16 nt, Shigella flexneri 2a str. 301
ucaaacgccagaucac

SEQ ID NO: 2010609 - RNA, 16 nt, Shigella flexneri 2a str. 301
ucaaacgguugauaaa

SEQ ID NO: 2010610 - RNA, 19 nt, Shigella flexneri 2a str. 301
ucaaacggcauaugccaug

SEQ ID NO: 2010611 - RNA, 18 nt, Shigella flexneri 2a str. 301
ucaaacggcguuuucuca

SEQ ID NO: 2010612 - RNA, 20 nt, Shigella flexneri 2a str. 301
ucaaaccguaguccauaccc

SEQ ID NO: 2010613 - RNA, 19 nt, Shigella flexneri 2a str. 301
ucaaaauaucgacauucaa

SEQ ID NO: 2010614 - RNA, 19 nt, Shigella flexneri 2a str. 301
ucaaagucgagaugaaacu

SEQ ID NO: 2010615 - RNA, 20 nt, Shigella flexneri 2a str. 301
ucaaaggcauuaaacgcaua

SEQ ID NO: 2010616 - RNA, 16 nt, Shigella flexneri 2a str. 301
ucaaaguuuuuaugag

SEQ ID NO: 2010617 - RNA, 22 nt, Shigella flexneri 2a str. 301
ucaaaguuugcaccucugcugc

SEQ ID NO: 2010618 - RNA, 19 nt, Shigella flexneri 2a str. 301
ucaaauacaccuauacuuu

SEQ ID NO: 2010619 - RNA, 18 nt, Shigella flexneri 2a str. 301
uauuuuuuuccuaaaccc

SEQ ID NO: 2010620 - RNA, 17 nt, Shigella flexneri 2a str. 301
uauuuuuuuaauuguga

SEQ ID NO: 2010621 - RNA, 20 nt, Shigella flexneri 2a str. 301
ucaaaaaacuggaaaaauaa

SEQ ID NO: 2010622 - RNA, 12 nt, Shigella flexneri 2a str. 301
ucaaaaaacugg

SEQ ID NO: 2010623 - RNA, 17 nt, Shigella flexneri 2a str. 301
ucaaaaaacuggaaaaa

SEQ ID NO: 2010624 - RNA, 19 nt, Shigella flexneri 2a str. 301
ucaaaaaaggcugacaaau

SEQ ID NO: 2010625 - RNA, 24 nt, Shigella flexneri 2a str. 301
ucaaaaaaauucugaacaauugga

SEQ ID NO: 2010626 - RNA, 13 nt, Shigella flexneri 2a str. 301
ucaaaaagcugua

SEQ ID NO: 2010627 - RNA, 12 nt, Shigella flexneri 2a str. 301
ucaaaacaacac

SEQ ID NO: 2010628 - RNA, 18 nt, Shigella flexneri 2a str. 301
ucaaaacgcucugagcug

SEQ ID NO: 2010629 - RNA, 18 nt, Shigella flexneri 2a str. 301
ucaaaacagcccuuuccu

SEQ ID NO: 2010630 - RNA, 13 nt, Shigella flexneri 2a str. 301
uauuuauuuccuu

SEQ ID NO: 2010631 - RNA, 19 nt, Shigella flexneri 2a str. 301
uauuuauuuuccaaaauaa

SEQ ID NO: 2010632 - RNA, 16 nt, Shigella flexneri 2a str. 301
uauuuauccauaauuu

SEQ ID NO: 2010633 - RNA, 17 nt, Shigella flexneri 2a str. 301
uauuucaauaugauaaa

SEQ ID NO: 2010634 - RNA, 15 nt, Shigella flexneri 2a str. 301
uauuucaaugcauua

SEQ ID NO: 2010635 - RNA, 22 nt, Shigella flexneri 2a str. 301
uauuucacccgcgaccaccagc

SEQ ID NO: 2010636 - RNA, 14 nt, Shigella flexneri 2a str. 301
uauuucagaccugu

SEQ ID NO: 2010637 - RNA, 13 nt, Shigella flexneri 2a str. 301
uauuucagcccca

SEQ ID NO: 2010638 - RNA, 17 nt, Shigella flexneri 2a str. 301
uauuuacgugaagaugc

SEQ ID NO: 2010639 - RNA, 18 nt, Shigella flexneri 2a str. 301
uauuuacgugaagaugcc

SEQ ID NO: 2010640 - RNA, 22 nt, Shigella flexneri 2a str. 301
uauuuaaaugauuacucguauu

SEQ ID NO: 2010641 - RNA, 15 nt, Shigella flexneri 2a str. 301
uauuuaccaauauaa

SEQ ID NO: 2010642 - RNA, 16 nt, Shigella flexneri 2a str. 301
uauuuaccaauauaau

SEQ ID NO: 2010643 - RNA, 16 nt, Shigella flexneri 2a str. 301
uauugcgcaaauguuu

SEQ ID NO: 2010644 - RNA, 19 nt, Shigella flexneri 2a str. 301
uauugcggauaaagcugcc

SEQ ID NO: 2010645 - RNA, 22 nt, Shigella flexneri 2a str. 301
uauugcuaugguccguucucac

SEQ ID NO: 2010646 - RNA, 16 nt, Shigella flexneri 2a str. 301
uauuggugaauugcac

SEQ ID NO: 2010647 - RNA, 12 nt, Shigella flexneri 2a str. 301
uauugcuguacu

SEQ ID NO: 2010648 - RNA, 13 nt, Shigella flexneri 2a str. 301
uauuguagacaac

SEQ ID NO: 2010649 - RNA, 22 nt, Shigella flexneri 2a str. 301
uauugugggucgauuaaauuca

SEQ ID NO: 2010650 - RNA, 13 nt, Shigella flexneri 2a str. 301
uauugagaucacc

SEQ ID NO: 2010651 - RNA, 13 nt, Shigella flexneri 2a str. 301
uauugagaucgcu

SEQ ID NO: 2010652 - RNA, 16 nt, Shigella flexneri 2a str. 301
uauugccaccugccgg

SEQ ID NO: 2010653 - RNA, 14 nt, Shigella flexneri 2a str. 301
uauugaugcucacu

SEQ ID NO: 2010654 - RNA, 20 nt, Shigella flexneri 2a str. 301
aaauccuucagcaacuuguu

SEQ ID NO: 2010655 - RNA, 19 nt, Shigella flexneri 2a str. 301
aaauccuucacuuuugcca

SEQ ID NO: 2010656 - RNA, 21 nt, Shigella flexneri 2a str. 301
uauuacguuccuuuacgguga

SEQ ID NO: 2010657 - RNA, 15 nt, Shigella flexneri 2a str. 301
uauuaccggcagagu

SEQ ID NO: 2010658 - RNA, 22 nt, Shigella flexneri 2a str. 301
uauuacugagauggcuucaucc

SEQ ID NO: 2010659 - RNA, 20 nt, Shigella flexneri 2a str. 301
uauuacugcguauuuccugc

SEQ ID NO: 2010660 - RNA, 23 nt, Shigella flexneri 2a str. 301
uauuacguggguaggaucagaau

SEQ ID NO: 2010661 - RNA, 21 nt, Shigella flexneri 2a str. 301
uauccgaccuacaaaaccugc

SEQ ID NO: 2010662 - RNA, 23 nt, Shigella flexneri 2a str. 301
uaucccuuacgcguucauacuuu

SEQ ID NO: 2010663 - RNA, 13 nt, Shigella flexneri 2a str. 301
uaucccuguuaaa

SEQ ID NO: 2010664 - RNA, 14 nt, Shigella flexneri 2a str. 301
uauuauauauaauu

SEQ ID NO: 2010665 - RNA, 20 nt, Shigella flexneri 2a str. 301
uauuagccgccagcucuuua

SEQ ID NO: 2010666 - RNA, 12 nt, Shigella flexneri 2a str. 301
uauuauugaaau

SEQ ID NO: 2010667 - RNA, 13 nt, Shigella flexneri 2a str. 301
uauuauuauuuuu

SEQ ID NO: 2010668 - RNA, 16 nt, Shigella flexneri 2a str. 301
uauuauucauaaugcc

SEQ ID NO: 2010669 - RNA, 15 nt, Shigella flexneri 2a str. 301
uauuaucggcaccau

SEQ ID NO: 2010670 - RNA, 16 nt, Shigella flexneri 2a str. 301
uauuaucggcaccauu

SEQ ID NO: 2010671 - RNA, 16 nt, Shigella flexneri 2a str. 301
uauucgccaucgcuuu

SEQ ID NO: 2010672 - RNA, 18 nt, Shigella flexneri 2a str. 301
uauucgcucgccacuucu

SEQ ID NO: 2010673 - RNA, 16 nt, Shigella flexneri 2a str. 301
uauucgacaccaucuu

SEQ ID NO: 2010674 - RNA, 15 nt, Shigella flexneri 2a str. 301
uauuccuuuaucauu

SEQ ID NO: 2010675 - RNA, 14 nt, Shigella flexneri 2a str. 301
uauuccuuaugguu

SEQ ID NO: 2010676 - RNA, 16 nt, Shigella flexneri 2a str. 301
uauucauggugaauau

SEQ ID NO: 2010677 - RNA, 18 nt, Shigella flexneri 2a str. 301
uauucauuguucucccau

SEQ ID NO: 2010678 - RNA, 14 nt, Shigella flexneri 2a str. 301
uauucauuuauguu

SEQ ID NO: 2010679 - RNA, 12 nt, Shigella flexneri 2a str. 301
uauucaugcccu

SEQ ID NO: 2010680 - RNA, 21 nt, Shigella flexneri 2a str. 301
uauucauaauauauaaagauu

SEQ ID NO: 2010681 - RNA, 13 nt, Shigella flexneri 2a str. 301
uauucagcuuauu

SEQ ID NO: 2010682 - RNA, 23 nt, Shigella flexneri 2a str. 301
uauucaguggcauuuagaucuau

SEQ ID NO: 2010683 - RNA, 21 nt, Shigella flexneri 2a str. 301
uauucagcaauucucucuuca

SEQ ID NO: 2010684 - RNA, 21 nt, Shigella flexneri 2a str. 301
uauucaggcguugaaaaauca

SEQ ID NO: 2010685 - RNA, 20 nt, Shigella flexneri 2a str. 301
uauucacgaaucuauucauu

SEQ ID NO: 2010686 - RNA, 22 nt, Shigella flexneri 2a str. 301
uauucacgaaucuauucauuua

SEQ ID NO: 2010687 - RNA, 18 nt, Shigella flexneri 2a str. 301
ucaagaaaccgaaguugu

SEQ ID NO: 2010688 - RNA, 12 nt, Shigella flexneri 2a str. 301
ucaagaaaugca

SEQ ID NO: 2010689 - RNA, 16 nt, Shigella flexneri 2a str. 301
ucaagaaacagcaguu

SEQ ID NO: 2010690 - RNA, 20 nt, Shigella flexneri 2a str. 301
ucaagaaagguugaggcuga

SEQ ID NO: 2010691 - RNA, 12 nt, Shigella flexneri 2a str. 301
ucaacugcgguu

SEQ ID NO: 2010692 - RNA, 17 nt, Shigella flexneri 2a str. 301
ucaacugcguucugucg

SEQ ID NO: 2010693 - RNA, 12 nt, Shigella flexneri 2a str. 301
ucaacgucaaac

SEQ ID NO: 2010694 - RNA, 18 nt, Shigella flexneri 2a str. 301
ucaacguaguaucguaau

SEQ ID NO: 2010695 - RNA, 17 nt, Shigella flexneri 2a str. 301
ucaacgugucuuuuacu

SEQ ID NO: 2010696 - RNA, 19 nt, Shigella flexneri 2a str. 301
ucaacgucauuaucugcag

SEQ ID NO: 2010697 - RNA, 16 nt, Shigella flexneri 2a str. 301
ucaacgucugcgccuu

SEQ ID NO: 2010698 - RNA, 19 nt, Shigella flexneri 2a str. 301
ucaacguacucugccacua

SEQ ID NO: 2010699 - RNA, 13 nt, Shigella flexneri 2a str. 301
ucaagcacaauca

SEQ ID NO: 2010700 - RNA, 14 nt, Shigella flexneri 2a str. 301
ucaagcaccauccu

SEQ ID NO: 2010701 - RNA, 22 nt, Shigella flexneri 2a str. 301
ucaagauuagcccccguuuugu

SEQ ID NO: 2010702 - RNA, 19 nt, Shigella flexneri 2a str. 301
ucaagauuagcgacgaaca

SEQ ID NO: 2010703 - RNA, 17 nt, Shigella flexneri 2a str. 301
ucaagcaacauaaccug

SEQ ID NO: 2010704 - RNA, 18 nt, Shigella flexneri 2a str. 301
ucaagauuaaaagugauu

SEQ ID NO: 2010705 - RNA, 18 nt, Shigella flexneri 2a str. 301
ucaagauauuucaccagc

SEQ ID NO: 2010706 - RNA, 19 nt, Shigella flexneri 2a str. 301
ucaagauauuucaccagcg

SEQ ID NO: 2010707 - RNA, 20 nt, Shigella flexneri 2a str. 301
ucaagauagggaaugagcug

SEQ ID NO: 2010708 - RNA, 22 nt, Shigella flexneri 2a str. 301
ucaagcgccgaguaaaaaaaca

SEQ ID NO: 2010709 - RNA, 19 nt, Shigella flexneri 2a str. 301
ucaagcgguaaccauccau

SEQ ID NO: 2010710 - RNA, 16 nt, Shigella flexneri 2a str. 301
ucaagccacuuuccuu

SEQ ID NO: 2010711 - RNA, 20 nt, Shigella flexneri 2a str. 301
ucaagcccugguaacugcca

SEQ ID NO: 2010712 - RNA, 20 nt, Shigella flexneri 2a str. 301
ucaagcaguugguuaaucuu

SEQ ID NO: 2010713 - RNA, 23 nt, Shigella flexneri 2a str. 301
ucaaggcauauaccacacccgca

SEQ ID NO: 2010714 - RNA, 15 nt, Shigella flexneri 2a str. 301
ucaagcgucgcauca

SEQ ID NO: 2010715 - RNA, 14 nt, Shigella flexneri 2a str. 301
ucaagcucaaaaua

SEQ ID NO: 2010716 - RNA, 19 nt, Shigella flexneri 2a str. 301
ucaagcucaaaauaauaca

SEQ ID NO: 2010717 - RNA, 16 nt, Shigella flexneri 2a str. 301
ucaagcucgccaccau

SEQ ID NO: 2010718 - RNA, 17 nt, Shigella flexneri 2a str. 301
ucaaggugcgcgaugcu

SEQ ID NO: 2010719 - RNA, 14 nt, Shigella flexneri 2a str. 301
ucaaggucaacauu

SEQ ID NO: 2010720 - RNA, 21 nt, Shigella flexneri 2a str. 301
ucaaucccuucgacuuucagu

SEQ ID NO: 2010721 - RNA, 12 nt, Shigella flexneri 2a str. 301
ucaauauuuuca

SEQ ID NO: 2010722 - RNA, 16 nt, Shigella flexneri 2a str. 301
ucaauauuuucaaucu

SEQ ID NO: 2010723 - RNA, 18 nt, Shigella flexneri 2a str. 301
ucaauauuugcaccuaaa

SEQ ID NO: 2010724 - RNA, 21 nt, Shigella flexneri 2a str. 301
ucaagucauugauucgaucaa

SEQ ID NO: 2010725 - RNA, 14 nt, Shigella flexneri 2a str. 301
ucaagucccccccc

SEQ ID NO: 2010726 - RNA, 20 nt, Shigella flexneri 2a str. 301
ucaauauuagcauuaaguaa

SEQ ID NO: 2010727 - RNA, 20 nt, Shigella flexneri 2a str. 301
ucaauauuaagaaucucuga

SEQ ID NO: 2010728 - RNA, 13 nt, Shigella flexneri 2a str. 301
ucaaguugacucu

SEQ ID NO: 2010729 - RNA, 21 nt, Shigella flexneri 2a str. 301
ucaaugcuuuuugcauuuccg

SEQ ID NO: 2010730 - RNA, 18 nt, Shigella flexneri 2a str. 301
ucaaugccggacuguaaa

SEQ ID NO: 2010731 - RNA, 18 nt, Shigella flexneri 2a str. 301
ucaaugccgucaccagca

SEQ ID NO: 2010732 - RNA, 12 nt, Shigella flexneri 2a str. 301
ucaaugcgaucu

SEQ ID NO: 2010733 - RNA, 14 nt, Shigella flexneri 2a str. 301
ucaaucgagauacg

SEQ ID NO: 2010734 - RNA, 14 nt, Shigella flexneri 2a str. 301
ucaaucgccaccac

SEQ ID NO: 2010735 - RNA, 17 nt, Shigella flexneri 2a str. 301
ucaaucuuuacacacaa

SEQ ID NO: 2010736 - RNA, 13 nt, Shigella flexneri 2a str. 301
ucaaucuucucuu

SEQ ID NO: 2010737 - RNA, 21 nt, Shigella flexneri 2a str. 301
ucaaucuuuuucaugcuauuc

SEQ ID NO: 2010738 - RNA, 20 nt, Shigella flexneri 2a str. 301
ucaauuuccgucgcaugggg

SEQ ID NO: 2010739 - RNA, 19 nt, Shigella flexneri 2a str. 301
ucaauuaccacaaguaaaa

SEQ ID NO: 2010740 - RNA, 18 nt, Shigella flexneri 2a str. 301
ucaauuuccaguuucaca

SEQ ID NO: 2010741 - RNA, 22 nt, Shigella flexneri 2a str. 301
ucaauuaaaaaauuagcaauac

SEQ ID NO: 2010742 - RNA, 23 nt, Shigella flexneri 2a str. 301
ucacaaauucuggcggcaauaac

SEQ ID NO: 2010743 - RNA, 22 nt, Shigella flexneri 2a str. 301
ucacaaggccauugacgcaucg

SEQ ID NO: 2010744 - RNA, 12 nt, Shigella flexneri 2a str. 301
ucacaagaccua

SEQ ID NO: 2010745 - RNA, 15 nt, Shigella flexneri 2a str. 301
ucacacagugaaucu

SEQ ID NO: 2010746 - RNA, 15 nt, Shigella flexneri 2a str. 301
ucacacauaucacaa

SEQ ID NO: 2010747 - RNA, 20 nt, Shigella flexneri 2a str. 301
ucacacauaucacaauugau

SEQ ID NO: 2010748 - RNA, 22 nt, Shigella flexneri 2a str. 301
ucacaauuacugagagaaaaaa

SEQ ID NO: 2010749 - RNA, 21 nt, Shigella flexneri 2a str. 301
ucacaaugccaccaauaauga

SEQ ID NO: 2010750 - RNA, 23 nt, Shigella flexneri 2a str. 301
ucacaauggcacaaauggcaaug

SEQ ID NO: 2010751 - RNA, 15 nt, Shigella flexneri 2a str. 301
ucacaauugaugcau

SEQ ID NO: 2010752 - RNA, 20 nt, Shigella flexneri 2a str. 301
ucacaccuuauuuacauccc

SEQ ID NO: 2010753 - RNA, 18 nt, Shigella flexneri 2a str. 301
ucacaccugcucagcccg

SEQ ID NO: 2010754 - RNA, 18 nt, Shigella flexneri 2a str. 301
ucacaccgcgaucuucca

SEQ ID NO: 2010755 - RNA, 19 nt, Shigella flexneri 2a str. 301
ucacaccgcgaucuuccac

SEQ ID NO: 2010756 - RNA, 20 nt, Shigella flexneri 2a str. 301
ucacaccauugauaauccau

SEQ ID NO: 2010757 - RNA, 18 nt, Shigella flexneri 2a str. 301
ucacacccgguaucaaac

SEQ ID NO: 2010758 - RNA, 13 nt, Shigella flexneri 2a str. 301
ucacaccagucca

SEQ ID NO: 2010759 - RNA, 16 nt, Shigella flexneri 2a str. 301
ucacauuuaaacaauu

SEQ ID NO: 2010760 - RNA, 12 nt, Shigella flexneri 2a str. 301
ucaccaaaggca

SEQ ID NO: 2010761 - RNA, 11 nt, Shigella flexneri 2a str. 301
ucaccaaagcu

SEQ ID NO: 2010762 - RNA, 19 nt, Shigella flexneri 2a str. 301
ucaccaaucggcagaacgg

SEQ ID NO: 2010763 - RNA, 14 nt, Shigella flexneri 2a str. 301
ucaccaaugaaagc

SEQ ID NO: 2010764 - RNA, 17 nt, Shigella flexneri 2a str. 301
ucacagaaggccaggau

SEQ ID NO: 2010765 - RNA, 16 nt, Shigella flexneri 2a str. 301
ucacagaagugaagca

SEQ ID NO: 2010766 - RNA, 16 nt, Shigella flexneri 2a str. 301
ucacagaaggccagga

SEQ ID NO: 2010767 - RNA, 18 nt, Shigella flexneri 2a str. 301
ucacacugaugacaggcu

SEQ ID NO: 2010768 - RNA, 19 nt, Shigella flexneri 2a str. 301
ucaccagcgcauugacgau

SEQ ID NO: 2010769 - RNA, 15 nt, Shigella flexneri 2a str. 301
ucaccagcgcacgca

SEQ ID NO: 2010770 - RNA, 23 nt, Shigella flexneri 2a str. 301
ucaccauuuccgguacuggcuau

SEQ ID NO: 2010771 - RNA, 22 nt, Shigella flexneri 2a str. 301
ucaccauuggugauccgaggcc

SEQ ID NO: 2010772 - RNA, 15 nt, Shigella flexneri 2a str. 301
ucaccauuagacagu

SEQ ID NO: 2010773 - RNA, 17 nt, Shigella flexneri 2a str. 301
ucaccauuagacaguuu

SEQ ID NO: 2010774 - RNA, 18 nt, Shigella flexneri 2a str. 301
ucacccaccgauuuucag

SEQ ID NO: 2010775 - RNA, 13 nt, Shigella flexneri 2a str. 301
ucacccacaucag

SEQ ID NO: 2010776 - RNA, 12 nt, Shigella flexneri 2a str. 301
ucacccaacaau

SEQ ID NO: 2010777 - RNA, 15 nt, Shigella flexneri 2a str. 301
ucaccacauccagcu

SEQ ID NO: 2010778 - RNA, 17 nt, Shigella flexneri 2a str. 301
ucaccacagacaaacag

SEQ ID NO: 2010779 - RNA, 16 nt, Shigella flexneri 2a str. 301
ucaccacagacaaaca

SEQ ID NO: 2010780 - RNA, 23 nt, Shigella flexneri 2a str. 301
ucaccaaugaaagccccaccagc

SEQ ID NO: 2010781 - RNA, 16 nt, Shigella flexneri 2a str. 301
ucaccaaucagaaagg

SEQ ID NO: 2010782 - RNA, 18 nt, Shigella flexneri 2a str. 301
ucaccagaaguaucguua

SEQ ID NO: 2010783 - RNA, 20 nt, Shigella flexneri 2a str. 301
ucaccagacaucccagugca

SEQ ID NO: 2010784 - RNA, 17 nt, Shigella flexneri 2a str. 301
ucaccagcaucagcgau

SEQ ID NO: 2010785 - RNA, 15 nt, Shigella flexneri 2a str. 301
ucaccagcacuucac

SEQ ID NO: 2010786 - RNA, 22 nt, Shigella flexneri 2a str. 301
ucacccccguuaaccacuucag

SEQ ID NO: 2010787 - RNA, 23 nt, Shigella flexneri 2a str. 301
ucaccgaagacgugcgccacaac

SEQ ID NO: 2010788 - RNA, 23 nt, Shigella flexneri 2a str. 301
ucaccgaagcggccgucagaucg

SEQ ID NO: 2010789 - RNA, 20 nt, Shigella flexneri 2a str. 301
ucaccgagcagcacaaugcc

SEQ ID NO: 2010790 - RNA, 17 nt, Shigella flexneri 2a str. 301
ucaccgaugaucgccau

SEQ ID NO: 2010791 - RNA, 15 nt, Shigella flexneri 2a str. 301
ucaccgcaucgucac

SEQ ID NO: 2010792 - RNA, 22 nt, Shigella flexneri 2a str. 301
ucaccgcaucgucacugauagu

SEQ ID NO: 2010793 - RNA, 23 nt, Shigella flexneri 2a str. 301
ucaccgcagcaucgucaucagcu

SEQ ID NO: 2010794 - RNA, 18 nt, Shigella flexneri 2a str. 301
ucaccguucagcuugcgu

SEQ ID NO: 2010795 - RNA, 17 nt, Shigella flexneri 2a str. 301
ucaccguucacugccac

SEQ ID NO: 2010796 - RNA, 19 nt, Shigella flexneri 2a str. 301
ucaccguugccaaccugaa

SEQ ID NO: 2010797 - RNA, 16 nt, Shigella flexneri 2a str. 301
ucaccggugagcugca

SEQ ID NO: 2010798 - RNA, 18 nt, Shigella flexneri 2a str. 301
ucaccggcguucccgucc

SEQ ID NO: 2010799 - RNA, 13 nt, Shigella flexneri 2a str. 301
ucaccgccgccuu

SEQ ID NO: 2010800 - RNA, 14 nt, Shigella flexneri 2a str. 301
ucaccgcgaccaga

SEQ ID NO: 2010801 - RNA, 21 nt, Shigella flexneri 2a str. 301
ucaccgcgucuucgcugcuuu

SEQ ID NO: 2010802 - RNA, 22 nt, Shigella flexneri 2a str. 301
ucaccgcuaaagcgguuacaca

SEQ ID NO: 2010803 - RNA, 21 nt, Shigella flexneri 2a str. 301
ucaccgcgguguauaccagcu

SEQ ID NO: 2010804 - RNA, 15 nt, Shigella flexneri 2a str. 301
ucaccggcaaagcca

SEQ ID NO: 2010805 - RNA, 18 nt, Shigella flexneri 2a str. 301
ucacgaccuguaccuuca

SEQ ID NO: 2010806 - RNA, 14 nt, Shigella flexneri 2a str. 301
ucacgaucacagca

SEQ ID NO: 2010807 - RNA, 20 nt, Shigella flexneri 2a str. 301
ucacgacaaaugcgccgcca

SEQ ID NO: 2010808 - RNA, 16 nt, Shigella flexneri 2a str. 301
ucacgaaucuauucau

SEQ ID NO: 2010809 - RNA, 15 nt, Shigella flexneri 2a str. 301
ucacgaacacagugg

SEQ ID NO: 2010810 - RNA, 13 nt, Shigella flexneri 2a str. 301
ucaccuuuaaccu

SEQ ID NO: 2010811 - RNA, 22 nt, Shigella flexneri 2a str. 301
ucaccuugcucgcccuggaugc

SEQ ID NO: 2010812 - RNA, 14 nt, Shigella flexneri 2a str. 301
ucaccucuuuggcg

SEQ ID NO: 2010813 - RNA, 19 nt, Shigella flexneri 2a str. 301
ucaccucuucauuaaacca

SEQ ID NO: 2010814 - RNA, 22 nt, Shigella flexneri 2a str. 301
ucaccucuucagcguccaucca

SEQ ID NO: 2010815 - RNA, 14 nt, Shigella flexneri 2a str. 301
ucaccucugucgau

SEQ ID NO: 2010816 - RNA, 22 nt, Shigella flexneri 2a str. 301
ucaccucugucgaugcgcucug

SEQ ID NO: 2010817 - RNA, 21 nt, Shigella flexneri 2a str. 301
ucaccugaugcccguacgcug

SEQ ID NO: 2010818 - RNA, 18 nt, Shigella flexneri 2a str. 301
ucaccugcauacaaauaa

SEQ ID NO: 2010819 - RNA, 22 nt, Shigella flexneri 2a str. 301
ucaccugugacgacuuuuucca

SEQ ID NO: 2010820 - RNA, 18 nt, Shigella flexneri 2a str. 301
ucaccuucucgcugauuc

SEQ ID NO: 2010821 - RNA, 13 nt, Shigella flexneri 2a str. 301
ucaccuuccagua

SEQ ID NO: 2010822 - RNA, 13 nt, Shigella flexneri 2a str. 301
ucacgcgccagcu

SEQ ID NO: 2010823 - RNA, 21 nt, Shigella flexneri 2a str. 301
ucacgcaaaacgcugcaacgu

SEQ ID NO: 2010824 - RNA, 13 nt, Shigella flexneri 2a str. 301
ucacgcaaccaca

SEQ ID NO: 2010825 - RNA, 14 nt, Shigella flexneri 2a str. 301
ucacgcaauaccug

SEQ ID NO: 2010826 - RNA, 14 nt, Shigella flexneri 2a str. 301
ucacgcucauccug

SEQ ID NO: 2010827 - RNA, 22 nt, Shigella flexneri 2a str. 301
ucacgcuauacaaccaccccac

SEQ ID NO: 2010828 - RNA, 21 nt, Shigella flexneri 2a str. 301
ucacuacaaccgggaucaccg

SEQ ID NO: 2010829 - RNA, 21 nt, Shigella flexneri 2a str. 301
ucacuaaacccgaccacuucc

SEQ ID NO: 2010830 - RNA, 21 nt, Shigella flexneri 2a str. 301
ucacguacaaaacgcaccacu

SEQ ID NO: 2010831 - RNA, 22 nt, Shigella flexneri 2a str. 301
ucacguacaaaacgcaccacuu

SEQ ID NO: 2010832 - RNA, 12 nt, Shigella flexneri 2a str. 301
ucacucaucaac

SEQ ID NO: 2010833 - RNA, 18 nt, Shigella flexneri 2a str. 301
ucacucaucaugcacucc

SEQ ID NO: 2010834 - RNA, 21 nt, Shigella flexneri 2a str. 301
ucacucauuaagacuguaaau

SEQ ID NO: 2010835 - RNA, 16 nt, Shigella flexneri 2a str. 301
ucacuccauccagcaa

SEQ ID NO: 2010836 - RNA, 13 nt, Shigella flexneri 2a str. 301
ucacucauacuca

SEQ ID NO: 2010837 - RNA, 16 nt, Shigella flexneri 2a str. 301
ucacuccacaccauau

SEQ ID NO: 2010838 - RNA, 19 nt, Shigella flexneri 2a str. 301
ucacuccccgcaacaguga

SEQ ID NO: 2010839 - RNA, 22 nt, Shigella flexneri 2a str. 301
ucacucacgccguuaacuucac

SEQ ID NO: 2010840 - RNA, 14 nt, Shigella flexneri 2a str. 301
ucacucaaaauauc

SEQ ID NO: 2010841 - RNA, 14 nt, Shigella flexneri 2a str. 301
ucacuauuaaagaa

SEQ ID NO: 2010842 - RNA, 23 nt, Shigella flexneri 2a str. 301
ucauaaugauggggucacagguu

SEQ ID NO: 2010843 - RNA, 18 nt, Shigella flexneri 2a str. 301
ucauaccccacauaguuu

SEQ ID NO: 2010844 - RNA, 14 nt, Shigella flexneri 2a str. 301
ucauaccugagugg

SEQ ID NO: 2010845 - RNA, 16 nt, Shigella flexneri 2a str. 301
ucauaccgaucaccga

SEQ ID NO: 2010846 - RNA, 17 nt, Shigella flexneri 2a str. 301
ucauacaagcggaaacg

SEQ ID NO: 2010847 - RNA, 14 nt, Shigella flexneri 2a str. 301
ucauacacuucaca

SEQ ID NO: 2010848 - RNA, 21 nt, Shigella flexneri 2a str. 301
ucauacgcggcagaaugguuu

SEQ ID NO: 2010849 - RNA, 14 nt, Shigella flexneri 2a str. 301
ucauacucaccguu

SEQ ID NO: 2010850 - RNA, 22 nt, Shigella flexneri 2a str. 301
ucauagggugugacgacaccau

SEQ ID NO: 2010851 - RNA, 18 nt, Shigella flexneri 2a str. 301
ucauaggccgcugaugcc

SEQ ID NO: 2010852 - RNA, 14 nt, Shigella flexneri 2a str. 301
ucauauaacgcagg

SEQ ID NO: 2010853 - RNA, 15 nt, Shigella flexneri 2a str. 301
ucauauaccgcauca

SEQ ID NO: 2010854 - RNA, 17 nt, Shigella flexneri 2a str. 301
ucauauagccgccuugu

SEQ ID NO: 2010855 - RNA, 16 nt, Shigella flexneri 2a str. 301
ucauagacuucccucc

SEQ ID NO: 2010856 - RNA, 24 nt, Shigella flexneri 2a str. 301
ucauacugccgaccaucuguucug

SEQ ID NO: 2010857 - RNA, 17 nt, Shigella flexneri 2a str. 301
ucauacugauuguacug

SEQ ID NO: 2010858 - RNA, 17 nt, Shigella flexneri 2a str. 301
ucaucacgcaggcugua

SEQ ID NO: 2010859 - RNA, 19 nt, Shigella flexneri 2a str. 301
ucaucaccggggauaacgu

SEQ ID NO: 2010860 - RNA, 23 nt, Shigella flexneri 2a str. 301
ucaucaccauugcaucgaggaaa

SEQ ID NO: 2010861 - RNA, 22 nt, Shigella flexneri 2a str. 301
ucaucacccaacgccuuucgcu

SEQ ID NO: 2010862 - RNA, 13 nt, Shigella flexneri 2a str. 301
ucaucaauaccug

SEQ ID NO: 2010863 - RNA, 21 nt, Shigella flexneri 2a str. 301
ucaucaauaccugguccuuca

SEQ ID NO: 2010864 - RNA, 12 nt, Shigella flexneri 2a str. 301
ucaucacaccgc

SEQ ID NO: 2010865 - RNA, 18 nt, Shigella flexneri 2a str. 301
ucaucacaucccagcaga

SEQ ID NO: 2010866 - RNA, 16 nt, Shigella flexneri 2a str. 301
ucaucacaucccagca

SEQ ID NO: 2010867 - RNA, 18 nt, Shigella flexneri 2a str. 301
ucaucaaaaucaucauug

SEQ ID NO: 2010868 - RNA, 17 nt, Shigella flexneri 2a str. 301
ucaucaaaaucaucauu

SEQ ID NO: 2010869 - RNA, 20 nt, Shigella flexneri 2a str. 301
ucaucaaauuacgauaauca

SEQ ID NO: 2010870 - RNA, 14 nt, Shigella flexneri 2a str. 301
ucaucaagcuguuc

SEQ ID NO: 2010871 - RNA, 16 nt, Shigella flexneri 2a str. 301
ucaucaagcuguucuu

SEQ ID NO: 2010872 - RNA, 15 nt, Shigella flexneri 2a str. 301
ucaucaacuggcaac

SEQ ID NO: 2010873 - RNA, 22 nt, Shigella flexneri 2a str. 301
ucaucaacugacuauccuggac

SEQ ID NO: 2010874 - RNA, 14 nt, Shigella flexneri 2a str. 301
ucaucaacguuuuu

SEQ ID NO: 2010875 - RNA, 21 nt, Shigella flexneri 2a str. 301
ucaucaaauuacgauaaucag

SEQ ID NO: 2010876 - RNA, 16 nt, Shigella flexneri 2a str. 301
ucauaugauaggcuuc

SEQ ID NO: 2010877 - RNA, 14 nt, Shigella flexneri 2a str. 301
ucauauggagcaaa

SEQ ID NO: 2010878 - RNA, 14 nt, Shigella flexneri 2a str. 301
ucauaucacaaauu

SEQ ID NO: 2010879 - RNA, 16 nt, Shigella flexneri 2a str. 301
ucauaucacaaauucu

SEQ ID NO: 2010880 - RNA, 14 nt, Shigella flexneri 2a str. 301
ucauauuaaauuuu

SEQ ID NO: 2010881 - RNA, 15 nt, Shigella flexneri 2a str. 301
ucauauuaaauuuuu

SEQ ID NO: 2010882 - RNA, 16 nt, Shigella flexneri 2a str. 301
ucauauuaaauuuuuu

SEQ ID NO: 2010883 - RNA, 23 nt, Shigella flexneri 2a str. 301
ucaucgcuuucggaaagaucgcc

SEQ ID NO: 2010884 - RNA, 19 nt, Shigella flexneri 2a str. 301
ucaucgggaagaggaucug

SEQ ID NO: 2010885 - RNA, 23 nt, Shigella flexneri 2a str. 301
ucaucgcccaguugaucaccagu

SEQ ID NO: 2010886 - RNA, 22 nt, Shigella flexneri 2a str. 301
ucaucgcccaguugaucaccag

SEQ ID NO: 2010887 - RNA, 21 nt, Shigella flexneri 2a str. 301
ucaucgccgcuggccauuucu

SEQ ID NO: 2010888 - RNA, 18 nt, Shigella flexneri 2a str. 301
ucaucgccgucacgguaa

SEQ ID NO: 2010889 - RNA, 16 nt, Shigella flexneri 2a str. 301
ucaucgccuuccagcg

SEQ ID NO: 2010890 - RNA, 19 nt, Shigella flexneri 2a str. 301
ucaucgcgcccaaaccacc

SEQ ID NO: 2010891 - RNA, 17 nt, Shigella flexneri 2a str. 301
ucaucgcggcacacagc

SEQ ID NO: 2010892 - RNA, 19 nt, Shigella flexneri 2a str. 301
ucaucgauauuaucuucau

SEQ ID NO: 2010893 - RNA, 17 nt, Shigella flexneri 2a str. 301
ucaucgaugagaugacg

SEQ ID NO: 2010894 - RNA, 14 nt, Shigella flexneri 2a str. 301
ucaucgcaaugauu

SEQ ID NO: 2010895 - RNA, 12 nt, Shigella flexneri 2a str. 301
ucaucgcaaaug

SEQ ID NO: 2010896 - RNA, 15 nt, Shigella flexneri 2a str. 301
ucaucgccagcgaau

SEQ ID NO: 2010897 - RNA, 15 nt, Shigella flexneri 2a str. 301
ucaucgcccaggcaa

SEQ ID NO: 2010898 - RNA, 19 nt, Shigella flexneri 2a str. 301
ucaucgauuuggcucaaca

SEQ ID NO: 2010899 - RNA, 17 nt, Shigella flexneri 2a str. 301
ucauccauaccacgacc

SEQ ID NO: 2010900 - RNA, 14 nt, Shigella flexneri 2a str. 301
ucauccaugauaau

SEQ ID NO: 2010901 - RNA, 17 nt, Shigella flexneri 2a str. 301
ucaucccaguggauauc

SEQ ID NO: 2010902 - RNA, 19 nt, Shigella flexneri 2a str. 301
ucaucccucucauccacgu

SEQ ID NO: 2010903 - RNA, 14 nt, Shigella flexneri 2a str. 301
ucauccugacccag

SEQ ID NO: 2010904 - RNA, 17 nt, Shigella flexneri 2a str. 301
ucauccugcugcacgcc

SEQ ID NO: 2010905 - RNA, 14 nt, Shigella flexneri 2a str. 301
ucauccugcgguaa

SEQ ID NO: 2010906 - RNA, 22 nt, Shigella flexneri 2a str. 301
ucauccuguacgacaaaagaau

SEQ ID NO: 2010907 - RNA, 12 nt, Shigella flexneri 2a str. 301
ucauccuucagu

SEQ ID NO: 2010908 - RNA, 23 nt, Shigella flexneri 2a str. 301
ucauccuuugggcauuugcacaa

SEQ ID NO: 2010909 - RNA, 13 nt, Shigella flexneri 2a str. 301
ucaucgaauaaau

SEQ ID NO: 2010910 - RNA, 19 nt, Shigella flexneri 2a str. 301
ucauccguuucucuguuca

SEQ ID NO: 2010911 - RNA, 20 nt, Shigella flexneri 2a str. 301
ucauccggcaccuuuucauc

SEQ ID NO: 2010912 - RNA, 21 nt, Shigella flexneri 2a str. 301
ucauccggcuuuuuuacauca

SEQ ID NO: 2010913 - RNA, 17 nt, Shigella flexneri 2a str. 301
ucauccgguguggcaug

SEQ ID NO: 2010914 - RNA, 16 nt, Shigella flexneri 2a str. 301
ucauccguuucucugu

SEQ ID NO: 2010915 - RNA, 16 nt, Shigella flexneri 2a str. 301
ucauccgccgcucaau

SEQ ID NO: 2010916 - RNA, 18 nt, Shigella flexneri 2a str. 301
ucauccgcacaaucccuu

SEQ ID NO: 2010917 - RNA, 16 nt, Shigella flexneri 2a str. 301
ucaucccuacagguaa

SEQ ID NO: 2010918 - RNA, 17 nt, Shigella flexneri 2a str. 301
ucauccaggaacuccag

SEQ ID NO: 2010919 - RNA, 17 nt, Shigella flexneri 2a str. 301
ucauccagcgcacgggc

SEQ ID NO: 2010920 - RNA, 13 nt, Shigella flexneri 2a str. 301
ucauccagcacuu

SEQ ID NO: 2010921 - RNA, 23 nt, Shigella flexneri 2a str. 301
ucauccagcacggugaagaagcg

SEQ ID NO: 2010922 - RNA, 11 nt, Shigella flexneri 2a str. 301
ucauccagcac

SEQ ID NO: 2010923 - RNA, 21 nt, Shigella flexneri 2a str. 301
ucauccagcacggugaagaag

SEQ ID NO: 2010924 - RNA, 18 nt, Shigella flexneri 2a str. 301
ucauccagacugcucagc

SEQ ID NO: 2010925 - RNA, 22 nt, Shigella flexneri 2a str. 301
ucauccagacugcucagcuccu

SEQ ID NO: 2010926 - RNA, 22 nt, Shigella flexneri 2a str. 301
ucauccagaccgcucagcuccu

SEQ ID NO: 2010927 - RNA, 16 nt, Shigella flexneri 2a str. 301
ucauccaccuuaaaac

SEQ ID NO: 2010928 - RNA, 18 nt, Shigella flexneri 2a str. 301
ucaucauuuuuucaccaa

SEQ ID NO: 2010929 - RNA, 12 nt, Shigella flexneri 2a str. 301
ucauccaacaau

SEQ ID NO: 2010930 - RNA, 21 nt, Shigella flexneri 2a str. 301
ucaucaucgcgcccaaaccac

SEQ ID NO: 2010931 - RNA, 16 nt, Shigella flexneri 2a str. 301
ucaucauuaauaucuu

SEQ ID NO: 2010932 - RNA, 18 nt, Shigella flexneri 2a str. 301
ucaucaugggcaagguau

SEQ ID NO: 2010933 - RNA, 16 nt, Shigella flexneri 2a str. 301
ucaucauguggcugga

SEQ ID NO: 2010934 - RNA, 21 nt, Shigella flexneri 2a str. 301
ucaucagcauaaucaccagua

SEQ ID NO: 2010935 - RNA, 19 nt, Shigella flexneri 2a str. 301
ucaucagcggcgaagccua

SEQ ID NO: 2010936 - RNA, 18 nt, Shigella flexneri 2a str. 301
ucaucagaaaugccagua

SEQ ID NO: 2010937 - RNA, 14 nt, Shigella flexneri 2a str. 301
ucaucacgaaaauc

SEQ ID NO: 2010938 - RNA, 14 nt, Shigella flexneri 2a str. 301
ucaucauccagcac

SEQ ID NO: 2010939 - RNA, 18 nt, Shigella flexneri 2a str. 301
ucaucaggggcagcacca

SEQ ID NO: 2010940 - RNA, 18 nt, Shigella flexneri 2a str. 301
ucauaaccgagcauuuuu

SEQ ID NO: 2010941 - RNA, 14 nt, Shigella flexneri 2a str. 301
ucauaaauacagag

SEQ ID NO: 2010942 - RNA, 23 nt, Shigella flexneri 2a str. 301
ucauaaauacagagcacgcaagg

SEQ ID NO: 2010943 - RNA, 24 nt, Shigella flexneri 2a str. 301
ucauaaagauaauguaaagcaggu

SEQ ID NO: 2010944 - RNA, 19 nt, Shigella flexneri 2a str. 301
ucauaaagcagccuauuuc

SEQ ID NO: 2010945 - RNA, 12 nt, Shigella flexneri 2a str. 301
ucagucagcagu

SEQ ID NO: 2010946 - RNA, 20 nt, Shigella flexneri 2a str. 301
ucagucaguggcagcaaauc

SEQ ID NO: 2010947 - RNA, 21 nt, Shigella flexneri 2a str. 301
ucagucacgacaaagacauca

SEQ ID NO: 2010948 - RNA, 15 nt, Shigella flexneri 2a str. 301
ucaguauuuccacaa

SEQ ID NO: 2010949 - RNA, 19 nt, Shigella flexneri 2a str. 301
ucaguaauccuuucucaau

SEQ ID NO: 2010950 - RNA, 13 nt, Shigella flexneri 2a str. 301
ucaguuaacggca

SEQ ID NO: 2010951 - RNA, 21 nt, Shigella flexneri 2a str. 301
ucaguucauggugcaagaaau

SEQ ID NO: 2010952 - RNA, 15 nt, Shigella flexneri 2a str. 301
ucaguuccagcagcg

SEQ ID NO: 2010953 - RNA, 14 nt, Shigella flexneri 2a str. 301
ucaguuccgcugca

SEQ ID NO: 2010954 - RNA, 18 nt, Shigella flexneri 2a str. 301
ucaguuccgcuucgccaa

SEQ ID NO: 2010955 - RNA, 15 nt, Shigella flexneri 2a str. 301
ucaguucaaauucau

SEQ ID NO: 2010956 - RNA, 15 nt, Shigella flexneri 2a str. 301
ucaguucaccauuag

SEQ ID NO: 2010957 - RNA, 22 nt, Shigella flexneri 2a str. 301
ucaguucagcgauauccagcga

SEQ ID NO: 2010958 - RNA, 16 nt, Shigella flexneri 2a str. 301
ucaguuuuacucuuuc

SEQ ID NO: 2010959 - RNA, 22 nt, Shigella flexneri 2a str. 301
ucaguuuuuguugauaaacaaa

SEQ ID NO: 2010960 - RNA, 22 nt, Shigella flexneri 2a str. 301
ucaguuugccguaccacgccac

SEQ ID NO: 2010961 - RNA, 21 nt, Shigella flexneri 2a str. 301
ucaggaucagccauuuugcac

SEQ ID NO: 2010962 - RNA, 16 nt, Shigella flexneri 2a str. 301
ucaggaucugacaucc

SEQ ID NO: 2010963 - RNA, 19 nt, Shigella flexneri 2a str. 301
ucagggaagggucuuuuaa

SEQ ID NO: 2010964 - RNA, 15 nt, Shigella flexneri 2a str. 301
ucaggguaucccgcc

SEQ ID NO: 2010965 - RNA, 16 nt, Shigella flexneri 2a str. 301
ucagggucuuccagca

SEQ ID NO: 2010966 - RNA, 18 nt, Shigella flexneri 2a str. 301
ucagggucuuccagcaaa

SEQ ID NO: 2010967 - RNA, 21 nt, Shigella flexneri 2a str. 301
ucagggucuuccagcaaaucc

SEQ ID NO: 2010968 - RNA, 17 nt, Shigella flexneri 2a str. 301
ucaggggcagcaccauc

SEQ ID NO: 2010969 - RNA, 12 nt, Shigella flexneri 2a str. 301
ucagggcggccg

SEQ ID NO: 2010970 - RNA, 20 nt, Shigella flexneri 2a str. 301
ucagggagucuugcuggaug

SEQ ID NO: 2010971 - RNA, 22 nt, Shigella flexneri 2a str. 301
ucagggcgacaaucaucgccuu

SEQ ID NO: 2010972 - RNA, 15 nt, Shigella flexneri 2a str. 301
ucaguacaccaccua

SEQ ID NO: 2010973 - RNA, 19 nt, Shigella flexneri 2a str. 301
ucaguaaccgcuuuuucaa

SEQ ID NO: 2010974 - RNA, 13 nt, Shigella flexneri 2a str. 301
ucaguaagccagc

SEQ ID NO: 2010975 - RNA, 12 nt, Shigella flexneri 2a str. 301
ucaguaagccuu

SEQ ID NO: 2010976 - RNA, 18 nt, Shigella flexneri 2a str. 301
ucaguaagccuuucagga

SEQ ID NO: 2010977 - RNA, 23 nt, Shigella flexneri 2a str. 301
ucaguaagccuuucaggaaacug

SEQ ID NO: 2010978 - RNA, 23 nt, Shigella flexneri 2a str. 301
ucaguaaaguuaccuucgaagaa

SEQ ID NO: 2010979 - RNA, 20 nt, Shigella flexneri 2a str. 301
ucagguuguuuucuggcuga

SEQ ID NO: 2010980 - RNA, 23 nt, Shigella flexneri 2a str. 301
ucaggugucuaacccgcgacugg

SEQ ID NO: 2010981 - RNA, 22 nt, Shigella flexneri 2a str. 301
ucaggguugccauacagacacc

SEQ ID NO: 2010982 - RNA, 15 nt, Shigella flexneri 2a str. 301
ucagguguuaguguu

SEQ ID NO: 2010983 - RNA, 15 nt, Shigella flexneri 2a str. 301
ucagcugccagggca

SEQ ID NO: 2010984 - RNA, 17 nt, Shigella flexneri 2a str. 301
ucagcugcacacagggc

SEQ ID NO: 2010985 - RNA, 14 nt, Shigella flexneri 2a str. 301
ucagcgccuucaga

SEQ ID NO: 2010986 - RNA, 14 nt, Shigella flexneri 2a str. 301
ucagcguugaaugc

SEQ ID NO: 2010987 - RNA, 14 nt, Shigella flexneri 2a str. 301
ucagcguuccccag

SEQ ID NO: 2010988 - RNA, 14 nt, Shigella flexneri 2a str. 301
ucagcgcguaagcg

SEQ ID NO: 2010989 - RNA, 13 nt, Shigella flexneri 2a str. 301
ucagcuucaccuu

SEQ ID NO: 2010990 - RNA, 22 nt, Shigella flexneri 2a str. 301
ucaggaaccacaaccacuuugu

SEQ ID NO: 2010991 - RNA, 14 nt, Shigella flexneri 2a str. 301
ucacugauaagaug

SEQ ID NO: 2010992 - RNA, 19 nt, Shigella flexneri 2a str. 301
ucacugugcuuuacaucag

SEQ ID NO: 2010993 - RNA, 15 nt, Shigella flexneri 2a str. 301
ucacugacaccagca

SEQ ID NO: 2010994 - RNA, 16 nt, Shigella flexneri 2a str. 301
ucacugacaccagcau

SEQ ID NO: 2010995 - RNA, 21 nt, Shigella flexneri 2a str. 301
ucacucuauagucuuuucgcu

SEQ ID NO: 2010996 - RNA, 20 nt, Shigella flexneri 2a str. 301
ucacucugcugccacauucc

SEQ ID NO: 2010997 - RNA, 17 nt, Shigella flexneri 2a str. 301
ucacuuaacccauuaca

SEQ ID NO: 2010998 - RNA, 21 nt, Shigella flexneri 2a str. 301
ucacuguucugauaguuaaaa

SEQ ID NO: 2010999 - RNA, 21 nt, Shigella flexneri 2a str. 301
ucacuuaaucguucugugccg

SEQ ID NO: 2011000 - RNA, 11 nt, Shigella flexneri 2a str. 301
ucacuuaaucc

SEQ ID NO: 2011001 - RNA, 13 nt, Shigella flexneri 2a str. 301
ucagccacuucuu

SEQ ID NO: 2011002 - RNA, 15 nt, Shigella flexneri 2a str. 301
ucacuucaaauuuaa

SEQ ID NO: 2011003 - RNA, 13 nt, Shigella flexneri 2a str. 301
ucagccacuccac

SEQ ID NO: 2011004 - RNA, 18 nt, Shigella flexneri 2a str. 301
ucagccgucauccaggaa

SEQ ID NO: 2011005 - RNA, 18 nt, Shigella flexneri 2a str. 301
ucagccguacccaggccc

SEQ ID NO: 2011006 - RNA, 15 nt, Shigella flexneri 2a str. 301
ucagcccaacaaagc

SEQ ID NO: 2011007 - RNA, 19 nt, Shigella flexneri 2a str. 301
ucagcgaucguuuuuaacc

SEQ ID NO: 2011008 - RNA, 22 nt, Shigella flexneri 2a str. 301
ucagcgagacgugcguaccauu

SEQ ID NO: 2011009 - RNA, 14 nt, Shigella flexneri 2a str. 301
ucauuuauuaccuu

SEQ ID NO: 2011010 - RNA, 19 nt, Shigella flexneri 2a str. 301
ucauuggccggaauaccac

SEQ ID NO: 2011011 - RNA, 22 nt, Shigella flexneri 2a str. 301
ucauugcugguauuuccagucc

SEQ ID NO: 2011012 - RNA, 24 nt, Shigella flexneri 2a str. 301
ucauuuuauugcguaaucuuuuca

SEQ ID NO: 2011013 - RNA, 22 nt, Shigella flexneri 2a str. 301
ucauuuuacguugcauuuccau

SEQ ID NO: 2011014 - RNA, 22 nt, Shigella flexneri 2a str. 301
ucauuuuuucgacaucaagaaa

SEQ ID NO: 2011015 - RNA, 19 nt, Shigella flexneri 2a str. 301
ucauuuuuucccauuacca

SEQ ID NO: 2011016 - RNA, 15 nt, Shigella flexneri 2a str. 301
uccaaaaaacaaacc

SEQ ID NO: 2011017 - RNA, 21 nt, Shigella flexneri 2a str. 301
ucauuuuuucgguuuagugua

SEQ ID NO: 2011018 - RNA, 13 nt, Shigella flexneri 2a str. 301
ucauuaaagccgc

SEQ ID NO: 2011019 - RNA, 19 nt, Shigella flexneri 2a str. 301
ucauuaagaacuccugaaa

SEQ ID NO: 2011020 - RNA, 20 nt, Shigella flexneri 2a str. 301
ucaugguuacgccggugauu

SEQ ID NO: 2011021 - RNA, 13 nt, Shigella flexneri 2a str. 301
ucauuaugcugga

SEQ ID NO: 2011022 - RNA, 13 nt, Shigella flexneri 2a str. 301
ucauuauuaauau

SEQ ID NO: 2011023 - RNA, 17 nt, Shigella flexneri 2a str. 301
ucauuacgccagucacg

SEQ ID NO: 2011024 - RNA, 13 nt, Shigella flexneri 2a str. 301
ucauuaccuucaa

SEQ ID NO: 2011025 - RNA, 19 nt, Shigella flexneri 2a str. 301
ucauuacgaaguuuaauuc

SEQ ID NO: 2011026 - RNA, 16 nt, Shigella flexneri 2a str. 301
ucauuaccugaaaaaa

SEQ ID NO: 2011027 - RNA, 16 nt, Shigella flexneri 2a str. 301
ucauuaccgaacaaca

SEQ ID NO: 2011028 - RNA, 23 nt, Shigella flexneri 2a str. 301
ucauuaccgaacaacaagaagcg

SEQ ID NO: 2011029 - RNA, 14 nt, Shigella flexneri 2a str. 301
ucauucgacaacug

SEQ ID NO: 2011030 - RNA, 17 nt, Shigella flexneri 2a str. 301
ucauuauuuucagaagg

SEQ ID NO: 2011031 - RNA, 21 nt, Shigella flexneri 2a str. 301
ucauucucuauucuuaaaaua

SEQ ID NO: 2011032 - RNA, 19 nt, Shigella flexneri 2a str. 301
ucauucgcgccagauggca

SEQ ID NO: 2011033 - RNA, 21 nt, Shigella flexneri 2a str. 301
ucauucgacgcgcgcacacaa

SEQ ID NO: 2011034 - RNA, 22 nt, Shigella flexneri 2a str. 301
ucauucgcaguugcaguaccag

SEQ ID NO: 2011035 - RNA, 19 nt, Shigella flexneri 2a str. 301
ucaugccgaucgucugggc

SEQ ID NO: 2011036 - RNA, 22 nt, Shigella flexneri 2a str. 301
ucaugccuacagguuugugccg

SEQ ID NO: 2011037 - RNA, 15 nt, Shigella flexneri 2a str. 301
ucaugccuacauauu

SEQ ID NO: 2011038 - RNA, 21 nt, Shigella flexneri 2a str. 301
ucaugcgccagguaacgaaga

SEQ ID NO: 2011039 - RNA, 23 nt, Shigella flexneri 2a str. 301
ucaugcccugcccguugccagga

SEQ ID NO: 2011040 - RNA, 13 nt, Shigella flexneri 2a str. 301
ucaugccagugau

SEQ ID NO: 2011041 - RNA, 19 nt, Shigella flexneri 2a str. 301
ucaugccgauaacucauau

SEQ ID NO: 2011042 - RNA, 15 nt, Shigella flexneri 2a str. 301
ucaugccaaaaggga

SEQ ID NO: 2011043 - RNA, 14 nt, Shigella flexneri 2a str. 301
ucaugccaaaaaua

SEQ ID NO: 2011044 - RNA, 17 nt, Shigella flexneri 2a str. 301
ucaugcaucaggaccug

SEQ ID NO: 2011045 - RNA, 20 nt, Shigella flexneri 2a str. 301
ucaugcagcuccaccgauuu

SEQ ID NO: 2011046 - RNA, 23 nt, Shigella flexneri 2a str. 301
ucaugcaacacguuaacaauguu

SEQ ID NO: 2011047 - RNA, 23 nt, Shigella flexneri 2a str. 301
ucaugaauauauaauuaaaaaua

SEQ ID NO: 2011048 - RNA, 20 nt, Shigella flexneri 2a str. 301
ucaugaauauauaauuaaaa

SEQ ID NO: 2011049 - RNA, 15 nt, Shigella flexneri 2a str. 301
ucaugaacacacccg

SEQ ID NO: 2011050 - RNA, 19 nt, Shigella flexneri 2a str. 301
ucaugaacacacccggaga

SEQ ID NO: 2011051 - RNA, 16 nt, Shigella flexneri 2a str. 301
ucaugacuacacuaaa

SEQ ID NO: 2011052 - RNA, 16 nt, Shigella flexneri 2a str. 301
ucaugacgccaccagc

SEQ ID NO: 2011053 - RNA, 19 nt, Shigella flexneri 2a str. 301
ucaucucuucuuccggcac

SEQ ID NO: 2011054 - RNA, 14 nt, Shigella flexneri 2a str. 301
ucaucucuccuuuc

SEQ ID NO: 2011055 - RNA, 17 nt, Shigella flexneri 2a str. 301
ucaucucgcucaaaaau

SEQ ID NO: 2011056 - RNA, 17 nt, Shigella flexneri 2a str. 301
ucaucucccacgcggca

SEQ ID NO: 2011057 - RNA, 16 nt, Shigella flexneri 2a str. 301
ucaucgguauaaccaa

SEQ ID NO: 2011058 - RNA, 23 nt, Shigella flexneri 2a str. 301
ucaucggucagcgcagugacauu

SEQ ID NO: 2011059 - RNA, 23 nt, Shigella flexneri 2a str. 301
ucaucggguuacugauuuuauug

SEQ ID NO: 2011060 - RNA, 16 nt, Shigella flexneri 2a str. 301
ucaucugccacuucug

SEQ ID NO: 2011061 - RNA, 15 nt, Shigella flexneri 2a str. 301
ucaucuucagucagg

SEQ ID NO: 2011062 - RNA, 14 nt, Shigella flexneri 2a str. 301
ucaucuuaacuucg

SEQ ID NO: 2011063 - RNA, 16 nt, Shigella flexneri 2a str. 301
ucaucuucaacugcca

SEQ ID NO: 2011064 - RNA, 13 nt, Shigella flexneri 2a str. 301
ucaucuucuucug

SEQ ID NO: 2011065 - RNA, 15 nt, Shigella flexneri 2a str. 301
ucaucuuguaggccu

SEQ ID NO: 2011066 - RNA, 16 nt, Shigella flexneri 2a str. 301
ucaugaaaaccguuag

SEQ ID NO: 2011067 - RNA, 15 nt, Shigella flexneri 2a str. 301
ucaucuuugaaauca

SEQ ID NO: 2011068 - RNA, 17 nt, Shigella flexneri 2a str. 301
ucaucuuuccaaaccuc

SEQ ID NO: 2011069 - RNA, 21 nt, Shigella flexneri 2a str. 301
ucaucuuugagcaugauuuca

SEQ ID NO: 2011070 - RNA, 20 nt, Shigella flexneri 2a str. 301
ucaucuuugaaaucacgcau

SEQ ID NO: 2011071 - RNA, 14 nt, Shigella flexneri 2a str. 301
ucaucuuugccuga

SEQ ID NO: 2011072 - RNA, 22 nt, Shigella flexneri 2a str. 301
uccacgaaacggcguugagcaa

SEQ ID NO: 2011073 - RNA, 21 nt, Shigella flexneri 2a str. 301
uccaccugcgucgcgccguag

SEQ ID NO: 2011074 - RNA, 22 nt, Shigella flexneri 2a str. 301
uccaccuggccugggaucauca

SEQ ID NO: 2011075 - RNA, 18 nt, Shigella flexneri 2a str. 301
uccaccuucuguaacugg

SEQ ID NO: 2011076 - RNA, 17 nt, Shigella flexneri 2a str. 301
uccaccgcguucagcag

SEQ ID NO: 2011077 - RNA, 18 nt, Shigella flexneri 2a str. 301
uccaccgggcgcaaggug

SEQ ID NO: 2011078 - RNA, 19 nt, Shigella flexneri 2a str. 301
uccaccguuucuuuuucga

SEQ ID NO: 2011079 - RNA, 18 nt, Shigella flexneri 2a str. 301
uccacuauuucaauauga

SEQ ID NO: 2011080 - RNA, 17 nt, Shigella flexneri 2a str. 301
uccagaauaucuucaac

SEQ ID NO: 2011081 - RNA, 15 nt, Shigella flexneri 2a str. 301
uccacugucaaaucc

SEQ ID NO: 2011082 - RNA, 14 nt, Shigella flexneri 2a str. 301
uccacugucaaauc

SEQ ID NO: 2011083 - RNA, 12 nt, Shigella flexneri 2a str. 301
uccacugucaaa

SEQ ID NO: 2011084 - RNA, 14 nt, Shigella flexneri 2a str. 301
uccagacccuucau

SEQ ID NO: 2011085 - RNA, 21 nt, Shigella flexneri 2a str. 301
uccagacgcgcagcuucacuu

SEQ ID NO: 2011086 - RNA, 13 nt, Shigella flexneri 2a str. 301
uccagacgcugca

SEQ ID NO: 2011087 - RNA, 20 nt, Shigella flexneri 2a str. 301
uccagacggagcugccaggc

SEQ ID NO: 2011088 - RNA, 22 nt, Shigella flexneri 2a str. 301
uccagacggguacaguuuucca

SEQ ID NO: 2011089 - RNA, 20 nt, Shigella flexneri 2a str. 301
uccagacacuccagagaauu

SEQ ID NO: 2011090 - RNA, 21 nt, Shigella flexneri 2a str. 301
uccagacgggucauaaucaga

SEQ ID NO: 2011091 - RNA, 21 nt, Shigella flexneri 2a str. 301
uccagagcagcgaauuucuca

SEQ ID NO: 2011092 - RNA, 19 nt, Shigella flexneri 2a str. 301
uccagauaauuaugccgau

SEQ ID NO: 2011093 - RNA, 22 nt, Shigella flexneri 2a str. 301
uccagaugugcaccuuuuccac

SEQ ID NO: 2011094 - RNA, 20 nt, Shigella flexneri 2a str. 301
uccagauggcuauaaucacu

SEQ ID NO: 2011095 - RNA, 17 nt, Shigella flexneri 2a str. 301
uccagauuacuuaacuu

SEQ ID NO: 2011096 - RNA, 18 nt, Shigella flexneri 2a str. 301
uccagauuaccagcgaca

SEQ ID NO: 2011097 - RNA, 21 nt, Shigella flexneri 2a str. 301
uccagauugaucucuaaggca

SEQ ID NO: 2011098 - RNA, 12 nt, Shigella flexneri 2a str. 301
uccagcaaaaag

SEQ ID NO: 2011099 - RNA, 17 nt, Shigella flexneri 2a str. 301
uccagauuuauaaaaga

SEQ ID NO: 2011100 - RNA, 22 nt, Shigella flexneri 2a str. 301
uccaccaccgcaaaauagguau

SEQ ID NO: 2011101 - RNA, 16 nt, Shigella flexneri 2a str. 301
uccaccacgcugcaug

SEQ ID NO: 2011102 - RNA, 15 nt, Shigella flexneri 2a str. 301
uccaccgauuuugag

SEQ ID NO: 2011103 - RNA, 16 nt, Shigella flexneri 2a str. 301
uccaccgaaauaauca

SEQ ID NO: 2011104 - RNA, 19 nt, Shigella flexneri 2a str. 301
uccacaucuaccgccagcc

SEQ ID NO: 2011105 - RNA, 15 nt, Shigella flexneri 2a str. 301
uccacagucaggcug

SEQ ID NO: 2011106 - RNA, 21 nt, Shigella flexneri 2a str. 301
uccacaguugcucaaucaucu

SEQ ID NO: 2011107 - RNA, 19 nt, Shigella flexneri 2a str. 301
uccacaggguguauucaug

SEQ ID NO: 2011108 - RNA, 15 nt, Shigella flexneri 2a str. 301
uccagggccucuccu

SEQ ID NO: 2011109 - RNA, 23 nt, Shigella flexneri 2a str. 301
uccagggcgaaaagcuucuuccu

SEQ ID NO: 2011110 - RNA, 21 nt, Shigella flexneri 2a str. 301
uccaguaaugcgcccaugccg

SEQ ID NO: 2011111 - RNA, 16 nt, Shigella flexneri 2a str. 301
uccaggcucgccgccg

SEQ ID NO: 2011112 - RNA, 23 nt, Shigella flexneri 2a str. 301
uccaggaagggcauaucagcaac

SEQ ID NO: 2011113 - RNA, 17 nt, Shigella flexneri 2a str. 301
uccaggaacagaagaaa

SEQ ID NO: 2011114 - RNA, 22 nt, Shigella flexneri 2a str. 301
uccaguuuucuuugccacuccu

SEQ ID NO: 2011115 - RNA, 13 nt, Shigella flexneri 2a str. 301
uccaguccccccc

SEQ ID NO: 2011116 - RNA, 14 nt, Shigella flexneri 2a str. 301
uccaguccccccca

SEQ ID NO: 2011117 - RNA, 15 nt, Shigella flexneri 2a str. 301
uccaguaccugcaaa

SEQ ID NO: 2011118 - RNA, 13 nt, Shigella flexneri 2a str. 301
uccaguacgccuu

SEQ ID NO: 2011119 - RNA, 17 nt, Shigella flexneri 2a str. 301
uccaguagauucaacau

SEQ ID NO: 2011120 - RNA, 21 nt, Shigella flexneri 2a str. 301
uccaguaucgauuuuccgauu

SEQ ID NO: 2011121 - RNA, 18 nt, Shigella flexneri 2a str. 301
uccauaagcccagaacaa

SEQ ID NO: 2011122 - RNA, 15 nt, Shigella flexneri 2a str. 301
uccauaagauugcau

SEQ ID NO: 2011123 - RNA, 22 nt, Shigella flexneri 2a str. 301
uccauacagcucagguucaacc

SEQ ID NO: 2011124 - RNA, 14 nt, Shigella flexneri 2a str. 301
uccauaaaacaucc

SEQ ID NO: 2011125 - RNA, 17 nt, Shigella flexneri 2a str. 301
uccagccaguguuaacc

SEQ ID NO: 2011126 - RNA, 16 nt, Shigella flexneri 2a str. 301
uccagccagucggaac

SEQ ID NO: 2011127 - RNA, 16 nt, Shigella flexneri 2a str. 301
uccagcccggcggcgu

SEQ ID NO: 2011128 - RNA, 21 nt, Shigella flexneri 2a str. 301
uccagcgauaccggugcaccu

SEQ ID NO: 2011129 - RNA, 17 nt, Shigella flexneri 2a str. 301
uccagcgcaauuggcac

SEQ ID NO: 2011130 - RNA, 16 nt, Shigella flexneri 2a str. 301
uccagcguuaccggcu

SEQ ID NO: 2011131 - RNA, 16 nt, Shigella flexneri 2a str. 301
uccagcguugagcccu

SEQ ID NO: 2011132 - RNA, 14 nt, Shigella flexneri 2a str. 301
uccagcagcggauc

SEQ ID NO: 2011133 - RNA, 19 nt, Shigella flexneri 2a str. 301
uccagccacggcuccagca

SEQ ID NO: 2011134 - RNA, 12 nt, Shigella flexneri 2a str. 301
uccagccagagc

SEQ ID NO: 2011135 - RNA, 21 nt, Shigella flexneri 2a str. 301
uccagccaccgcguggcagac

SEQ ID NO: 2011136 - RNA, 22 nt, Shigella flexneri 2a str. 301
uccagcagaccuucugccagac

SEQ ID NO: 2011137 - RNA, 18 nt, Shigella flexneri 2a str. 301
uccagcagaccagcaaaa

SEQ ID NO: 2011138 - RNA, 17 nt, Shigella flexneri 2a str. 301
uccagcagaccagcaaa

SEQ ID NO: 2011139 - RNA, 18 nt, Shigella flexneri 2a str. 301
uccagcacgucgagcagg

SEQ ID NO: 2011140 - RNA, 12 nt, Shigella flexneri 2a str. 301
uccagcagcccu

SEQ ID NO: 2011141 - RNA, 17 nt, Shigella flexneri 2a str. 301
uccagcagcgcaauuaa

SEQ ID NO: 2011142 - RNA, 14 nt, Shigella flexneri 2a str. 301
uccagcaacaacag

SEQ ID NO: 2011143 - RNA, 14 nt, Shigella flexneri 2a str. 301
uccagauuuuucag

SEQ ID NO: 2011144 - RNA, 17 nt, Shigella flexneri 2a str. 301
uccagcacacuguaagc

SEQ ID NO: 2011145 - RNA, 14 nt, Shigella flexneri 2a str. 301
uccagcaagccacu

SEQ ID NO: 2011146 - RNA, 16 nt, Shigella flexneri 2a str. 301
ugcacgaggcuggcuu

SEQ ID NO: 2011147 - RNA, 17 nt, Shigella flexneri 2a str. 301
ugcacgaggcuggcuuu

SEQ ID NO: 2011148 - RNA, 21 nt, Shigella flexneri 2a str. 301
ugcaccgacuggcuccgggaa

SEQ ID NO: 2011149 - RNA, 14 nt, Shigella flexneri 2a str. 301
ugcaccgaguucuu

SEQ ID NO: 2011150 - RNA, 23 nt, Shigella flexneri 2a str. 301
ugcaccgaguucuucacugacgc

SEQ ID NO: 2011151 - RNA, 15 nt, Shigella flexneri 2a str. 301
ugcaccgauuucgag

SEQ ID NO: 2011152 - RNA, 19 nt, Shigella flexneri 2a str. 301
ugcaccccgagcuuaugca

SEQ ID NO: 2011153 - RNA, 15 nt, Shigella flexneri 2a str. 301
ugcagaaaccaaagc

SEQ ID NO: 2011154 - RNA, 15 nt, Shigella flexneri 2a str. 301
ugcagaaacaaccug

SEQ ID NO: 2011155 - RNA, 16 nt, Shigella flexneri 2a str. 301
ugcagaaacaaccuga

SEQ ID NO: 2011156 - RNA, 20 nt, Shigella flexneri 2a str. 301
ugcagaaacaaccugagcgu

SEQ ID NO: 2011157 - RNA, 22 nt, Shigella flexneri 2a str. 301
ugcacgaugccucaucacaaaa

SEQ ID NO: 2011158 - RNA, 15 nt, Shigella flexneri 2a str. 301
ugcacgaugccugau

SEQ ID NO: 2011159 - RNA, 23 nt, Shigella flexneri 2a str. 301
ugcacgccaucuggcugacggug

SEQ ID NO: 2011160 - RNA, 22 nt, Shigella flexneri 2a str. 301
ugcacggcaugagccgccgcca

SEQ ID NO: 2011161 - RNA, 17 nt, Shigella flexneri 2a str. 301
ugcacggagauauccag

SEQ ID NO: 2011162 - RNA, 17 nt, Shigella flexneri 2a str. 301
ugcaggacuuaaccguu

SEQ ID NO: 2011163 - RNA, 16 nt, Shigella flexneri 2a str. 301
ugcaggaccauacuga

SEQ ID NO: 2011164 - RNA, 22 nt, Shigella flexneri 2a str. 301
ugcaggagcgauuaugaaacaa

SEQ ID NO: 2011165 - RNA, 19 nt, Shigella flexneri 2a str. 301
ugcaggauuaauaaauuuu

SEQ ID NO: 2011166 - RNA, 16 nt, Shigella flexneri 2a str. 301
ugcaggcaacagggaa

SEQ ID NO: 2011167 - RNA, 21 nt, Shigella flexneri 2a str. 301
ugcagcuucuuauccagcugc

SEQ ID NO: 2011168 - RNA, 22 nt, Shigella flexneri 2a str. 301
ugcagcggaucgccgccggaga

SEQ ID NO: 2011169 - RNA, 19 nt, Shigella flexneri 2a str. 301
ugcagcgcaaucgccucca

SEQ ID NO: 2011170 - RNA, 14 nt, Shigella flexneri 2a str. 301
ugcagcaugcaccc

SEQ ID NO: 2011171 - RNA, 15 nt, Shigella flexneri 2a str. 301
ugcagcaugcacccu

SEQ ID NO: 2011172 - RNA, 16 nt, Shigella flexneri 2a str. 301
ugcagcaugcacccuc

SEQ ID NO: 2011173 - RNA, 19 nt, Shigella flexneri 2a str. 301
ugcagccagcgucacccag

SEQ ID NO: 2011174 - RNA, 21 nt, Shigella flexneri 2a str. 301
ugcagccagcgucacccagac

SEQ ID NO: 2011175 - RNA, 14 nt, Shigella flexneri 2a str. 301
ugcagaaucaaucu

SEQ ID NO: 2011176 - RNA, 22 nt, Shigella flexneri 2a str. 301
ugcagacaugacgcccggcaag

SEQ ID NO: 2011177 - RNA, 21 nt, Shigella flexneri 2a str. 301
ugcagacaugacgcccggcaa

SEQ ID NO: 2011178 - RNA, 16 nt, Shigella flexneri 2a str. 301
ugcagacggcucauca

SEQ ID NO: 2011179 - RNA, 17 nt, Shigella flexneri 2a str. 301
ugcagacggcucaucac

SEQ ID NO: 2011180 - RNA, 15 nt, Shigella flexneri 2a str. 301
ugcagacugaauacg

SEQ ID NO: 2011181 - RNA, 14 nt, Shigella flexneri 2a str. 301
ugcaucgccugauu

SEQ ID NO: 2011182 - RNA, 14 nt, Shigella flexneri 2a str. 301
ugcaucgccaaucu

SEQ ID NO: 2011183 - RNA, 16 nt, Shigella flexneri 2a str. 301
ugcaucgaggaaaacc

SEQ ID NO: 2011184 - RNA, 20 nt, Shigella flexneri 2a str. 301
ugcauccgcuuacucaucca

SEQ ID NO: 2011185 - RNA, 23 nt, Shigella flexneri 2a str. 301
ugcaucccucuuugucuuuugcu

SEQ ID NO: 2011186 - RNA, 21 nt, Shigella flexneri 2a str. 301
ugcaucgccugauucaaugag

SEQ ID NO: 2011187 - RNA, 17 nt, Shigella flexneri 2a str. 301
ugcaucgcgcugaacau

SEQ ID NO: 2011188 - RNA, 16 nt, Shigella flexneri 2a str. 301
ugcaugauuacuggcg

SEQ ID NO: 2011189 - RNA, 20 nt, Shigella flexneri 2a str. 301
ugcauguaaaucaagcgccg

SEQ ID NO: 2011190 - RNA, 23 nt, Shigella flexneri 2a str. 301
ugcauuaaauugugaacgagaaa

SEQ ID NO: 2011191 - RNA, 19 nt, Shigella flexneri 2a str. 301
ugcauccacuuugguuaca

SEQ ID NO: 2011192 - RNA, 13 nt, Shigella flexneri 2a str. 301
ugcauccagcucg

SEQ ID NO: 2011193 - RNA, 20 nt, Shigella flexneri 2a str. 301
ugcagggcaucgcaggccag

SEQ ID NO: 2011194 - RNA, 15 nt, Shigella flexneri 2a str. 301
ugccaaaaugcugga

SEQ ID NO: 2011195 - RNA, 15 nt, Shigella flexneri 2a str. 301
ugccaaauauuucuu

SEQ ID NO: 2011196 - RNA, 19 nt, Shigella flexneri 2a str. 301
ugccaaauccggcaaauaa

SEQ ID NO: 2011197 - RNA, 15 nt, Shigella flexneri 2a str. 301
ugccaaccugaacaa

SEQ ID NO: 2011198 - RNA, 23 nt, Shigella flexneri 2a str. 301
ugccaacgcaaacgcccguccau

SEQ ID NO: 2011199 - RNA, 19 nt, Shigella flexneri 2a str. 301
ugccagauggcauccagag

SEQ ID NO: 2011200 - RNA, 13 nt, Shigella flexneri 2a str. 301
ugccagcaaauag

SEQ ID NO: 2011201 - RNA, 20 nt, Shigella flexneri 2a str. 301
ugccagauuuaacggcagca

SEQ ID NO: 2011202 - RNA, 22 nt, Shigella flexneri 2a str. 301
ugccagcaacggccaaauaucc

SEQ ID NO: 2011203 - RNA, 13 nt, Shigella flexneri 2a str. 301
ugccagcacagau

SEQ ID NO: 2011204 - RNA, 15 nt, Shigella flexneri 2a str. 301
ugccagaucggccau

SEQ ID NO: 2011205 - RNA, 14 nt, Shigella flexneri 2a str. 301
ugccagauagccag

SEQ ID NO: 2011206 - RNA, 22 nt, Shigella flexneri 2a str. 301
ugccacugguuuuccugagcaa

SEQ ID NO: 2011207 - RNA, 18 nt, Shigella flexneri 2a str. 301
ugccacugccggugucga

SEQ ID NO: 2011208 - RNA, 22 nt, Shigella flexneri 2a str. 301
ugccacgguaugacccagcgcg

SEQ ID NO: 2011209 - RNA, 18 nt, Shigella flexneri 2a str. 301
ugccaccacaccggacca

SEQ ID NO: 2011210 - RNA, 15 nt, Shigella flexneri 2a str. 301
ugccaccaauaauga

SEQ ID NO: 2011211 - RNA, 16 nt, Shigella flexneri 2a str. 301
ugccaccaauaaugaa

SEQ ID NO: 2011212 - RNA, 14 nt, Shigella flexneri 2a str. 301
ugccaccacaccgg

SEQ ID NO: 2011213 - RNA, 23 nt, Shigella flexneri 2a str. 301
ugccacauuagauaaaaaugaag

SEQ ID NO: 2011214 - RNA, 21 nt, Shigella flexneri 2a str. 301
ugccacauuagauaaaaauga

SEQ ID NO: 2011215 - RNA, 19 nt, Shigella flexneri 2a str. 301
ugccacacgcucuuccagg

SEQ ID NO: 2011216 - RNA, 15 nt, Shigella flexneri 2a str. 301
ugcccaaucucacca

SEQ ID NO: 2011217 - RNA, 17 nt, Shigella flexneri 2a str. 301
ugccauuucugcugcca

SEQ ID NO: 2011218 - RNA, 16 nt, Shigella flexneri 2a str. 301
ugccauuugccagacu

SEQ ID NO: 2011219 - RNA, 14 nt, Shigella flexneri 2a str. 301
ugccauuccacaaa

SEQ ID NO: 2011220 - RNA, 18 nt, Shigella flexneri 2a str. 301
ugccauucgccaguccuu

SEQ ID NO: 2011221 - RNA, 15 nt, Shigella flexneri 2a str. 301
ugccauuaaaccaac

SEQ ID NO: 2011222 - RNA, 15 nt, Shigella flexneri 2a str. 301
ugccaugccaaucag

SEQ ID NO: 2011223 - RNA, 19 nt, Shigella flexneri 2a str. 301
ugccaugaccgcuccgcca

SEQ ID NO: 2011224 - RNA, 22 nt, Shigella flexneri 2a str. 301
ugccaugguuuggaucuguugc

SEQ ID NO: 2011225 - RNA, 16 nt, Shigella flexneri 2a str. 301
ugccauguucaucaag

SEQ ID NO: 2011226 - RNA, 19 nt, Shigella flexneri 2a str. 301
ugccaucgacgaaauggug

SEQ ID NO: 2011227 - RNA, 19 nt, Shigella flexneri 2a str. 301
ugccaucgcauagcgcaau

SEQ ID NO: 2011228 - RNA, 14 nt, Shigella flexneri 2a str. 301
ugccauccagcuuu

SEQ ID NO: 2011229 - RNA, 22 nt, Shigella flexneri 2a str. 301
ugccauccguaauuuuuacucc

SEQ ID NO: 2011230 - RNA, 17 nt, Shigella flexneri 2a str. 301
ugccauccguaauuuuu

SEQ ID NO: 2011231 - RNA, 18 nt, Shigella flexneri 2a str. 301
ugccaucugccagcaagc

SEQ ID NO: 2011232 - RNA, 13 nt, Shigella flexneri 2a str. 301
ugccaugcauauc

SEQ ID NO: 2011233 - RNA, 15 nt, Shigella flexneri 2a str. 301
ugccaucgggcuaga

SEQ ID NO: 2011234 - RNA, 17 nt, Shigella flexneri 2a str. 301
ugccaucagggcggccg

SEQ ID NO: 2011235 - RNA, 17 nt, Shigella flexneri 2a str. 301
ugccaucagcgccugau

SEQ ID NO: 2011236 - RNA, 21 nt, Shigella flexneri 2a str. 301
ugccagugaugcgcaggguaa

SEQ ID NO: 2011237 - RNA, 15 nt, Shigella flexneri 2a str. 301
ugccagugaugcgca

SEQ ID NO: 2011238 - RNA, 19 nt, Shigella flexneri 2a str. 301
ugccagucgcgccuuacgc

SEQ ID NO: 2011239 - RNA, 14 nt, Shigella flexneri 2a str. 301
ugccagucuggcuu

SEQ ID NO: 2011240 - RNA, 13 nt, Shigella flexneri 2a str. 301
ugccaguuuuucc

SEQ ID NO: 2011241 - RNA, 21 nt, Shigella flexneri 2a str. 301
ugccauaaccugugcaccaga

SEQ ID NO: 2011242 - RNA, 13 nt, Shigella flexneri 2a str. 301
ugccauaacgcgu

SEQ ID NO: 2011243 - RNA, 15 nt, Shigella flexneri 2a str. 301
ugccaguccuaaaaa

SEQ ID NO: 2011244 - RNA, 17 nt, Shigella flexneri 2a str. 301
ugccagucaaugaaauu

SEQ ID NO: 2011245 - RNA, 15 nt, Shigella flexneri 2a str. 301
ugccagucagcucca

SEQ ID NO: 2011246 - RNA, 23 nt, Shigella flexneri 2a str. 301
ugccaguacgccaaucugcaaaa

SEQ ID NO: 2011247 - RNA, 24 nt, Shigella flexneri 2a str. 301
ugccaguaaucacgaucucgccag

SEQ ID NO: 2011248 - RNA, 15 nt, Shigella flexneri 2a str. 301
ugccaguaaagcagc

SEQ ID NO: 2011249 - RNA, 22 nt, Shigella flexneri 2a str. 301
ugccaguaacagaacgcauaac

SEQ ID NO: 2011250 - RNA, 15 nt, Shigella flexneri 2a str. 301
ugccagguagucacg

SEQ ID NO: 2011251 - RNA, 13 nt, Shigella flexneri 2a str. 301
ugccagcugcuca

SEQ ID NO: 2011252 - RNA, 19 nt, Shigella flexneri 2a str. 301
ugccagcuugcuuuccagc

SEQ ID NO: 2011253 - RNA, 16 nt, Shigella flexneri 2a str. 301
ugccagcuuuaaauua

SEQ ID NO: 2011254 - RNA, 17 nt, Shigella flexneri 2a str. 301
ugccagcuucagcgcgu

SEQ ID NO: 2011255 - RNA, 17 nt, Shigella flexneri 2a str. 301
ugccagcuucccgcugg

SEQ ID NO: 2011256 - RNA, 14 nt, Shigella flexneri 2a str. 301
ugccagcgugucga

SEQ ID NO: 2011257 - RNA, 20 nt, Shigella flexneri 2a str. 301
ugccagcucggauaaggcuu

SEQ ID NO: 2011258 - RNA, 18 nt, Shigella flexneri 2a str. 301
ugccaggaacacugguuc

SEQ ID NO: 2011259 - RNA, 15 nt, Shigella flexneri 2a str. 301
ugccagcuuucaccu

SEQ ID NO: 2011260 - RNA, 18 nt, Shigella flexneri 2a str. 301
ugccagcuugcuuuccag

SEQ ID NO: 2011261 - RNA, 21 nt, Shigella flexneri 2a str. 301
ugccaggccaguucuucuuca

SEQ ID NO: 2011262 - RNA, 21 nt, Shigella flexneri 2a str. 301
ugccagccaucuuucgcagau

SEQ ID NO: 2011263 - RNA, 22 nt, Shigella flexneri 2a str. 301
ugccagcccuaaucccgugccg

SEQ ID NO: 2011264 - RNA, 20 nt, Shigella flexneri 2a str. 301
ugccagcauaccgccgagga

SEQ ID NO: 2011265 - RNA, 22 nt, Shigella flexneri 2a str. 301
ugccagcgguggugacugguuu

SEQ ID NO: 2011266 - RNA, 19 nt, Shigella flexneri 2a str. 301
ugccagcguaaauccugac

SEQ ID NO: 2011267 - RNA, 23 nt, Shigella flexneri 2a str. 301
ugccagcguaccaugauccugca

SEQ ID NO: 2011268 - RNA, 16 nt, Shigella flexneri 2a str. 301
ugccagcgaagaagug

SEQ ID NO: 2011269 - RNA, 17 nt, Shigella flexneri 2a str. 301
ugcccgcuuaacguacu

SEQ ID NO: 2011270 - RNA, 17 nt, Shigella flexneri 2a str. 301
ugcccggagcagcaguc

SEQ ID NO: 2011271 - RNA, 15 nt, Shigella flexneri 2a str. 301
ugcccgcuugagaca

SEQ ID NO: 2011272 - RNA, 20 nt, Shigella flexneri 2a str. 301
ugcccgcgcugucgggcagc

SEQ ID NO: 2011273 - RNA, 17 nt, Shigella flexneri 2a str. 301
ugcccgggucagcgcca

SEQ ID NO: 2011274 - RNA, 23 nt, Shigella flexneri 2a str. 301
ugcccguaaaaaauggcuggcua

SEQ ID NO: 2011275 - RNA, 16 nt, Shigella flexneri 2a str. 301
ugcccgugacucccac

SEQ ID NO: 2011276 - RNA, 22 nt, Shigella flexneri 2a str. 301
ugcccgagauacaucaccgcca

SEQ ID NO: 2011277 - RNA, 19 nt, Shigella flexneri 2a str. 301
ugcccgagauacaucaccg

SEQ ID NO: 2011278 - RNA, 19 nt, Shigella flexneri 2a str. 301
ugcccgaccagauaagaac

SEQ ID NO: 2011279 - RNA, 22 nt, Shigella flexneri 2a str. 301
ugcccgaugaccuugucaugca

SEQ ID NO: 2011280 - RNA, 19 nt, Shigella flexneri 2a str. 301
ugcccgaugcgcaaacuua

SEQ ID NO: 2011281 - RNA, 19 nt, Shigella flexneri 2a str. 301
ugcccgcaacggcugcuuc

SEQ ID NO: 2011282 - RNA, 14 nt, Shigella flexneri 2a str. 301
ugcccgcagaucca

SEQ ID NO: 2011283 - RNA, 13 nt, Shigella flexneri 2a str. 301
ugcccgcaucugc

SEQ ID NO: 2011284 - RNA, 17 nt, Shigella flexneri 2a str. 301
ugcccgcauuauuuccc

SEQ ID NO: 2011285 - RNA, 13 nt, Shigella flexneri 2a str. 301
ugcccauggcaag

SEQ ID NO: 2011286 - RNA, 18 nt, Shigella flexneri 2a str. 301
ugcccauguccgcggccu

SEQ ID NO: 2011287 - RNA, 12 nt, Shigella flexneri 2a str. 301
ugcccaugcuuc

SEQ ID NO: 2011288 - RNA, 22 nt, Shigella flexneri 2a str. 301
ugcccccaacuuugugcaauug

SEQ ID NO: 2011289 - RNA, 14 nt, Shigella flexneri 2a str. 301
ugccccagugggcu

SEQ ID NO: 2011290 - RNA, 14 nt, Shigella flexneri 2a str. 301
ugcccccagcagcg

SEQ ID NO: 2011291 - RNA, 21 nt, Shigella flexneri 2a str. 301
ugcccccgcaugccuaccaaa

SEQ ID NO: 2011292 - RNA, 17 nt, Shigella flexneri 2a str. 301
ugcccacgcgcacgcug

SEQ ID NO: 2011293 - RNA, 21 nt, Shigella flexneri 2a str. 301
ugcccaccgacgcagucaugc

SEQ ID NO: 2011294 - RNA, 15 nt, Shigella flexneri 2a str. 301
ugcccagaaaccagu

SEQ ID NO: 2011295 - RNA, 15 nt, Shigella flexneri 2a str. 301
ugcccagugaccaaa

SEQ ID NO: 2011296 - RNA, 19 nt, Shigella flexneri 2a str. 301
ugcccaggugugucucaag

SEQ ID NO: 2011297 - RNA, 17 nt, Shigella flexneri 2a str. 301
ugccgccggaaacauaa

SEQ ID NO: 2011298 - RNA, 18 nt, Shigella flexneri 2a str. 301
ugccgccggaaacauaaa

SEQ ID NO: 2011299 - RNA, 13 nt, Shigella flexneri 2a str. 301
ugccgccucugcc

SEQ ID NO: 2011300 - RNA, 20 nt, Shigella flexneri 2a str. 301
ugccgcgccagaucagggaa

SEQ ID NO: 2011301 - RNA, 20 nt, Shigella flexneri 2a str. 301
ugccggacagaucugccugu

SEQ ID NO: 2011302 - RNA, 22 nt, Shigella flexneri 2a str. 301
ugccggaaggcagccuuucuca

SEQ ID NO: 2011303 - RNA, 17 nt, Shigella flexneri 2a str. 301
ugccggacaugcugccu

SEQ ID NO: 2011304 - RNA, 21 nt, Shigella flexneri 2a str. 301
ugccggagcgccaccacccug

SEQ ID NO: 2011305 - RNA, 21 nt, Shigella flexneri 2a str. 301
ugccggaggaguaucugcugu

SEQ ID NO: 2011306 - RNA, 13 nt, Shigella flexneri 2a str. 301
ugccgcuuccagc

SEQ ID NO: 2011307 - RNA, 21 nt, Shigella flexneri 2a str. 301
ugccggaaggcagccuuucuc

SEQ ID NO: 2011308 - RNA, 18 nt, Shigella flexneri 2a str. 301
ugccggaacuauuggucu

SEQ ID NO: 2011309 - RNA, 22 nt, Shigella flexneri 2a str. 301
ugccgcuaauggugcgcgcacu

SEQ ID NO: 2011310 - RNA, 22 nt, Shigella flexneri 2a str. 301
ugccgcugguguugcugaccaa

SEQ ID NO: 2011311 - RNA, 13 nt, Shigella flexneri 2a str. 301
ugccguuaaaacu

SEQ ID NO: 2011312 - RNA, 21 nt, Shigella flexneri 2a str. 301
ugccuaacaauucgccagggc

SEQ ID NO: 2011313 - RNA, 16 nt, Shigella flexneri 2a str. 301
ugccuaccaaaccugc

SEQ ID NO: 2011314 - RNA, 20 nt, Shigella flexneri 2a str. 301
ugccuaccaaaccugcacgc

SEQ ID NO: 2011315 - RNA, 19 nt, Shigella flexneri 2a str. 301
ugccucacgaucacagcag

SEQ ID NO: 2011316 - RNA, 20 nt, Shigella flexneri 2a str. 301
ugccucacgaucacagcagu

SEQ ID NO: 2011317 - RNA, 21 nt, Shigella flexneri 2a str. 301
ugccggggagauauuccccag

SEQ ID NO: 2011318 - RNA, 18 nt, Shigella flexneri 2a str. 301
ugccguauacacacuuuc

SEQ ID NO: 2011319 - RNA, 14 nt, Shigella flexneri 2a str. 301
ugccgucaccagca

SEQ ID NO: 2011320 - RNA, 20 nt, Shigella flexneri 2a str. 301
ugccggaugcgccagcaucc

SEQ ID NO: 2011321 - RNA, 17 nt, Shigella flexneri 2a str. 301
ugccggaugcggugcaa

SEQ ID NO: 2011322 - RNA, 21 nt, Shigella flexneri 2a str. 301
ugccggauauacccgccaaac

SEQ ID NO: 2011323 - RNA, 17 nt, Shigella flexneri 2a str. 301
ugccggauggcagaguu

SEQ ID NO: 2011324 - RNA, 21 nt, Shigella flexneri 2a str. 301
ugccgccaaaucggaacaaca

SEQ ID NO: 2011325 - RNA, 20 nt, Shigella flexneri 2a str. 301
ugccgcauggaaccaguuca

SEQ ID NO: 2011326 - RNA, 18 nt, Shigella flexneri 2a str. 301
ugccgccaguucuuccag

SEQ ID NO: 2011327 - RNA, 15 nt, Shigella flexneri 2a str. 301
ugccgcccagaagca

SEQ ID NO: 2011328 - RNA, 23 nt, Shigella flexneri 2a str. 301
ugccgaugaacggcggcggcgcg

SEQ ID NO: 2011329 - RNA, 18 nt, Shigella flexneri 2a str. 301
ugccgaucaauuucacag

SEQ ID NO: 2011330 - RNA, 18 nt, Shigella flexneri 2a str. 301
ugccgaucaccacggaaa

SEQ ID NO: 2011331 - RNA, 13 nt, Shigella flexneri 2a str. 301
ugccgauggucac

SEQ ID NO: 2011332 - RNA, 16 nt, Shigella flexneri 2a str. 301
ugccgauggcaaaagu

SEQ ID NO: 2011333 - RNA, 13 nt, Shigella flexneri 2a str. 301
ugccgcagaagau

SEQ ID NO: 2011334 - RNA, 15 nt, Shigella flexneri 2a str. 301
ugccgcauccggcau

SEQ ID NO: 2011335 - RNA, 22 nt, Shigella flexneri 2a str. 301
ugccgcagcuucuguuauucca

SEQ ID NO: 2011336 - RNA, 15 nt, Shigella flexneri 2a str. 301
ugccgcacauuuccc

SEQ ID NO: 2011337 - RNA, 20 nt, Shigella flexneri 2a str. 301
ugccgcaauugucuguuugc

SEQ ID NO: 2011338 - RNA, 13 nt, Shigella flexneri 2a str. 301
ugccgcaauggcc

SEQ ID NO: 2011339 - RNA, 13 nt, Shigella flexneri 2a str. 301
ugcccugcuggug

SEQ ID NO: 2011340 - RNA, 17 nt, Shigella flexneri 2a str. 301
ugcccugcugaucgcca

SEQ ID NO: 2011341 - RNA, 14 nt, Shigella flexneri 2a str. 301
ugcccucugaauaa

SEQ ID NO: 2011342 - RNA, 16 nt, Shigella flexneri 2a str. 301
ugcccguugccaggac

SEQ ID NO: 2011343 - RNA, 16 nt, Shigella flexneri 2a str. 301
ugcccguuaaccauaa

SEQ ID NO: 2011344 - RNA, 14 nt, Shigella flexneri 2a str. 301
ugcccgugaugcaa

SEQ ID NO: 2011345 - RNA, 14 nt, Shigella flexneri 2a str. 301
ugcccgugcugaca

SEQ ID NO: 2011346 - RNA, 18 nt, Shigella flexneri 2a str. 301
ugcccuaucacgccacca

SEQ ID NO: 2011347 - RNA, 14 nt, Shigella flexneri 2a str. 301
ugcccuugccaacg

SEQ ID NO: 2011348 - RNA, 12 nt, Shigella flexneri 2a str. 301
ugcccuuucaac

SEQ ID NO: 2011349 - RNA, 22 nt, Shigella flexneri 2a str. 301
ugcccuguuugucgaucaucag

SEQ ID NO: 2011350 - RNA, 17 nt, Shigella flexneri 2a str. 301
ugccgaccaucuguucu

SEQ ID NO: 2011351 - RNA, 17 nt, Shigella flexneri 2a str. 301
ugccgagaguaacacau

SEQ ID NO: 2011352 - RNA, 14 nt, Shigella flexneri 2a str. 301
ugccgauaaauaca

SEQ ID NO: 2011353 - RNA, 22 nt, Shigella flexneri 2a str. 301
ugccgaagccuguaaagucauc

SEQ ID NO: 2011354 - RNA, 17 nt, Shigella flexneri 2a str. 301
ugccgaagcagucaaca

SEQ ID NO: 2011355 - RNA, 16 nt, Shigella flexneri 2a str. 301
ugccgaagaacauaaa

SEQ ID NO: 2011356 - RNA, 13 nt, Shigella flexneri 2a str. 301
ugccgacaaaugc

SEQ ID NO: 2011357 - RNA, 19 nt, Shigella flexneri 2a str. 301
ugcccuuuucaccaugggc

SEQ ID NO: 2011358 - RNA, 14 nt, Shigella flexneri 2a str. 301
ugccgaaccacuga

SEQ ID NO: 2011359 - RNA, 18 nt, Shigella flexneri 2a str. 301
ugcgagaaguucugcagc

SEQ ID NO: 2011360 - RNA, 21 nt, Shigella flexneri 2a str. 301
ugcgagacggcggaaagggcc

SEQ ID NO: 2011361 - RNA, 15 nt, Shigella flexneri 2a str. 301
ugcgauguucuucac

SEQ ID NO: 2011362 - RNA, 13 nt, Shigella flexneri 2a str. 301
ugcgagcaaaauc

SEQ ID NO: 2011363 - RNA, 19 nt, Shigella flexneri 2a str. 301
ugcgagcaaagcgcagccg

SEQ ID NO: 2011364 - RNA, 21 nt, Shigella flexneri 2a str. 301
ugcgagcaaagcgcagccguc

SEQ ID NO: 2011365 - RNA, 14 nt, Shigella flexneri 2a str. 301
ugcgcaacugaggc

SEQ ID NO: 2011366 - RNA, 23 nt, Shigella flexneri 2a str. 301
ugccugcuggcuagccucccugc

SEQ ID NO: 2011367 - RNA, 19 nt, Shigella flexneri 2a str. 301
ugccugcugugccagugcc

SEQ ID NO: 2011368 - RNA, 20 nt, Shigella flexneri 2a str. 301
ugccugcugugccagugcca

SEQ ID NO: 2011369 - RNA, 16 nt, Shigella flexneri 2a str. 301
ugccuccccaacauau

SEQ ID NO: 2011370 - RNA, 16 nt, Shigella flexneri 2a str. 301
ugcgacaggagccgca

SEQ ID NO: 2011371 - RNA, 20 nt, Shigella flexneri 2a str. 301
ugccuggguuuucacagaag

SEQ ID NO: 2011372 - RNA, 18 nt, Shigella flexneri 2a str. 301
ugccugggcgauuuccuu

SEQ ID NO: 2011373 - RNA, 22 nt, Shigella flexneri 2a str. 301
ugcgaccguacaaccaaaucug

SEQ ID NO: 2011374 - RNA, 16 nt, Shigella flexneri 2a str. 301
ugcgaccguacaacca

SEQ ID NO: 2011375 - RNA, 12 nt, Shigella flexneri 2a str. 301
ugcgaccgcucu

SEQ ID NO: 2011376 - RNA, 21 nt, Shigella flexneri 2a str. 301
ugcgaccggcguaacggccac

SEQ ID NO: 2011377 - RNA, 14 nt, Shigella flexneri 2a str. 301
ugcgaccaaacugc

SEQ ID NO: 2011378 - RNA, 16 nt, Shigella flexneri 2a str. 301
ugcgaccagaccaggc

SEQ ID NO: 2011379 - RNA, 20 nt, Shigella flexneri 2a str. 301
ugcgacagggaucucuucca

SEQ ID NO: 2011380 - RNA, 23 nt, Shigella flexneri 2a str. 301
ugcgacgcuuacgcgucuuauca

SEQ ID NO: 2011381 - RNA, 16 nt, Shigella flexneri 2a str. 301
ugcgacgcuugccgcg

SEQ ID NO: 2011382 - RNA, 14 nt, Shigella flexneri 2a str. 301
ugcgacgagaaaau

SEQ ID NO: 2011383 - RNA, 21 nt, Shigella flexneri 2a str. 301
ugcgccauuuuuuugucugcu

SEQ ID NO: 2011384 - RNA, 17 nt, Shigella flexneri 2a str. 301
ugcgcauucuacuuugc

SEQ ID NO: 2011385 - RNA, 19 nt, Shigella flexneri 2a str. 301
aaauggcguuagucaugaa

SEQ ID NO: 2011386 - RNA, 18 nt, Shigella flexneri 2a str. 301
aaauggccagccagcaga

SEQ ID NO: 2011387 - RNA, 22 nt, Shigella flexneri 2a str. 301
aaauggcccuucuggucaugaa

SEQ ID NO: 2011388 - RNA, 19 nt, Shigella flexneri 2a str. 301
aaauggccgucaggguugc

SEQ ID NO: 2011389 - RNA, 17 nt, Shigella flexneri 2a str. 301
aaaugguuucugauugg

SEQ ID NO: 2011390 - RNA, 14 nt, Shigella flexneri 2a str. 301
aaaugguaaagaag

SEQ ID NO: 2011391 - RNA, 19 nt, Shigella flexneri 2a str. 301
aaaugggugucgccuucca

SEQ ID NO: 2011392 - RNA, 16 nt, Shigella flexneri 2a str. 301
ugcgccguuuuuuuuc

SEQ ID NO: 2011393 - RNA, 20 nt, Shigella flexneri 2a str. 301
ugcgccuacggcauucugca

SEQ ID NO: 2011394 - RNA, 22 nt, Shigella flexneri 2a str. 301
ugcgccucaagaaucacuucau

SEQ ID NO: 2011395 - RNA, 13 nt, Shigella flexneri 2a str. 301
ugcgcgcaaucag

SEQ ID NO: 2011396 - RNA, 15 nt, Shigella flexneri 2a str. 301
ugcgcgagcuggugc

SEQ ID NO: 2011397 - RNA, 21 nt, Shigella flexneri 2a str. 301
ugcgcgaccaacugcaaggcc

SEQ ID NO: 2011398 - RNA, 17 nt, Shigella flexneri 2a str. 301
ugcgcgacuucauucag

SEQ ID NO: 2011399 - RNA, 24 nt, Shigella flexneri 2a str. 301
ugcgcgacguugcuucucuugcug

SEQ ID NO: 2011400 - RNA, 19 nt, Shigella flexneri 2a str. 301
ugcgccuguucccuucuca

SEQ ID NO: 2011401 - RNA, 18 nt, Shigella flexneri 2a str. 301
ugcgccuuucgagaagca

SEQ ID NO: 2011402 - RNA, 21 nt, Shigella flexneri 2a str. 301
ugcguagucugaccucuucua

SEQ ID NO: 2011403 - RNA, 18 nt, Shigella flexneri 2a str. 301
ugcguagccgauccgcgu

SEQ ID NO: 2011404 - RNA, 22 nt, Shigella flexneri 2a str. 301
ugcguaucgacggcguauugca

SEQ ID NO: 2011405 - RNA, 17 nt, Shigella flexneri 2a str. 301
ugcguacuggcauuuau

SEQ ID NO: 2011406 - RNA, 18 nt, Shigella flexneri 2a str. 301
ugcguacaccaacaucac

SEQ ID NO: 2011407 - RNA, 14 nt, Shigella flexneri 2a str. 301
ugcguaauguuuag

SEQ ID NO: 2011408 - RNA, 17 nt, Shigella flexneri 2a str. 301
ugcggucaaaagcugca

SEQ ID NO: 2011409 - RNA, 16 nt, Shigella flexneri 2a str. 301
ugcguaaucgccgaac

SEQ ID NO: 2011410 - RNA, 17 nt, Shigella flexneri 2a str. 301
ugcgggucaggccagga

SEQ ID NO: 2011411 - RNA, 16 nt, Shigella flexneri 2a str. 301
ugcgggucaggccagg

SEQ ID NO: 2011412 - RNA, 15 nt, Shigella flexneri 2a str. 301
ugcgggucaggccag

SEQ ID NO: 2011413 - RNA, 16 nt, Shigella flexneri 2a str. 301
ugcggguuagucugca

SEQ ID NO: 2011414 - RNA, 18 nt, Shigella flexneri 2a str. 301
ugcggguuagucugcauu

SEQ ID NO: 2011415 - RNA, 18 nt, Shigella flexneri 2a str. 301
ugcgguaaucgcccggau

SEQ ID NO: 2011416 - RNA, 14 nt, Shigella flexneri 2a str. 301
ugcgguaagcugcg

SEQ ID NO: 2011417 - RNA, 22 nt, Shigella flexneri 2a str. 301
ugcgguaagguugucgauacca

SEQ ID NO: 2011418 - RNA, 15 nt, Shigella flexneri 2a str. 301
ugcgggcgaaaacau

SEQ ID NO: 2011419 - RNA, 19 nt, Shigella flexneri 2a str. 301
ugcgggcgaaagcagaaaa

SEQ ID NO: 2011420 - RNA, 23 nt, Shigella flexneri 2a str. 301
ugcgggcgaccaaucaaauaccc

SEQ ID NO: 2011421 - RNA, 13 nt, Shigella flexneri 2a str. 301
ugcggccagcagc

SEQ ID NO: 2011422 - RNA, 14 nt, Shigella flexneri 2a str. 301
ugcggccagcagcu

SEQ ID NO: 2011423 - RNA, 12 nt, Shigella flexneri 2a str. 301
ugcggccagcag

SEQ ID NO: 2011424 - RNA, 22 nt, Shigella flexneri 2a str. 301
ugcgcugcuuguuccacuucau

SEQ ID NO: 2011425 - RNA, 13 nt, Shigella flexneri 2a str. 301
ugcggaucugcuc

SEQ ID NO: 2011426 - RNA, 22 nt, Shigella flexneri 2a str. 301
ugcggaucaacuuuguucugaa

SEQ ID NO: 2011427 - RNA, 18 nt, Shigella flexneri 2a str. 301
ugcggagguuucuuuuua

SEQ ID NO: 2011428 - RNA, 17 nt, Shigella flexneri 2a str. 301
ugcgcucuucgaggccg

SEQ ID NO: 2011429 - RNA, 20 nt, Shigella flexneri 2a str. 301
ugcgcugaauacggaagcga

SEQ ID NO: 2011430 - RNA, 16 nt, Shigella flexneri 2a str. 301
ugcgcugacucuacug

SEQ ID NO: 2011431 - RNA, 21 nt, Shigella flexneri 2a str. 301
ugcgcucuucaacuucagcag

SEQ ID NO: 2011432 - RNA, 14 nt, Shigella flexneri 2a str. 301
ugcgcuaccaggaa

SEQ ID NO: 2011433 - RNA, 23 nt, Shigella flexneri 2a str. 301
ugcgcgucuuaucaggccugugg

SEQ ID NO: 2011434 - RNA, 17 nt, Shigella flexneri 2a str. 301
ugcgcuaaacaggaucu

SEQ ID NO: 2011435 - RNA, 12 nt, Shigella flexneri 2a str. 301
ugagcaugaugc

SEQ ID NO: 2011436 - RNA, 17 nt, Shigella flexneri 2a str. 301
ugagcaguccccacauc

SEQ ID NO: 2011437 - RNA, 19 nt, Shigella flexneri 2a str. 301
ugagccaggacgauaaacc

SEQ ID NO: 2011438 - RNA, 21 nt, Shigella flexneri 2a str. 301
ugagccggaguugcagauuug

SEQ ID NO: 2011439 - RNA, 18 nt, Shigella flexneri 2a str. 301
ugagaucgugaaacucag

SEQ ID NO: 2011440 - RNA, 15 nt, Shigella flexneri 2a str. 301
ugagauucaaauaag

SEQ ID NO: 2011441 - RNA, 17 nt, Shigella flexneri 2a str. 301
ugagauucaaauaagcg

SEQ ID NO: 2011442 - RNA, 19 nt, Shigella flexneri 2a str. 301
ugagcagaagguaaauugu

SEQ ID NO: 2011443 - RNA, 13 nt, Shigella flexneri 2a str. 301
ugagcacuuuucu

SEQ ID NO: 2011444 - RNA, 16 nt, Shigella flexneri 2a str. 301
ugagcagaccaauaac

SEQ ID NO: 2011445 - RNA, 20 nt, Shigella flexneri 2a str. 301
ugagcaccuuuuuucugucu

SEQ ID NO: 2011446 - RNA, 16 nt, Shigella flexneri 2a str. 301
ugagcagccaccacuu

SEQ ID NO: 2011447 - RNA, 10 nt, Shigella flexneri 2a str. 301
ugagaaaaag

SEQ ID NO: 2011448 - RNA, 16 nt, Shigella flexneri 2a str. 301
ugagaaaauuucauua

SEQ ID NO: 2011449 - RNA, 14 nt, Shigella flexneri 2a str. 301
ugagaaaauuucau

SEQ ID NO: 2011450 - RNA, 15 nt, Shigella flexneri 2a str. 301
ugacugcggcguggg

SEQ ID NO: 2011451 - RNA, 20 nt, Shigella flexneri 2a str. 301
ugacugcgccacuucccagc

SEQ ID NO: 2011452 - RNA, 16 nt, Shigella flexneri 2a str. 301
ugacugcggcgugggc

SEQ ID NO: 2011453 - RNA, 15 nt, Shigella flexneri 2a str. 301
ugacugccccaguuc

SEQ ID NO: 2011454 - RNA, 14 nt, Shigella flexneri 2a str. 301
ugaccuuuuuucag

SEQ ID NO: 2011455 - RNA, 16 nt, Shigella flexneri 2a str. 301
ugaccuuaccaccuua

SEQ ID NO: 2011456 - RNA, 14 nt, Shigella flexneri 2a str. 301
ugacuggcuacugu

SEQ ID NO: 2011457 - RNA, 21 nt, Shigella flexneri 2a str. 301
ugacuggggcggcuaaaauau

SEQ ID NO: 2011458 - RNA, 16 nt, Shigella flexneri 2a str. 301
ugacugguagugcagu

SEQ ID NO: 2011459 - RNA, 23 nt, Shigella flexneri 2a str. 301
ugagcgauuuuuuauaguacuuc

SEQ ID NO: 2011460 - RNA, 14 nt, Shigella flexneri 2a str. 301
ugaggaugcggguc

SEQ ID NO: 2011461 - RNA, 17 nt, Shigella flexneri 2a str. 301
ugaggaugcuaaggcug

SEQ ID NO: 2011462 - RNA, 23 nt, Shigella flexneri 2a str. 301
ugagguuguggcauuagauauuu

SEQ ID NO: 2011463 - RNA, 12 nt, Shigella flexneri 2a str. 301
ugagguuaugca

SEQ ID NO: 2011464 - RNA, 19 nt, Shigella flexneri 2a str. 301
ugaggcauaagcgacaucu

SEQ ID NO: 2011465 - RNA, 19 nt, Shigella flexneri 2a str. 301
ugaggcaauaaugacgcug

SEQ ID NO: 2011466 - RNA, 22 nt, Shigella flexneri 2a str. 301
ugaguaagcaggguugcagcca

SEQ ID NO: 2011467 - RNA, 13 nt, Shigella flexneri 2a str. 301
ugaguacugauga

SEQ ID NO: 2011468 - RNA, 13 nt, Shigella flexneri 2a str. 301
ugaguaauaacuu

SEQ ID NO: 2011469 - RNA, 14 nt, Shigella flexneri 2a str. 301
ugaguaucaauuau

SEQ ID NO: 2011470 - RNA, 15 nt, Shigella flexneri 2a str. 301
ugauaauuaugaagu

SEQ ID NO: 2011471 - RNA, 15 nt, Shigella flexneri 2a str. 301
ugauaauuauuauaa

SEQ ID NO: 2011472 - RNA, 21 nt, Shigella flexneri 2a str. 301
ugauaauuuucgguaaugacu

SEQ ID NO: 2011473 - RNA, 14 nt, Shigella flexneri 2a str. 301
ugauacaucaaguc

SEQ ID NO: 2011474 - RNA, 17 nt, Shigella flexneri 2a str. 301
ugauacaucaagucaga

SEQ ID NO: 2011475 - RNA, 11 nt, Shigella flexneri 2a str. 301
ugauacaugaa

SEQ ID NO: 2011476 - RNA, 16 nt, Shigella flexneri 2a str. 301
ugauacaggaacagcc

SEQ ID NO: 2011477 - RNA, 14 nt, Shigella flexneri 2a str. 301
ugauaaucauccca

SEQ ID NO: 2011478 - RNA, 16 nt, Shigella flexneri 2a str. 301
ugauaauguuauuuaa

SEQ ID NO: 2011479 - RNA, 16 nt, Shigella flexneri 2a str. 301
ugagucgcaaaacuca

SEQ ID NO: 2011480 - RNA, 19 nt, Shigella flexneri 2a str. 301
ugauccagccauugccaua

SEQ ID NO: 2011481 - RNA, 22 nt, Shigella flexneri 2a str. 301
ugauccaggagcuccagguccu

SEQ ID NO: 2011482 - RNA, 16 nt, Shigella flexneri 2a str. 301
ugaucauucaccagcc

SEQ ID NO: 2011483 - RNA, 13 nt, Shigella flexneri 2a str. 301
ugaucaccugcau

SEQ ID NO: 2011484 - RNA, 18 nt, Shigella flexneri 2a str. 301
ugaucaccugcauacaaa

SEQ ID NO: 2011485 - RNA, 17 nt, Shigella flexneri 2a str. 301
ugaucccaguuuucgcc

SEQ ID NO: 2011486 - RNA, 21 nt, Shigella flexneri 2a str. 301
ugauccccgcuuccugcagcg

SEQ ID NO: 2011487 - RNA, 19 nt, Shigella flexneri 2a str. 301
ugauccccggaaucagagg

SEQ ID NO: 2011488 - RNA, 14 nt, Shigella flexneri 2a str. 301
ugaucaaauacuuc

SEQ ID NO: 2011489 - RNA, 13 nt, Shigella flexneri 2a str. 301
ugaucacccacau

SEQ ID NO: 2011490 - RNA, 19 nt, Shigella flexneri 2a str. 301
ugaucacccacaucagcgg

SEQ ID NO: 2011491 - RNA, 18 nt, Shigella flexneri 2a str. 301
ugauauuucgaauuuucc

SEQ ID NO: 2011492 - RNA, 22 nt, Shigella flexneri 2a str. 301
ugauauucccguuuucuuuuac

SEQ ID NO: 2011493 - RNA, 14 nt, Shigella flexneri 2a str. 301
ugauggaauuucau

SEQ ID NO: 2011494 - RNA, 16 nt, Shigella flexneri 2a str. 301
ugaugcucuugaaaug

SEQ ID NO: 2011495 - RNA, 21 nt, Shigella flexneri 2a str. 301
ugaugcgcugcgcuuaucagg

SEQ ID NO: 2011496 - RNA, 22 nt, Shigella flexneri 2a str. 301
ugaugcgugagguaacaauaaa

SEQ ID NO: 2011497 - RNA, 18 nt, Shigella flexneri 2a str. 301
ugaugcggcgcuuucagc

SEQ ID NO: 2011498 - RNA, 20 nt, Shigella flexneri 2a str. 301
ugaugcguugcgcuucucag

SEQ ID NO: 2011499 - RNA, 17 nt, Shigella flexneri 2a str. 301
ugauggaauuucaucau

SEQ ID NO: 2011500 - RNA, 21 nt, Shigella flexneri 2a str. 301
ugauggcauucucacuccagc

SEQ ID NO: 2011501 - RNA, 15 nt, Shigella flexneri 2a str. 301
ugauggcuauuagaa

SEQ ID NO: 2011502 - RNA, 14 nt, Shigella flexneri 2a str. 301
ugaugcauaaaaaa

SEQ ID NO: 2011503 - RNA, 17 nt, Shigella flexneri 2a str. 301
ugaugcagccagugauu

SEQ ID NO: 2011504 - RNA, 17 nt, Shigella flexneri 2a str. 301
ugaugcauuguuugcaa

SEQ ID NO: 2011505 - RNA, 20 nt, Shigella flexneri 2a str. 301
ugaugcauuuuuuagugauu

SEQ ID NO: 2011506 - RNA, 22 nt, Shigella flexneri 2a str. 301
ugaugcauuuuuuagugauuaa

SEQ ID NO: 2011507 - RNA, 21 nt, Shigella flexneri 2a str. 301
ugaugccgccagacugcgaga

SEQ ID NO: 2011508 - RNA, 21 nt, Shigella flexneri 2a str. 301
ugaugcgacgcuugacgcguc

SEQ ID NO: 2011509 - RNA, 16 nt, Shigella flexneri 2a str. 301
ugaugccgguuuuaca

SEQ ID NO: 2011510 - RNA, 17 nt, Shigella flexneri 2a str. 301
ugaucuccuuggagaaa

SEQ ID NO: 2011511 - RNA, 18 nt, Shigella flexneri 2a str. 301
ugaucuccuuuguaccag

SEQ ID NO: 2011512 - RNA, 14 nt, Shigella flexneri 2a str. 301
ugaugaagacagac

SEQ ID NO: 2011513 - RNA, 13 nt, Shigella flexneri 2a str. 301
ugaugaaaaaacc

SEQ ID NO: 2011514 - RNA, 18 nt, Shigella flexneri 2a str. 301
ugauugggucauuuccca

SEQ ID NO: 2011515 - RNA, 20 nt, Shigella flexneri 2a str. 301
ugauugcuuuaucaaucacc

SEQ ID NO: 2011516 - RNA, 19 nt, Shigella flexneri 2a str. 301
ugauugcuuuaucaaucac

SEQ ID NO: 2011517 - RNA, 16 nt, Shigella flexneri 2a str. 301
ugauucugauccugca

SEQ ID NO: 2011518 - RNA, 21 nt, Shigella flexneri 2a str. 301
ugauucugauccugcacuuuc

SEQ ID NO: 2011519 - RNA, 19 nt, Shigella flexneri 2a str. 301
ugauugaaauagccaauac

SEQ ID NO: 2011520 - RNA, 15 nt, Shigella flexneri 2a str. 301
ugauugccuuccacc

SEQ ID NO: 2011521 - RNA, 13 nt, Shigella flexneri 2a str. 301
ugauugccucagu

SEQ ID NO: 2011522 - RNA, 20 nt, Shigella flexneri 2a str. 301
ugauuucaccugcauuugcu

SEQ ID NO: 2011523 - RNA, 12 nt, Shigella flexneri 2a str. 301
ugauuuauagau

SEQ ID NO: 2011524 - RNA, 14 nt, Shigella flexneri 2a str. 301
ugauuuauagauuu

SEQ ID NO: 2011525 - RNA, 21 nt, Shigella flexneri 2a str. 301
ugauuucguccauguuggaga

SEQ ID NO: 2011526 - RNA, 20 nt, Shigella flexneri 2a str. 301
ugauuuccugcgugacuaaa

SEQ ID NO: 2011527 - RNA, 12 nt, Shigella flexneri 2a str. 301
ugauugucggug

SEQ ID NO: 2011528 - RNA, 18 nt, Shigella flexneri 2a str. 301
ugauuguggcaaucauau

SEQ ID NO: 2011529 - RNA, 17 nt, Shigella flexneri 2a str. 301
ugauuguuaacaacgug

SEQ ID NO: 2011530 - RNA, 14 nt, Shigella flexneri 2a str. 301
ugauuaucgaucau

SEQ ID NO: 2011531 - RNA, 12 nt, Shigella flexneri 2a str. 301
ugauucagauaa

SEQ ID NO: 2011532 - RNA, 11 nt, Shigella flexneri 2a str. 301
ugauucacaag

SEQ ID NO: 2011533 - RNA, 13 nt, Shigella flexneri 2a str. 301
ugauucaggauau

SEQ ID NO: 2011534 - RNA, 22 nt, Shigella flexneri 2a str. 301
ugauuauuggacgguaaaaaga

SEQ ID NO: 2011535 - RNA, 20 nt, Shigella flexneri 2a str. 301
ugauucauaguaagcagauu

SEQ ID NO: 2011536 - RNA, 19 nt, Shigella flexneri 2a str. 301
ugauucaucucuucuuccg

SEQ ID NO: 2011537 - RNA, 19 nt, Shigella flexneri 2a str. 301
ugauucauggcauuuucuc

SEQ ID NO: 2011538 - RNA, 19 nt, Shigella flexneri 2a str. 301
ugauuaacgcuuguaaaug

SEQ ID NO: 2011539 - RNA, 21 nt, Shigella flexneri 2a str. 301
ugauuaacgcuuguaaaugaa

SEQ ID NO: 2011540 - RNA, 20 nt, Shigella flexneri 2a str. 301
ugauuaacgcuuguaaauga

SEQ ID NO: 2011541 - RNA, 23 nt, Shigella flexneri 2a str. 301
ugauuacuuccuucauggggaug

SEQ ID NO: 2011542 - RNA, 18 nt, Shigella flexneri 2a str. 301
ugauuacgguauugcuau

SEQ ID NO: 2011543 - RNA, 20 nt, Shigella flexneri 2a str. 301
ugauuacacaaauccagcac

SEQ ID NO: 2011544 - RNA, 19 nt, Shigella flexneri 2a str. 301
ugauguggugcaaggaaau

SEQ ID NO: 2011545 - RNA, 16 nt, Shigella flexneri 2a str. 301
ugaugugauccaucag

SEQ ID NO: 2011546 - RNA, 22 nt, Shigella flexneri 2a str. 301
ugaugucagcacuuccagcucc

SEQ ID NO: 2011547 - RNA, 15 nt, Shigella flexneri 2a str. 301
ugauguccugcaucc

SEQ ID NO: 2011548 - RNA, 16 nt, Shigella flexneri 2a str. 301
ugaugucucuguuuug

SEQ ID NO: 2011549 - RNA, 19 nt, Shigella flexneri 2a str. 301
ugaugucggcauaaagcug

SEQ ID NO: 2011550 - RNA, 16 nt, Shigella flexneri 2a str. 301
ugauggugguggggga

SEQ ID NO: 2011551 - RNA, 13 nt, Shigella flexneri 2a str. 301
ugauggugguggg

SEQ ID NO: 2011552 - RNA, 21 nt, Shigella flexneri 2a str. 301
ugaugguaacgcgccaggauc

SEQ ID NO: 2011553 - RNA, 20 nt, Shigella flexneri 2a str. 301
ugaauugcacgaaggugcau

SEQ ID NO: 2011554 - RNA, 23 nt, Shigella flexneri 2a str. 301
ugaauuuuaggaugcugcaauaa

SEQ ID NO: 2011555 - RNA, 18 nt, Shigella flexneri 2a str. 301
ugaauuucuaucaaggcg

SEQ ID NO: 2011556 - RNA, 23 nt, Shigella flexneri 2a str. 301
ugaauuccgaauuucauccugua

SEQ ID NO: 2011557 - RNA, 15 nt, Shigella flexneri 2a str. 301
ugaauuacuucucuu

SEQ ID NO: 2011558 - RNA, 19 nt, Shigella flexneri 2a str. 301
ugaauuccgaauuucaucc

SEQ ID NO: 2011559 - RNA, 22 nt, Shigella flexneri 2a str. 301
ugaaugguggcgaugauuuccg

SEQ ID NO: 2011560 - RNA, 15 nt, Shigella flexneri 2a str. 301
ugaauguugcgcggu

SEQ ID NO: 2011561 - RNA, 21 nt, Shigella flexneri 2a str. 301
ugaauuaaacacgggguuaaa

SEQ ID NO: 2011562 - RNA, 20 nt, Shigella flexneri 2a str. 301
ugaaugcuuucauauuccag

SEQ ID NO: 2011563 - RNA, 14 nt, Shigella flexneri 2a str. 301
ugaaugcuuucaua

SEQ ID NO: 2011564 - RNA, 22 nt, Shigella flexneri 2a str. 301
ugaaugccaaauccggcaaaua

SEQ ID NO: 2011565 - RNA, 19 nt, Shigella flexneri 2a str. 301
ugaaugccccuuuaaauac

SEQ ID NO: 2011566 - RNA, 21 nt, Shigella flexneri 2a str. 301
ugaaugccccuuuaaauaccu

SEQ ID NO: 2011567 - RNA, 19 nt, Shigella flexneri 2a str. 301
ugaaugccguaggcccagc

SEQ ID NO: 2011568 - RNA, 13 nt, Shigella flexneri 2a str. 301
ugaaugcggcagg

SEQ ID NO: 2011569 - RNA, 23 nt, Shigella flexneri 2a str. 301
ugaaucucuuaucauccagguga

SEQ ID NO: 2011570 - RNA, 13 nt, Shigella flexneri 2a str. 301
ugaaucuuuucau

SEQ ID NO: 2011571 - RNA, 16 nt, Shigella flexneri 2a str. 301
ugaaugaguacugaug

SEQ ID NO: 2011572 - RNA, 15 nt, Shigella flexneri 2a str. 301
ugaaucacgccgccc

SEQ ID NO: 2011573 - RNA, 17 nt, Shigella flexneri 2a str. 301
ugaaucaccacaggccu

SEQ ID NO: 2011574 - RNA, 22 nt, Shigella flexneri 2a str. 301
ugaaucaaaaucaucaucuuua

SEQ ID NO: 2011575 - RNA, 13 nt, Shigella flexneri 2a str. 301
ugaaucaacacca

SEQ ID NO: 2011576 - RNA, 16 nt, Shigella flexneri 2a str. 301
ugaaucaaucagagcc

SEQ ID NO: 2011577 - RNA, 19 nt, Shigella flexneri 2a str. 301
ugaaucgggaccagcauuc

SEQ ID NO: 2011578 - RNA, 20 nt, Shigella flexneri 2a str. 301
ugaaucgggcgugauuccag

SEQ ID NO: 2011579 - RNA, 23 nt, Shigella flexneri 2a str. 301
ugaaucgcuauuaacccgcaaca

SEQ ID NO: 2011580 - RNA, 19 nt, Shigella flexneri 2a str. 301
ugacacaaucaaauccugc

SEQ ID NO: 2011581 - RNA, 15 nt, Shigella flexneri 2a str. 301
ugacacaaucaaauc

SEQ ID NO: 2011582 - RNA, 18 nt, Shigella flexneri 2a str. 301
ugacaacucaucacugua

SEQ ID NO: 2011583 - RNA, 18 nt, Shigella flexneri 2a str. 301
ugacaacuuucaucagca

SEQ ID NO: 2011584 - RNA, 21 nt, Shigella flexneri 2a str. 301
ugacaacuuucaucagcacaa

SEQ ID NO: 2011585 - RNA, 21 nt, Shigella flexneri 2a str. 301
ugacaauaauugucaacggca

SEQ ID NO: 2011586 - RNA, 22 nt, Shigella flexneri 2a str. 301
ugacagguugcucauaaaauga

SEQ ID NO: 2011587 - RNA, 17 nt, Shigella flexneri 2a str. 301
ugacaguaucgugacaa

SEQ ID NO: 2011588 - RNA, 20 nt, Shigella flexneri 2a str. 301
ugacagcuuauguugcuuac

SEQ ID NO: 2011589 - RNA, 17 nt, Shigella flexneri 2a str. 301
ugacagccuugcgugcc

SEQ ID NO: 2011590 - RNA, 17 nt, Shigella flexneri 2a str. 301
ugacagcgccgacuguu

SEQ ID NO: 2011591 - RNA, 18 nt, Shigella flexneri 2a str. 301
ugacagcgcgcgccgcca

SEQ ID NO: 2011592 - RNA, 17 nt, Shigella flexneri 2a str. 301
ugacagccaaagggcug

SEQ ID NO: 2011593 - RNA, 17 nt, Shigella flexneri 2a str. 301
ugacagcauaccuucac

SEQ ID NO: 2011594 - RNA, 19 nt, Shigella flexneri 2a str. 301
ugacagaguuccggcccua

SEQ ID NO: 2011595 - RNA, 23 nt, Shigella flexneri 2a str. 301
ugacagaccguugcucagaauca

SEQ ID NO: 2011596 - RNA, 17 nt, Shigella flexneri 2a str. 301
ugacacaucaccuccag

SEQ ID NO: 2011597 - RNA, 16 nt, Shigella flexneri 2a str. 301
ugacacaggcagcaau

SEQ ID NO: 2011598 - RNA, 14 nt, Shigella flexneri 2a str. 301
ugacaccagcacau

SEQ ID NO: 2011599 - RNA, 16 nt, Shigella flexneri 2a str. 301
ugacacgaauacggga

SEQ ID NO: 2011600 - RNA, 19 nt, Shigella flexneri 2a str. 301
ugaccgcguugcagcauau

SEQ ID NO: 2011601 - RNA, 14 nt, Shigella flexneri 2a str. 301
ugaccgcuccgcca

SEQ ID NO: 2011602 - RNA, 16 nt, Shigella flexneri 2a str. 301
ugaccgcgccauccau

SEQ ID NO: 2011603 - RNA, 16 nt, Shigella flexneri 2a str. 301
ugaccgcgcuggcaau

SEQ ID NO: 2011604 - RNA, 18 nt, Shigella flexneri 2a str. 301
ugaccgccgcagcaaccg

SEQ ID NO: 2011605 - RNA, 15 nt, Shigella flexneri 2a str. 301
ugacccaccccagca

SEQ ID NO: 2011606 - RNA, 22 nt, Shigella flexneri 2a str. 301
ugacccaccccagcagcagccg

SEQ ID NO: 2011607 - RNA, 15 nt, Shigella flexneri 2a str. 301
ugaccugacauuaag

SEQ ID NO: 2011608 - RNA, 17 nt, Shigella flexneri 2a str. 301
ugaccugcggcaccagc

SEQ ID NO: 2011609 - RNA, 20 nt, Shigella flexneri 2a str. 301
ugaccugcggcaccagcggu

SEQ ID NO: 2011610 - RNA, 16 nt, Shigella flexneri 2a str. 301
ugaccaguccggcuuu

SEQ ID NO: 2011611 - RNA, 18 nt, Shigella flexneri 2a str. 301
ugacauaguagccagcca

SEQ ID NO: 2011612 - RNA, 14 nt, Shigella flexneri 2a str. 301
ugacaguugucagc

SEQ ID NO: 2011613 - RNA, 20 nt, Shigella flexneri 2a str. 301
ugacauacucuuuccauugc

SEQ ID NO: 2011614 - RNA, 17 nt, Shigella flexneri 2a str. 301
ugaaaccagacacuuca

SEQ ID NO: 2011615 - RNA, 20 nt, Shigella flexneri 2a str. 301
ucuucgguucguaagcaaga

SEQ ID NO: 2011616 - RNA, 17 nt, Shigella flexneri 2a str. 301
ucuucgguucaaguccc

SEQ ID NO: 2011617 - RNA, 14 nt, Shigella flexneri 2a str. 301
ucuucguucgcugc

SEQ ID NO: 2011618 - RNA, 14 nt, Shigella flexneri 2a str. 301
ucuucguucuucuu

SEQ ID NO: 2011619 - RNA, 16 nt, Shigella flexneri 2a str. 301
ucuucggucagagaau

SEQ ID NO: 2011620 - RNA, 18 nt, Shigella flexneri 2a str. 301
ucuucggccauugaauau

SEQ ID NO: 2011621 - RNA, 17 nt, Shigella flexneri 2a str. 301
ucuucggcaaguguugg

SEQ ID NO: 2011622 - RNA, 21 nt, Shigella flexneri 2a str. 301
ugaaagugguuucaugauugc

SEQ ID NO: 2011623 - RNA, 19 nt, Shigella flexneri 2a str. 301
ugaaagaagcggugaaaaa

SEQ ID NO: 2011624 - RNA, 21 nt, Shigella flexneri 2a str. 301
ugaaagaagcggugaaaaaau

SEQ ID NO: 2011625 - RNA, 15 nt, Shigella flexneri 2a str. 301
ugaaaguaaaaaaga

SEQ ID NO: 2011626 - RNA, 20 nt, Shigella flexneri 2a str. 301
ugaaagagccgucauucugc

SEQ ID NO: 2011627 - RNA, 19 nt, Shigella flexneri 2a str. 301
ugaaauuacuuuccaucuu

SEQ ID NO: 2011628 - RNA, 22 nt, Shigella flexneri 2a str. 301
ugaaaugugccggaugcaucac

SEQ ID NO: 2011629 - RNA, 22 nt, Shigella flexneri 2a str. 301
ugaaauuuugggcgucuuuccg

SEQ ID NO: 2011630 - RNA, 22 nt, Shigella flexneri 2a str. 301
ugaaauuuaugcgcuaaauguu

SEQ ID NO: 2011631 - RNA, 20 nt, Shigella flexneri 2a str. 301
ugaacacgaucucacgcuga

SEQ ID NO: 2011632 - RNA, 19 nt, Shigella flexneri 2a str. 301
ugaacauagucauccucuc

SEQ ID NO: 2011633 - RNA, 16 nt, Shigella flexneri 2a str. 301
ugaacauuacuuuccg

SEQ ID NO: 2011634 - RNA, 19 nt, Shigella flexneri 2a str. 301
ugaaccagccaacuugccc

SEQ ID NO: 2011635 - RNA, 22 nt, Shigella flexneri 2a str. 301
ugaacaaaaaagaguaaaguua

SEQ ID NO: 2011636 - RNA, 21 nt, Shigella flexneri 2a str. 301
ugaacaccaaacccugaguga

SEQ ID NO: 2011637 - RNA, 13 nt, Shigella flexneri 2a str. 301
ugaacaauuucag

SEQ ID NO: 2011638 - RNA, 16 nt, Shigella flexneri 2a str. 301
ugaacaauuggauagu

SEQ ID NO: 2011639 - RNA, 17 nt, Shigella flexneri 2a str. 301
ugaacaauuaacguauc

SEQ ID NO: 2011640 - RNA, 23 nt, Shigella flexneri 2a str. 301
ugaacaauuaacguaucaauuag

SEQ ID NO: 2011641 - RNA, 18 nt, Shigella flexneri 2a str. 301
ugaauaccaagucucaag

SEQ ID NO: 2011642 - RNA, 15 nt, Shigella flexneri 2a str. 301
ugaauaauacacaca

SEQ ID NO: 2011643 - RNA, 18 nt, Shigella flexneri 2a str. 301
ugaagugagaauuuuuca

SEQ ID NO: 2011644 - RNA, 20 nt, Shigella flexneri 2a str. 301
ugaagugagaauuuuucacu

SEQ ID NO: 2011645 - RNA, 21 nt, Shigella flexneri 2a str. 301
ugaaguaaaaggucugaaaga

SEQ ID NO: 2011646 - RNA, 22 nt, Shigella flexneri 2a str. 301
ugaagguuucugcauuauccag

SEQ ID NO: 2011647 - RNA, 22 nt, Shigella flexneri 2a str. 301
ugaagugugcaaacgauaaaag

SEQ ID NO: 2011648 - RNA, 23 nt, Shigella flexneri 2a str. 301
ugaagugugcaaacgauaaaagu

SEQ ID NO: 2011649 - RNA, 17 nt, Shigella flexneri 2a str. 301
ugaauagcggaaaucuc

SEQ ID NO: 2011650 - RNA, 20 nt, Shigella flexneri 2a str. 301
ugaauagcggaaaucuccag

SEQ ID NO: 2011651 - RNA, 20 nt, Shigella flexneri 2a str. 301
ugaauagugccacaccagcu

SEQ ID NO: 2011652 - RNA, 18 nt, Shigella flexneri 2a str. 301
ugaauauuccuuaugguu

SEQ ID NO: 2011653 - RNA, 19 nt, Shigella flexneri 2a str. 301
ugaauaugucgcgccaggc

SEQ ID NO: 2011654 - RNA, 18 nt, Shigella flexneri 2a str. 301
ugaauauauccgaaaaag

SEQ ID NO: 2011655 - RNA, 17 nt, Shigella flexneri 2a str. 301
ugaauaucuccucugcu

SEQ ID NO: 2011656 - RNA, 22 nt, Shigella flexneri 2a str. 301
ugaagcccucgacauguucuau

SEQ ID NO: 2011657 - RNA, 23 nt, Shigella flexneri 2a str. 301
ugaagcucacuucgcuuacgccu

SEQ ID NO: 2011658 - RNA, 23 nt, Shigella flexneri 2a str. 301
ugaagcguucuucugcuucuuua

SEQ ID NO: 2011659 - RNA, 15 nt, Shigella flexneri 2a str. 301
ugaagaacucaaagc

SEQ ID NO: 2011660 - RNA, 21 nt, Shigella flexneri 2a str. 301
ugaagaacugcuugcccagca

SEQ ID NO: 2011661 - RNA, 23 nt, Shigella flexneri 2a str. 301
ugaagaaaucaguugauuaugau

SEQ ID NO: 2011662 - RNA, 22 nt, Shigella flexneri 2a str. 301
ugaacgagaaaagccaaccugc

SEQ ID NO: 2011663 - RNA, 18 nt, Shigella flexneri 2a str. 301
ugaacgaaauuauggugu

SEQ ID NO: 2011664 - RNA, 18 nt, Shigella flexneri 2a str. 301
ugaacgccaaauucuuua

SEQ ID NO: 2011665 - RNA, 20 nt, Shigella flexneri 2a str. 301
ugaacgccaaauucuuuauc

SEQ ID NO: 2011666 - RNA, 15 nt, Shigella flexneri 2a str. 301
ugaacgccaccccac

SEQ ID NO: 2011667 - RNA, 20 nt, Shigella flexneri 2a str. 301
ugaacgcaaauguaaaacca

SEQ ID NO: 2011668 - RNA, 19 nt, Shigella flexneri 2a str. 301
ucgccugguaccagcaccg

SEQ ID NO: 2011669 - RNA, 19 nt, Shigella flexneri 2a str. 301
ucgccuucagguuuuucag

SEQ ID NO: 2011670 - RNA, 12 nt, Shigella flexneri 2a str. 301
ucgccuuaauaa

SEQ ID NO: 2011671 - RNA, 22 nt, Shigella flexneri 2a str. 301
ucgcgaaccgccuggcgcugcu

SEQ ID NO: 2011672 - RNA, 16 nt, Shigella flexneri 2a str. 301
ucgcgauagcgcaccg

SEQ ID NO: 2011673 - RNA, 15 nt, Shigella flexneri 2a str. 301
ucgcgauauugcugc

SEQ ID NO: 2011674 - RNA, 21 nt, Shigella flexneri 2a str. 301
ucgcgauagccgcuuucuaac

SEQ ID NO: 2011675 - RNA, 12 nt, Shigella flexneri 2a str. 301
ucgcgacgcuga

SEQ ID NO: 2011676 - RNA, 15 nt, Shigella flexneri 2a str. 301
ucgcgaccucaagcu

SEQ ID NO: 2011677 - RNA, 23 nt, Shigella flexneri 2a str. 301
ucgcgaccgccucgcgccagcgu

SEQ ID NO: 2011678 - RNA, 16 nt, Shigella flexneri 2a str. 301
ucgcgaaucgccacaa

SEQ ID NO: 2011679 - RNA, 14 nt, Shigella flexneri 2a str. 301
ucgcgccagccagu

SEQ ID NO: 2011680 - RNA, 19 nt, Shigella flexneri 2a str. 301
ucgcgccgcauccggcauu

SEQ ID NO: 2011681 - RNA, 16 nt, Shigella flexneri 2a str. 301
ucgcgcaucagcaguu

SEQ ID NO: 2011682 - RNA, 13 nt, Shigella flexneri 2a str. 301
ucgcgcagcacuu

SEQ ID NO: 2011683 - RNA, 24 nt, Shigella flexneri 2a str. 301
ucgcgcacgaggaacagcgcgcug

SEQ ID NO: 2011684 - RNA, 20 nt, Shigella flexneri 2a str. 301
ucgccgcugacggcucgccc

SEQ ID NO: 2011685 - RNA, 16 nt, Shigella flexneri 2a str. 301
ucgccggaauuucuuu

SEQ ID NO: 2011686 - RNA, 22 nt, Shigella flexneri 2a str. 301
ucgccggaauuucuuucagcag

SEQ ID NO: 2011687 - RNA, 13 nt, Shigella flexneri 2a str. 301
ucgccuccuguuc

SEQ ID NO: 2011688 - RNA, 14 nt, Shigella flexneri 2a str. 301
ucgccugccgccag

SEQ ID NO: 2011689 - RNA, 17 nt, Shigella flexneri 2a str. 301
ucgccugcaccaugucc

SEQ ID NO: 2011690 - RNA, 22 nt, Shigella flexneri 2a str. 301
ucgccgguaguuucagcggcgu

SEQ ID NO: 2011691 - RNA, 14 nt, Shigella flexneri 2a str. 301
ucgccgaggcgcug

SEQ ID NO: 2011692 - RNA, 21 nt, Shigella flexneri 2a str. 301
ucgccgaugaaguacagccca

SEQ ID NO: 2011693 - RNA, 20 nt, Shigella flexneri 2a str. 301
ucgccgccagcgucugagca

SEQ ID NO: 2011694 - RNA, 17 nt, Shigella flexneri 2a str. 301
ucgccgccgcuggcgug

SEQ ID NO: 2011695 - RNA, 17 nt, Shigella flexneri 2a str. 301
ucgcccugcuccagcaa

SEQ ID NO: 2011696 - RNA, 15 nt, Shigella flexneri 2a str. 301
ucgcccguucauccg

SEQ ID NO: 2011697 - RNA, 15 nt, Shigella flexneri 2a str. 301
ucgcccacaccagau

SEQ ID NO: 2011698 - RNA, 13 nt, Shigella flexneri 2a str. 301
ucgcccacaucau

SEQ ID NO: 2011699 - RNA, 17 nt, Shigella flexneri 2a str. 301
ucgcccacgccagagau

SEQ ID NO: 2011700 - RNA, 14 nt, Shigella flexneri 2a str. 301
ucgccauuuuucag

SEQ ID NO: 2011701 - RNA, 19 nt, Shigella flexneri 2a str. 301
ucgccauuuucugccgcau

SEQ ID NO: 2011702 - RNA, 19 nt, Shigella flexneri 2a str. 301
ucgcccaguugaucaccag

SEQ ID NO: 2011703 - RNA, 15 nt, Shigella flexneri 2a str. 301
ucgcccggauaucca

SEQ ID NO: 2011704 - RNA, 12 nt, Shigella flexneri 2a str. 301
ucgcccccucuu

SEQ ID NO: 2011705 - RNA, 16 nt, Shigella flexneri 2a str. 301
ucgcccauuuuucaug

SEQ ID NO: 2011706 - RNA, 22 nt, Shigella flexneri 2a str. 301
ucgcccgaccaucgccagcuca

SEQ ID NO: 2011707 - RNA, 17 nt, Shigella flexneri 2a str. 301
ucgccccugcccuuuca

SEQ ID NO: 2011708 - RNA, 19 nt, Shigella flexneri 2a str. 301
ucgccaacaaucucuucca

SEQ ID NO: 2011709 - RNA, 21 nt, Shigella flexneri 2a str. 301
ucgccaaauuuggugcucagu

SEQ ID NO: 2011710 - RNA, 16 nt, Shigella flexneri 2a str. 301
uccauacgggcaugug

SEQ ID NO: 2011711 - RNA, 11 nt, Shigella flexneri 2a str. 301
uccauacuguc

SEQ ID NO: 2011712 - RNA, 15 nt, Shigella flexneri 2a str. 301
uccauacugucucca

SEQ ID NO: 2011713 - RNA, 16 nt, Shigella flexneri 2a str. 301
uccauaccuaaaaaau

SEQ ID NO: 2011714 - RNA, 18 nt, Shigella flexneri 2a str. 301
ucgccagaccgcagaagc

SEQ ID NO: 2011715 - RNA, 16 nt, Shigella flexneri 2a str. 301
ucgccacuaaagccug

SEQ ID NO: 2011716 - RNA, 19 nt, Shigella flexneri 2a str. 301
ucgccacggcaugaaagcg

SEQ ID NO: 2011717 - RNA, 16 nt, Shigella flexneri 2a str. 301
ucgccacggcaugaaa

SEQ ID NO: 2011718 - RNA, 23 nt, Shigella flexneri 2a str. 301
ucgccaggcguuugaaaaagcca

SEQ ID NO: 2011719 - RNA, 15 nt, Shigella flexneri 2a str. 301
ucgccagucccuuuc

SEQ ID NO: 2011720 - RNA, 16 nt, Shigella flexneri 2a str. 301
ucgccagucccuuuca

SEQ ID NO: 2011721 - RNA, 20 nt, Shigella flexneri 2a str. 301
ucgccagugccgcccaccac

SEQ ID NO: 2011722 - RNA, 22 nt, Shigella flexneri 2a str. 301
ucgccaucuuuacaccuuacuu

SEQ ID NO: 2011723 - RNA, 20 nt, Shigella flexneri 2a str. 301
ucgccaucccugucguccag

SEQ ID NO: 2011724 - RNA, 15 nt, Shigella flexneri 2a str. 301
ucgccaucaaaucac

SEQ ID NO: 2011725 - RNA, 15 nt, Shigella flexneri 2a str. 301
ucgccaucaaaggcu

SEQ ID NO: 2011726 - RNA, 17 nt, Shigella flexneri 2a str. 301
ucgccagcgccagcgcu

SEQ ID NO: 2011727 - RNA, 16 nt, Shigella flexneri 2a str. 301
ucgccagcaacacaaa

SEQ ID NO: 2011728 - RNA, 15 nt, Shigella flexneri 2a str. 301
ucgccagccaccaug

SEQ ID NO: 2011729 - RNA, 23 nt, Shigella flexneri 2a str. 301
ucgccagcccguagcuucccaua

SEQ ID NO: 2011730 - RNA, 19 nt, Shigella flexneri 2a str. 301
ucgccagcccguagcuucc

SEQ ID NO: 2011731 - RNA, 13 nt, Shigella flexneri 2a str. 301
ucgcugaagcuua

SEQ ID NO: 2011732 - RNA, 18 nt, Shigella flexneri 2a str. 301
ucgcugaagucucgccag

SEQ ID NO: 2011733 - RNA, 17 nt, Shigella flexneri 2a str. 301
ucgcucucuuucucgcu

SEQ ID NO: 2011734 - RNA, 19 nt, Shigella flexneri 2a str. 301
ucgcugauuucaccaucuu

SEQ ID NO: 2011735 - RNA, 23 nt, Shigella flexneri 2a str. 301
ucgcugauccucuaucuguuugc

SEQ ID NO: 2011736 - RNA, 20 nt, Shigella flexneri 2a str. 301
ucgcugauauacccuucauc

SEQ ID NO: 2011737 - RNA, 13 nt, Shigella flexneri 2a str. 301
ucgcuggcaggcc

SEQ ID NO: 2011738 - RNA, 21 nt, Shigella flexneri 2a str. 301
ucgcugcgcucuaaaaucauc

SEQ ID NO: 2011739 - RNA, 23 nt, Shigella flexneri 2a str. 301
ucgcugcgcucuaaaaucaucac

SEQ ID NO: 2011740 - RNA, 15 nt, Shigella flexneri 2a str. 301
ucgcugcuggaucug

SEQ ID NO: 2011741 - RNA, 11 nt, Shigella flexneri 2a str. 301
ucgcuggaagc

SEQ ID NO: 2011742 - RNA, 22 nt, Shigella flexneri 2a str. 301
ucgcucgagagagaaaauaauc

SEQ ID NO: 2011743 - RNA, 21 nt, Shigella flexneri 2a str. 301
ucgcucgcgccgcauccgaca

SEQ ID NO: 2011744 - RNA, 18 nt, Shigella flexneri 2a str. 301
ucgcuccagucaucgcuu

SEQ ID NO: 2011745 - RNA, 20 nt, Shigella flexneri 2a str. 301
ucgcuccauuccaucgccug

SEQ ID NO: 2011746 - RNA, 22 nt, Shigella flexneri 2a str. 301
ucgcucauaugacguaucaccg

SEQ ID NO: 2011747 - RNA, 19 nt, Shigella flexneri 2a str. 301
ucgcucaauauccugaccu

SEQ ID NO: 2011748 - RNA, 22 nt, Shigella flexneri 2a str. 301
ucgcucaaugcgcugaguguaa

SEQ ID NO: 2011749 - RNA, 23 nt, Shigella flexneri 2a str. 301
ucgcuauagacaccuugcaacuc

SEQ ID NO: 2011750 - RNA, 16 nt, Shigella flexneri 2a str. 301
ucgcuaucagcgccac

SEQ ID NO: 2011751 - RNA, 22 nt, Shigella flexneri 2a str. 301
ucgcuaauuucgccgaggcgcu

SEQ ID NO: 2011752 - RNA, 18 nt, Shigella flexneri 2a str. 301
ucgcgucuaaauuuugca

SEQ ID NO: 2011753 - RNA, 16 nt, Shigella flexneri 2a str. 301
ucgcgguuagcggcuu

SEQ ID NO: 2011754 - RNA, 17 nt, Shigella flexneri 2a str. 301
ucgcgcguuaucccuua

SEQ ID NO: 2011755 - RNA, 15 nt, Shigella flexneri 2a str. 301
ucgcgcuaauuccag

SEQ ID NO: 2011756 - RNA, 12 nt, Shigella flexneri 2a str. 301
ucgcgcgcugcc

SEQ ID NO: 2011757 - RNA, 14 nt, Shigella flexneri 2a str. 301
ucggaaaauuauuu

SEQ ID NO: 2011758 - RNA, 14 nt, Shigella flexneri 2a str. 301
ucgcuuugugcugg

SEQ ID NO: 2011759 - RNA, 12 nt, Shigella flexneri 2a str. 301
ucgcuuucucuu

SEQ ID NO: 2011760 - RNA, 18 nt, Shigella flexneri 2a str. 301
ucgcuuucgcuuucucuu

SEQ ID NO: 2011761 - RNA, 18 nt, Shigella flexneri 2a str. 301
ucgcuugcaggaucagcu

SEQ ID NO: 2011762 - RNA, 12 nt, Shigella flexneri 2a str. 301
ucgcuucauuua

SEQ ID NO: 2011763 - RNA, 18 nt, Shigella flexneri 2a str. 301
ucgcuuccauugagaaag

SEQ ID NO: 2011764 - RNA, 19 nt, Shigella flexneri 2a str. 301
ucgcuuccauugagaaagc

SEQ ID NO: 2011765 - RNA, 16 nt, Shigella flexneri 2a str. 301
ucgcuucuagugcuug

SEQ ID NO: 2011766 - RNA, 22 nt, Shigella flexneri 2a str. 301
ucgcuucgucgucaccugcguc

SEQ ID NO: 2011767 - RNA, 13 nt, Shigella flexneri 2a str. 301
ucgcuuacgccug

SEQ ID NO: 2011768 - RNA, 11 nt, Shigella flexneri 2a str. 301
ucgcuucaacc

SEQ ID NO: 2011769 - RNA, 16 nt, Shigella flexneri 2a str. 301
ucgcuucaugcccgcc

SEQ ID NO: 2011770 - RNA, 19 nt, Shigella flexneri 2a str. 301
ucgcugucuuccugguuuc

SEQ ID NO: 2011771 - RNA, 16 nt, Shigella flexneri 2a str. 301
ucgcugucgccauccc

SEQ ID NO: 2011772 - RNA, 13 nt, Shigella flexneri 2a str. 301
ucgcuuaagccau

SEQ ID NO: 2011773 - RNA, 15 nt, Shigella flexneri 2a str. 301
ucggaaugcaccgcc

SEQ ID NO: 2011774 - RNA, 20 nt, Shigella flexneri 2a str. 301
ucggaaugcaccgccugaua

SEQ ID NO: 2011775 - RNA, 19 nt, Shigella flexneri 2a str. 301
ucggacauguuuuccagca

SEQ ID NO: 2011776 - RNA, 16 nt, Shigella flexneri 2a str. 301
ucggagguucgaaucc

SEQ ID NO: 2011777 - RNA, 21 nt, Shigella flexneri 2a str. 301
ucggagaacugcaacucaccu

SEQ ID NO: 2011778 - RNA, 14 nt, Shigella flexneri 2a str. 301
ucggcauuggcaua

SEQ ID NO: 2011779 - RNA, 17 nt, Shigella flexneri 2a str. 301
ucggcauuaaccagucg

SEQ ID NO: 2011780 - RNA, 22 nt, Shigella flexneri 2a str. 301
ucggcaucaaaccauucccugc

SEQ ID NO: 2011781 - RNA, 20 nt, Shigella flexneri 2a str. 301
ucggcagaguugagcagucc

SEQ ID NO: 2011782 - RNA, 23 nt, Shigella flexneri 2a str. 301
ucggcacugcgaccgaucaccac

SEQ ID NO: 2011783 - RNA, 22 nt, Shigella flexneri 2a str. 301
ucggcaguaucagagauaacca

SEQ ID NO: 2011784 - RNA, 21 nt, Shigella flexneri 2a str. 301
ucggauaagacgcgccagcgu

SEQ ID NO: 2011785 - RNA, 14 nt, Shigella flexneri 2a str. 301
ucggcaaaauacau

SEQ ID NO: 2011786 - RNA, 19 nt, Shigella flexneri 2a str. 301
ucggcaaaauacaugaccg

SEQ ID NO: 2011787 - RNA, 22 nt, Shigella flexneri 2a str. 301
ucggauuggucgcucgcgccgc

SEQ ID NO: 2011788 - RNA, 17 nt, Shigella flexneri 2a str. 301
ucggcaauuucgcugcc

SEQ ID NO: 2011789 - RNA, 16 nt, Shigella flexneri 2a str. 301
ucggcacacacaucac

SEQ ID NO: 2011790 - RNA, 16 nt, Shigella flexneri 2a str. 301
ucggcaccagcgcaga

SEQ ID NO: 2011791 - RNA, 19 nt, Shigella flexneri 2a str. 301
ucggcaccagcgcagaaga

SEQ ID NO: 2011792 - RNA, 15 nt, Shigella flexneri 2a str. 301
ucggcaaacugcuga

SEQ ID NO: 2011793 - RNA, 14 nt, Shigella flexneri 2a str. 301
ucggcaaagcgcug

SEQ ID NO: 2011794 - RNA, 18 nt, Shigella flexneri 2a str. 301
ucggcaacaccucagcca

SEQ ID NO: 2011795 - RNA, 22 nt, Shigella flexneri 2a str. 301
ucgggcgauuuugcuuuuguca

SEQ ID NO: 2011796 - RNA, 21 nt, Shigella flexneri 2a str. 301
ucgggccguauugauuuucuu

SEQ ID NO: 2011797 - RNA, 22 nt, Shigella flexneri 2a str. 301
ucgggcuagacugaugacaaag

SEQ ID NO: 2011798 - RNA, 21 nt, Shigella flexneri 2a str. 301
ucgggcuuugcuacagccugg

SEQ ID NO: 2011799 - RNA, 20 nt, Shigella flexneri 2a str. 301
ucgggcaacguugaccaguc

SEQ ID NO: 2011800 - RNA, 20 nt, Shigella flexneri 2a str. 301
ucgggcaauggcuccgggug

SEQ ID NO: 2011801 - RNA, 15 nt, Shigella flexneri 2a str. 301
ucgggcacagcggug

SEQ ID NO: 2011802 - RNA, 17 nt, Shigella flexneri 2a str. 301
ucgggcagaaugcccug

SEQ ID NO: 2011803 - RNA, 23 nt, Shigella flexneri 2a str. 301
ucgggcagaaugcccugcggcug

SEQ ID NO: 2011804 - RNA, 14 nt, Shigella flexneri 2a str. 301
ucgggcaucagaag

SEQ ID NO: 2011805 - RNA, 18 nt, Shigella flexneri 2a str. 301
ucgggugcgacaggagcc

SEQ ID NO: 2011806 - RNA, 19 nt, Shigella flexneri 2a str. 301
ucggggcuguuuuccagca

SEQ ID NO: 2011807 - RNA, 17 nt, Shigella flexneri 2a str. 301
ucggggcuguuuuccag

SEQ ID NO: 2011808 - RNA, 16 nt, Shigella flexneri 2a str. 301
ucgguagcagcuuuca

SEQ ID NO: 2011809 - RNA, 14 nt, Shigella flexneri 2a str. 301
ucgguguccacuuc

SEQ ID NO: 2011810 - RNA, 16 nt, Shigella flexneri 2a str. 301
ucgguggaaaauagca

SEQ ID NO: 2011811 - RNA, 14 nt, Shigella flexneri 2a str. 301
ucgguuguuuucag

SEQ ID NO: 2011812 - RNA, 14 nt, Shigella flexneri 2a str. 301
ucgguuucaucaca

SEQ ID NO: 2011813 - RNA, 16 nt, Shigella flexneri 2a str. 301
ucgguucgccugcacc

SEQ ID NO: 2011814 - RNA, 20 nt, Shigella flexneri 2a str. 301
ucgguuuucgcgccagccag

SEQ ID NO: 2011815 - RNA, 22 nt, Shigella flexneri 2a str. 301
ucgguccaccacguaccacggc

SEQ ID NO: 2011816 - RNA, 19 nt, Shigella flexneri 2a str. 301
ucggucuuagcaaaggcuu

SEQ ID NO: 2011817 - RNA, 14 nt, Shigella flexneri 2a str. 301
ucgguauuuccauu

SEQ ID NO: 2011818 - RNA, 15 nt, Shigella flexneri 2a str. 301
ucggucagacccagu

SEQ ID NO: 2011819 - RNA, 14 nt, Shigella flexneri 2a str. 301
ucggucaaguaauu

SEQ ID NO: 2011820 - RNA, 14 nt, Shigella flexneri 2a str. 301
ucggucagcacgcg

SEQ ID NO: 2011821 - RNA, 15 nt, Shigella flexneri 2a str. 301
ucggugcgcugugug

SEQ ID NO: 2011822 - RNA, 15 nt, Shigella flexneri 2a str. 301
ucggugcaaaugcca

SEQ ID NO: 2011823 - RNA, 17 nt, Shigella flexneri 2a str. 301
ucggugcaaaugccaga

SEQ ID NO: 2011824 - RNA, 19 nt, Shigella flexneri 2a str. 301
ucggugcacuguaugaaac

SEQ ID NO: 2011825 - RNA, 15 nt, Shigella flexneri 2a str. 301
ucggugacagaaacu

SEQ ID NO: 2011826 - RNA, 14 nt, Shigella flexneri 2a str. 301
ucggugaauucagc

SEQ ID NO: 2011827 - RNA, 16 nt, Shigella flexneri 2a str. 301
ucggcgcagguuuaau

SEQ ID NO: 2011828 - RNA, 13 nt, Shigella flexneri 2a str. 301
ucggcgcaaucgc

SEQ ID NO: 2011829 - RNA, 19 nt, Shigella flexneri 2a str. 301
ucggcgagucgcuccugcc

SEQ ID NO: 2011830 - RNA, 22 nt, Shigella flexneri 2a str. 301
ucggcuucugccuuauccagca

SEQ ID NO: 2011831 - RNA, 16 nt, Shigella flexneri 2a str. 301
ucggcuucauuggcgc

SEQ ID NO: 2011832 - RNA, 22 nt, Shigella flexneri 2a str. 301
ucggcuuugaauaucuccucug

SEQ ID NO: 2011833 - RNA, 22 nt, Shigella flexneri 2a str. 301
ucgggaaggcccuuucccuucu

SEQ ID NO: 2011834 - RNA, 18 nt, Shigella flexneri 2a str. 301
ucgggaacgcuuuugcau

SEQ ID NO: 2011835 - RNA, 17 nt, Shigella flexneri 2a str. 301
ucgggagguaaugacuc

SEQ ID NO: 2011836 - RNA, 12 nt, Shigella flexneri 2a str. 301
ucggcggcggca

SEQ ID NO: 2011837 - RNA, 19 nt, Shigella flexneri 2a str. 301
ucggcguaauccugaaagc

SEQ ID NO: 2011838 - RNA, 22 nt, Shigella flexneri 2a str. 301
ucggcgugaacgcgcucgacuu

SEQ ID NO: 2011839 - RNA, 12 nt, Shigella flexneri 2a str. 301
ucgucccagucg

SEQ ID NO: 2011840 - RNA, 19 nt, Shigella flexneri 2a str. 301
ucguccauuucagcgcaga

SEQ ID NO: 2011841 - RNA, 16 nt, Shigella flexneri 2a str. 301
ucguccacuugaaaau

SEQ ID NO: 2011842 - RNA, 17 nt, Shigella flexneri 2a str. 301
ucguccacgucaucaaa

SEQ ID NO: 2011843 - RNA, 14 nt, Shigella flexneri 2a str. 301
ucgucagaaauggu

SEQ ID NO: 2011844 - RNA, 21 nt, Shigella flexneri 2a str. 301
ucgucacgcgcgccaagcccg

SEQ ID NO: 2011845 - RNA, 13 nt, Shigella flexneri 2a str. 301
ucgucaucccagu

SEQ ID NO: 2011846 - RNA, 15 nt, Shigella flexneri 2a str. 301
ucgucaucagcucca

SEQ ID NO: 2011847 - RNA, 23 nt, Shigella flexneri 2a str. 301
ucgucaggaucagccauuuugca

SEQ ID NO: 2011848 - RNA, 22 nt, Shigella flexneri 2a str. 301
ucgucaguuccauaauguacau

SEQ ID NO: 2011849 - RNA, 14 nt, Shigella flexneri 2a str. 301
ucgucaguuuauac

SEQ ID NO: 2011850 - RNA, 14 nt, Shigella flexneri 2a str. 301
ucguccuucacauu

SEQ ID NO: 2011851 - RNA, 15 nt, Shigella flexneri 2a str. 301
ucgucgcgcacgccc

SEQ ID NO: 2011852 - RNA, 19 nt, Shigella flexneri 2a str. 301
ucgucgggcuggugcugaa

SEQ ID NO: 2011853 - RNA, 19 nt, Shigella flexneri 2a str. 301
ucguaccaucauuggagag

SEQ ID NO: 2011854 - RNA, 18 nt, Shigella flexneri 2a str. 301
ucguagccaccaucuuuu

SEQ ID NO: 2011855 - RNA, 16 nt, Shigella flexneri 2a str. 301
ucguagccaccaucuu

SEQ ID NO: 2011856 - RNA, 15 nt, Shigella flexneri 2a str. 301
ucguacucaccagac

SEQ ID NO: 2011857 - RNA, 16 nt, Shigella flexneri 2a str. 301
ucguacucaccagaca

SEQ ID NO: 2011858 - RNA, 12 nt, Shigella flexneri 2a str. 301
ucguaaguaagc

SEQ ID NO: 2011859 - RNA, 15 nt, Shigella flexneri 2a str. 301
ucguaaugaauguuu

SEQ ID NO: 2011860 - RNA, 21 nt, Shigella flexneri 2a str. 301
ucguaauaacucacccaugaa

SEQ ID NO: 2011861 - RNA, 18 nt, Shigella flexneri 2a str. 301
ucguauugguacauaaca

SEQ ID NO: 2011862 - RNA, 13 nt, Shigella flexneri 2a str. 301
ucguauuuaaaac

SEQ ID NO: 2011863 - RNA, 15 nt, Shigella flexneri 2a str. 301
ucguauuuaaaaccc

SEQ ID NO: 2011864 - RNA, 17 nt, Shigella flexneri 2a str. 301
ucguagcguuuuuucau

SEQ ID NO: 2011865 - RNA, 14 nt, Shigella flexneri 2a str. 301
ucguaggccugaua

SEQ ID NO: 2011866 - RNA, 15 nt, Shigella flexneri 2a str. 301
ucguaguaguucauc

SEQ ID NO: 2011867 - RNA, 18 nt, Shigella flexneri 2a str. 301
ucgucgguguccacuucc

SEQ ID NO: 2011868 - RNA, 14 nt, Shigella flexneri 2a str. 301
ucgucuguuuuauc

SEQ ID NO: 2011869 - RNA, 17 nt, Shigella flexneri 2a str. 301
ucgucuggcgauuuuga

SEQ ID NO: 2011870 - RNA, 22 nt, Shigella flexneri 2a str. 301
ucgugaauuuuaggaugcugca

SEQ ID NO: 2011871 - RNA, 21 nt, Shigella flexneri 2a str. 301
ucgugaagcuggcagaaguug

SEQ ID NO: 2011872 - RNA, 22 nt, Shigella flexneri 2a str. 301
ucgugaagcuggcagaaguugu

SEQ ID NO: 2011873 - RNA, 22 nt, Shigella flexneri 2a str. 301
ucgucuuuuucucccuuaaaaa

SEQ ID NO: 2011874 - RNA, 16 nt, Shigella flexneri 2a str. 301
ucgucuuuauccugac

SEQ ID NO: 2011875 - RNA, 17 nt, Shigella flexneri 2a str. 301
ucgucuucgucccaguc

SEQ ID NO: 2011876 - RNA, 10 nt, Shigella flexneri 2a str. 301
ucgugcuaaa

SEQ ID NO: 2011877 - RNA, 12 nt, Shigella flexneri 2a str. 301
ucgugcucgcuu

SEQ ID NO: 2011878 - RNA, 18 nt, Shigella flexneri 2a str. 301
ucgugcggguaaccagcc

SEQ ID NO: 2011879 - RNA, 13 nt, Shigella flexneri 2a str. 301
ucgugcaccaauu

SEQ ID NO: 2011880 - RNA, 10 nt, Shigella flexneri 2a str. 301
ucgugcagaa

SEQ ID NO: 2011881 - RNA, 14 nt, Shigella flexneri 2a str. 301
ucguggagaacaau

SEQ ID NO: 2011882 - RNA, 23 nt, Shigella flexneri 2a str. 301
ucguguugcaccgaguucuucac

SEQ ID NO: 2011883 - RNA, 11 nt, Shigella flexneri 2a str. 301
ucguguuaaca

SEQ ID NO: 2011884 - RNA, 16 nt, Shigella flexneri 2a str. 301
ucguuaaauucuaaug

SEQ ID NO: 2011885 - RNA, 16 nt, Shigella flexneri 2a str. 301
ucguuaaacucugccg

SEQ ID NO: 2011886 - RNA, 19 nt, Shigella flexneri 2a str. 301
ucguuaacaacaacuucua

SEQ ID NO: 2011887 - RNA, 18 nt, Shigella flexneri 2a str. 301
ucguguggaguaauaauu

SEQ ID NO: 2011888 - RNA, 22 nt, Shigella flexneri 2a str. 301
ucguuacgccccgguuucucuu

SEQ ID NO: 2011889 - RNA, 18 nt, Shigella flexneri 2a str. 301
ucguucgcaccaaaucca

SEQ ID NO: 2011890 - RNA, 13 nt, Shigella flexneri 2a str. 301
ucguucauauauu

SEQ ID NO: 2011891 - RNA, 12 nt, Shigella flexneri 2a str. 301
ucguucagaucu

SEQ ID NO: 2011892 - RNA, 19 nt, Shigella flexneri 2a str. 301
ucguucucugcaaucacca

SEQ ID NO: 2011893 - RNA, 17 nt, Shigella flexneri 2a str. 301
ucguugccgaagcggcg

SEQ ID NO: 2011894 - RNA, 23 nt, Shigella flexneri 2a str. 301
ucguugccugcgaagcucuuucg

SEQ ID NO: 2011895 - RNA, 21 nt, Shigella flexneri 2a str. 301
ucguugugggccgaaaugaga

SEQ ID NO: 2011896 - RNA, 19 nt, Shigella flexneri 2a str. 301
ucuccacuauaaaaaaacc

SEQ ID NO: 2011897 - RNA, 22 nt, Shigella flexneri 2a str. 301
ucuccaacaucgaaaacgccac

SEQ ID NO: 2011898 - RNA, 18 nt, Shigella flexneri 2a str. 301
ucuccagcaguucuacug

SEQ ID NO: 2011899 - RNA, 15 nt, Shigella flexneri 2a str. 301
ucuccagcuccccac

SEQ ID NO: 2011900 - RNA, 19 nt, Shigella flexneri 2a str. 301
ucuccagcuucaaaucauu

SEQ ID NO: 2011901 - RNA, 18 nt, Shigella flexneri 2a str. 301
ucucauccaauaacguga

SEQ ID NO: 2011902 - RNA, 13 nt, Shigella flexneri 2a str. 301
ucucauuuuucag

SEQ ID NO: 2011903 - RNA, 12 nt, Shigella flexneri 2a str. 301
ucucauuuuuca

SEQ ID NO: 2011904 - RNA, 20 nt, Shigella flexneri 2a str. 301
ucucccgaaaaaccugacgu

SEQ ID NO: 2011905 - RNA, 20 nt, Shigella flexneri 2a str. 301
ucucccucaucauuugaaau

SEQ ID NO: 2011906 - RNA, 20 nt, Shigella flexneri 2a str. 301
ucucccuacagagcgaggga

SEQ ID NO: 2011907 - RNA, 22 nt, Shigella flexneri 2a str. 301
ucucccgauaaccuucuucauu

SEQ ID NO: 2011908 - RNA, 18 nt, Shigella flexneri 2a str. 301
ucucccuguaucccagau

SEQ ID NO: 2011909 - RNA, 15 nt, Shigella flexneri 2a str. 301
ucuccauuucauuga

SEQ ID NO: 2011910 - RNA, 23 nt, Shigella flexneri 2a str. 301
ucucgcgcagcgguuucacagga

SEQ ID NO: 2011911 - RNA, 23 nt, Shigella flexneri 2a str. 301
ucucgcucaaaaauccagauuua

SEQ ID NO: 2011912 - RNA, 13 nt, Shigella flexneri 2a str. 301
ucucgccagcacu

SEQ ID NO: 2011913 - RNA, 17 nt, Shigella flexneri 2a str. 301
ucuccuuuaccacucuc

SEQ ID NO: 2011914 - RNA, 22 nt, Shigella flexneri 2a str. 301
ucuccuuuaccgugguugcgcc

SEQ ID NO: 2011915 - RNA, 11 nt, Shigella flexneri 2a str. 301
ucuccuucacg

SEQ ID NO: 2011916 - RNA, 15 nt, Shigella flexneri 2a str. 301
ucuccuucacucuau

SEQ ID NO: 2011917 - RNA, 13 nt, Shigella flexneri 2a str. 301
ucuccuucgcaca

SEQ ID NO: 2011918 - RNA, 15 nt, Shigella flexneri 2a str. 301
ucuccuuugccaaaa

SEQ ID NO: 2011919 - RNA, 15 nt, Shigella flexneri 2a str. 301
ucucgaucacuucgc

SEQ ID NO: 2011920 - RNA, 20 nt, Shigella flexneri 2a str. 301
ucuccggcgcauccaugaua

SEQ ID NO: 2011921 - RNA, 11 nt, Shigella flexneri 2a str. 301
ucuccggcguu

SEQ ID NO: 2011922 - RNA, 20 nt, Shigella flexneri 2a str. 301
ucuccgucaacguuaacuuu

SEQ ID NO: 2011923 - RNA, 13 nt, Shigella flexneri 2a str. 301
ucuccucccuugu

SEQ ID NO: 2011924 - RNA, 20 nt, Shigella flexneri 2a str. 301
ucuccugcggcgacaaaugu

SEQ ID NO: 2011925 - RNA, 21 nt, Shigella flexneri 2a str. 301
ucuccugcgccucuccacacg

SEQ ID NO: 2011926 - RNA, 15 nt, Shigella flexneri 2a str. 301
ucuccugcgccuguc

SEQ ID NO: 2011927 - RNA, 14 nt, Shigella flexneri 2a str. 301
ucuccuuacugccc

SEQ ID NO: 2011928 - RNA, 17 nt, Shigella flexneri 2a str. 301
ucuccuguugugaugca

SEQ ID NO: 2011929 - RNA, 18 nt, Shigella flexneri 2a str. 301
ucuccuguugugaugcaa

SEQ ID NO: 2011930 - RNA, 17 nt, Shigella flexneri 2a str. 301
ucuccuguucucacuaa

SEQ ID NO: 2011931 - RNA, 20 nt, Shigella flexneri 2a str. 301
ucucucugauuacccuucgc

SEQ ID NO: 2011932 - RNA, 17 nt, Shigella flexneri 2a str. 301
ucucuauuccaccauca

SEQ ID NO: 2011933 - RNA, 13 nt, Shigella flexneri 2a str. 301
ucucucagcacac

SEQ ID NO: 2011934 - RNA, 15 nt, Shigella flexneri 2a str. 301
ucucggcgcggcccu

SEQ ID NO: 2011935 - RNA, 22 nt, Shigella flexneri 2a str. 301
ucucgcuucguagcaggcaggc

SEQ ID NO: 2011936 - RNA, 13 nt, Shigella flexneri 2a str. 301
ucucgcuucugag

SEQ ID NO: 2011937 - RNA, 13 nt, Shigella flexneri 2a str. 301
ucucgugccacca

SEQ ID NO: 2011938 - RNA, 17 nt, Shigella flexneri 2a str. 301
ucucgugccaccagugc

SEQ ID NO: 2011939 - RNA, 20 nt, Shigella flexneri 2a str. 301
ucucgugccaccagugcagg

SEQ ID NO: 2011940 - RNA, 17 nt, Shigella flexneri 2a str. 301
ucucguugaucacccac

SEQ ID NO: 2011941 - RNA, 22 nt, Shigella flexneri 2a str. 301
ucucugaaguagccaguaccac

SEQ ID NO: 2011942 - RNA, 17 nt, Shigella flexneri 2a str. 301
ucucugacgcucucuac

SEQ ID NO: 2011943 - RNA, 13 nt, Shigella flexneri 2a str. 301
ucucuucuccuug

SEQ ID NO: 2011944 - RNA, 18 nt, Shigella flexneri 2a str. 301
ucucuugccgguuuugca

SEQ ID NO: 2011945 - RNA, 18 nt, Shigella flexneri 2a str. 301
ucugacgcugaauacgca

SEQ ID NO: 2011946 - RNA, 14 nt, Shigella flexneri 2a str. 301
ucugacgaaaucaa

SEQ ID NO: 2011947 - RNA, 16 nt, Shigella flexneri 2a str. 301
ucugacgccaccauuc

SEQ ID NO: 2011948 - RNA, 23 nt, Shigella flexneri 2a str. 301
ucugacauuuuuacuccuuagca

SEQ ID NO: 2011949 - RNA, 22 nt, Shigella flexneri 2a str. 301
ucugacaccaucacccaacaau

SEQ ID NO: 2011950 - RNA, 19 nt, Shigella flexneri 2a str. 301
ucugacauccgaccaaugc

SEQ ID NO: 2011951 - RNA, 23 nt, Shigella flexneri 2a str. 301
ucugacauaaccacucaccgccg

SEQ ID NO: 2011952 - RNA, 18 nt, Shigella flexneri 2a str. 301
ucucuuucggcagugcca

SEQ ID NO: 2011953 - RNA, 16 nt, Shigella flexneri 2a str. 301
ucugcaaucaccacug

SEQ ID NO: 2011954 - RNA, 20 nt, Shigella flexneri 2a str. 301
ucugcacguuuugcugaugc

SEQ ID NO: 2011955 - RNA, 21 nt, Shigella flexneri 2a str. 301
ucugagcugggccguuguucu

SEQ ID NO: 2011956 - RNA, 12 nt, Shigella flexneri 2a str. 301
ucugcaaggcga

SEQ ID NO: 2011957 - RNA, 19 nt, Shigella flexneri 2a str. 301
ucugcaagguucuuugcug

SEQ ID NO: 2011958 - RNA, 17 nt, Shigella flexneri 2a str. 301
ucugcaagcaucauaaa

SEQ ID NO: 2011959 - RNA, 19 nt, Shigella flexneri 2a str. 301
ucugauacuaaugccauau

SEQ ID NO: 2011960 - RNA, 19 nt, Shigella flexneri 2a str. 301
ucuuauccagcugcgcgcg

SEQ ID NO: 2011961 - RNA, 20 nt, Shigella flexneri 2a str. 301
ucuuaucaugccuacauauu

SEQ ID NO: 2011962 - RNA, 21 nt, Shigella flexneri 2a str. 301
ucuuaucaugccuacauauuu

SEQ ID NO: 2011963 - RNA, 16 nt, Shigella flexneri 2a str. 301
ucuuaucaggccugug

SEQ ID NO: 2011964 - RNA, 22 nt, Shigella flexneri 2a str. 301
ucuuaucaggccuaccuuaacc

SEQ ID NO: 2011965 - RNA, 21 nt, Shigella flexneri 2a str. 301
ucuuaucaggccuacaacucc

SEQ ID NO: 2011966 - RNA, 23 nt, Shigella flexneri 2a str. 301
ucuuaucacgaugcuaaaaacau

SEQ ID NO: 2011967 - RNA, 17 nt, Shigella flexneri 2a str. 301
ucuuauaugaugaaacu

SEQ ID NO: 2011968 - RNA, 19 nt, Shigella flexneri 2a str. 301
ucuucaagaaucauaggcu

SEQ ID NO: 2011969 - RNA, 22 nt, Shigella flexneri 2a str. 301
ucuuauccggccuacguguguu

SEQ ID NO: 2011970 - RNA, 16 nt, Shigella flexneri 2a str. 301
ucuuaucuaacaaccu

SEQ ID NO: 2011971 - RNA, 22 nt, Shigella flexneri 2a str. 301
ucuucaaccgcagugauuucaa

SEQ ID NO: 2011972 - RNA, 18 nt, Shigella flexneri 2a str. 301
ucuuacguaauuuauaau

SEQ ID NO: 2011973 - RNA, 17 nt, Shigella flexneri 2a str. 301
ucuuaccgcuucaauua

SEQ ID NO: 2011974 - RNA, 21 nt, Shigella flexneri 2a str. 301
ucuuaccggucccuucaaucu

SEQ ID NO: 2011975 - RNA, 18 nt, Shigella flexneri 2a str. 301
ucuguuguaauaguguau

SEQ ID NO: 2011976 - RNA, 23 nt, Shigella flexneri 2a str. 301
ucuguugugccacauccaguggc

SEQ ID NO: 2011977 - RNA, 14 nt, Shigella flexneri 2a str. 301
ucuguugugccaca

SEQ ID NO: 2011978 - RNA, 16 nt, Shigella flexneri 2a str. 301
ucuguuucaucucuuc

SEQ ID NO: 2011979 - RNA, 12 nt, Shigella flexneri 2a str. 301
ucuguuaauguu

SEQ ID NO: 2011980 - RNA, 14 nt, Shigella flexneri 2a str. 301
ucuguuaauguuag

SEQ ID NO: 2011981 - RNA, 13 nt, Shigella flexneri 2a str. 301
ucuuccaguuccg

SEQ ID NO: 2011982 - RNA, 20 nt, Shigella flexneri 2a str. 301
ucuuccagugccucaagaau

SEQ ID NO: 2011983 - RNA, 22 nt, Shigella flexneri 2a str. 301
ucuuccauugcuuugguaaaug

SEQ ID NO: 2011984 - RNA, 21 nt, Shigella flexneri 2a str. 301
ucuuccggcgauucuuugcug

SEQ ID NO: 2011985 - RNA, 17 nt, Shigella flexneri 2a str. 301
ucuuccggcgauucuuu

SEQ ID NO: 2011986 - RNA, 19 nt, Shigella flexneri 2a str. 301
ucuuccggcaccauuccac

SEQ ID NO: 2011987 - RNA, 17 nt, Shigella flexneri 2a str. 301
ucuucccagcccccgca

SEQ ID NO: 2011988 - RNA, 11 nt, Shigella flexneri 2a str. 301
ucuucccagcc

SEQ ID NO: 2011989 - RNA, 23 nt, Shigella flexneri 2a str. 301
ucuucgccugccugcagcugcuc

SEQ ID NO: 2011990 - RNA, 13 nt, Shigella flexneri 2a str. 301
ucuucaaugguca

SEQ ID NO: 2011991 - RNA, 14 nt, Shigella flexneri 2a str. 301
ucuucacaucauca

SEQ ID NO: 2011992 - RNA, 16 nt, Shigella flexneri 2a str. 301
ucuucacggaaaauau

SEQ ID NO: 2011993 - RNA, 21 nt, Shigella flexneri 2a str. 301
ucuucacguuuuucgaaaauc

SEQ ID NO: 2011994 - RNA, 18 nt, Shigella flexneri 2a str. 301
ucuucacgcgcagaucgu

SEQ ID NO: 2011995 - RNA, 13 nt, Shigella flexneri 2a str. 301
ucuucacggaaaa

SEQ ID NO: 2011996 - RNA, 15 nt, Shigella flexneri 2a str. 301
ucuucaccagauugu

SEQ ID NO: 2011997 - RNA, 18 nt, Shigella flexneri 2a str. 301
ucuucacuguccgucaga

SEQ ID NO: 2011998 - RNA, 14 nt, Shigella flexneri 2a str. 301
ucuuccacgccugc

SEQ ID NO: 2011999 - RNA, 16 nt, Shigella flexneri 2a str. 301
ucuuccacgccugcau

SEQ ID NO: 2012000 - RNA, 19 nt, Shigella flexneri 2a str. 301
ucuuccagaauaaacaacu

SEQ ID NO: 2012001 - RNA, 16 nt, Shigella flexneri 2a str. 301
ucuuccagcaaaucca

SEQ ID NO: 2012002 - RNA, 21 nt, Shigella flexneri 2a str. 301
ucuuccagcagcggcagauca

SEQ ID NO: 2012003 - RNA, 13 nt, Shigella flexneri 2a str. 301
ucuguaacaaggu

SEQ ID NO: 2012004 - RNA, 22 nt, Shigella flexneri 2a str. 301
ucugguuuuucugaaaacuguu

SEQ ID NO: 2012005 - RNA, 20 nt, Shigella flexneri 2a str. 301
ucugguucgccaaaugucac

SEQ ID NO: 2012006 - RNA, 22 nt, Shigella flexneri 2a str. 301
ucugguucgccaaaugucacca

SEQ ID NO: 2012007 - RNA, 19 nt, Shigella flexneri 2a str. 301
ucugguguggagugcagca

SEQ ID NO: 2012008 - RNA, 22 nt, Shigella flexneri 2a str. 301
ucugguuucaguaauccuuucu

SEQ ID NO: 2012009 - RNA, 14 nt, Shigella flexneri 2a str. 301
ucugguuguggugg

SEQ ID NO: 2012010 - RNA, 21 nt, Shigella flexneri 2a str. 301
ucugguuucaguaauccuuuc

SEQ ID NO: 2012011 - RNA, 21 nt, Shigella flexneri 2a str. 301
ucuguaauugaaggcuuauaa

SEQ ID NO: 2012012 - RNA, 18 nt, Shigella flexneri 2a str. 301
ucuguauauaaauguuaa

SEQ ID NO: 2012013 - RNA, 22 nt, Shigella flexneri 2a str. 301
ucugucaguggacgauaagcac

SEQ ID NO: 2012014 - RNA, 15 nt, Shigella flexneri 2a str. 301
ucugucagguaacaa

SEQ ID NO: 2012015 - RNA, 18 nt, Shigella flexneri 2a str. 301
ucugucaguuggcugugg

SEQ ID NO: 2012016 - RNA, 14 nt, Shigella flexneri 2a str. 301
ucuguaugacaaca

SEQ ID NO: 2012017 - RNA, 15 nt, Shigella flexneri 2a str. 301
ucuguggcagggcag

SEQ ID NO: 2012018 - RNA, 18 nt, Shigella flexneri 2a str. 301
ucugucugauaaaaaacc

SEQ ID NO: 2012019 - RNA, 18 nt, Shigella flexneri 2a str. 301
ucugccacgccacgcugc

SEQ ID NO: 2012020 - RNA, 13 nt, Shigella flexneri 2a str. 301
ucugccacgccac

SEQ ID NO: 2012021 - RNA, 22 nt, Shigella flexneri 2a str. 301
ucugccaacuuugccgugaaca

SEQ ID NO: 2012022 - RNA, 11 nt, Shigella flexneri 2a str. 301
ucuggaugaaa

SEQ ID NO: 2012023 - RNA, 15 nt, Shigella flexneri 2a str. 301
ucugccagcaaauag

SEQ ID NO: 2012024 - RNA, 17 nt, Shigella flexneri 2a str. 301
ucugccagcugcucaua

SEQ ID NO: 2012025 - RNA, 23 nt, Shigella flexneri 2a str. 301
ucugcuucguuaacgugucauaa

SEQ ID NO: 2012026 - RNA, 23 nt, Shigella flexneri 2a str. 301
ucugcuucugccaguuguugcug

SEQ ID NO: 2012027 - RNA, 14 nt, Shigella flexneri 2a str. 301
ucugcuucugccug

SEQ ID NO: 2012028 - RNA, 16 nt, Shigella flexneri 2a str. 301
ucugcuucugccuggg

SEQ ID NO: 2012029 - RNA, 19 nt, Shigella flexneri 2a str. 301
ucugcuucugccugggccu

SEQ ID NO: 2012030 - RNA, 18 nt, Shigella flexneri 2a str. 301
ucuggcgucaaagcugcu

SEQ ID NO: 2012031 - RNA, 21 nt, Shigella flexneri 2a str. 301
ucuggcaccuguaccagcccg

SEQ ID NO: 2012032 - RNA, 16 nt, Shigella flexneri 2a str. 301
ucuggcagauccugaa

SEQ ID NO: 2012033 - RNA, 17 nt, Shigella flexneri 2a str. 301
ucuggcagauccugaaa

SEQ ID NO: 2012034 - RNA, 20 nt, Shigella flexneri 2a str. 301
ucuggcagauccugaaauuc

SEQ ID NO: 2012035 - RNA, 15 nt, Shigella flexneri 2a str. 301
ucuggauuuggcugc

SEQ ID NO: 2012036 - RNA, 20 nt, Shigella flexneri 2a str. 301
ucugggcaaaaucaucacuc

SEQ ID NO: 2012037 - RNA, 15 nt, Shigella flexneri 2a str. 301
ucuggcuucccggca

SEQ ID NO: 2012038 - RNA, 16 nt, Shigella flexneri 2a str. 301
ucuggcuguuucgcuu

SEQ ID NO: 2012039 - RNA, 23 nt, Shigella flexneri 2a str. 301
ucuggcugacauaaacaccagca

SEQ ID NO: 2012040 - RNA, 17 nt, Shigella flexneri 2a str. 301
ucuggucaguuggcugg

SEQ ID NO: 2012041 - RNA, 15 nt, Shigella flexneri 2a str. 301
ucuggugaccuggga

SEQ ID NO: 2012042 - RNA, 20 nt, Shigella flexneri 2a str. 301
ucuggugaccugggaaaucc

SEQ ID NO: 2012043 - RNA, 23 nt, Shigella flexneri 2a str. 301
ucuggugguguggcugcacaccu

SEQ ID NO: 2012044 - RNA, 15 nt, Shigella flexneri 2a str. 301
ucugguggaaaagaa

SEQ ID NO: 2012045 - RNA, 22 nt, Shigella flexneri 2a str. 301
ucugguggacaaccauaaauuu

SEQ ID NO: 2012046 - RNA, 14 nt, Shigella flexneri 2a str. 301
ucguuugcugccuu

SEQ ID NO: 2012047 - RNA, 21 nt, Shigella flexneri 2a str. 301
ucguuuucacgaagcucucug

SEQ ID NO: 2012048 - RNA, 16 nt, Shigella flexneri 2a str. 301
ucuaaccauuauuaaa

SEQ ID NO: 2012049 - RNA, 20 nt, Shigella flexneri 2a str. 301
ucuaaagcaacuccaucaag

SEQ ID NO: 2012050 - RNA, 16 nt, Shigella flexneri 2a str. 301
aaaucuuuauaauuaa

SEQ ID NO: 2012051 - RNA, 17 nt, Shigella flexneri 2a str. 301
aaaugaaaaaauagaau

SEQ ID NO: 2012052 - RNA, 14 nt, Shigella flexneri 2a str. 301
aaaugaacugggca

SEQ ID NO: 2012053 - RNA, 20 nt, Shigella flexneri 2a str. 301
ucuaagcugccuguacggca

SEQ ID NO: 2012054 - RNA, 13 nt, Shigella flexneri 2a str. 301
aaaucuucguuau

SEQ ID NO: 2012055 - RNA, 16 nt, Shigella flexneri 2a str. 301
aaaugaccauaaaagg

SEQ ID NO: 2012056 - RNA, 19 nt, Shigella flexneri 2a str. 301
aaaugaccauaaaaggcac

SEQ ID NO: 2012057 - RNA, 14 nt, Shigella flexneri 2a str. 301
aaaugacucguuau

SEQ ID NO: 2012058 - RNA, 23 nt, Shigella flexneri 2a str. 301
aaaugacauucacgcugucggca

SEQ ID NO: 2012059 - RNA, 15 nt, Shigella flexneri 2a str. 301
ucuaccaucaauggc

SEQ ID NO: 2012060 - RNA, 23 nt, Shigella flexneri 2a str. 301
ucuaccagaugcucuuuucugaa

SEQ ID NO: 2012061 - RNA, 13 nt, Shigella flexneri 2a str. 301
ucuaccagcaccu

SEQ ID NO: 2012062 - RNA, 15 nt, Shigella flexneri 2a str. 301
ucuaccguuggccug

SEQ ID NO: 2012063 - RNA, 14 nt, Shigella flexneri 2a str. 301
ucuaccgcaccuuc

SEQ ID NO: 2012064 - RNA, 23 nt, Shigella flexneri 2a str. 301
ucuaccccagugguuucgccagc

SEQ ID NO: 2012065 - RNA, 17 nt, Shigella flexneri 2a str. 301
ucuacucguuuauuaug

SEQ ID NO: 2012066 - RNA, 22 nt, Shigella flexneri 2a str. 301
ucuacucguuuauuaugccaca

SEQ ID NO: 2012067 - RNA, 16 nt, Shigella flexneri 2a str. 301
ucuacugcgcgcgcca

SEQ ID NO: 2012068 - RNA, 13 nt, Shigella flexneri 2a str. 301
aaaugaggaauua

SEQ ID NO: 2012069 - RNA, 17 nt, Shigella flexneri 2a str. 301
ucuacagcauuuccuua

SEQ ID NO: 2012070 - RNA, 16 nt, Shigella flexneri 2a str. 301
ucuacagcgcccgcca

SEQ ID NO: 2012071 - RNA, 16 nt, Shigella flexneri 2a str. 301
ucuacagcauuuccuu

SEQ ID NO: 2012072 - RNA, 11 nt, Shigella flexneri 2a str. 301
ucuacaguacg

SEQ ID NO: 2012073 - RNA, 14 nt, Shigella flexneri 2a str. 301
ucuacauucauaga

SEQ ID NO: 2012074 - RNA, 15 nt, Shigella flexneri 2a str. 301
ucuacaaaaaacugg

SEQ ID NO: 2012075 - RNA, 17 nt, Shigella flexneri 2a str. 301
ucuacaaaaacugccgc

SEQ ID NO: 2012076 - RNA, 14 nt, Shigella flexneri 2a str. 301
ucuacagaaaugaa

SEQ ID NO: 2012077 - RNA, 21 nt, Shigella flexneri 2a str. 301
ucuacacagacgguuuuucaa

SEQ ID NO: 2012078 - RNA, 21 nt, Shigella flexneri 2a str. 301
ucuaaucgcacaaaaucauga

SEQ ID NO: 2012079 - RNA, 21 nt, Shigella flexneri 2a str. 301
ucuaauauuagucaauuaaaa

SEQ ID NO: 2012080 - RNA, 14 nt, Shigella flexneri 2a str. 301
ucuaauagccauca

SEQ ID NO: 2012081 - RNA, 20 nt, Shigella flexneri 2a str. 301
ucuaaugcguagaccggaaa

SEQ ID NO: 2012082 - RNA, 12 nt, Shigella flexneri 2a str. 301
ucuaaugcuuuu

SEQ ID NO: 2012083 - RNA, 17 nt, Shigella flexneri 2a str. 301
ucuaaugucauaagcau

SEQ ID NO: 2012084 - RNA, 12 nt, Shigella flexneri 2a str. 301
ucucaaucccuu

SEQ ID NO: 2012085 - RNA, 18 nt, Shigella flexneri 2a str. 301
ucucaaucccuuucucuu

SEQ ID NO: 2012086 - RNA, 22 nt, Shigella flexneri 2a str. 301
ucucaaucccuuucucuucaaa

SEQ ID NO: 2012087 - RNA, 18 nt, Shigella flexneri 2a str. 301
ucucaaucucuuuuucca

SEQ ID NO: 2012088 - RNA, 14 nt, Shigella flexneri 2a str. 301
ucucaauuuucacu

SEQ ID NO: 2012089 - RNA, 17 nt, Shigella flexneri 2a str. 301
ucucaauuacugucguu

SEQ ID NO: 2012090 - RNA, 13 nt, Shigella flexneri 2a str. 301
ucucaaucuucac

SEQ ID NO: 2012091 - RNA, 14 nt, Shigella flexneri 2a str. 301
ucucaagagugaac

SEQ ID NO: 2012092 - RNA, 13 nt, Shigella flexneri 2a str. 301
ucucaauaaaagg

SEQ ID NO: 2012093 - RNA, 18 nt, Shigella flexneri 2a str. 301
ucucaauaaaaggaaaca

SEQ ID NO: 2012094 - RNA, 13 nt, Shigella flexneri 2a str. 301
ucucaaaugaccg

SEQ ID NO: 2012095 - RNA, 12 nt, Shigella flexneri 2a str. 301
ucucaacacacg

SEQ ID NO: 2012096 - RNA, 20 nt, Shigella flexneri 2a str. 301
ucuauuccgcgugaaaugcc

SEQ ID NO: 2012097 - RNA, 13 nt, Shigella flexneri 2a str. 301
ucuauuaaaaagc

SEQ ID NO: 2012098 - RNA, 18 nt, Shigella flexneri 2a str. 301
ucucacccgcuucauaac

SEQ ID NO: 2012099 - RNA, 19 nt, Shigella flexneri 2a str. 301
ucucacuccggccagagca

SEQ ID NO: 2012100 - RNA, 16 nt, Shigella flexneri 2a str. 301
ucucacuccagccaga

SEQ ID NO: 2012101 - RNA, 13 nt, Shigella flexneri 2a str. 301
ucucacucaccgc

SEQ ID NO: 2012102 - RNA, 23 nt, Shigella flexneri 2a str. 301
ucucaccuauguggaaacaguga

SEQ ID NO: 2012103 - RNA, 11 nt, Shigella flexneri 2a str. 301
aaaugccagau

SEQ ID NO: 2012104 - RNA, 13 nt, Shigella flexneri 2a str. 301
aaaugccgcacau

SEQ ID NO: 2012105 - RNA, 16 nt, Shigella flexneri 2a str. 301
aaaugccgcacaucac

SEQ ID NO: 2012106 - RNA, 13 nt, Shigella flexneri 2a str. 301
aaaugccuuucuc

SEQ ID NO: 2012107 - RNA, 18 nt, Shigella flexneri 2a str. 301
ucucacuuggguaacagc

SEQ ID NO: 2012108 - RNA, 21 nt, Shigella flexneri 2a str. 301
ucucagagaacuguagacaaa

SEQ ID NO: 2012109 - RNA, 11 nt, Shigella flexneri 2a str. 301
ucucagcacac

SEQ ID NO: 2012110 - RNA, 15 nt, Shigella flexneri 2a str. 301
ucucagauaaaugca

SEQ ID NO: 2012111 - RNA, 21 nt, Shigella flexneri 2a str. 301
ucucagcgccgcuuuccaggc

SEQ ID NO: 2012112 - RNA, 23 nt, Shigella flexneri 2a str. 301
ucucagcgccgcuuuccaggcug

SEQ ID NO: 2012113 - RNA, 15 nt, Shigella flexneri 2a str. 301
ucucagcugcaagau

SEQ ID NO: 2012114 - RNA, 23 nt, Shigella flexneri 2a str. 301
ucucaggccuacaaaaucuugca

SEQ ID NO: 2012115 - RNA, 22 nt, Shigella flexneri 2a str. 301
ucucaguggcuauuuaccaaua

SEQ ID NO: 2012116 - RNA, 23 nt, Shigella flexneri 2a str. 301
ucucagguagcgcauaagccacc

SEQ ID NO: 2012117 - RNA, 13 nt, Shigella flexneri 2a str. 301
ucucauccaucaa

SEQ ID NO: 2012118 - RNA, 14 nt, Shigella flexneri 2a str. 301
aaaugcaguuuuua

SEQ ID NO: 2012119 - RNA, 20 nt, Shigella flexneri 2a str. 301
aaaugcaucggcauaaucau

SEQ ID NO: 2012120 - RNA, 13 nt, Shigella flexneri 2a str. 301
aaaugaugcacca

SEQ ID NO: 2012121 - RNA, 14 nt, Shigella flexneri 2a str. 301
aaaugaucgccgga

SEQ ID NO: 2012122 - RNA, 16 nt, Shigella flexneri 2a str. 301
ucuaucaacaguuugu

SEQ ID NO: 2012123 - RNA, 17 nt, Shigella flexneri 2a str. 301
ucuauccagcucaucca

SEQ ID NO: 2012124 - RNA, 16 nt, Shigella flexneri 2a str. 301
ucuaucuuucagaccu

SEQ ID NO: 2012125 - RNA, 16 nt, Shigella flexneri 2a str. 301
ucuaugagaaaauuuc

SEQ ID NO: 2012126 - RNA, 17 nt, Shigella flexneri 2a str. 301
ucuaugguuuuuucuac

SEQ ID NO: 2012127 - RNA, 23 nt, Shigella flexneri 2a str. 301
ucuauauuacgagucacaaacau

SEQ ID NO: 2012128 - RNA, 20 nt, Shigella flexneri 2a str. 301
aaaugccaaauauuucuuua

SEQ ID NO: 2012129 - RNA, 16 nt, Shigella flexneri 2a str. 301
ucuauaaaaaagagcg

SEQ ID NO: 2012130 - RNA, 13 nt, Shigella flexneri 2a str. 301
uuaaauuuaauaa

SEQ ID NO: 2012131 - RNA, 17 nt, Shigella flexneri 2a str. 301
uuaacaccaguaaauaa

SEQ ID NO: 2012132 - RNA, 19 nt, Shigella flexneri 2a str. 301
uuaacaccaguaaauaacg

SEQ ID NO: 2012133 - RNA, 14 nt, Shigella flexneri 2a str. 301
uuaaauuaauaauc

SEQ ID NO: 2012134 - RNA, 18 nt, Shigella flexneri 2a str. 301
uuaaauccugucuggcga

SEQ ID NO: 2012135 - RNA, 14 nt, Shigella flexneri 2a str. 301
uuaaaguuaucgcc

SEQ ID NO: 2012136 - RNA, 20 nt, Shigella flexneri 2a str. 301
uuaaaguugagcgaaaacga

SEQ ID NO: 2012137 - RNA, 21 nt, Shigella flexneri 2a str. 301
uuaaagucuuuguauuuauuu

SEQ ID NO: 2012138 - RNA, 16 nt, Shigella flexneri 2a str. 301
uuaaaggggugaaaaa

SEQ ID NO: 2012139 - RNA, 18 nt, Shigella flexneri 2a str. 301
uuaaaggaaggucaucca

SEQ ID NO: 2012140 - RNA, 12 nt, Shigella flexneri 2a str. 301
uuaaaggaaagu

SEQ ID NO: 2012141 - RNA, 19 nt, Shigella flexneri 2a str. 301
uuaaagccgccaaacggau

SEQ ID NO: 2012142 - RNA, 16 nt, Shigella flexneri 2a str. 301
uuaaauaucaucaaaa

SEQ ID NO: 2012143 - RNA, 17 nt, Shigella flexneri 2a str. 301
uuaaauaucaucaaaau

SEQ ID NO: 2012144 - RNA, 15 nt, Shigella flexneri 2a str. 301
uuaaauaucaucaaa

SEQ ID NO: 2012145 - RNA, 20 nt, Shigella flexneri 2a str. 301
uuaaaucgguauuuccauuu

SEQ ID NO: 2012146 - RNA, 23 nt, Shigella flexneri 2a str. 301
uuaaauauuaaggguaaaaggau

SEQ ID NO: 2012147 - RNA, 19 nt, Shigella flexneri 2a str. 301
uuaaauauaaaacaacgga

SEQ ID NO: 2012148 - RNA, 15 nt, Shigella flexneri 2a str. 301
uuaaauauaaaacaa

SEQ ID NO: 2012149 - RNA, 18 nt, Shigella flexneri 2a str. 301
uuaaauacagcuuaauca

SEQ ID NO: 2012150 - RNA, 21 nt, Shigella flexneri 2a str. 301
uuaauaaaauuauccagcuuu

SEQ ID NO: 2012151 - RNA, 19 nt, Shigella flexneri 2a str. 301
uuaauaaaauacuuuuacu

SEQ ID NO: 2012152 - RNA, 15 nt, Shigella flexneri 2a str. 301
uuaauaaauuuuaua

SEQ ID NO: 2012153 - RNA, 20 nt, Shigella flexneri 2a str. 301
uuaauaaauuuagcuguccc

SEQ ID NO: 2012154 - RNA, 15 nt, Shigella flexneri 2a str. 301
uuaagccaucaucaa

SEQ ID NO: 2012155 - RNA, 20 nt, Shigella flexneri 2a str. 301
uuaagccaguucucaccaaa

SEQ ID NO: 2012156 - RNA, 18 nt, Shigella flexneri 2a str. 301
uuaaggcagaaacaaacg

SEQ ID NO: 2012157 - RNA, 13 nt, Shigella flexneri 2a str. 301
uuaagggugauca

SEQ ID NO: 2012158 - RNA, 17 nt, Shigella flexneri 2a str. 301
uuaaguaugcaauaaca

SEQ ID NO: 2012159 - RNA, 22 nt, Shigella flexneri 2a str. 301
uuaauaccaucggcagcgccaa

SEQ ID NO: 2012160 - RNA, 13 nt, Shigella flexneri 2a str. 301
uuaaucaucaaug

SEQ ID NO: 2012161 - RNA, 21 nt, Shigella flexneri 2a str. 301
uuaaucauccaccuuaaaaca

SEQ ID NO: 2012162 - RNA, 20 nt, Shigella flexneri 2a str. 301
uuaaucagcgaguuaccuua

SEQ ID NO: 2012163 - RNA, 14 nt, Shigella flexneri 2a str. 301
uuaaccuuauauug

SEQ ID NO: 2012164 - RNA, 19 nt, Shigella flexneri 2a str. 301
uuaaccaaaaauuuccaca

SEQ ID NO: 2012165 - RNA, 14 nt, Shigella flexneri 2a str. 301
uuaaccaacaauaa

SEQ ID NO: 2012166 - RNA, 15 nt, Shigella flexneri 2a str. 301
uuaaccaacaauaaa

SEQ ID NO: 2012167 - RNA, 11 nt, Shigella flexneri 2a str. 301
uuaacauuaac

SEQ ID NO: 2012168 - RNA, 23 nt, Shigella flexneri 2a str. 301
uuaacugacuuucguuugaaaac

SEQ ID NO: 2012169 - RNA, 18 nt, Shigella flexneri 2a str. 301
uuaacucuuccugauaca

SEQ ID NO: 2012170 - RNA, 19 nt, Shigella flexneri 2a str. 301
uuaacggaggagagugcaa

SEQ ID NO: 2012171 - RNA, 21 nt, Shigella flexneri 2a str. 301
uuaacgccuucccuuucagca

SEQ ID NO: 2012172 - RNA, 13 nt, Shigella flexneri 2a str. 301
uuaacgacgcaua

SEQ ID NO: 2012173 - RNA, 20 nt, Shigella flexneri 2a str. 301
uuaacgcagaaucuucuucu

SEQ ID NO: 2012174 - RNA, 19 nt, Shigella flexneri 2a str. 301
uuaacgcgaucgacgcguc

SEQ ID NO: 2012175 - RNA, 20 nt, Shigella flexneri 2a str. 301
uuaagaaaacggaagcucag

SEQ ID NO: 2012176 - RNA, 21 nt, Shigella flexneri 2a str. 301
uuaagcaagugcaaucuacaa

SEQ ID NO: 2012177 - RNA, 22 nt, Shigella flexneri 2a str. 301
uuaagcaagugcaaucuacaaa

SEQ ID NO: 2012178 - RNA, 20 nt, Shigella flexneri 2a str. 301
uuaagcaauaccgcgaauca

SEQ ID NO: 2012179 - RNA, 17 nt, Shigella flexneri 2a str. 301
uuaagcaacugacuggc

SEQ ID NO: 2012180 - RNA, 20 nt, Shigella flexneri 2a str. 301
uuaacugcgcgauuaucauu

SEQ ID NO: 2012181 - RNA, 22 nt, Shigella flexneri 2a str. 301
uuaacugacuuucguuugaaaa

SEQ ID NO: 2012182 - RNA, 17 nt, Shigella flexneri 2a str. 301
uuaacuguaugcaugca

SEQ ID NO: 2012183 - RNA, 23 nt, Shigella flexneri 2a str. 301
uuacggagcaggcguuaaaacag

SEQ ID NO: 2012184 - RNA, 21 nt, Shigella flexneri 2a str. 301
uuacgcucccacggaauagaa

SEQ ID NO: 2012185 - RNA, 20 nt, Shigella flexneri 2a str. 301
uuacgccgcauccggcauaa

SEQ ID NO: 2012186 - RNA, 23 nt, Shigella flexneri 2a str. 301
uuacgccgagcgccagccauuca

SEQ ID NO: 2012187 - RNA, 23 nt, Shigella flexneri 2a str. 301
uuacgcauuaccccuuccugaac

SEQ ID NO: 2012188 - RNA, 16 nt, Shigella flexneri 2a str. 301
uuacgccaccagcuga

SEQ ID NO: 2012189 - RNA, 14 nt, Shigella flexneri 2a str. 301
uuacgcccgugaug

SEQ ID NO: 2012190 - RNA, 13 nt, Shigella flexneri 2a str. 301
uuacgccaggcau

SEQ ID NO: 2012191 - RNA, 16 nt, Shigella flexneri 2a str. 301
uuacuucaccuucuuu

SEQ ID NO: 2012192 - RNA, 14 nt, Shigella flexneri 2a str. 301
uuacuucacgcagu

SEQ ID NO: 2012193 - RNA, 10 nt, Shigella flexneri 2a str. 301
uuacuuaaug

SEQ ID NO: 2012194 - RNA, 13 nt, Shigella flexneri 2a str. 301
uuacugacaucaa

SEQ ID NO: 2012195 - RNA, 19 nt, Shigella flexneri 2a str. 301
uuacugacaucaaacccuu

SEQ ID NO: 2012196 - RNA, 18 nt, Shigella flexneri 2a str. 301
uuacugacaauuugccca

SEQ ID NO: 2012197 - RNA, 14 nt, Shigella flexneri 2a str. 301
uuacugaaaaugaa

SEQ ID NO: 2012198 - RNA, 17 nt, Shigella flexneri 2a str. 301
uuacugaaaaugaaagc

SEQ ID NO: 2012199 - RNA, 21 nt, Shigella flexneri 2a str. 301
uuacuccuuagcaacaggcca

SEQ ID NO: 2012200 - RNA, 13 nt, Shigella flexneri 2a str. 301
uuacucuuaucaa

SEQ ID NO: 2012201 - RNA, 13 nt, Shigella flexneri 2a str. 301
uuacucuccugcg

SEQ ID NO: 2012202 - RNA, 13 nt, Shigella flexneri 2a str. 301
uuacuagccugcu

SEQ ID NO: 2012203 - RNA, 19 nt, Shigella flexneri 2a str. 301
uuacuagccugcucccuua

SEQ ID NO: 2012204 - RNA, 23 nt, Shigella flexneri 2a str. 301
uuagaaacaaaaaaaccgccuca

SEQ ID NO: 2012205 - RNA, 15 nt, Shigella flexneri 2a str. 301
uuagaaacaaaaaaa

SEQ ID NO: 2012206 - RNA, 20 nt, Shigella flexneri 2a str. 301
uuacuuccgguuacgccacc

SEQ ID NO: 2012207 - RNA, 19 nt, Shigella flexneri 2a str. 301
uuagcaaccaaaaaaagaa

SEQ ID NO: 2012208 - RNA, 19 nt, Shigella flexneri 2a str. 301
uuagcaaauuaucccccag

SEQ ID NO: 2012209 - RNA, 13 nt, Shigella flexneri 2a str. 301
uuagccgguuuuu

SEQ ID NO: 2012210 - RNA, 18 nt, Shigella flexneri 2a str. 301
uuagcgcaugaccaguga

SEQ ID NO: 2012211 - RNA, 17 nt, Shigella flexneri 2a str. 301
uuagcgacgaacagcga

SEQ ID NO: 2012212 - RNA, 23 nt, Shigella flexneri 2a str. 301
uuagcguugcgccuguucccuuc

SEQ ID NO: 2012213 - RNA, 21 nt, Shigella flexneri 2a str. 301
uuagaugauggcauucucacu

SEQ ID NO: 2012214 - RNA, 17 nt, Shigella flexneri 2a str. 301
uuaccuuuaugacgauc

SEQ ID NO: 2012215 - RNA, 16 nt, Shigella flexneri 2a str. 301
uuaccugaaaaaacaa

SEQ ID NO: 2012216 - RNA, 21 nt, Shigella flexneri 2a str. 301
uuaccuguggcguauucggca

SEQ ID NO: 2012217 - RNA, 16 nt, Shigella flexneri 2a str. 301
uuaccugagugcaggc

SEQ ID NO: 2012218 - RNA, 15 nt, Shigella flexneri 2a str. 301
uuaccucgauauuca

SEQ ID NO: 2012219 - RNA, 15 nt, Shigella flexneri 2a str. 301
uuaccuccgcuuugu

SEQ ID NO: 2012220 - RNA, 19 nt, Shigella flexneri 2a str. 301
uuacgacgcaaucaaaaaa

SEQ ID NO: 2012221 - RNA, 16 nt, Shigella flexneri 2a str. 301
uuacgagucacaaaca

SEQ ID NO: 2012222 - RNA, 19 nt, Shigella flexneri 2a str. 301
uuacgagugcgcucuucaa

SEQ ID NO: 2012223 - RNA, 21 nt, Shigella flexneri 2a str. 301
uuacgacucaaccccagccau

SEQ ID NO: 2012224 - RNA, 13 nt, Shigella flexneri 2a str. 301
uuacgauagaaua

SEQ ID NO: 2012225 - RNA, 23 nt, Shigella flexneri 2a str. 301
uuaccgcuuggcgauaccccaac

SEQ ID NO: 2012226 - RNA, 13 nt, Shigella flexneri 2a str. 301
uuacccagcagca

SEQ ID NO: 2012227 - RNA, 22 nt, Shigella flexneri 2a str. 301
uuaccguaccaaccgcaauugc

SEQ ID NO: 2012228 - RNA, 18 nt, Shigella flexneri 2a str. 301
uuaccgguuugcguauca

SEQ ID NO: 2012229 - RNA, 17 nt, Shigella flexneri 2a str. 301
uuaccggugccagcaac

SEQ ID NO: 2012230 - RNA, 20 nt, Shigella flexneri 2a str. 301
uuacaucccuauagauuauu

SEQ ID NO: 2012231 - RNA, 20 nt, Shigella flexneri 2a str. 301
uuacaucagcguaggacaca

SEQ ID NO: 2012232 - RNA, 22 nt, Shigella flexneri 2a str. 301
uuacaucagcguaggacacaga

SEQ ID NO: 2012233 - RNA, 11 nt, Shigella flexneri 2a str. 301
uuacaucauca

SEQ ID NO: 2012234 - RNA, 16 nt, Shigella flexneri 2a str. 301
uuacaucaucagaaau

SEQ ID NO: 2012235 - RNA, 17 nt, Shigella flexneri 2a str. 301
uuacaguuucugacuca

SEQ ID NO: 2012236 - RNA, 20 nt, Shigella flexneri 2a str. 301
uuaauuuugugcagcaugca

SEQ ID NO: 2012237 - RNA, 19 nt, Shigella flexneri 2a str. 301
uuaaugaacucgauaacac

SEQ ID NO: 2012238 - RNA, 13 nt, Shigella flexneri 2a str. 301
uuaaucuuuuugg

SEQ ID NO: 2012239 - RNA, 16 nt, Shigella flexneri 2a str. 301
uuacaacguauugaaa

SEQ ID NO: 2012240 - RNA, 16 nt, Shigella flexneri 2a str. 301
uuacaagcaacuugca

SEQ ID NO: 2012241 - RNA, 14 nt, Shigella flexneri 2a str. 301
uuacaacaucaaca

SEQ ID NO: 2012242 - RNA, 22 nt, Shigella flexneri 2a str. 301
uuacacagcgacguaaaaaaca

SEQ ID NO: 2012243 - RNA, 19 nt, Shigella flexneri 2a str. 301
uuacaaaaagugcuuucug

SEQ ID NO: 2012244 - RNA, 16 nt, Shigella flexneri 2a str. 301
uuacaacacauuauua

SEQ ID NO: 2012245 - RNA, 14 nt, Shigella flexneri 2a str. 301
uguuugaaucaaca

SEQ ID NO: 2012246 - RNA, 19 nt, Shigella flexneri 2a str. 301
uguuugcaggugaccagca

SEQ ID NO: 2012247 - RNA, 16 nt, Shigella flexneri 2a str. 301
uguuuccauccggcaa

SEQ ID NO: 2012248 - RNA, 16 nt, Shigella flexneri 2a str. 301
uguuuccauauguacg

SEQ ID NO: 2012249 - RNA, 17 nt, Shigella flexneri 2a str. 301
uguuuccagauuuugcu

SEQ ID NO: 2012250 - RNA, 14 nt, Shigella flexneri 2a str. 301
uguuuaucaggcca

SEQ ID NO: 2012251 - RNA, 14 nt, Shigella flexneri 2a str. 301
uguuuauaagccau

SEQ ID NO: 2012252 - RNA, 22 nt, Shigella flexneri 2a str. 301
uguuuuccguugugcgauccac

SEQ ID NO: 2012253 - RNA, 13 nt, Shigella flexneri 2a str. 301
uguuuuccagcac

SEQ ID NO: 2012254 - RNA, 23 nt, Shigella flexneri 2a str. 301
uguuuuuucaaccuaaaguaaag

SEQ ID NO: 2012255 - RNA, 16 nt, Shigella flexneri 2a str. 301
uguuuuauguucagau

SEQ ID NO: 2012256 - RNA, 23 nt, Shigella flexneri 2a str. 301
uguuuuaucucccuguaucccag

SEQ ID NO: 2012257 - RNA, 16 nt, Shigella flexneri 2a str. 301
uguuuuagagaauuaa

SEQ ID NO: 2012258 - RNA, 13 nt, Shigella flexneri 2a str. 301
uguuuuauaaaga

SEQ ID NO: 2012259 - RNA, 22 nt, Shigella flexneri 2a str. 301
uuaaagagcauuacacgcggcu

SEQ ID NO: 2012260 - RNA, 17 nt, Shigella flexneri 2a str. 301
uuaaagagacagaauca

SEQ ID NO: 2012261 - RNA, 17 nt, Shigella flexneri 2a str. 301
uuaaacgggucaucaaa

SEQ ID NO: 2012262 - RNA, 20 nt, Shigella flexneri 2a str. 301
uuaaacgggucaucaaaauc

SEQ ID NO: 2012263 - RNA, 22 nt, Shigella flexneri 2a str. 301
uuaaacgcaguaagcgccaggg

SEQ ID NO: 2012264 - RNA, 15 nt, Shigella flexneri 2a str. 301
uuaaacuuucauaaa

SEQ ID NO: 2012265 - RNA, 15 nt, Shigella flexneri 2a str. 301
uuaaacucugccgca

SEQ ID NO: 2012266 - RNA, 17 nt, Shigella flexneri 2a str. 301
uuaaacccgcucaaaca

SEQ ID NO: 2012267 - RNA, 18 nt, Shigella flexneri 2a str. 301
uuaaacgauuccacuuuu

SEQ ID NO: 2012268 - RNA, 12 nt, Shigella flexneri 2a str. 301
uuaaaccugauu

SEQ ID NO: 2012269 - RNA, 16 nt, Shigella flexneri 2a str. 301
uuaaaccauuccagca

SEQ ID NO: 2012270 - RNA, 18 nt, Shigella flexneri 2a str. 301
uuaaacacgggguuaaau

SEQ ID NO: 2012271 - RNA, 15 nt, Shigella flexneri 2a str. 301
uuaaacauuaaaauu

SEQ ID NO: 2012272 - RNA, 17 nt, Shigella flexneri 2a str. 301
uuaaaauuucaugcuga

SEQ ID NO: 2012273 - RNA, 20 nt, Shigella flexneri 2a str. 301
uuaaaauucaagacaucaau

SEQ ID NO: 2012274 - RNA, 21 nt, Shigella flexneri 2a str. 301
uuaaaaacuucguuagguucu

SEQ ID NO: 2012275 - RNA, 18 nt, Shigella flexneri 2a str. 301
uuaaaaacccugcagaaa

SEQ ID NO: 2012276 - RNA, 10 nt, Shigella flexneri 2a str. 301
uuaaaaacag

SEQ ID NO: 2012277 - RNA, 12 nt, Shigella flexneri 2a str. 301
uuaaaaagugcu

SEQ ID NO: 2012278 - RNA, 12 nt, Shigella flexneri 2a str. 301
uuaaaaaaagca

SEQ ID NO: 2012279 - RNA, 12 nt, Shigella flexneri 2a str. 301
uuaaaaaaacac

SEQ ID NO: 2012280 - RNA, 18 nt, Shigella flexneri 2a str. 301
uuaaaacgcacgcuguca

SEQ ID NO: 2012281 - RNA, 13 nt, Shigella flexneri 2a str. 301
uguuauucagaau

SEQ ID NO: 2012282 - RNA, 16 nt, Shigella flexneri 2a str. 301
uguuauuguguagcca

SEQ ID NO: 2012283 - RNA, 19 nt, Shigella flexneri 2a str. 301
uguuauuaguguguauaua

SEQ ID NO: 2012284 - RNA, 16 nt, Shigella flexneri 2a str. 301
uguuaugagauaauuc

SEQ ID NO: 2012285 - RNA, 22 nt, Shigella flexneri 2a str. 301
uguuauccgacuuauucuucaa

SEQ ID NO: 2012286 - RNA, 20 nt, Shigella flexneri 2a str. 301
uguuagcgaauaaaguagaa

SEQ ID NO: 2012287 - RNA, 12 nt, Shigella flexneri 2a str. 301
uguucaggagaa

SEQ ID NO: 2012288 - RNA, 15 nt, Shigella flexneri 2a str. 301
uguucagcugcgugc

SEQ ID NO: 2012289 - RNA, 18 nt, Shigella flexneri 2a str. 301
uguucagccugacagcac

SEQ ID NO: 2012290 - RNA, 13 nt, Shigella flexneri 2a str. 301
uguucacugccgu

SEQ ID NO: 2012291 - RNA, 13 nt, Shigella flexneri 2a str. 301
uguucacugugcu

SEQ ID NO: 2012292 - RNA, 22 nt, Shigella flexneri 2a str. 301
uguucacuuuugcugcaaaauu

SEQ ID NO: 2012293 - RNA, 17 nt, Shigella flexneri 2a str. 301
uguucagaaagcgccag

SEQ ID NO: 2012294 - RNA, 16 nt, Shigella flexneri 2a str. 301
uguucacccaacucuc

SEQ ID NO: 2012295 - RNA, 20 nt, Shigella flexneri 2a str. 301
uguucaccacugaauaacau

SEQ ID NO: 2012296 - RNA, 15 nt, Shigella flexneri 2a str. 301
uguucaacaauucgu

SEQ ID NO: 2012297 - RNA, 21 nt, Shigella flexneri 2a str. 301
uguucaaaaaaaucacauagu

SEQ ID NO: 2012298 - RNA, 13 nt, Shigella flexneri 2a str. 301
uguucaucugcau

SEQ ID NO: 2012299 - RNA, 17 nt, Shigella flexneri 2a str. 301
uguucauagugccugau

SEQ ID NO: 2012300 - RNA, 21 nt, Shigella flexneri 2a str. 301
uguuccagaccauauuuucau

SEQ ID NO: 2012301 - RNA, 19 nt, Shigella flexneri 2a str. 301
uguucccugcgccagcgcg

SEQ ID NO: 2012302 - RNA, 15 nt, Shigella flexneri 2a str. 301
uguucccuucucagc

SEQ ID NO: 2012303 - RNA, 20 nt, Shigella flexneri 2a str. 301
uguuccgccagcgacugcgc

SEQ ID NO: 2012304 - RNA, 14 nt, Shigella flexneri 2a str. 301
uguucguuauuggg

SEQ ID NO: 2012305 - RNA, 16 nt, Shigella flexneri 2a str. 301
uguucuacgugcgcua

SEQ ID NO: 2012306 - RNA, 15 nt, Shigella flexneri 2a str. 301
uguucucuucauuac

SEQ ID NO: 2012307 - RNA, 21 nt, Shigella flexneri 2a str. 301
uguucugauaguuaaaauuca

SEQ ID NO: 2012308 - RNA, 13 nt, Shigella flexneri 2a str. 301
uguucugaaucac

SEQ ID NO: 2012309 - RNA, 13 nt, Shigella flexneri 2a str. 301
uguucucccauag

SEQ ID NO: 2012310 - RNA, 14 nt, Shigella flexneri 2a str. 301
uguucuccuggccc

SEQ ID NO: 2012311 - RNA, 16 nt, Shigella flexneri 2a str. 301
uguucuccuggcccgg

SEQ ID NO: 2012312 - RNA, 21 nt, Shigella flexneri 2a str. 301
uguucgcccacgcgcauuccc

SEQ ID NO: 2012313 - RNA, 22 nt, Shigella flexneri 2a str. 301
uguucgcaaccuaaaccaaaca

SEQ ID NO: 2012314 - RNA, 20 nt, Shigella flexneri 2a str. 301
uguucgucccgauucagcac

SEQ ID NO: 2012315 - RNA, 13 nt, Shigella flexneri 2a str. 301
uguucggcauucu

SEQ ID NO: 2012316 - RNA, 18 nt, Shigella flexneri 2a str. 301
uguucggcauucugcugg

SEQ ID NO: 2012317 - RNA, 23 nt, Shigella flexneri 2a str. 301
uguucggcauucugcuggccugg

SEQ ID NO: 2012318 - RNA, 21 nt, Shigella flexneri 2a str. 301
uguucgcucuauucauugacu

SEQ ID NO: 2012319 - RNA, 21 nt, Shigella flexneri 2a str. 301
uguugagaugguuacuuuuua

SEQ ID NO: 2012320 - RNA, 15 nt, Shigella flexneri 2a str. 301
uguugaggaagcgca

SEQ ID NO: 2012321 - RNA, 11 nt, Shigella flexneri 2a str. 301
uguugaagaaa

SEQ ID NO: 2012322 - RNA, 15 nt, Shigella flexneri 2a str. 301
uguugaaugccgguu

SEQ ID NO: 2012323 - RNA, 17 nt, Shigella flexneri 2a str. 301
uguugcgcugaaacuuu

SEQ ID NO: 2012324 - RNA, 22 nt, Shigella flexneri 2a str. 301
uguugcccagcgcaucaggcaa

SEQ ID NO: 2012325 - RNA, 17 nt, Shigella flexneri 2a str. 301
uguugcccaugcuucug

SEQ ID NO: 2012326 - RNA, 13 nt, Shigella flexneri 2a str. 301
uguugcugaauuu

SEQ ID NO: 2012327 - RNA, 22 nt, Shigella flexneri 2a str. 301
uguugcugccgacaaaugcagu

SEQ ID NO: 2012328 - RNA, 21 nt, Shigella flexneri 2a str. 301
uguugccauuucugcugccac

SEQ ID NO: 2012329 - RNA, 18 nt, Shigella flexneri 2a str. 301
uguugccacacgcccaac

SEQ ID NO: 2012330 - RNA, 14 nt, Shigella flexneri 2a str. 301
uguugauccaggag

SEQ ID NO: 2012331 - RNA, 12 nt, Shigella flexneri 2a str. 301
uguugcaaauaa

SEQ ID NO: 2012332 - RNA, 23 nt, Shigella flexneri 2a str. 301
uguugcaagacgaugacauuauc

SEQ ID NO: 2012333 - RNA, 14 nt, Shigella flexneri 2a str. 301
uguugauaaggaaa

SEQ ID NO: 2012334 - RNA, 15 nt, Shigella flexneri 2a str. 301
uguugucugaaugau

SEQ ID NO: 2012335 - RNA, 20 nt, Shigella flexneri 2a str. 301
uguugucuucucaacacauu

SEQ ID NO: 2012336 - RNA, 17 nt, Shigella flexneri 2a str. 301
uguuguaauaguguauu

SEQ ID NO: 2012337 - RNA, 18 nt, Shigella flexneri 2a str. 301
uguuguagacaugguaaa

SEQ ID NO: 2012338 - RNA, 22 nt, Shigella flexneri 2a str. 301
uguuggauccccugcccggcaa

SEQ ID NO: 2012339 - RNA, 20 nt, Shigella flexneri 2a str. 301
uguuggcaggccaaaaaaca

SEQ ID NO: 2012340 - RNA, 22 nt, Shigella flexneri 2a str. 301
uguuggccaacccgcgugguuu

SEQ ID NO: 2012341 - RNA, 12 nt, Shigella flexneri 2a str. 301
uguuuaaauauc

SEQ ID NO: 2012342 - RNA, 21 nt, Shigella flexneri 2a str. 301
uguuuaacuccuucuaaagca

SEQ ID NO: 2012343 - RNA, 18 nt, Shigella flexneri 2a str. 301
uguuuaaggaaaaacgaa

SEQ ID NO: 2012344 - RNA, 19 nt, Shigella flexneri 2a str. 301
uguuuaauggcaaaaacuu

SEQ ID NO: 2012345 - RNA, 17 nt, Shigella flexneri 2a str. 301
uguuguuuuuucaaccu

SEQ ID NO: 2012346 - RNA, 21 nt, Shigella flexneri 2a str. 301
uguuuaccaucugcgccgcca

SEQ ID NO: 2012347 - RNA, 22 nt, Shigella flexneri 2a str. 301
uguaccuucacgcgcuccagga

SEQ ID NO: 2012348 - RNA, 23 nt, Shigella flexneri 2a str. 301
uguaccuucacgcgcuccaggag

SEQ ID NO: 2012349 - RNA, 22 nt, Shigella flexneri 2a str. 301
uguacuuccggacguucagcca

SEQ ID NO: 2012350 - RNA, 13 nt, Shigella flexneri 2a str. 301
uguacauuuugac

SEQ ID NO: 2012351 - RNA, 23 nt, Shigella flexneri 2a str. 301
uguacccuuaacucuuccugaua

SEQ ID NO: 2012352 - RNA, 20 nt, Shigella flexneri 2a str. 301
uguacccgcugcagcucuuu

SEQ ID NO: 2012353 - RNA, 18 nt, Shigella flexneri 2a str. 301
uguaccggauaaauuuaa

SEQ ID NO: 2012354 - RNA, 23 nt, Shigella flexneri 2a str. 301
uguaacugcgccagacccagacg

SEQ ID NO: 2012355 - RNA, 17 nt, Shigella flexneri 2a str. 301
uguaacggagguacaac

SEQ ID NO: 2012356 - RNA, 18 nt, Shigella flexneri 2a str. 301
uguaacgccuuuuccagc

SEQ ID NO: 2012357 - RNA, 18 nt, Shigella flexneri 2a str. 301
uguaacgccggguaaaug

SEQ ID NO: 2012358 - RNA, 17 nt, Shigella flexneri 2a str. 301
uguaacgccuuuuccag

SEQ ID NO: 2012359 - RNA, 17 nt, Shigella flexneri 2a str. 301
uguaaccuucacccuca

SEQ ID NO: 2012360 - RNA, 16 nt, Shigella flexneri 2a str. 301
uguaacccaccaugcc

SEQ ID NO: 2012361 - RNA, 15 nt, Shigella flexneri 2a str. 301
uguacaaaaaaugug

SEQ ID NO: 2012362 - RNA, 18 nt, Shigella flexneri 2a str. 301
uguaauuuuuuuauugau

SEQ ID NO: 2012363 - RNA, 15 nt, Shigella flexneri 2a str. 301
uguaaucauauuaaa

SEQ ID NO: 2012364 - RNA, 18 nt, Shigella flexneri 2a str. 301
uguaaucauauuaaauuu

SEQ ID NO: 2012365 - RNA, 20 nt, Shigella flexneri 2a str. 301
ugguuuuucgauuuaaauga

SEQ ID NO: 2012366 - RNA, 16 nt, Shigella flexneri 2a str. 301
ugguuucgccagcacc

SEQ ID NO: 2012367 - RNA, 17 nt, Shigella flexneri 2a str. 301
ugguuuugcuuuauuaa

SEQ ID NO: 2012368 - RNA, 15 nt, Shigella flexneri 2a str. 301
ugguuuauuucccag

SEQ ID NO: 2012369 - RNA, 15 nt, Shigella flexneri 2a str. 301
ugguuuaugcaauau

SEQ ID NO: 2012370 - RNA, 14 nt, Shigella flexneri 2a str. 301
ugguuucaaugcuc

SEQ ID NO: 2012371 - RNA, 14 nt, Shigella flexneri 2a str. 301
ugguuucaaagauu

SEQ ID NO: 2012372 - RNA, 21 nt, Shigella flexneri 2a str. 301
uggucuuguagguuuuggcgc

SEQ ID NO: 2012373 - RNA, 20 nt, Shigella flexneri 2a str. 301
uggugacgcgcuuuaacuuc

SEQ ID NO: 2012374 - RNA, 21 nt, Shigella flexneri 2a str. 301
uggugaauuugucgauuucca

SEQ ID NO: 2012375 - RNA, 19 nt, Shigella flexneri 2a str. 301
uggugacaaaguacaacgc

SEQ ID NO: 2012376 - RNA, 19 nt, Shigella flexneri 2a str. 301
uguaaauucucaauaucau

SEQ ID NO: 2012377 - RNA, 12 nt, Shigella flexneri 2a str. 301
uguaaacaacau

SEQ ID NO: 2012378 - RNA, 13 nt, Shigella flexneri 2a str. 301
uguaacaacuggc

SEQ ID NO: 2012379 - RNA, 15 nt, Shigella flexneri 2a str. 301
uguaacauaccuaaa

SEQ ID NO: 2012380 - RNA, 19 nt, Shigella flexneri 2a str. 301
uguaaaacagcacuccugc

SEQ ID NO: 2012381 - RNA, 11 nt, Shigella flexneri 2a str. 301
uguaaaagaag

SEQ ID NO: 2012382 - RNA, 17 nt, Shigella flexneri 2a str. 301
uguagcgcugcaaacca

SEQ ID NO: 2012383 - RNA, 20 nt, Shigella flexneri 2a str. 301
uguagcgcaucacuuccagu

SEQ ID NO: 2012384 - RNA, 16 nt, Shigella flexneri 2a str. 301
uguagcuacgcaucaa

SEQ ID NO: 2012385 - RNA, 21 nt, Shigella flexneri 2a str. 301
uguaggccugauaagcguagc

SEQ ID NO: 2012386 - RNA, 14 nt, Shigella flexneri 2a str. 301
uguaggccagauaa

SEQ ID NO: 2012387 - RNA, 17 nt, Shigella flexneri 2a str. 301
uguagguuuuggcgcaa

SEQ ID NO: 2012388 - RNA, 20 nt, Shigella flexneri 2a str. 301
uguaggguggggaaaaacac

SEQ ID NO: 2012389 - RNA, 14 nt, Shigella flexneri 2a str. 301
uguaggguggggaa

SEQ ID NO: 2012390 - RNA, 18 nt, Shigella flexneri 2a str. 301
uguauauuauccaucaaa

SEQ ID NO: 2012391 - RNA, 13 nt, Shigella flexneri 2a str. 301
uguauacgcuggc

SEQ ID NO: 2012392 - RNA, 19 nt, Shigella flexneri 2a str. 301
uguauacgggcuuuuuaau

SEQ ID NO: 2012393 - RNA, 16 nt, Shigella flexneri 2a str. 301
ugucacgucucaucag

SEQ ID NO: 2012394 - RNA, 21 nt, Shigella flexneri 2a str. 301
ugucacggugcgcguugcuua

SEQ ID NO: 2012395 - RNA, 14 nt, Shigella flexneri 2a str. 301
ugucaauaaacgcc

SEQ ID NO: 2012396 - RNA, 18 nt, Shigella flexneri 2a str. 301
ugucaaacgggcuucuaa

SEQ ID NO: 2012397 - RNA, 16 nt, Shigella flexneri 2a str. 301
uguauuacaacgugcu

SEQ ID NO: 2012398 - RNA, 22 nt, Shigella flexneri 2a str. 301
uguauuacagagguuuuaugau

SEQ ID NO: 2012399 - RNA, 16 nt, Shigella flexneri 2a str. 301
uguaugccucuuucag

SEQ ID NO: 2012400 - RNA, 18 nt, Shigella flexneri 2a str. 301
uguaugccgaauaaagca

SEQ ID NO: 2012401 - RNA, 14 nt, Shigella flexneri 2a str. 301
ugucagaaguugca

SEQ ID NO: 2012402 - RNA, 11 nt, Shigella flexneri 2a str. 301
ugucacuuuga

SEQ ID NO: 2012403 - RNA, 23 nt, Shigella flexneri 2a str. 301
ugucauacgggcuguagcuuuuc

SEQ ID NO: 2012404 - RNA, 22 nt, Shigella flexneri 2a str. 301
ugucauacgagucgccuguacu

SEQ ID NO: 2012405 - RNA, 20 nt, Shigella flexneri 2a str. 301
ugucauaacuggucaucaaa

SEQ ID NO: 2012406 - RNA, 19 nt, Shigella flexneri 2a str. 301
ugucauaagcaucccuuua

SEQ ID NO: 2012407 - RNA, 16 nt, Shigella flexneri 2a str. 301
ugucaguggacgauaa

SEQ ID NO: 2012408 - RNA, 23 nt, Shigella flexneri 2a str. 301
ugucaucagcauucucaucacca

SEQ ID NO: 2012409 - RNA, 13 nt, Shigella flexneri 2a str. 301
ugucaucagcauu

SEQ ID NO: 2012410 - RNA, 14 nt, Shigella flexneri 2a str. 301
ugucaugcagcucc

SEQ ID NO: 2012411 - RNA, 18 nt, Shigella flexneri 2a str. 301
ugucaugacuacacuaaa

SEQ ID NO: 2012412 - RNA, 22 nt, Shigella flexneri 2a str. 301
ugucaucuucgaaaguagaagc

SEQ ID NO: 2012413 - RNA, 13 nt, Shigella flexneri 2a str. 301
ugucaugcagcuc

SEQ ID NO: 2012414 - RNA, 18 nt, Shigella flexneri 2a str. 301
ugucaugcgcucucccau

SEQ ID NO: 2012415 - RNA, 16 nt, Shigella flexneri 2a str. 301
ugucuauuuccaccca

SEQ ID NO: 2012416 - RNA, 13 nt, Shigella flexneri 2a str. 301
ugucuauuuccac

SEQ ID NO: 2012417 - RNA, 19 nt, Shigella flexneri 2a str. 301
ugucggugguguuaucacc

SEQ ID NO: 2012418 - RNA, 12 nt, Shigella flexneri 2a str. 301
ugucgggcauca

SEQ ID NO: 2012419 - RNA, 20 nt, Shigella flexneri 2a str. 301
ugucgcucaaugugcugagu

SEQ ID NO: 2012420 - RNA, 20 nt, Shigella flexneri 2a str. 301
ugucgcucaaugcgcugagu

SEQ ID NO: 2012421 - RNA, 14 nt, Shigella flexneri 2a str. 301
ugucgcgccaggcg

SEQ ID NO: 2012422 - RNA, 21 nt, Shigella flexneri 2a str. 301
ugucauuaaagccgccaaacg

SEQ ID NO: 2012423 - RNA, 15 nt, Shigella flexneri 2a str. 301
uguccagcacgccgc

SEQ ID NO: 2012424 - RNA, 17 nt, Shigella flexneri 2a str. 301
uguccaccacgcugcau

SEQ ID NO: 2012425 - RNA, 15 nt, Shigella flexneri 2a str. 301
uguccagcggcauaa

SEQ ID NO: 2012426 - RNA, 22 nt, Shigella flexneri 2a str. 301
uguccauagcgauguauuucau

SEQ ID NO: 2012427 - RNA, 17 nt, Shigella flexneri 2a str. 301
ugugcagcguacuucau

SEQ ID NO: 2012428 - RNA, 15 nt, Shigella flexneri 2a str. 301
ugugcaguuccugca

SEQ ID NO: 2012429 - RNA, 20 nt, Shigella flexneri 2a str. 301
ugugcaucaggcaaacuuca

SEQ ID NO: 2012430 - RNA, 19 nt, Shigella flexneri 2a str. 301
ugugcauuuaagagaaacg

SEQ ID NO: 2012431 - RNA, 21 nt, Shigella flexneri 2a str. 301
ugugcgccauuuuuuugucug

SEQ ID NO: 2012432 - RNA, 14 nt, Shigella flexneri 2a str. 301
ugugccacauccag

SEQ ID NO: 2012433 - RNA, 17 nt, Shigella flexneri 2a str. 301
ugugacaacaacaucac

SEQ ID NO: 2012434 - RNA, 15 nt, Shigella flexneri 2a str. 301
ugugacaacaacauc

SEQ ID NO: 2012435 - RNA, 16 nt, Shigella flexneri 2a str. 301
ugugaaucgccuggac

SEQ ID NO: 2012436 - RNA, 17 nt, Shigella flexneri 2a str. 301
ugucugcuucugccugg

SEQ ID NO: 2012437 - RNA, 17 nt, Shigella flexneri 2a str. 301
ugugacgacaccaucuc

SEQ ID NO: 2012438 - RNA, 13 nt, Shigella flexneri 2a str. 301
ugugacagcagcg

SEQ ID NO: 2012439 - RNA, 13 nt, Shigella flexneri 2a str. 301
ugugacagagcca

SEQ ID NO: 2012440 - RNA, 17 nt, Shigella flexneri 2a str. 301
ugugacuuccgacagaa

SEQ ID NO: 2012441 - RNA, 19 nt, Shigella flexneri 2a str. 301
ugugacucaaugaaaucca

SEQ ID NO: 2012442 - RNA, 21 nt, Shigella flexneri 2a str. 301
uguuacgcaaaaccucuucca

SEQ ID NO: 2012443 - RNA, 14 nt, Shigella flexneri 2a str. 301
uguuacguuucucu

SEQ ID NO: 2012444 - RNA, 22 nt, Shigella flexneri 2a str. 301
uguuaaguuuaucccaauuauc

SEQ ID NO: 2012445 - RNA, 12 nt, Shigella flexneri 2a str. 301
uguuaaccaacg

SEQ ID NO: 2012446 - RNA, 21 nt, Shigella flexneri 2a str. 301
uguuaaccaccaguaaauugu

SEQ ID NO: 2012447 - RNA, 14 nt, Shigella flexneri 2a str. 301
uguuacaaccuccu

SEQ ID NO: 2012448 - RNA, 19 nt, Shigella flexneri 2a str. 301
uguuaaaacgcacgcuguc

SEQ ID NO: 2012449 - RNA, 20 nt, Shigella flexneri 2a str. 301
uguguuuacgcguuuuucag

SEQ ID NO: 2012450 - RNA, 13 nt, Shigella flexneri 2a str. 301
uguguuuuuauuu

SEQ ID NO: 2012451 - RNA, 12 nt, Shigella flexneri 2a str. 301
ugugugaaaguc

SEQ ID NO: 2012452 - RNA, 14 nt, Shigella flexneri 2a str. 301
ugugucuuauuggc

SEQ ID NO: 2012453 - RNA, 21 nt, Shigella flexneri 2a str. 301
ugugcguuacccacaguuuca

SEQ ID NO: 2012454 - RNA, 15 nt, Shigella flexneri 2a str. 301
ugugcucuaaccaac

SEQ ID NO: 2012455 - RNA, 19 nt, Shigella flexneri 2a str. 301
uguggauuaugcgcggcau

SEQ ID NO: 2012456 - RNA, 15 nt, Shigella flexneri 2a str. 301
uguggcagcaacugg

SEQ ID NO: 2012457 - RNA, 17 nt, Shigella flexneri 2a str. 301
ugugggauuccagcgcc

SEQ ID NO: 2012458 - RNA, 20 nt, Shigella flexneri 2a str. 301
uguggcugcgcgagguuaaa

SEQ ID NO: 2012459 - RNA, 21 nt, Shigella flexneri 2a str. 301
uguggcugggguacgaggauu

SEQ ID NO: 2012460 - RNA, 15 nt, Shigella flexneri 2a str. 301
uguguaaacccagcc

SEQ ID NO: 2012461 - RNA, 20 nt, Shigella flexneri 2a str. 301
ugugguuugucauuggcagc

SEQ ID NO: 2012462 - RNA, 16 nt, Shigella flexneri 2a str. 301
ugugggucgaggaaau

SEQ ID NO: 2012463 - RNA, 15 nt, Shigella flexneri 2a str. 301
ugugggguauuucca

SEQ ID NO: 2012464 - RNA, 23 nt, Shigella flexneri 2a str. 301
uguggggaacagaauguuugcca

SEQ ID NO: 2012465 - RNA, 15 nt, Shigella flexneri 2a str. 301
ugugguguuuuuuua

SEQ ID NO: 2012466 - RNA, 16 nt, Shigella flexneri 2a str. 301
uguggugcaggcgcag

SEQ ID NO: 2012467 - RNA, 17 nt, Shigella flexneri 2a str. 301
uguggugagauugcugc

SEQ ID NO: 2012468 - RNA, 22 nt, Shigella flexneri 2a str. 301
uggggauagaaacagucuggag

SEQ ID NO: 2012469 - RNA, 18 nt, Shigella flexneri 2a str. 301
uggggauagcgcugcugc

SEQ ID NO: 2012470 - RNA, 14 nt, Shigella flexneri 2a str. 301
uggggcaaaugguu

SEQ ID NO: 2012471 - RNA, 20 nt, Shigella flexneri 2a str. 301
uggggcauauuaucagcaaa

SEQ ID NO: 2012472 - RNA, 14 nt, Shigella flexneri 2a str. 301
uggguggcagaucc

SEQ ID NO: 2012473 - RNA, 16 nt, Shigella flexneri 2a str. 301
ugggugagcgaugcug

SEQ ID NO: 2012474 - RNA, 17 nt, Shigella flexneri 2a str. 301
uggggcguguuuuguca

SEQ ID NO: 2012475 - RNA, 19 nt, Shigella flexneri 2a str. 301
uggggcuugccagagcagc

SEQ ID NO: 2012476 - RNA, 12 nt, Shigella flexneri 2a str. 301
uggggcuggcgg

SEQ ID NO: 2012477 - RNA, 16 nt, Shigella flexneri 2a str. 301
uggggguaacccaccg

SEQ ID NO: 2012478 - RNA, 14 nt, Shigella flexneri 2a str. 301
ugggcguagcuggg

SEQ ID NO: 2012479 - RNA, 15 nt, Shigella flexneri 2a str. 301
ugggcguagcugggu

SEQ ID NO: 2012480 - RNA, 12 nt, Shigella flexneri 2a str. 301
ugggcucaucaa

SEQ ID NO: 2012481 - RNA, 15 nt, Shigella flexneri 2a str. 301
ugggcuaacacccgu

SEQ ID NO: 2012482 - RNA, 18 nt, Shigella flexneri 2a str. 301
ugggcguuacagcuggag

SEQ ID NO: 2012483 - RNA, 16 nt, Shigella flexneri 2a str. 301
ugggcucaucaauacg

SEQ ID NO: 2012484 - RNA, 17 nt, Shigella flexneri 2a str. 301
ugggcgcaccugaaucg

SEQ ID NO: 2012485 - RNA, 17 nt, Shigella flexneri 2a str. 301
uggcguggcgcuccacu

SEQ ID NO: 2012486 - RNA, 14 nt, Shigella flexneri 2a str. 301
uggcgucuccugcc

SEQ ID NO: 2012487 - RNA, 22 nt, Shigella flexneri 2a str. 301
uggcguuaaucugcguuacuca

SEQ ID NO: 2012488 - RNA, 21 nt, Shigella flexneri 2a str. 301
uggcgucggauauaaaaaacc

SEQ ID NO: 2012489 - RNA, 18 nt, Shigella flexneri 2a str. 301
uggcgugaacgccuuauc

SEQ ID NO: 2012490 - RNA, 16 nt, Shigella flexneri 2a str. 301
uggcuuaucuuccugu

SEQ ID NO: 2012491 - RNA, 18 nt, Shigella flexneri 2a str. 301
uggcuuaucuuccuguuc

SEQ ID NO: 2012492 - RNA, 18 nt, Shigella flexneri 2a str. 301
uggcuucgguuuuuauuu

SEQ ID NO: 2012493 - RNA, 14 nt, Shigella flexneri 2a str. 301
uggcuugccagcca

SEQ ID NO: 2012494 - RNA, 21 nt, Shigella flexneri 2a str. 301
ugggauuaaaaaguaagaauu

SEQ ID NO: 2012495 - RNA, 21 nt, Shigella flexneri 2a str. 301
ugggaugguuuugcuuuauua

SEQ ID NO: 2012496 - RNA, 14 nt, Shigella flexneri 2a str. 301
ugggauugcuucag

SEQ ID NO: 2012497 - RNA, 15 nt, Shigella flexneri 2a str. 301
ugggaucgccagguu

SEQ ID NO: 2012498 - RNA, 15 nt, Shigella flexneri 2a str. 301
ugggcaaucucacuc

SEQ ID NO: 2012499 - RNA, 20 nt, Shigella flexneri 2a str. 301
ugggcaaucucacuccggcc

SEQ ID NO: 2012500 - RNA, 20 nt, Shigella flexneri 2a str. 301
ugggauugcuucaguugccu

SEQ ID NO: 2012501 - RNA, 12 nt, Shigella flexneri 2a str. 301
ugggaaaacagg

SEQ ID NO: 2012502 - RNA, 19 nt, Shigella flexneri 2a str. 301
uggucaaugauuucugcca

SEQ ID NO: 2012503 - RNA, 14 nt, Shigella flexneri 2a str. 301
uggucagaacgacc

SEQ ID NO: 2012504 - RNA, 22 nt, Shigella flexneri 2a str. 301
uggucaucacuuuugaaaucaa

SEQ ID NO: 2012505 - RNA, 17 nt, Shigella flexneri 2a str. 301
uggucaguacgccgccg

SEQ ID NO: 2012506 - RNA, 13 nt, Shigella flexneri 2a str. 301
uggucagagcauu

SEQ ID NO: 2012507 - RNA, 16 nt, Shigella flexneri 2a str. 301
uggucccgacaaccug

SEQ ID NO: 2012508 - RNA, 15 nt, Shigella flexneri 2a str. 301
uggucaguuggcugg

SEQ ID NO: 2012509 - RNA, 18 nt, Shigella flexneri 2a str. 301
ugguccacauccguccuc

SEQ ID NO: 2012510 - RNA, 14 nt, Shigella flexneri 2a str. 301
uggucauuuuauug

SEQ ID NO: 2012511 - RNA, 19 nt, Shigella flexneri 2a str. 301
ugguccgcuuguaggccug

SEQ ID NO: 2012512 - RNA, 17 nt, Shigella flexneri 2a str. 301
uggucccgacaaccuga

SEQ ID NO: 2012513 - RNA, 23 nt, Shigella flexneri 2a str. 301
ugguaaagccgauuaaucuucca

SEQ ID NO: 2012514 - RNA, 20 nt, Shigella flexneri 2a str. 301
ugguaaagccgguuuugguu

SEQ ID NO: 2012515 - RNA, 22 nt, Shigella flexneri 2a str. 301
ugguaaaggagaggcccuggaa

SEQ ID NO: 2012516 - RNA, 22 nt, Shigella flexneri 2a str. 301
ugguaaauggcugaccagaauu

SEQ ID NO: 2012517 - RNA, 18 nt, Shigella flexneri 2a str. 301
ugguaacgccccacaaac

SEQ ID NO: 2012518 - RNA, 15 nt, Shigella flexneri 2a str. 301
uggguuucauccugc

SEQ ID NO: 2012519 - RNA, 21 nt, Shigella flexneri 2a str. 301
uggguucacuuuccccggcau

SEQ ID NO: 2012520 - RNA, 16 nt, Shigella flexneri 2a str. 301
uggguguuuaugcccg

SEQ ID NO: 2012521 - RNA, 15 nt, Shigella flexneri 2a str. 301
uggguuucugccgcu

SEQ ID NO: 2012522 - RNA, 20 nt, Shigella flexneri 2a str. 301
uggguuuguccauaaaaugc

SEQ ID NO: 2012523 - RNA, 21 nt, Shigella flexneri 2a str. 301
uggguuuguccauaaaaugca

SEQ ID NO: 2012524 - RNA, 16 nt, Shigella flexneri 2a str. 301
ugguauuaaauuugcu

SEQ ID NO: 2012525 - RNA, 18 nt, Shigella flexneri 2a str. 301
ugguauuuccaguccagc

SEQ ID NO: 2012526 - RNA, 19 nt, Shigella flexneri 2a str. 301
ugguauuggaagguuaaua

SEQ ID NO: 2012527 - RNA, 15 nt, Shigella flexneri 2a str. 301
ugguacuggugcaaa

SEQ ID NO: 2012528 - RNA, 21 nt, Shigella flexneri 2a str. 301
ugguaccguguaaaaugacuc

SEQ ID NO: 2012529 - RNA, 15 nt, Shigella flexneri 2a str. 301
ugguagcugcccccg

SEQ ID NO: 2012530 - RNA, 23 nt, Shigella flexneri 2a str. 301
ugguagggcugacgcaucauuac

SEQ ID NO: 2012531 - RNA, 16 nt, Shigella flexneri 2a str. 301
uggcggggaucacucc

SEQ ID NO: 2012532 - RNA, 21 nt, Shigella flexneri 2a str. 301
uggcggggagggaauccagca

SEQ ID NO: 2012533 - RNA, 14 nt, Shigella flexneri 2a str. 301
uggcggaaacgggu

SEQ ID NO: 2012534 - RNA, 17 nt, Shigella flexneri 2a str. 301
uggcggaaaucuuucau

SEQ ID NO: 2012535 - RNA, 15 nt, Shigella flexneri 2a str. 301
uggcggaauugguag

SEQ ID NO: 2012536 - RNA, 12 nt, Shigella flexneri 2a str. 301
uggcgcugcuca

SEQ ID NO: 2012537 - RNA, 12 nt, Shigella flexneri 2a str. 301
uggcgauagccc

SEQ ID NO: 2012538 - RNA, 13 nt, Shigella flexneri 2a str. 301
uggcgaggaacga

SEQ ID NO: 2012539 - RNA, 22 nt, Shigella flexneri 2a str. 301
uggcgauaaucgaaccaaacag

SEQ ID NO: 2012540 - RNA, 12 nt, Shigella flexneri 2a str. 301
uggcgaauagaa

SEQ ID NO: 2012541 - RNA, 20 nt, Shigella flexneri 2a str. 301
uggccucugccagcugcuca

SEQ ID NO: 2012542 - RNA, 14 nt, Shigella flexneri 2a str. 301
uggccucugccagc

SEQ ID NO: 2012543 - RNA, 15 nt, Shigella flexneri 2a str. 301
uggccugauaaacau

SEQ ID NO: 2012544 - RNA, 18 nt, Shigella flexneri 2a str. 301
uggccuuuaauaugccac

SEQ ID NO: 2012545 - RNA, 15 nt, Shigella flexneri 2a str. 301
uggccguuauccuga

SEQ ID NO: 2012546 - RNA, 23 nt, Shigella flexneri 2a str. 301
uggccgucaggguugccauacag

SEQ ID NO: 2012547 - RNA, 21 nt, Shigella flexneri 2a str. 301
uggcagcaccgauccuggcgg

SEQ ID NO: 2012548 - RNA, 22 nt, Shigella flexneri 2a str. 301
uggcauuuuuaucucaaaaauu

SEQ ID NO: 2012549 - RNA, 15 nt, Shigella flexneri 2a str. 301
uggccaauuggcugg

SEQ ID NO: 2012550 - RNA, 19 nt, Shigella flexneri 2a str. 301
uggccaauuggcuggcccu

SEQ ID NO: 2012551 - RNA, 20 nt, Shigella flexneri 2a str. 301
uggccaauuggcuggcccuu

SEQ ID NO: 2012552 - RNA, 16 nt, Shigella flexneri 2a str. 301
uggccgauaccaucac

SEQ ID NO: 2012553 - RNA, 21 nt, Shigella flexneri 2a str. 301
uggccgauccggacaugcugc

SEQ ID NO: 2012554 - RNA, 14 nt, Shigella flexneri 2a str. 301
uggccgccacgcgu

SEQ ID NO: 2012555 - RNA, 17 nt, Shigella flexneri 2a str. 301
uggccaguaaucggcug

SEQ ID NO: 2012556 - RNA, 19 nt, Shigella flexneri 2a str. 301
uggcaaaugcaucagugac

SEQ ID NO: 2012557 - RNA, 21 nt, Shigella flexneri 2a str. 301
uggcaaagcugucaccaauca

SEQ ID NO: 2012558 - RNA, 15 nt, Shigella flexneri 2a str. 301
ugcguugcgcuucuc

SEQ ID NO: 2012559 - RNA, 18 nt, Shigella flexneri 2a str. 301
ugcguuccggcaugauuc

SEQ ID NO: 2012560 - RNA, 21 nt, Shigella flexneri 2a str. 301
ugcguuccagcauguuauuca

SEQ ID NO: 2012561 - RNA, 19 nt, Shigella flexneri 2a str. 301
ugcguuacccacaguuuca

SEQ ID NO: 2012562 - RNA, 18 nt, Shigella flexneri 2a str. 301
uggcacauucugacuggg

SEQ ID NO: 2012563 - RNA, 19 nt, Shigella flexneri 2a str. 301
uggcacaugcauaaagcgg

SEQ ID NO: 2012564 - RNA, 20 nt, Shigella flexneri 2a str. 301
uggcacaaauggcaaugacu

SEQ ID NO: 2012565 - RNA, 12 nt, Shigella flexneri 2a str. 301
uggcacaacucg

SEQ ID NO: 2012566 - RNA, 17 nt, Shigella flexneri 2a str. 301
uggcaccaguaaaccaa

SEQ ID NO: 2012567 - RNA, 18 nt, Shigella flexneri 2a str. 301
uggcaccuguaccagccc

SEQ ID NO: 2012568 - RNA, 20 nt, Shigella flexneri 2a str. 301
uggcaauacgauccugagca

SEQ ID NO: 2012569 - RNA, 22 nt, Shigella flexneri 2a str. 301
uggcaauacuggcagcagucgc

SEQ ID NO: 2012570 - RNA, 19 nt, Shigella flexneri 2a str. 301
uggcaaucagcggcaguuc

SEQ ID NO: 2012571 - RNA, 17 nt, Shigella flexneri 2a str. 301
uggcaaaucaguggcug

SEQ ID NO: 2012572 - RNA, 16 nt, Shigella flexneri 2a str. 301
uggcaaauuuauuauc

SEQ ID NO: 2012573 - RNA, 13 nt, Shigella flexneri 2a str. 301
uggcaacacagau

SEQ ID NO: 2012574 - RNA, 16 nt, Shigella flexneri 2a str. 301
uggcaaugcgcuguuu

SEQ ID NO: 2012575 - RNA, 18 nt, Shigella flexneri 2a str. 301
uggcaauggcgacuucug

SEQ ID NO: 2012576 - RNA, 20 nt, Shigella flexneri 2a str. 301
uggcaaugcccgguguuccc

SEQ ID NO: 2012577 - RNA, 21 nt, Shigella flexneri 2a str. 301
uggcaaugacuagcgccauaa

SEQ ID NO: 2012578 - RNA, 21 nt, Shigella flexneri 2a str. 301
uggcaauccagcucuuuucca

SEQ ID NO: 2012579 - RNA, 18 nt, Shigella flexneri 2a str. 301
uggcaaucuuccucgcca

SEQ ID NO: 2012580 - RNA, 16 nt, Shigella flexneri 2a str. 301
uggcaaucuuccucgc

SEQ ID NO: 2012581 - RNA, 21 nt, Shigella flexneri 2a str. 301
uucaaaucgacgcgugaaaau

SEQ ID NO: 2012582 - RNA, 17 nt, Shigella flexneri 2a str. 301
uucaaauccucaaugac

SEQ ID NO: 2012583 - RNA, 18 nt, Shigella flexneri 2a str. 301
uucaaauccucaaugacu

SEQ ID NO: 2012584 - RNA, 14 nt, Shigella flexneri 2a str. 301
uucaaauccuucag

SEQ ID NO: 2012585 - RNA, 17 nt, Shigella flexneri 2a str. 301
uucaaagguaaugguca

SEQ ID NO: 2012586 - RNA, 17 nt, Shigella flexneri 2a str. 301
uuauuuugcccugcuau

SEQ ID NO: 2012587 - RNA, 12 nt, Shigella flexneri 2a str. 301
uuauuuuuaaac

SEQ ID NO: 2012588 - RNA, 22 nt, Shigella flexneri 2a str. 301
uucaaacugaagauugaacagc

SEQ ID NO: 2012589 - RNA, 22 nt, Shigella flexneri 2a str. 301
uucaacgguaaguugacgagau

SEQ ID NO: 2012590 - RNA, 23 nt, Shigella flexneri 2a str. 301
uucaacagguuuuguugcccagc

SEQ ID NO: 2012591 - RNA, 17 nt, Shigella flexneri 2a str. 301
uucaacagcgugaacug

SEQ ID NO: 2012592 - RNA, 23 nt, Shigella flexneri 2a str. 301
uucaacggacgauuugccgucuc

SEQ ID NO: 2012593 - RNA, 18 nt, Shigella flexneri 2a str. 301
uucaacauauccuucaca

SEQ ID NO: 2012594 - RNA, 23 nt, Shigella flexneri 2a str. 301
uucaacgcucuccugcggaaugc

SEQ ID NO: 2012595 - RNA, 14 nt, Shigella flexneri 2a str. 301
uucaaauuaugucu

SEQ ID NO: 2012596 - RNA, 19 nt, Shigella flexneri 2a str. 301
uucaacagauuacauuaaa

SEQ ID NO: 2012597 - RNA, 19 nt, Shigella flexneri 2a str. 301
uucaacaauugaagaauau

SEQ ID NO: 2012598 - RNA, 17 nt, Shigella flexneri 2a str. 301
uuaggaccgguuucaaa

SEQ ID NO: 2012599 - RNA, 18 nt, Shigella flexneri 2a str. 301
uuaggaugcugcaauaaa

SEQ ID NO: 2012600 - RNA, 21 nt, Shigella flexneri 2a str. 301
uuauucagcuggcagugcuau

SEQ ID NO: 2012601 - RNA, 15 nt, Shigella flexneri 2a str. 301
uuauucagcagacca

SEQ ID NO: 2012602 - RNA, 20 nt, Shigella flexneri 2a str. 301
uuauugguaguguguuugau

SEQ ID NO: 2012603 - RNA, 23 nt, Shigella flexneri 2a str. 301
uuauuucaacagauuacauuaaa

SEQ ID NO: 2012604 - RNA, 12 nt, Shigella flexneri 2a str. 301
uuauugauaacc

SEQ ID NO: 2012605 - RNA, 13 nt, Shigella flexneri 2a str. 301
uucaaucugguga

SEQ ID NO: 2012606 - RNA, 20 nt, Shigella flexneri 2a str. 301
uucaaugauaaaggucauca

SEQ ID NO: 2012607 - RNA, 22 nt, Shigella flexneri 2a str. 301
uucaaugaaugcuucgcucucu

SEQ ID NO: 2012608 - RNA, 22 nt, Shigella flexneri 2a str. 301
uucaaugauaaaggucaucaca

SEQ ID NO: 2012609 - RNA, 15 nt, Shigella flexneri 2a str. 301
uucaaugccgccgau

SEQ ID NO: 2012610 - RNA, 17 nt, Shigella flexneri 2a str. 301
uucaaugcgaucuaccc

SEQ ID NO: 2012611 - RNA, 17 nt, Shigella flexneri 2a str. 301
uucaagcucaaaauaau

SEQ ID NO: 2012612 - RNA, 21 nt, Shigella flexneri 2a str. 301
uucaaggagggaucgacagau

SEQ ID NO: 2012613 - RNA, 22 nt, Shigella flexneri 2a str. 301
uucaaguccccccccucgcacc

SEQ ID NO: 2012614 - RNA, 16 nt, Shigella flexneri 2a str. 301
uucaauuaauugugaa

SEQ ID NO: 2012615 - RNA, 22 nt, Shigella flexneri 2a str. 301
uucaauuauaguaucguuaaau

SEQ ID NO: 2012616 - RNA, 20 nt, Shigella flexneri 2a str. 301
uucaauuagcgccucggggc

SEQ ID NO: 2012617 - RNA, 20 nt, Shigella flexneri 2a str. 301
uucaauuagcuuuaauccau

SEQ ID NO: 2012618 - RNA, 20 nt, Shigella flexneri 2a str. 301
uucaauucacgaauauuucc

SEQ ID NO: 2012619 - RNA, 11 nt, Shigella flexneri 2a str. 301
uucacauguuc

SEQ ID NO: 2012620 - RNA, 19 nt, Shigella flexneri 2a str. 301
uucacaaccgggcauuuuu

SEQ ID NO: 2012621 - RNA, 14 nt, Shigella flexneri 2a str. 301
uucaccaaagcuga

SEQ ID NO: 2012622 - RNA, 15 nt, Shigella flexneri 2a str. 301
uucacauuuaaacaa

SEQ ID NO: 2012623 - RNA, 15 nt, Shigella flexneri 2a str. 301
uucacaaguuguccc

SEQ ID NO: 2012624 - RNA, 16 nt, Shigella flexneri 2a str. 301
uucacaaacagcgccu

SEQ ID NO: 2012625 - RNA, 18 nt, Shigella flexneri 2a str. 301
uucagaacacaaaaccga

SEQ ID NO: 2012626 - RNA, 20 nt, Shigella flexneri 2a str. 301
uucagaucuuuaaugaucuu

SEQ ID NO: 2012627 - RNA, 13 nt, Shigella flexneri 2a str. 301
uucagaucuuuca

SEQ ID NO: 2012628 - RNA, 15 nt, Shigella flexneri 2a str. 301
uucagauugcagaca

SEQ ID NO: 2012629 - RNA, 20 nt, Shigella flexneri 2a str. 301
uucagauugcagacaaagug

SEQ ID NO: 2012630 - RNA, 20 nt, Shigella flexneri 2a str. 301
uucagccugaccgcacaccc

SEQ ID NO: 2012631 - RNA, 21 nt, Shigella flexneri 2a str. 301
uucagcaaaccacugauaagc

SEQ ID NO: 2012632 - RNA, 17 nt, Shigella flexneri 2a str. 301
uucacuucaaccacauu

SEQ ID NO: 2012633 - RNA, 20 nt, Shigella flexneri 2a str. 301
uucacugggcgauuaauaaa

SEQ ID NO: 2012634 - RNA, 20 nt, Shigella flexneri 2a str. 301
uucacuuuugccagacgaau

SEQ ID NO: 2012635 - RNA, 17 nt, Shigella flexneri 2a str. 301
uucacuuuugcugcaaa

SEQ ID NO: 2012636 - RNA, 19 nt, Shigella flexneri 2a str. 301
uucagaaauuuggcuccuc

SEQ ID NO: 2012637 - RNA, 17 nt, Shigella flexneri 2a str. 301
uucacuucuucaauaaa

SEQ ID NO: 2012638 - RNA, 13 nt, Shigella flexneri 2a str. 301
uucacuucgucag

SEQ ID NO: 2012639 - RNA, 16 nt, Shigella flexneri 2a str. 301
uucacugacgcccguu

SEQ ID NO: 2012640 - RNA, 19 nt, Shigella flexneri 2a str. 301
uucacugccguacaggcag

SEQ ID NO: 2012641 - RNA, 22 nt, Shigella flexneri 2a str. 301
uucacugccaccagcagcguuu

SEQ ID NO: 2012642 - RNA, 12 nt, Shigella flexneri 2a str. 301
uucacugccugc

SEQ ID NO: 2012643 - RNA, 17 nt, Shigella flexneri 2a str. 301
uucacucugcugccaca

SEQ ID NO: 2012644 - RNA, 16 nt, Shigella flexneri 2a str. 301
uucacgguauuauuca

SEQ ID NO: 2012645 - RNA, 19 nt, Shigella flexneri 2a str. 301
uucacgcgcuccaggaguu

SEQ ID NO: 2012646 - RNA, 18 nt, Shigella flexneri 2a str. 301
uucacgcuaaaagcgauu

SEQ ID NO: 2012647 - RNA, 18 nt, Shigella flexneri 2a str. 301
uucacgcgcuccaggagu

SEQ ID NO: 2012648 - RNA, 22 nt, Shigella flexneri 2a str. 301
uucacgccgggaaauuuuuccg

SEQ ID NO: 2012649 - RNA, 20 nt, Shigella flexneri 2a str. 301
uucacggcuuugucauuaaa

SEQ ID NO: 2012650 - RNA, 21 nt, Shigella flexneri 2a str. 301
uucacggcgauaccaguaaua

SEQ ID NO: 2012651 - RNA, 17 nt, Shigella flexneri 2a str. 301
uucaccaaucggcagaa

SEQ ID NO: 2012652 - RNA, 23 nt, Shigella flexneri 2a str. 301
uucaccagaccugaaaccgccuu

SEQ ID NO: 2012653 - RNA, 18 nt, Shigella flexneri 2a str. 301
uucaccagcacuucacug

SEQ ID NO: 2012654 - RNA, 16 nt, Shigella flexneri 2a str. 301
uucaccagcaucgccg

SEQ ID NO: 2012655 - RNA, 14 nt, Shigella flexneri 2a str. 301
uucaccagcgcacg

SEQ ID NO: 2012656 - RNA, 18 nt, Shigella flexneri 2a str. 301
uucacgccgcaucuggca

SEQ ID NO: 2012657 - RNA, 23 nt, Shigella flexneri 2a str. 301
uucacgccgcauccggcaguaau

SEQ ID NO: 2012658 - RNA, 23 nt, Shigella flexneri 2a str. 301
uucacgccgcauccggcaaguug

SEQ ID NO: 2012659 - RNA, 19 nt, Shigella flexneri 2a str. 301
uucacgccgcauccggcaa

SEQ ID NO: 2012660 - RNA, 21 nt, Shigella flexneri 2a str. 301
uucacgcccgccccaguaaau

SEQ ID NO: 2012661 - RNA, 16 nt, Shigella flexneri 2a str. 301
uucaccauuggucuuu

SEQ ID NO: 2012662 - RNA, 15 nt, Shigella flexneri 2a str. 301
uucacgcagugcugc

SEQ ID NO: 2012663 - RNA, 18 nt, Shigella flexneri 2a str. 301
uucacgccaaccagcuga

SEQ ID NO: 2012664 - RNA, 22 nt, Shigella flexneri 2a str. 301
uucaccauucugcgcugacucu

SEQ ID NO: 2012665 - RNA, 14 nt, Shigella flexneri 2a str. 301
uucaucaccagcuc

SEQ ID NO: 2012666 - RNA, 24 nt, Shigella flexneri 2a str. 301
uucaucauccuuugggcauuugca

SEQ ID NO: 2012667 - RNA, 15 nt, Shigella flexneri 2a str. 301
uucaucgcccuuuuu

SEQ ID NO: 2012668 - RNA, 17 nt, Shigella flexneri 2a str. 301
uucaucgcuaaaauacu

SEQ ID NO: 2012669 - RNA, 19 nt, Shigella flexneri 2a str. 301
uucaucgccuucuugaacc

SEQ ID NO: 2012670 - RNA, 19 nt, Shigella flexneri 2a str. 301
uucauccuggcacagcagu

SEQ ID NO: 2012671 - RNA, 17 nt, Shigella flexneri 2a str. 301
uucauccuggcacagca

SEQ ID NO: 2012672 - RNA, 22 nt, Shigella flexneri 2a str. 301
uucauccguuucucuguucagc

SEQ ID NO: 2012673 - RNA, 14 nt, Shigella flexneri 2a str. 301
uucauccguuuccc

SEQ ID NO: 2012674 - RNA, 18 nt, Shigella flexneri 2a str. 301
uucaucccgaccaaugca

SEQ ID NO: 2012675 - RNA, 16 nt, Shigella flexneri 2a str. 301
uucauccgauccucac

SEQ ID NO: 2012676 - RNA, 12 nt, Shigella flexneri 2a str. 301
uucauccagcag

SEQ ID NO: 2012677 - RNA, 13 nt, Shigella flexneri 2a str. 301
uucauccagugcu

SEQ ID NO: 2012678 - RNA, 16 nt, Shigella flexneri 2a str. 301
uucauauccgucauau

SEQ ID NO: 2012679 - RNA, 12 nt, Shigella flexneri 2a str. 301
uucauauugccg

SEQ ID NO: 2012680 - RNA, 22 nt, Shigella flexneri 2a str. 301
uucaucaagcugugccugaaua

SEQ ID NO: 2012681 - RNA, 22 nt, Shigella flexneri 2a str. 301
uucaucaagaaaacgaauacug

SEQ ID NO: 2012682 - RNA, 21 nt, Shigella flexneri 2a str. 301
uucauacugccgaccaucugu

SEQ ID NO: 2012683 - RNA, 22 nt, Shigella flexneri 2a str. 301
uucauacggcacuuucaucgcg

SEQ ID NO: 2012684 - RNA, 15 nt, Shigella flexneri 2a str. 301
uucauauagaucuuu

SEQ ID NO: 2012685 - RNA, 19 nt, Shigella flexneri 2a str. 301
uucauaguaagcagauucu

SEQ ID NO: 2012686 - RNA, 21 nt, Shigella flexneri 2a str. 301
uucagcgaucgcuuucgcuuu

SEQ ID NO: 2012687 - RNA, 16 nt, Shigella flexneri 2a str. 301
uucagcgaaaaagucc

SEQ ID NO: 2012688 - RNA, 16 nt, Shigella flexneri 2a str. 301
uucagcguuccccaga

SEQ ID NO: 2012689 - RNA, 10 nt, Shigella flexneri 2a str. 301
uucaggucag

SEQ ID NO: 2012690 - RNA, 14 nt, Shigella flexneri 2a str. 301
uucagugcaaaugc

SEQ ID NO: 2012691 - RNA, 19 nt, Shigella flexneri 2a str. 301
uucagugacuucugccagc

SEQ ID NO: 2012692 - RNA, 16 nt, Shigella flexneri 2a str. 301
uucagugcaaaugcca

SEQ ID NO: 2012693 - RNA, 13 nt, Shigella flexneri 2a str. 301
uucagugccaggu

SEQ ID NO: 2012694 - RNA, 19 nt, Shigella flexneri 2a str. 301
uucaguggcuuaucuuccu

SEQ ID NO: 2012695 - RNA, 22 nt, Shigella flexneri 2a str. 301
uucaguauagcggggaacauca

SEQ ID NO: 2012696 - RNA, 15 nt, Shigella flexneri 2a str. 301
uucaguaugguauua

SEQ ID NO: 2012697 - RNA, 15 nt, Shigella flexneri 2a str. 301
uucaguauugagcaa

SEQ ID NO: 2012698 - RNA, 19 nt, Shigella flexneri 2a str. 301
uucagguguuaguguccuu

SEQ ID NO: 2012699 - RNA, 18 nt, Shigella flexneri 2a str. 301
uucaguacgaaauaacug

SEQ ID NO: 2012700 - RNA, 19 nt, Shigella flexneri 2a str. 301
uucauaaagagguggggga

SEQ ID NO: 2012701 - RNA, 16 nt, Shigella flexneri 2a str. 301
uucauaaucacgcuuu

SEQ ID NO: 2012702 - RNA, 10 nt, Shigella flexneri 2a str. 301
uucaguuccg

SEQ ID NO: 2012703 - RNA, 16 nt, Shigella flexneri 2a str. 301
uucaguucagaaagca

SEQ ID NO: 2012704 - RNA, 17 nt, Shigella flexneri 2a str. 301
uucaguuaccugaaugc

SEQ ID NO: 2012705 - RNA, 18 nt, Shigella flexneri 2a str. 301
uucaguggguuaugaaac

SEQ ID NO: 2012706 - RNA, 14 nt, Shigella flexneri 2a str. 301
uucaguuuuacucu

SEQ ID NO: 2012707 - RNA, 19 nt, Shigella flexneri 2a str. 301
uucaguuugccgcucaguu

SEQ ID NO: 2012708 - RNA, 14 nt, Shigella flexneri 2a str. 301
uucaucgugcucgc

SEQ ID NO: 2012709 - RNA, 17 nt, Shigella flexneri 2a str. 301
uucaucggcguuuucug

SEQ ID NO: 2012710 - RNA, 18 nt, Shigella flexneri 2a str. 301
uucaucucuucacgcuuu

SEQ ID NO: 2012711 - RNA, 15 nt, Shigella flexneri 2a str. 301
uucaucucuucuucc

SEQ ID NO: 2012712 - RNA, 13 nt, Shigella flexneri 2a str. 301
uucaucucaaaca

SEQ ID NO: 2012713 - RNA, 20 nt, Shigella flexneri 2a str. 301
uucaucuuuccaaaccucag

SEQ ID NO: 2012714 - RNA, 22 nt, Shigella flexneri 2a str. 301
uucaucuucuucgaaacguucc

SEQ ID NO: 2012715 - RNA, 19 nt, Shigella flexneri 2a str. 301
uucaugaucuuuuuugucg

SEQ ID NO: 2012716 - RNA, 16 nt, Shigella flexneri 2a str. 301
uucauuacaccaauac

SEQ ID NO: 2012717 - RNA, 20 nt, Shigella flexneri 2a str. 301
uucauuaagaacuccugaaa

SEQ ID NO: 2012718 - RNA, 17 nt, Shigella flexneri 2a str. 301
uucaugcaggccauguu

SEQ ID NO: 2012719 - RNA, 14 nt, Shigella flexneri 2a str. 301
uucaugcacuuggu

SEQ ID NO: 2012720 - RNA, 21 nt, Shigella flexneri 2a str. 301
uucaugguacgggacagcagg

SEQ ID NO: 2012721 - RNA, 14 nt, Shigella flexneri 2a str. 301
uucauggugcaaga

SEQ ID NO: 2012722 - RNA, 16 nt, Shigella flexneri 2a str. 301
uucauggugcaagaaa

SEQ ID NO: 2012723 - RNA, 22 nt, Shigella flexneri 2a str. 301
uucaugcugacaucaagccaga

SEQ ID NO: 2012724 - RNA, 21 nt, Shigella flexneri 2a str. 301
uuccaacuguaccagcaacug

SEQ ID NO: 2012725 - RNA, 22 nt, Shigella flexneri 2a str. 301
uucauugaacgggugauuuccc

SEQ ID NO: 2012726 - RNA, 21 nt, Shigella flexneri 2a str. 301
uucauugaaugcggcaggcac

SEQ ID NO: 2012727 - RNA, 21 nt, Shigella flexneri 2a str. 301
uucauugagcgcaaaugguga

SEQ ID NO: 2012728 - RNA, 12 nt, Shigella flexneri 2a str. 301
uucauuccuuga

SEQ ID NO: 2012729 - RNA, 13 nt, Shigella flexneri 2a str. 301
uucauuguugacu

SEQ ID NO: 2012730 - RNA, 13 nt, Shigella flexneri 2a str. 301
uucauuuacauca

SEQ ID NO: 2012731 - RNA, 18 nt, Shigella flexneri 2a str. 301
uucauuucaauaaauucc

SEQ ID NO: 2012732 - RNA, 13 nt, Shigella flexneri 2a str. 301
uucauuugccagc

SEQ ID NO: 2012733 - RNA, 18 nt, Shigella flexneri 2a str. 301
uuccugagcacuggggcu

SEQ ID NO: 2012734 - RNA, 17 nt, Shigella flexneri 2a str. 301
uuccugagcaauaaucu

SEQ ID NO: 2012735 - RNA, 13 nt, Shigella flexneri 2a str. 301
uuccugagaggau

SEQ ID NO: 2012736 - RNA, 16 nt, Shigella flexneri 2a str. 301
uuccugaguaauaacu

SEQ ID NO: 2012737 - RNA, 19 nt, Shigella flexneri 2a str. 301
uuccuaaccgaauucaaau

SEQ ID NO: 2012738 - RNA, 19 nt, Shigella flexneri 2a str. 301
uuccguucaaaacagcccu

SEQ ID NO: 2012739 - RNA, 15 nt, Shigella flexneri 2a str. 301
uuccgucagcggcaa

SEQ ID NO: 2012740 - RNA, 13 nt, Shigella flexneri 2a str. 301
uuccgucaucuua

SEQ ID NO: 2012741 - RNA, 22 nt, Shigella flexneri 2a str. 301
uuccgguuugcguugcacgcag

SEQ ID NO: 2012742 - RNA, 16 nt, Shigella flexneri 2a str. 301
uuccggucgcaggcag

SEQ ID NO: 2012743 - RNA, 17 nt, Shigella flexneri 2a str. 301
uucgacaauaaucaacg

SEQ ID NO: 2012744 - RNA, 13 nt, Shigella flexneri 2a str. 301
uuccuucaacccg

SEQ ID NO: 2012745 - RNA, 20 nt, Shigella flexneri 2a str. 301
uuccuucgcuuccuguauau

SEQ ID NO: 2012746 - RNA, 15 nt, Shigella flexneri 2a str. 301
uuccuugaaaaagag

SEQ ID NO: 2012747 - RNA, 14 nt, Shigella flexneri 2a str. 301
uucgaagacaucca

SEQ ID NO: 2012748 - RNA, 11 nt, Shigella flexneri 2a str. 301
uucgaacugga

SEQ ID NO: 2012749 - RNA, 23 nt, Shigella flexneri 2a str. 301
uuccgcacguuagaaacaaaaaa

SEQ ID NO: 2012750 - RNA, 20 nt, Shigella flexneri 2a str. 301
uuccgcaccugccagcgccg

SEQ ID NO: 2012751 - RNA, 20 nt, Shigella flexneri 2a str. 301
uucccuucaggcgugauuca

SEQ ID NO: 2012752 - RNA, 22 nt, Shigella flexneri 2a str. 301
uucccuggcguucgguauuaau

SEQ ID NO: 2012753 - RNA, 13 nt, Shigella flexneri 2a str. 301
uucccugacaaau

SEQ ID NO: 2012754 - RNA, 19 nt, Shigella flexneri 2a str. 301
uucccugcgccagcgcgac

SEQ ID NO: 2012755 - RNA, 21 nt, Shigella flexneri 2a str. 301
uucccugcagucaccugcccu

SEQ ID NO: 2012756 - RNA, 15 nt, Shigella flexneri 2a str. 301
uuccggccaucgccu

SEQ ID NO: 2012757 - RNA, 14 nt, Shigella flexneri 2a str. 301
uuccgcgaaacagg

SEQ ID NO: 2012758 - RNA, 14 nt, Shigella flexneri 2a str. 301
uuccggcuuguuca

SEQ ID NO: 2012759 - RNA, 18 nt, Shigella flexneri 2a str. 301
uuccgggagcaauuugua

SEQ ID NO: 2012760 - RNA, 20 nt, Shigella flexneri 2a str. 301
uuccgccagcgacugcgccg

SEQ ID NO: 2012761 - RNA, 19 nt, Shigella flexneri 2a str. 301
uucccggguaguacuuaac

SEQ ID NO: 2012762 - RNA, 14 nt, Shigella flexneri 2a str. 301
uucccgggcuucuc

SEQ ID NO: 2012763 - RNA, 18 nt, Shigella flexneri 2a str. 301
uuccccuguugcaaacug

SEQ ID NO: 2012764 - RNA, 20 nt, Shigella flexneri 2a str. 301
uucccguccacugcgagaaa

SEQ ID NO: 2012765 - RNA, 20 nt, Shigella flexneri 2a str. 301
uucccucccguuucccuguc

SEQ ID NO: 2012766 - RNA, 17 nt, Shigella flexneri 2a str. 301
uuccccggaugaguaca

SEQ ID NO: 2012767 - RNA, 20 nt, Shigella flexneri 2a str. 301
uuccccggaaccugaacucg

SEQ ID NO: 2012768 - RNA, 14 nt, Shigella flexneri 2a str. 301
uucccccugccaga

SEQ ID NO: 2012769 - RNA, 23 nt, Shigella flexneri 2a str. 301
uuccccuguaacgagaaguuuuu

SEQ ID NO: 2012770 - RNA, 17 nt, Shigella flexneri 2a str. 301
uuccccucuaccgcuuu

SEQ ID NO: 2012771 - RNA, 12 nt, Shigella flexneri 2a str. 301
uuccccucugcg

SEQ ID NO: 2012772 - RNA, 22 nt, Shigella flexneri 2a str. 301
uucgcgaucaaacgccagauca

SEQ ID NO: 2012773 - RNA, 16 nt, Shigella flexneri 2a str. 301
uucgcgcacaggcugc

SEQ ID NO: 2012774 - RNA, 19 nt, Shigella flexneri 2a str. 301
uucgcgaaucgccacaacu

SEQ ID NO: 2012775 - RNA, 16 nt, Shigella flexneri 2a str. 301
uucgcggaauuucaga

SEQ ID NO: 2012776 - RNA, 15 nt, Shigella flexneri 2a str. 301
uucgccgaacacaca

SEQ ID NO: 2012777 - RNA, 15 nt, Shigella flexneri 2a str. 301
uucgcccgccagcgu

SEQ ID NO: 2012778 - RNA, 16 nt, Shigella flexneri 2a str. 301
uucgccauuccuguag

SEQ ID NO: 2012779 - RNA, 21 nt, Shigella flexneri 2a str. 301
uucgcaauaaucaucucuccu

SEQ ID NO: 2012780 - RNA, 19 nt, Shigella flexneri 2a str. 301
uucgccaggucagagagcc

SEQ ID NO: 2012781 - RNA, 16 nt, Shigella flexneri 2a str. 301
uucgccaggacagaga

SEQ ID NO: 2012782 - RNA, 14 nt, Shigella flexneri 2a str. 301
uucgauugcacaaa

SEQ ID NO: 2012783 - RNA, 19 nt, Shigella flexneri 2a str. 301
uucgcaaaaaaccaucccu

SEQ ID NO: 2012784 - RNA, 15 nt, Shigella flexneri 2a str. 301
uucgcaaaaaaccau

SEQ ID NO: 2012785 - RNA, 16 nt, Shigella flexneri 2a str. 301
uucgagcaauuuuccu

SEQ ID NO: 2012786 - RNA, 22 nt, Shigella flexneri 2a str. 301
uucgagcaucacaucaaauccc

SEQ ID NO: 2012787 - RNA, 23 nt, Shigella flexneri 2a str. 301
uucgauaaacucaaucaggcuau

SEQ ID NO: 2012788 - RNA, 14 nt, Shigella flexneri 2a str. 301
uucgacggcaucag

SEQ ID NO: 2012789 - RNA, 20 nt, Shigella flexneri 2a str. 301
uucgagaagcaagcauuaua

SEQ ID NO: 2012790 - RNA, 14 nt, Shigella flexneri 2a str. 301
uucgaugagagcgg

SEQ ID NO: 2012791 - RNA, 20 nt, Shigella flexneri 2a str. 301
uucgauagacucccagccuc

SEQ ID NO: 2012792 - RNA, 17 nt, Shigella flexneri 2a str. 301
uucgauacauucagaau

SEQ ID NO: 2012793 - RNA, 14 nt, Shigella flexneri 2a str. 301
uucgauauaaaccu

SEQ ID NO: 2012794 - RNA, 13 nt, Shigella flexneri 2a str. 301
uucgaucuggcag

SEQ ID NO: 2012795 - RNA, 17 nt, Shigella flexneri 2a str. 301
uucgaucuggcagcuaa

SEQ ID NO: 2012796 - RNA, 18 nt, Shigella flexneri 2a str. 301
uucgggcacagauuucca

SEQ ID NO: 2012797 - RNA, 16 nt, Shigella flexneri 2a str. 301
uucgguaaugacucca

SEQ ID NO: 2012798 - RNA, 15 nt, Shigella flexneri 2a str. 301
uucggguuauugguu

SEQ ID NO: 2012799 - RNA, 21 nt, Shigella flexneri 2a str. 301
uucgucccagucgucauccca

SEQ ID NO: 2012800 - RNA, 19 nt, Shigella flexneri 2a str. 301
uucgucuggcgauuuugaa

SEQ ID NO: 2012801 - RNA, 22 nt, Shigella flexneri 2a str. 301
uucgucguaguaguucaucccc

SEQ ID NO: 2012802 - RNA, 22 nt, Shigella flexneri 2a str. 301
uucgucgaguuuauagccuguc

SEQ ID NO: 2012803 - RNA, 15 nt, Shigella flexneri 2a str. 301
uucguucuucagacu

SEQ ID NO: 2012804 - RNA, 18 nt, Shigella flexneri 2a str. 301
uucggcagucacuuuuuu

SEQ ID NO: 2012805 - RNA, 21 nt, Shigella flexneri 2a str. 301
uucggcgucuuguugaacagg

SEQ ID NO: 2012806 - RNA, 13 nt, Shigella flexneri 2a str. 301
uucggcaaucacc

SEQ ID NO: 2012807 - RNA, 16 nt, Shigella flexneri 2a str. 301
uucggcaggcuuugcu

SEQ ID NO: 2012808 - RNA, 21 nt, Shigella flexneri 2a str. 301
uucgcggcguugaauuuaugu

SEQ ID NO: 2012809 - RNA, 16 nt, Shigella flexneri 2a str. 301
uucgcgguaaugacuc

SEQ ID NO: 2012810 - RNA, 22 nt, Shigella flexneri 2a str. 301
uucuguguaaaugccuuucuca

SEQ ID NO: 2012811 - RNA, 16 nt, Shigella flexneri 2a str. 301
uucuguggcagggcag

SEQ ID NO: 2012812 - RNA, 21 nt, Shigella flexneri 2a str. 301
uucuguguaaaugccuuucuc

SEQ ID NO: 2012813 - RNA, 21 nt, Shigella flexneri 2a str. 301
uucuguugcugaaauuccauc

SEQ ID NO: 2012814 - RNA, 20 nt, Shigella flexneri 2a str. 301
uucugucgauaaacucaugg

SEQ ID NO: 2012815 - RNA, 11 nt, Shigella flexneri 2a str. 301
uucugucauga

SEQ ID NO: 2012816 - RNA, 15 nt, Shigella flexneri 2a str. 301
uucugucggcaaaac

SEQ ID NO: 2012817 - RNA, 19 nt, Shigella flexneri 2a str. 301
uucugugcagccaaaaaug

SEQ ID NO: 2012818 - RNA, 13 nt, Shigella flexneri 2a str. 301
uucugugcaucug

SEQ ID NO: 2012819 - RNA, 20 nt, Shigella flexneri 2a str. 301
uucugucuuaacgcaccaug

SEQ ID NO: 2012820 - RNA, 23 nt, Shigella flexneri 2a str. 301
uucuguaugccggauaagguguu

SEQ ID NO: 2012821 - RNA, 17 nt, Shigella flexneri 2a str. 301
uucugguuauauuuccc

SEQ ID NO: 2012822 - RNA, 14 nt, Shigella flexneri 2a str. 301
uucuggucauugcc

SEQ ID NO: 2012823 - RNA, 21 nt, Shigella flexneri 2a str. 301
uucuggcugacauaaacacca

SEQ ID NO: 2012824 - RNA, 21 nt, Shigella flexneri 2a str. 301
uucuuauaaagaaaaucugaa

SEQ ID NO: 2012825 - RNA, 14 nt, Shigella flexneri 2a str. 301
uucuuauaaagaaa

SEQ ID NO: 2012826 - RNA, 20 nt, Shigella flexneri 2a str. 301
uucuuagucccaaacagcag

SEQ ID NO: 2012827 - RNA, 15 nt, Shigella flexneri 2a str. 301
uucuucuucacuaag

SEQ ID NO: 2012828 - RNA, 14 nt, Shigella flexneri 2a str. 301
uucuucuucagcgc

SEQ ID NO: 2012829 - RNA, 22 nt, Shigella flexneri 2a str. 301
uucuucucgauaaaaccuuccu

SEQ ID NO: 2012830 - RNA, 19 nt, Shigella flexneri 2a str. 301
uucuucuagcgcaauaacc

SEQ ID NO: 2012831 - RNA, 18 nt, Shigella flexneri 2a str. 301
uucuucucaaccuuuccu

SEQ ID NO: 2012832 - RNA, 20 nt, Shigella flexneri 2a str. 301
uucuucgcugacaguaccca

SEQ ID NO: 2012833 - RNA, 15 nt, Shigella flexneri 2a str. 301
uucuuccagcggcag

SEQ ID NO: 2012834 - RNA, 15 nt, Shigella flexneri 2a str. 301
uucuucccaaaucuu

SEQ ID NO: 2012835 - RNA, 11 nt, Shigella flexneri 2a str. 301
uucuuccuuga

SEQ ID NO: 2012836 - RNA, 15 nt, Shigella flexneri 2a str. 301
uucuuccuugaaaug

SEQ ID NO: 2012837 - RNA, 15 nt, Shigella flexneri 2a str. 301
uucuucaacaauuga

SEQ ID NO: 2012838 - RNA, 13 nt, Shigella flexneri 2a str. 301
uucuucaaaaaua

SEQ ID NO: 2012839 - RNA, 17 nt, Shigella flexneri 2a str. 301
uucuucaacaauugaag

SEQ ID NO: 2012840 - RNA, 16 nt, Shigella flexneri 2a str. 301
uucuucaacgaagaaa

SEQ ID NO: 2012841 - RNA, 16 nt, Shigella flexneri 2a str. 301
uucuuauuaaauuguc

SEQ ID NO: 2012842 - RNA, 14 nt, Shigella flexneri 2a str. 301
uucuucacugacgc

SEQ ID NO: 2012843 - RNA, 17 nt, Shigella flexneri 2a str. 301
uucuucacggaaaauau

SEQ ID NO: 2012844 - RNA, 21 nt, Shigella flexneri 2a str. 301
uucuucaagccaggcuuuaaa

SEQ ID NO: 2012845 - RNA, 19 nt, Shigella flexneri 2a str. 301
uucuucaaguguggccgcc

SEQ ID NO: 2012846 - RNA, 22 nt, Shigella flexneri 2a str. 301
uucuucagcgacagggccagga

SEQ ID NO: 2012847 - RNA, 16 nt, Shigella flexneri 2a str. 301
uucuucaugccaaaag

SEQ ID NO: 2012848 - RNA, 12 nt, Shigella flexneri 2a str. 301
uucuuccagcau

SEQ ID NO: 2012849 - RNA, 21 nt, Shigella flexneri 2a str. 301
uucuuccagcaucgcccccau

SEQ ID NO: 2012850 - RNA, 23 nt, Shigella flexneri 2a str. 301
uucuucauucccggaaauugcca

SEQ ID NO: 2012851 - RNA, 21 nt, Shigella flexneri 2a str. 301
uucucccugguucaagagaga

SEQ ID NO: 2012852 - RNA, 11 nt, Shigella flexneri 2a str. 301
uucuccccccu

SEQ ID NO: 2012853 - RNA, 17 nt, Shigella flexneri 2a str. 301
uucuccgcguucaauac

SEQ ID NO: 2012854 - RNA, 18 nt, Shigella flexneri 2a str. 301
uucugaacugaacaaaaa

SEQ ID NO: 2012855 - RNA, 22 nt, Shigella flexneri 2a str. 301
uucugaacugaacaaaaaagag

SEQ ID NO: 2012856 - RNA, 20 nt, Shigella flexneri 2a str. 301
uucucuuuguuaaacagugc

SEQ ID NO: 2012857 - RNA, 14 nt, Shigella flexneri 2a str. 301
uucugaaaacuguu

SEQ ID NO: 2012858 - RNA, 15 nt, Shigella flexneri 2a str. 301
uucucuuucggcagu

SEQ ID NO: 2012859 - RNA, 17 nt, Shigella flexneri 2a str. 301
uucuccuucacucuaua

SEQ ID NO: 2012860 - RNA, 16 nt, Shigella flexneri 2a str. 301
uucuccuucacucuau

SEQ ID NO: 2012861 - RNA, 13 nt, Shigella flexneri 2a str. 301
uucuccuggcccg

SEQ ID NO: 2012862 - RNA, 20 nt, Shigella flexneri 2a str. 301
uucugcguucugauuuaauc

SEQ ID NO: 2012863 - RNA, 20 nt, Shigella flexneri 2a str. 301
uucugcgcuugguuuugcca

SEQ ID NO: 2012864 - RNA, 20 nt, Shigella flexneri 2a str. 301
uucugagcggccuuuuccuu

SEQ ID NO: 2012865 - RNA, 21 nt, Shigella flexneri 2a str. 301
uucugagucaauuucugcaaa

SEQ ID NO: 2012866 - RNA, 17 nt, Shigella flexneri 2a str. 301
uucugacuauauaaauu

SEQ ID NO: 2012867 - RNA, 22 nt, Shigella flexneri 2a str. 301
uucugacuauauaaauuacccu

SEQ ID NO: 2012868 - RNA, 19 nt, Shigella flexneri 2a str. 301
uucugagaucaaugcgcca

SEQ ID NO: 2012869 - RNA, 19 nt, Shigella flexneri 2a str. 301
uucugcguucugauuuaau

SEQ ID NO: 2012870 - RNA, 18 nt, Shigella flexneri 2a str. 301
uucugcuuuucccuccac

SEQ ID NO: 2012871 - RNA, 21 nt, Shigella flexneri 2a str. 301
uucuggcaccuguaccagccc

SEQ ID NO: 2012872 - RNA, 12 nt, Shigella flexneri 2a str. 301
uucuggcaucac

SEQ ID NO: 2012873 - RNA, 13 nt, Shigella flexneri 2a str. 301
uucuggcaccagu

SEQ ID NO: 2012874 - RNA, 14 nt, Shigella flexneri 2a str. 301
uucuggaugccauc

SEQ ID NO: 2012875 - RNA, 18 nt, Shigella flexneri 2a str. 301
uucuaugaagaacuggaa

SEQ ID NO: 2012876 - RNA, 14 nt, Shigella flexneri 2a str. 301
uucuaugaagaacu

SEQ ID NO: 2012877 - RNA, 17 nt, Shigella flexneri 2a str. 301
uucuauuuugcauuauu

SEQ ID NO: 2012878 - RNA, 16 nt, Shigella flexneri 2a str. 301
uucucaaucccuuucu

SEQ ID NO: 2012879 - RNA, 20 nt, Shigella flexneri 2a str. 301
uucucaauaaaaggaaacag

SEQ ID NO: 2012880 - RNA, 13 nt, Shigella flexneri 2a str. 301
uucucaaaugacc

SEQ ID NO: 2012881 - RNA, 21 nt, Shigella flexneri 2a str. 301
uucuccagcgaauccguucuu

SEQ ID NO: 2012882 - RNA, 13 nt, Shigella flexneri 2a str. 301
uucuccagcgccg

SEQ ID NO: 2012883 - RNA, 14 nt, Shigella flexneri 2a str. 301
uucguuuucagcuu

SEQ ID NO: 2012884 - RNA, 22 nt, Shigella flexneri 2a str. 301
uucguuuuggcagaaacagcca

SEQ ID NO: 2012885 - RNA, 23 nt, Shigella flexneri 2a str. 301
uucuacgugcgcuauguguuaaa

SEQ ID NO: 2012886 - RNA, 13 nt, Shigella flexneri 2a str. 301
uucuaaagccuga

SEQ ID NO: 2012887 - RNA, 21 nt, Shigella flexneri 2a str. 301
uugugccagaccaaacagcau

SEQ ID NO: 2012888 - RNA, 12 nt, Shigella flexneri 2a str. 301
uugugccagacc

SEQ ID NO: 2012889 - RNA, 14 nt, Shigella flexneri 2a str. 301
uugugcaccaccaa

SEQ ID NO: 2012890 - RNA, 15 nt, Shigella flexneri 2a str. 301
uugugcaccaccaaa

SEQ ID NO: 2012891 - RNA, 16 nt, Shigella flexneri 2a str. 301
uugugcaaauucaaua

SEQ ID NO: 2012892 - RNA, 18 nt, Shigella flexneri 2a str. 301
uugugcacgugccagaug

SEQ ID NO: 2012893 - RNA, 17 nt, Shigella flexneri 2a str. 301
uugugcaccagcuggcu

SEQ ID NO: 2012894 - RNA, 14 nt, Shigella flexneri 2a str. 301
uugugaucuuuuuc

SEQ ID NO: 2012895 - RNA, 11 nt, Shigella flexneri 2a str. 301
uugugaugcaa

SEQ ID NO: 2012896 - RNA, 16 nt, Shigella flexneri 2a str. 301
uugugcugugacagau

SEQ ID NO: 2012897 - RNA, 13 nt, Shigella flexneri 2a str. 301
uugugcuggcaaa

SEQ ID NO: 2012898 - RNA, 22 nt, Shigella flexneri 2a str. 301
uugugcuggcaaaucaguggcu

SEQ ID NO: 2012899 - RNA, 17 nt, Shigella flexneri 2a str. 301
uugucuuuuuaaugacu

SEQ ID NO: 2012900 - RNA, 20 nt, Shigella flexneri 2a str. 301
uugugacauuaaccaaccac

SEQ ID NO: 2012901 - RNA, 16 nt, Shigella flexneri 2a str. 301
uugugaagguaguccc

SEQ ID NO: 2012902 - RNA, 16 nt, Shigella flexneri 2a str. 301
uugucuccaccaauga

SEQ ID NO: 2012903 - RNA, 15 nt, Shigella flexneri 2a str. 301
uuguguaaguuuaac

SEQ ID NO: 2012904 - RNA, 15 nt, Shigella flexneri 2a str. 301
uuguggcggaaagac

SEQ ID NO: 2012905 - RNA, 16 nt, Shigella flexneri 2a str. 301
uuguucaugccggaug

SEQ ID NO: 2012906 - RNA, 22 nt, Shigella flexneri 2a str. 301
uuguuaacaacgugugcuuugu

SEQ ID NO: 2012907 - RNA, 20 nt, Shigella flexneri 2a str. 301
uuguguuuuuuauuucagua

SEQ ID NO: 2012908 - RNA, 16 nt, Shigella flexneri 2a str. 301
uuguguuuauuuaaug

SEQ ID NO: 2012909 - RNA, 14 nt, Shigella flexneri 2a str. 301
uuguuuucaugccg

SEQ ID NO: 2012910 - RNA, 15 nt, Shigella flexneri 2a str. 301
uuguuuuauaaagaa

SEQ ID NO: 2012911 - RNA, 20 nt, Shigella flexneri 2a str. 301
uuguuugcaaaaucaaauac

SEQ ID NO: 2012912 - RNA, 20 nt, Shigella flexneri 2a str. 301
uuguucucuucugcuuugcc

SEQ ID NO: 2012913 - RNA, 19 nt, Shigella flexneri 2a str. 301
uuguaaagaccauugaugc

SEQ ID NO: 2012914 - RNA, 23 nt, Shigella flexneri 2a str. 301
uuguaacaauccgauaaucccuu

SEQ ID NO: 2012915 - RNA, 12 nt, Shigella flexneri 2a str. 301
uuguaaaugaac

SEQ ID NO: 2012916 - RNA, 13 nt, Shigella flexneri 2a str. 301
uuguaaaagaagg

SEQ ID NO: 2012917 - RNA, 21 nt, Shigella flexneri 2a str. 301
uuguaagcugucgaaaagaua

SEQ ID NO: 2012918 - RNA, 12 nt, Shigella flexneri 2a str. 301
uuguacaaaaaa

SEQ ID NO: 2012919 - RNA, 14 nt, Shigella flexneri 2a str. 301
uuguagauuuugca

SEQ ID NO: 2012920 - RNA, 21 nt, Shigella flexneri 2a str. 301
uuguagccaauaaaugccacc

SEQ ID NO: 2012921 - RNA, 15 nt, Shigella flexneri 2a str. 301
uuguaguuugauaau

SEQ ID NO: 2012922 - RNA, 15 nt, Shigella flexneri 2a str. 301
uuguacuuuccagcc

SEQ ID NO: 2012923 - RNA, 13 nt, Shigella flexneri 2a str. 301
uuguagaccugau

SEQ ID NO: 2012924 - RNA, 13 nt, Shigella flexneri 2a str. 301
uuguagagcagca

SEQ ID NO: 2012925 - RNA, 17 nt, Shigella flexneri 2a str. 301
uuguaaucauauuaaau

SEQ ID NO: 2012926 - RNA, 15 nt, Shigella flexneri 2a str. 301
uugucaagauugaua

SEQ ID NO: 2012927 - RNA, 15 nt, Shigella flexneri 2a str. 301
uuguauccuguuuuu

SEQ ID NO: 2012928 - RNA, 13 nt, Shigella flexneri 2a str. 301
uugucgaucuccg

SEQ ID NO: 2012929 - RNA, 17 nt, Shigella flexneri 2a str. 301
uugucgauaaacaguuu

SEQ ID NO: 2012930 - RNA, 14 nt, Shigella flexneri 2a str. 301
uugucgauuuccau

SEQ ID NO: 2012931 - RNA, 19 nt, Shigella flexneri 2a str. 301
uugucgcacauuucaauca

SEQ ID NO: 2012932 - RNA, 17 nt, Shigella flexneri 2a str. 301
uuguccgcuauuucuug

SEQ ID NO: 2012933 - RNA, 15 nt, Shigella flexneri 2a str. 301
uuguccgucugaaaa

SEQ ID NO: 2012934 - RNA, 17 nt, Shigella flexneri 2a str. 301
uuguccgucugaaaacu

SEQ ID NO: 2012935 - RNA, 19 nt, Shigella flexneri 2a str. 301
uugucauagcgacuaccac

SEQ ID NO: 2012936 - RNA, 17 nt, Shigella flexneri 2a str. 301
uugucaucaguuucaaa

SEQ ID NO: 2012937 - RNA, 12 nt, Shigella flexneri 2a str. 301
uugucauuggca

SEQ ID NO: 2012938 - RNA, 18 nt, Shigella flexneri 2a str. 301
uuuaagcuggguaaaugc

SEQ ID NO: 2012939 - RNA, 13 nt, Shigella flexneri 2a str. 301
uuuaaguuuaugg

SEQ ID NO: 2012940 - RNA, 17 nt, Shigella flexneri 2a str. 301
uuuaaaacugccugaua

SEQ ID NO: 2012941 - RNA, 16 nt, Shigella flexneri 2a str. 301
uuuaaaacauuguuga

SEQ ID NO: 2012942 - RNA, 23 nt, Shigella flexneri 2a str. 301
uuuaauaaucucgccuuaucaga

SEQ ID NO: 2012943 - RNA, 14 nt, Shigella flexneri 2a str. 301
uuuaauaaauuuag

SEQ ID NO: 2012944 - RNA, 15 nt, Shigella flexneri 2a str. 301
uuuaauauuaaacca

SEQ ID NO: 2012945 - RNA, 12 nt, Shigella flexneri 2a str. 301
uuuaaucaccug

SEQ ID NO: 2012946 - RNA, 18 nt, Shigella flexneri 2a str. 301
uuuaaugccacauuagau

SEQ ID NO: 2012947 - RNA, 14 nt, Shigella flexneri 2a str. 301
uuuaauggauguaa

SEQ ID NO: 2012948 - RNA, 17 nt, Shigella flexneri 2a str. 301
uuuacggcuugcgcgca

SEQ ID NO: 2012949 - RNA, 23 nt, Shigella flexneri 2a str. 301
uuuaccggucaggauuuccagcu

SEQ ID NO: 2012950 - RNA, 17 nt, Shigella flexneri 2a str. 301
uuuaccggugccagcaa

SEQ ID NO: 2012951 - RNA, 18 nt, Shigella flexneri 2a str. 301
uuuaccgcaacucauuua

SEQ ID NO: 2012952 - RNA, 22 nt, Shigella flexneri 2a str. 301
uuuacauuaucgcgucuaaauu

SEQ ID NO: 2012953 - RNA, 15 nt, Shigella flexneri 2a str. 301
uuuaccucuuucuca

SEQ ID NO: 2012954 - RNA, 18 nt, Shigella flexneri 2a str. 301
uuuaccugcgccggucac

SEQ ID NO: 2012955 - RNA, 16 nt, Shigella flexneri 2a str. 301
uuuaccucgaaaacca

SEQ ID NO: 2012956 - RNA, 20 nt, Shigella flexneri 2a str. 301
uuuaccugcuuaaucauauu

SEQ ID NO: 2012957 - RNA, 22 nt, Shigella flexneri 2a str. 301
uuuacaugcgcgacaaaaauua

SEQ ID NO: 2012958 - RNA, 17 nt, Shigella flexneri 2a str. 301
uuuacauguucaaaaaa

SEQ ID NO: 2012959 - RNA, 14 nt, Shigella flexneri 2a str. 301
uuuacauccggcaa

SEQ ID NO: 2012960 - RNA, 13 nt, Shigella flexneri 2a str. 301
uuuacaucaucag

SEQ ID NO: 2012961 - RNA, 21 nt, Shigella flexneri 2a str. 301
uuuacaucaucagaaaugcca

SEQ ID NO: 2012962 - RNA, 18 nt, Shigella flexneri 2a str. 301
uuuacaggcucaaagacu

SEQ ID NO: 2012963 - RNA, 17 nt, Shigella flexneri 2a str. 301
uuuacagauuucccauu

SEQ ID NO: 2012964 - RNA, 22 nt, Shigella flexneri 2a str. 301
uuuacagcccuggcucugcacu

SEQ ID NO: 2012965 - RNA, 22 nt, Shigella flexneri 2a str. 301
uuuacagccggacccacacccc

SEQ ID NO: 2012966 - RNA, 17 nt, Shigella flexneri 2a str. 301
uuuacagccugccagca

SEQ ID NO: 2012967 - RNA, 22 nt, Shigella flexneri 2a str. 301
uuuauuguuaaguuuaucccaa

SEQ ID NO: 2012968 - RNA, 22 nt, Shigella flexneri 2a str. 301
uuuauuaacucagcauuauuuu

SEQ ID NO: 2012969 - RNA, 23 nt, Shigella flexneri 2a str. 301
uuuauuaauccagggaucaacau

SEQ ID NO: 2012970 - RNA, 18 nt, Shigella flexneri 2a str. 301
uuuauuaaugacauucag

SEQ ID NO: 2012971 - RNA, 15 nt, Shigella flexneri 2a str. 301
uuuauuaauucuaaa

SEQ ID NO: 2012972 - RNA, 18 nt, Shigella flexneri 2a str. 301
uuuaucucuuacagaaau

SEQ ID NO: 2012973 - RNA, 20 nt, Shigella flexneri 2a str. 301
uuuaucgaucacauccagua

SEQ ID NO: 2012974 - RNA, 15 nt, Shigella flexneri 2a str. 301
uuuaucggucuuagc

SEQ ID NO: 2012975 - RNA, 16 nt, Shigella flexneri 2a str. 301
uuuaucguuuucacga

SEQ ID NO: 2012976 - RNA, 20 nt, Shigella flexneri 2a str. 301
uuuaucuucgagauucuuaa

SEQ ID NO: 2012977 - RNA, 12 nt, Shigella flexneri 2a str. 301
uuuaucuuccca

SEQ ID NO: 2012978 - RNA, 23 nt, Shigella flexneri 2a str. 301
uuuaugcccgcgauaaauaaacu

SEQ ID NO: 2012979 - RNA, 19 nt, Shigella flexneri 2a str. 301
uuuaugccggaucaggcgu

SEQ ID NO: 2012980 - RNA, 21 nt, Shigella flexneri 2a str. 301
uuuaugggcacggugcggggu

SEQ ID NO: 2012981 - RNA, 18 nt, Shigella flexneri 2a str. 301
uuuaucaucggucagcgu

SEQ ID NO: 2012982 - RNA, 15 nt, Shigella flexneri 2a str. 301
uuuaucccaauuauc

SEQ ID NO: 2012983 - RNA, 23 nt, Shigella flexneri 2a str. 301
uuuaucgauaaauggcgcaucca

SEQ ID NO: 2012984 - RNA, 21 nt, Shigella flexneri 2a str. 301
uuuaucagaccgcuucugcgu

SEQ ID NO: 2012985 - RNA, 15 nt, Shigella flexneri 2a str. 301
uuuaucaccaaugau

SEQ ID NO: 2012986 - RNA, 22 nt, Shigella flexneri 2a str. 301
uuuaucacgcaaccacaacgca

SEQ ID NO: 2012987 - RNA, 14 nt, Shigella flexneri 2a str. 301
uuuagcauaaaaac

SEQ ID NO: 2012988 - RNA, 13 nt, Shigella flexneri 2a str. 301
uuuagcaaacuga

SEQ ID NO: 2012989 - RNA, 22 nt, Shigella flexneri 2a str. 301
uuuauaucugguuugccacguu

SEQ ID NO: 2012990 - RNA, 17 nt, Shigella flexneri 2a str. 301
uuuauaccaacaaaaaa

SEQ ID NO: 2012991 - RNA, 20 nt, Shigella flexneri 2a str. 301
uuuauaacggugcugcacau

SEQ ID NO: 2012992 - RNA, 20 nt, Shigella flexneri 2a str. 301
uucuuggcacccagcgcuuu

SEQ ID NO: 2012993 - RNA, 14 nt, Shigella flexneri 2a str. 301
uucuucuuucagua

SEQ ID NO: 2012994 - RNA, 13 nt, Shigella flexneri 2a str. 301
uucuucuuucgcc

SEQ ID NO: 2012995 - RNA, 20 nt, Shigella flexneri 2a str. 301
uucuugguaaugacuccaac

SEQ ID NO: 2012996 - RNA, 17 nt, Shigella flexneri 2a str. 301
uugagcaggagcagcag

SEQ ID NO: 2012997 - RNA, 16 nt, Shigella flexneri 2a str. 301
uugagcgaaaacgaau

SEQ ID NO: 2012998 - RNA, 15 nt, Shigella flexneri 2a str. 301
uugaggcacaucuua

SEQ ID NO: 2012999 - RNA, 22 nt, Shigella flexneri 2a str. 301
uugaggaaguuauacagacuca

SEQ ID NO: 2013000 - RNA, 15 nt, Shigella flexneri 2a str. 301
uugaguucacugccg

SEQ ID NO: 2013001 - RNA, 17 nt, Shigella flexneri 2a str. 301
uugauaaggaaauucag

SEQ ID NO: 2013002 - RNA, 16 nt, Shigella flexneri 2a str. 301
uugauaauaaagcuac

SEQ ID NO: 2013003 - RNA, 16 nt, Shigella flexneri 2a str. 301
uugauguccaguuccc

SEQ ID NO: 2013004 - RNA, 13 nt, Shigella flexneri 2a str. 301
uugaugguaaaau

SEQ ID NO: 2013005 - RNA, 15 nt, Shigella flexneri 2a str. 301
uugauggggguccug

SEQ ID NO: 2013006 - RNA, 17 nt, Shigella flexneri 2a str. 301
uugauuacagcuggagu

SEQ ID NO: 2013007 - RNA, 13 nt, Shigella flexneri 2a str. 301
uugauuaaaggaa

SEQ ID NO: 2013008 - RNA, 23 nt, Shigella flexneri 2a str. 301
uugauuauuggacgguaaaaaga

SEQ ID NO: 2013009 - RNA, 13 nt, Shigella flexneri 2a str. 301
uugauuuaucagg

SEQ ID NO: 2013010 - RNA, 13 nt, Shigella flexneri 2a str. 301
uugauaauguuau

SEQ ID NO: 2013011 - RNA, 20 nt, Shigella flexneri 2a str. 301
uugauacaggcgcuguaugc

SEQ ID NO: 2013012 - RNA, 13 nt, Shigella flexneri 2a str. 301
uugauacgagagc

SEQ ID NO: 2013013 - RNA, 13 nt, Shigella flexneri 2a str. 301
uugauagcaauac

SEQ ID NO: 2013014 - RNA, 18 nt, Shigella flexneri 2a str. 301
uugaugcuguaaaaugag

SEQ ID NO: 2013015 - RNA, 20 nt, Shigella flexneri 2a str. 301
uugauggaaaauuguuccgu

SEQ ID NO: 2013016 - RNA, 18 nt, Shigella flexneri 2a str. 301
uugauuuucgaaaaaaaa

SEQ ID NO: 2013017 - RNA, 21 nt, Shigella flexneri 2a str. 301
uugauuuucgaaaaaaaagaa

SEQ ID NO: 2013018 - RNA, 16 nt, Shigella flexneri 2a str. 301
uugauuuucgaauagc

SEQ ID NO: 2013019 - RNA, 17 nt, Shigella flexneri 2a str. 301
uugcacucgcagaagca

SEQ ID NO: 2013020 - RNA, 19 nt, Shigella flexneri 2a str. 301
uugcagaggugcugaaagg

SEQ ID NO: 2013021 - RNA, 16 nt, Shigella flexneri 2a str. 301
uugcagauaccacauc

SEQ ID NO: 2013022 - RNA, 17 nt, Shigella flexneri 2a str. 301
uugcagcacacauuaua

SEQ ID NO: 2013023 - RNA, 21 nt, Shigella flexneri 2a str. 301
uugcaggucguccugcaaagc

SEQ ID NO: 2013024 - RNA, 22 nt, Shigella flexneri 2a str. 301
uugcaggggagcgaauacuccc

SEQ ID NO: 2013025 - RNA, 21 nt, Shigella flexneri 2a str. 301
uugccagagcagcaacaagcc

SEQ ID NO: 2013026 - RNA, 18 nt, Shigella flexneri 2a str. 301
uugccagaaauccaggcc

SEQ ID NO: 2013027 - RNA, 14 nt, Shigella flexneri 2a str. 301
uugccagauaaaua

SEQ ID NO: 2013028 - RNA, 21 nt, Shigella flexneri 2a str. 301
uugccaccgguacaaacauca

SEQ ID NO: 2013029 - RNA, 22 nt, Shigella flexneri 2a str. 301
uugccacugcccgagaacagca

SEQ ID NO: 2013030 - RNA, 23 nt, Shigella flexneri 2a str. 301
uugcauuacuacgguaauacaac

SEQ ID NO: 2013031 - RNA, 22 nt, Shigella flexneri 2a str. 301
uugcaucgucuguuuuaucucc

SEQ ID NO: 2013032 - RNA, 13 nt, Shigella flexneri 2a str. 301
uugcauccgguca

SEQ ID NO: 2013033 - RNA, 17 nt, Shigella flexneri 2a str. 301
uugcaucccagaaaaaa

SEQ ID NO: 2013034 - RNA, 22 nt, Shigella flexneri 2a str. 301
uugcauaaaugccgcaaugugc

SEQ ID NO: 2013035 - RNA, 18 nt, Shigella flexneri 2a str. 301
uugcauagcggcgacuug

SEQ ID NO: 2013036 - RNA, 21 nt, Shigella flexneri 2a str. 301
uugcauagcuucgaaguuuuc

SEQ ID NO: 2013037 - RNA, 20 nt, Shigella flexneri 2a str. 301
uugcggaaauuccagcggca

SEQ ID NO: 2013038 - RNA, 14 nt, Shigella flexneri 2a str. 301
uugcgcuggcaccg

SEQ ID NO: 2013039 - RNA, 17 nt, Shigella flexneri 2a str. 301
uugcgcuaaaaaguucc

SEQ ID NO: 2013040 - RNA, 19 nt, Shigella flexneri 2a str. 301
uugcggcuuuugaagcuga

SEQ ID NO: 2013041 - RNA, 23 nt, Shigella flexneri 2a str. 301
uugcgauacaggaaugcagucgc

SEQ ID NO: 2013042 - RNA, 17 nt, Shigella flexneri 2a str. 301
uugcgcgacuuuuuccu

SEQ ID NO: 2013043 - RNA, 18 nt, Shigella flexneri 2a str. 301
uugcgcgacguugcuucu

SEQ ID NO: 2013044 - RNA, 24 nt, Shigella flexneri 2a str. 301
uugcgcgucgcccaguucuacaau

SEQ ID NO: 2013045 - RNA, 15 nt, Shigella flexneri 2a str. 301
uugcgacgagaaaau

SEQ ID NO: 2013046 - RNA, 15 nt, Shigella flexneri 2a str. 301
uugccguucuucccg

SEQ ID NO: 2013047 - RNA, 13 nt, Shigella flexneri 2a str. 301
uugccgugugccg

SEQ ID NO: 2013048 - RNA, 13 nt, Shigella flexneri 2a str. 301
uugccguaagcaa

SEQ ID NO: 2013049 - RNA, 18 nt, Shigella flexneri 2a str. 301
uugccgugccccauaugg

SEQ ID NO: 2013050 - RNA, 20 nt, Shigella flexneri 2a str. 301
uugccgucgauaugcaaauc

SEQ ID NO: 2013051 - RNA, 21 nt, Shigella flexneri 2a str. 301
uugccaugcauauccaggcua

SEQ ID NO: 2013052 - RNA, 19 nt, Shigella flexneri 2a str. 301
uugccaguaacagaacgca

SEQ ID NO: 2013053 - RNA, 12 nt, Shigella flexneri 2a str. 301
uugccauaucuu

SEQ ID NO: 2013054 - RNA, 19 nt, Shigella flexneri 2a str. 301
uugccaguccuaaaaacag

SEQ ID NO: 2013055 - RNA, 13 nt, Shigella flexneri 2a str. 301
uuggaauacauau

SEQ ID NO: 2013056 - RNA, 16 nt, Shigella flexneri 2a str. 301
uuggcagaaacagcca

SEQ ID NO: 2013057 - RNA, 17 nt, Shigella flexneri 2a str. 301
uuggcaucguauuucag

SEQ ID NO: 2013058 - RNA, 19 nt, Shigella flexneri 2a str. 301
uuggcauaaauaauaagag

SEQ ID NO: 2013059 - RNA, 16 nt, Shigella flexneri 2a str. 301
uuggcaagauaggcau

SEQ ID NO: 2013060 - RNA, 23 nt, Shigella flexneri 2a str. 301
uuggauaggcaccgccaaagaua

SEQ ID NO: 2013061 - RNA, 13 nt, Shigella flexneri 2a str. 301
uugcuucugcuuc

SEQ ID NO: 2013062 - RNA, 16 nt, Shigella flexneri 2a str. 301
uugcuucguuuacugu

SEQ ID NO: 2013063 - RNA, 18 nt, Shigella flexneri 2a str. 301
uugcuucuaugaguggaa

SEQ ID NO: 2013064 - RNA, 13 nt, Shigella flexneri 2a str. 301
uugcuuuccagcu

SEQ ID NO: 2013065 - RNA, 15 nt, Shigella flexneri 2a str. 301
uugcuuguucgaugc

SEQ ID NO: 2013066 - RNA, 19 nt, Shigella flexneri 2a str. 301
uugcuuuuaccauacugga

SEQ ID NO: 2013067 - RNA, 14 nt, Shigella flexneri 2a str. 301
uugcuuaacugacu

SEQ ID NO: 2013068 - RNA, 15 nt, Shigella flexneri 2a str. 301
uugcugugcuuuaca

SEQ ID NO: 2013069 - RNA, 16 nt, Shigella flexneri 2a str. 301
uugcuuaaguuuugca

SEQ ID NO: 2013070 - RNA, 18 nt, Shigella flexneri 2a str. 301
uugcuaacuggaaaggaa

SEQ ID NO: 2013071 - RNA, 17 nt, Shigella flexneri 2a str. 301
uugcuaccgcgaugacc

SEQ ID NO: 2013072 - RNA, 23 nt, Shigella flexneri 2a str. 301
uugcuaccgcuucgcucacauca

SEQ ID NO: 2013073 - RNA, 13 nt, Shigella flexneri 2a str. 301
uugcuggaaaacc

SEQ ID NO: 2013074 - RNA, 18 nt, Shigella flexneri 2a str. 301
uugcuggacgcauugcau

SEQ ID NO: 2013075 - RNA, 12 nt, Shigella flexneri 2a str. 301
uugcugcugccg

SEQ ID NO: 2013076 - RNA, 12 nt, Shigella flexneri 2a str. 301
uugcuguacaua

SEQ ID NO: 2013077 - RNA, 12 nt, Shigella flexneri 2a str. 301
uuggcuggcccu

SEQ ID NO: 2013078 - RNA, 20 nt, Shigella flexneri 2a str. 301
uuggcugggguacgaggauu

SEQ ID NO: 2013079 - RNA, 18 nt, Shigella flexneri 2a str. 301
uuggcucuucgcuccagu

SEQ ID NO: 2013080 - RNA, 20 nt, Shigella flexneri 2a str. 301
uuggcugagugaaucagaag

SEQ ID NO: 2013081 - RNA, 17 nt, Shigella flexneri 2a str. 301
uuggcuucguguacaaa

SEQ ID NO: 2013082 - RNA, 18 nt, Shigella flexneri 2a str. 301
uugggcaauucaccguaa

SEQ ID NO: 2013083 - RNA, 17 nt, Shigella flexneri 2a str. 301
uugggaugccgaaaaaa

SEQ ID NO: 2013084 - RNA, 20 nt, Shigella flexneri 2a str. 301
uuggcgcacaaugccugaug

SEQ ID NO: 2013085 - RNA, 17 nt, Shigella flexneri 2a str. 301
uugggcgaucucccgcu

SEQ ID NO: 2013086 - RNA, 15 nt, Shigella flexneri 2a str. 301
uugggcucaucaaua

SEQ ID NO: 2013087 - RNA, 16 nt, Shigella flexneri 2a str. 301
uugguacauaacacaa

SEQ ID NO: 2013088 - RNA, 14 nt, Shigella flexneri 2a str. 301
uuggugcuuuugcu

SEQ ID NO: 2013089 - RNA, 21 nt, Shigella flexneri 2a str. 301
uugguggcgaccggaauguuc

SEQ ID NO: 2013090 - RNA, 17 nt, Shigella flexneri 2a str. 301
uugguucaucgugcugu

SEQ ID NO: 2013091 - RNA, 22 nt, Shigella flexneri 2a str. 301
uugguuaacugaauauuccagu

SEQ ID NO: 2013092 - RNA, 16 nt, Shigella flexneri 2a str. 301
uuggugaaaaaaugau

SEQ ID NO: 2013093 - RNA, 14 nt, Shigella flexneri 2a str. 301
uuggugaacagcau

SEQ ID NO: 2013094 - RNA, 22 nt, Shigella flexneri 2a str. 301
uuggugauauucauggugaaua

SEQ ID NO: 2013095 - RNA, 16 nt, Shigella flexneri 2a str. 301
aauaauucaaaaaccu

SEQ ID NO: 2013096 - RNA, 14 nt, Shigella flexneri 2a str. 301
aauaaucguaauca

SEQ ID NO: 2013097 - RNA, 22 nt, Shigella flexneri 2a str. 301
aauaaucgggaauacagaaaau

SEQ ID NO: 2013098 - RNA, 15 nt, Shigella flexneri 2a str. 301
aauaaucucuacacc

SEQ ID NO: 2013099 - RNA, 18 nt, Shigella flexneri 2a str. 301
aauaaucguaaucagcau

SEQ ID NO: 2013100 - RNA, 16 nt, Shigella flexneri 2a str. 301
aauaaucucuacacca

SEQ ID NO: 2013101 - RNA, 22 nt, Shigella flexneri 2a str. 301
aauaaucgcgcuaauuccaguc

SEQ ID NO: 2013102 - RNA, 18 nt, Shigella flexneri 2a str. 301
aauaaucgcaauuaccca

SEQ ID NO: 2013103 - RNA, 22 nt, Shigella flexneri 2a str. 301
aauaaucgaucgcguaauaaaa

SEQ ID NO: 2013104 - RNA, 19 nt, Shigella flexneri 2a str. 301
aauaaucccgcgcaacaaa

SEQ ID NO: 2013105 - RNA, 22 nt, Shigella flexneri 2a str. 301
aauaauccccauaucaggcaca

SEQ ID NO: 2013106 - RNA, 23 nt, Shigella flexneri 2a str. 301
aauaaugcgacaacagaaauaau

SEQ ID NO: 2013107 - RNA, 17 nt, Shigella flexneri 2a str. 301
aauaaugcgacaacaga

SEQ ID NO: 2013108 - RNA, 19 nt, Shigella flexneri 2a str. 301
aauaauggccuuuucgcca

SEQ ID NO: 2013109 - RNA, 21 nt, Shigella flexneri 2a str. 301
aauaauggccuuuucgccacc

SEQ ID NO: 2013110 - RNA, 21 nt, Shigella flexneri 2a str. 301
aauaaugcccaucgugauaaa

SEQ ID NO: 2013111 - RNA, 17 nt, Shigella flexneri 2a str. 301
aauaaguacgauacaga

SEQ ID NO: 2013112 - RNA, 15 nt, Shigella flexneri 2a str. 301
aauaagcuauaaaaa

SEQ ID NO: 2013113 - RNA, 19 nt, Shigella flexneri 2a str. 301
aauaagccaaauccagcgc

SEQ ID NO: 2013114 - RNA, 18 nt, Shigella flexneri 2a str. 301
aauaagcacgguuaacac

SEQ ID NO: 2013115 - RNA, 14 nt, Shigella flexneri 2a str. 301
aauaaucaccacac

SEQ ID NO: 2013116 - RNA, 22 nt, Shigella flexneri 2a str. 301
aauaaucacauaauccagacac

SEQ ID NO: 2013117 - RNA, 20 nt, Shigella flexneri 2a str. 301
aauaaucaaaugaaugccaa

SEQ ID NO: 2013118 - RNA, 14 nt, Shigella flexneri 2a str. 301
aauaaucaacgcga

SEQ ID NO: 2013119 - RNA, 14 nt, Shigella flexneri 2a str. 301
aauaauaucuuuuu

SEQ ID NO: 2013120 - RNA, 18 nt, Shigella flexneri 2a str. 301
aaguugccggauguguug

SEQ ID NO: 2013121 - RNA, 17 nt, Shigella flexneri 2a str. 301
aaguugcucaagcugaa

SEQ ID NO: 2013122 - RNA, 15 nt, Shigella flexneri 2a str. 301
aaguugcucaagcug

SEQ ID NO: 2013123 - RNA, 18 nt, Shigella flexneri 2a str. 301
aauaaauauuaauacaac

SEQ ID NO: 2013124 - RNA, 15 nt, Shigella flexneri 2a str. 301
aauaaauauuaauac

SEQ ID NO: 2013125 - RNA, 20 nt, Shigella flexneri 2a str. 301
aauaaaucgugaaacaaucu

SEQ ID NO: 2013126 - RNA, 15 nt, Shigella flexneri 2a str. 301
aauaaaucuaaaaga

SEQ ID NO: 2013127 - RNA, 17 nt, Shigella flexneri 2a str. 301
aauaaaucuaaaagaug

SEQ ID NO: 2013128 - RNA, 23 nt, Shigella flexneri 2a str. 301
aauaaauccccggcggcguucag

SEQ ID NO: 2013129 - RNA, 23 nt, Shigella flexneri 2a str. 301
aauaaauguguuuuuauuugauu

SEQ ID NO: 2013130 - RNA, 11 nt, Shigella flexneri 2a str. 301
aauaaauuuag

SEQ ID NO: 2013131 - RNA, 12 nt, Shigella flexneri 2a str. 301
aauaaauuuuau

SEQ ID NO: 2013132 - RNA, 14 nt, Shigella flexneri 2a str. 301
aauaacaauacuua

SEQ ID NO: 2013133 - RNA, 20 nt, Shigella flexneri 2a str. 301
aauaacggcugauaacaaua

SEQ ID NO: 2013134 - RNA, 16 nt, Shigella flexneri 2a str. 301
aauaacucuuugauga

SEQ ID NO: 2013135 - RNA, 21 nt, Shigella flexneri 2a str. 301
aauaacucuuugaugaaacau

SEQ ID NO: 2013136 - RNA, 21 nt, Shigella flexneri 2a str. 301
aauaacuggugcuaacagcaa

SEQ ID NO: 2013137 - RNA, 18 nt, Shigella flexneri 2a str. 301
aauaaccgcugcaaaaaa

SEQ ID NO: 2013138 - RNA, 17 nt, Shigella flexneri 2a str. 301
aauaaccgcugcaaaaa

SEQ ID NO: 2013139 - RNA, 22 nt, Shigella flexneri 2a str. 301
aauaacccgcuguaaaugcugc

SEQ ID NO: 2013140 - RNA, 16 nt, Shigella flexneri 2a str. 301
aauaaccggcacuuca

SEQ ID NO: 2013141 - RNA, 16 nt, Shigella flexneri 2a str. 301
aauaacaucgccagaa

SEQ ID NO: 2013142 - RNA, 18 nt, Shigella flexneri 2a str. 301
aauaacagauuuuuaugc

SEQ ID NO: 2013143 - RNA, 24 nt, Shigella flexneri 2a str. 301
aauaaccagcguuuccagcaccag

SEQ ID NO: 2013144 - RNA, 17 nt, Shigella flexneri 2a str. 301
aauagccacauugcugc

SEQ ID NO: 2013145 - RNA, 21 nt, Shigella flexneri 2a str. 301
aauagccagcagagcaaaaau

SEQ ID NO: 2013146 - RNA, 14 nt, Shigella flexneri 2a str. 301
aauagccaaucauu

SEQ ID NO: 2013147 - RNA, 14 nt, Shigella flexneri 2a str. 301
aauagcauccacca

SEQ ID NO: 2013148 - RNA, 16 nt, Shigella flexneri 2a str. 301
aauagcacugcuuucc

SEQ ID NO: 2013149 - RNA, 16 nt, Shigella flexneri 2a str. 301
aauagcaacugauuua

SEQ ID NO: 2013150 - RNA, 21 nt, Shigella flexneri 2a str. 301
aauagauuuugaguaagcagg

SEQ ID NO: 2013151 - RNA, 17 nt, Shigella flexneri 2a str. 301
aauacuuucacaaaaau

SEQ ID NO: 2013152 - RNA, 19 nt, Shigella flexneri 2a str. 301
aauacuuuuacucucugga

SEQ ID NO: 2013153 - RNA, 19 nt, Shigella flexneri 2a str. 301
aauaccgcccaccaccagc

SEQ ID NO: 2013154 - RNA, 15 nt, Shigella flexneri 2a str. 301
aauaccggaugccaa

SEQ ID NO: 2013155 - RNA, 15 nt, Shigella flexneri 2a str. 301
aauaccgacaucacg

SEQ ID NO: 2013156 - RNA, 15 nt, Shigella flexneri 2a str. 301
aauaccgauaucgcc

SEQ ID NO: 2013157 - RNA, 18 nt, Shigella flexneri 2a str. 301
aauaccgacuucggccag

SEQ ID NO: 2013158 - RNA, 20 nt, Shigella flexneri 2a str. 301
aauaccguucucuuuaaaaa

SEQ ID NO: 2013159 - RNA, 21 nt, Shigella flexneri 2a str. 301
aauaccugccugucacgcagg

SEQ ID NO: 2013160 - RNA, 17 nt, Shigella flexneri 2a str. 301
aauacgauuaacgccag

SEQ ID NO: 2013161 - RNA, 22 nt, Shigella flexneri 2a str. 301
aauacgcaccgggcuuccggca

SEQ ID NO: 2013162 - RNA, 20 nt, Shigella flexneri 2a str. 301
aauacgcucacgcgcugccu

SEQ ID NO: 2013163 - RNA, 20 nt, Shigella flexneri 2a str. 301
aauacgcuggcgcgccgccu

SEQ ID NO: 2013164 - RNA, 23 nt, Shigella flexneri 2a str. 301
aauacggauauucaucuccagca

SEQ ID NO: 2013165 - RNA, 18 nt, Shigella flexneri 2a str. 301
aauacgcuuaaucuguac

SEQ ID NO: 2013166 - RNA, 20 nt, Shigella flexneri 2a str. 301
aauacaaaauuuaacaccau

SEQ ID NO: 2013167 - RNA, 14 nt, Shigella flexneri 2a str. 301
aauaauuuuaaaua

SEQ ID NO: 2013168 - RNA, 21 nt, Shigella flexneri 2a str. 301
aauacccuguauaauaggaaa

SEQ ID NO: 2013169 - RNA, 23 nt, Shigella flexneri 2a str. 301
aauaccgaagaguaaccaaacgu

SEQ ID NO: 2013170 - RNA, 19 nt, Shigella flexneri 2a str. 301
aauaccacccggucuuuuc

SEQ ID NO: 2013171 - RNA, 22 nt, Shigella flexneri 2a str. 301
aauaccacccgucgggcagaaa

SEQ ID NO: 2013172 - RNA, 19 nt, Shigella flexneri 2a str. 301
aauaccaauaaucaauuua

SEQ ID NO: 2013173 - RNA, 12 nt, Shigella flexneri 2a str. 301
aauaccaauaau

SEQ ID NO: 2013174 - RNA, 18 nt, Shigella flexneri 2a str. 301
aauauauaauuaaaaaua

SEQ ID NO: 2013175 - RNA, 22 nt, Shigella flexneri 2a str. 301
aauauauacaccaacaggugcc

SEQ ID NO: 2013176 - RNA, 20 nt, Shigella flexneri 2a str. 301
aauauaguagaucuugauuu

SEQ ID NO: 2013177 - RNA, 16 nt, Shigella flexneri 2a str. 301
aauaucaguuauuaca

SEQ ID NO: 2013178 - RNA, 19 nt, Shigella flexneri 2a str. 301
aauaucaggcauucuuuuu

SEQ ID NO: 2013179 - RNA, 19 nt, Shigella flexneri 2a str. 301
aauauauccgaaaaaggau

SEQ ID NO: 2013180 - RNA, 14 nt, Shigella flexneri 2a str. 301
aauaucaucccccu

SEQ ID NO: 2013181 - RNA, 22 nt, Shigella flexneri 2a str. 301
aauauccaccgggguaaaucca

SEQ ID NO: 2013182 - RNA, 22 nt, Shigella flexneri 2a str. 301
aauauccagcgcgcgcagcacg

SEQ ID NO: 2013183 - RNA, 16 nt, Shigella flexneri 2a str. 301
aauaugguuagagaac

SEQ ID NO: 2013184 - RNA, 19 nt, Shigella flexneri 2a str. 301
aauaugcugguuccugacu

SEQ ID NO: 2013185 - RNA, 18 nt, Shigella flexneri 2a str. 301
aauaugcugaaucgccaa

SEQ ID NO: 2013186 - RNA, 23 nt, Shigella flexneri 2a str. 301
aauaugcugaaucgccaaaaaca

SEQ ID NO: 2013187 - RNA, 14 nt, Shigella flexneri 2a str. 301
aauaugcauaaacc

SEQ ID NO: 2013188 - RNA, 20 nt, Shigella flexneri 2a str. 301
aauauccgucgaaaaugauc

SEQ ID NO: 2013189 - RNA, 16 nt, Shigella flexneri 2a str. 301
aauauccgucacuuca

SEQ ID NO: 2013190 - RNA, 12 nt, Shigella flexneri 2a str. 301
aauauccugagc

SEQ ID NO: 2013191 - RNA, 18 nt, Shigella flexneri 2a str. 301
aauaucuauccaguaucu

SEQ ID NO: 2013192 - RNA, 22 nt, Shigella flexneri 2a str. 301
aauagugccuggcugcgugagg

SEQ ID NO: 2013193 - RNA, 21 nt, Shigella flexneri 2a str. 301
aauagugacagauuugauuau

SEQ ID NO: 2013194 - RNA, 18 nt, Shigella flexneri 2a str. 301
aauagccugccagaggag

SEQ ID NO: 2013195 - RNA, 23 nt, Shigella flexneri 2a str. 301
aauagccaucacaaaacgugaca

SEQ ID NO: 2013196 - RNA, 20 nt, Shigella flexneri 2a str. 301
aauagcgaacagacaaaaag

SEQ ID NO: 2013197 - RNA, 17 nt, Shigella flexneri 2a str. 301
aauagccgcagccauca

SEQ ID NO: 2013198 - RNA, 12 nt, Shigella flexneri 2a str. 301
aauauacaggcg

SEQ ID NO: 2013199 - RNA, 16 nt, Shigella flexneri 2a str. 301
aauauagcgccacgcu

SEQ ID NO: 2013200 - RNA, 18 nt, Shigella flexneri 2a str. 301
aagccguuagucaucauc

SEQ ID NO: 2013201 - RNA, 13 nt, Shigella flexneri 2a str. 301
aagccgugaauca

SEQ ID NO: 2013202 - RNA, 12 nt, Shigella flexneri 2a str. 301
aagccugacagg

SEQ ID NO: 2013203 - RNA, 17 nt, Shigella flexneri 2a str. 301
aagccggaugaucaucc

SEQ ID NO: 2013204 - RNA, 17 nt, Shigella flexneri 2a str. 301
aagccgcuaacagcagc

SEQ ID NO: 2013205 - RNA, 17 nt, Shigella flexneri 2a str. 301
aagccgcgugcgcugga

SEQ ID NO: 2013206 - RNA, 21 nt, Shigella flexneri 2a str. 301
aagccggaugaucauccggcu

SEQ ID NO: 2013207 - RNA, 22 nt, Shigella flexneri 2a str. 301
aagccuucgccuuucaguucaa

SEQ ID NO: 2013208 - RNA, 17 nt, Shigella flexneri 2a str. 301
aagccuuccgcaaacag

SEQ ID NO: 2013209 - RNA, 21 nt, Shigella flexneri 2a str. 301
aagcgagguauuuucugaaac

SEQ ID NO: 2013210 - RNA, 16 nt, Shigella flexneri 2a str. 301
aagcgaguugcgccag

SEQ ID NO: 2013211 - RNA, 17 nt, Shigella flexneri 2a str. 301
aagcgauaaaaauaccg

SEQ ID NO: 2013212 - RNA, 15 nt, Shigella flexneri 2a str. 301
aagcgcaaaggccag

SEQ ID NO: 2013213 - RNA, 17 nt, Shigella flexneri 2a str. 301
aagcgcaaaggccagca

SEQ ID NO: 2013214 - RNA, 14 nt, Shigella flexneri 2a str. 301
aagcgauaacgcug

SEQ ID NO: 2013215 - RNA, 15 nt, Shigella flexneri 2a str. 301
aagcgaucuuucugu

SEQ ID NO: 2013216 - RNA, 14 nt, Shigella flexneri 2a str. 301
aagccagaauuaau

SEQ ID NO: 2013217 - RNA, 15 nt, Shigella flexneri 2a str. 301
aagccagcauacagc

SEQ ID NO: 2013218 - RNA, 20 nt, Shigella flexneri 2a str. 301
aagaaguaaaacagucgcuc

SEQ ID NO: 2013219 - RNA, 17 nt, Shigella flexneri 2a str. 301
aagccaguccagaaaug

SEQ ID NO: 2013220 - RNA, 14 nt, Shigella flexneri 2a str. 301
aagccagguuuuga

SEQ ID NO: 2013221 - RNA, 14 nt, Shigella flexneri 2a str. 301
aagccaucccugua

SEQ ID NO: 2013222 - RNA, 13 nt, Shigella flexneri 2a str. 301
aagccauccagca

SEQ ID NO: 2013223 - RNA, 21 nt, Shigella flexneri 2a str. 301
aagccaugcccgugcugacag

SEQ ID NO: 2013224 - RNA, 13 nt, Shigella flexneri 2a str. 301
aagccgccaaacg

SEQ ID NO: 2013225 - RNA, 23 nt, Shigella flexneri 2a str. 301
aagccgccacgaccugcagaaaa

SEQ ID NO: 2013226 - RNA, 19 nt, Shigella flexneri 2a str. 301
aagccgccaucucuuccag

SEQ ID NO: 2013227 - RNA, 13 nt, Shigella flexneri 2a str. 301
aagcccucaaaca

SEQ ID NO: 2013228 - RNA, 18 nt, Shigella flexneri 2a str. 301
aagccccgcauaaagcga

SEQ ID NO: 2013229 - RNA, 21 nt, Shigella flexneri 2a str. 301
aagcccaucaguacaccaccu

SEQ ID NO: 2013230 - RNA, 14 nt, Shigella flexneri 2a str. 301
aagccccaccagca

SEQ ID NO: 2013231 - RNA, 17 nt, Shigella flexneri 2a str. 301
aagccccagcaggaugu

SEQ ID NO: 2013232 - RNA, 17 nt, Shigella flexneri 2a str. 301
aagccccguagccauga

SEQ ID NO: 2013233 - RNA, 15 nt, Shigella flexneri 2a str. 301
aagcggugauaaacc

SEQ ID NO: 2013234 - RNA, 20 nt, Shigella flexneri 2a str. 301
aagcgcucccgcaggagcgc

SEQ ID NO: 2013235 - RNA, 23 nt, Shigella flexneri 2a str. 301
aagcggcguuccaccgcucccag

SEQ ID NO: 2013236 - RNA, 18 nt, Shigella flexneri 2a str. 301
aagcgcggauuuuauuca

SEQ ID NO: 2013237 - RNA, 17 nt, Shigella flexneri 2a str. 301
aagcgcgcuagccuguu

SEQ ID NO: 2013238 - RNA, 20 nt, Shigella flexneri 2a str. 301
aagcgccggacauugcguuu

SEQ ID NO: 2013239 - RNA, 14 nt, Shigella flexneri 2a str. 301
aagcgccaucaaug

SEQ ID NO: 2013240 - RNA, 17 nt, Shigella flexneri 2a str. 301
aagcgccgaguaaaaaa

SEQ ID NO: 2013241 - RNA, 19 nt, Shigella flexneri 2a str. 301
aagcgccgaguaaaaaaac

SEQ ID NO: 2013242 - RNA, 20 nt, Shigella flexneri 2a str. 301
aagcgcaccugaucagcaau

SEQ ID NO: 2013243 - RNA, 22 nt, Shigella flexneri 2a str. 301
aagcgcacuuugucaaaaaucu

SEQ ID NO: 2013244 - RNA, 14 nt, Shigella flexneri 2a str. 301
aagcgcagccaaaa

SEQ ID NO: 2013245 - RNA, 16 nt, Shigella flexneri 2a str. 301
aagcgccacaaucgcu

SEQ ID NO: 2013246 - RNA, 17 nt, Shigella flexneri 2a str. 301
aagcgcauccggcacca

SEQ ID NO: 2013247 - RNA, 15 nt, Shigella flexneri 2a str. 301
aagcguuucaucuuc

SEQ ID NO: 2013248 - RNA, 15 nt, Shigella flexneri 2a str. 301
aagcucaaaauaaua

SEQ ID NO: 2013249 - RNA, 18 nt, Shigella flexneri 2a str. 301
aaggaccaaagaaugaca

SEQ ID NO: 2013250 - RNA, 15 nt, Shigella flexneri 2a str. 301
aaggacauuauucag

SEQ ID NO: 2013251 - RNA, 13 nt, Shigella flexneri 2a str. 301
aaggaaaguaaau

SEQ ID NO: 2013252 - RNA, 19 nt, Shigella flexneri 2a str. 301
aaggaaacucucaaaacaa

SEQ ID NO: 2013253 - RNA, 20 nt, Shigella flexneri 2a str. 301
aagcuguaaaggugauauag

SEQ ID NO: 2013254 - RNA, 22 nt, Shigella flexneri 2a str. 301
aagcugagcacaaaacaggucg

SEQ ID NO: 2013255 - RNA, 14 nt, Shigella flexneri 2a str. 301
aagcugagcacaaa

SEQ ID NO: 2013256 - RNA, 20 nt, Shigella flexneri 2a str. 301
aagcuggaaggguugaaaua

SEQ ID NO: 2013257 - RNA, 17 nt, Shigella flexneri 2a str. 301
aagcuggaaaucaaugg

SEQ ID NO: 2013258 - RNA, 20 nt, Shigella flexneri 2a str. 301
aagugagguguacuggcaau

SEQ ID NO: 2013259 - RNA, 11 nt, Shigella flexneri 2a str. 301
aagugaguauc

SEQ ID NO: 2013260 - RNA, 18 nt, Shigella flexneri 2a str. 301
aagugagaauuuuucacu

SEQ ID NO: 2013261 - RNA, 17 nt, Shigella flexneri 2a str. 301
aagugugcaaacgauaa

SEQ ID NO: 2013262 - RNA, 18 nt, Shigella flexneri 2a str. 301
aagugugaugguauucau

SEQ ID NO: 2013263 - RNA, 17 nt, Shigella flexneri 2a str. 301
aagugguguugaagaaa

SEQ ID NO: 2013264 - RNA, 14 nt, Shigella flexneri 2a str. 301
aagugguuucauga

SEQ ID NO: 2013265 - RNA, 21 nt, Shigella flexneri 2a str. 301
aaguuauacagacucaaacca

SEQ ID NO: 2013266 - RNA, 16 nt, Shigella flexneri 2a str. 301
aagucauuaccagcga

SEQ ID NO: 2013267 - RNA, 12 nt, Shigella flexneri 2a str. 301
aaguccaaaagg

SEQ ID NO: 2013268 - RNA, 15 nt, Shigella flexneri 2a str. 301
aagucauuguccagu

SEQ ID NO: 2013269 - RNA, 18 nt, Shigella flexneri 2a str. 301
aagucgggaaacuuaaca

SEQ ID NO: 2013270 - RNA, 14 nt, Shigella flexneri 2a str. 301
aaguagccuucauc

SEQ ID NO: 2013271 - RNA, 20 nt, Shigella flexneri 2a str. 301
aaguagccuucaucagauga

SEQ ID NO: 2013272 - RNA, 15 nt, Shigella flexneri 2a str. 301
aaguagcugaaaauc

SEQ ID NO: 2013273 - RNA, 13 nt, Shigella flexneri 2a str. 301
aaguagccaguac

SEQ ID NO: 2013274 - RNA, 14 nt, Shigella flexneri 2a str. 301
aaguagcagguaau

SEQ ID NO: 2013275 - RNA, 16 nt, Shigella flexneri 2a str. 301
aaguagugauuuuaau

SEQ ID NO: 2013276 - RNA, 18 nt, Shigella flexneri 2a str. 301
aaguaguuccagcaugau

SEQ ID NO: 2013277 - RNA, 18 nt, Shigella flexneri 2a str. 301
aaguauauaaaaaacaau

SEQ ID NO: 2013278 - RNA, 16 nt, Shigella flexneri 2a str. 301
aaguauauaaaaaaca

SEQ ID NO: 2013279 - RNA, 19 nt, Shigella flexneri 2a str. 301
aaguacucuuugaacagcc

SEQ ID NO: 2013280 - RNA, 18 nt, Shigella flexneri 2a str. 301
aaguacagcccaggcacu

SEQ ID NO: 2013281 - RNA, 19 nt, Shigella flexneri 2a str. 301
aaguacuucacaaucagcg

SEQ ID NO: 2013282 - RNA, 21 nt, Shigella flexneri 2a str. 301
aaguagagugguuuuucaaca

SEQ ID NO: 2013283 - RNA, 14 nt, Shigella flexneri 2a str. 301
aaguaauucauuca

SEQ ID NO: 2013284 - RNA, 21 nt, Shigella flexneri 2a str. 301
aaguaccaucguccagcagca

SEQ ID NO: 2013285 - RNA, 19 nt, Shigella flexneri 2a str. 301
aaguaccaucguccagcag

SEQ ID NO: 2013286 - RNA, 23 nt, Shigella flexneri 2a str. 301
aaggucacucccggauaaaucuc

SEQ ID NO: 2013287 - RNA, 16 nt, Shigella flexneri 2a str. 301
aaguaaaaaagaagga

SEQ ID NO: 2013288 - RNA, 19 nt, Shigella flexneri 2a str. 301
aaguaaaaaagaaggaaaa

SEQ ID NO: 2013289 - RNA, 18 nt, Shigella flexneri 2a str. 301
aaggucaucaaucauuuu

SEQ ID NO: 2013290 - RNA, 23 nt, Shigella flexneri 2a str. 301
aaguaauagaacuauaauugcuu

SEQ ID NO: 2013291 - RNA, 22 nt, Shigella flexneri 2a str. 301
aaggcgugaucuccuuggagaa

SEQ ID NO: 2013292 - RNA, 15 nt, Shigella flexneri 2a str. 301
aaggcguucacgcca

SEQ ID NO: 2013293 - RNA, 14 nt, Shigella flexneri 2a str. 301
aaggagauaaaccg

SEQ ID NO: 2013294 - RNA, 18 nt, Shigella flexneri 2a str. 301
aaggauugcagcacugau

SEQ ID NO: 2013295 - RNA, 18 nt, Shigella flexneri 2a str. 301
aaggcggcagaacagaac

SEQ ID NO: 2013296 - RNA, 13 nt, Shigella flexneri 2a str. 301
aaggauuacucag

SEQ ID NO: 2013297 - RNA, 16 nt, Shigella flexneri 2a str. 301
aaggauggucgcuuug

SEQ ID NO: 2013298 - RNA, 15 nt, Shigella flexneri 2a str. 301
aagggcggcgagaaa

SEQ ID NO: 2013299 - RNA, 17 nt, Shigella flexneri 2a str. 301
aaggggacguaaagaag

SEQ ID NO: 2013300 - RNA, 13 nt, Shigella flexneri 2a str. 301
aaggguaugcugu

SEQ ID NO: 2013301 - RNA, 19 nt, Shigella flexneri 2a str. 301
aaggguaugcuguaaacaa

SEQ ID NO: 2013302 - RNA, 14 nt, Shigella flexneri 2a str. 301
aaggguaagggagg

SEQ ID NO: 2013303 - RNA, 22 nt, Shigella flexneri 2a str. 301
aaggguaagggaggauuucucc

SEQ ID NO: 2013304 - RNA, 15 nt, Shigella flexneri 2a str. 301
aaggggugaaaaaaa

SEQ ID NO: 2013305 - RNA, 23 nt, Shigella flexneri 2a str. 301
aagggagagggauucucuuuguu

SEQ ID NO: 2013306 - RNA, 23 nt, Shigella flexneri 2a str. 301
aagggccgcaguggauaauacac

SEQ ID NO: 2013307 - RNA, 17 nt, Shigella flexneri 2a str. 301
aauuggaguaucaccau

SEQ ID NO: 2013308 - RNA, 21 nt, Shigella flexneri 2a str. 301
aauuggcacgccgacaucuuu

SEQ ID NO: 2013309 - RNA, 15 nt, Shigella flexneri 2a str. 301
aauugcgaacugugc

SEQ ID NO: 2013310 - RNA, 17 nt, Shigella flexneri 2a str. 301
aauugcgaauuauaauu

SEQ ID NO: 2013311 - RNA, 19 nt, Shigella flexneri 2a str. 301
aauugcgcgacuuuuuccu

SEQ ID NO: 2013312 - RNA, 12 nt, Shigella flexneri 2a str. 301
aauugcgucagu

SEQ ID NO: 2013313 - RNA, 14 nt, Shigella flexneri 2a str. 301
aauugcgucaguau

SEQ ID NO: 2013314 - RNA, 19 nt, Shigella flexneri 2a str. 301
aauugcguaaagccugcug

SEQ ID NO: 2013315 - RNA, 19 nt, Shigella flexneri 2a str. 301
aauugcgguuuucucuugu

SEQ ID NO: 2013316 - RNA, 20 nt, Shigella flexneri 2a str. 301
aauugcgggccaaagaccag

SEQ ID NO: 2013317 - RNA, 18 nt, Shigella flexneri 2a str. 301
aauugcgcaacugaggca

SEQ ID NO: 2013318 - RNA, 18 nt, Shigella flexneri 2a str. 301
aauugcucauagagcgca

SEQ ID NO: 2013319 - RNA, 23 nt, Shigella flexneri 2a str. 301
aauugauccgcgauaagucuuug

SEQ ID NO: 2013320 - RNA, 20 nt, Shigella flexneri 2a str. 301
aauugauuuucgaaaaaaaa

SEQ ID NO: 2013321 - RNA, 20 nt, Shigella flexneri 2a str. 301
aauugcacauauuuuucacc

SEQ ID NO: 2013322 - RNA, 23 nt, Shigella flexneri 2a str. 301
aauugcaccauccauuuuucacg

SEQ ID NO: 2013323 - RNA, 22 nt, Shigella flexneri 2a str. 301
aauugcacguccgguggcaucc

SEQ ID NO: 2013324 - RNA, 14 nt, Shigella flexneri 2a str. 301
aauugccagacaac

SEQ ID NO: 2013325 - RNA, 18 nt, Shigella flexneri 2a str. 301
aauugccugauggccugc

SEQ ID NO: 2013326 - RNA, 15 nt, Shigella flexneri 2a str. 301
aauugccccagaugc

SEQ ID NO: 2013327 - RNA, 17 nt, Shigella flexneri 2a str. 301
aauugcccggucaggug

SEQ ID NO: 2013328 - RNA, 12 nt, Shigella flexneri 2a str. 301
aauucuucugaa

SEQ ID NO: 2013329 - RNA, 20 nt, Shigella flexneri 2a str. 301
aauugaaaaguccaggcugc

SEQ ID NO: 2013330 - RNA, 21 nt, Shigella flexneri 2a str. 301
aauugaaagagccgauaaaca

SEQ ID NO: 2013331 - RNA, 22 nt, Shigella flexneri 2a str. 301
aauugaggcccggcguauauug

SEQ ID NO: 2013332 - RNA, 23 nt, Shigella flexneri 2a str. 301
aauugagaaccacaaugaagaaa

SEQ ID NO: 2013333 - RNA, 19 nt, Shigella flexneri 2a str. 301
aauuuauaaucuuuaaaaa

SEQ ID NO: 2013334 - RNA, 16 nt, Shigella flexneri 2a str. 301
aauuuagcgacccauu

SEQ ID NO: 2013335 - RNA, 23 nt, Shigella flexneri 2a str. 301
aauuuagcgccacgggcaauaag

SEQ ID NO: 2013336 - RNA, 16 nt, Shigella flexneri 2a str. 301
aauuuacgcuuuucuu

SEQ ID NO: 2013337 - RNA, 14 nt, Shigella flexneri 2a str. 301
aauuuaucagacaa

SEQ ID NO: 2013338 - RNA, 21 nt, Shigella flexneri 2a str. 301
aauuucacaguaaugauuuaa

SEQ ID NO: 2013339 - RNA, 12 nt, Shigella flexneri 2a str. 301
aauuguuuuaua

SEQ ID NO: 2013340 - RNA, 22 nt, Shigella flexneri 2a str. 301
aauuguuugacuuauaagucuc

SEQ ID NO: 2013341 - RNA, 20 nt, Shigella flexneri 2a str. 301
aauuguuuaaucaacugccc

SEQ ID NO: 2013342 - RNA, 22 nt, Shigella flexneri 2a str. 301
aauuguuccgucagccgcccgc

SEQ ID NO: 2013343 - RNA, 15 nt, Shigella flexneri 2a str. 301
aauuguuccggacug

SEQ ID NO: 2013344 - RNA, 17 nt, Shigella flexneri 2a str. 301
aauugucuccaccaaug

SEQ ID NO: 2013345 - RNA, 21 nt, Shigella flexneri 2a str. 301
aauugguagacgcgcuagccu

SEQ ID NO: 2013346 - RNA, 21 nt, Shigella flexneri 2a str. 301
aauugguagacgcgcuagcuu

SEQ ID NO: 2013347 - RNA, 12 nt, Shigella flexneri 2a str. 301
aauucaaauccu

SEQ ID NO: 2013348 - RNA, 11 nt, Shigella flexneri 2a str. 301
aauucaaugaa

SEQ ID NO: 2013349 - RNA, 22 nt, Shigella flexneri 2a str. 301
aauucaaugacaguaucgccaa

SEQ ID NO: 2013350 - RNA, 14 nt, Shigella flexneri 2a str. 301
aauucaauauauug

SEQ ID NO: 2013351 - RNA, 15 nt, Shigella flexneri 2a str. 301
aauuauuucuuuuac

SEQ ID NO: 2013352 - RNA, 20 nt, Shigella flexneri 2a str. 301
aauuaucccugcggaaaaaa

SEQ ID NO: 2013353 - RNA, 20 nt, Shigella flexneri 2a str. 301
aauuaucaccgcaccuguaa

SEQ ID NO: 2013354 - RNA, 19 nt, Shigella flexneri 2a str. 301
aauuauggcgauaucaaaa

SEQ ID NO: 2013355 - RNA, 13 nt, Shigella flexneri 2a str. 301
aauuauuaccauc

SEQ ID NO: 2013356 - RNA, 14 nt, Shigella flexneri 2a str. 301
aauuauuaacaaaa

SEQ ID NO: 2013357 - RNA, 13 nt, Shigella flexneri 2a str. 301
aauuaauugugaa

SEQ ID NO: 2013358 - RNA, 22 nt, Shigella flexneri 2a str. 301
aauuacaaaaagugcuuucuga

SEQ ID NO: 2013359 - RNA, 16 nt, Shigella flexneri 2a str. 301
aauuaacgaaaucuca

SEQ ID NO: 2013360 - RNA, 16 nt, Shigella flexneri 2a str. 301
aauuaacauugcaaga

SEQ ID NO: 2013361 - RNA, 10 nt, Shigella flexneri 2a str. 301
aauguagccg

SEQ ID NO: 2013362 - RNA, 21 nt, Shigella flexneri 2a str. 301
aauuacugggaugugaaaaug

SEQ ID NO: 2013363 - RNA, 17 nt, Shigella flexneri 2a str. 301
aauuacugagagaaaaa

SEQ ID NO: 2013364 - RNA, 19 nt, Shigella flexneri 2a str. 301
aauuacugagagaaaaaaa

SEQ ID NO: 2013365 - RNA, 20 nt, Shigella flexneri 2a str. 301
aauuacugccgcuguugcaa

SEQ ID NO: 2013366 - RNA, 18 nt, Shigella flexneri 2a str. 301
aauuacugccuuaaucaa

SEQ ID NO: 2013367 - RNA, 19 nt, Shigella flexneri 2a str. 301
aauuacugccuugaugaaa

SEQ ID NO: 2013368 - RNA, 22 nt, Shigella flexneri 2a str. 301
aauuacucccgugccagagcau

SEQ ID NO: 2013369 - RNA, 13 nt, Shigella flexneri 2a str. 301
aauuacucauacu

SEQ ID NO: 2013370 - RNA, 21 nt, Shigella flexneri 2a str. 301
aauuacacaucaggcgauaau

SEQ ID NO: 2013371 - RNA, 18 nt, Shigella flexneri 2a str. 301
aauuacgcuguucauccc

SEQ ID NO: 2013372 - RNA, 17 nt, Shigella flexneri 2a str. 301
aauuacggauuacaugg

SEQ ID NO: 2013373 - RNA, 21 nt, Shigella flexneri 2a str. 301
aauuagauuuaauaacaacga

SEQ ID NO: 2013374 - RNA, 16 nt, Shigella flexneri 2a str. 301
aauuagcacgauuuug

SEQ ID NO: 2013375 - RNA, 16 nt, Shigella flexneri 2a str. 301
aauuagcuuuaaucca

SEQ ID NO: 2013376 - RNA, 16 nt, Shigella flexneri 2a str. 301
aauucgacuuucucug

SEQ ID NO: 2013377 - RNA, 14 nt, Shigella flexneri 2a str. 301
aauucgaagcugua

SEQ ID NO: 2013378 - RNA, 19 nt, Shigella flexneri 2a str. 301
aauuccuaaccgaauucaa

SEQ ID NO: 2013379 - RNA, 17 nt, Shigella flexneri 2a str. 301
aauuccggugcgccaga

SEQ ID NO: 2013380 - RNA, 21 nt, Shigella flexneri 2a str. 301
aauuccuaugcaacaacugaa

SEQ ID NO: 2013381 - RNA, 23 nt, Shigella flexneri 2a str. 301
aauucgcggauguugcugcacca

SEQ ID NO: 2013382 - RNA, 23 nt, Shigella flexneri 2a str. 301
aauucgcccuucggcaucacgaa

SEQ ID NO: 2013383 - RNA, 13 nt, Shigella flexneri 2a str. 301
aauucgcccuucg

SEQ ID NO: 2013384 - RNA, 17 nt, Shigella flexneri 2a str. 301
aauucuacagaaaugaa

SEQ ID NO: 2013385 - RNA, 15 nt, Shigella flexneri 2a str. 301
aauucuaauguuaaa

SEQ ID NO: 2013386 - RNA, 18 nt, Shigella flexneri 2a str. 301
aauucuacagaaaugaaa

SEQ ID NO: 2013387 - RNA, 21 nt, Shigella flexneri 2a str. 301
aauucuacagaaaugaaaaaa

SEQ ID NO: 2013388 - RNA, 16 nt, Shigella flexneri 2a str. 301
aauucuaaauguucaa

SEQ ID NO: 2013389 - RNA, 14 nt, Shigella flexneri 2a str. 301
aauucuaaauguuc

SEQ ID NO: 2013390 - RNA, 22 nt, Shigella flexneri 2a str. 301
aauucugagagcaugaaaugaa

SEQ ID NO: 2013391 - RNA, 23 nt, Shigella flexneri 2a str. 301
aauucucucuucagcuuccauca

SEQ ID NO: 2013392 - RNA, 17 nt, Shigella flexneri 2a str. 301
aauucuccgcucucaau

SEQ ID NO: 2013393 - RNA, 18 nt, Shigella flexneri 2a str. 301
aauucccgcuucuucugc

SEQ ID NO: 2013394 - RNA, 19 nt, Shigella flexneri 2a str. 301
aauucccgcuucuucugcc

SEQ ID NO: 2013395 - RNA, 20 nt, Shigella flexneri 2a str. 301
aauucccgcagcuccagccc

SEQ ID NO: 2013396 - RNA, 18 nt, Shigella flexneri 2a str. 301
aauucccgagcugcucgu

SEQ ID NO: 2013397 - RNA, 23 nt, Shigella flexneri 2a str. 301
aauuccauuucccugacaaauca

SEQ ID NO: 2013398 - RNA, 20 nt, Shigella flexneri 2a str. 301
aauuccauuucccugacaaa

SEQ ID NO: 2013399 - RNA, 14 nt, Shigella flexneri 2a str. 301
aauucccugcgcca

SEQ ID NO: 2013400 - RNA, 13 nt, Shigella flexneri 2a str. 301
aauuccgaacaaa

SEQ ID NO: 2013401 - RNA, 18 nt, Shigella flexneri 2a str. 301
aauuccgaauuucauccu

SEQ ID NO: 2013402 - RNA, 17 nt, Shigella flexneri 2a str. 301
aauuccgcuucucuuuc

SEQ ID NO: 2013403 - RNA, 21 nt, Shigella flexneri 2a str. 301
aauucauucaauuaauaacac

SEQ ID NO: 2013404 - RNA, 14 nt, Shigella flexneri 2a str. 301
aauucauuccugga

SEQ ID NO: 2013405 - RNA, 20 nt, Shigella flexneri 2a str. 301
aauucauuugaauaguuaau

SEQ ID NO: 2013406 - RNA, 14 nt, Shigella flexneri 2a str. 301
aauucacgccuucu

SEQ ID NO: 2013407 - RNA, 23 nt, Shigella flexneri 2a str. 301
aauucacgccacugucauauuug

SEQ ID NO: 2013408 - RNA, 19 nt, Shigella flexneri 2a str. 301
aauucacgcaggcgagaau

SEQ ID NO: 2013409 - RNA, 18 nt, Shigella flexneri 2a str. 301
aauucacgaauauuuccc

SEQ ID NO: 2013410 - RNA, 15 nt, Shigella flexneri 2a str. 301
aauucacucuauacc

SEQ ID NO: 2013411 - RNA, 12 nt, Shigella flexneri 2a str. 301
aauucaggaaau

SEQ ID NO: 2013412 - RNA, 15 nt, Shigella flexneri 2a str. 301
aauucaggagcaggc

SEQ ID NO: 2013413 - RNA, 21 nt, Shigella flexneri 2a str. 301
aauucauaagaagcuuuucuc

SEQ ID NO: 2013414 - RNA, 17 nt, Shigella flexneri 2a str. 301
aaugcgcguaauuugcg

SEQ ID NO: 2013415 - RNA, 19 nt, Shigella flexneri 2a str. 301
aaugcggagguuucuuuuu

SEQ ID NO: 2013416 - RNA, 16 nt, Shigella flexneri 2a str. 301
aaugcgggugcaauca

SEQ ID NO: 2013417 - RNA, 12 nt, Shigella flexneri 2a str. 301
aaugcuucacac

SEQ ID NO: 2013418 - RNA, 17 nt, Shigella flexneri 2a str. 301
aauggaaacagcaccau

SEQ ID NO: 2013419 - RNA, 12 nt, Shigella flexneri 2a str. 301
aauggaaaacug

SEQ ID NO: 2013420 - RNA, 22 nt, Shigella flexneri 2a str. 301
aauggaaagcccgccccgcucg

SEQ ID NO: 2013421 - RNA, 17 nt, Shigella flexneri 2a str. 301
aauggacacuauuuccc

SEQ ID NO: 2013422 - RNA, 13 nt, Shigella flexneri 2a str. 301
aaugcuuuaaaug

SEQ ID NO: 2013423 - RNA, 16 nt, Shigella flexneri 2a str. 301
aauggaaacagcacca

SEQ ID NO: 2013424 - RNA, 23 nt, Shigella flexneri 2a str. 301
aauggccggaacgcuuucuuugg

SEQ ID NO: 2013425 - RNA, 14 nt, Shigella flexneri 2a str. 301
aauggcgcgaaaac

SEQ ID NO: 2013426 - RNA, 19 nt, Shigella flexneri 2a str. 301
aauggcgcauccagccaac

SEQ ID NO: 2013427 - RNA, 12 nt, Shigella flexneri 2a str. 301
aauggcaugcuc

SEQ ID NO: 2013428 - RNA, 19 nt, Shigella flexneri 2a str. 301
aauggcaggcucagacuga

SEQ ID NO: 2013429 - RNA, 20 nt, Shigella flexneri 2a str. 301
aauggcaucugauaagccca

SEQ ID NO: 2013430 - RNA, 22 nt, Shigella flexneri 2a str. 301
aauggauuagcgaccgaacaga

SEQ ID NO: 2013431 - RNA, 15 nt, Shigella flexneri 2a str. 301
aauggcaggcucaga

SEQ ID NO: 2013432 - RNA, 16 nt, Shigella flexneri 2a str. 301
aauggaugcaaucaca

SEQ ID NO: 2013433 - RNA, 22 nt, Shigella flexneri 2a str. 301
aauggugugcaugguguucaga

SEQ ID NO: 2013434 - RNA, 21 nt, Shigella flexneri 2a str. 301
aauggcgcuguaaaaggcgcc

SEQ ID NO: 2013435 - RNA, 18 nt, Shigella flexneri 2a str. 301
aaugguuucauuccagua

SEQ ID NO: 2013436 - RNA, 14 nt, Shigella flexneri 2a str. 301
aaugccgccgauac

SEQ ID NO: 2013437 - RNA, 21 nt, Shigella flexneri 2a str. 301
aaugccaaguaauagaacuau

SEQ ID NO: 2013438 - RNA, 19 nt, Shigella flexneri 2a str. 301
aaugccacauuagauaaaa

SEQ ID NO: 2013439 - RNA, 17 nt, Shigella flexneri 2a str. 301
aaugccaccaauaauga

SEQ ID NO: 2013440 - RNA, 21 nt, Shigella flexneri 2a str. 301
aaugccaaauauuucuuuauc

SEQ ID NO: 2013441 - RNA, 14 nt, Shigella flexneri 2a str. 301
aaugccagauaaga

SEQ ID NO: 2013442 - RNA, 17 nt, Shigella flexneri 2a str. 301
aaugccacugaauaaag

SEQ ID NO: 2013443 - RNA, 23 nt, Shigella flexneri 2a str. 301
aaugcagucgcguagguaaucau

SEQ ID NO: 2013444 - RNA, 15 nt, Shigella flexneri 2a str. 301
aaugcaguuccauau

SEQ ID NO: 2013445 - RNA, 23 nt, Shigella flexneri 2a str. 301
aaugcaguuccauaugaauuccu

SEQ ID NO: 2013446 - RNA, 14 nt, Shigella flexneri 2a str. 301
aaugcaggcaccug

SEQ ID NO: 2013447 - RNA, 18 nt, Shigella flexneri 2a str. 301
aaugcagcguuuccagcc

SEQ ID NO: 2013448 - RNA, 22 nt, Shigella flexneri 2a str. 301
aaugcaucgcgaccaaucacac

SEQ ID NO: 2013449 - RNA, 22 nt, Shigella flexneri 2a str. 301
aaugcaucagugacaaauuccg

SEQ ID NO: 2013450 - RNA, 21 nt, Shigella flexneri 2a str. 301
aaugcaguuuuuaauuuucgu

SEQ ID NO: 2013451 - RNA, 13 nt, Shigella flexneri 2a str. 301
aaugcaucagcca

SEQ ID NO: 2013452 - RNA, 17 nt, Shigella flexneri 2a str. 301
aaugcauggcagauaaa

SEQ ID NO: 2013453 - RNA, 14 nt, Shigella flexneri 2a str. 301
aaugccuuucucag

SEQ ID NO: 2013454 - RNA, 21 nt, Shigella flexneri 2a str. 301
aaugcgaaaacgauguuugcu

SEQ ID NO: 2013455 - RNA, 16 nt, Shigella flexneri 2a str. 301
aaugcgauggcaaaag

SEQ ID NO: 2013456 - RNA, 15 nt, Shigella flexneri 2a str. 301
aaugcgcagccagcg

SEQ ID NO: 2013457 - RNA, 14 nt, Shigella flexneri 2a str. 301
aaugcgcaguugca

SEQ ID NO: 2013458 - RNA, 23 nt, Shigella flexneri 2a str. 301
aaugcgcccagcgucagcauaaa

SEQ ID NO: 2013459 - RNA, 18 nt, Shigella flexneri 2a str. 301
aaugccgguggugaccug

SEQ ID NO: 2013460 - RNA, 17 nt, Shigella flexneri 2a str. 301
aaugccggaaucagaau

SEQ ID NO: 2013461 - RNA, 23 nt, Shigella flexneri 2a str. 301
aaugccugagacagacagccuca

SEQ ID NO: 2013462 - RNA, 18 nt, Shigella flexneri 2a str. 301
aaugccucagagcuaacu

SEQ ID NO: 2013463 - RNA, 16 nt, Shigella flexneri 2a str. 301
aaugccucagagcuaa

SEQ ID NO: 2013464 - RNA, 16 nt, Shigella flexneri 2a str. 301
aaugccguucucuggc

SEQ ID NO: 2013465 - RNA, 12 nt, Shigella flexneri 2a str. 301
aaugaccgcgcc

SEQ ID NO: 2013466 - RNA, 14 nt, Shigella flexneri 2a str. 301
aaugacccacccca

SEQ ID NO: 2013467 - RNA, 20 nt, Shigella flexneri 2a str. 301
aaugacccaccccagcagca

SEQ ID NO: 2013468 - RNA, 13 nt, Shigella flexneri 2a str. 301
aaugaaugaugcg

SEQ ID NO: 2013469 - RNA, 21 nt, Shigella flexneri 2a str. 301
aaugaaucaucguucauauau

SEQ ID NO: 2013470 - RNA, 17 nt, Shigella flexneri 2a str. 301
aaugagagggcgauaaa

SEQ ID NO: 2013471 - RNA, 22 nt, Shigella flexneri 2a str. 301
aaugagagggcgauaaaucucc

SEQ ID NO: 2013472 - RNA, 14 nt, Shigella flexneri 2a str. 301
aaugacgaugcacc

SEQ ID NO: 2013473 - RNA, 19 nt, Shigella flexneri 2a str. 301
aaugaugcccgguugcuuu

SEQ ID NO: 2013474 - RNA, 20 nt, Shigella flexneri 2a str. 301
aaugaucagcgguuuugcca

SEQ ID NO: 2013475 - RNA, 13 nt, Shigella flexneri 2a str. 301
aaugaucagugga

SEQ ID NO: 2013476 - RNA, 15 nt, Shigella flexneri 2a str. 301
aaugaucaguggaag

SEQ ID NO: 2013477 - RNA, 19 nt, Shigella flexneri 2a str. 301
aaugagccggaccucuuuc

SEQ ID NO: 2013478 - RNA, 16 nt, Shigella flexneri 2a str. 301
aaugaaacaggggcug

SEQ ID NO: 2013479 - RNA, 22 nt, Shigella flexneri 2a str. 301
aaugaaaccuucuugacgcuga

SEQ ID NO: 2013480 - RNA, 14 nt, Shigella flexneri 2a str. 301
aaugaaaaucacca

SEQ ID NO: 2013481 - RNA, 15 nt, Shigella flexneri 2a str. 301
aaugaacaccaaacc

SEQ ID NO: 2013482 - RNA, 23 nt, Shigella flexneri 2a str. 301
aaugaaagccccaccagcaaaua

SEQ ID NO: 2013483 - RNA, 22 nt, Shigella flexneri 2a str. 301
aaucuuuuugggguuuuaauuc

SEQ ID NO: 2013484 - RNA, 21 nt, Shigella flexneri 2a str. 301
aaucuuauaugaugaaacuga

SEQ ID NO: 2013485 - RNA, 19 nt, Shigella flexneri 2a str. 301
aaucuuugcagcuuugcug

SEQ ID NO: 2013486 - RNA, 15 nt, Shigella flexneri 2a str. 301
aaucuauugcaacau

SEQ ID NO: 2013487 - RNA, 21 nt, Shigella flexneri 2a str. 301
aaucuauugcaacauguugaa

SEQ ID NO: 2013488 - RNA, 21 nt, Shigella flexneri 2a str. 301
aaucuguaacaaggugaauca

SEQ ID NO: 2013489 - RNA, 17 nt, Shigella flexneri 2a str. 301
aaucugucagguaacaa

SEQ ID NO: 2013490 - RNA, 19 nt, Shigella flexneri 2a str. 301
aaucugucguaacugcgcc

SEQ ID NO: 2013491 - RNA, 13 nt, Shigella flexneri 2a str. 301
aauccgcaccaac

SEQ ID NO: 2013492 - RNA, 16 nt, Shigella flexneri 2a str. 301
aauccgauuacgugaa

SEQ ID NO: 2013493 - RNA, 14 nt, Shigella flexneri 2a str. 301
aaucccacauccua

SEQ ID NO: 2013494 - RNA, 20 nt, Shigella flexneri 2a str. 301
aaucccaucuucgaguaaaa

SEQ ID NO: 2013495 - RNA, 20 nt, Shigella flexneri 2a str. 301
aaucccgccauaacggcugu

SEQ ID NO: 2013496 - RNA, 15 nt, Shigella flexneri 2a str. 301
aaucccccacuuuua

SEQ ID NO: 2013497 - RNA, 18 nt, Shigella flexneri 2a str. 301
aauccgcuuguucaguau

SEQ ID NO: 2013498 - RNA, 17 nt, Shigella flexneri 2a str. 301
aauccgcccuaacaucg

SEQ ID NO: 2013499 - RNA, 14 nt, Shigella flexneri 2a str. 301
aauccggcaaauaa

SEQ ID NO: 2013500 - RNA, 15 nt, Shigella flexneri 2a str. 301
aauccggcagcgaac

SEQ ID NO: 2013501 - RNA, 22 nt, Shigella flexneri 2a str. 301
aauccgucagcgaguugaucac

SEQ ID NO: 2013502 - RNA, 23 nt, Shigella flexneri 2a str. 301
aauccucuuugcuuccugaguaa

SEQ ID NO: 2013503 - RNA, 23 nt, Shigella flexneri 2a str. 301
aaucgccuuacccggaccgucuu

SEQ ID NO: 2013504 - RNA, 23 nt, Shigella flexneri 2a str. 301
aaucgccuuaauaacccacacca

SEQ ID NO: 2013505 - RNA, 17 nt, Shigella flexneri 2a str. 301
aaucgcgaaauaacugc

SEQ ID NO: 2013506 - RNA, 13 nt, Shigella flexneri 2a str. 301
aaucgcucagcgc

SEQ ID NO: 2013507 - RNA, 14 nt, Shigella flexneri 2a str. 301
aaucgccagcggca

SEQ ID NO: 2013508 - RNA, 18 nt, Shigella flexneri 2a str. 301
aaucgccagcggcagcuc

SEQ ID NO: 2013509 - RNA, 20 nt, Shigella flexneri 2a str. 301
aaucgccguauaauaucuuu

SEQ ID NO: 2013510 - RNA, 21 nt, Shigella flexneri 2a str. 301
aaucgccagcaaaaucaccau

SEQ ID NO: 2013511 - RNA, 17 nt, Shigella flexneri 2a str. 301
aaucggugcaaaugcca

SEQ ID NO: 2013512 - RNA, 19 nt, Shigella flexneri 2a str. 301
aaucgguucgccugcacca

SEQ ID NO: 2013513 - RNA, 14 nt, Shigella flexneri 2a str. 301
aaucgguaacgcuu

SEQ ID NO: 2013514 - RNA, 18 nt, Shigella flexneri 2a str. 301
aaucggggauaagaauau

SEQ ID NO: 2013515 - RNA, 12 nt, Shigella flexneri 2a str. 301
aaucgucaguuc

SEQ ID NO: 2013516 - RNA, 22 nt, Shigella flexneri 2a str. 301
aaucgcuucagccggaauaauc

SEQ ID NO: 2013517 - RNA, 18 nt, Shigella flexneri 2a str. 301
aaucgcuucauaaagaua

SEQ ID NO: 2013518 - RNA, 22 nt, Shigella flexneri 2a str. 301
aaucgcuucaucgcccacauca

SEQ ID NO: 2013519 - RNA, 14 nt, Shigella flexneri 2a str. 301
aaucgcugaauauc

SEQ ID NO: 2013520 - RNA, 18 nt, Shigella flexneri 2a str. 301
aaucgcugcggcaauaau

SEQ ID NO: 2013521 - RNA, 21 nt, Shigella flexneri 2a str. 301
aaucgucgguguccacuuccg

SEQ ID NO: 2013522 - RNA, 13 nt, Shigella flexneri 2a str. 301
aaucgucaucagc

SEQ ID NO: 2013523 - RNA, 16 nt, Shigella flexneri 2a str. 301
aaucgucaucgacagc

SEQ ID NO: 2013524 - RNA, 20 nt, Shigella flexneri 2a str. 301
aauccaucccgcucuguaag

SEQ ID NO: 2013525 - RNA, 14 nt, Shigella flexneri 2a str. 301
aauccagcaauaau

SEQ ID NO: 2013526 - RNA, 12 nt, Shigella flexneri 2a str. 301
aauccagaacac

SEQ ID NO: 2013527 - RNA, 22 nt, Shigella flexneri 2a str. 301
aauccacguuccuggaaccagu

SEQ ID NO: 2013528 - RNA, 14 nt, Shigella flexneri 2a str. 301
aauccacagcaaug

SEQ ID NO: 2013529 - RNA, 13 nt, Shigella flexneri 2a str. 301
aauccaaccaucc

SEQ ID NO: 2013530 - RNA, 18 nt, Shigella flexneri 2a str. 301
aauccaaccauccccauc

SEQ ID NO: 2013531 - RNA, 13 nt, Shigella flexneri 2a str. 301
aauccaacaacac

SEQ ID NO: 2013532 - RNA, 21 nt, Shigella flexneri 2a str. 301
aauaugugaucgaauauauca

SEQ ID NO: 2013533 - RNA, 17 nt, Shigella flexneri 2a str. 301
aaucagcuuuuccauau

SEQ ID NO: 2013534 - RNA, 22 nt, Shigella flexneri 2a str. 301
aaucagguaagcgauaaaaaua

SEQ ID NO: 2013535 - RNA, 21 nt, Shigella flexneri 2a str. 301
aaucaggaacuggaagcugcc

SEQ ID NO: 2013536 - RNA, 22 nt, Shigella flexneri 2a str. 301
aaucauacaagcggaaacguaa

SEQ ID NO: 2013537 - RNA, 19 nt, Shigella flexneri 2a str. 301
aaucauaauguugcugccu

SEQ ID NO: 2013538 - RNA, 13 nt, Shigella flexneri 2a str. 301
aaucaugcaacac

SEQ ID NO: 2013539 - RNA, 14 nt, Shigella flexneri 2a str. 301
aaucaugcaauaaa

SEQ ID NO: 2013540 - RNA, 20 nt, Shigella flexneri 2a str. 301
aaucaucugauaucucacca

SEQ ID NO: 2013541 - RNA, 17 nt, Shigella flexneri 2a str. 301
aaucaucgcgugacagc

SEQ ID NO: 2013542 - RNA, 17 nt, Shigella flexneri 2a str. 301
aaucaucgacuccagcg

SEQ ID NO: 2013543 - RNA, 21 nt, Shigella flexneri 2a str. 301
aaucauauaucgcaagucauu

SEQ ID NO: 2013544 - RNA, 14 nt, Shigella flexneri 2a str. 301
aaucauauuaaauu

SEQ ID NO: 2013545 - RNA, 18 nt, Shigella flexneri 2a str. 301
aaucauauuaaauuuuuu

SEQ ID NO: 2013546 - RNA, 23 nt, Shigella flexneri 2a str. 301
aaucauucgccgguuccagcuuc

SEQ ID NO: 2013547 - RNA, 22 nt, Shigella flexneri 2a str. 301
aaucauucgccgguuccagcuu

SEQ ID NO: 2013548 - RNA, 17 nt, Shigella flexneri 2a str. 301
aaucauucgcaguugca

SEQ ID NO: 2013549 - RNA, 17 nt, Shigella flexneri 2a str. 301
aaccugugacagcagcg

SEQ ID NO: 2013550 - RNA, 15 nt, Shigella flexneri 2a str. 301
aaccuuaaagcauuu

SEQ ID NO: 2013551 - RNA, 13 nt, Shigella flexneri 2a str. 301
aaccuuaaauggc

SEQ ID NO: 2013552 - RNA, 14 nt, Shigella flexneri 2a str. 301
aaccuuacaaguaa

SEQ ID NO: 2013553 - RNA, 13 nt, Shigella flexneri 2a str. 301
aaccuguuuucac

SEQ ID NO: 2013554 - RNA, 19 nt, Shigella flexneri 2a str. 301
aaccuucaucguuucugcu

SEQ ID NO: 2013555 - RNA, 21 nt, Shigella flexneri 2a str. 301
aaccuuugcgguuaaaaauaa

SEQ ID NO: 2013556 - RNA, 16 nt, Shigella flexneri 2a str. 301
aaccuuuccuuguaac

SEQ ID NO: 2013557 - RNA, 16 nt, Shigella flexneri 2a str. 301
aaccuuuaugcagcuc

SEQ ID NO: 2013558 - RNA, 16 nt, Shigella flexneri 2a str. 301
aaccuucuugacgcug

SEQ ID NO: 2013559 - RNA, 15 nt, Shigella flexneri 2a str. 301
aaccuugccauucca

SEQ ID NO: 2013560 - RNA, 16 nt, Shigella flexneri 2a str. 301
aaccuugcuggcgauu

SEQ ID NO: 2013561 - RNA, 13 nt, Shigella flexneri 2a str. 301
aaccuuuaaucag

SEQ ID NO: 2013562 - RNA, 10 nt, Shigella flexneri 2a str. 301
aaccuuuaau

SEQ ID NO: 2013563 - RNA, 19 nt, Shigella flexneri 2a str. 301
aaccuugccauuccacaaa

SEQ ID NO: 2013564 - RNA, 21 nt, Shigella flexneri 2a str. 301
aaccuuuucucaaucaaaaga

SEQ ID NO: 2013565 - RNA, 16 nt, Shigella flexneri 2a str. 301
aacgaagcgccauuca

SEQ ID NO: 2013566 - RNA, 12 nt, Shigella flexneri 2a str. 301
aacgaagaaaac

SEQ ID NO: 2013567 - RNA, 18 nt, Shigella flexneri 2a str. 301
aacgaaucugcaaaucug

SEQ ID NO: 2013568 - RNA, 19 nt, Shigella flexneri 2a str. 301
aacgacagugacuuccguc

SEQ ID NO: 2013569 - RNA, 21 nt, Shigella flexneri 2a str. 301
aacgaccggccauuccagcac

SEQ ID NO: 2013570 - RNA, 21 nt, Shigella flexneri 2a str. 301
aaccucgcccauuuuucauga

SEQ ID NO: 2013571 - RNA, 14 nt, Shigella flexneri 2a str. 301
aaccugacaacaaa

SEQ ID NO: 2013572 - RNA, 16 nt, Shigella flexneri 2a str. 301
aaccucuuccagcaga

SEQ ID NO: 2013573 - RNA, 13 nt, Shigella flexneri 2a str. 301
aaccugcaaaaua

SEQ ID NO: 2013574 - RNA, 12 nt, Shigella flexneri 2a str. 301
aaccugccuuac

SEQ ID NO: 2013575 - RNA, 21 nt, Shigella flexneri 2a str. 301
aaccugccgccuuaaaccucu

SEQ ID NO: 2013576 - RNA, 18 nt, Shigella flexneri 2a str. 301
aaccugcuccucaguuuc

SEQ ID NO: 2013577 - RNA, 18 nt, Shigella flexneri 2a str. 301
aaccuaagaaccagaauu

SEQ ID NO: 2013578 - RNA, 13 nt, Shigella flexneri 2a str. 301
aaccuaaaguaaa

SEQ ID NO: 2013579 - RNA, 20 nt, Shigella flexneri 2a str. 301
aaccuaaaguaaaggaacaa

SEQ ID NO: 2013580 - RNA, 19 nt, Shigella flexneri 2a str. 301
aaccuacgugcgcaauaac

SEQ ID NO: 2013581 - RNA, 20 nt, Shigella flexneri 2a str. 301
aaccuauuguuuuaaugaca

SEQ ID NO: 2013582 - RNA, 15 nt, Shigella flexneri 2a str. 301
aaccgucgagauaca

SEQ ID NO: 2013583 - RNA, 21 nt, Shigella flexneri 2a str. 301
aaccguaguggccacagauaa

SEQ ID NO: 2013584 - RNA, 15 nt, Shigella flexneri 2a str. 301
aaccgucagcaccag

SEQ ID NO: 2013585 - RNA, 19 nt, Shigella flexneri 2a str. 301
aaccguugcuggaaaaccu

SEQ ID NO: 2013586 - RNA, 13 nt, Shigella flexneri 2a str. 301
aaccuaaaccaaa

SEQ ID NO: 2013587 - RNA, 17 nt, Shigella flexneri 2a str. 301
aacgcagcuccgggcuc

SEQ ID NO: 2013588 - RNA, 21 nt, Shigella flexneri 2a str. 301
aacgcagcgaguaauagauga

SEQ ID NO: 2013589 - RNA, 16 nt, Shigella flexneri 2a str. 301
aacgcacacauccaca

SEQ ID NO: 2013590 - RNA, 16 nt, Shigella flexneri 2a str. 301
aacgcaccgccaccac

SEQ ID NO: 2013591 - RNA, 20 nt, Shigella flexneri 2a str. 301
aacgcaaacaccagcgaaug

SEQ ID NO: 2013592 - RNA, 21 nt, Shigella flexneri 2a str. 301
aacgauuuuagcaaacugauc

SEQ ID NO: 2013593 - RNA, 20 nt, Shigella flexneri 2a str. 301
aacgcaaagagagaagccag

SEQ ID NO: 2013594 - RNA, 23 nt, Shigella flexneri 2a str. 301
aacgcaaagagagaagccagaua

SEQ ID NO: 2013595 - RNA, 14 nt, Shigella flexneri 2a str. 301
aacgcaaagagaga

SEQ ID NO: 2013596 - RNA, 16 nt, Shigella flexneri 2a str. 301
aacgcaaauacugacu

SEQ ID NO: 2013597 - RNA, 20 nt, Shigella flexneri 2a str. 301
aacgcaaauguaaaaccaac

SEQ ID NO: 2013598 - RNA, 20 nt, Shigella flexneri 2a str. 301
aacgaugucgcccacuuuca

SEQ ID NO: 2013599 - RNA, 12 nt, Shigella flexneri 2a str. 301
aacgauggcgcg

SEQ ID NO: 2013600 - RNA, 15 nt, Shigella flexneri 2a str. 301
aacgacgcagaacug

SEQ ID NO: 2013601 - RNA, 21 nt, Shigella flexneri 2a str. 301
aacgacgacugccgcucaccu

SEQ ID NO: 2013602 - RNA, 18 nt, Shigella flexneri 2a str. 301
aacgacgagcgcugguga

SEQ ID NO: 2013603 - RNA, 17 nt, Shigella flexneri 2a str. 301
aacgaccuugcaauaau

SEQ ID NO: 2013604 - RNA, 19 nt, Shigella flexneri 2a str. 301
aacgacgcauacucuuuga

SEQ ID NO: 2013605 - RNA, 15 nt, Shigella flexneri 2a str. 301
aacgacgguaaacca

SEQ ID NO: 2013606 - RNA, 18 nt, Shigella flexneri 2a str. 301
aacgacugcgagcaaaau

SEQ ID NO: 2013607 - RNA, 14 nt, Shigella flexneri 2a str. 301
aacgaucgcccaga

SEQ ID NO: 2013608 - RNA, 16 nt, Shigella flexneri 2a str. 301
aacgauaacggugcaa

SEQ ID NO: 2013609 - RNA, 23 nt, Shigella flexneri 2a str. 301
aacgauaacguuccggggccucu

SEQ ID NO: 2013610 - RNA, 22 nt, Shigella flexneri 2a str. 301
aacgccugggcgagguggauau

SEQ ID NO: 2013611 - RNA, 14 nt, Shigella flexneri 2a str. 301
aacgccuguguccu

SEQ ID NO: 2013612 - RNA, 15 nt, Shigella flexneri 2a str. 301
aacgcgaaggccaga

SEQ ID NO: 2013613 - RNA, 21 nt, Shigella flexneri 2a str. 301
aacgcgaaaaugccccagcgc

SEQ ID NO: 2013614 - RNA, 19 nt, Shigella flexneri 2a str. 301
aacgcgaucgacgcgucca

SEQ ID NO: 2013615 - RNA, 17 nt, Shigella flexneri 2a str. 301
aacgcgcaaccagcagg

SEQ ID NO: 2013616 - RNA, 19 nt, Shigella flexneri 2a str. 301
aacgcgcaccgugacagua

SEQ ID NO: 2013617 - RNA, 16 nt, Shigella flexneri 2a str. 301
aacgccggagugaaaa

SEQ ID NO: 2013618 - RNA, 18 nt, Shigella flexneri 2a str. 301
aacgccggagugaaaauu

SEQ ID NO: 2013619 - RNA, 20 nt, Shigella flexneri 2a str. 301
aacgccggagugaaaauucu

SEQ ID NO: 2013620 - RNA, 15 nt, Shigella flexneri 2a str. 301
aacgccggguaaaug

SEQ ID NO: 2013621 - RNA, 15 nt, Shigella flexneri 2a str. 301
aacgccuaaugccag

SEQ ID NO: 2013622 - RNA, 17 nt, Shigella flexneri 2a str. 301
aacgccuaucaccagaa

SEQ ID NO: 2013623 - RNA, 14 nt, Shigella flexneri 2a str. 301
aacgccgucaucac

SEQ ID NO: 2013624 - RNA, 13 nt, Shigella flexneri 2a str. 301
aacgcccuuaccu

SEQ ID NO: 2013625 - RNA, 16 nt, Shigella flexneri 2a str. 301
aacgcaugcacaucca

SEQ ID NO: 2013626 - RNA, 15 nt, Shigella flexneri 2a str. 301
aacgccaucgccagg

SEQ ID NO: 2013627 - RNA, 14 nt, Shigella flexneri 2a str. 301
aacgccauccggca

SEQ ID NO: 2013628 - RNA, 20 nt, Shigella flexneri 2a str. 301
aacgccagccuguuccagac

SEQ ID NO: 2013629 - RNA, 13 nt, Shigella flexneri 2a str. 301
aacgccagcagca

SEQ ID NO: 2013630 - RNA, 23 nt, Shigella flexneri 2a str. 301
aacgccagcagaguuuuuuaugc

SEQ ID NO: 2013631 - RNA, 14 nt, Shigella flexneri 2a str. 301
aacgccagaucacc

SEQ ID NO: 2013632 - RNA, 18 nt, Shigella flexneri 2a str. 301
aacgccccuucugccgca

SEQ ID NO: 2013633 - RNA, 11 nt, Shigella flexneri 2a str. 301
aacgcccauca

SEQ ID NO: 2013634 - RNA, 18 nt, Shigella flexneri 2a str. 301
aacgcccgcaagccaaca

SEQ ID NO: 2013635 - RNA, 14 nt, Shigella flexneri 2a str. 301
aacgccaguuuaau

SEQ ID NO: 2013636 - RNA, 21 nt, Shigella flexneri 2a str. 301
aacggauaugauuuaaaaaau

SEQ ID NO: 2013637 - RNA, 17 nt, Shigella flexneri 2a str. 301
aacggaugaugcucccc

SEQ ID NO: 2013638 - RNA, 12 nt, Shigella flexneri 2a str. 301
aacggagcuacc

SEQ ID NO: 2013639 - RNA, 17 nt, Shigella flexneri 2a str. 301
aacggcacggaaagcag

SEQ ID NO: 2013640 - RNA, 19 nt, Shigella flexneri 2a str. 301
aacggcacggaaagcagca

SEQ ID NO: 2013641 - RNA, 21 nt, Shigella flexneri 2a str. 301
aacggcaagaucagcauccau

SEQ ID NO: 2013642 - RNA, 16 nt, Shigella flexneri 2a str. 301
aacggcacgaugagca

SEQ ID NO: 2013643 - RNA, 20 nt, Shigella flexneri 2a str. 301
aacgcuuguaaaugaacuca

SEQ ID NO: 2013644 - RNA, 19 nt, Shigella flexneri 2a str. 301
aacgcuuuuuugagcagca

SEQ ID NO: 2013645 - RNA, 15 nt, Shigella flexneri 2a str. 301
aacgcuucucccagc

SEQ ID NO: 2013646 - RNA, 20 nt, Shigella flexneri 2a str. 301
aacgcuuuacucaacucccc

SEQ ID NO: 2013647 - RNA, 19 nt, Shigella flexneri 2a str. 301
aacgcuuucccugaagcag

SEQ ID NO: 2013648 - RNA, 16 nt, Shigella flexneri 2a str. 301
aacgcguucacugccg

SEQ ID NO: 2013649 - RNA, 14 nt, Shigella flexneri 2a str. 301
aacgcguucacugc

SEQ ID NO: 2013650 - RNA, 16 nt, Shigella flexneri 2a str. 301
aacgcucuccugcgga

SEQ ID NO: 2013651 - RNA, 14 nt, Shigella flexneri 2a str. 301
aacgcuggcagcau

SEQ ID NO: 2013652 - RNA, 16 nt, Shigella flexneri 2a str. 301
aacgcugacauauuuu

SEQ ID NO: 2013653 - RNA, 18 nt, Shigella flexneri 2a str. 301
aacgcugacggugccagg

SEQ ID NO: 2013654 - RNA, 12 nt, Shigella flexneri 2a str. 301
aacgcucacuug

SEQ ID NO: 2013655 - RNA, 15 nt, Shigella flexneri 2a str. 301
aacgcguacccagca

SEQ ID NO: 2013656 - RNA, 17 nt, Shigella flexneri 2a str. 301
aacgcggcuacuuucuu

SEQ ID NO: 2013657 - RNA, 20 nt, Shigella flexneri 2a str. 301
aacgcgcccucagcccacau

SEQ ID NO: 2013658 - RNA, 13 nt, Shigella flexneri 2a str. 301
aacgcgccaagau

SEQ ID NO: 2013659 - RNA, 20 nt, Shigella flexneri 2a str. 301
aacgcgcuacugaaucccug

SEQ ID NO: 2013660 - RNA, 21 nt, Shigella flexneri 2a str. 301
aacgggcauggugucaccacc

SEQ ID NO: 2013661 - RNA, 21 nt, Shigella flexneri 2a str. 301
aacgggcaggguggugacacc

SEQ ID NO: 2013662 - RNA, 18 nt, Shigella flexneri 2a str. 301
aacgggauuccugcgcuu

SEQ ID NO: 2013663 - RNA, 18 nt, Shigella flexneri 2a str. 301
aacggcugcuucggucag

SEQ ID NO: 2013664 - RNA, 18 nt, Shigella flexneri 2a str. 301
aacggcugggaaaucacc

SEQ ID NO: 2013665 - RNA, 20 nt, Shigella flexneri 2a str. 301
aacggcucacgcccaucagc

SEQ ID NO: 2013666 - RNA, 18 nt, Shigella flexneri 2a str. 301
aacggcugauaacaauau

SEQ ID NO: 2013667 - RNA, 14 nt, Shigella flexneri 2a str. 301
aacggcuaaagccg

SEQ ID NO: 2013668 - RNA, 12 nt, Shigella flexneri 2a str. 301
aacggcgaaaaa

SEQ ID NO: 2013669 - RNA, 17 nt, Shigella flexneri 2a str. 301
aacggccugaccauuac

SEQ ID NO: 2013670 - RNA, 14 nt, Shigella flexneri 2a str. 301
aacguacugcugaa

SEQ ID NO: 2013671 - RNA, 21 nt, Shigella flexneri 2a str. 301
aacguacgcaauccucuuuuc

SEQ ID NO: 2013672 - RNA, 15 nt, Shigella flexneri 2a str. 301
aacguaaacgcagca

SEQ ID NO: 2013673 - RNA, 20 nt, Shigella flexneri 2a str. 301
aacgguuuauccccaaggau

SEQ ID NO: 2013674 - RNA, 22 nt, Shigella flexneri 2a str. 301
aacgguucuuuggucaggcgcu

SEQ ID NO: 2013675 - RNA, 14 nt, Shigella flexneri 2a str. 301
aacgguccuuacca

SEQ ID NO: 2013676 - RNA, 21 nt, Shigella flexneri 2a str. 301
aacggucgugcgagauaacca

SEQ ID NO: 2013677 - RNA, 23 nt, Shigella flexneri 2a str. 301
aacggugccauugaccagcugcc

SEQ ID NO: 2013678 - RNA, 22 nt, Shigella flexneri 2a str. 301
aacggugcggcucucuuucucc

SEQ ID NO: 2013679 - RNA, 14 nt, Shigella flexneri 2a str. 301
aacgguuaacaguu

SEQ ID NO: 2013680 - RNA, 15 nt, Shigella flexneri 2a str. 301
aacguuuaaaaacuu

SEQ ID NO: 2013681 - RNA, 19 nt, Shigella flexneri 2a str. 301
aacguuuacagggauggcu

SEQ ID NO: 2013682 - RNA, 22 nt, Shigella flexneri 2a str. 301
aacguuucuuucaucaggucaa

SEQ ID NO: 2013683 - RNA, 12 nt, Shigella flexneri 2a str. 301
aacguuccagca

SEQ ID NO: 2013684 - RNA, 13 nt, Shigella flexneri 2a str. 301
aacguuccagcaa

SEQ ID NO: 2013685 - RNA, 17 nt, Shigella flexneri 2a str. 301
aacguugaauuucaggu

SEQ ID NO: 2013686 - RNA, 16 nt, Shigella flexneri 2a str. 301
aacguugggaucagua

SEQ ID NO: 2013687 - RNA, 21 nt, Shigella flexneri 2a str. 301
aacguguuuauauuugaacau

SEQ ID NO: 2013688 - RNA, 21 nt, Shigella flexneri 2a str. 301
aacguggccuccaaaaaacaa

SEQ ID NO: 2013689 - RNA, 20 nt, Shigella flexneri 2a str. 301
aacgugcggggguuuucucu

SEQ ID NO: 2013690 - RNA, 22 nt, Shigella flexneri 2a str. 301
aacgugcuacgguugacugaaa

SEQ ID NO: 2013691 - RNA, 23 nt, Shigella flexneri 2a str. 301
aacgugcucaccacgcagcagcc

SEQ ID NO: 2013692 - RNA, 14 nt, Shigella flexneri 2a str. 301
aacguuaucgccga

SEQ ID NO: 2013693 - RNA, 16 nt, Shigella flexneri 2a str. 301
aacgugcaaaaucaaa

SEQ ID NO: 2013694 - RNA, 12 nt, Shigella flexneri 2a str. 301
aacgugcagcuu

SEQ ID NO: 2013695 - RNA, 21 nt, Shigella flexneri 2a str. 301
aacgugcagguuuuguagguc

SEQ ID NO: 2013696 - RNA, 20 nt, Shigella flexneri 2a str. 301
aacgugagcgguuucgccuc

SEQ ID NO: 2013697 - RNA, 20 nt, Shigella flexneri 2a str. 301
aacgucgucgugaagcagag

SEQ ID NO: 2013698 - RNA, 12 nt, Shigella flexneri 2a str. 301
aacgucuucccg

SEQ ID NO: 2013699 - RNA, 15 nt, Shigella flexneri 2a str. 301
aacgucgcaucugac

SEQ ID NO: 2013700 - RNA, 16 nt, Shigella flexneri 2a str. 301
aacgucgguuucauca

SEQ ID NO: 2013701 - RNA, 18 nt, Shigella flexneri 2a str. 301
aacgucgguuucaucaca

SEQ ID NO: 2013702 - RNA, 17 nt, Shigella flexneri 2a str. 301
aacguccgguuaaaucg

SEQ ID NO: 2013703 - RNA, 15 nt, Shigella flexneri 2a str. 301
aacgucccccagauc

SEQ ID NO: 2013704 - RNA, 16 nt, Shigella flexneri 2a str. 301
aacguccaucacuucg

SEQ ID NO: 2013705 - RNA, 22 nt, Shigella flexneri 2a str. 301
aacgucaacgacggcuucucgg

SEQ ID NO: 2013706 - RNA, 15 nt, Shigella flexneri 2a str. 301
aacgucaccucagga

SEQ ID NO: 2013707 - RNA, 20 nt, Shigella flexneri 2a str. 301
aacgucacccaggagaugcc

SEQ ID NO: 2013708 - RNA, 12 nt, Shigella flexneri 2a str. 301
aacuacaaauua

SEQ ID NO: 2013709 - RNA, 24 nt, Shigella flexneri 2a str. 301
aacuacauagcguguugauuauaa

SEQ ID NO: 2013710 - RNA, 21 nt, Shigella flexneri 2a str. 301
aacuacggcaaaagaauauca

SEQ ID NO: 2013711 - RNA, 18 nt, Shigella flexneri 2a str. 301
aacuaagcgcacuuuguc

SEQ ID NO: 2013712 - RNA, 16 nt, Shigella flexneri 2a str. 301
aacuaacugacuuccg

SEQ ID NO: 2013713 - RNA, 12 nt, Shigella flexneri 2a str. 301
aacuaaacaacg

SEQ ID NO: 2013714 - RNA, 22 nt, Shigella flexneri 2a str. 301
aacuaaaaacagcaucaauaau

SEQ ID NO: 2013715 - RNA, 15 nt, Shigella flexneri 2a str. 301
aacucauaaauucaa

SEQ ID NO: 2013716 - RNA, 18 nt, Shigella flexneri 2a str. 301
aacucagcauuauuuuua

SEQ ID NO: 2013717 - RNA, 18 nt, Shigella flexneri 2a str. 301
aacucacgccccagauug

SEQ ID NO: 2013718 - RNA, 14 nt, Shigella flexneri 2a str. 301
aacucaccuuuaaa

SEQ ID NO: 2013719 - RNA, 16 nt, Shigella flexneri 2a str. 301
aacucaccuuuuuugu

SEQ ID NO: 2013720 - RNA, 18 nt, Shigella flexneri 2a str. 301
aacucaccggcauuuuuu

SEQ ID NO: 2013721 - RNA, 12 nt, Shigella flexneri 2a str. 301
aacucacgcagg

SEQ ID NO: 2013722 - RNA, 20 nt, Shigella flexneri 2a str. 301
aacucauuuuuuaauaugcu

SEQ ID NO: 2013723 - RNA, 18 nt, Shigella flexneri 2a str. 301
aacucauuuacagaaacu

SEQ ID NO: 2013724 - RNA, 19 nt, Shigella flexneri 2a str. 301
aacucaucaccaucaggca

SEQ ID NO: 2013725 - RNA, 11 nt, Shigella flexneri 2a str. 301
aacucaucacu

SEQ ID NO: 2013726 - RNA, 18 nt, Shigella flexneri 2a str. 301
aacucaucaccaucaggc

SEQ ID NO: 2013727 - RNA, 20 nt, Shigella flexneri 2a str. 301
aacucaaaaauaaucaucuc

SEQ ID NO: 2013728 - RNA, 22 nt, Shigella flexneri 2a str. 301
aacuauuguuuugaugaaucag

SEQ ID NO: 2013729 - RNA, 16 nt, Shigella flexneri 2a str. 301
aacucaaucaggcuau

SEQ ID NO: 2013730 - RNA, 12 nt, Shigella flexneri 2a str. 301
aacucacacagc

SEQ ID NO: 2013731 - RNA, 16 nt, Shigella flexneri 2a str. 301
aacucaauuaccaacu

SEQ ID NO: 2013732 - RNA, 17 nt, Shigella flexneri 2a str. 301
aacucaauuaccaacuc

SEQ ID NO: 2013733 - RNA, 18 nt, Shigella flexneri 2a str. 301
aacucacccaugaagaau

SEQ ID NO: 2013734 - RNA, 20 nt, Shigella flexneri 2a str. 301
aacucacccaugaagaauau

SEQ ID NO: 2013735 - RNA, 17 nt, Shigella flexneri 2a str. 301
aacucucaaaacaacac

SEQ ID NO: 2013736 - RNA, 20 nt, Shigella flexneri 2a str. 301
aacucucaaaacaacacaaa

SEQ ID NO: 2013737 - RNA, 19 nt, Shigella flexneri 2a str. 301
aacucucuuuugcuugaca

SEQ ID NO: 2013738 - RNA, 22 nt, Shigella flexneri 2a str. 301
aacucucaucuuugaaaucacg

SEQ ID NO: 2013739 - RNA, 22 nt, Shigella flexneri 2a str. 301
aacucugccgcaaucaucgacc

SEQ ID NO: 2013740 - RNA, 20 nt, Shigella flexneri 2a str. 301
aacucuuccugauacaugaa

SEQ ID NO: 2013741 - RNA, 14 nt, Shigella flexneri 2a str. 301
aacucuuccuuaac

SEQ ID NO: 2013742 - RNA, 16 nt, Shigella flexneri 2a str. 301
aacuccagcggcgcgu

SEQ ID NO: 2013743 - RNA, 17 nt, Shigella flexneri 2a str. 301
aacuccccgagaaauac

SEQ ID NO: 2013744 - RNA, 13 nt, Shigella flexneri 2a str. 301
aacuccagaauac

SEQ ID NO: 2013745 - RNA, 18 nt, Shigella flexneri 2a str. 301
aacuccagaauaccgcca

SEQ ID NO: 2013746 - RNA, 22 nt, Shigella flexneri 2a str. 301
aacuccacuucaccgcgaauau

SEQ ID NO: 2013747 - RNA, 15 nt, Shigella flexneri 2a str. 301
aacuccgugaagcuc

SEQ ID NO: 2013748 - RNA, 15 nt, Shigella flexneri 2a str. 301
aacuccggcgaaaau

SEQ ID NO: 2013749 - RNA, 22 nt, Shigella flexneri 2a str. 301
aacucccgcgcggguaauugcu

SEQ ID NO: 2013750 - RNA, 22 nt, Shigella flexneri 2a str. 301
aacuccgccagcaacugauaaa

SEQ ID NO: 2013751 - RNA, 14 nt, Shigella flexneri 2a str. 301
aacuccguugaaau

SEQ ID NO: 2013752 - RNA, 22 nt, Shigella flexneri 2a str. 301
aacucgcguaaauccagcggca

SEQ ID NO: 2013753 - RNA, 18 nt, Shigella flexneri 2a str. 301
aacucgcugaauaaacuc

SEQ ID NO: 2013754 - RNA, 17 nt, Shigella flexneri 2a str. 301
aacucgccagccaccau

SEQ ID NO: 2013755 - RNA, 20 nt, Shigella flexneri 2a str. 301
aacugauuuucaucuucuuc

SEQ ID NO: 2013756 - RNA, 19 nt, Shigella flexneri 2a str. 301
aacugauuuagcaucagcg

SEQ ID NO: 2013757 - RNA, 16 nt, Shigella flexneri 2a str. 301
aacugcccgaucaacg

SEQ ID NO: 2013758 - RNA, 15 nt, Shigella flexneri 2a str. 301
aacugccguugcugc

SEQ ID NO: 2013759 - RNA, 17 nt, Shigella flexneri 2a str. 301
aacugccaguucccccu

SEQ ID NO: 2013760 - RNA, 18 nt, Shigella flexneri 2a str. 301
aacugccaguucccccug

SEQ ID NO: 2013761 - RNA, 20 nt, Shigella flexneri 2a str. 301
aacugauggcaaaugcagca

SEQ ID NO: 2013762 - RNA, 20 nt, Shigella flexneri 2a str. 301
aacugaguggaguccagcgc

SEQ ID NO: 2013763 - RNA, 15 nt, Shigella flexneri 2a str. 301
aacugaacaaaaaag

SEQ ID NO: 2013764 - RNA, 14 nt, Shigella flexneri 2a str. 301
aacugaacaaaaaa

SEQ ID NO: 2013765 - RNA, 13 nt, Shigella flexneri 2a str. 301
aacugaacaaaaa

SEQ ID NO: 2013766 - RNA, 19 nt, Shigella flexneri 2a str. 301
aacucuuuuuccugcugca

SEQ ID NO: 2013767 - RNA, 21 nt, Shigella flexneri 2a str. 301
aacugaaaggcgcucauuuuc

SEQ ID NO: 2013768 - RNA, 23 nt, Shigella flexneri 2a str. 301
aacugaagauugaacagcagaac

SEQ ID NO: 2013769 - RNA, 15 nt, Shigella flexneri 2a str. 301
aacugaauaauacac

SEQ ID NO: 2013770 - RNA, 15 nt, Shigella flexneri 2a str. 301
aacugacuggcucuu

SEQ ID NO: 2013771 - RNA, 17 nt, Shigella flexneri 2a str. 301
aacugacugaaugccac

SEQ ID NO: 2013772 - RNA, 14 nt, Shigella flexneri 2a str. 301
aacugacuggcucu

SEQ ID NO: 2013773 - RNA, 22 nt, Shigella flexneri 2a str. 301
aacugacuuucguuugaaaacu

SEQ ID NO: 2013774 - RNA, 12 nt, Shigella flexneri 2a str. 301
aacugacaauuc

SEQ ID NO: 2013775 - RNA, 13 nt, Shigella flexneri 2a str. 301
aacuguuccaacu

SEQ ID NO: 2013776 - RNA, 16 nt, Shigella flexneri 2a str. 301
aacuuaacaguaacaa

SEQ ID NO: 2013777 - RNA, 15 nt, Shigella flexneri 2a str. 301
aacuguaccagcaac

SEQ ID NO: 2013778 - RNA, 22 nt, Shigella flexneri 2a str. 301
aacuguaguguugcaguaaauu

SEQ ID NO: 2013779 - RNA, 21 nt, Shigella flexneri 2a str. 301
aacuguaacgcagaagguuau

SEQ ID NO: 2013780 - RNA, 17 nt, Shigella flexneri 2a str. 301
aacugucuucaccauag

SEQ ID NO: 2013781 - RNA, 19 nt, Shigella flexneri 2a str. 301
aacugucgcugaagucucg

SEQ ID NO: 2013782 - RNA, 19 nt, Shigella flexneri 2a str. 301
aacuguggcgcgaagcccu

SEQ ID NO: 2013783 - RNA, 14 nt, Shigella flexneri 2a str. 301
aacuguguaaugcg

SEQ ID NO: 2013784 - RNA, 21 nt, Shigella flexneri 2a str. 301
aacuggcguguuucauuagcc

SEQ ID NO: 2013785 - RNA, 17 nt, Shigella flexneri 2a str. 301
aacuggcguguuucauu

SEQ ID NO: 2013786 - RNA, 20 nt, Shigella flexneri 2a str. 301
aacugguggauuauauggaa

SEQ ID NO: 2013787 - RNA, 16 nt, Shigella flexneri 2a str. 301
aacugguguaagucgg

SEQ ID NO: 2013788 - RNA, 20 nt, Shigella flexneri 2a str. 301
aacugguguugaaaccgcug

SEQ ID NO: 2013789 - RNA, 15 nt, Shigella flexneri 2a str. 301
aacuggucaucaaau

SEQ ID NO: 2013790 - RNA, 13 nt, Shigella flexneri 2a str. 301
aacuggcaggaaa

SEQ ID NO: 2013791 - RNA, 18 nt, Shigella flexneri 2a str. 301
aacuggauuacaaauaaa

SEQ ID NO: 2013792 - RNA, 15 nt, Shigella flexneri 2a str. 301
aacuggauggcucug

SEQ ID NO: 2013793 - RNA, 11 nt, Shigella flexneri 2a str. 301
aacuggcaaca

SEQ ID NO: 2013794 - RNA, 14 nt, Shigella flexneri 2a str. 301
aacuggaaaaauaa

SEQ ID NO: 2013795 - RNA, 16 nt, Shigella flexneri 2a str. 301
aacugcuuaucaucac

SEQ ID NO: 2013796 - RNA, 23 nt, Shigella flexneri 2a str. 301
aacugcuucaaaaaaauucugaa

SEQ ID NO: 2013797 - RNA, 13 nt, Shigella flexneri 2a str. 301
aacuucucuuucg

SEQ ID NO: 2013798 - RNA, 20 nt, Shigella flexneri 2a str. 301
aacuucucgcaagccgaaua

SEQ ID NO: 2013799 - RNA, 22 nt, Shigella flexneri 2a str. 301
aacuucuuuacuggcuuucauu

SEQ ID NO: 2013800 - RNA, 19 nt, Shigella flexneri 2a str. 301
aacuucucuucuuccgcuu

SEQ ID NO: 2013801 - RNA, 17 nt, Shigella flexneri 2a str. 301
aacuuccugcuggcugu

SEQ ID NO: 2013802 - RNA, 22 nt, Shigella flexneri 2a str. 301
aacuuccugcuggcuguaaaau

SEQ ID NO: 2013803 - RNA, 23 nt, Shigella flexneri 2a str. 301
aacuucagcccuuuaauggcuuu

SEQ ID NO: 2013804 - RNA, 15 nt, Shigella flexneri 2a str. 301
aacuucacucucuuu

SEQ ID NO: 2013805 - RNA, 12 nt, Shigella flexneri 2a str. 301
aacuuaagucuc

SEQ ID NO: 2013806 - RNA, 14 nt, Shigella flexneri 2a str. 301
aacuuaaugucaua

SEQ ID NO: 2013807 - RNA, 14 nt, Shigella flexneri 2a str. 301
aacuuacugaugca

SEQ ID NO: 2013808 - RNA, 15 nt, Shigella flexneri 2a str. 301
aacuuaucaucaggc

SEQ ID NO: 2013809 - RNA, 17 nt, Shigella flexneri 2a str. 301
aacuucacaucaccaua

SEQ ID NO: 2013810 - RNA, 22 nt, Shigella flexneri 2a str. 301
aacuucacaucaccauagccua

SEQ ID NO: 2013811 - RNA, 16 nt, Shigella flexneri 2a str. 301
aacuucaccgguucau

SEQ ID NO: 2013812 - RNA, 21 nt, Shigella flexneri 2a str. 301
aacuucaccgguucaucacga

SEQ ID NO: 2013813 - RNA, 14 nt, Shigella flexneri 2a str. 301
aacuuaucuguaau

SEQ ID NO: 2013814 - RNA, 18 nt, Shigella flexneri 2a str. 301
aacuuuguucugaaucac

SEQ ID NO: 2013815 - RNA, 17 nt, Shigella flexneri 2a str. 301
aacuuugccgugaacaa

SEQ ID NO: 2013816 - RNA, 20 nt, Shigella flexneri 2a str. 301
aacuuucugcgauagcagca

SEQ ID NO: 2013817 - RNA, 18 nt, Shigella flexneri 2a str. 301
aacuuuucaacaaauucu

SEQ ID NO: 2013818 - RNA, 17 nt, Shigella flexneri 2a str. 301
aacuuuucccuacugcu

SEQ ID NO: 2013819 - RNA, 22 nt, Shigella flexneri 2a str. 301
aacuuuugggcguaagaugaca

SEQ ID NO: 2013820 - RNA, 17 nt, Shigella flexneri 2a str. 301
aacuuuagucgcccauu

SEQ ID NO: 2013821 - RNA, 18 nt, Shigella flexneri 2a str. 301
aacuugauagaacaaaag

SEQ ID NO: 2013822 - RNA, 21 nt, Shigella flexneri 2a str. 301
aacuucuuuuucgacaaacac

SEQ ID NO: 2013823 - RNA, 16 nt, Shigella flexneri 2a str. 301
aacuuuaagcugaaaa

SEQ ID NO: 2013824 - RNA, 15 nt, Shigella flexneri 2a str. 301
aacuuuaagcugaaa

SEQ ID NO: 2013825 - RNA, 19 nt, Shigella flexneri 2a str. 301
aacuugugcucguguugca

SEQ ID NO: 2013826 - RNA, 13 nt, Shigella flexneri 2a str. 301
aagaacaucauuc

SEQ ID NO: 2013827 - RNA, 14 nt, Shigella flexneri 2a str. 301
aagaacaagcaaac

SEQ ID NO: 2013828 - RNA, 15 nt, Shigella flexneri 2a str. 301
aagaaccugaacgcc

SEQ ID NO: 2013829 - RNA, 18 nt, Shigella flexneri 2a str. 301
aagaaccaacgcugccag

SEQ ID NO: 2013830 - RNA, 22 nt, Shigella flexneri 2a str. 301
aagaacucgaggauaaauuuuc

SEQ ID NO: 2013831 - RNA, 19 nt, Shigella flexneri 2a str. 301
aagaagcuuuccacgcagg

SEQ ID NO: 2013832 - RNA, 22 nt, Shigella flexneri 2a str. 301
aagaagcuuuccacgcaggcau

SEQ ID NO: 2013833 - RNA, 16 nt, Shigella flexneri 2a str. 301
aagaagcuuuucucaa

SEQ ID NO: 2013834 - RNA, 22 nt, Shigella flexneri 2a str. 301
aagaagccuuuaucugguuguu

SEQ ID NO: 2013835 - RNA, 23 nt, Shigella flexneri 2a str. 301
aagaacugacuuccacuuccugc

SEQ ID NO: 2013836 - RNA, 15 nt, Shigella flexneri 2a str. 301
aagaacugcuugccc

SEQ ID NO: 2013837 - RNA, 22 nt, Shigella flexneri 2a str. 301
aagaacuguugaccauuugugc

SEQ ID NO: 2013838 - RNA, 11 nt, Shigella flexneri 2a str. 301
aagaagaccug

SEQ ID NO: 2013839 - RNA, 23 nt, Shigella flexneri 2a str. 301
aagaaaaucaauccaguguaaaa

SEQ ID NO: 2013840 - RNA, 13 nt, Shigella flexneri 2a str. 301
aagaaacaccaga

SEQ ID NO: 2013841 - RNA, 11 nt, Shigella flexneri 2a str. 301
aagaaacaucc

SEQ ID NO: 2013842 - RNA, 19 nt, Shigella flexneri 2a str. 301
aagaaaaaacuaacagugu

SEQ ID NO: 2013843 - RNA, 17 nt, Shigella flexneri 2a str. 301
aagaaacgccaucugaa

SEQ ID NO: 2013844 - RNA, 21 nt, Shigella flexneri 2a str. 301
aagaaagcaaugaaauucauu

SEQ ID NO: 2013845 - RNA, 22 nt, Shigella flexneri 2a str. 301
aagaaaguuugcagaaauuguc

SEQ ID NO: 2013846 - RNA, 22 nt, Shigella flexneri 2a str. 301
aagaaauaacgccggagagaaa

SEQ ID NO: 2013847 - RNA, 16 nt, Shigella flexneri 2a str. 301
aaauugcaggaacgau

SEQ ID NO: 2013848 - RNA, 16 nt, Shigella flexneri 2a str. 301
uuucaaaaacaaagaa

SEQ ID NO: 2013849 - RNA, 13 nt, Shigella flexneri 2a str. 301
aaauugccccaga

SEQ ID NO: 2013850 - RNA, 23 nt, Shigella flexneri 2a str. 301
aaauugcguaaagccugcuggca

SEQ ID NO: 2013851 - RNA, 22 nt, Shigella flexneri 2a str. 301
aaauuuacaguauaaguaauga

SEQ ID NO: 2013852 - RNA, 18 nt, Shigella flexneri 2a str. 301
aaauuuagcaaauuuuua

SEQ ID NO: 2013853 - RNA, 15 nt, Shigella flexneri 2a str. 301
aaauugugauaaaaa

SEQ ID NO: 2013854 - RNA, 18 nt, Shigella flexneri 2a str. 301
aaauuguggcguccagga

SEQ ID NO: 2013855 - RNA, 17 nt, Shigella flexneri 2a str. 301
aaauugugauaaaaauc

SEQ ID NO: 2013856 - RNA, 19 nt, Shigella flexneri 2a str. 301
aaauuucuuaccacugccg

SEQ ID NO: 2013857 - RNA, 21 nt, Shigella flexneri 2a str. 301
aaauuucuuaccacugccgca

SEQ ID NO: 2013858 - RNA, 12 nt, Shigella flexneri 2a str. 301
aaauuucuuccc

SEQ ID NO: 2013859 - RNA, 14 nt, Shigella flexneri 2a str. 301
aaauuuccgcgaaa

SEQ ID NO: 2013860 - RNA, 17 nt, Shigella flexneri 2a str. 301
aaauuucccacucuuga

SEQ ID NO: 2013861 - RNA, 21 nt, Shigella flexneri 2a str. 301
aaauuuaugcgcuaaauguuu

SEQ ID NO: 2013862 - RNA, 15 nt, Shigella flexneri 2a str. 301
aaauuucauuaauau

SEQ ID NO: 2013863 - RNA, 21 nt, Shigella flexneri 2a str. 301
aaauuuugugggcaggagaaa

SEQ ID NO: 2013864 - RNA, 17 nt, Shigella flexneri 2a str. 301
aaauuugcggauaaagc

SEQ ID NO: 2013865 - RNA, 16 nt, Shigella flexneri 2a str. 301
aaauuuggcuccucug

SEQ ID NO: 2013866 - RNA, 15 nt, Shigella flexneri 2a str. 301
aaauuucuucccuuu

SEQ ID NO: 2013867 - RNA, 16 nt, Shigella flexneri 2a str. 301
aaauuucuucccuuuc

SEQ ID NO: 2013868 - RNA, 20 nt, Shigella flexneri 2a str. 301
aacaacccggcgaaagagcu

SEQ ID NO: 2013869 - RNA, 19 nt, Shigella flexneri 2a str. 301
aacaacccuaaagcaccca

SEQ ID NO: 2013870 - RNA, 21 nt, Shigella flexneri 2a str. 301
aacaacccuaaagcacccagc

SEQ ID NO: 2013871 - RNA, 20 nt, Shigella flexneri 2a str. 301
aacaacgccucguaaugcuc

SEQ ID NO: 2013872 - RNA, 18 nt, Shigella flexneri 2a str. 301
aacaacgagccaauaaaa

SEQ ID NO: 2013873 - RNA, 19 nt, Shigella flexneri 2a str. 301
aacaacagcgauuauggau

SEQ ID NO: 2013874 - RNA, 22 nt, Shigella flexneri 2a str. 301
aacaacgggcaccgccgccgcu

SEQ ID NO: 2013875 - RNA, 15 nt, Shigella flexneri 2a str. 301
aacaacgugguuuuc

SEQ ID NO: 2013876 - RNA, 21 nt, Shigella flexneri 2a str. 301
aacaacgugugcuuuguucau

SEQ ID NO: 2013877 - RNA, 20 nt, Shigella flexneri 2a str. 301
aacaagccaguccagaaaug

SEQ ID NO: 2013878 - RNA, 21 nt, Shigella flexneri 2a str. 301
aacaagguuugaaaaaaccug

SEQ ID NO: 2013879 - RNA, 16 nt, Shigella flexneri 2a str. 301
aacaaggguaagggag

SEQ ID NO: 2013880 - RNA, 17 nt, Shigella flexneri 2a str. 301
aacaaggguaagggagg

SEQ ID NO: 2013881 - RNA, 23 nt, Shigella flexneri 2a str. 301
aacaaggguaugcuguaaacaac

SEQ ID NO: 2013882 - RNA, 18 nt, Shigella flexneri 2a str. 301
aacaauaaaaccaguaau

SEQ ID NO: 2013883 - RNA, 22 nt, Shigella flexneri 2a str. 301
aacaaaaccuguugaaauuauu

SEQ ID NO: 2013884 - RNA, 21 nt, Shigella flexneri 2a str. 301
aacaaaacucaacgguccaau

SEQ ID NO: 2013885 - RNA, 12 nt, Shigella flexneri 2a str. 301
aacaaaaucgug

SEQ ID NO: 2013886 - RNA, 14 nt, Shigella flexneri 2a str. 301
aacaaauaaaagca

SEQ ID NO: 2013887 - RNA, 17 nt, Shigella flexneri 2a str. 301
aacaaaguuugcaacuu

SEQ ID NO: 2013888 - RNA, 12 nt, Shigella flexneri 2a str. 301
aacaaagccacu

SEQ ID NO: 2013889 - RNA, 14 nt, Shigella flexneri 2a str. 301
aacaaagaaauguu

SEQ ID NO: 2013890 - RNA, 12 nt, Shigella flexneri 2a str. 301
aacaaauuuuuc

SEQ ID NO: 2013891 - RNA, 19 nt, Shigella flexneri 2a str. 301
aacaacagaucaacauacu

SEQ ID NO: 2013892 - RNA, 16 nt, Shigella flexneri 2a str. 301
aacaauugaagaauau

SEQ ID NO: 2013893 - RNA, 21 nt, Shigella flexneri 2a str. 301
aacaauugagauucaaauaag

SEQ ID NO: 2013894 - RNA, 22 nt, Shigella flexneri 2a str. 301
aacaauucccgcagcuccagcc

SEQ ID NO: 2013895 - RNA, 14 nt, Shigella flexneri 2a str. 301
aacaauguuguggc

SEQ ID NO: 2013896 - RNA, 20 nt, Shigella flexneri 2a str. 301
aacaauuaacguaucaauua

SEQ ID NO: 2013897 - RNA, 16 nt, Shigella flexneri 2a str. 301
aacaauuucuucuggu

SEQ ID NO: 2013898 - RNA, 15 nt, Shigella flexneri 2a str. 301
aacacaaaacugccu

SEQ ID NO: 2013899 - RNA, 18 nt, Shigella flexneri 2a str. 301
aacacaacgcuuucaaca

SEQ ID NO: 2013900 - RNA, 17 nt, Shigella flexneri 2a str. 301
aacacaauccccgcgcc

SEQ ID NO: 2013901 - RNA, 15 nt, Shigella flexneri 2a str. 301
aacaauacaaaugcc

SEQ ID NO: 2013902 - RNA, 22 nt, Shigella flexneri 2a str. 301
aacaauaauuaucauuacaauu

SEQ ID NO: 2013903 - RNA, 23 nt, Shigella flexneri 2a str. 301
aacaaugagauauuuaaaugauu

SEQ ID NO: 2013904 - RNA, 17 nt, Shigella flexneri 2a str. 301
aacaaugccgauaaaua

SEQ ID NO: 2013905 - RNA, 19 nt, Shigella flexneri 2a str. 301
aacaaugccgauaaauaca

SEQ ID NO: 2013906 - RNA, 12 nt, Shigella flexneri 2a str. 301
aacaaugggaaa

SEQ ID NO: 2013907 - RNA, 15 nt, Shigella flexneri 2a str. 301
aacaaugggaaaaca

SEQ ID NO: 2013908 - RNA, 20 nt, Shigella flexneri 2a str. 301
aacaaugggaaaacaggaua

SEQ ID NO: 2013909 - RNA, 18 nt, Shigella flexneri 2a str. 301
aacaaucucuuccagaau

SEQ ID NO: 2013910 - RNA, 22 nt, Shigella flexneri 2a str. 301
aacaaucugcaaaucgaucuca

SEQ ID NO: 2013911 - RNA, 15 nt, Shigella flexneri 2a str. 301
aacaaucucuuccag

SEQ ID NO: 2013912 - RNA, 19 nt, Shigella flexneri 2a str. 301
aacaaucacaauagaaaua

SEQ ID NO: 2013913 - RNA, 14 nt, Shigella flexneri 2a str. 301
aacaccgaaccaga

SEQ ID NO: 2013914 - RNA, 21 nt, Shigella flexneri 2a str. 301
aacaccgauuuuguaaaagaa

SEQ ID NO: 2013915 - RNA, 22 nt, Shigella flexneri 2a str. 301
aacaccgauuuuguaaaagaag

SEQ ID NO: 2013916 - RNA, 23 nt, Shigella flexneri 2a str. 301
aacaccgugcauuucucacuuuu

SEQ ID NO: 2013917 - RNA, 21 nt, Shigella flexneri 2a str. 301
aacacccgaccaucaacuaaa

SEQ ID NO: 2013918 - RNA, 22 nt, Shigella flexneri 2a str. 301
aacaccauaucuaugguuuuuu

SEQ ID NO: 2013919 - RNA, 19 nt, Shigella flexneri 2a str. 301
aacaccuucauccagcauc

SEQ ID NO: 2013920 - RNA, 18 nt, Shigella flexneri 2a str. 301
aacaccuucauccagcau

SEQ ID NO: 2013921 - RNA, 18 nt, Shigella flexneri 2a str. 301
aacaccuguuccaguggc

SEQ ID NO: 2013922 - RNA, 20 nt, Shigella flexneri 2a str. 301
aacacgacauacaccgcagc

SEQ ID NO: 2013923 - RNA, 18 nt, Shigella flexneri 2a str. 301
aacaccugggcaauggug

SEQ ID NO: 2013924 - RNA, 12 nt, Shigella flexneri 2a str. 301
aacaccuggcgc

SEQ ID NO: 2013925 - RNA, 20 nt, Shigella flexneri 2a str. 301
aacaccguugcccgcauuau

SEQ ID NO: 2013926 - RNA, 15 nt, Shigella flexneri 2a str. 301
aacaccguuuuacca

SEQ ID NO: 2013927 - RNA, 20 nt, Shigella flexneri 2a str. 301
aacacauaaccguacaaucg

SEQ ID NO: 2013928 - RNA, 13 nt, Shigella flexneri 2a str. 301
aacaccagcagua

SEQ ID NO: 2013929 - RNA, 13 nt, Shigella flexneri 2a str. 301
aacaccagccaga

SEQ ID NO: 2013930 - RNA, 13 nt, Shigella flexneri 2a str. 301
aacaccagcgaau

SEQ ID NO: 2013931 - RNA, 17 nt, Shigella flexneri 2a str. 301
aacaccaccugccagag

SEQ ID NO: 2013932 - RNA, 14 nt, Shigella flexneri 2a str. 301
aacaccaaacccug

SEQ ID NO: 2013933 - RNA, 19 nt, Shigella flexneri 2a str. 301
aacacauugugaaugauca

SEQ ID NO: 2013934 - RNA, 17 nt, Shigella flexneri 2a str. 301
aacacauucaauaacac

SEQ ID NO: 2013935 - RNA, 16 nt, Shigella flexneri 2a str. 301
aacagaauaacgucgc

SEQ ID NO: 2013936 - RNA, 14 nt, Shigella flexneri 2a str. 301
aacagaagaaagca

SEQ ID NO: 2013937 - RNA, 19 nt, Shigella flexneri 2a str. 301
aacagaccacauuccaggc

SEQ ID NO: 2013938 - RNA, 13 nt, Shigella flexneri 2a str. 301
aacagaccagcac

SEQ ID NO: 2013939 - RNA, 13 nt, Shigella flexneri 2a str. 301
aacagaccauaac

SEQ ID NO: 2013940 - RNA, 20 nt, Shigella flexneri 2a str. 301
aacacuuguuaugagauaau

SEQ ID NO: 2013941 - RNA, 16 nt, Shigella flexneri 2a str. 301
aacagaacaauaauaa

SEQ ID NO: 2013942 - RNA, 21 nt, Shigella flexneri 2a str. 301
aacagaugaugcgucucauca

SEQ ID NO: 2013943 - RNA, 17 nt, Shigella flexneri 2a str. 301
aacagagccgcgauaaa

SEQ ID NO: 2013944 - RNA, 17 nt, Shigella flexneri 2a str. 301
aacagacuggcaacgac

SEQ ID NO: 2013945 - RNA, 16 nt, Shigella flexneri 2a str. 301
aacagauaaaucauaa

SEQ ID NO: 2013946 - RNA, 23 nt, Shigella flexneri 2a str. 301
aacacucuuccagucgccugcuu

SEQ ID NO: 2013947 - RNA, 20 nt, Shigella flexneri 2a str. 301
aacacuguuaccgcugcugg

SEQ ID NO: 2013948 - RNA, 22 nt, Shigella flexneri 2a str. 301
aacacgaucucacgcugaaaga

SEQ ID NO: 2013949 - RNA, 17 nt, Shigella flexneri 2a str. 301
aacacgcucccagcaga

SEQ ID NO: 2013950 - RNA, 19 nt, Shigella flexneri 2a str. 301
aacacgcgaccaaaggcga

SEQ ID NO: 2013951 - RNA, 17 nt, Shigella flexneri 2a str. 301
aacagcaggcagaucca

SEQ ID NO: 2013952 - RNA, 11 nt, Shigella flexneri 2a str. 301
aacagcaguug

SEQ ID NO: 2013953 - RNA, 13 nt, Shigella flexneri 2a str. 301
aacagccagaagc

SEQ ID NO: 2013954 - RNA, 18 nt, Shigella flexneri 2a str. 301
aacagccggaugucugga

SEQ ID NO: 2013955 - RNA, 21 nt, Shigella flexneri 2a str. 301
aacagccauaaccccaccagc

SEQ ID NO: 2013956 - RNA, 17 nt, Shigella flexneri 2a str. 301
aacagccagcagcgaau

SEQ ID NO: 2013957 - RNA, 15 nt, Shigella flexneri 2a str. 301
aacagcaaucccaaa

SEQ ID NO: 2013958 - RNA, 11 nt, Shigella flexneri 2a str. 301
aacagcaccau

SEQ ID NO: 2013959 - RNA, 18 nt, Shigella flexneri 2a str. 301
aacagcaauuuugucauu

SEQ ID NO: 2013960 - RNA, 13 nt, Shigella flexneri 2a str. 301
aacagcacaucag

SEQ ID NO: 2013961 - RNA, 16 nt, Shigella flexneri 2a str. 301
aacagcacaucagcca

SEQ ID NO: 2013962 - RNA, 13 nt, Shigella flexneri 2a str. 301
aacagcaccaucc

SEQ ID NO: 2013963 - RNA, 14 nt, Shigella flexneri 2a str. 301
aacagcggcauuac

SEQ ID NO: 2013964 - RNA, 22 nt, Shigella flexneri 2a str. 301
aacagcgaguucaggcgcugca

SEQ ID NO: 2013965 - RNA, 19 nt, Shigella flexneri 2a str. 301
aacagcgcaccagaaacaa

SEQ ID NO: 2013966 - RNA, 14 nt, Shigella flexneri 2a str. 301
aacagcgacaccag

SEQ ID NO: 2013967 - RNA, 22 nt, Shigella flexneri 2a str. 301
aacagccugugccugagccgga

SEQ ID NO: 2013968 - RNA, 22 nt, Shigella flexneri 2a str. 301
aacagccuuaaacucaauauua

SEQ ID NO: 2013969 - RNA, 15 nt, Shigella flexneri 2a str. 301
aacagcuuuuuccug

SEQ ID NO: 2013970 - RNA, 22 nt, Shigella flexneri 2a str. 301
aacagcgguuuugcuauccagu

SEQ ID NO: 2013971 - RNA, 17 nt, Shigella flexneri 2a str. 301
aacaggcgaucuucccg

SEQ ID NO: 2013972 - RNA, 19 nt, Shigella flexneri 2a str. 301
aacaggauauguaagcaga

SEQ ID NO: 2013973 - RNA, 14 nt, Shigella flexneri 2a str. 301
aacaggcagcugcc

SEQ ID NO: 2013974 - RNA, 12 nt, Shigella flexneri 2a str. 301
aacaggaucugg

SEQ ID NO: 2013975 - RNA, 22 nt, Shigella flexneri 2a str. 301
aacagguugcgcuggauuucaa

SEQ ID NO: 2013976 - RNA, 14 nt, Shigella flexneri 2a str. 301
aacagguuuaaaca

SEQ ID NO: 2013977 - RNA, 16 nt, Shigella flexneri 2a str. 301
aacagguuuaaacaga

SEQ ID NO: 2013978 - RNA, 17 nt, Shigella flexneri 2a str. 301
aacagguuuaaacagag

SEQ ID NO: 2013979 - RNA, 20 nt, Shigella flexneri 2a str. 301
aacaguacauuguuuuccag

SEQ ID NO: 2013980 - RNA, 17 nt, Shigella flexneri 2a str. 301
aacaguacuggccucca

SEQ ID NO: 2013981 - RNA, 21 nt, Shigella flexneri 2a str. 301
aacagggaggggugcaugaaa

SEQ ID NO: 2013982 - RNA, 15 nt, Shigella flexneri 2a str. 301
aacaggggcuggaag

SEQ ID NO: 2013983 - RNA, 22 nt, Shigella flexneri 2a str. 301
aacagguaaagaccauaaauau

SEQ ID NO: 2013984 - RNA, 19 nt, Shigella flexneri 2a str. 301
aacagggugcagcgagugc

SEQ ID NO: 2013985 - RNA, 12 nt, Shigella flexneri 2a str. 301
aacaguuaccuu

SEQ ID NO: 2013986 - RNA, 22 nt, Shigella flexneri 2a str. 301
aacaguucaacgccgcuaucag

SEQ ID NO: 2013987 - RNA, 23 nt, Shigella flexneri 2a str. 301
aacagugccgcacauagcaccac

SEQ ID NO: 2013988 - RNA, 18 nt, Shigella flexneri 2a str. 301
aacagugauuucuucauu

SEQ ID NO: 2013989 - RNA, 19 nt, Shigella flexneri 2a str. 301
aacaguagccucgccgagc

SEQ ID NO: 2013990 - RNA, 13 nt, Shigella flexneri 2a str. 301
aacaguaucugaa

SEQ ID NO: 2013991 - RNA, 22 nt, Shigella flexneri 2a str. 301
aacagucgcucggcgacacguu

SEQ ID NO: 2013992 - RNA, 13 nt, Shigella flexneri 2a str. 301
aacauccagauca

SEQ ID NO: 2013993 - RNA, 13 nt, Shigella flexneri 2a str. 301
aacaucaucuccc

SEQ ID NO: 2013994 - RNA, 12 nt, Shigella flexneri 2a str. 301
aacaucagauaa

SEQ ID NO: 2013995 - RNA, 12 nt, Shigella flexneri 2a str. 301
aacaucauaaua

SEQ ID NO: 2013996 - RNA, 17 nt, Shigella flexneri 2a str. 301
aacaucaccaagucccu

SEQ ID NO: 2013997 - RNA, 19 nt, Shigella flexneri 2a str. 301
aacaucaaaaagcugucgu

SEQ ID NO: 2013998 - RNA, 15 nt, Shigella flexneri 2a str. 301
aacauaucagcgcaa

SEQ ID NO: 2013999 - RNA, 20 nt, Shigella flexneri 2a str. 301
aacauagcuuggcagagcaa

SEQ ID NO: 2014000 - RNA, 19 nt, Shigella flexneri 2a str. 301
aacauagucauccucucgg

SEQ ID NO: 2014001 - RNA, 20 nt, Shigella flexneri 2a str. 301
aacauaccuaaaagcacgcc

SEQ ID NO: 2014002 - RNA, 22 nt, Shigella flexneri 2a str. 301
aacauacugcccgagcgccauu

SEQ ID NO: 2014003 - RNA, 22 nt, Shigella flexneri 2a str. 301
aacauacugcuccauaauugcc

SEQ ID NO: 2014004 - RNA, 19 nt, Shigella flexneri 2a str. 301
aacauacaaauagccaauu

SEQ ID NO: 2014005 - RNA, 20 nt, Shigella flexneri 2a str. 301
aacauacaaauagccaauuc

SEQ ID NO: 2014006 - RNA, 12 nt, Shigella flexneri 2a str. 301
aacaguuuucaa

SEQ ID NO: 2014007 - RNA, 19 nt, Shigella flexneri 2a str. 301
aacauucccaucaguagca

SEQ ID NO: 2014008 - RNA, 14 nt, Shigella flexneri 2a str. 301
aacauuaugucugu

SEQ ID NO: 2014009 - RNA, 19 nt, Shigella flexneri 2a str. 301
aacauugcugcugaagcaa

SEQ ID NO: 2014010 - RNA, 22 nt, Shigella flexneri 2a str. 301
aacauuggcucaucaaacaacg

SEQ ID NO: 2014011 - RNA, 12 nt, Shigella flexneri 2a str. 301
aacauuggcuca

SEQ ID NO: 2014012 - RNA, 23 nt, Shigella flexneri 2a str. 301
aacauuguuauucuccuucacga

SEQ ID NO: 2014013 - RNA, 11 nt, Shigella flexneri 2a str. 301
aacauuuucau

SEQ ID NO: 2014014 - RNA, 13 nt, Shigella flexneri 2a str. 301
aaccaacaaugca

SEQ ID NO: 2014015 - RNA, 16 nt, Shigella flexneri 2a str. 301
aaccaacaauaaaauu

SEQ ID NO: 2014016 - RNA, 13 nt, Shigella flexneri 2a str. 301
aaccaacaccugu

SEQ ID NO: 2014017 - RNA, 21 nt, Shigella flexneri 2a str. 301
aaccaacaccuguuccagugg

SEQ ID NO: 2014018 - RNA, 17 nt, Shigella flexneri 2a str. 301
aaccaacgccagcagca

SEQ ID NO: 2014019 - RNA, 18 nt, Shigella flexneri 2a str. 301
aacaugcagcccagcauc

SEQ ID NO: 2014020 - RNA, 22 nt, Shigella flexneri 2a str. 301
aacauggcacugcgaucccggc

SEQ ID NO: 2014021 - RNA, 23 nt, Shigella flexneri 2a str. 301
aacauggugggcggguggaguau

SEQ ID NO: 2014022 - RNA, 17 nt, Shigella flexneri 2a str. 301
aacauggaaaccaucau

SEQ ID NO: 2014023 - RNA, 15 nt, Shigella flexneri 2a str. 301
aacauggcaaccuuc

SEQ ID NO: 2014024 - RNA, 14 nt, Shigella flexneri 2a str. 301
aacauuacuuuccg

SEQ ID NO: 2014025 - RNA, 18 nt, Shigella flexneri 2a str. 301
aacaucccuguaaaacgc

SEQ ID NO: 2014026 - RNA, 23 nt, Shigella flexneri 2a str. 301
aacaucguaucuggcaagcagga

SEQ ID NO: 2014027 - RNA, 22 nt, Shigella flexneri 2a str. 301
aacaucgccgccguugcgggaa

SEQ ID NO: 2014028 - RNA, 21 nt, Shigella flexneri 2a str. 301
aacaucgccugccgcaggacg

SEQ ID NO: 2014029 - RNA, 18 nt, Shigella flexneri 2a str. 301
aacaugaaacagaaaauu

SEQ ID NO: 2014030 - RNA, 16 nt, Shigella flexneri 2a str. 301
aacaugaaacagaaaa

SEQ ID NO: 2014031 - RNA, 19 nt, Shigella flexneri 2a str. 301
aacaugagaacaguucagc

SEQ ID NO: 2014032 - RNA, 22 nt, Shigella flexneri 2a str. 301
aacaugacgcgcaucacgacaa

SEQ ID NO: 2014033 - RNA, 16 nt, Shigella flexneri 2a str. 301
aacaucuccacaguca

SEQ ID NO: 2014034 - RNA, 18 nt, Shigella flexneri 2a str. 301
aacaucuuugaugccagc

SEQ ID NO: 2014035 - RNA, 17 nt, Shigella flexneri 2a str. 301
aacccggcaccaacaaa

SEQ ID NO: 2014036 - RNA, 17 nt, Shigella flexneri 2a str. 301
aacccgcagcuuaauga

SEQ ID NO: 2014037 - RNA, 16 nt, Shigella flexneri 2a str. 301
aacccgcucaaacacc

SEQ ID NO: 2014038 - RNA, 23 nt, Shigella flexneri 2a str. 301
aacccguacugccgaacagaaug

SEQ ID NO: 2014039 - RNA, 16 nt, Shigella flexneri 2a str. 301
aacccgaccacuucca

SEQ ID NO: 2014040 - RNA, 13 nt, Shigella flexneri 2a str. 301
aaccccgggcugg

SEQ ID NO: 2014041 - RNA, 21 nt, Shigella flexneri 2a str. 301
aacccuucaagaauuaaaaua

SEQ ID NO: 2014042 - RNA, 19 nt, Shigella flexneri 2a str. 301
aacccugagcgguuaacac

SEQ ID NO: 2014043 - RNA, 21 nt, Shigella flexneri 2a str. 301
aacccuugcguuucugacucu

SEQ ID NO: 2014044 - RNA, 17 nt, Shigella flexneri 2a str. 301
aacccuaacccaacauu

SEQ ID NO: 2014045 - RNA, 16 nt, Shigella flexneri 2a str. 301
aacccucuccccaagg

SEQ ID NO: 2014046 - RNA, 13 nt, Shigella flexneri 2a str. 301
aaccgacugccau

SEQ ID NO: 2014047 - RNA, 18 nt, Shigella flexneri 2a str. 301
aaccgaguuaguccacac

SEQ ID NO: 2014048 - RNA, 19 nt, Shigella flexneri 2a str. 301
aacccuuuuuuaaacauua

SEQ ID NO: 2014049 - RNA, 19 nt, Shigella flexneri 2a str. 301
aaccgaauucaaauccuuc

SEQ ID NO: 2014050 - RNA, 16 nt, Shigella flexneri 2a str. 301
aaccgaacccagcagg

SEQ ID NO: 2014051 - RNA, 13 nt, Shigella flexneri 2a str. 301
aaccgccuggcgc

SEQ ID NO: 2014052 - RNA, 17 nt, Shigella flexneri 2a str. 301
aaccgcgaugaccaaaa

SEQ ID NO: 2014053 - RNA, 19 nt, Shigella flexneri 2a str. 301
aaccgcgcagcgggcauuu

SEQ ID NO: 2014054 - RNA, 17 nt, Shigella flexneri 2a str. 301
aaccgccucaggcaaca

SEQ ID NO: 2014055 - RNA, 21 nt, Shigella flexneri 2a str. 301
aaccgccugcgaguguuaccu

SEQ ID NO: 2014056 - RNA, 22 nt, Shigella flexneri 2a str. 301
aaccgcuguugucugaaugaua

SEQ ID NO: 2014057 - RNA, 15 nt, Shigella flexneri 2a str. 301
aaccgcugcaaaaaa

SEQ ID NO: 2014058 - RNA, 20 nt, Shigella flexneri 2a str. 301
aaccgcaucaacagugccaa

SEQ ID NO: 2014059 - RNA, 21 nt, Shigella flexneri 2a str. 301
aaccgcaucaacagugccaau

SEQ ID NO: 2014060 - RNA, 15 nt, Shigella flexneri 2a str. 301
aaccgccaauuucug

SEQ ID NO: 2014061 - RNA, 15 nt, Shigella flexneri 2a str. 301
aaccgcagugauuuc

SEQ ID NO: 2014062 - RNA, 18 nt, Shigella flexneri 2a str. 301
aaccgcaguguaguucug

SEQ ID NO: 2014063 - RNA, 22 nt, Shigella flexneri 2a str. 301
aaccgccaguaaucuggccaau

SEQ ID NO: 2014064 - RNA, 21 nt, Shigella flexneri 2a str. 301
aaccgcaaaugauuagugcca

SEQ ID NO: 2014065 - RNA, 15 nt, Shigella flexneri 2a str. 301
aaccgcacuccauug

SEQ ID NO: 2014066 - RNA, 16 nt, Shigella flexneri 2a str. 301
aaccggcacuucaacu

SEQ ID NO: 2014067 - RNA, 12 nt, Shigella flexneri 2a str. 301
aaccggcucacc

SEQ ID NO: 2014068 - RNA, 15 nt, Shigella flexneri 2a str. 301
aaccgggaagaucca

SEQ ID NO: 2014069 - RNA, 18 nt, Shigella flexneri 2a str. 301
aaccggauuuucaccauc

SEQ ID NO: 2014070 - RNA, 13 nt, Shigella flexneri 2a str. 301
aaccggcaagcaa

SEQ ID NO: 2014071 - RNA, 19 nt, Shigella flexneri 2a str. 301
aaccggaaauccaggucag

SEQ ID NO: 2014072 - RNA, 14 nt, Shigella flexneri 2a str. 301
aaccgcuuuuucaa

SEQ ID NO: 2014073 - RNA, 14 nt, Shigella flexneri 2a str. 301
aaccggauacccug

SEQ ID NO: 2014074 - RNA, 19 nt, Shigella flexneri 2a str. 301
aaccggaucaggguuaaaa

SEQ ID NO: 2014075 - RNA, 15 nt, Shigella flexneri 2a str. 301
aaccggaaccagcgc

SEQ ID NO: 2014076 - RNA, 19 nt, Shigella flexneri 2a str. 301
aaccggaccagcaacaaau

SEQ ID NO: 2014077 - RNA, 17 nt, Shigella flexneri 2a str. 301
aaccgggcgaauuuacc

SEQ ID NO: 2014078 - RNA, 15 nt, Shigella flexneri 2a str. 301
aaccgguaaagaaga

SEQ ID NO: 2014079 - RNA, 14 nt, Shigella flexneri 2a str. 301
aaccgguaccggac

SEQ ID NO: 2014080 - RNA, 14 nt, Shigella flexneri 2a str. 301
aaccgguaaagaag

SEQ ID NO: 2014081 - RNA, 13 nt, Shigella flexneri 2a str. 301
aaccguaccaaaa

SEQ ID NO: 2014082 - RNA, 16 nt, Shigella flexneri 2a str. 301
aaccguacgcaucacc

SEQ ID NO: 2014083 - RNA, 23 nt, Shigella flexneri 2a str. 301
aaccguaguccauacccagcauc

SEQ ID NO: 2014084 - RNA, 15 nt, Shigella flexneri 2a str. 301
aaccggucguuacca

SEQ ID NO: 2014085 - RNA, 22 nt, Shigella flexneri 2a str. 301
aaccaggaagauguacgccagu

SEQ ID NO: 2014086 - RNA, 19 nt, Shigella flexneri 2a str. 301
aaccagggaaaaaagcccc

SEQ ID NO: 2014087 - RNA, 23 nt, Shigella flexneri 2a str. 301
aaccaggcgagaucggcaggcag

SEQ ID NO: 2014088 - RNA, 22 nt, Shigella flexneri 2a str. 301
aaccagcgcggcgauaaugccc

SEQ ID NO: 2014089 - RNA, 14 nt, Shigella flexneri 2a str. 301
aaccagcgucagcc

SEQ ID NO: 2014090 - RNA, 18 nt, Shigella flexneri 2a str. 301
aaccagcgucagccagaa

SEQ ID NO: 2014091 - RNA, 21 nt, Shigella flexneri 2a str. 301
aaccagcguuuccagcaccag

SEQ ID NO: 2014092 - RNA, 23 nt, Shigella flexneri 2a str. 301
aaccagcguuuccagcaccaguu

SEQ ID NO: 2014093 - RNA, 18 nt, Shigella flexneri 2a str. 301
aaccagcgcagacaccag

SEQ ID NO: 2014094 - RNA, 18 nt, Shigella flexneri 2a str. 301
aaccagccaaauaaaauc

SEQ ID NO: 2014095 - RNA, 13 nt, Shigella flexneri 2a str. 301
aaccagagacaga

SEQ ID NO: 2014096 - RNA, 15 nt, Shigella flexneri 2a str. 301
aaccagagaauauua

SEQ ID NO: 2014097 - RNA, 23 nt, Shigella flexneri 2a str. 301
aaccagagcgccgcaaaagguca

SEQ ID NO: 2014098 - RNA, 13 nt, Shigella flexneri 2a str. 301
aaccacagcgccg

SEQ ID NO: 2014099 - RNA, 14 nt, Shigella flexneri 2a str. 301
aaccaccaaacugc

SEQ ID NO: 2014100 - RNA, 14 nt, Shigella flexneri 2a str. 301
aaccacccaccagc

SEQ ID NO: 2014101 - RNA, 14 nt, Shigella flexneri 2a str. 301
aaccaccaguaaau

SEQ ID NO: 2014102 - RNA, 20 nt, Shigella flexneri 2a str. 301
aaccaccccaccuuaccugu

SEQ ID NO: 2014103 - RNA, 15 nt, Shigella flexneri 2a str. 301
aaccaccggcaccac

SEQ ID NO: 2014104 - RNA, 14 nt, Shigella flexneri 2a str. 301
aaccacccagcagc

SEQ ID NO: 2014105 - RNA, 16 nt, Shigella flexneri 2a str. 301
aaccacuuaauuauua

SEQ ID NO: 2014106 - RNA, 20 nt, Shigella flexneri 2a str. 301
aaccagaaagggaagaacau

SEQ ID NO: 2014107 - RNA, 23 nt, Shigella flexneri 2a str. 301
aaccacggcagcaacuuaaucau

SEQ ID NO: 2014108 - RNA, 23 nt, Shigella flexneri 2a str. 301
aaccacggaguugaccagcucca

SEQ ID NO: 2014109 - RNA, 17 nt, Shigella flexneri 2a str. 301
aaccacggaaaggcagu

SEQ ID NO: 2014110 - RNA, 19 nt, Shigella flexneri 2a str. 301
aaccagugaauacugcgcg

SEQ ID NO: 2014111 - RNA, 19 nt, Shigella flexneri 2a str. 301
aaccagucgccgcuuucaa

SEQ ID NO: 2014112 - RNA, 20 nt, Shigella flexneri 2a str. 301
aaccagucggaaacaugaaa

SEQ ID NO: 2014113 - RNA, 20 nt, Shigella flexneri 2a str. 301
aaccaguugugcaccaccaa

SEQ ID NO: 2014114 - RNA, 20 nt, Shigella flexneri 2a str. 301
aaccauacauaaaaaagccg

SEQ ID NO: 2014115 - RNA, 19 nt, Shigella flexneri 2a str. 301
aaccaucaccaucgcccca

SEQ ID NO: 2014116 - RNA, 18 nt, Shigella flexneri 2a str. 301
aaccauauaugauaauua

SEQ ID NO: 2014117 - RNA, 17 nt, Shigella flexneri 2a str. 301
aaccaucgguacgcuuu

SEQ ID NO: 2014118 - RNA, 16 nt, Shigella flexneri 2a str. 301
aaccaucgcauacugc

SEQ ID NO: 2014119 - RNA, 14 nt, Shigella flexneri 2a str. 301
aaccauuauccguc

SEQ ID NO: 2014120 - RNA, 21 nt, Shigella flexneri 2a str. 301
aaccauuuguucguguuaaca

SEQ ID NO: 2014121 - RNA, 22 nt, Shigella flexneri 2a str. 301
aacccagcggaugacccagcgc

SEQ ID NO: 2014122 - RNA, 21 nt, Shigella flexneri 2a str. 301
aacccagcgauggacgcagac

SEQ ID NO: 2014123 - RNA, 23 nt, Shigella flexneri 2a str. 301
aacccagaagaaagccggaugau

SEQ ID NO: 2014124 - RNA, 15 nt, Shigella flexneri 2a str. 301
aacccauccagcaga

SEQ ID NO: 2014125 - RNA, 21 nt, Shigella flexneri 2a str. 301
aacccauccagcagagauaca

SEQ ID NO: 2014126 - RNA, 17 nt, Shigella flexneri 2a str. 301
aacccaacggcaaacau

SEQ ID NO: 2014127 - RNA, 14 nt, Shigella flexneri 2a str. 301
aacccacacauuuc

SEQ ID NO: 2014128 - RNA, 13 nt, Shigella flexneri 2a str. 301
aacccaccaugcc

SEQ ID NO: 2014129 - RNA, 17 nt, Shigella flexneri 2a str. 301
accgcuccgccaucuuc

SEQ ID NO: 2014130 - RNA, 11 nt, Shigella flexneri 2a str. 301
accgcugucac

SEQ ID NO: 2014131 - RNA, 22 nt, Shigella flexneri 2a str. 301
accgcugacggcagcgaagggu

SEQ ID NO: 2014132 - RNA, 22 nt, Shigella flexneri 2a str. 301
accgcugagcgauaaaaucaga

SEQ ID NO: 2014133 - RNA, 14 nt, Shigella flexneri 2a str. 301
accgccuggcgcug

SEQ ID NO: 2014134 - RNA, 16 nt, Shigella flexneri 2a str. 301
accgccuggcgcugcu

SEQ ID NO: 2014135 - RNA, 13 nt, Shigella flexneri 2a str. 301
accgccuugcugu

SEQ ID NO: 2014136 - RNA, 14 nt, Shigella flexneri 2a str. 301
accgccugcgggga

SEQ ID NO: 2014137 - RNA, 16 nt, Shigella flexneri 2a str. 301
accgccugcaaauaaa

SEQ ID NO: 2014138 - RNA, 17 nt, Shigella flexneri 2a str. 301
accgcgaaauaaucaaa

SEQ ID NO: 2014139 - RNA, 13 nt, Shigella flexneri 2a str. 301
accgcgaagaaca

SEQ ID NO: 2014140 - RNA, 19 nt, Shigella flexneri 2a str. 301
accgccauuaaacgcagua

SEQ ID NO: 2014141 - RNA, 19 nt, Shigella flexneri 2a str. 301
accgccauucauacccuga

SEQ ID NO: 2014142 - RNA, 20 nt, Shigella flexneri 2a str. 301
accgcccagugccagcacca

SEQ ID NO: 2014143 - RNA, 16 nt, Shigella flexneri 2a str. 301
accgccguugccuuua

SEQ ID NO: 2014144 - RNA, 16 nt, Shigella flexneri 2a str. 301
accgccuaccauaauc

SEQ ID NO: 2014145 - RNA, 17 nt, Shigella flexneri 2a str. 301
accgccuaccauaauca

SEQ ID NO: 2014146 - RNA, 17 nt, Shigella flexneri 2a str. 301
accccgccgggcuuacc

SEQ ID NO: 2014147 - RNA, 13 nt, Shigella flexneri 2a str. 301
accccugauuuug

SEQ ID NO: 2014148 - RNA, 12 nt, Shigella flexneri 2a str. 301
accccugcggcc

SEQ ID NO: 2014149 - RNA, 20 nt, Shigella flexneri 2a str. 301
accgauccugaaguggcguu

SEQ ID NO: 2014150 - RNA, 16 nt, Shigella flexneri 2a str. 301
accgaucgccagcagg

SEQ ID NO: 2014151 - RNA, 19 nt, Shigella flexneri 2a str. 301
accgauccggcaccaaugu

SEQ ID NO: 2014152 - RNA, 15 nt, Shigella flexneri 2a str. 301
accccuuccugaaua

SEQ ID NO: 2014153 - RNA, 23 nt, Shigella flexneri 2a str. 301
accgaugaucgccaucagugcca

SEQ ID NO: 2014154 - RNA, 17 nt, Shigella flexneri 2a str. 301
accgaucgccagcaggg

SEQ ID NO: 2014155 - RNA, 13 nt, Shigella flexneri 2a str. 301
accgccaccaccg

SEQ ID NO: 2014156 - RNA, 16 nt, Shigella flexneri 2a str. 301
accgccacagcagccu

SEQ ID NO: 2014157 - RNA, 15 nt, Shigella flexneri 2a str. 301
accgcauuuugacua

SEQ ID NO: 2014158 - RNA, 19 nt, Shigella flexneri 2a str. 301
accgcauuggacagauuca

SEQ ID NO: 2014159 - RNA, 15 nt, Shigella flexneri 2a str. 301
accgcauugagggca

SEQ ID NO: 2014160 - RNA, 17 nt, Shigella flexneri 2a str. 301
accgcauugagggcauu

SEQ ID NO: 2014161 - RNA, 15 nt, Shigella flexneri 2a str. 301
accgcacgcagaauc

SEQ ID NO: 2014162 - RNA, 15 nt, Shigella flexneri 2a str. 301
accgcacgcaggcca

SEQ ID NO: 2014163 - RNA, 13 nt, Shigella flexneri 2a str. 301
accgcaccaccag

SEQ ID NO: 2014164 - RNA, 14 nt, Shigella flexneri 2a str. 301
accgcaucggcauc

SEQ ID NO: 2014165 - RNA, 12 nt, Shigella flexneri 2a str. 301
accgcuucccuu

SEQ ID NO: 2014166 - RNA, 20 nt, Shigella flexneri 2a str. 301
accggauuuccgaaaaaagc

SEQ ID NO: 2014167 - RNA, 13 nt, Shigella flexneri 2a str. 301
accggauuuucac

SEQ ID NO: 2014168 - RNA, 14 nt, Shigella flexneri 2a str. 301
accggauuuucacc

SEQ ID NO: 2014169 - RNA, 18 nt, Shigella flexneri 2a str. 301
accggauuuucaccaucg

SEQ ID NO: 2014170 - RNA, 16 nt, Shigella flexneri 2a str. 301
accggcaaccagcacc

SEQ ID NO: 2014171 - RNA, 15 nt, Shigella flexneri 2a str. 301
accggcaaccagcac

SEQ ID NO: 2014172 - RNA, 14 nt, Shigella flexneri 2a str. 301
accggcaaucugcu

SEQ ID NO: 2014173 - RNA, 13 nt, Shigella flexneri 2a str. 301
accggcacccaau

SEQ ID NO: 2014174 - RNA, 19 nt, Shigella flexneri 2a str. 301
accggcauauccaccaccc

SEQ ID NO: 2014175 - RNA, 14 nt, Shigella flexneri 2a str. 301
accggcaggugacu

SEQ ID NO: 2014176 - RNA, 20 nt, Shigella flexneri 2a str. 301
accggccguaagaaagucau

SEQ ID NO: 2014177 - RNA, 21 nt, Shigella flexneri 2a str. 301
accggguuuucaaugauaaag

SEQ ID NO: 2014178 - RNA, 15 nt, Shigella flexneri 2a str. 301
accgguaaagaagag

SEQ ID NO: 2014179 - RNA, 14 nt, Shigella flexneri 2a str. 301
accgggcuguucac

SEQ ID NO: 2014180 - RNA, 16 nt, Shigella flexneri 2a str. 301
accggggacaggcggc

SEQ ID NO: 2014181 - RNA, 17 nt, Shigella flexneri 2a str. 301
accgggcguccugcuug

SEQ ID NO: 2014182 - RNA, 22 nt, Shigella flexneri 2a str. 301
accgguucggggcuguuuucca

SEQ ID NO: 2014183 - RNA, 21 nt, Shigella flexneri 2a str. 301
accgguaugaauuugcagcca

SEQ ID NO: 2014184 - RNA, 23 nt, Shigella flexneri 2a str. 301
accgguucggggcuguuuuccag

SEQ ID NO: 2014185 - RNA, 15 nt, Shigella flexneri 2a str. 301
accguaaaagccugg

SEQ ID NO: 2014186 - RNA, 13 nt, Shigella flexneri 2a str. 301
accguaaacagau

SEQ ID NO: 2014187 - RNA, 18 nt, Shigella flexneri 2a str. 301
accguaaacccuaacauc

SEQ ID NO: 2014188 - RNA, 17 nt, Shigella flexneri 2a str. 301
accguacaaccaaaucu

SEQ ID NO: 2014189 - RNA, 14 nt, Shigella flexneri 2a str. 301
accguaccaaaaug

SEQ ID NO: 2014190 - RNA, 13 nt, Shigella flexneri 2a str. 301
accguaccggcac

SEQ ID NO: 2014191 - RNA, 23 nt, Shigella flexneri 2a str. 301
accguaaguaagauaaaagcaau

SEQ ID NO: 2014192 - RNA, 20 nt, Shigella flexneri 2a str. 301
accgucuucccgcagccacg

SEQ ID NO: 2014193 - RNA, 14 nt, Shigella flexneri 2a str. 301
accgucgccuucau

SEQ ID NO: 2014194 - RNA, 23 nt, Shigella flexneri 2a str. 301
accgucuggcagauccugaaauu

SEQ ID NO: 2014195 - RNA, 16 nt, Shigella flexneri 2a str. 301
accguggcguaaauca

SEQ ID NO: 2014196 - RNA, 18 nt, Shigella flexneri 2a str. 301
accguggcguaaaucauc

SEQ ID NO: 2014197 - RNA, 18 nt, Shigella flexneri 2a str. 301
accguguaaaaugacucg

SEQ ID NO: 2014198 - RNA, 16 nt, Shigella flexneri 2a str. 301
accgugguugcgccug

SEQ ID NO: 2014199 - RNA, 20 nt, Shigella flexneri 2a str. 301
accgugguugcgccugggcc

SEQ ID NO: 2014200 - RNA, 21 nt, Shigella flexneri 2a str. 301
accgugcgggcgaaagcagaa

SEQ ID NO: 2014201 - RNA, 17 nt, Shigella flexneri 2a str. 301
accgugcauuucucacu

SEQ ID NO: 2014202 - RNA, 22 nt, Shigella flexneri 2a str. 301
accguaguccauacccagcauc

SEQ ID NO: 2014203 - RNA, 15 nt, Shigella flexneri 2a str. 301
accguagacuuuagc

SEQ ID NO: 2014204 - RNA, 23 nt, Shigella flexneri 2a str. 301
accguaguccauacccagcauca

SEQ ID NO: 2014205 - RNA, 20 nt, Shigella flexneri 2a str. 301
accguaucccccagagcaaa

SEQ ID NO: 2014206 - RNA, 16 nt, Shigella flexneri 2a str. 301
accguaucuaccacug

SEQ ID NO: 2014207 - RNA, 15 nt, Shigella flexneri 2a str. 301
accgucaaacacagc

SEQ ID NO: 2014208 - RNA, 18 nt, Shigella flexneri 2a str. 301
accgucaaacacagcacu

SEQ ID NO: 2014209 - RNA, 22 nt, Shigella flexneri 2a str. 301
accguccucuucccagacccag

SEQ ID NO: 2014210 - RNA, 18 nt, Shigella flexneri 2a str. 301
accgucaucuuccaccug

SEQ ID NO: 2014211 - RNA, 20 nt, Shigella flexneri 2a str. 301
accgucaccccauugaagaa

SEQ ID NO: 2014212 - RNA, 13 nt, Shigella flexneri 2a str. 301
accgucagccuga

SEQ ID NO: 2014213 - RNA, 14 nt, Shigella flexneri 2a str. 301
accgucacuucuuc

SEQ ID NO: 2014214 - RNA, 20 nt, Shigella flexneri 2a str. 301
accuagcacuguaaaccucu

SEQ ID NO: 2014215 - RNA, 21 nt, Shigella flexneri 2a str. 301
accuacgcuuucgaugugaac

SEQ ID NO: 2014216 - RNA, 22 nt, Shigella flexneri 2a str. 301
accuacuuuuuaauucaggaaa

SEQ ID NO: 2014217 - RNA, 20 nt, Shigella flexneri 2a str. 301
accuacuuuuuaauucagga

SEQ ID NO: 2014218 - RNA, 12 nt, Shigella flexneri 2a str. 301
accuaauuuuuu

SEQ ID NO: 2014219 - RNA, 18 nt, Shigella flexneri 2a str. 301
accuacaaacguugcuga

SEQ ID NO: 2014220 - RNA, 22 nt, Shigella flexneri 2a str. 301
accguucgccaggucagagagc

SEQ ID NO: 2014221 - RNA, 22 nt, Shigella flexneri 2a str. 301
accguuucuuugccgaggaaga

SEQ ID NO: 2014222 - RNA, 23 nt, Shigella flexneri 2a str. 301
accguuggcgcguguuccagaga

SEQ ID NO: 2014223 - RNA, 21 nt, Shigella flexneri 2a str. 301
accguugccaaccugaacaau

SEQ ID NO: 2014224 - RNA, 16 nt, Shigella flexneri 2a str. 301
accguugcuggaaaac

SEQ ID NO: 2014225 - RNA, 15 nt, Shigella flexneri 2a str. 301
accguuuuuucugcc

SEQ ID NO: 2014226 - RNA, 18 nt, Shigella flexneri 2a str. 301
accuaaaguaaaggcaca

SEQ ID NO: 2014227 - RNA, 22 nt, Shigella flexneri 2a str. 301
accuaugcgugggccgcgucgg

SEQ ID NO: 2014228 - RNA, 22 nt, Shigella flexneri 2a str. 301
accuaugccgaucaauuucaca

SEQ ID NO: 2014229 - RNA, 13 nt, Shigella flexneri 2a str. 301
accucaaaggccg

SEQ ID NO: 2014230 - RNA, 22 nt, Shigella flexneri 2a str. 301
accucaucaccacagacaaaca

SEQ ID NO: 2014231 - RNA, 19 nt, Shigella flexneri 2a str. 301
accucaggaaaagcaaaau

SEQ ID NO: 2014232 - RNA, 23 nt, Shigella flexneri 2a str. 301
accucaguacccgcguucuggau

SEQ ID NO: 2014233 - RNA, 16 nt, Shigella flexneri 2a str. 301
accucaggaaaagcaa

SEQ ID NO: 2014234 - RNA, 17 nt, Shigella flexneri 2a str. 301
accucaggaaaagcaaa

SEQ ID NO: 2014235 - RNA, 20 nt, Shigella flexneri 2a str. 301
accuccagccugaugaugag

SEQ ID NO: 2014236 - RNA, 19 nt, Shigella flexneri 2a str. 301
accuccagcgaaggaucac

SEQ ID NO: 2014237 - RNA, 17 nt, Shigella flexneri 2a str. 301
accuccagcuccgccag

SEQ ID NO: 2014238 - RNA, 16 nt, Shigella flexneri 2a str. 301
accuccgccucuuuca

SEQ ID NO: 2014239 - RNA, 18 nt, Shigella flexneri 2a str. 301
accuccauguccagcuug

SEQ ID NO: 2014240 - RNA, 23 nt, Shigella flexneri 2a str. 301
accucccgucgcccacaccagau

SEQ ID NO: 2014241 - RNA, 14 nt, Shigella flexneri 2a str. 301
accuccuucacagu

SEQ ID NO: 2014242 - RNA, 19 nt, Shigella flexneri 2a str. 301
accucgcccauuuuucaug

SEQ ID NO: 2014243 - RNA, 23 nt, Shigella flexneri 2a str. 301
accugagcuugauccuacacaua

SEQ ID NO: 2014244 - RNA, 16 nt, Shigella flexneri 2a str. 301
accugauccagcucuu

SEQ ID NO: 2014245 - RNA, 13 nt, Shigella flexneri 2a str. 301
accugauuuugcc

SEQ ID NO: 2014246 - RNA, 20 nt, Shigella flexneri 2a str. 301
accugauugaccgccagcgc

SEQ ID NO: 2014247 - RNA, 22 nt, Shigella flexneri 2a str. 301
accucuuucgcacgaaccguaa

SEQ ID NO: 2014248 - RNA, 13 nt, Shigella flexneri 2a str. 301
accucuuucuaga

SEQ ID NO: 2014249 - RNA, 12 nt, Shigella flexneri 2a str. 301
accugaauauua

SEQ ID NO: 2014250 - RNA, 11 nt, Shigella flexneri 2a str. 301
accugaacucg

SEQ ID NO: 2014251 - RNA, 21 nt, Shigella flexneri 2a str. 301
accucuggcgaauagaaagca

SEQ ID NO: 2014252 - RNA, 23 nt, Shigella flexneri 2a str. 301
accucuggcgaauagaaagcaag

SEQ ID NO: 2014253 - RNA, 20 nt, Shigella flexneri 2a str. 301
accucuuaaugcaggcagca

SEQ ID NO: 2014254 - RNA, 23 nt, Shigella flexneri 2a str. 301
accucuucggcagucacuuuuuu

SEQ ID NO: 2014255 - RNA, 19 nt, Shigella flexneri 2a str. 301
accucuuguaaauuuccca

SEQ ID NO: 2014256 - RNA, 23 nt, Shigella flexneri 2a str. 301
accuucaacacuggcaaaaucaa

SEQ ID NO: 2014257 - RNA, 15 nt, Shigella flexneri 2a str. 301
accuuaucgacaugc

SEQ ID NO: 2014258 - RNA, 21 nt, Shigella flexneri 2a str. 301
accuuaucaaucucagcaaga

SEQ ID NO: 2014259 - RNA, 14 nt, Shigella flexneri 2a str. 301
accuuauaacgcuu

SEQ ID NO: 2014260 - RNA, 21 nt, Shigella flexneri 2a str. 301
accuuacggcacuccucuuca

SEQ ID NO: 2014261 - RNA, 17 nt, Shigella flexneri 2a str. 301
accuuacggcacuccuc

SEQ ID NO: 2014262 - RNA, 20 nt, Shigella flexneri 2a str. 301
accuuacggcacuccucuuc

SEQ ID NO: 2014263 - RNA, 20 nt, Shigella flexneri 2a str. 301
accuuaccuguguuuugcau

SEQ ID NO: 2014264 - RNA, 16 nt, Shigella flexneri 2a str. 301
accuuacacucaaaua

SEQ ID NO: 2014265 - RNA, 21 nt, Shigella flexneri 2a str. 301
accuuaaucagaauuuuucgc

SEQ ID NO: 2014266 - RNA, 14 nt, Shigella flexneri 2a str. 301
accuuaaauggccc

SEQ ID NO: 2014267 - RNA, 12 nt, Shigella flexneri 2a str. 301
accuguuuucac

SEQ ID NO: 2014268 - RNA, 12 nt, Shigella flexneri 2a str. 301
accuuaaaacaa

SEQ ID NO: 2014269 - RNA, 15 nt, Shigella flexneri 2a str. 301
accuuaaaacaauau

SEQ ID NO: 2014270 - RNA, 16 nt, Shigella flexneri 2a str. 301
accugguccuucaucu

SEQ ID NO: 2014271 - RNA, 22 nt, Shigella flexneri 2a str. 301
accugggucugcagauauucau

SEQ ID NO: 2014272 - RNA, 20 nt, Shigella flexneri 2a str. 301
accugguguucggcauucug

SEQ ID NO: 2014273 - RNA, 14 nt, Shigella flexneri 2a str. 301
accuguaccagccc

SEQ ID NO: 2014274 - RNA, 22 nt, Shigella flexneri 2a str. 301
accuguaguguguugcaauaca

SEQ ID NO: 2014275 - RNA, 21 nt, Shigella flexneri 2a str. 301
accugugaauuucuaagcugc

SEQ ID NO: 2014276 - RNA, 16 nt, Shigella flexneri 2a str. 301
accuguggugcaggcg

SEQ ID NO: 2014277 - RNA, 22 nt, Shigella flexneri 2a str. 301
accuguccuguaggccugauaa

SEQ ID NO: 2014278 - RNA, 12 nt, Shigella flexneri 2a str. 301
accuguccagac

SEQ ID NO: 2014279 - RNA, 17 nt, Shigella flexneri 2a str. 301
accuguugaaauuauug

SEQ ID NO: 2014280 - RNA, 11 nt, Shigella flexneri 2a str. 301
accugcucagc

SEQ ID NO: 2014281 - RNA, 21 nt, Shigella flexneri 2a str. 301
accugcugauuauccgcauca

SEQ ID NO: 2014282 - RNA, 23 nt, Shigella flexneri 2a str. 301
accugcugauuaucggcaucgcu

SEQ ID NO: 2014283 - RNA, 18 nt, Shigella flexneri 2a str. 301
accuggaaccaggcgcga

SEQ ID NO: 2014284 - RNA, 18 nt, Shigella flexneri 2a str. 301
accuggaaauuuugcuga

SEQ ID NO: 2014285 - RNA, 22 nt, Shigella flexneri 2a str. 301
accugcuuaaggcagaaacaaa

SEQ ID NO: 2014286 - RNA, 16 nt, Shigella flexneri 2a str. 301
accuggcgcagcugcg

SEQ ID NO: 2014287 - RNA, 16 nt, Shigella flexneri 2a str. 301
accuggcgcuguucgg

SEQ ID NO: 2014288 - RNA, 22 nt, Shigella flexneri 2a str. 301
accugggcaauggugaacugcc

SEQ ID NO: 2014289 - RNA, 21 nt, Shigella flexneri 2a str. 301
accugggaaauccaacagacc

SEQ ID NO: 2014290 - RNA, 22 nt, Shigella flexneri 2a str. 301
accugcacguuagcccuuugua

SEQ ID NO: 2014291 - RNA, 19 nt, Shigella flexneri 2a str. 301
accugcccgguauccauca

SEQ ID NO: 2014292 - RNA, 13 nt, Shigella flexneri 2a str. 301
accugccagggag

SEQ ID NO: 2014293 - RNA, 13 nt, Shigella flexneri 2a str. 301
accugcguucagc

SEQ ID NO: 2014294 - RNA, 16 nt, Shigella flexneri 2a str. 301
accugcggugcagccg

SEQ ID NO: 2014295 - RNA, 17 nt, Shigella flexneri 2a str. 301
accugcgcaggcauuca

SEQ ID NO: 2014296 - RNA, 16 nt, Shigella flexneri 2a str. 301
accugccgccaccaug

SEQ ID NO: 2014297 - RNA, 16 nt, Shigella flexneri 2a str. 301
accuucuucagcaaua

SEQ ID NO: 2014298 - RNA, 11 nt, Shigella flexneri 2a str. 301
accuucuuccu

SEQ ID NO: 2014299 - RNA, 19 nt, Shigella flexneri 2a str. 301
accuucgaaugccgcagca

SEQ ID NO: 2014300 - RNA, 14 nt, Shigella flexneri 2a str. 301
accuuccuuauuuc

SEQ ID NO: 2014301 - RNA, 16 nt, Shigella flexneri 2a str. 301
accuucgcgguaauga

SEQ ID NO: 2014302 - RNA, 17 nt, Shigella flexneri 2a str. 301
accuucggauugcccug

SEQ ID NO: 2014303 - RNA, 23 nt, Shigella flexneri 2a str. 301
accuucccgucuacaaaaacugc

SEQ ID NO: 2014304 - RNA, 14 nt, Shigella flexneri 2a str. 301
accuucccuauuuc

SEQ ID NO: 2014305 - RNA, 14 nt, Shigella flexneri 2a str. 301
accuucauuugcca

SEQ ID NO: 2014306 - RNA, 14 nt, Shigella flexneri 2a str. 301
accuucuucuuuca

SEQ ID NO: 2014307 - RNA, 18 nt, Shigella flexneri 2a str. 301
accuucuuccugcgccag

SEQ ID NO: 2014308 - RNA, 23 nt, Shigella flexneri 2a str. 301
accuugcaauaauuuacagccug

SEQ ID NO: 2014309 - RNA, 17 nt, Shigella flexneri 2a str. 301
accuugcacucgcagaa

SEQ ID NO: 2014310 - RNA, 19 nt, Shigella flexneri 2a str. 301
accuugcacucgcagaagc

SEQ ID NO: 2014311 - RNA, 20 nt, Shigella flexneri 2a str. 301
accuugcuuauccucuguaa

SEQ ID NO: 2014312 - RNA, 15 nt, Shigella flexneri 2a str. 301
accuugcuuauccuc

SEQ ID NO: 2014313 - RNA, 19 nt, Shigella flexneri 2a str. 301
accuugcggaaacugucaa

SEQ ID NO: 2014314 - RNA, 21 nt, Shigella flexneri 2a str. 301
accuuugaacaaccagaaaga

SEQ ID NO: 2014315 - RNA, 18 nt, Shigella flexneri 2a str. 301
accuuugcgguuaaaaau

SEQ ID NO: 2014316 - RNA, 16 nt, Shigella flexneri 2a str. 301
accuuuuuccagauug

SEQ ID NO: 2014317 - RNA, 13 nt, Shigella flexneri 2a str. 301
accuuuaaacaga

SEQ ID NO: 2014318 - RNA, 16 nt, Shigella flexneri 2a str. 301
accuuguuucugagca

SEQ ID NO: 2014319 - RNA, 16 nt, Shigella flexneri 2a str. 301
acgaaaccgacugcca

SEQ ID NO: 2014320 - RNA, 13 nt, Shigella flexneri 2a str. 301
acgaaaacugcgc

SEQ ID NO: 2014321 - RNA, 18 nt, Shigella flexneri 2a str. 301
acgaaaaaaauuacucau

SEQ ID NO: 2014322 - RNA, 16 nt, Shigella flexneri 2a str. 301
acgaaauugaggaugc

SEQ ID NO: 2014323 - RNA, 19 nt, Shigella flexneri 2a str. 301
acgaaaguuaauccacagc

SEQ ID NO: 2014324 - RNA, 14 nt, Shigella flexneri 2a str. 301
acgacgacaggcaa

SEQ ID NO: 2014325 - RNA, 14 nt, Shigella flexneri 2a str. 301
acgaccaccuucaa

SEQ ID NO: 2014326 - RNA, 23 nt, Shigella flexneri 2a str. 301
acgaccacucuuucgacggcauc

SEQ ID NO: 2014327 - RNA, 18 nt, Shigella flexneri 2a str. 301
acgaccaaugacagccag

SEQ ID NO: 2014328 - RNA, 13 nt, Shigella flexneri 2a str. 301
acgaccaccaccg

SEQ ID NO: 2014329 - RNA, 14 nt, Shigella flexneri 2a str. 301
acgacaugugccag

SEQ ID NO: 2014330 - RNA, 16 nt, Shigella flexneri 2a str. 301
acgacgguuuccaccg

SEQ ID NO: 2014331 - RNA, 14 nt, Shigella flexneri 2a str. 301
acgacggcugccau

SEQ ID NO: 2014332 - RNA, 18 nt, Shigella flexneri 2a str. 301
acgacgcugaugucagca

SEQ ID NO: 2014333 - RNA, 20 nt, Shigella flexneri 2a str. 301
acgacucaaaucacgcaguu

SEQ ID NO: 2014334 - RNA, 13 nt, Shigella flexneri 2a str. 301
acgagauaaaauu

SEQ ID NO: 2014335 - RNA, 13 nt, Shigella flexneri 2a str. 301
acgagcaaaacgc

SEQ ID NO: 2014336 - RNA, 22 nt, Shigella flexneri 2a str. 301
acgagagccggaagaauuucau

SEQ ID NO: 2014337 - RNA, 19 nt, Shigella flexneri 2a str. 301
acgagacgguuaaaaacag

SEQ ID NO: 2014338 - RNA, 17 nt, Shigella flexneri 2a str. 301
acgacugcgagcaaaau

SEQ ID NO: 2014339 - RNA, 18 nt, Shigella flexneri 2a str. 301
acgacugccgcucaccug

SEQ ID NO: 2014340 - RNA, 17 nt, Shigella flexneri 2a str. 301
acgacugccgcucaccu

SEQ ID NO: 2014341 - RNA, 12 nt, Shigella flexneri 2a str. 301
acgaaccagaga

SEQ ID NO: 2014342 - RNA, 16 nt, Shigella flexneri 2a str. 301
acgaacccgaacgcgc

SEQ ID NO: 2014343 - RNA, 17 nt, Shigella flexneri 2a str. 301
acgaacagcgauugcuu

SEQ ID NO: 2014344 - RNA, 14 nt, Shigella flexneri 2a str. 301
acgaaccgagcggu

SEQ ID NO: 2014345 - RNA, 14 nt, Shigella flexneri 2a str. 301
acgaagccgugcca

SEQ ID NO: 2014346 - RNA, 14 nt, Shigella flexneri 2a str. 301
acgaauugcaggac

SEQ ID NO: 2014347 - RNA, 17 nt, Shigella flexneri 2a str. 301
acgacacugcucgcaga

SEQ ID NO: 2014348 - RNA, 12 nt, Shigella flexneri 2a str. 301
acgacaccaucu

SEQ ID NO: 2014349 - RNA, 22 nt, Shigella flexneri 2a str. 301
acgacaaucucaauuuucacuu

SEQ ID NO: 2014350 - RNA, 12 nt, Shigella flexneri 2a str. 301
acgacaggcaag

SEQ ID NO: 2014351 - RNA, 16 nt, Shigella flexneri 2a str. 301
acgaauuccaagcaga

SEQ ID NO: 2014352 - RNA, 17 nt, Shigella flexneri 2a str. 301
acgaaugacugauugcc

SEQ ID NO: 2014353 - RNA, 21 nt, Shigella flexneri 2a str. 301
acgaaucuauucauuuauguu

SEQ ID NO: 2014354 - RNA, 20 nt, Shigella flexneri 2a str. 301
acgaauaaaacagaaaccga

SEQ ID NO: 2014355 - RNA, 14 nt, Shigella flexneri 2a str. 301
acgaauaguuucag

SEQ ID NO: 2014356 - RNA, 17 nt, Shigella flexneri 2a str. 301
acgaauaccuucuuccu

SEQ ID NO: 2014357 - RNA, 23 nt, Shigella flexneri 2a str. 301
acgauucgcccgcagccaucacu

SEQ ID NO: 2014358 - RNA, 16 nt, Shigella flexneri 2a str. 301
acgauuaauuacacag

SEQ ID NO: 2014359 - RNA, 19 nt, Shigella flexneri 2a str. 301
acgauuaacgcuucuccca

SEQ ID NO: 2014360 - RNA, 15 nt, Shigella flexneri 2a str. 301
acgauguuugcugcg

SEQ ID NO: 2014361 - RNA, 22 nt, Shigella flexneri 2a str. 301
acgauuugcggcguauccggcu

SEQ ID NO: 2014362 - RNA, 12 nt, Shigella flexneri 2a str. 301
acgcaaccacaa

SEQ ID NO: 2014363 - RNA, 13 nt, Shigella flexneri 2a str. 301
acgcaaccacaaa

SEQ ID NO: 2014364 - RNA, 22 nt, Shigella flexneri 2a str. 301
acgcaaccacaacgcacuggcg

SEQ ID NO: 2014365 - RNA, 18 nt, Shigella flexneri 2a str. 301
acgcaaccgcaaaugauu

SEQ ID NO: 2014366 - RNA, 18 nt, Shigella flexneri 2a str. 301
acgcaaauguaaaaccaa

SEQ ID NO: 2014367 - RNA, 19 nt, Shigella flexneri 2a str. 301
acgcaacaucgcaauccuu

SEQ ID NO: 2014368 - RNA, 18 nt, Shigella flexneri 2a str. 301
acgcaaacaccagcgaau

SEQ ID NO: 2014369 - RNA, 14 nt, Shigella flexneri 2a str. 301
acgcaaaauugccu

SEQ ID NO: 2014370 - RNA, 13 nt, Shigella flexneri 2a str. 301
acgcaaacaccag

SEQ ID NO: 2014371 - RNA, 19 nt, Shigella flexneri 2a str. 301
acgcaaagagagaagccag

SEQ ID NO: 2014372 - RNA, 16 nt, Shigella flexneri 2a str. 301
acgcaaaacugccuga

SEQ ID NO: 2014373 - RNA, 22 nt, Shigella flexneri 2a str. 301
acgcaaaaccucuuccagcaga

SEQ ID NO: 2014374 - RNA, 16 nt, Shigella flexneri 2a str. 301
acgaucgcuuucaacg

SEQ ID NO: 2014375 - RNA, 18 nt, Shigella flexneri 2a str. 301
acgaucucgccagugacc

SEQ ID NO: 2014376 - RNA, 21 nt, Shigella flexneri 2a str. 301
acgaugaccgcaucaaugacc

SEQ ID NO: 2014377 - RNA, 19 nt, Shigella flexneri 2a str. 301
acgaucuucggcgucagaa

SEQ ID NO: 2014378 - RNA, 14 nt, Shigella flexneri 2a str. 301
acgaugcagcguuu

SEQ ID NO: 2014379 - RNA, 15 nt, Shigella flexneri 2a str. 301
acgaugucaaucagg

SEQ ID NO: 2014380 - RNA, 15 nt, Shigella flexneri 2a str. 301
acgauguucugagcg

SEQ ID NO: 2014381 - RNA, 19 nt, Shigella flexneri 2a str. 301
acgauggaaccguacagca

SEQ ID NO: 2014382 - RNA, 17 nt, Shigella flexneri 2a str. 301
acgauggcaauuuucac

SEQ ID NO: 2014383 - RNA, 19 nt, Shigella flexneri 2a str. 301
acgaugccugaugcgacgc

SEQ ID NO: 2014384 - RNA, 18 nt, Shigella flexneri 2a str. 301
acgagucacaaacaucau

SEQ ID NO: 2014385 - RNA, 18 nt, Shigella flexneri 2a str. 301
acgaguggcggacgggug

SEQ ID NO: 2014386 - RNA, 18 nt, Shigella flexneri 2a str. 301
acgaggggagaccucacu

SEQ ID NO: 2014387 - RNA, 13 nt, Shigella flexneri 2a str. 301
acgaggagacugc

SEQ ID NO: 2014388 - RNA, 18 nt, Shigella flexneri 2a str. 301
acgagcccuucggggcua

SEQ ID NO: 2014389 - RNA, 12 nt, Shigella flexneri 2a str. 301
acgagaucguca

SEQ ID NO: 2014390 - RNA, 18 nt, Shigella flexneri 2a str. 301
acgaucgccugguaccag

SEQ ID NO: 2014391 - RNA, 14 nt, Shigella flexneri 2a str. 301
acgauccaccaccg

SEQ ID NO: 2014392 - RNA, 22 nt, Shigella flexneri 2a str. 301
acgaucaagauugauccccgcu

SEQ ID NO: 2014393 - RNA, 14 nt, Shigella flexneri 2a str. 301
acgauauuuuuccg

SEQ ID NO: 2014394 - RNA, 13 nt, Shigella flexneri 2a str. 301
acgauaagcaccg

SEQ ID NO: 2014395 - RNA, 17 nt, Shigella flexneri 2a str. 301
acgauaaucucugcuuu

SEQ ID NO: 2014396 - RNA, 15 nt, Shigella flexneri 2a str. 301
acgauacagaagcac

SEQ ID NO: 2014397 - RNA, 13 nt, Shigella flexneri 2a str. 301
acgauaauucagc

SEQ ID NO: 2014398 - RNA, 22 nt, Shigella flexneri 2a str. 301
acgauauguucaggauauuuau

SEQ ID NO: 2014399 - RNA, 22 nt, Shigella flexneri 2a str. 301
accaacaguaucugaaucaaaa

SEQ ID NO: 2014400 - RNA, 15 nt, Shigella flexneri 2a str. 301
accaaagaaugacac

SEQ ID NO: 2014401 - RNA, 21 nt, Shigella flexneri 2a str. 301
accaaagaaugacacuuucag

SEQ ID NO: 2014402 - RNA, 18 nt, Shigella flexneri 2a str. 301
accaaagccccgcuuuug

SEQ ID NO: 2014403 - RNA, 19 nt, Shigella flexneri 2a str. 301
accaaauaaacgaaucugc

SEQ ID NO: 2014404 - RNA, 21 nt, Shigella flexneri 2a str. 301
accaaaggcgaguucaaucaa

SEQ ID NO: 2014405 - RNA, 14 nt, Shigella flexneri 2a str. 301
accaaacugauuua

SEQ ID NO: 2014406 - RNA, 16 nt, Shigella flexneri 2a str. 301
accaaaacaccagccc

SEQ ID NO: 2014407 - RNA, 15 nt, Shigella flexneri 2a str. 301
accaaaaacgccaug

SEQ ID NO: 2014408 - RNA, 20 nt, Shigella flexneri 2a str. 301
acauuucagaaaguauauaa

SEQ ID NO: 2014409 - RNA, 21 nt, Shigella flexneri 2a str. 301
acauuucagaaaguauauaaa

SEQ ID NO: 2014410 - RNA, 19 nt, Shigella flexneri 2a str. 301
acauuucagaaaguauaua

SEQ ID NO: 2014411 - RNA, 21 nt, Shigella flexneri 2a str. 301
acauuuaccgcaacucauuua

SEQ ID NO: 2014412 - RNA, 19 nt, Shigella flexneri 2a str. 301
acauuuaacccuucaagaa

SEQ ID NO: 2014413 - RNA, 22 nt, Shigella flexneri 2a str. 301
acauuuaaacaauuucagaaua

SEQ ID NO: 2014414 - RNA, 13 nt, Shigella flexneri 2a str. 301
acauggcccagcc

SEQ ID NO: 2014415 - RNA, 22 nt, Shigella flexneri 2a str. 301
acauggugggcggguggaguau

SEQ ID NO: 2014416 - RNA, 15 nt, Shigella flexneri 2a str. 301
acauguacauggugc

SEQ ID NO: 2014417 - RNA, 15 nt, Shigella flexneri 2a str. 301
accaaucaccgccag

SEQ ID NO: 2014418 - RNA, 19 nt, Shigella flexneri 2a str. 301
accaaucaccgccagcaag

SEQ ID NO: 2014419 - RNA, 20 nt, Shigella flexneri 2a str. 301
accaaucaccgccagcaagg

SEQ ID NO: 2014420 - RNA, 12 nt, Shigella flexneri 2a str. 301
accaaucaccac

SEQ ID NO: 2014421 - RNA, 14 nt, Shigella flexneri 2a str. 301
accaauauccugaa

SEQ ID NO: 2014422 - RNA, 20 nt, Shigella flexneri 2a str. 301
accaauaucaaauaaaaagg

SEQ ID NO: 2014423 - RNA, 14 nt, Shigella flexneri 2a str. 301
accaauccagccgg

SEQ ID NO: 2014424 - RNA, 21 nt, Shigella flexneri 2a str. 301
accaaucaccgccagcaaggc

SEQ ID NO: 2014425 - RNA, 22 nt, Shigella flexneri 2a str. 301
accacauguuguacaugcugcu

SEQ ID NO: 2014426 - RNA, 23 nt, Shigella flexneri 2a str. 301
accacauguuguacaugcugcuu

SEQ ID NO: 2014427 - RNA, 14 nt, Shigella flexneri 2a str. 301
accaccaaaaccac

SEQ ID NO: 2014428 - RNA, 16 nt, Shigella flexneri 2a str. 301
accaacgcugccagcc

SEQ ID NO: 2014429 - RNA, 15 nt, Shigella flexneri 2a str. 301
accaacggcgagcca

SEQ ID NO: 2014430 - RNA, 18 nt, Shigella flexneri 2a str. 301
accaacugauccugacaa

SEQ ID NO: 2014431 - RNA, 14 nt, Shigella flexneri 2a str. 301
accaacuccagcgg

SEQ ID NO: 2014432 - RNA, 13 nt, Shigella flexneri 2a str. 301
accaacgcacaca

SEQ ID NO: 2014433 - RNA, 17 nt, Shigella flexneri 2a str. 301
accagcaucaacaacaa

SEQ ID NO: 2014434 - RNA, 23 nt, Shigella flexneri 2a str. 301
accagcaucaacaacaauuucac

SEQ ID NO: 2014435 - RNA, 11 nt, Shigella flexneri 2a str. 301
accagcaucgc

SEQ ID NO: 2014436 - RNA, 13 nt, Shigella flexneri 2a str. 301
accagcaucaaca

SEQ ID NO: 2014437 - RNA, 20 nt, Shigella flexneri 2a str. 301
accagcgaaaucaccgccac

SEQ ID NO: 2014438 - RNA, 23 nt, Shigella flexneri 2a str. 301
accagccguugucagucaucacu

SEQ ID NO: 2014439 - RNA, 17 nt, Shigella flexneri 2a str. 301
accagccagaauuaccc

SEQ ID NO: 2014440 - RNA, 16 nt, Shigella flexneri 2a str. 301
accagauuauaagcca

SEQ ID NO: 2014441 - RNA, 22 nt, Shigella flexneri 2a str. 301
accagauuauaagccaguaaga

SEQ ID NO: 2014442 - RNA, 21 nt, Shigella flexneri 2a str. 301
accagaucuggcgauuauuuu

SEQ ID NO: 2014443 - RNA, 21 nt, Shigella flexneri 2a str. 301
accagaucguaauggucguuc

SEQ ID NO: 2014444 - RNA, 18 nt, Shigella flexneri 2a str. 301
accagauaaucaccugcc

SEQ ID NO: 2014445 - RNA, 21 nt, Shigella flexneri 2a str. 301
accagauaagccugcgcgccc

SEQ ID NO: 2014446 - RNA, 17 nt, Shigella flexneri 2a str. 301
accagaguaacgggcac

SEQ ID NO: 2014447 - RNA, 22 nt, Shigella flexneri 2a str. 301
accagaguaacgggcacguaaa

SEQ ID NO: 2014448 - RNA, 23 nt, Shigella flexneri 2a str. 301
accagagauguugaagaagucga

SEQ ID NO: 2014449 - RNA, 19 nt, Shigella flexneri 2a str. 301
accagaaagggaagaacau

SEQ ID NO: 2014450 - RNA, 13 nt, Shigella flexneri 2a str. 301
accacuuuugcuc

SEQ ID NO: 2014451 - RNA, 14 nt, Shigella flexneri 2a str. 301
accacuuuugcucc

SEQ ID NO: 2014452 - RNA, 23 nt, Shigella flexneri 2a str. 301
accagaagcguaaaucccagcac

SEQ ID NO: 2014453 - RNA, 20 nt, Shigella flexneri 2a str. 301
accacugcgcauaauccacu

SEQ ID NO: 2014454 - RNA, 15 nt, Shigella flexneri 2a str. 301
accacugcgccagcg

SEQ ID NO: 2014455 - RNA, 14 nt, Shigella flexneri 2a str. 301
accacugcgcauaa

SEQ ID NO: 2014456 - RNA, 14 nt, Shigella flexneri 2a str. 301
accacugcaaugac

SEQ ID NO: 2014457 - RNA, 15 nt, Shigella flexneri 2a str. 301
accacugauggaauu

SEQ ID NO: 2014458 - RNA, 18 nt, Shigella flexneri 2a str. 301
accagacugugaaucaug

SEQ ID NO: 2014459 - RNA, 22 nt, Shigella flexneri 2a str. 301
accagacugugaaucauggaug

SEQ ID NO: 2014460 - RNA, 17 nt, Shigella flexneri 2a str. 301
accagacgcaacagaaa

SEQ ID NO: 2014461 - RNA, 14 nt, Shigella flexneri 2a str. 301
accagacgcgggca

SEQ ID NO: 2014462 - RNA, 18 nt, Shigella flexneri 2a str. 301
accagaaucgccagcauc

SEQ ID NO: 2014463 - RNA, 14 nt, Shigella flexneri 2a str. 301
accagaaucgccag

SEQ ID NO: 2014464 - RNA, 24 nt, Shigella flexneri 2a str. 301
accagaccugaaaccgccuucugc

SEQ ID NO: 2014465 - RNA, 15 nt, Shigella flexneri 2a str. 301
accagaccgcacacc

SEQ ID NO: 2014466 - RNA, 13 nt, Shigella flexneri 2a str. 301
accagaccaggcg

SEQ ID NO: 2014467 - RNA, 19 nt, Shigella flexneri 2a str. 301
accagacaucguaaagcug

SEQ ID NO: 2014468 - RNA, 15 nt, Shigella flexneri 2a str. 301
accagacauguggau

SEQ ID NO: 2014469 - RNA, 15 nt, Shigella flexneri 2a str. 301
accacgaagcaaugg

SEQ ID NO: 2014470 - RNA, 14 nt, Shigella flexneri 2a str. 301
accacgacuucugu

SEQ ID NO: 2014471 - RNA, 15 nt, Shigella flexneri 2a str. 301
accacgaacgagguu

SEQ ID NO: 2014472 - RNA, 18 nt, Shigella flexneri 2a str. 301
accacgauauguucagga

SEQ ID NO: 2014473 - RNA, 14 nt, Shigella flexneri 2a str. 301
accacggaguugac

SEQ ID NO: 2014474 - RNA, 16 nt, Shigella flexneri 2a str. 301
accacggcagcaacuu

SEQ ID NO: 2014475 - RNA, 20 nt, Shigella flexneri 2a str. 301
accacggaguugaccagcuc

SEQ ID NO: 2014476 - RNA, 11 nt, Shigella flexneri 2a str. 301
accacgggcuu

SEQ ID NO: 2014477 - RNA, 18 nt, Shigella flexneri 2a str. 301
accacugacacggaacaa

SEQ ID NO: 2014478 - RNA, 14 nt, Shigella flexneri 2a str. 301
accacuccggcaug

SEQ ID NO: 2014479 - RNA, 18 nt, Shigella flexneri 2a str. 301
accaccgcaaucgccagu

SEQ ID NO: 2014480 - RNA, 23 nt, Shigella flexneri 2a str. 301
accaccgcaucggcaucaaacca

SEQ ID NO: 2014481 - RNA, 21 nt, Shigella flexneri 2a str. 301
accaccgacgugguuaacgac

SEQ ID NO: 2014482 - RNA, 13 nt, Shigella flexneri 2a str. 301
accaccggcacca

SEQ ID NO: 2014483 - RNA, 14 nt, Shigella flexneri 2a str. 301
accaccagacgagc

SEQ ID NO: 2014484 - RNA, 23 nt, Shigella flexneri 2a str. 301
accacccgcagcgaucugcaccu

SEQ ID NO: 2014485 - RNA, 17 nt, Shigella flexneri 2a str. 301
accacccauuuuaaugu

SEQ ID NO: 2014486 - RNA, 12 nt, Shigella flexneri 2a str. 301
accacccagcgg

SEQ ID NO: 2014487 - RNA, 16 nt, Shigella flexneri 2a str. 301
accaguugcuccagca

SEQ ID NO: 2014488 - RNA, 19 nt, Shigella flexneri 2a str. 301
accaguugcuccagcaaua

SEQ ID NO: 2014489 - RNA, 23 nt, Shigella flexneri 2a str. 301
accaguuacguuuaugccacugu

SEQ ID NO: 2014490 - RNA, 15 nt, Shigella flexneri 2a str. 301
accaguucacaccag

SEQ ID NO: 2014491 - RNA, 19 nt, Shigella flexneri 2a str. 301
accaguucacaccagccac

SEQ ID NO: 2014492 - RNA, 17 nt, Shigella flexneri 2a str. 301
accagugguaagaggaa

SEQ ID NO: 2014493 - RNA, 20 nt, Shigella flexneri 2a str. 301
accagugcggauaccaccag

SEQ ID NO: 2014494 - RNA, 19 nt, Shigella flexneri 2a str. 301
accaguacgcccacgccag

SEQ ID NO: 2014495 - RNA, 15 nt, Shigella flexneri 2a str. 301
accaguccagcgccu

SEQ ID NO: 2014496 - RNA, 14 nt, Shigella flexneri 2a str. 301
accaguaccgccac

SEQ ID NO: 2014497 - RNA, 17 nt, Shigella flexneri 2a str. 301
accaguccugugacuca

SEQ ID NO: 2014498 - RNA, 23 nt, Shigella flexneri 2a str. 301
accaguccugugacucaaugaaa

SEQ ID NO: 2014499 - RNA, 16 nt, Shigella flexneri 2a str. 301
accagucgcugacacu

SEQ ID NO: 2014500 - RNA, 20 nt, Shigella flexneri 2a str. 301
accauauaugauaauuauua

SEQ ID NO: 2014501 - RNA, 17 nt, Shigella flexneri 2a str. 301
accaucagcugccaggg

SEQ ID NO: 2014502 - RNA, 20 nt, Shigella flexneri 2a str. 301
accaucagcugccagggcac

SEQ ID NO: 2014503 - RNA, 15 nt, Shigella flexneri 2a str. 301
accauagcaucccaa

SEQ ID NO: 2014504 - RNA, 21 nt, Shigella flexneri 2a str. 301
accauacugcuuaaaccauuc

SEQ ID NO: 2014505 - RNA, 19 nt, Shigella flexneri 2a str. 301
accauaaucucaucagcgu

SEQ ID NO: 2014506 - RNA, 19 nt, Shigella flexneri 2a str. 301
accauauagcgcacaugca

SEQ ID NO: 2014507 - RNA, 16 nt, Shigella flexneri 2a str. 301
accauauagcgcacau

SEQ ID NO: 2014508 - RNA, 23 nt, Shigella flexneri 2a str. 301
accauaguauuuauccauaauuu

SEQ ID NO: 2014509 - RNA, 22 nt, Shigella flexneri 2a str. 301
accauaaauauggugaaaguaa

SEQ ID NO: 2014510 - RNA, 19 nt, Shigella flexneri 2a str. 301
accauaaauccaacaacac

SEQ ID NO: 2014511 - RNA, 22 nt, Shigella flexneri 2a str. 301
accauaaaacgcgcuacugaau

SEQ ID NO: 2014512 - RNA, 20 nt, Shigella flexneri 2a str. 301
accauaacccgcuuccagaa

SEQ ID NO: 2014513 - RNA, 16 nt, Shigella flexneri 2a str. 301
accauacagcagcaac

SEQ ID NO: 2014514 - RNA, 15 nt, Shigella flexneri 2a str. 301
accaggccaucagca

SEQ ID NO: 2014515 - RNA, 19 nt, Shigella flexneri 2a str. 301
accaggcgaccguuuucac

SEQ ID NO: 2014516 - RNA, 18 nt, Shigella flexneri 2a str. 301
accaggcgaccguuuuca

SEQ ID NO: 2014517 - RNA, 18 nt, Shigella flexneri 2a str. 301
accagcgccugcgcggca

SEQ ID NO: 2014518 - RNA, 14 nt, Shigella flexneri 2a str. 301
accagcgcuucacu

SEQ ID NO: 2014519 - RNA, 18 nt, Shigella flexneri 2a str. 301
accagcgcuucacuauga

SEQ ID NO: 2014520 - RNA, 14 nt, Shigella flexneri 2a str. 301
accaggccagcgca

SEQ ID NO: 2014521 - RNA, 19 nt, Shigella flexneri 2a str. 301
accagcgacaucaccgccg

SEQ ID NO: 2014522 - RNA, 18 nt, Shigella flexneri 2a str. 301
accagcgaggucaaaauc

SEQ ID NO: 2014523 - RNA, 22 nt, Shigella flexneri 2a str. 301
accagcgaauggguaaaaccgc

SEQ ID NO: 2014524 - RNA, 13 nt, Shigella flexneri 2a str. 301
accagcgacauca

SEQ ID NO: 2014525 - RNA, 15 nt, Shigella flexneri 2a str. 301
accagccuucuucau

SEQ ID NO: 2014526 - RNA, 15 nt, Shigella flexneri 2a str. 301
accaggcguggauac

SEQ ID NO: 2014527 - RNA, 19 nt, Shigella flexneri 2a str. 301
accaggcggauaauuucac

SEQ ID NO: 2014528 - RNA, 20 nt, Shigella flexneri 2a str. 301
accaggcggauaauuucacu

SEQ ID NO: 2014529 - RNA, 22 nt, Shigella flexneri 2a str. 301
accagggaaauaaucgggaaua

SEQ ID NO: 2014530 - RNA, 23 nt, Shigella flexneri 2a str. 301
accaguaaaccaauuucugugca

SEQ ID NO: 2014531 - RNA, 22 nt, Shigella flexneri 2a str. 301
accagguugccuugucaucguc

SEQ ID NO: 2014532 - RNA, 15 nt, Shigella flexneri 2a str. 301
accagguucaacagc

SEQ ID NO: 2014533 - RNA, 16 nt, Shigella flexneri 2a str. 301
acccccauccacgcau

SEQ ID NO: 2014534 - RNA, 13 nt, Shigella flexneri 2a str. 301
acccccagacgac

SEQ ID NO: 2014535 - RNA, 14 nt, Shigella flexneri 2a str. 301
acccccuccuuuua

SEQ ID NO: 2014536 - RNA, 15 nt, Shigella flexneri 2a str. 301
accccauugaagaau

SEQ ID NO: 2014537 - RNA, 19 nt, Shigella flexneri 2a str. 301
accccauggagaaaaugug

SEQ ID NO: 2014538 - RNA, 22 nt, Shigella flexneri 2a str. 301
accccagugguuucgccagcac

SEQ ID NO: 2014539 - RNA, 18 nt, Shigella flexneri 2a str. 301
accccagcagaauccggu

SEQ ID NO: 2014540 - RNA, 20 nt, Shigella flexneri 2a str. 301
accccaggccgcguaccgca

SEQ ID NO: 2014541 - RNA, 22 nt, Shigella flexneri 2a str. 301
accccaggccgcguaccgcagc

SEQ ID NO: 2014542 - RNA, 20 nt, Shigella flexneri 2a str. 301
accccaauguagccgcacgc

SEQ ID NO: 2014543 - RNA, 15 nt, Shigella flexneri 2a str. 301
accccaauguagccg

SEQ ID NO: 2014544 - RNA, 20 nt, Shigella flexneri 2a str. 301
accccacgauguauccggca

SEQ ID NO: 2014545 - RNA, 20 nt, Shigella flexneri 2a str. 301
acccagcguguugaggaagc

SEQ ID NO: 2014546 - RNA, 15 nt, Shigella flexneri 2a str. 301
acccagcagcgccac

SEQ ID NO: 2014547 - RNA, 11 nt, Shigella flexneri 2a str. 301
acccagcagca

SEQ ID NO: 2014548 - RNA, 23 nt, Shigella flexneri 2a str. 301
acccagcagguccccgagcacau

SEQ ID NO: 2014549 - RNA, 16 nt, Shigella flexneri 2a str. 301
acccagccagacgcca

SEQ ID NO: 2014550 - RNA, 17 nt, Shigella flexneri 2a str. 301
acccagcgaauccagca

SEQ ID NO: 2014551 - RNA, 13 nt, Shigella flexneri 2a str. 301
acccagcaaggcg

SEQ ID NO: 2014552 - RNA, 16 nt, Shigella flexneri 2a str. 301
acccagcaauccugca

SEQ ID NO: 2014553 - RNA, 16 nt, Shigella flexneri 2a str. 301
acccagacaaaauuca

SEQ ID NO: 2014554 - RNA, 11 nt, Shigella flexneri 2a str. 301
acccaauccag

SEQ ID NO: 2014555 - RNA, 18 nt, Shigella flexneri 2a str. 301
acccaacguaacaaaacu

SEQ ID NO: 2014556 - RNA, 17 nt, Shigella flexneri 2a str. 301
acccaacgcaaagagag

SEQ ID NO: 2014557 - RNA, 21 nt, Shigella flexneri 2a str. 301
acccaacgcaaagagagaagc

SEQ ID NO: 2014558 - RNA, 13 nt, Shigella flexneri 2a str. 301
acccaacaugccg

SEQ ID NO: 2014559 - RNA, 12 nt, Shigella flexneri 2a str. 301
acccagaacuau

SEQ ID NO: 2014560 - RNA, 22 nt, Shigella flexneri 2a str. 301
acccaccaugccgauggcaaaa

SEQ ID NO: 2014561 - RNA, 16 nt, Shigella flexneri 2a str. 301
acccacauguugcgcu

SEQ ID NO: 2014562 - RNA, 22 nt, Shigella flexneri 2a str. 301
acccacauguugcgcuucacca

SEQ ID NO: 2014563 - RNA, 17 nt, Shigella flexneri 2a str. 301
accauugaggauugcgc

SEQ ID NO: 2014564 - RNA, 16 nt, Shigella flexneri 2a str. 301
accauugaagcaaucc

SEQ ID NO: 2014565 - RNA, 17 nt, Shigella flexneri 2a str. 301
accauugcugccgccag

SEQ ID NO: 2014566 - RNA, 23 nt, Shigella flexneri 2a str. 301
accauugcaucgaggaaaaccag

SEQ ID NO: 2014567 - RNA, 20 nt, Shigella flexneri 2a str. 301
accauuggcauugguaucgg

SEQ ID NO: 2014568 - RNA, 21 nt, Shigella flexneri 2a str. 301
accauuggucuuugugccacg

SEQ ID NO: 2014569 - RNA, 22 nt, Shigella flexneri 2a str. 301
accauugguugcgcuucuucca

SEQ ID NO: 2014570 - RNA, 16 nt, Shigella flexneri 2a str. 301
accauccauucagugc

SEQ ID NO: 2014571 - RNA, 14 nt, Shigella flexneri 2a str. 301
accauucaggcugg

SEQ ID NO: 2014572 - RNA, 14 nt, Shigella flexneri 2a str. 301
accauuaucaaaca

SEQ ID NO: 2014573 - RNA, 14 nt, Shigella flexneri 2a str. 301
accaucauauuuuc

SEQ ID NO: 2014574 - RNA, 21 nt, Shigella flexneri 2a str. 301
accaucauaccgaucaccgau

SEQ ID NO: 2014575 - RNA, 13 nt, Shigella flexneri 2a str. 301
accaucagcauga

SEQ ID NO: 2014576 - RNA, 14 nt, Shigella flexneri 2a str. 301
accauccaggagau

SEQ ID NO: 2014577 - RNA, 14 nt, Shigella flexneri 2a str. 301
accaucauggaagc

SEQ ID NO: 2014578 - RNA, 19 nt, Shigella flexneri 2a str. 301
acagccggacccacacccc

SEQ ID NO: 2014579 - RNA, 23 nt, Shigella flexneri 2a str. 301
acagccgucgagggcaaccugcu

SEQ ID NO: 2014580 - RNA, 17 nt, Shigella flexneri 2a str. 301
acagccggaugucugga

SEQ ID NO: 2014581 - RNA, 20 nt, Shigella flexneri 2a str. 301
acagccggaugucuggaacg

SEQ ID NO: 2014582 - RNA, 19 nt, Shigella flexneri 2a str. 301
acagccaugcgaaugccaa

SEQ ID NO: 2014583 - RNA, 22 nt, Shigella flexneri 2a str. 301
acagcccgccaaccaccgccag

SEQ ID NO: 2014584 - RNA, 21 nt, Shigella flexneri 2a str. 301
acagcccuuuccugacucagc

SEQ ID NO: 2014585 - RNA, 13 nt, Shigella flexneri 2a str. 301
acagcccggcaug

SEQ ID NO: 2014586 - RNA, 18 nt, Shigella flexneri 2a str. 301
acagccgacaaugccaca

SEQ ID NO: 2014587 - RNA, 18 nt, Shigella flexneri 2a str. 301
acagccuuauugucuuua

SEQ ID NO: 2014588 - RNA, 20 nt, Shigella flexneri 2a str. 301
acagccugauacaggaaggc

SEQ ID NO: 2014589 - RNA, 17 nt, Shigella flexneri 2a str. 301
acagccugccagcaugc

SEQ ID NO: 2014590 - RNA, 17 nt, Shigella flexneri 2a str. 301
acagcgacaccagccau

SEQ ID NO: 2014591 - RNA, 14 nt, Shigella flexneri 2a str. 301
acagcgaccgcaga

SEQ ID NO: 2014592 - RNA, 16 nt, Shigella flexneri 2a str. 301
acagcgacguaaaaaa

SEQ ID NO: 2014593 - RNA, 15 nt, Shigella flexneri 2a str. 301
acagcgacucucuga

SEQ ID NO: 2014594 - RNA, 14 nt, Shigella flexneri 2a str. 301
acagcguuaaaaag

SEQ ID NO: 2014595 - RNA, 20 nt, Shigella flexneri 2a str. 301
acagcggcgaauguuccauc

SEQ ID NO: 2014596 - RNA, 17 nt, Shigella flexneri 2a str. 301
acagcggccagccaucc

SEQ ID NO: 2014597 - RNA, 20 nt, Shigella flexneri 2a str. 301
acagcggccagccauccguc

SEQ ID NO: 2014598 - RNA, 22 nt, Shigella flexneri 2a str. 301
acagcgggugcauuuucacuuc

SEQ ID NO: 2014599 - RNA, 14 nt, Shigella flexneri 2a str. 301
acagcgcccaacac

SEQ ID NO: 2014600 - RNA, 23 nt, Shigella flexneri 2a str. 301
acagcgccagacaaaccacgccu

SEQ ID NO: 2014601 - RNA, 17 nt, Shigella flexneri 2a str. 301
acagcgcaccagaaaca

SEQ ID NO: 2014602 - RNA, 15 nt, Shigella flexneri 2a str. 301
acagcgauuccaguu

SEQ ID NO: 2014603 - RNA, 22 nt, Shigella flexneri 2a str. 301
acagcgcaaaacgcaggaucca

SEQ ID NO: 2014604 - RNA, 19 nt, Shigella flexneri 2a str. 301
acagcgcugcgaaaguacc

SEQ ID NO: 2014605 - RNA, 14 nt, Shigella flexneri 2a str. 301
acagcgcgcugaca

SEQ ID NO: 2014606 - RNA, 19 nt, Shigella flexneri 2a str. 301
acagcggaguaaucgccag

SEQ ID NO: 2014607 - RNA, 19 nt, Shigella flexneri 2a str. 301
acagcuuagcgccuucuac

SEQ ID NO: 2014608 - RNA, 18 nt, Shigella flexneri 2a str. 301
acagcuuauguugcuuac

SEQ ID NO: 2014609 - RNA, 17 nt, Shigella flexneri 2a str. 301
acagcuuuuacagccaa

SEQ ID NO: 2014610 - RNA, 19 nt, Shigella flexneri 2a str. 301
acagcuaaucaucaucagu

SEQ ID NO: 2014611 - RNA, 21 nt, Shigella flexneri 2a str. 301
acagcuggaguacggccuugg

SEQ ID NO: 2014612 - RNA, 20 nt, Shigella flexneri 2a str. 301
acagcuuuuacagccaaugc

SEQ ID NO: 2014613 - RNA, 23 nt, Shigella flexneri 2a str. 301
acaggaaugcagucgcuguauuu

SEQ ID NO: 2014614 - RNA, 21 nt, Shigella flexneri 2a str. 301
acaggauaauuagaggucagu

SEQ ID NO: 2014615 - RNA, 16 nt, Shigella flexneri 2a str. 301
acaggauauguaagca

SEQ ID NO: 2014616 - RNA, 18 nt, Shigella flexneri 2a str. 301
acaggauaauuagagguc

SEQ ID NO: 2014617 - RNA, 22 nt, Shigella flexneri 2a str. 301
acaggauggcguucgcaacacc

SEQ ID NO: 2014618 - RNA, 14 nt, Shigella flexneri 2a str. 301
acaggcagcaauca

SEQ ID NO: 2014619 - RNA, 22 nt, Shigella flexneri 2a str. 301
acaggccaucacauccugauag

SEQ ID NO: 2014620 - RNA, 16 nt, Shigella flexneri 2a str. 301
acaggcgaucuucccg

SEQ ID NO: 2014621 - RNA, 13 nt, Shigella flexneri 2a str. 301
acaggcgaugcca

SEQ ID NO: 2014622 - RNA, 15 nt, Shigella flexneri 2a str. 301
acagauucaugcugc

SEQ ID NO: 2014623 - RNA, 23 nt, Shigella flexneri 2a str. 301
acagagcacuguuacugucggca

SEQ ID NO: 2014624 - RNA, 17 nt, Shigella flexneri 2a str. 301
acagagguuuuaugaua

SEQ ID NO: 2014625 - RNA, 22 nt, Shigella flexneri 2a str. 301
acagaugcgacggcaccacauu

SEQ ID NO: 2014626 - RNA, 23 nt, Shigella flexneri 2a str. 301
acagccagauuaaaagugcuggg

SEQ ID NO: 2014627 - RNA, 13 nt, Shigella flexneri 2a str. 301
acagcagcccuug

SEQ ID NO: 2014628 - RNA, 22 nt, Shigella flexneri 2a str. 301
acagccacacaccgcaaacugc

SEQ ID NO: 2014629 - RNA, 16 nt, Shigella flexneri 2a str. 301
acagcagaacgaccag

SEQ ID NO: 2014630 - RNA, 17 nt, Shigella flexneri 2a str. 301
acagccagccagcacca

SEQ ID NO: 2014631 - RNA, 13 nt, Shigella flexneri 2a str. 301
acagccagcagcg

SEQ ID NO: 2014632 - RNA, 18 nt, Shigella flexneri 2a str. 301
acagccauccgucaucca

SEQ ID NO: 2014633 - RNA, 20 nt, Shigella flexneri 2a str. 301
acagccaggugauacgucca

SEQ ID NO: 2014634 - RNA, 20 nt, Shigella flexneri 2a str. 301
acagcacgccccggcggccg

SEQ ID NO: 2014635 - RNA, 16 nt, Shigella flexneri 2a str. 301
acagcaccagcaggug

SEQ ID NO: 2014636 - RNA, 23 nt, Shigella flexneri 2a str. 301
acagcaccauccgcccacaccag

SEQ ID NO: 2014637 - RNA, 17 nt, Shigella flexneri 2a str. 301
acagcacggcagcaacg

SEQ ID NO: 2014638 - RNA, 17 nt, Shigella flexneri 2a str. 301
acacugaaccgaaaugg

SEQ ID NO: 2014639 - RNA, 17 nt, Shigella flexneri 2a str. 301
aauuucagcggcacugu

SEQ ID NO: 2014640 - RNA, 18 nt, Shigella flexneri 2a str. 301
aauuucacugccuuucag

SEQ ID NO: 2014641 - RNA, 12 nt, Shigella flexneri 2a str. 301
aauuucacugcu

SEQ ID NO: 2014642 - RNA, 18 nt, Shigella flexneri 2a str. 301
acacugacgcgucuuauc

SEQ ID NO: 2014643 - RNA, 17 nt, Shigella flexneri 2a str. 301
acacugcguacagcgcg

SEQ ID NO: 2014644 - RNA, 19 nt, Shigella flexneri 2a str. 301
acacugggaugaaagugau

SEQ ID NO: 2014645 - RNA, 21 nt, Shigella flexneri 2a str. 301
acacugguucccaacaacagc

SEQ ID NO: 2014646 - RNA, 20 nt, Shigella flexneri 2a str. 301
acacugguucccaacaacag

SEQ ID NO: 2014647 - RNA, 18 nt, Shigella flexneri 2a str. 301
acacugcuuacaggcugg

SEQ ID NO: 2014648 - RNA, 15 nt, Shigella flexneri 2a str. 301
acacugcucgcagaa

SEQ ID NO: 2014649 - RNA, 13 nt, Shigella flexneri 2a str. 301
acacuuuucuuua

SEQ ID NO: 2014650 - RNA, 14 nt, Shigella flexneri 2a str. 301
acagaauguugcuu

SEQ ID NO: 2014651 - RNA, 18 nt, Shigella flexneri 2a str. 301
acagacauaaagccugcu

SEQ ID NO: 2014652 - RNA, 17 nt, Shigella flexneri 2a str. 301
acagaccaguaaagugc

SEQ ID NO: 2014653 - RNA, 12 nt, Shigella flexneri 2a str. 301
acagaccaucaa

SEQ ID NO: 2014654 - RNA, 19 nt, Shigella flexneri 2a str. 301
acagaccacauuccaggcc

SEQ ID NO: 2014655 - RNA, 18 nt, Shigella flexneri 2a str. 301
acacuucuucagccaguu

SEQ ID NO: 2014656 - RNA, 19 nt, Shigella flexneri 2a str. 301
acacuucaauauuaaugcu

SEQ ID NO: 2014657 - RNA, 14 nt, Shigella flexneri 2a str. 301
acacuuaacuguau

SEQ ID NO: 2014658 - RNA, 22 nt, Shigella flexneri 2a str. 301
acacuuuaaugccacauuagau

SEQ ID NO: 2014659 - RNA, 21 nt, Shigella flexneri 2a str. 301
acacuuuccaguuccggcauu

SEQ ID NO: 2014660 - RNA, 14 nt, Shigella flexneri 2a str. 301
acauaauccagaca

SEQ ID NO: 2014661 - RNA, 21 nt, Shigella flexneri 2a str. 301
acauaauccagacacuccaga

SEQ ID NO: 2014662 - RNA, 16 nt, Shigella flexneri 2a str. 301
acauacaaauagccaa

SEQ ID NO: 2014663 - RNA, 14 nt, Shigella flexneri 2a str. 301
acauacacaagcca

SEQ ID NO: 2014664 - RNA, 14 nt, Shigella flexneri 2a str. 301
acauauuccccugg

SEQ ID NO: 2014665 - RNA, 22 nt, Shigella flexneri 2a str. 301
acauauuuuuguugaaauaaua

SEQ ID NO: 2014666 - RNA, 22 nt, Shigella flexneri 2a str. 301
acaucacuccauccagcaacaa

SEQ ID NO: 2014667 - RNA, 19 nt, Shigella flexneri 2a str. 301
acaucacuccauccagcaa

SEQ ID NO: 2014668 - RNA, 15 nt, Shigella flexneri 2a str. 301
acaucacuguuugac

SEQ ID NO: 2014669 - RNA, 15 nt, Shigella flexneri 2a str. 301
acaucacugcaaaua

SEQ ID NO: 2014670 - RNA, 17 nt, Shigella flexneri 2a str. 301
acaucaaaugcgcagcc

SEQ ID NO: 2014671 - RNA, 14 nt, Shigella flexneri 2a str. 301
acaucacgcagcug

SEQ ID NO: 2014672 - RNA, 19 nt, Shigella flexneri 2a str. 301
acaucagccagaugcaccg

SEQ ID NO: 2014673 - RNA, 13 nt, Shigella flexneri 2a str. 301
acaucagcgacaa

SEQ ID NO: 2014674 - RNA, 19 nt, Shigella flexneri 2a str. 301
acaucagaggcgaaccgcu

SEQ ID NO: 2014675 - RNA, 13 nt, Shigella flexneri 2a str. 301
acaucacucauaa

SEQ ID NO: 2014676 - RNA, 13 nt, Shigella flexneri 2a str. 301
acaucgauaaggu

SEQ ID NO: 2014677 - RNA, 19 nt, Shigella flexneri 2a str. 301
acaucgacucaagcguugc

SEQ ID NO: 2014678 - RNA, 14 nt, Shigella flexneri 2a str. 301
acaucgcagcaaac

SEQ ID NO: 2014679 - RNA, 18 nt, Shigella flexneri 2a str. 301
acaucgcagggaucaucc

SEQ ID NO: 2014680 - RNA, 18 nt, Shigella flexneri 2a str. 301
acauccacgccuuuuuuc

SEQ ID NO: 2014681 - RNA, 23 nt, Shigella flexneri 2a str. 301
acaucauuuuuucccauuaccau

SEQ ID NO: 2014682 - RNA, 18 nt, Shigella flexneri 2a str. 301
acaucauuaguaccuucc

SEQ ID NO: 2014683 - RNA, 21 nt, Shigella flexneri 2a str. 301
acaucagcuaaaucacaccau

SEQ ID NO: 2014684 - RNA, 14 nt, Shigella flexneri 2a str. 301
acaucauucccgcc

SEQ ID NO: 2014685 - RNA, 22 nt, Shigella flexneri 2a str. 301
acaugcuucaggacuucuuugc

SEQ ID NO: 2014686 - RNA, 13 nt, Shigella flexneri 2a str. 301
acaugcuguugga

SEQ ID NO: 2014687 - RNA, 16 nt, Shigella flexneri 2a str. 301
acaugcuggaaccaca

SEQ ID NO: 2014688 - RNA, 17 nt, Shigella flexneri 2a str. 301
acaugccacuggcccca

SEQ ID NO: 2014689 - RNA, 18 nt, Shigella flexneri 2a str. 301
acaugcauaaagcgguuu

SEQ ID NO: 2014690 - RNA, 18 nt, Shigella flexneri 2a str. 301
acaugcagcccagcauca

SEQ ID NO: 2014691 - RNA, 14 nt, Shigella flexneri 2a str. 301
acaugcagggcaaa

SEQ ID NO: 2014692 - RNA, 19 nt, Shigella flexneri 2a str. 301
acaugagguccagcgagcc

SEQ ID NO: 2014693 - RNA, 14 nt, Shigella flexneri 2a str. 301
acaugagagaaaau

SEQ ID NO: 2014694 - RNA, 15 nt, Shigella flexneri 2a str. 301
acaugagaacaguuc

SEQ ID NO: 2014695 - RNA, 14 nt, Shigella flexneri 2a str. 301
acaugaagcacugc

SEQ ID NO: 2014696 - RNA, 23 nt, Shigella flexneri 2a str. 301
acaugaaugaugauuugguggcc

SEQ ID NO: 2014697 - RNA, 14 nt, Shigella flexneri 2a str. 301
acaucuuccagaau

SEQ ID NO: 2014698 - RNA, 16 nt, Shigella flexneri 2a str. 301
acaucuucaauccacg

SEQ ID NO: 2014699 - RNA, 20 nt, Shigella flexneri 2a str. 301
acaucugucugauaaaaaac

SEQ ID NO: 2014700 - RNA, 12 nt, Shigella flexneri 2a str. 301
acaucucuuccc

SEQ ID NO: 2014701 - RNA, 13 nt, Shigella flexneri 2a str. 301
acaucucaacaac

SEQ ID NO: 2014702 - RNA, 17 nt, Shigella flexneri 2a str. 301
acaucgcuaccgcgcag

SEQ ID NO: 2014703 - RNA, 18 nt, Shigella flexneri 2a str. 301
acaucuaaccauuauuaa

SEQ ID NO: 2014704 - RNA, 16 nt, Shigella flexneri 2a str. 301
acaucuacaaaaaacu

SEQ ID NO: 2014705 - RNA, 17 nt, Shigella flexneri 2a str. 301
acaucuaaccauuauua

SEQ ID NO: 2014706 - RNA, 18 nt, Shigella flexneri 2a str. 301
acauaaccacucaccgcc

SEQ ID NO: 2014707 - RNA, 21 nt, Shigella flexneri 2a str. 301
acauaaacagguaaagaccau

SEQ ID NO: 2014708 - RNA, 15 nt, Shigella flexneri 2a str. 301
acaguugcucaauca

SEQ ID NO: 2014709 - RNA, 13 nt, Shigella flexneri 2a str. 301
acaguuguaaagu

SEQ ID NO: 2014710 - RNA, 12 nt, Shigella flexneri 2a str. 301
acaguucaaucu

SEQ ID NO: 2014711 - RNA, 12 nt, Shigella flexneri 2a str. 301
acaguuaucaaa

SEQ ID NO: 2014712 - RNA, 17 nt, Shigella flexneri 2a str. 301
acagugggauuaaaaag

SEQ ID NO: 2014713 - RNA, 22 nt, Shigella flexneri 2a str. 301
acagugcugauuuugcaacaac

SEQ ID NO: 2014714 - RNA, 20 nt, Shigella flexneri 2a str. 301
acaguguaauuaggcuaaau

SEQ ID NO: 2014715 - RNA, 19 nt, Shigella flexneri 2a str. 301
acaguggugcuuugcugug

SEQ ID NO: 2014716 - RNA, 14 nt, Shigella flexneri 2a str. 301
acagugcaccggac

SEQ ID NO: 2014717 - RNA, 18 nt, Shigella flexneri 2a str. 301
acagugaccaucuuccag

SEQ ID NO: 2014718 - RNA, 20 nt, Shigella flexneri 2a str. 301
acagugaccaucuuccagca

SEQ ID NO: 2014719 - RNA, 14 nt, Shigella flexneri 2a str. 301
acagugaaucucuu

SEQ ID NO: 2014720 - RNA, 22 nt, Shigella flexneri 2a str. 301
acagucgcccgaccaucgccag

SEQ ID NO: 2014721 - RNA, 15 nt, Shigella flexneri 2a str. 301
acaggugccggauuu

SEQ ID NO: 2014722 - RNA, 19 nt, Shigella flexneri 2a str. 301
acagguggcguuugccacc

SEQ ID NO: 2014723 - RNA, 23 nt, Shigella flexneri 2a str. 301
acagguggcaaauggcgaaggau

SEQ ID NO: 2014724 - RNA, 23 nt, Shigella flexneri 2a str. 301
acagguugccgaugauucccagu

SEQ ID NO: 2014725 - RNA, 16 nt, Shigella flexneri 2a str. 301
acaguaacccggcacc

SEQ ID NO: 2014726 - RNA, 12 nt, Shigella flexneri 2a str. 301
acaguaaaguuu

SEQ ID NO: 2014727 - RNA, 15 nt, Shigella flexneri 2a str. 301
acaguacaucuucca

SEQ ID NO: 2014728 - RNA, 20 nt, Shigella flexneri 2a str. 301
acaguacgguaaagccgugc

SEQ ID NO: 2014729 - RNA, 21 nt, Shigella flexneri 2a str. 301
acaguagacaauuuuucauaa

SEQ ID NO: 2014730 - RNA, 15 nt, Shigella flexneri 2a str. 301
acaguaucaucauua

SEQ ID NO: 2014731 - RNA, 21 nt, Shigella flexneri 2a str. 301
acaguaucaucauuauuaaua

SEQ ID NO: 2014732 - RNA, 18 nt, Shigella flexneri 2a str. 301
acaguauccgggcaucca

SEQ ID NO: 2014733 - RNA, 23 nt, Shigella flexneri 2a str. 301
acaguaucugaaucaaaaucauc

SEQ ID NO: 2014734 - RNA, 21 nt, Shigella flexneri 2a str. 301
acaggcggguaaucuuuccag

SEQ ID NO: 2014735 - RNA, 19 nt, Shigella flexneri 2a str. 301
acaggcgcuggguaaagag

SEQ ID NO: 2014736 - RNA, 18 nt, Shigella flexneri 2a str. 301
acaggcuuuccugauaau

SEQ ID NO: 2014737 - RNA, 18 nt, Shigella flexneri 2a str. 301
acaggcugguuucucuuc

SEQ ID NO: 2014738 - RNA, 17 nt, Shigella flexneri 2a str. 301
acagggcuuacugaaaa

SEQ ID NO: 2014739 - RNA, 15 nt, Shigella flexneri 2a str. 301
acagggugagcagaa

SEQ ID NO: 2014740 - RNA, 18 nt, Shigella flexneri 2a str. 301
acagguaucgacaauguc

SEQ ID NO: 2014741 - RNA, 22 nt, Shigella flexneri 2a str. 301
acaggucgccagucccuuucag

SEQ ID NO: 2014742 - RNA, 18 nt, Shigella flexneri 2a str. 301
agaagcaagcauuauaua

SEQ ID NO: 2014743 - RNA, 22 nt, Shigella flexneri 2a str. 301
agaagcagcaacacaaucagac

SEQ ID NO: 2014744 - RNA, 23 nt, Shigella flexneri 2a str. 301
agaagccaccgcgccacgaccua

SEQ ID NO: 2014745 - RNA, 19 nt, Shigella flexneri 2a str. 301
agaagauuuuuugccagca

SEQ ID NO: 2014746 - RNA, 14 nt, Shigella flexneri 2a str. 301
agaagaaagccgga

SEQ ID NO: 2014747 - RNA, 13 nt, Shigella flexneri 2a str. 301
agaacuucugcaa

SEQ ID NO: 2014748 - RNA, 19 nt, Shigella flexneri 2a str. 301
agaacuuuaucgaucacau

SEQ ID NO: 2014749 - RNA, 23 nt, Shigella flexneri 2a str. 301
agaauaccugccugucacgcagg

SEQ ID NO: 2014750 - RNA, 21 nt, Shigella flexneri 2a str. 301
agaaguaaacgccgagcugga

SEQ ID NO: 2014751 - RNA, 17 nt, Shigella flexneri 2a str. 301
agaaguaacaacuggcu

SEQ ID NO: 2014752 - RNA, 20 nt, Shigella flexneri 2a str. 301
agaaguacguagcguaagga

SEQ ID NO: 2014753 - RNA, 23 nt, Shigella flexneri 2a str. 301
agaagcugcugccgcuguugcgu

SEQ ID NO: 2014754 - RNA, 13 nt, Shigella flexneri 2a str. 301
agaagcuggaagg

SEQ ID NO: 2014755 - RNA, 19 nt, Shigella flexneri 2a str. 301
agaagcugcaggaccauac

SEQ ID NO: 2014756 - RNA, 13 nt, Shigella flexneri 2a str. 301
agaagcugcagga

SEQ ID NO: 2014757 - RNA, 14 nt, Shigella flexneri 2a str. 301
agaagcguuccauu

SEQ ID NO: 2014758 - RNA, 14 nt, Shigella flexneri 2a str. 301
agaaggaaaauaca

SEQ ID NO: 2014759 - RNA, 20 nt, Shigella flexneri 2a str. 301
agaagcuuuucucaauauaa

SEQ ID NO: 2014760 - RNA, 21 nt, Shigella flexneri 2a str. 301
agaagcuuuucucaauauaau

SEQ ID NO: 2014761 - RNA, 19 nt, Shigella flexneri 2a str. 301
agaagcuuuccacgcaggc

SEQ ID NO: 2014762 - RNA, 18 nt, Shigella flexneri 2a str. 301
agaaucuggcgcagguga

SEQ ID NO: 2014763 - RNA, 19 nt, Shigella flexneri 2a str. 301
agaaucucuuuuguuuccc

SEQ ID NO: 2014764 - RNA, 21 nt, Shigella flexneri 2a str. 301
agaauggacaccagcucagug

SEQ ID NO: 2014765 - RNA, 16 nt, Shigella flexneri 2a str. 301
agaaugacaacugcau

SEQ ID NO: 2014766 - RNA, 22 nt, Shigella flexneri 2a str. 301
agaaugacaacugcauuuucaa

SEQ ID NO: 2014767 - RNA, 23 nt, Shigella flexneri 2a str. 301
agaaugcgcaacgccguaaguaa

SEQ ID NO: 2014768 - RNA, 16 nt, Shigella flexneri 2a str. 301
agaauucacgcacuuc

SEQ ID NO: 2014769 - RNA, 15 nt, Shigella flexneri 2a str. 301
agaauggcuguaggg

SEQ ID NO: 2014770 - RNA, 20 nt, Shigella flexneri 2a str. 301
agaaugggaugguuuugcuu

SEQ ID NO: 2014771 - RNA, 18 nt, Shigella flexneri 2a str. 301
agaauggcaucagaagga

SEQ ID NO: 2014772 - RNA, 19 nt, Shigella flexneri 2a str. 301
agaauggcaucagaaggag

SEQ ID NO: 2014773 - RNA, 20 nt, Shigella flexneri 2a str. 301
agaauggcaucugauaagcc

SEQ ID NO: 2014774 - RNA, 19 nt, Shigella flexneri 2a str. 301
agaauggcgcacucaaaac

SEQ ID NO: 2014775 - RNA, 15 nt, Shigella flexneri 2a str. 301
agaauauugugcuca

SEQ ID NO: 2014776 - RNA, 14 nt, Shigella flexneri 2a str. 301
agaauauuugauug

SEQ ID NO: 2014777 - RNA, 14 nt, Shigella flexneri 2a str. 301
agaaucaagucuau

SEQ ID NO: 2014778 - RNA, 17 nt, Shigella flexneri 2a str. 301
agaaucgggaaauaaca

SEQ ID NO: 2014779 - RNA, 13 nt, Shigella flexneri 2a str. 301
agaaucgguccac

SEQ ID NO: 2014780 - RNA, 19 nt, Shigella flexneri 2a str. 301
agaaucaaucucagcgaug

SEQ ID NO: 2014781 - RNA, 15 nt, Shigella flexneri 2a str. 301
agaaucaaucucagc

SEQ ID NO: 2014782 - RNA, 16 nt, Shigella flexneri 2a str. 301
agaauccccacugcau

SEQ ID NO: 2014783 - RNA, 21 nt, Shigella flexneri 2a str. 301
agaccauuugaucgcuggcag

SEQ ID NO: 2014784 - RNA, 16 nt, Shigella flexneri 2a str. 301
agaccguugcucagaa

SEQ ID NO: 2014785 - RNA, 21 nt, Shigella flexneri 2a str. 301
agacccaguuucggcaucagc

SEQ ID NO: 2014786 - RNA, 22 nt, Shigella flexneri 2a str. 301
agaccaucaauuggaucugaug

SEQ ID NO: 2014787 - RNA, 16 nt, Shigella flexneri 2a str. 301
agaccauguuugaaau

SEQ ID NO: 2014788 - RNA, 14 nt, Shigella flexneri 2a str. 301
agaccuaccaucuc

SEQ ID NO: 2014789 - RNA, 18 nt, Shigella flexneri 2a str. 301
agaccguugcucagaauc

SEQ ID NO: 2014790 - RNA, 22 nt, Shigella flexneri 2a str. 301
agaccugaauuugcuccagaaa

SEQ ID NO: 2014791 - RNA, 21 nt, Shigella flexneri 2a str. 301
agacgacggaagaucguugcc

SEQ ID NO: 2014792 - RNA, 17 nt, Shigella flexneri 2a str. 301
agaccuggcgcuucacu

SEQ ID NO: 2014793 - RNA, 13 nt, Shigella flexneri 2a str. 301
agaccugcguuca

SEQ ID NO: 2014794 - RNA, 17 nt, Shigella flexneri 2a str. 301
agaccugauacauagca

SEQ ID NO: 2014795 - RNA, 15 nt, Shigella flexneri 2a str. 301
agaccugauccggau

SEQ ID NO: 2014796 - RNA, 23 nt, Shigella flexneri 2a str. 301
agacgauuacucgccuuucacac

SEQ ID NO: 2014797 - RNA, 22 nt, Shigella flexneri 2a str. 301
agacgauuacucgccuuucaca

SEQ ID NO: 2014798 - RNA, 17 nt, Shigella flexneri 2a str. 301
agacgaugcgucuugcc

SEQ ID NO: 2014799 - RNA, 19 nt, Shigella flexneri 2a str. 301
agacgauagaaccuuccau

SEQ ID NO: 2014800 - RNA, 14 nt, Shigella flexneri 2a str. 301
agacgagcauaaaa

SEQ ID NO: 2014801 - RNA, 15 nt, Shigella flexneri 2a str. 301
agacgaugaaaaaga

SEQ ID NO: 2014802 - RNA, 15 nt, Shigella flexneri 2a str. 301
agacgguacccgcug

SEQ ID NO: 2014803 - RNA, 20 nt, Shigella flexneri 2a str. 301
agacggcugucauccagcag

SEQ ID NO: 2014804 - RNA, 18 nt, Shigella flexneri 2a str. 301
agacggcgcuuacucaug

SEQ ID NO: 2014805 - RNA, 22 nt, Shigella flexneri 2a str. 301
agacgguuaaaaacagccagca

SEQ ID NO: 2014806 - RNA, 16 nt, Shigella flexneri 2a str. 301
agacgguuaaaaacag

SEQ ID NO: 2014807 - RNA, 23 nt, Shigella flexneri 2a str. 301
agacgguuuaucucaucuuccac

SEQ ID NO: 2014808 - RNA, 18 nt, Shigella flexneri 2a str. 301
agacgguuauauuuacaa

SEQ ID NO: 2014809 - RNA, 16 nt, Shigella flexneri 2a str. 301
agacguugauucacuu

SEQ ID NO: 2014810 - RNA, 23 nt, Shigella flexneri 2a str. 301
agacguugauucacuuucugaag

SEQ ID NO: 2014811 - RNA, 21 nt, Shigella flexneri 2a str. 301
agacguguugucagcucaucc

SEQ ID NO: 2014812 - RNA, 15 nt, Shigella flexneri 2a str. 301
agacguuucgccagc

SEQ ID NO: 2014813 - RNA, 12 nt, Shigella flexneri 2a str. 301
agacaacuuccc

SEQ ID NO: 2014814 - RNA, 17 nt, Shigella flexneri 2a str. 301
agacaauaucggcacca

SEQ ID NO: 2014815 - RNA, 15 nt, Shigella flexneri 2a str. 301
agacaauauaacugc

SEQ ID NO: 2014816 - RNA, 16 nt, Shigella flexneri 2a str. 301
agacacgcugccccug

SEQ ID NO: 2014817 - RNA, 16 nt, Shigella flexneri 2a str. 301
agacacuccagagaau

SEQ ID NO: 2014818 - RNA, 19 nt, Shigella flexneri 2a str. 301
agacacuccagagaauuua

SEQ ID NO: 2014819 - RNA, 18 nt, Shigella flexneri 2a str. 301
agaauuucuuuacugaca

SEQ ID NO: 2014820 - RNA, 19 nt, Shigella flexneri 2a str. 301
agaccagauuaaucagcag

SEQ ID NO: 2014821 - RNA, 14 nt, Shigella flexneri 2a str. 301
agaccagcaaaaau

SEQ ID NO: 2014822 - RNA, 18 nt, Shigella flexneri 2a str. 301
agaccagaaacgccacca

SEQ ID NO: 2014823 - RNA, 22 nt, Shigella flexneri 2a str. 301
agaccagacugcuccuguauga

SEQ ID NO: 2014824 - RNA, 12 nt, Shigella flexneri 2a str. 301
agaccagacugc

SEQ ID NO: 2014825 - RNA, 17 nt, Shigella flexneri 2a str. 301
agaccacucauuuuuuc

SEQ ID NO: 2014826 - RNA, 16 nt, Shigella flexneri 2a str. 301
agacaucaauaaacaa

SEQ ID NO: 2014827 - RNA, 19 nt, Shigella flexneri 2a str. 301
agacaucaauaaacaauga

SEQ ID NO: 2014828 - RNA, 21 nt, Shigella flexneri 2a str. 301
agacauaaggaaacuccagcc

SEQ ID NO: 2014829 - RNA, 20 nt, Shigella flexneri 2a str. 301
agacauaaggaaacuccagc

SEQ ID NO: 2014830 - RNA, 14 nt, Shigella flexneri 2a str. 301
agacaguuugccuu

SEQ ID NO: 2014831 - RNA, 14 nt, Shigella flexneri 2a str. 301
agacauaacccagc

SEQ ID NO: 2014832 - RNA, 15 nt, Shigella flexneri 2a str. 301
agacagaccuggcgc

SEQ ID NO: 2014833 - RNA, 14 nt, Shigella flexneri 2a str. 301
agacaguucuuccu

SEQ ID NO: 2014834 - RNA, 16 nt, Shigella flexneri 2a str. 301
agacaguucuuccugg

SEQ ID NO: 2014835 - RNA, 17 nt, Shigella flexneri 2a str. 301
agacagacagccucaag

SEQ ID NO: 2014836 - RNA, 13 nt, Shigella flexneri 2a str. 301
agacagaaucagg

SEQ ID NO: 2014837 - RNA, 13 nt, Shigella flexneri 2a str. 301
agacacuggaaac

SEQ ID NO: 2014838 - RNA, 17 nt, Shigella flexneri 2a str. 301
agaacagcggugcaaga

SEQ ID NO: 2014839 - RNA, 16 nt, Shigella flexneri 2a str. 301
agaacaguucagcagc

SEQ ID NO: 2014840 - RNA, 19 nt, Shigella flexneri 2a str. 301
agaacauaaaaaccuguau

SEQ ID NO: 2014841 - RNA, 19 nt, Shigella flexneri 2a str. 301
agaacacgcucccagcaga

SEQ ID NO: 2014842 - RNA, 21 nt, Shigella flexneri 2a str. 301
agaacacgcucccagcagaga

SEQ ID NO: 2014843 - RNA, 19 nt, Shigella flexneri 2a str. 301
agaacacuguuaccgcugc

SEQ ID NO: 2014844 - RNA, 13 nt, Shigella flexneri 2a str. 301
agaacagaacauc

SEQ ID NO: 2014845 - RNA, 11 nt, Shigella flexneri 2a str. 301
agaaccaugca

SEQ ID NO: 2014846 - RNA, 13 nt, Shigella flexneri 2a str. 301
agaacaucuuacc

SEQ ID NO: 2014847 - RNA, 17 nt, Shigella flexneri 2a str. 301
agaaccaacgcugccag

SEQ ID NO: 2014848 - RNA, 16 nt, Shigella flexneri 2a str. 301
agaacaauaauaacuc

SEQ ID NO: 2014849 - RNA, 12 nt, Shigella flexneri 2a str. 301
agaacaccaccu

SEQ ID NO: 2014850 - RNA, 20 nt, Shigella flexneri 2a str. 301
agaacaacccggcgaaagag

SEQ ID NO: 2014851 - RNA, 17 nt, Shigella flexneri 2a str. 301
agaacaaauaaauagau

SEQ ID NO: 2014852 - RNA, 20 nt, Shigella flexneri 2a str. 301
agaaauugucuccaccaaug

SEQ ID NO: 2014853 - RNA, 14 nt, Shigella flexneri 2a str. 301
agaacaaauaaaua

SEQ ID NO: 2014854 - RNA, 23 nt, Shigella flexneri 2a str. 301
agaaaguauauaaaaaacaauau

SEQ ID NO: 2014855 - RNA, 21 nt, Shigella flexneri 2a str. 301
agaaaguauauaaaaaacaau

SEQ ID NO: 2014856 - RNA, 22 nt, Shigella flexneri 2a str. 301
agaacggcgcaccagaauaccu

SEQ ID NO: 2014857 - RNA, 19 nt, Shigella flexneri 2a str. 301
agaacgccuguguccuguu

SEQ ID NO: 2014858 - RNA, 13 nt, Shigella flexneri 2a str. 301
agaaccuuccaug

SEQ ID NO: 2014859 - RNA, 13 nt, Shigella flexneri 2a str. 301
agaacgacaguga

SEQ ID NO: 2014860 - RNA, 15 nt, Shigella flexneri 2a str. 301
agaaccuaagaacca

SEQ ID NO: 2014861 - RNA, 19 nt, Shigella flexneri 2a str. 301
agaaccuaagaaccagaau

SEQ ID NO: 2014862 - RNA, 19 nt, Shigella flexneri 2a str. 301
agaacugcuugcccagcaa

SEQ ID NO: 2014863 - RNA, 20 nt, Shigella flexneri 2a str. 301
agaacugcaacucaccuuua

SEQ ID NO: 2014864 - RNA, 19 nt, Shigella flexneri 2a str. 301
agaacugagcgaucauuag

SEQ ID NO: 2014865 - RNA, 21 nt, Shigella flexneri 2a str. 301
agaacuguagacaaaauguuc

SEQ ID NO: 2014866 - RNA, 14 nt, Shigella flexneri 2a str. 301
agaacucggaagca

SEQ ID NO: 2014867 - RNA, 22 nt, Shigella flexneri 2a str. 301
agaacucguucagcgcauucca

SEQ ID NO: 2014868 - RNA, 21 nt, Shigella flexneri 2a str. 301
agaacgugccgggaaaguggc

SEQ ID NO: 2014869 - RNA, 14 nt, Shigella flexneri 2a str. 301
agaacgugccggga

SEQ ID NO: 2014870 - RNA, 16 nt, Shigella flexneri 2a str. 301
agaacguaaacgcagc

SEQ ID NO: 2014871 - RNA, 18 nt, Shigella flexneri 2a str. 301
acuuccuuuuuuauuuac

SEQ ID NO: 2014872 - RNA, 21 nt, Shigella flexneri 2a str. 301
acuuccugcggagcaaccugc

SEQ ID NO: 2014873 - RNA, 15 nt, Shigella flexneri 2a str. 301
acuuccugcggagca

SEQ ID NO: 2014874 - RNA, 13 nt, Shigella flexneri 2a str. 301
acuuuugcccggc

SEQ ID NO: 2014875 - RNA, 15 nt, Shigella flexneri 2a str. 301
acuuuugcccggcau

SEQ ID NO: 2014876 - RNA, 13 nt, Shigella flexneri 2a str. 301
acuuuugaaugag

SEQ ID NO: 2014877 - RNA, 23 nt, Shigella flexneri 2a str. 301
acuucgcguucuguggcagggca

SEQ ID NO: 2014878 - RNA, 14 nt, Shigella flexneri 2a str. 301
acuuuuguauuuua

SEQ ID NO: 2014879 - RNA, 18 nt, Shigella flexneri 2a str. 301
acuuuuuaugucauuaac

SEQ ID NO: 2014880 - RNA, 22 nt, Shigella flexneri 2a str. 301
acuuuuuccaguccacguucaa

SEQ ID NO: 2014881 - RNA, 13 nt, Shigella flexneri 2a str. 301
acuuuuucaagaa

SEQ ID NO: 2014882 - RNA, 15 nt, Shigella flexneri 2a str. 301
agaaagcccuggcgc

SEQ ID NO: 2014883 - RNA, 12 nt, Shigella flexneri 2a str. 301
agaaagcccugg

SEQ ID NO: 2014884 - RNA, 17 nt, Shigella flexneri 2a str. 301
agaaagcgccagcaaga

SEQ ID NO: 2014885 - RNA, 14 nt, Shigella flexneri 2a str. 301
agaaagcugcgcag

SEQ ID NO: 2014886 - RNA, 23 nt, Shigella flexneri 2a str. 301
agaaagcugcugaccaccagcac

SEQ ID NO: 2014887 - RNA, 18 nt, Shigella flexneri 2a str. 301
agaaaaucucaauguauu

SEQ ID NO: 2014888 - RNA, 22 nt, Shigella flexneri 2a str. 301
agaaaaugcccauggcaagaau

SEQ ID NO: 2014889 - RNA, 16 nt, Shigella flexneri 2a str. 301
agaaaaucgugccaga

SEQ ID NO: 2014890 - RNA, 18 nt, Shigella flexneri 2a str. 301
agaaacggaccugggaga

SEQ ID NO: 2014891 - RNA, 19 nt, Shigella flexneri 2a str. 301
agaaacgcuuaaaacgcuc

SEQ ID NO: 2014892 - RNA, 16 nt, Shigella flexneri 2a str. 301
agaaacgccaucugaa

SEQ ID NO: 2014893 - RNA, 20 nt, Shigella flexneri 2a str. 301
agaaaccugauuacgcaccg

SEQ ID NO: 2014894 - RNA, 18 nt, Shigella flexneri 2a str. 301
agagccugaauaaacgcc

SEQ ID NO: 2014895 - RNA, 22 nt, Shigella flexneri 2a str. 301
agagccucgucggcgguuuuca

SEQ ID NO: 2014896 - RNA, 14 nt, Shigella flexneri 2a str. 301
agagcgcggcgcag

SEQ ID NO: 2014897 - RNA, 20 nt, Shigella flexneri 2a str. 301
agagcgccucccuuuuucaa

SEQ ID NO: 2014898 - RNA, 22 nt, Shigella flexneri 2a str. 301
agagcuugugcaccagcuggcu

SEQ ID NO: 2014899 - RNA, 23 nt, Shigella flexneri 2a str. 301
agagcuuuucagccugaagauca

SEQ ID NO: 2014900 - RNA, 14 nt, Shigella flexneri 2a str. 301
agagcugauuuccg

SEQ ID NO: 2014901 - RNA, 20 nt, Shigella flexneri 2a str. 301
agagcuggcgaacgugcagg

SEQ ID NO: 2014902 - RNA, 20 nt, Shigella flexneri 2a str. 301
agagucaugcguuugagugg

SEQ ID NO: 2014903 - RNA, 15 nt, Shigella flexneri 2a str. 301
agagucgacacagau

SEQ ID NO: 2014904 - RNA, 17 nt, Shigella flexneri 2a str. 301
agacuaaauuucacugc

SEQ ID NO: 2014905 - RNA, 20 nt, Shigella flexneri 2a str. 301
agagagccagccccacagca

SEQ ID NO: 2014906 - RNA, 13 nt, Shigella flexneri 2a str. 301
agagagccagccc

SEQ ID NO: 2014907 - RNA, 21 nt, Shigella flexneri 2a str. 301
agagacuuuuccagccgacca

SEQ ID NO: 2014908 - RNA, 20 nt, Shigella flexneri 2a str. 301
agagagugacgucauagcag

SEQ ID NO: 2014909 - RNA, 22 nt, Shigella flexneri 2a str. 301
agagcaaaaaucgacagcagga

SEQ ID NO: 2014910 - RNA, 13 nt, Shigella flexneri 2a str. 301
agagcaaccaccu

SEQ ID NO: 2014911 - RNA, 14 nt, Shigella flexneri 2a str. 301
agagcaacauacag

SEQ ID NO: 2014912 - RNA, 17 nt, Shigella flexneri 2a str. 301
agagcaacggcgaaucu

SEQ ID NO: 2014913 - RNA, 19 nt, Shigella flexneri 2a str. 301
agagcaaauaaaacaucac

SEQ ID NO: 2014914 - RNA, 17 nt, Shigella flexneri 2a str. 301
agagauuugcuccagcg

SEQ ID NO: 2014915 - RNA, 18 nt, Shigella flexneri 2a str. 301
agagauuacuuuauuuau

SEQ ID NO: 2014916 - RNA, 22 nt, Shigella flexneri 2a str. 301
agagauuacuuuauuuauauca

SEQ ID NO: 2014917 - RNA, 15 nt, Shigella flexneri 2a str. 301
agagauguugaagaa

SEQ ID NO: 2014918 - RNA, 22 nt, Shigella flexneri 2a str. 301
agagaucgauguuuucugccuc

SEQ ID NO: 2014919 - RNA, 13 nt, Shigella flexneri 2a str. 301
agagauccuggcg

SEQ ID NO: 2014920 - RNA, 18 nt, Shigella flexneri 2a str. 301
agagauaaacgaccacuc

SEQ ID NO: 2014921 - RNA, 22 nt, Shigella flexneri 2a str. 301
agagauagcacgacguuucuuu

SEQ ID NO: 2014922 - RNA, 20 nt, Shigella flexneri 2a str. 301
agagauccaccacgcuguag

SEQ ID NO: 2014923 - RNA, 18 nt, Shigella flexneri 2a str. 301
agauacguuugccagugc

SEQ ID NO: 2014924 - RNA, 14 nt, Shigella flexneri 2a str. 301
agauagaacugcau

SEQ ID NO: 2014925 - RNA, 21 nt, Shigella flexneri 2a str. 301
agauagcguucuuuaacugcc

SEQ ID NO: 2014926 - RNA, 12 nt, Shigella flexneri 2a str. 301
agauagccagca

SEQ ID NO: 2014927 - RNA, 15 nt, Shigella flexneri 2a str. 301
agauagccagcaaca

SEQ ID NO: 2014928 - RNA, 19 nt, Shigella flexneri 2a str. 301
agauagccagguuuaccag

SEQ ID NO: 2014929 - RNA, 22 nt, Shigella flexneri 2a str. 301
agauagccagguuuaccagcag

SEQ ID NO: 2014930 - RNA, 21 nt, Shigella flexneri 2a str. 301
agauagccagguuuaccagca

SEQ ID NO: 2014931 - RNA, 14 nt, Shigella flexneri 2a str. 301
agauagccugauca

SEQ ID NO: 2014932 - RNA, 21 nt, Shigella flexneri 2a str. 301
agauacccggauacaacucgc

SEQ ID NO: 2014933 - RNA, 13 nt, Shigella flexneri 2a str. 301
agauaccuucuug

SEQ ID NO: 2014934 - RNA, 15 nt, Shigella flexneri 2a str. 301
agauacgaccguucc

SEQ ID NO: 2014935 - RNA, 15 nt, Shigella flexneri 2a str. 301
agauaccccagcgca

SEQ ID NO: 2014936 - RNA, 19 nt, Shigella flexneri 2a str. 301
agauacaguuuuugcgcuu

SEQ ID NO: 2014937 - RNA, 18 nt, Shigella flexneri 2a str. 301
agauaauuuuuucuucca

SEQ ID NO: 2014938 - RNA, 15 nt, Shigella flexneri 2a str. 301
agauacaaccaaucg

SEQ ID NO: 2014939 - RNA, 15 nt, Shigella flexneri 2a str. 301
agauacagccucuuu

SEQ ID NO: 2014940 - RNA, 12 nt, Shigella flexneri 2a str. 301
agauacaucagc

SEQ ID NO: 2014941 - RNA, 15 nt, Shigella flexneri 2a str. 301
agaguugcaccagca

SEQ ID NO: 2014942 - RNA, 16 nt, Shigella flexneri 2a str. 301
agaguugcaccagcaa

SEQ ID NO: 2014943 - RNA, 19 nt, Shigella flexneri 2a str. 301
agaguugaaaaacaugucu

SEQ ID NO: 2014944 - RNA, 18 nt, Shigella flexneri 2a str. 301
agagugacgucauagcag

SEQ ID NO: 2014945 - RNA, 16 nt, Shigella flexneri 2a str. 301
agaguuuuaaacgcag

SEQ ID NO: 2014946 - RNA, 18 nt, Shigella flexneri 2a str. 301
agaguuucaacaucaucu

SEQ ID NO: 2014947 - RNA, 14 nt, Shigella flexneri 2a str. 301
agauauuucaccag

SEQ ID NO: 2014948 - RNA, 15 nt, Shigella flexneri 2a str. 301
agauauuucagagcu

SEQ ID NO: 2014949 - RNA, 20 nt, Shigella flexneri 2a str. 301
agauaguugauuaauuucau

SEQ ID NO: 2014950 - RNA, 15 nt, Shigella flexneri 2a str. 301
agauaguugauuaau

SEQ ID NO: 2014951 - RNA, 21 nt, Shigella flexneri 2a str. 301
agauauaaacggguauuugau

SEQ ID NO: 2014952 - RNA, 14 nt, Shigella flexneri 2a str. 301
agaucaaacucuuu

SEQ ID NO: 2014953 - RNA, 15 nt, Shigella flexneri 2a str. 301
agaucaacacaucca

SEQ ID NO: 2014954 - RNA, 16 nt, Shigella flexneri 2a str. 301
agaucaccugcuggac

SEQ ID NO: 2014955 - RNA, 13 nt, Shigella flexneri 2a str. 301
agaucagauaaua

SEQ ID NO: 2014956 - RNA, 12 nt, Shigella flexneri 2a str. 301
agaucagaccaa

SEQ ID NO: 2014957 - RNA, 15 nt, Shigella flexneri 2a str. 301
agaucagaccaaucc

SEQ ID NO: 2014958 - RNA, 14 nt, Shigella flexneri 2a str. 301
agaucagggaaggg

SEQ ID NO: 2014959 - RNA, 23 nt, Shigella flexneri 2a str. 301
agaugaucgccgcacuuucuccu

SEQ ID NO: 2014960 - RNA, 18 nt, Shigella flexneri 2a str. 301
agaugauggcauucucac

SEQ ID NO: 2014961 - RNA, 21 nt, Shigella flexneri 2a str. 301
agaugauggcauucucacucc

SEQ ID NO: 2014962 - RNA, 11 nt, Shigella flexneri 2a str. 301
agaugauuuuu

SEQ ID NO: 2014963 - RNA, 23 nt, Shigella flexneri 2a str. 301
agaugcaccguuucuuugccgag

SEQ ID NO: 2014964 - RNA, 19 nt, Shigella flexneri 2a str. 301
agaugcgacggcaccacau

SEQ ID NO: 2014965 - RNA, 13 nt, Shigella flexneri 2a str. 301
agaugauaacccc

SEQ ID NO: 2014966 - RNA, 23 nt, Shigella flexneri 2a str. 301
agaugacuugccgcaaaacccag

SEQ ID NO: 2014967 - RNA, 22 nt, Shigella flexneri 2a str. 301
agaucuugcgcgaccacgauau

SEQ ID NO: 2014968 - RNA, 14 nt, Shigella flexneri 2a str. 301
agaucuugauuuac

SEQ ID NO: 2014969 - RNA, 18 nt, Shigella flexneri 2a str. 301
agaucuggcgauuauuuu

SEQ ID NO: 2014970 - RNA, 16 nt, Shigella flexneri 2a str. 301
agaucuuucacgccca

SEQ ID NO: 2014971 - RNA, 15 nt, Shigella flexneri 2a str. 301
agaugaagcuggcaa

SEQ ID NO: 2014972 - RNA, 18 nt, Shigella flexneri 2a str. 301
agaugaagcuggcaaagu

SEQ ID NO: 2014973 - RNA, 16 nt, Shigella flexneri 2a str. 301
agaugaauaauguuua

SEQ ID NO: 2014974 - RNA, 16 nt, Shigella flexneri 2a str. 301
agaucgaacacgguga

SEQ ID NO: 2014975 - RNA, 14 nt, Shigella flexneri 2a str. 301
agaucgaucauauu

SEQ ID NO: 2014976 - RNA, 19 nt, Shigella flexneri 2a str. 301
agaucgcggcaauuuuuac

SEQ ID NO: 2014977 - RNA, 21 nt, Shigella flexneri 2a str. 301
agaucgcgaccgccuucaguc

SEQ ID NO: 2014978 - RNA, 20 nt, Shigella flexneri 2a str. 301
agaucgcgaugggucgccgc

SEQ ID NO: 2014979 - RNA, 16 nt, Shigella flexneri 2a str. 301
agaucgcgcaucagcu

SEQ ID NO: 2014980 - RNA, 15 nt, Shigella flexneri 2a str. 301
agaucgcucaucagc

SEQ ID NO: 2014981 - RNA, 16 nt, Shigella flexneri 2a str. 301
agaucgcucaucagcu

SEQ ID NO: 2014982 - RNA, 17 nt, Shigella flexneri 2a str. 301
agaucgccccggcaaga

SEQ ID NO: 2014983 - RNA, 20 nt, Shigella flexneri 2a str. 301
agaucgcuuucccagcgaug

SEQ ID NO: 2014984 - RNA, 16 nt, Shigella flexneri 2a str. 301
agaucgguugccauaa

SEQ ID NO: 2014985 - RNA, 22 nt, Shigella flexneri 2a str. 301
agaucguucgcaccaaauccaa

SEQ ID NO: 2014986 - RNA, 22 nt, Shigella flexneri 2a str. 301
agaucauccugcggcagcucca

SEQ ID NO: 2014987 - RNA, 15 nt, Shigella flexneri 2a str. 301
agauccauaaggucc

SEQ ID NO: 2014988 - RNA, 23 nt, Shigella flexneri 2a str. 301
agauccagugcguaucaauagca

SEQ ID NO: 2014989 - RNA, 13 nt, Shigella flexneri 2a str. 301
agauccagguuac

SEQ ID NO: 2014990 - RNA, 17 nt, Shigella flexneri 2a str. 301
agaucccauaaccaaca

SEQ ID NO: 2014991 - RNA, 17 nt, Shigella flexneri 2a str. 301
agauccauaagguccuc

SEQ ID NO: 2014992 - RNA, 20 nt, Shigella flexneri 2a str. 301
agauccauaagguccuccag

SEQ ID NO: 2014993 - RNA, 16 nt, Shigella flexneri 2a str. 301
agauccauaagguccu

SEQ ID NO: 2014994 - RNA, 17 nt, Shigella flexneri 2a str. 301
agauccugaaauuccug

SEQ ID NO: 2014995 - RNA, 18 nt, Shigella flexneri 2a str. 301
agauccgggcauauuucc

SEQ ID NO: 2014996 - RNA, 20 nt, Shigella flexneri 2a str. 301
agauccggaucccaccagac

SEQ ID NO: 2014997 - RNA, 12 nt, Shigella flexneri 2a str. 301
agauccgccagu

SEQ ID NO: 2014998 - RNA, 14 nt, Shigella flexneri 2a str. 301
agaucccuucaccu

SEQ ID NO: 2014999 - RNA, 14 nt, Shigella flexneri 2a str. 301
agaugcuacaacau

SEQ ID NO: 2015000 - RNA, 12 nt, Shigella flexneri 2a str. 301
agaugcguucac

SEQ ID NO: 2015001 - RNA, 15 nt, Shigella flexneri 2a str. 301
agaugcuuucagcac

SEQ ID NO: 2015002 - RNA, 22 nt, Shigella flexneri 2a str. 301
agauggaaaaguuacaaaaaaa

SEQ ID NO: 2015003 - RNA, 22 nt, Shigella flexneri 2a str. 301
agaugcuugcgauauucuucag

SEQ ID NO: 2015004 - RNA, 18 nt, Shigella flexneri 2a str. 301
agauggauugcugaaaua

SEQ ID NO: 2015005 - RNA, 23 nt, Shigella flexneri 2a str. 301
agauggcccacgacgucuccauc

SEQ ID NO: 2015006 - RNA, 20 nt, Shigella flexneri 2a str. 301
agauggcuuugcccuuucug

SEQ ID NO: 2015007 - RNA, 19 nt, Shigella flexneri 2a str. 301
agauggcuuugcccuuucu

SEQ ID NO: 2015008 - RNA, 17 nt, Shigella flexneri 2a str. 301
agauggcuuugcccuuu

SEQ ID NO: 2015009 - RNA, 23 nt, Shigella flexneri 2a str. 301
agauggcuauaaucacucaaaau

SEQ ID NO: 2015010 - RNA, 21 nt, Shigella flexneri 2a str. 301
agaugugcaguuccugcaacu

SEQ ID NO: 2015011 - RNA, 16 nt, Shigella flexneri 2a str. 301
agaugugcaguuccug

SEQ ID NO: 2015012 - RNA, 20 nt, Shigella flexneri 2a str. 301
agaugugggcaaucucacuc

SEQ ID NO: 2015013 - RNA, 19 nt, Shigella flexneri 2a str. 301
agaugugggcaaucucacu

SEQ ID NO: 2015014 - RNA, 14 nt, Shigella flexneri 2a str. 301
agaugucuuuaccc

SEQ ID NO: 2015015 - RNA, 15 nt, Shigella flexneri 2a str. 301
agaugugauaacgcu

SEQ ID NO: 2015016 - RNA, 22 nt, Shigella flexneri 2a str. 301
agauggucuguaccaccagaau

SEQ ID NO: 2015017 - RNA, 20 nt, Shigella flexneri 2a str. 301
agaugguuacgcauaaaacc

SEQ ID NO: 2015018 - RNA, 17 nt, Shigella flexneri 2a str. 301
agaugguggucauauca

SEQ ID NO: 2015019 - RNA, 15 nt, Shigella flexneri 2a str. 301
agauuaaaccaguuc

SEQ ID NO: 2015020 - RNA, 20 nt, Shigella flexneri 2a str. 301
agauuaccagcgacaucacc

SEQ ID NO: 2015021 - RNA, 20 nt, Shigella flexneri 2a str. 301
agauguucuaucuuucagac

SEQ ID NO: 2015022 - RNA, 21 nt, Shigella flexneri 2a str. 301
agauguugucucagauucaga

SEQ ID NO: 2015023 - RNA, 12 nt, Shigella flexneri 2a str. 301
agauucuuaaag

SEQ ID NO: 2015024 - RNA, 14 nt, Shigella flexneri 2a str. 301
agauugaagugaac

SEQ ID NO: 2015025 - RNA, 20 nt, Shigella flexneri 2a str. 301
agauugaacgcuggcggcag

SEQ ID NO: 2015026 - RNA, 13 nt, Shigella flexneri 2a str. 301
agauucgccagau

SEQ ID NO: 2015027 - RNA, 14 nt, Shigella flexneri 2a str. 301
agauucgauagaga

SEQ ID NO: 2015028 - RNA, 15 nt, Shigella flexneri 2a str. 301
agauucgguaaccau

SEQ ID NO: 2015029 - RNA, 22 nt, Shigella flexneri 2a str. 301
agauugccugaugcgcugggca

SEQ ID NO: 2015030 - RNA, 23 nt, Shigella flexneri 2a str. 301
agauuagccgguaaaucaccagc

SEQ ID NO: 2015031 - RNA, 23 nt, Shigella flexneri 2a str. 301
agauuagcccccguuuuguuguc

SEQ ID NO: 2015032 - RNA, 14 nt, Shigella flexneri 2a str. 301
agauuagccgguaa

SEQ ID NO: 2015033 - RNA, 17 nt, Shigella flexneri 2a str. 301
agauuauaagccaguaa

SEQ ID NO: 2015034 - RNA, 23 nt, Shigella flexneri 2a str. 301
agauucaugguacgggacagcag

SEQ ID NO: 2015035 - RNA, 16 nt, Shigella flexneri 2a str. 301
agauucaugcugcggc

SEQ ID NO: 2015036 - RNA, 22 nt, Shigella flexneri 2a str. 301
agauuccccgcaguuacagcag

SEQ ID NO: 2015037 - RNA, 16 nt, Shigella flexneri 2a str. 301
agauucaggcgcagca

SEQ ID NO: 2015038 - RNA, 14 nt, Shigella flexneri 2a str. 301
agauucagccacau

SEQ ID NO: 2015039 - RNA, 14 nt, Shigella flexneri 2a str. 301
agauucaauuauag

SEQ ID NO: 2015040 - RNA, 23 nt, Shigella flexneri 2a str. 301
acuccugguaucuuuacagcgcu

SEQ ID NO: 2015041 - RNA, 16 nt, Shigella flexneri 2a str. 301
acucgagcagcugacu

SEQ ID NO: 2015042 - RNA, 20 nt, Shigella flexneri 2a str. 301
acucgacgcccuggaagaaa

SEQ ID NO: 2015043 - RNA, 21 nt, Shigella flexneri 2a str. 301
acucgacgcccuggaagaaaa

SEQ ID NO: 2015044 - RNA, 13 nt, Shigella flexneri 2a str. 301
acuccugccacca

SEQ ID NO: 2015045 - RNA, 20 nt, Shigella flexneri 2a str. 301
acuccugccaccacugcaau

SEQ ID NO: 2015046 - RNA, 13 nt, Shigella flexneri 2a str. 301
acucaaccgccac

SEQ ID NO: 2015047 - RNA, 14 nt, Shigella flexneri 2a str. 301
acucaaccccagcc

SEQ ID NO: 2015048 - RNA, 17 nt, Shigella flexneri 2a str. 301
acucaacuuuaccuuca

SEQ ID NO: 2015049 - RNA, 23 nt, Shigella flexneri 2a str. 301
acuccggaaaaacagaggcccgc

SEQ ID NO: 2015050 - RNA, 19 nt, Shigella flexneri 2a str. 301
acuccgccgcaucuuccca

SEQ ID NO: 2015051 - RNA, 21 nt, Shigella flexneri 2a str. 301
acuccgguuauuauuuacuug

SEQ ID NO: 2015052 - RNA, 19 nt, Shigella flexneri 2a str. 301
acucugggcugaagaguaa

SEQ ID NO: 2015053 - RNA, 15 nt, Shigella flexneri 2a str. 301
acucucuuuugcuug

SEQ ID NO: 2015054 - RNA, 21 nt, Shigella flexneri 2a str. 301
acucugaaacucgaccagcag

SEQ ID NO: 2015055 - RNA, 14 nt, Shigella flexneri 2a str. 301
acucucgaaaucca

SEQ ID NO: 2015056 - RNA, 23 nt, Shigella flexneri 2a str. 301
acucuacugaaggcgcauugcug

SEQ ID NO: 2015057 - RNA, 17 nt, Shigella flexneri 2a str. 301
acucuaccguuaaaaua

SEQ ID NO: 2015058 - RNA, 20 nt, Shigella flexneri 2a str. 301
acucgauaauaaagcggcuc

SEQ ID NO: 2015059 - RNA, 23 nt, Shigella flexneri 2a str. 301
acucgauaccagauuaauuauug

SEQ ID NO: 2015060 - RNA, 22 nt, Shigella flexneri 2a str. 301
acucgaugcugccgucuucguu

SEQ ID NO: 2015061 - RNA, 22 nt, Shigella flexneri 2a str. 301
acucgcugaauaaacucaccaa

SEQ ID NO: 2015062 - RNA, 13 nt, Shigella flexneri 2a str. 301
acugaucaucauu

SEQ ID NO: 2015063 - RNA, 22 nt, Shigella flexneri 2a str. 301
acugaucccgauggucagcuuc

SEQ ID NO: 2015064 - RNA, 12 nt, Shigella flexneri 2a str. 301
acugaucaucau

SEQ ID NO: 2015065 - RNA, 19 nt, Shigella flexneri 2a str. 301
acugaugaauaaauacauu

SEQ ID NO: 2015066 - RNA, 22 nt, Shigella flexneri 2a str. 301
acugaugacaaacacaaaacug

SEQ ID NO: 2015067 - RNA, 15 nt, Shigella flexneri 2a str. 301
acugaugacaaacgc

SEQ ID NO: 2015068 - RNA, 13 nt, Shigella flexneri 2a str. 301
acugcaaaccaug

SEQ ID NO: 2015069 - RNA, 14 nt, Shigella flexneri 2a str. 301
acugauuuagcucc

SEQ ID NO: 2015070 - RNA, 15 nt, Shigella flexneri 2a str. 301
acugauugccacccu

SEQ ID NO: 2015071 - RNA, 15 nt, Shigella flexneri 2a str. 301
acugcaacucaccuu

SEQ ID NO: 2015072 - RNA, 15 nt, Shigella flexneri 2a str. 301
acugcaaaucaccac

SEQ ID NO: 2015073 - RNA, 20 nt, Shigella flexneri 2a str. 301
acugcaaauacccaaaaaau

SEQ ID NO: 2015074 - RNA, 14 nt, Shigella flexneri 2a str. 301
acugacuuucguuu

SEQ ID NO: 2015075 - RNA, 13 nt, Shigella flexneri 2a str. 301
acugagagaaaaa

SEQ ID NO: 2015076 - RNA, 15 nt, Shigella flexneri 2a str. 301
acugacugacuucaa

SEQ ID NO: 2015077 - RNA, 22 nt, Shigella flexneri 2a str. 301
acucuuuuuuccgcuuugugua

SEQ ID NO: 2015078 - RNA, 15 nt, Shigella flexneri 2a str. 301
acugauaaaccuuca

SEQ ID NO: 2015079 - RNA, 18 nt, Shigella flexneri 2a str. 301
acugauaauaaauaacag

SEQ ID NO: 2015080 - RNA, 18 nt, Shigella flexneri 2a str. 301
acugauaacgcauuucau

SEQ ID NO: 2015081 - RNA, 22 nt, Shigella flexneri 2a str. 301
acugccuuugcccgcaagcugc

SEQ ID NO: 2015082 - RNA, 16 nt, Shigella flexneri 2a str. 301
acugccguugcugccg

SEQ ID NO: 2015083 - RNA, 19 nt, Shigella flexneri 2a str. 301
acugccggaacugccugcu

SEQ ID NO: 2015084 - RNA, 16 nt, Shigella flexneri 2a str. 301
acugccgcacuuugag

SEQ ID NO: 2015085 - RNA, 16 nt, Shigella flexneri 2a str. 301
acugcgcccgccagca

SEQ ID NO: 2015086 - RNA, 19 nt, Shigella flexneri 2a str. 301
acugcgcgauuaucauuuu

SEQ ID NO: 2015087 - RNA, 22 nt, Shigella flexneri 2a str. 301
acugcgcgagcgucauauagcc

SEQ ID NO: 2015088 - RNA, 16 nt, Shigella flexneri 2a str. 301
acugcgcugcauuacu

SEQ ID NO: 2015089 - RNA, 18 nt, Shigella flexneri 2a str. 301
acugcgcgccgcgcugcu

SEQ ID NO: 2015090 - RNA, 13 nt, Shigella flexneri 2a str. 301
acugcgcgcgcca

SEQ ID NO: 2015091 - RNA, 23 nt, Shigella flexneri 2a str. 301
acugcgcgcgccacuuuuugcuc

SEQ ID NO: 2015092 - RNA, 20 nt, Shigella flexneri 2a str. 301
acugcgcguuaaagagcauu

SEQ ID NO: 2015093 - RNA, 19 nt, Shigella flexneri 2a str. 301
acugcgaccguacaaccaa

SEQ ID NO: 2015094 - RNA, 17 nt, Shigella flexneri 2a str. 301
acugcgacguggaucaa

SEQ ID NO: 2015095 - RNA, 23 nt, Shigella flexneri 2a str. 301
acugcgaugggagcagccagcca

SEQ ID NO: 2015096 - RNA, 18 nt, Shigella flexneri 2a str. 301
acugcgccacgguguugu

SEQ ID NO: 2015097 - RNA, 15 nt, Shigella flexneri 2a str. 301
acugcgccacucgau

SEQ ID NO: 2015098 - RNA, 15 nt, Shigella flexneri 2a str. 301
acugcgccaucaaug

SEQ ID NO: 2015099 - RNA, 22 nt, Shigella flexneri 2a str. 301
acugccagaauagccgcagcca

SEQ ID NO: 2015100 - RNA, 18 nt, Shigella flexneri 2a str. 301
acugccaguucccccugc

SEQ ID NO: 2015101 - RNA, 14 nt, Shigella flexneri 2a str. 301
acugccaucuuccg

SEQ ID NO: 2015102 - RNA, 12 nt, Shigella flexneri 2a str. 301
acugcccgagaa

SEQ ID NO: 2015103 - RNA, 18 nt, Shigella flexneri 2a str. 301
acugccgaacagaaugca

SEQ ID NO: 2015104 - RNA, 23 nt, Shigella flexneri 2a str. 301
acugcccugaucgcuguggaaca

SEQ ID NO: 2015105 - RNA, 16 nt, Shigella flexneri 2a str. 301
acugccacaagggcau

SEQ ID NO: 2015106 - RNA, 20 nt, Shigella flexneri 2a str. 301
acugccacaagggcauauuu

SEQ ID NO: 2015107 - RNA, 17 nt, Shigella flexneri 2a str. 301
acugcauucccaucgca

SEQ ID NO: 2015108 - RNA, 23 nt, Shigella flexneri 2a str. 301
acugcauaaucgcaacgccuucc

SEQ ID NO: 2015109 - RNA, 16 nt, Shigella flexneri 2a str. 301
acugcacaccgcggaa

SEQ ID NO: 2015110 - RNA, 17 nt, Shigella flexneri 2a str. 301
acuggcaaagcaggcca

SEQ ID NO: 2015111 - RNA, 14 nt, Shigella flexneri 2a str. 301
acuggcaaccagaa

SEQ ID NO: 2015112 - RNA, 16 nt, Shigella flexneri 2a str. 301
acuggcaaaugacaua

SEQ ID NO: 2015113 - RNA, 18 nt, Shigella flexneri 2a str. 301
acuggcaauccagcucuu

SEQ ID NO: 2015114 - RNA, 18 nt, Shigella flexneri 2a str. 301
acuggcaaugacgggcuu

SEQ ID NO: 2015115 - RNA, 15 nt, Shigella flexneri 2a str. 301
acuggcauuacggca

SEQ ID NO: 2015116 - RNA, 18 nt, Shigella flexneri 2a str. 301
acuggcagguaaugaaug

SEQ ID NO: 2015117 - RNA, 18 nt, Shigella flexneri 2a str. 301
acuggcagccaggcgcga

SEQ ID NO: 2015118 - RNA, 14 nt, Shigella flexneri 2a str. 301
acuggcggcaaaaa

SEQ ID NO: 2015119 - RNA, 17 nt, Shigella flexneri 2a str. 301
acuggcggucaugacga

SEQ ID NO: 2015120 - RNA, 16 nt, Shigella flexneri 2a str. 301
acuggcgcgagccugu

SEQ ID NO: 2015121 - RNA, 18 nt, Shigella flexneri 2a str. 301
acuggcgcgagccuguuu

SEQ ID NO: 2015122 - RNA, 16 nt, Shigella flexneri 2a str. 301
acuggcgguuuucuuc

SEQ ID NO: 2015123 - RNA, 13 nt, Shigella flexneri 2a str. 301
acuggcgugggca

SEQ ID NO: 2015124 - RNA, 14 nt, Shigella flexneri 2a str. 301
acuggcuaagaagc

SEQ ID NO: 2015125 - RNA, 23 nt, Shigella flexneri 2a str. 301
acuggccucuuggcaucuugaac

SEQ ID NO: 2015126 - RNA, 22 nt, Shigella flexneri 2a str. 301
acuggcugcgugguuuguuccg

SEQ ID NO: 2015127 - RNA, 16 nt, Shigella flexneri 2a str. 301
acugggcgaagguggc

SEQ ID NO: 2015128 - RNA, 18 nt, Shigella flexneri 2a str. 301
acugggcgaagguggcgg

SEQ ID NO: 2015129 - RNA, 16 nt, Shigella flexneri 2a str. 301
acuggggcuggcggca

SEQ ID NO: 2015130 - RNA, 16 nt, Shigella flexneri 2a str. 301
acugggucaguaugga

SEQ ID NO: 2015131 - RNA, 23 nt, Shigella flexneri 2a str. 301
acuggugacuuuugcccggcaug

SEQ ID NO: 2015132 - RNA, 14 nt, Shigella flexneri 2a str. 301
acuggugagcggug

SEQ ID NO: 2015133 - RNA, 19 nt, Shigella flexneri 2a str. 301
acugguucccaacaacagc

SEQ ID NO: 2015134 - RNA, 20 nt, Shigella flexneri 2a str. 301
acugguggcaggaaaacaau

SEQ ID NO: 2015135 - RNA, 18 nt, Shigella flexneri 2a str. 301
acugguggcaggaaaaca

SEQ ID NO: 2015136 - RNA, 22 nt, Shigella flexneri 2a str. 301
acuggguuggguucacuuuccc

SEQ ID NO: 2015137 - RNA, 13 nt, Shigella flexneri 2a str. 301
acugguacucaac

SEQ ID NO: 2015138 - RNA, 19 nt, Shigella flexneri 2a str. 301
acugguagcuguagguaaa

SEQ ID NO: 2015139 - RNA, 14 nt, Shigella flexneri 2a str. 301
acugcguucugucg

SEQ ID NO: 2015140 - RNA, 20 nt, Shigella flexneri 2a str. 301
acugcguuucuggcuuaaac

SEQ ID NO: 2015141 - RNA, 20 nt, Shigella flexneri 2a str. 301
acugcucagacggugaccag

SEQ ID NO: 2015142 - RNA, 14 nt, Shigella flexneri 2a str. 301
acugcuaucacaau

SEQ ID NO: 2015143 - RNA, 20 nt, Shigella flexneri 2a str. 301
acugcggucuaaaucuuccg

SEQ ID NO: 2015144 - RNA, 23 nt, Shigella flexneri 2a str. 301
acugcgggcgaaaguguaaagca

SEQ ID NO: 2015145 - RNA, 20 nt, Shigella flexneri 2a str. 301
acugcgucauuucgaagaaa

SEQ ID NO: 2015146 - RNA, 23 nt, Shigella flexneri 2a str. 301
acugcguauuuccugccagaccu

SEQ ID NO: 2015147 - RNA, 19 nt, Shigella flexneri 2a str. 301
acugcggucuaaaucuucc

SEQ ID NO: 2015148 - RNA, 21 nt, Shigella flexneri 2a str. 301
acugcgugucguaagccaccg

SEQ ID NO: 2015149 - RNA, 13 nt, Shigella flexneri 2a str. 301
acugcugcauccg

SEQ ID NO: 2015150 - RNA, 15 nt, Shigella flexneri 2a str. 301
acugcugaaugaggc

SEQ ID NO: 2015151 - RNA, 14 nt, Shigella flexneri 2a str. 301
acugcucguucagc

SEQ ID NO: 2015152 - RNA, 16 nt, Shigella flexneri 2a str. 301
acugcucguucagcac

SEQ ID NO: 2015153 - RNA, 18 nt, Shigella flexneri 2a str. 301
acugcuccggcuuuuuag

SEQ ID NO: 2015154 - RNA, 13 nt, Shigella flexneri 2a str. 301
acugcucgcagaa

SEQ ID NO: 2015155 - RNA, 14 nt, Shigella flexneri 2a str. 301
acugcuugaagcgc

SEQ ID NO: 2015156 - RNA, 15 nt, Shigella flexneri 2a str. 301
acugcuugagcgggg

SEQ ID NO: 2015157 - RNA, 14 nt, Shigella flexneri 2a str. 301
acugcuuaauauua

SEQ ID NO: 2015158 - RNA, 18 nt, Shigella flexneri 2a str. 301
acugcuggcuuaaaaaac

SEQ ID NO: 2015159 - RNA, 22 nt, Shigella flexneri 2a str. 301
acuggaacggggcgauuuuguu

SEQ ID NO: 2015160 - RNA, 22 nt, Shigella flexneri 2a str. 301
acuuaaccccagaccaaucccg

SEQ ID NO: 2015161 - RNA, 16 nt, Shigella flexneri 2a str. 301
acuuaauaaacaucag

SEQ ID NO: 2015162 - RNA, 21 nt, Shigella flexneri 2a str. 301
acuuaaauccguuaugucucc

SEQ ID NO: 2015163 - RNA, 15 nt, Shigella flexneri 2a str. 301
acuuaacaggaucug

SEQ ID NO: 2015164 - RNA, 18 nt, Shigella flexneri 2a str. 301
acuguuuucuaacucauu

SEQ ID NO: 2015165 - RNA, 20 nt, Shigella flexneri 2a str. 301
acugguucccaacaacagcg

SEQ ID NO: 2015166 - RNA, 15 nt, Shigella flexneri 2a str. 301
acugguuuuccugag

SEQ ID NO: 2015167 - RNA, 16 nt, Shigella flexneri 2a str. 301
acugucuaauggugaa

SEQ ID NO: 2015168 - RNA, 14 nt, Shigella flexneri 2a str. 301
acugucgcgcagca

SEQ ID NO: 2015169 - RNA, 18 nt, Shigella flexneri 2a str. 301
acugucgaacuggcagga

SEQ ID NO: 2015170 - RNA, 16 nt, Shigella flexneri 2a str. 301
acuguuacugucggca

SEQ ID NO: 2015171 - RNA, 23 nt, Shigella flexneri 2a str. 301
acugugaaccucgaucagagugg

SEQ ID NO: 2015172 - RNA, 22 nt, Shigella flexneri 2a str. 301
acugucugcucggaaauauuca

SEQ ID NO: 2015173 - RNA, 22 nt, Shigella flexneri 2a str. 301
acugucuccacuauaaaaaaac

SEQ ID NO: 2015174 - RNA, 17 nt, Shigella flexneri 2a str. 301
acuuaucgugccuacac

SEQ ID NO: 2015175 - RNA, 18 nt, Shigella flexneri 2a str. 301
acuuaucacugccaguac

SEQ ID NO: 2015176 - RNA, 18 nt, Shigella flexneri 2a str. 301
acuuauaagucucagaaa

SEQ ID NO: 2015177 - RNA, 15 nt, Shigella flexneri 2a str. 301
acuuauaaaccacgc

SEQ ID NO: 2015178 - RNA, 17 nt, Shigella flexneri 2a str. 301
acuucaaucgccaccac

SEQ ID NO: 2015179 - RNA, 22 nt, Shigella flexneri 2a str. 301
acuuccgacagaauauaaguca

SEQ ID NO: 2015180 - RNA, 14 nt, Shigella flexneri 2a str. 301
acuuccccucugcg

SEQ ID NO: 2015181 - RNA, 17 nt, Shigella flexneri 2a str. 301
acuuccccucugcggcu

SEQ ID NO: 2015182 - RNA, 20 nt, Shigella flexneri 2a str. 301
acuuccugagugaauauuua

SEQ ID NO: 2015183 - RNA, 16 nt, Shigella flexneri 2a str. 301
acuuccguaccagccu

SEQ ID NO: 2015184 - RNA, 21 nt, Shigella flexneri 2a str. 301
acuuccgggauuucccggcac

SEQ ID NO: 2015185 - RNA, 14 nt, Shigella flexneri 2a str. 301
acuucacuucuucu

SEQ ID NO: 2015186 - RNA, 13 nt, Shigella flexneri 2a str. 301
acuucacuucccc

SEQ ID NO: 2015187 - RNA, 22 nt, Shigella flexneri 2a str. 301
acuucagauaaaucacgcuuca

SEQ ID NO: 2015188 - RNA, 21 nt, Shigella flexneri 2a str. 301
acuucagcaagcgauaauuua

SEQ ID NO: 2015189 - RNA, 12 nt, Shigella flexneri 2a str. 301
acuucagcagca

SEQ ID NO: 2015190 - RNA, 20 nt, Shigella flexneri 2a str. 301
acuucacggcugcuaauauu

SEQ ID NO: 2015191 - RNA, 23 nt, Shigella flexneri 2a str. 301
acuucacggcugcuaauauuuuc

SEQ ID NO: 2015192 - RNA, 13 nt, Shigella flexneri 2a str. 301
acguaauuucaau

SEQ ID NO: 2015193 - RNA, 16 nt, Shigella flexneri 2a str. 301
acguaaugauguaaaa

SEQ ID NO: 2015194 - RNA, 17 nt, Shigella flexneri 2a str. 301
acguaauggaugcccgc

SEQ ID NO: 2015195 - RNA, 14 nt, Shigella flexneri 2a str. 301
acguaccaaaacac

SEQ ID NO: 2015196 - RNA, 19 nt, Shigella flexneri 2a str. 301
acguaaguuagaggcacau

SEQ ID NO: 2015197 - RNA, 20 nt, Shigella flexneri 2a str. 301
acguaauuauaugccagccc

SEQ ID NO: 2015198 - RNA, 14 nt, Shigella flexneri 2a str. 301
acguaccaacugau

SEQ ID NO: 2015199 - RNA, 15 nt, Shigella flexneri 2a str. 301
acgucccaugaugcg

SEQ ID NO: 2015200 - RNA, 17 nt, Shigella flexneri 2a str. 301
acguccuguacuguuuc

SEQ ID NO: 2015201 - RNA, 19 nt, Shigella flexneri 2a str. 301
acguccggcaauauagaua

SEQ ID NO: 2015202 - RNA, 16 nt, Shigella flexneri 2a str. 301
acgucgcaagacgaaa

SEQ ID NO: 2015203 - RNA, 22 nt, Shigella flexneri 2a str. 301
acgucgauauaauugaccagau

SEQ ID NO: 2015204 - RNA, 22 nt, Shigella flexneri 2a str. 301
acgucgauuucuggguggcguu

SEQ ID NO: 2015205 - RNA, 13 nt, Shigella flexneri 2a str. 301
acgucgcccaccg

SEQ ID NO: 2015206 - RNA, 17 nt, Shigella flexneri 2a str. 301
acgucuccaucaauaca

SEQ ID NO: 2015207 - RNA, 13 nt, Shigella flexneri 2a str. 301
acgucucaucagg

SEQ ID NO: 2015208 - RNA, 12 nt, Shigella flexneri 2a str. 301
acgucucaucag

SEQ ID NO: 2015209 - RNA, 18 nt, Shigella flexneri 2a str. 301
acgucucaaucaccacca

SEQ ID NO: 2015210 - RNA, 14 nt, Shigella flexneri 2a str. 301
acgucgucgucuuc

SEQ ID NO: 2015211 - RNA, 19 nt, Shigella flexneri 2a str. 301
acgucgucgugaagcagag

SEQ ID NO: 2015212 - RNA, 15 nt, Shigella flexneri 2a str. 301
acgucgucaggcaac

SEQ ID NO: 2015213 - RNA, 14 nt, Shigella flexneri 2a str. 301
acgucgcuuuauag

SEQ ID NO: 2015214 - RNA, 18 nt, Shigella flexneri 2a str. 301
acgugccugugcagcgac

SEQ ID NO: 2015215 - RNA, 16 nt, Shigella flexneri 2a str. 301
acgugccgcagcuucu

SEQ ID NO: 2015216 - RNA, 18 nt, Shigella flexneri 2a str. 301
acgugccagauguuugaa

SEQ ID NO: 2015217 - RNA, 18 nt, Shigella flexneri 2a str. 301
acguuacguacuuccuua

SEQ ID NO: 2015218 - RNA, 15 nt, Shigella flexneri 2a str. 301
acguuacuaauaaau

SEQ ID NO: 2015219 - RNA, 14 nt, Shigella flexneri 2a str. 301
acguuagaaacaaa

SEQ ID NO: 2015220 - RNA, 16 nt, Shigella flexneri 2a str. 301
acguuaccggguguuc

SEQ ID NO: 2015221 - RNA, 19 nt, Shigella flexneri 2a str. 301
acgugcucugcgccgccuu

SEQ ID NO: 2015222 - RNA, 19 nt, Shigella flexneri 2a str. 301
acgugcugcauuugccccu

SEQ ID NO: 2015223 - RNA, 22 nt, Shigella flexneri 2a str. 301
acgugcucaccacgcagcagcc

SEQ ID NO: 2015224 - RNA, 20 nt, Shigella flexneri 2a str. 301
acgugcuacgguugacugaa

SEQ ID NO: 2015225 - RNA, 17 nt, Shigella flexneri 2a str. 301
acguuuggucagaucag

SEQ ID NO: 2015226 - RNA, 15 nt, Shigella flexneri 2a str. 301
acguuucuggugugc

SEQ ID NO: 2015227 - RNA, 16 nt, Shigella flexneri 2a str. 301
acguuucuggugugca

SEQ ID NO: 2015228 - RNA, 13 nt, Shigella flexneri 2a str. 301
acguuuugcugau

SEQ ID NO: 2015229 - RNA, 14 nt, Shigella flexneri 2a str. 301
acguuuuuacguuc

SEQ ID NO: 2015230 - RNA, 20 nt, Shigella flexneri 2a str. 301
acuaaacccgaccacuucca

SEQ ID NO: 2015231 - RNA, 16 nt, Shigella flexneri 2a str. 301
acuaaaacuuuauuca

SEQ ID NO: 2015232 - RNA, 23 nt, Shigella flexneri 2a str. 301
acuaaaaucauucgugagcuggu

SEQ ID NO: 2015233 - RNA, 17 nt, Shigella flexneri 2a str. 301
acguuuaacacgcucug

SEQ ID NO: 2015234 - RNA, 14 nt, Shigella flexneri 2a str. 301
acguuuacuucgcu

SEQ ID NO: 2015235 - RNA, 17 nt, Shigella flexneri 2a str. 301
acguuucaaacaggcug

SEQ ID NO: 2015236 - RNA, 10 nt, Shigella flexneri 2a str. 301
acguuucucu

SEQ ID NO: 2015237 - RNA, 16 nt, Shigella flexneri 2a str. 301
acguuagcccuuugua

SEQ ID NO: 2015238 - RNA, 21 nt, Shigella flexneri 2a str. 301
acguuaugcaccgacaauccg

SEQ ID NO: 2015239 - RNA, 16 nt, Shigella flexneri 2a str. 301
acguuauggugccuug

SEQ ID NO: 2015240 - RNA, 13 nt, Shigella flexneri 2a str. 301
acguuggcaaagu

SEQ ID NO: 2015241 - RNA, 21 nt, Shigella flexneri 2a str. 301
acguugcuguugguucagugg

SEQ ID NO: 2015242 - RNA, 14 nt, Shigella flexneri 2a str. 301
acuagugauaacca

SEQ ID NO: 2015243 - RNA, 17 nt, Shigella flexneri 2a str. 301
acuagacgaugaaaaag

SEQ ID NO: 2015244 - RNA, 18 nt, Shigella flexneri 2a str. 301
acuacgccaacagaagug

SEQ ID NO: 2015245 - RNA, 23 nt, Shigella flexneri 2a str. 301
acuacggcuucugacauaaccac

SEQ ID NO: 2015246 - RNA, 17 nt, Shigella flexneri 2a str. 301
acuacgacgccaagaaa

SEQ ID NO: 2015247 - RNA, 20 nt, Shigella flexneri 2a str. 301
acuacgacgccaagaaagag

SEQ ID NO: 2015248 - RNA, 19 nt, Shigella flexneri 2a str. 301
acuaccggaacccaccgca

SEQ ID NO: 2015249 - RNA, 15 nt, Shigella flexneri 2a str. 301
acuacccauauuuaa

SEQ ID NO: 2015250 - RNA, 19 nt, Shigella flexneri 2a str. 301
acuaccauuuguucuuuuu

SEQ ID NO: 2015251 - RNA, 20 nt, Shigella flexneri 2a str. 301
acuaccauuuguucuuuuuu

SEQ ID NO: 2015252 - RNA, 13 nt, Shigella flexneri 2a str. 301
acuaccauaaaaa

SEQ ID NO: 2015253 - RNA, 18 nt, Shigella flexneri 2a str. 301
acuaaagccuuuugccag

SEQ ID NO: 2015254 - RNA, 17 nt, Shigella flexneri 2a str. 301
acuaaacccgaccacuu

SEQ ID NO: 2015255 - RNA, 17 nt, Shigella flexneri 2a str. 301
acuaucauacucauuua

SEQ ID NO: 2015256 - RNA, 14 nt, Shigella flexneri 2a str. 301
acuauaaaaaaacc

SEQ ID NO: 2015257 - RNA, 16 nt, Shigella flexneri 2a str. 301
acuauuaaaauuucau

SEQ ID NO: 2015258 - RNA, 13 nt, Shigella flexneri 2a str. 301
acuauuucuuugu

SEQ ID NO: 2015259 - RNA, 14 nt, Shigella flexneri 2a str. 301
acuauuucuuugua

SEQ ID NO: 2015260 - RNA, 17 nt, Shigella flexneri 2a str. 301
acuauuucuuuguagau

SEQ ID NO: 2015261 - RNA, 15 nt, Shigella flexneri 2a str. 301
acuauuucaauauga

SEQ ID NO: 2015262 - RNA, 22 nt, Shigella flexneri 2a str. 301
acuauugacgaaaagcugaaaa

SEQ ID NO: 2015263 - RNA, 13 nt, Shigella flexneri 2a str. 301
acucaaagucgag

SEQ ID NO: 2015264 - RNA, 19 nt, Shigella flexneri 2a str. 301
acucaaauaucuauauaca

SEQ ID NO: 2015265 - RNA, 17 nt, Shigella flexneri 2a str. 301
acucaacaaccagaagg

SEQ ID NO: 2015266 - RNA, 12 nt, Shigella flexneri 2a str. 301
acucaaaacuac

SEQ ID NO: 2015267 - RNA, 14 nt, Shigella flexneri 2a str. 301
acucaaacagggca

SEQ ID NO: 2015268 - RNA, 18 nt, Shigella flexneri 2a str. 301
acucaaaaauaaucaucu

SEQ ID NO: 2015269 - RNA, 22 nt, Shigella flexneri 2a str. 301
acggaugaauaaaauucuccag

SEQ ID NO: 2015270 - RNA, 16 nt, Shigella flexneri 2a str. 301
acggaugaugcucccc

SEQ ID NO: 2015271 - RNA, 15 nt, Shigella flexneri 2a str. 301
acggaucuuuucuuu

SEQ ID NO: 2015272 - RNA, 17 nt, Shigella flexneri 2a str. 301
acggcaaaagaauauca

SEQ ID NO: 2015273 - RNA, 22 nt, Shigella flexneri 2a str. 301
acggauugcuuguucgaugccu

SEQ ID NO: 2015274 - RNA, 15 nt, Shigella flexneri 2a str. 301
acggccaaaaucucu

SEQ ID NO: 2015275 - RNA, 18 nt, Shigella flexneri 2a str. 301
acggcauuuugcugaugc

SEQ ID NO: 2015276 - RNA, 15 nt, Shigella flexneri 2a str. 301
acggccacucugccu

SEQ ID NO: 2015277 - RNA, 16 nt, Shigella flexneri 2a str. 301
acggccacagccagcc

SEQ ID NO: 2015278 - RNA, 17 nt, Shigella flexneri 2a str. 301
acggcaauucccagaau

SEQ ID NO: 2015279 - RNA, 19 nt, Shigella flexneri 2a str. 301
acggcaauucccagaaugu

SEQ ID NO: 2015280 - RNA, 21 nt, Shigella flexneri 2a str. 301
acggcaauuuuaccuagcacu

SEQ ID NO: 2015281 - RNA, 14 nt, Shigella flexneri 2a str. 301
acggcgagccagcg

SEQ ID NO: 2015282 - RNA, 18 nt, Shigella flexneri 2a str. 301
acggccugaccaugcuca

SEQ ID NO: 2015283 - RNA, 20 nt, Shigella flexneri 2a str. 301
acggccugaccaugcucaac

SEQ ID NO: 2015284 - RNA, 19 nt, Shigella flexneri 2a str. 301
acggccuucggugcgacaa

SEQ ID NO: 2015285 - RNA, 18 nt, Shigella flexneri 2a str. 301
acggcccugugccugcgu

SEQ ID NO: 2015286 - RNA, 22 nt, Shigella flexneri 2a str. 301
acggccgcacuuacagcaacgc

SEQ ID NO: 2015287 - RNA, 21 nt, Shigella flexneri 2a str. 301
acggaaagcagauaacccagc

SEQ ID NO: 2015288 - RNA, 15 nt, Shigella flexneri 2a str. 301
acgcuuaacaacccg

SEQ ID NO: 2015289 - RNA, 21 nt, Shigella flexneri 2a str. 301
acgcuuauaaauguguaauca

SEQ ID NO: 2015290 - RNA, 13 nt, Shigella flexneri 2a str. 301
acggaccaauaaa

SEQ ID NO: 2015291 - RNA, 15 nt, Shigella flexneri 2a str. 301
acggaacgaaaaaaa

SEQ ID NO: 2015292 - RNA, 15 nt, Shigella flexneri 2a str. 301
acggaauaaccagcg

SEQ ID NO: 2015293 - RNA, 13 nt, Shigella flexneri 2a str. 301
acgcuggcccagu

SEQ ID NO: 2015294 - RNA, 12 nt, Shigella flexneri 2a str. 301
acgcuggugagu

SEQ ID NO: 2015295 - RNA, 16 nt, Shigella flexneri 2a str. 301
acgcugcugccggcac

SEQ ID NO: 2015296 - RNA, 20 nt, Shigella flexneri 2a str. 301
acgcugcggucgaacauaca

SEQ ID NO: 2015297 - RNA, 14 nt, Shigella flexneri 2a str. 301
acgcugcucaaugg

SEQ ID NO: 2015298 - RNA, 23 nt, Shigella flexneri 2a str. 301
acgcaauuccagcaagccacugg

SEQ ID NO: 2015299 - RNA, 15 nt, Shigella flexneri 2a str. 301
acgcaauauccgcca

SEQ ID NO: 2015300 - RNA, 15 nt, Shigella flexneri 2a str. 301
acgcaaucaaaaaag

SEQ ID NO: 2015301 - RNA, 22 nt, Shigella flexneri 2a str. 301
acgcaacugccaguaaagcagc

SEQ ID NO: 2015302 - RNA, 17 nt, Shigella flexneri 2a str. 301
acggggugcgguaaaac

SEQ ID NO: 2015303 - RNA, 18 nt, Shigella flexneri 2a str. 301
acggggugcgguaaaacc

SEQ ID NO: 2015304 - RNA, 20 nt, Shigella flexneri 2a str. 301
acggguaaaacgugccauua

SEQ ID NO: 2015305 - RNA, 19 nt, Shigella flexneri 2a str. 301
acggggcugccagcucuca

SEQ ID NO: 2015306 - RNA, 16 nt, Shigella flexneri 2a str. 301
acggcggaaagggccg

SEQ ID NO: 2015307 - RNA, 20 nt, Shigella flexneri 2a str. 301
acgggcgauggaaccacaug

SEQ ID NO: 2015308 - RNA, 17 nt, Shigella flexneri 2a str. 301
acggcgggugacuuccc

SEQ ID NO: 2015309 - RNA, 16 nt, Shigella flexneri 2a str. 301
acgguaguugaacucg

SEQ ID NO: 2015310 - RNA, 21 nt, Shigella flexneri 2a str. 301
acgguacucaucacgucgccu

SEQ ID NO: 2015311 - RNA, 16 nt, Shigella flexneri 2a str. 301
acgguaauggcaaaga

SEQ ID NO: 2015312 - RNA, 18 nt, Shigella flexneri 2a str. 301
acgguaaguucacgcagg

SEQ ID NO: 2015313 - RNA, 22 nt, Shigella flexneri 2a str. 301
acgguucauuggguucaucuga

SEQ ID NO: 2015314 - RNA, 20 nt, Shigella flexneri 2a str. 301
acgguuuaucucaucuucca

SEQ ID NO: 2015315 - RNA, 15 nt, Shigella flexneri 2a str. 301
acgguuaaaaacagc

SEQ ID NO: 2015316 - RNA, 21 nt, Shigella flexneri 2a str. 301
acgguuaaaaacagccagcag

SEQ ID NO: 2015317 - RNA, 22 nt, Shigella flexneri 2a str. 301
acgguguaccggauaaauuuaa

SEQ ID NO: 2015318 - RNA, 13 nt, Shigella flexneri 2a str. 301
acguaaaaacccg

SEQ ID NO: 2015319 - RNA, 17 nt, Shigella flexneri 2a str. 301
acgguuuuuugaacaga

SEQ ID NO: 2015320 - RNA, 15 nt, Shigella flexneri 2a str. 301
acguaacaaaacuca

SEQ ID NO: 2015321 - RNA, 17 nt, Shigella flexneri 2a str. 301
acguaaccguugaccag

SEQ ID NO: 2015322 - RNA, 17 nt, Shigella flexneri 2a str. 301
acguaacgaccaccacc

SEQ ID NO: 2015323 - RNA, 13 nt, Shigella flexneri 2a str. 301
acguaacccacca

SEQ ID NO: 2015324 - RNA, 15 nt, Shigella flexneri 2a str. 301
acggugguaaagccg

SEQ ID NO: 2015325 - RNA, 12 nt, Shigella flexneri 2a str. 301
acggugcagcug

SEQ ID NO: 2015326 - RNA, 15 nt, Shigella flexneri 2a str. 301
acggugaacucacac

SEQ ID NO: 2015327 - RNA, 19 nt, Shigella flexneri 2a str. 301
acggugaacucacacagcg

SEQ ID NO: 2015328 - RNA, 23 nt, Shigella flexneri 2a str. 301
acggugaaaaaccaaucucccag

SEQ ID NO: 2015329 - RNA, 21 nt, Shigella flexneri 2a str. 301
acggucgaggcaaccagcacg

SEQ ID NO: 2015330 - RNA, 22 nt, Shigella flexneri 2a str. 301
acgguccuuaccaugcugcagu

SEQ ID NO: 2015331 - RNA, 13 nt, Shigella flexneri 2a str. 301
acgguccggcauc

SEQ ID NO: 2015332 - RNA, 14 nt, Shigella flexneri 2a str. 301
acggucacggcugu

SEQ ID NO: 2015333 - RNA, 15 nt, Shigella flexneri 2a str. 301
aggugguagcugccc

SEQ ID NO: 2015334 - RNA, 17 nt, Shigella flexneri 2a str. 301
aggugguagcugccccc

SEQ ID NO: 2015335 - RNA, 17 nt, Shigella flexneri 2a str. 301
aggugcucaaugagcac

SEQ ID NO: 2015336 - RNA, 21 nt, Shigella flexneri 2a str. 301
aggugcugaaagggcaaauaa

SEQ ID NO: 2015337 - RNA, 14 nt, Shigella flexneri 2a str. 301
aggugauacaucaa

SEQ ID NO: 2015338 - RNA, 14 nt, Shigella flexneri 2a str. 301
aggugacaucgugc

SEQ ID NO: 2015339 - RNA, 21 nt, Shigella flexneri 2a str. 301
aggugcagcccguaagcaaaa

SEQ ID NO: 2015340 - RNA, 20 nt, Shigella flexneri 2a str. 301
aggugcagcccguaagcaaa

SEQ ID NO: 2015341 - RNA, 14 nt, Shigella flexneri 2a str. 301
aggugcauugcugg

SEQ ID NO: 2015342 - RNA, 20 nt, Shigella flexneri 2a str. 301
aggucuuugacgucgaaacu

SEQ ID NO: 2015343 - RNA, 14 nt, Shigella flexneri 2a str. 301
aggucgugccagaa

SEQ ID NO: 2015344 - RNA, 17 nt, Shigella flexneri 2a str. 301
aggucguugggaggagg

SEQ ID NO: 2015345 - RNA, 15 nt, Shigella flexneri 2a str. 301
aggucgacagcagcc

SEQ ID NO: 2015346 - RNA, 14 nt, Shigella flexneri 2a str. 301
aggucgacagcagc

SEQ ID NO: 2015347 - RNA, 13 nt, Shigella flexneri 2a str. 301
agguccuccagcu

SEQ ID NO: 2015348 - RNA, 16 nt, Shigella flexneri 2a str. 301
aggucgaugcgcucgc

SEQ ID NO: 2015349 - RNA, 22 nt, Shigella flexneri 2a str. 301
aggucgagaacaacggcgaggu

SEQ ID NO: 2015350 - RNA, 21 nt, Shigella flexneri 2a str. 301
aggucgcccggauuacagcuc

SEQ ID NO: 2015351 - RNA, 18 nt, Shigella flexneri 2a str. 301
agguccccgagcacaugc

SEQ ID NO: 2015352 - RNA, 16 nt, Shigella flexneri 2a str. 301
agguccggauggcaaa

SEQ ID NO: 2015353 - RNA, 23 nt, Shigella flexneri 2a str. 301
agguaggcagucauaaaaucaau

SEQ ID NO: 2015354 - RNA, 22 nt, Shigella flexneri 2a str. 301
agguaguggucaggauuauguu

SEQ ID NO: 2015355 - RNA, 15 nt, Shigella flexneri 2a str. 301
agguacuuuugaaug

SEQ ID NO: 2015356 - RNA, 19 nt, Shigella flexneri 2a str. 301
agguacaaagccaacagca

SEQ ID NO: 2015357 - RNA, 20 nt, Shigella flexneri 2a str. 301
agguaccagcauuagcaaug

SEQ ID NO: 2015358 - RNA, 16 nt, Shigella flexneri 2a str. 301
agguacgcuccagcag

SEQ ID NO: 2015359 - RNA, 15 nt, Shigella flexneri 2a str. 301
agguauuuugucagc

SEQ ID NO: 2015360 - RNA, 13 nt, Shigella flexneri 2a str. 301
agguauuuuguca

SEQ ID NO: 2015361 - RNA, 16 nt, Shigella flexneri 2a str. 301
aggucaaccuagccuu

SEQ ID NO: 2015362 - RNA, 21 nt, Shigella flexneri 2a str. 301
aggucacagaagagagauaau

SEQ ID NO: 2015363 - RNA, 22 nt, Shigella flexneri 2a str. 301
aggucagcaggagcagccccug

SEQ ID NO: 2015364 - RNA, 20 nt, Shigella flexneri 2a str. 301
aggucagcaggagcagcccc

SEQ ID NO: 2015365 - RNA, 19 nt, Shigella flexneri 2a str. 301
aggucagcgccuggcugca

SEQ ID NO: 2015366 - RNA, 18 nt, Shigella flexneri 2a str. 301
agggugcagaaucaaucu

SEQ ID NO: 2015367 - RNA, 14 nt, Shigella flexneri 2a str. 301
agggugaucaccag

SEQ ID NO: 2015368 - RNA, 12 nt, Shigella flexneri 2a str. 301
aggguuaaaucu

SEQ ID NO: 2015369 - RNA, 23 nt, Shigella flexneri 2a str. 301
agggucuuccagcaaauccauca

SEQ ID NO: 2015370 - RNA, 21 nt, Shigella flexneri 2a str. 301
agggucuuccagcaaauccau

SEQ ID NO: 2015371 - RNA, 13 nt, Shigella flexneri 2a str. 301
agguaaaaccuga

SEQ ID NO: 2015372 - RNA, 22 nt, Shigella flexneri 2a str. 301
aggguuucggcuuuuuccugcc

SEQ ID NO: 2015373 - RNA, 22 nt, Shigella flexneri 2a str. 301
aggguuauuuguucagcaaaug

SEQ ID NO: 2015374 - RNA, 13 nt, Shigella flexneri 2a str. 301
agguaagcaaagg

SEQ ID NO: 2015375 - RNA, 20 nt, Shigella flexneri 2a str. 301
agguaaggauaaaaaagggu

SEQ ID NO: 2015376 - RNA, 23 nt, Shigella flexneri 2a str. 301
agguaaggcgcgagguuuuccuu

SEQ ID NO: 2015377 - RNA, 14 nt, Shigella flexneri 2a str. 301
agguaaacagaaau

SEQ ID NO: 2015378 - RNA, 16 nt, Shigella flexneri 2a str. 301
agguuucccgccguaa

SEQ ID NO: 2015379 - RNA, 13 nt, Shigella flexneri 2a str. 301
agguuuccggguc

SEQ ID NO: 2015380 - RNA, 15 nt, Shigella flexneri 2a str. 301
agguuuccucaugca

SEQ ID NO: 2015381 - RNA, 11 nt, Shigella flexneri 2a str. 301
agguuucugcc

SEQ ID NO: 2015382 - RNA, 15 nt, Shigella flexneri 2a str. 301
agguuuaccagcagc

SEQ ID NO: 2015383 - RNA, 18 nt, Shigella flexneri 2a str. 301
agguuucacguaccagau

SEQ ID NO: 2015384 - RNA, 16 nt, Shigella flexneri 2a str. 301
agguuuaaacagagau

SEQ ID NO: 2015385 - RNA, 17 nt, Shigella flexneri 2a str. 301
agguuuaaccaucaggc

SEQ ID NO: 2015386 - RNA, 19 nt, Shigella flexneri 2a str. 301
agguuguggcauuagauau

SEQ ID NO: 2015387 - RNA, 23 nt, Shigella flexneri 2a str. 301
agguuguuaaccaccaguaaauu

SEQ ID NO: 2015388 - RNA, 13 nt, Shigella flexneri 2a str. 301
agguuuuccuuca

SEQ ID NO: 2015389 - RNA, 19 nt, Shigella flexneri 2a str. 301
agguuuucuuucaccucuu

SEQ ID NO: 2015390 - RNA, 20 nt, Shigella flexneri 2a str. 301
agguuuucuuucaccucuuc

SEQ ID NO: 2015391 - RNA, 14 nt, Shigella flexneri 2a str. 301
agguuuuccuucag

SEQ ID NO: 2015392 - RNA, 16 nt, Shigella flexneri 2a str. 301
agguuuuucagcugcc

SEQ ID NO: 2015393 - RNA, 23 nt, Shigella flexneri 2a str. 301
aguaaaaaagaaggaaaauacag

SEQ ID NO: 2015394 - RNA, 12 nt, Shigella flexneri 2a str. 301
aguaaaaaagaa

SEQ ID NO: 2015395 - RNA, 16 nt, Shigella flexneri 2a str. 301
aguaaaaaaacaucau

SEQ ID NO: 2015396 - RNA, 17 nt, Shigella flexneri 2a str. 301
aguaaaaaaacaucaua

SEQ ID NO: 2015397 - RNA, 13 nt, Shigella flexneri 2a str. 301
aguaaauaaccau

SEQ ID NO: 2015398 - RNA, 14 nt, Shigella flexneri 2a str. 301
aguaaaggcacaag

SEQ ID NO: 2015399 - RNA, 14 nt, Shigella flexneri 2a str. 301
aguaaaggaacaag

SEQ ID NO: 2015400 - RNA, 15 nt, Shigella flexneri 2a str. 301
aguaaacgcuuuuuu

SEQ ID NO: 2015401 - RNA, 21 nt, Shigella flexneri 2a str. 301
aguaaacgccgagcuggaaca

SEQ ID NO: 2015402 - RNA, 14 nt, Shigella flexneri 2a str. 301
aggugucacaugca

SEQ ID NO: 2015403 - RNA, 16 nt, Shigella flexneri 2a str. 301
agguguauuguucugg

SEQ ID NO: 2015404 - RNA, 17 nt, Shigella flexneri 2a str. 301
agguuaaaguacucuuu

SEQ ID NO: 2015405 - RNA, 23 nt, Shigella flexneri 2a str. 301
aggugugggcaaucacuuugucg

SEQ ID NO: 2015406 - RNA, 21 nt, Shigella flexneri 2a str. 301
agguuaacucccccuuucuga

SEQ ID NO: 2015407 - RNA, 21 nt, Shigella flexneri 2a str. 301
agguuacgcaccagauaagca

SEQ ID NO: 2015408 - RNA, 17 nt, Shigella flexneri 2a str. 301
agguuaauauuuucgcc

SEQ ID NO: 2015409 - RNA, 15 nt, Shigella flexneri 2a str. 301
agguuauaaauaaaa

SEQ ID NO: 2015410 - RNA, 21 nt, Shigella flexneri 2a str. 301
agguuccacggaauauuucac

SEQ ID NO: 2015411 - RNA, 17 nt, Shigella flexneri 2a str. 301
agguuccaauauugguc

SEQ ID NO: 2015412 - RNA, 15 nt, Shigella flexneri 2a str. 301
agguugaacccuuuc

SEQ ID NO: 2015413 - RNA, 18 nt, Shigella flexneri 2a str. 301
aguaaucgccagcaaaau

SEQ ID NO: 2015414 - RNA, 19 nt, Shigella flexneri 2a str. 301
aguaaucaggcuaucuucg

SEQ ID NO: 2015415 - RNA, 19 nt, Shigella flexneri 2a str. 301
aguaaucacaucaaagucu

SEQ ID NO: 2015416 - RNA, 12 nt, Shigella flexneri 2a str. 301
aguaaugccagu

SEQ ID NO: 2015417 - RNA, 21 nt, Shigella flexneri 2a str. 301
aguaaugccggaggcaaguuu

SEQ ID NO: 2015418 - RNA, 16 nt, Shigella flexneri 2a str. 301
aguaaugcgcccaugc

SEQ ID NO: 2015419 - RNA, 16 nt, Shigella flexneri 2a str. 301
aguaaugcggcaaggg

SEQ ID NO: 2015420 - RNA, 21 nt, Shigella flexneri 2a str. 301
aguacaucguagugaugccau

SEQ ID NO: 2015421 - RNA, 16 nt, Shigella flexneri 2a str. 301
aguacaucuuccacuu

SEQ ID NO: 2015422 - RNA, 15 nt, Shigella flexneri 2a str. 301
aguaccaauggcaau

SEQ ID NO: 2015423 - RNA, 18 nt, Shigella flexneri 2a str. 301
aguacauuguuuuccaga

SEQ ID NO: 2015424 - RNA, 17 nt, Shigella flexneri 2a str. 301
aguacaugaagcacugc

SEQ ID NO: 2015425 - RNA, 18 nt, Shigella flexneri 2a str. 301
aguaccauugaagcaauc

SEQ ID NO: 2015426 - RNA, 21 nt, Shigella flexneri 2a str. 301
aguaccauuuucgcuggcaga

SEQ ID NO: 2015427 - RNA, 22 nt, Shigella flexneri 2a str. 301
aguacccgaugcgcgaacugga

SEQ ID NO: 2015428 - RNA, 19 nt, Shigella flexneri 2a str. 301
aguaccagcgcacucgcag

SEQ ID NO: 2015429 - RNA, 18 nt, Shigella flexneri 2a str. 301
aguaauaacuuccugagu

SEQ ID NO: 2015430 - RNA, 22 nt, Shigella flexneri 2a str. 301
aguaauaaugaucaguggaaga

SEQ ID NO: 2015431 - RNA, 21 nt, Shigella flexneri 2a str. 301
aguaagucuuccggugcauca

SEQ ID NO: 2015432 - RNA, 17 nt, Shigella flexneri 2a str. 301
aguaaggcgagaauauu

SEQ ID NO: 2015433 - RNA, 19 nt, Shigella flexneri 2a str. 301
aguaaggguuuuuuuaugc

SEQ ID NO: 2015434 - RNA, 23 nt, Shigella flexneri 2a str. 301
aguaaggguuuuuuuaugcccgc

SEQ ID NO: 2015435 - RNA, 17 nt, Shigella flexneri 2a str. 301
aguaagaauugauaaaa

SEQ ID NO: 2015436 - RNA, 22 nt, Shigella flexneri 2a str. 301
aguaacguuugauuaacgccag

SEQ ID NO: 2015437 - RNA, 17 nt, Shigella flexneri 2a str. 301
aguaacguuugauuaac

SEQ ID NO: 2015438 - RNA, 15 nt, Shigella flexneri 2a str. 301
aguaacccggcacca

SEQ ID NO: 2015439 - RNA, 19 nt, Shigella flexneri 2a str. 301
aguaaccgcuuuuucaauu

SEQ ID NO: 2015440 - RNA, 22 nt, Shigella flexneri 2a str. 301
aguaaccgcuuuuucaauuucc

SEQ ID NO: 2015441 - RNA, 22 nt, Shigella flexneri 2a str. 301
aguaaccuuuaucgcgcagcag

SEQ ID NO: 2015442 - RNA, 14 nt, Shigella flexneri 2a str. 301
aguaaccuuucaga

SEQ ID NO: 2015443 - RNA, 15 nt, Shigella flexneri 2a str. 301
aguaaccuuugaaca

SEQ ID NO: 2015444 - RNA, 15 nt, Shigella flexneri 2a str. 301
aguaacagguuuuga

SEQ ID NO: 2015445 - RNA, 17 nt, Shigella flexneri 2a str. 301
aguaacagucaguuauc

SEQ ID NO: 2015446 - RNA, 11 nt, Shigella flexneri 2a str. 301
aguaacaauau

SEQ ID NO: 2015447 - RNA, 18 nt, Shigella flexneri 2a str. 301
aguaaaugacagcgaaug

SEQ ID NO: 2015448 - RNA, 17 nt, Shigella flexneri 2a str. 301
aguaaauggugauauca

SEQ ID NO: 2015449 - RNA, 22 nt, Shigella flexneri 2a str. 301
aguaaauucacugccugcugau

SEQ ID NO: 2015450 - RNA, 20 nt, Shigella flexneri 2a str. 301
aggcucugauugccuuccac

SEQ ID NO: 2015451 - RNA, 19 nt, Shigella flexneri 2a str. 301
aggcuaucgaacaugcggg

SEQ ID NO: 2015452 - RNA, 13 nt, Shigella flexneri 2a str. 301
aggcuacucccag

SEQ ID NO: 2015453 - RNA, 20 nt, Shigella flexneri 2a str. 301
aggcucaaagacugugccau

SEQ ID NO: 2015454 - RNA, 23 nt, Shigella flexneri 2a str. 301
aggcuaauaccgucgaugccaau

SEQ ID NO: 2015455 - RNA, 23 nt, Shigella flexneri 2a str. 301
aggcguuuugcagauucagccac

SEQ ID NO: 2015456 - RNA, 15 nt, Shigella flexneri 2a str. 301
aggcguucacgccgc

SEQ ID NO: 2015457 - RNA, 13 nt, Shigella flexneri 2a str. 301
aggcguuucaacu

SEQ ID NO: 2015458 - RNA, 19 nt, Shigella flexneri 2a str. 301
aggcguuugaaaaagccaa

SEQ ID NO: 2015459 - RNA, 21 nt, Shigella flexneri 2a str. 301
aggcguuuguaacccaccaug

SEQ ID NO: 2015460 - RNA, 19 nt, Shigella flexneri 2a str. 301
aggcguuuacccuucgcac

SEQ ID NO: 2015461 - RNA, 19 nt, Shigella flexneri 2a str. 301
aggcguugauuggcgcagg

SEQ ID NO: 2015462 - RNA, 20 nt, Shigella flexneri 2a str. 301
aggcgugaucuccuuggaga

SEQ ID NO: 2015463 - RNA, 14 nt, Shigella flexneri 2a str. 301
aggcguuaaaacag

SEQ ID NO: 2015464 - RNA, 22 nt, Shigella flexneri 2a str. 301
aggcggguuaaaaacauuuuca

SEQ ID NO: 2015465 - RNA, 23 nt, Shigella flexneri 2a str. 301
aggcggguuaaaaacauuuucau

SEQ ID NO: 2015466 - RNA, 19 nt, Shigella flexneri 2a str. 301
aggcguaauuuccacgcca

SEQ ID NO: 2015467 - RNA, 21 nt, Shigella flexneri 2a str. 301
aggcggcucaccugcacacca

SEQ ID NO: 2015468 - RNA, 15 nt, Shigella flexneri 2a str. 301
aggcggcgcaucggu

SEQ ID NO: 2015469 - RNA, 21 nt, Shigella flexneri 2a str. 301
aggcgcugguaaucaccaccc

SEQ ID NO: 2015470 - RNA, 21 nt, Shigella flexneri 2a str. 301
aggcgcugaaggcacagaaaa

SEQ ID NO: 2015471 - RNA, 14 nt, Shigella flexneri 2a str. 301
aggcgcuggguaaa

SEQ ID NO: 2015472 - RNA, 13 nt, Shigella flexneri 2a str. 301
aggcgcuggcaga

SEQ ID NO: 2015473 - RNA, 21 nt, Shigella flexneri 2a str. 301
aggcgcugaaagaagcgguga

SEQ ID NO: 2015474 - RNA, 21 nt, Shigella flexneri 2a str. 301
aggcgcuugucgucccaggca

SEQ ID NO: 2015475 - RNA, 14 nt, Shigella flexneri 2a str. 301
aggcgcuaaaagca

SEQ ID NO: 2015476 - RNA, 16 nt, Shigella flexneri 2a str. 301
aggcgacgaauagcau

SEQ ID NO: 2015477 - RNA, 21 nt, Shigella flexneri 2a str. 301
aggcgagaucggcaggcaggu

SEQ ID NO: 2015478 - RNA, 19 nt, Shigella flexneri 2a str. 301
aggcgaggcggacugaaua

SEQ ID NO: 2015479 - RNA, 15 nt, Shigella flexneri 2a str. 301
aggcgagcgcggcug

SEQ ID NO: 2015480 - RNA, 18 nt, Shigella flexneri 2a str. 301
aggcgaggggaccgcccc

SEQ ID NO: 2015481 - RNA, 21 nt, Shigella flexneri 2a str. 301
aggcgacauaucauuuugcug

SEQ ID NO: 2015482 - RNA, 17 nt, Shigella flexneri 2a str. 301
aggcgaccguuuucacc

SEQ ID NO: 2015483 - RNA, 14 nt, Shigella flexneri 2a str. 301
aggcgaaugcguuu

SEQ ID NO: 2015484 - RNA, 22 nt, Shigella flexneri 2a str. 301
aggccuugaacucugaaucgcu

SEQ ID NO: 2015485 - RNA, 13 nt, Shigella flexneri 2a str. 301
aggcgaacaugcg

SEQ ID NO: 2015486 - RNA, 15 nt, Shigella flexneri 2a str. 301
aggccuggacucuua

SEQ ID NO: 2015487 - RNA, 14 nt, Shigella flexneri 2a str. 301
aggccugauaagug

SEQ ID NO: 2015488 - RNA, 22 nt, Shigella flexneri 2a str. 301
aggcgcauugcuggcugcggga

SEQ ID NO: 2015489 - RNA, 20 nt, Shigella flexneri 2a str. 301
aggcgcacgccgacaaagau

SEQ ID NO: 2015490 - RNA, 13 nt, Shigella flexneri 2a str. 301
aggcgcagaacuu

SEQ ID NO: 2015491 - RNA, 16 nt, Shigella flexneri 2a str. 301
aggcgcagauacagcc

SEQ ID NO: 2015492 - RNA, 21 nt, Shigella flexneri 2a str. 301
aggcgcaauguugcgggggcu

SEQ ID NO: 2015493 - RNA, 22 nt, Shigella flexneri 2a str. 301
aggcgcaacauauuccgcaccu

SEQ ID NO: 2015494 - RNA, 16 nt, Shigella flexneri 2a str. 301
aggcgaugaaauucac

SEQ ID NO: 2015495 - RNA, 14 nt, Shigella flexneri 2a str. 301
aggcgaucuucccg

SEQ ID NO: 2015496 - RNA, 14 nt, Shigella flexneri 2a str. 301
aggcgauguucugg

SEQ ID NO: 2015497 - RNA, 20 nt, Shigella flexneri 2a str. 301
aggccuacauuggugccgga

SEQ ID NO: 2015498 - RNA, 23 nt, Shigella flexneri 2a str. 301
aggccugagaagcgcaacgcauc

SEQ ID NO: 2015499 - RNA, 18 nt, Shigella flexneri 2a str. 301
aggccguccgcucaagaa

SEQ ID NO: 2015500 - RNA, 14 nt, Shigella flexneri 2a str. 301
aggccgcuuucuga

SEQ ID NO: 2015501 - RNA, 23 nt, Shigella flexneri 2a str. 301
aggccgccaguguuggcgucaga

SEQ ID NO: 2015502 - RNA, 14 nt, Shigella flexneri 2a str. 301
agggcaauuaaaaa

SEQ ID NO: 2015503 - RNA, 21 nt, Shigella flexneri 2a str. 301
agggcaauaaucucuacacca

SEQ ID NO: 2015504 - RNA, 22 nt, Shigella flexneri 2a str. 301
agggcacuuuuauccugucagu

SEQ ID NO: 2015505 - RNA, 17 nt, Shigella flexneri 2a str. 301
agggcaucaagaaugcu

SEQ ID NO: 2015506 - RNA, 11 nt, Shigella flexneri 2a str. 301
agggcauggcg

SEQ ID NO: 2015507 - RNA, 16 nt, Shigella flexneri 2a str. 301
agggcaucgcaggcca

SEQ ID NO: 2015508 - RNA, 14 nt, Shigella flexneri 2a str. 301
agggcggcaggcag

SEQ ID NO: 2015509 - RNA, 16 nt, Shigella flexneri 2a str. 301
agggcgauuagcagca

SEQ ID NO: 2015510 - RNA, 20 nt, Shigella flexneri 2a str. 301
agggcgauuagcagcaugau

SEQ ID NO: 2015511 - RNA, 13 nt, Shigella flexneri 2a str. 301
aggguaaaaggau

SEQ ID NO: 2015512 - RNA, 15 nt, Shigella flexneri 2a str. 301
aggggcguccagaug

SEQ ID NO: 2015513 - RNA, 14 nt, Shigella flexneri 2a str. 301
aggggcuuucccgu

SEQ ID NO: 2015514 - RNA, 18 nt, Shigella flexneri 2a str. 301
agggcuacaaguccggga

SEQ ID NO: 2015515 - RNA, 17 nt, Shigella flexneri 2a str. 301
agggcuaucuggagaua

SEQ ID NO: 2015516 - RNA, 17 nt, Shigella flexneri 2a str. 301
agggcuaacgugcaggu

SEQ ID NO: 2015517 - RNA, 16 nt, Shigella flexneri 2a str. 301
agggcuuacugaaaau

SEQ ID NO: 2015518 - RNA, 13 nt, Shigella flexneri 2a str. 301
aggggacauuuag

SEQ ID NO: 2015519 - RNA, 21 nt, Shigella flexneri 2a str. 301
aggcuggcuuuaucacugagu

SEQ ID NO: 2015520 - RNA, 20 nt, Shigella flexneri 2a str. 301
aggcuggcuuuaucacugag

SEQ ID NO: 2015521 - RNA, 15 nt, Shigella flexneri 2a str. 301
aggcugguuucucuu

SEQ ID NO: 2015522 - RNA, 20 nt, Shigella flexneri 2a str. 301
aggcugccagaucaucguuu

SEQ ID NO: 2015523 - RNA, 13 nt, Shigella flexneri 2a str. 301
aggcuuagcgcaa

SEQ ID NO: 2015524 - RNA, 16 nt, Shigella flexneri 2a str. 301
aggcuguucccacgca

SEQ ID NO: 2015525 - RNA, 21 nt, Shigella flexneri 2a str. 301
aggcuguuuuuuauacuugca

SEQ ID NO: 2015526 - RNA, 15 nt, Shigella flexneri 2a str. 301
aggcuucaaucaaua

SEQ ID NO: 2015527 - RNA, 18 nt, Shigella flexneri 2a str. 301
aggcuucaaucaauaaca

SEQ ID NO: 2015528 - RNA, 16 nt, Shigella flexneri 2a str. 301
aggcuucccaauugca

SEQ ID NO: 2015529 - RNA, 13 nt, Shigella flexneri 2a str. 301
aggcuugcugcau

SEQ ID NO: 2015530 - RNA, 21 nt, Shigella flexneri 2a str. 301
aggcuuugccuccccaacaua

SEQ ID NO: 2015531 - RNA, 14 nt, Shigella flexneri 2a str. 301
aggcuugcugaugc

SEQ ID NO: 2015532 - RNA, 13 nt, Shigella flexneri 2a str. 301
agggauauuucac

SEQ ID NO: 2015533 - RNA, 14 nt, Shigella flexneri 2a str. 301
agggcaaacaccgc

SEQ ID NO: 2015534 - RNA, 14 nt, Shigella flexneri 2a str. 301
agggcaaacagcac

SEQ ID NO: 2015535 - RNA, 15 nt, Shigella flexneri 2a str. 301
agggauugugcaggc

SEQ ID NO: 2015536 - RNA, 18 nt, Shigella flexneri 2a str. 301
agggaugaaauagacauu

SEQ ID NO: 2015537 - RNA, 15 nt, Shigella flexneri 2a str. 301
agggaagcgaguuac

SEQ ID NO: 2015538 - RNA, 13 nt, Shigella flexneri 2a str. 301
agggaauccagca

SEQ ID NO: 2015539 - RNA, 20 nt, Shigella flexneri 2a str. 301
aggcuuuuacgcauugcuca

SEQ ID NO: 2015540 - RNA, 21 nt, Shigella flexneri 2a str. 301
agggaaagagcgauccguuca

SEQ ID NO: 2015541 - RNA, 17 nt, Shigella flexneri 2a str. 301
agggaaaugaggaauua

SEQ ID NO: 2015542 - RNA, 12 nt, Shigella flexneri 2a str. 301
agcuaauuuuug

SEQ ID NO: 2015543 - RNA, 17 nt, Shigella flexneri 2a str. 301
agcucaaucaacuccau

SEQ ID NO: 2015544 - RNA, 16 nt, Shigella flexneri 2a str. 301
agcucaauaaaagaaa

SEQ ID NO: 2015545 - RNA, 17 nt, Shigella flexneri 2a str. 301
agcuauucuuauaaaga

SEQ ID NO: 2015546 - RNA, 19 nt, Shigella flexneri 2a str. 301
agcucaaacgaaugcaggc

SEQ ID NO: 2015547 - RNA, 20 nt, Shigella flexneri 2a str. 301
agcguuacgccccaacacaa

SEQ ID NO: 2015548 - RNA, 14 nt, Shigella flexneri 2a str. 301
agcguguugcggag

SEQ ID NO: 2015549 - RNA, 17 nt, Shigella flexneri 2a str. 301
agcuaacagagccgcga

SEQ ID NO: 2015550 - RNA, 21 nt, Shigella flexneri 2a str. 301
agcuaacgaaaauggccugau

SEQ ID NO: 2015551 - RNA, 16 nt, Shigella flexneri 2a str. 301
agcuaacgaaagaaca

SEQ ID NO: 2015552 - RNA, 23 nt, Shigella flexneri 2a str. 301
agcuaacgaaagaacaguuaaca

SEQ ID NO: 2015553 - RNA, 21 nt, Shigella flexneri 2a str. 301
agcuaaugcaaaucacgcugc

SEQ ID NO: 2015554 - RNA, 20 nt, Shigella flexneri 2a str. 301
agcuaaucaucaucagugcu

SEQ ID NO: 2015555 - RNA, 14 nt, Shigella flexneri 2a str. 301
agcguggucauggc

SEQ ID NO: 2015556 - RNA, 11 nt, Shigella flexneri 2a str. 301
agcgugcuggu

SEQ ID NO: 2015557 - RNA, 23 nt, Shigella flexneri 2a str. 301
agcguggaacuugacgaucugcu

SEQ ID NO: 2015558 - RNA, 23 nt, Shigella flexneri 2a str. 301
agcgucugcuccuccuucucacc

SEQ ID NO: 2015559 - RNA, 16 nt, Shigella flexneri 2a str. 301
agcgucugagcaggcg

SEQ ID NO: 2015560 - RNA, 19 nt, Shigella flexneri 2a str. 301
agcgucuggaagaaguaaa

SEQ ID NO: 2015561 - RNA, 16 nt, Shigella flexneri 2a str. 301
agcguauccagcauac

SEQ ID NO: 2015562 - RNA, 17 nt, Shigella flexneri 2a str. 301
agcguagcgcaucaggc

SEQ ID NO: 2015563 - RNA, 13 nt, Shigella flexneri 2a str. 301
agcggggaacacc

SEQ ID NO: 2015564 - RNA, 16 nt, Shigella flexneri 2a str. 301
agcgggcgcgcaggcg

SEQ ID NO: 2015565 - RNA, 19 nt, Shigella flexneri 2a str. 301
agcggugaaaaaauuaaac

SEQ ID NO: 2015566 - RNA, 19 nt, Shigella flexneri 2a str. 301
agcguacaauagccacauu

SEQ ID NO: 2015567 - RNA, 15 nt, Shigella flexneri 2a str. 301
agcgguggugacugg

SEQ ID NO: 2015568 - RNA, 20 nt, Shigella flexneri 2a str. 301
agcgguguacccugcucgcu

SEQ ID NO: 2015569 - RNA, 16 nt, Shigella flexneri 2a str. 301
agcggcguaucuucca

SEQ ID NO: 2015570 - RNA, 19 nt, Shigella flexneri 2a str. 301
agcggcggucuucucaccg

SEQ ID NO: 2015571 - RNA, 16 nt, Shigella flexneri 2a str. 301
agcggcgggcuuuaau

SEQ ID NO: 2015572 - RNA, 23 nt, Shigella flexneri 2a str. 301
agcggcguuuuguagagcagcac

SEQ ID NO: 2015573 - RNA, 16 nt, Shigella flexneri 2a str. 301
agcggcugccagcaug

SEQ ID NO: 2015574 - RNA, 16 nt, Shigella flexneri 2a str. 301
agcggcuuccaccgcc

SEQ ID NO: 2015575 - RNA, 20 nt, Shigella flexneri 2a str. 301
agcggaaauuaccgcaccac

SEQ ID NO: 2015576 - RNA, 16 nt, Shigella flexneri 2a str. 301
agcggaauauuuuuac

SEQ ID NO: 2015577 - RNA, 17 nt, Shigella flexneri 2a str. 301
agcggaaaucuccagau

SEQ ID NO: 2015578 - RNA, 12 nt, Shigella flexneri 2a str. 301
agcggaaaucuc

SEQ ID NO: 2015579 - RNA, 13 nt, Shigella flexneri 2a str. 301
agcggaaaucacg

SEQ ID NO: 2015580 - RNA, 17 nt, Shigella flexneri 2a str. 301
agcgcuuuuuuccugcc

SEQ ID NO: 2015581 - RNA, 21 nt, Shigella flexneri 2a str. 301
agcggacucaccgagcagcac

SEQ ID NO: 2015582 - RNA, 17 nt, Shigella flexneri 2a str. 301
agcgcggcgcaggcaau

SEQ ID NO: 2015583 - RNA, 20 nt, Shigella flexneri 2a str. 301
agcgcugcggcgcgcaucuu

SEQ ID NO: 2015584 - RNA, 19 nt, Shigella flexneri 2a str. 301
agcgcugcugcacauacug

SEQ ID NO: 2015585 - RNA, 22 nt, Shigella flexneri 2a str. 301
agcgcuggugacaucgccagag

SEQ ID NO: 2015586 - RNA, 23 nt, Shigella flexneri 2a str. 301
agcgcuggugacaucgccagaga

SEQ ID NO: 2015587 - RNA, 19 nt, Shigella flexneri 2a str. 301
agcgcuggugacaucgcca

SEQ ID NO: 2015588 - RNA, 19 nt, Shigella flexneri 2a str. 301
agcgcggggaucacuggca

SEQ ID NO: 2015589 - RNA, 18 nt, Shigella flexneri 2a str. 301
agcgcugacgugauuuag

SEQ ID NO: 2015590 - RNA, 15 nt, Shigella flexneri 2a str. 301
agcgcugagacgcgc

SEQ ID NO: 2015591 - RNA, 19 nt, Shigella flexneri 2a str. 301
agcgcgcaguuugucuuca

SEQ ID NO: 2015592 - RNA, 23 nt, Shigella flexneri 2a str. 301
agauugguaaugcguaacguuuc

SEQ ID NO: 2015593 - RNA, 23 nt, Shigella flexneri 2a str. 301
agauuggucaguaagccuuucag

SEQ ID NO: 2015594 - RNA, 13 nt, Shigella flexneri 2a str. 301
agcgcgcugacau

SEQ ID NO: 2015595 - RNA, 20 nt, Shigella flexneri 2a str. 301
agcgcgcgaauauggcggcg

SEQ ID NO: 2015596 - RNA, 12 nt, Shigella flexneri 2a str. 301
agcucagugacc

SEQ ID NO: 2015597 - RNA, 19 nt, Shigella flexneri 2a str. 301
agcucguuuacaaccugau

SEQ ID NO: 2015598 - RNA, 11 nt, Shigella flexneri 2a str. 301
agcucaucguu

SEQ ID NO: 2015599 - RNA, 15 nt, Shigella flexneri 2a str. 301
agcucaucuaaugca

SEQ ID NO: 2015600 - RNA, 16 nt, Shigella flexneri 2a str. 301
agcucauauuugcugg

SEQ ID NO: 2015601 - RNA, 17 nt, Shigella flexneri 2a str. 301
agcucucuuccaguucg

SEQ ID NO: 2015602 - RNA, 18 nt, Shigella flexneri 2a str. 301
agcucucagacgauuacu

SEQ ID NO: 2015603 - RNA, 16 nt, Shigella flexneri 2a str. 301
agcucuuuuccagcca

SEQ ID NO: 2015604 - RNA, 11 nt, Shigella flexneri 2a str. 301
agcucugccac

SEQ ID NO: 2015605 - RNA, 16 nt, Shigella flexneri 2a str. 301
agcucugauauucccg

SEQ ID NO: 2015606 - RNA, 15 nt, Shigella flexneri 2a str. 301
agcucuuuuccagcc

SEQ ID NO: 2015607 - RNA, 18 nt, Shigella flexneri 2a str. 301
agcugaagcucguuguuu

SEQ ID NO: 2015608 - RNA, 22 nt, Shigella flexneri 2a str. 301
agcugaauaucacgggcgcgga

SEQ ID NO: 2015609 - RNA, 16 nt, Shigella flexneri 2a str. 301
agcugaaaaucagauc

SEQ ID NO: 2015610 - RNA, 17 nt, Shigella flexneri 2a str. 301
agcugaagcucguuguu

SEQ ID NO: 2015611 - RNA, 12 nt, Shigella flexneri 2a str. 301
agcugcccggcu

SEQ ID NO: 2015612 - RNA, 14 nt, Shigella flexneri 2a str. 301
agcugccgccaggc

SEQ ID NO: 2015613 - RNA, 21 nt, Shigella flexneri 2a str. 301
agcugaauuucaucaccagcu

SEQ ID NO: 2015614 - RNA, 23 nt, Shigella flexneri 2a str. 301
agcugcauuucauauucaaaauc

SEQ ID NO: 2015615 - RNA, 22 nt, Shigella flexneri 2a str. 301
agcugcauccgggguucgaauc

SEQ ID NO: 2015616 - RNA, 15 nt, Shigella flexneri 2a str. 301
agcuguaucccagcc

SEQ ID NO: 2015617 - RNA, 15 nt, Shigella flexneri 2a str. 301
agcugucgaaaagau

SEQ ID NO: 2015618 - RNA, 13 nt, Shigella flexneri 2a str. 301
agcuguccgauuu

SEQ ID NO: 2015619 - RNA, 21 nt, Shigella flexneri 2a str. 301
agcugguucucgcuucugagc

SEQ ID NO: 2015620 - RNA, 23 nt, Shigella flexneri 2a str. 301
agcuguuuauuuauacagugagu

SEQ ID NO: 2015621 - RNA, 14 nt, Shigella flexneri 2a str. 301
agcuguuguaauga

SEQ ID NO: 2015622 - RNA, 21 nt, Shigella flexneri 2a str. 301
agcugugggguauuuccaggg

SEQ ID NO: 2015623 - RNA, 11 nt, Shigella flexneri 2a str. 301
agcugugccug

SEQ ID NO: 2015624 - RNA, 23 nt, Shigella flexneri 2a str. 301
agcuggaaaaucuacguuaaaaa

SEQ ID NO: 2015625 - RNA, 18 nt, Shigella flexneri 2a str. 301
agcuggcucgacaaaaug

SEQ ID NO: 2015626 - RNA, 19 nt, Shigella flexneri 2a str. 301
agcuggcucgacaaaauga

SEQ ID NO: 2015627 - RNA, 11 nt, Shigella flexneri 2a str. 301
agcugguaacc

SEQ ID NO: 2015628 - RNA, 20 nt, Shigella flexneri 2a str. 301
agcugggcgauuuucuacuu

SEQ ID NO: 2015629 - RNA, 22 nt, Shigella flexneri 2a str. 301
agcugggccguuguucucgacg

SEQ ID NO: 2015630 - RNA, 24 nt, Shigella flexneri 2a str. 301
agcuuacgcugauauucgacacca

SEQ ID NO: 2015631 - RNA, 22 nt, Shigella flexneri 2a str. 301
agcuuaccguccucuucccaga

SEQ ID NO: 2015632 - RNA, 19 nt, Shigella flexneri 2a str. 301
agcuuacguuacccagcac

SEQ ID NO: 2015633 - RNA, 20 nt, Shigella flexneri 2a str. 301
agcuuacguuacccagcacg

SEQ ID NO: 2015634 - RNA, 18 nt, Shigella flexneri 2a str. 301
agcuuaaucaccagcgca

SEQ ID NO: 2015635 - RNA, 14 nt, Shigella flexneri 2a str. 301
agcuuauccagcaa

SEQ ID NO: 2015636 - RNA, 20 nt, Shigella flexneri 2a str. 301
agcuuaccguccucuuccca

SEQ ID NO: 2015637 - RNA, 20 nt, Shigella flexneri 2a str. 301
agcuuaucuguucagcaaaa

SEQ ID NO: 2015638 - RNA, 21 nt, Shigella flexneri 2a str. 301
agcuucaaauagugccuggcu

SEQ ID NO: 2015639 - RNA, 19 nt, Shigella flexneri 2a str. 301
agcuuauuuguugagcugg

SEQ ID NO: 2015640 - RNA, 21 nt, Shigella flexneri 2a str. 301
agcuucacaaaggcuugcugc

SEQ ID NO: 2015641 - RNA, 12 nt, Shigella flexneri 2a str. 301
agcuucacccgc

SEQ ID NO: 2015642 - RNA, 21 nt, Shigella flexneri 2a str. 301
agcuucacgcgccagcuuagu

SEQ ID NO: 2015643 - RNA, 18 nt, Shigella flexneri 2a str. 301
agcuucaucaucgcagau

SEQ ID NO: 2015644 - RNA, 14 nt, Shigella flexneri 2a str. 301
agcuucacuuucag

SEQ ID NO: 2015645 - RNA, 14 nt, Shigella flexneri 2a str. 301
agcuucccaaagau

SEQ ID NO: 2015646 - RNA, 18 nt, Shigella flexneri 2a str. 301
agcuucuuauccagcugc

SEQ ID NO: 2015647 - RNA, 21 nt, Shigella flexneri 2a str. 301
agcuucuucaaaaaagucaga

SEQ ID NO: 2015648 - RNA, 20 nt, Shigella flexneri 2a str. 301
agcuuuauccugcccacucc

SEQ ID NO: 2015649 - RNA, 15 nt, Shigella flexneri 2a str. 301
agcuuuaucccuucg

SEQ ID NO: 2015650 - RNA, 14 nt, Shigella flexneri 2a str. 301
agcuuucauuucaa

SEQ ID NO: 2015651 - RNA, 15 nt, Shigella flexneri 2a str. 301
agcuuuccacgcagg

SEQ ID NO: 2015652 - RNA, 16 nt, Shigella flexneri 2a str. 301
agcuuucgaccagcca

SEQ ID NO: 2015653 - RNA, 20 nt, Shigella flexneri 2a str. 301
agcuuguuugaagucaacgc

SEQ ID NO: 2015654 - RNA, 21 nt, Shigella flexneri 2a str. 301
agcuuugugcuucaguuccug

SEQ ID NO: 2015655 - RNA, 17 nt, Shigella flexneri 2a str. 301
agcuuugcgccucgcca

SEQ ID NO: 2015656 - RNA, 20 nt, Shigella flexneri 2a str. 301
agcuuuuccauaucaagcau

SEQ ID NO: 2015657 - RNA, 18 nt, Shigella flexneri 2a str. 301
agcuugcuuuccagcuuc

SEQ ID NO: 2015658 - RNA, 17 nt, Shigella flexneri 2a str. 301
agcuugugcaccagcug

SEQ ID NO: 2015659 - RNA, 16 nt, Shigella flexneri 2a str. 301
agcuugcgauccugca

SEQ ID NO: 2015660 - RNA, 14 nt, Shigella flexneri 2a str. 301
agcuugcgauccug

SEQ ID NO: 2015661 - RNA, 19 nt, Shigella flexneri 2a str. 301
agcuugccgcgcucugcca

SEQ ID NO: 2015662 - RNA, 20 nt, Shigella flexneri 2a str. 301
agcuugcguguuuuauauaa

SEQ ID NO: 2015663 - RNA, 14 nt, Shigella flexneri 2a str. 301
aggacguuaaagaa

SEQ ID NO: 2015664 - RNA, 15 nt, Shigella flexneri 2a str. 301
aggacguuaaagaaa

SEQ ID NO: 2015665 - RNA, 18 nt, Shigella flexneri 2a str. 301
aggaccgguuucaaaacu

SEQ ID NO: 2015666 - RNA, 18 nt, Shigella flexneri 2a str. 301
aggagacacgcugccccu

SEQ ID NO: 2015667 - RNA, 16 nt, Shigella flexneri 2a str. 301
aggagaaugggauggu

SEQ ID NO: 2015668 - RNA, 20 nt, Shigella flexneri 2a str. 301
aggacuauuuuaagaauaga

SEQ ID NO: 2015669 - RNA, 20 nt, Shigella flexneri 2a str. 301
aggagaguaugcgcgucaga

SEQ ID NO: 2015670 - RNA, 20 nt, Shigella flexneri 2a str. 301
aggagccaacacuuucacua

SEQ ID NO: 2015671 - RNA, 17 nt, Shigella flexneri 2a str. 301
aggagcacgccuggaaa

SEQ ID NO: 2015672 - RNA, 20 nt, Shigella flexneri 2a str. 301
aggagcacgccuggaaagug

SEQ ID NO: 2015673 - RNA, 23 nt, Shigella flexneri 2a str. 301
aggagaugcccgacuugagcgca

SEQ ID NO: 2015674 - RNA, 22 nt, Shigella flexneri 2a str. 301
aggauaggcuucuauaccaaug

SEQ ID NO: 2015675 - RNA, 14 nt, Shigella flexneri 2a str. 301
aggauacuuaucug

SEQ ID NO: 2015676 - RNA, 13 nt, Shigella flexneri 2a str. 301
aggaucagaauuc

SEQ ID NO: 2015677 - RNA, 17 nt, Shigella flexneri 2a str. 301
aggauauguaagcagaa

SEQ ID NO: 2015678 - RNA, 19 nt, Shigella flexneri 2a str. 301
aggagcgauuaugaaacaa

SEQ ID NO: 2015679 - RNA, 20 nt, Shigella flexneri 2a str. 301
aggaggcguaauuuccacgc

SEQ ID NO: 2015680 - RNA, 18 nt, Shigella flexneri 2a str. 301
aggaggcguaauuuccac

SEQ ID NO: 2015681 - RNA, 21 nt, Shigella flexneri 2a str. 301
aggauaaaaaagggugcugca

SEQ ID NO: 2015682 - RNA, 17 nt, Shigella flexneri 2a str. 301
aggaguuuaauaaauuu

SEQ ID NO: 2015683 - RNA, 15 nt, Shigella flexneri 2a str. 301
aggauaaauuuucug

SEQ ID NO: 2015684 - RNA, 18 nt, Shigella flexneri 2a str. 301
aggaacagaagaaagcaa

SEQ ID NO: 2015685 - RNA, 18 nt, Shigella flexneri 2a str. 301
aggaaauuaccgcaaagc

SEQ ID NO: 2015686 - RNA, 17 nt, Shigella flexneri 2a str. 301
aggaaauguuccggguu

SEQ ID NO: 2015687 - RNA, 20 nt, Shigella flexneri 2a str. 301
aggaacgaucccagcgugga

SEQ ID NO: 2015688 - RNA, 21 nt, Shigella flexneri 2a str. 301
aggaacgggauugccagcaua

SEQ ID NO: 2015689 - RNA, 15 nt, Shigella flexneri 2a str. 301
aggaacggcauuuac

SEQ ID NO: 2015690 - RNA, 22 nt, Shigella flexneri 2a str. 301
aggaaaaaaauuaacgcagaau

SEQ ID NO: 2015691 - RNA, 13 nt, Shigella flexneri 2a str. 301
aggaaaaaaauua

SEQ ID NO: 2015692 - RNA, 15 nt, Shigella flexneri 2a str. 301
aggaaaacuacaggc

SEQ ID NO: 2015693 - RNA, 15 nt, Shigella flexneri 2a str. 301
agcuuuuuauagcaa

SEQ ID NO: 2015694 - RNA, 19 nt, Shigella flexneri 2a str. 301
agcuuuuuaaucgccaucu

SEQ ID NO: 2015695 - RNA, 16 nt, Shigella flexneri 2a str. 301
agcuuuucucaauaua

SEQ ID NO: 2015696 - RNA, 11 nt, Shigella flexneri 2a str. 301
aggaaauaaau

SEQ ID NO: 2015697 - RNA, 13 nt, Shigella flexneri 2a str. 301
aggaaaguaaauu

SEQ ID NO: 2015698 - RNA, 19 nt, Shigella flexneri 2a str. 301
aggaaacccaacgcaaaga

SEQ ID NO: 2015699 - RNA, 17 nt, Shigella flexneri 2a str. 301
aggaaacuaaacgccgc

SEQ ID NO: 2015700 - RNA, 14 nt, Shigella flexneri 2a str. 301
aggaaacuccagcc

SEQ ID NO: 2015701 - RNA, 14 nt, Shigella flexneri 2a str. 301
aggaaucaggcagg

SEQ ID NO: 2015702 - RNA, 14 nt, Shigella flexneri 2a str. 301
aggaaucagauacu

SEQ ID NO: 2015703 - RNA, 19 nt, Shigella flexneri 2a str. 301
aggaaucugauuacuuccu

SEQ ID NO: 2015704 - RNA, 22 nt, Shigella flexneri 2a str. 301
aggaaucauuguuauaucaauu

SEQ ID NO: 2015705 - RNA, 13 nt, Shigella flexneri 2a str. 301
aggacacagaaug

SEQ ID NO: 2015706 - RNA, 16 nt, Shigella flexneri 2a str. 301
aggaauguggcaauga

SEQ ID NO: 2015707 - RNA, 20 nt, Shigella flexneri 2a str. 301
aggaauucagaaaaauacaa

SEQ ID NO: 2015708 - RNA, 22 nt, Shigella flexneri 2a str. 301
aggaagccggaauuuuccuucg

SEQ ID NO: 2015709 - RNA, 21 nt, Shigella flexneri 2a str. 301
aggaagcgacccgguucaauu

SEQ ID NO: 2015710 - RNA, 17 nt, Shigella flexneri 2a str. 301
aggaaggcaagaaagcg

SEQ ID NO: 2015711 - RNA, 19 nt, Shigella flexneri 2a str. 301
aggaaguuaagaucagaag

SEQ ID NO: 2015712 - RNA, 18 nt, Shigella flexneri 2a str. 301
aggaagugaguaucaauu

SEQ ID NO: 2015713 - RNA, 23 nt, Shigella flexneri 2a str. 301
aggcccaacuguugauccaggag

SEQ ID NO: 2015714 - RNA, 22 nt, Shigella flexneri 2a str. 301
aggccauguuuaccaucugcgc

SEQ ID NO: 2015715 - RNA, 16 nt, Shigella flexneri 2a str. 301
aggccagcguaccuug

SEQ ID NO: 2015716 - RNA, 19 nt, Shigella flexneri 2a str. 301
aggccagcggcuucgacga

SEQ ID NO: 2015717 - RNA, 22 nt, Shigella flexneri 2a str. 301
aggccagcaauuuugguggcuu

SEQ ID NO: 2015718 - RNA, 17 nt, Shigella flexneri 2a str. 301
aggccgaggcacagcag

SEQ ID NO: 2015719 - RNA, 14 nt, Shigella flexneri 2a str. 301
aggccgacagcagg

SEQ ID NO: 2015720 - RNA, 15 nt, Shigella flexneri 2a str. 301
aggccgacagcaggc

SEQ ID NO: 2015721 - RNA, 16 nt, Shigella flexneri 2a str. 301
aggcccgcccccgggc

SEQ ID NO: 2015722 - RNA, 20 nt, Shigella flexneri 2a str. 301
aggccauuuuuucgauaauc

SEQ ID NO: 2015723 - RNA, 20 nt, Shigella flexneri 2a str. 301
aggcaucagcaauuguaaau

SEQ ID NO: 2015724 - RNA, 21 nt, Shigella flexneri 2a str. 301
aggcaucagaucccaauucau

SEQ ID NO: 2015725 - RNA, 16 nt, Shigella flexneri 2a str. 301
aggcaucagacaaaug

SEQ ID NO: 2015726 - RNA, 14 nt, Shigella flexneri 2a str. 301
aggcauagaaaaag

SEQ ID NO: 2015727 - RNA, 16 nt, Shigella flexneri 2a str. 301
aggcaguuuugcguuu

SEQ ID NO: 2015728 - RNA, 15 nt, Shigella flexneri 2a str. 301
aggcagccuuucuca

SEQ ID NO: 2015729 - RNA, 15 nt, Shigella flexneri 2a str. 301
aggcagcauccggca

SEQ ID NO: 2015730 - RNA, 22 nt, Shigella flexneri 2a str. 301
aggcagcaucucgcgcucuucu

SEQ ID NO: 2015731 - RNA, 15 nt, Shigella flexneri 2a str. 301
aggcaggcaucaaug

SEQ ID NO: 2015732 - RNA, 12 nt, Shigella flexneri 2a str. 301
aggcagcuuaga

SEQ ID NO: 2015733 - RNA, 16 nt, Shigella flexneri 2a str. 301
aggcagcuuagaaauu

SEQ ID NO: 2015734 - RNA, 17 nt, Shigella flexneri 2a str. 301
aggcagggccaccagcg

SEQ ID NO: 2015735 - RNA, 22 nt, Shigella flexneri 2a str. 301
aggcaguaaaccgucagcacca

SEQ ID NO: 2015736 - RNA, 16 nt, Shigella flexneri 2a str. 301
aggcauucuuuuucau

SEQ ID NO: 2015737 - RNA, 19 nt, Shigella flexneri 2a str. 301
aggcauucuuuuucauuau

SEQ ID NO: 2015738 - RNA, 16 nt, Shigella flexneri 2a str. 301
aggcaugaugcgccaa

SEQ ID NO: 2015739 - RNA, 17 nt, Shigella flexneri 2a str. 301
aggcaugggucacucag

SEQ ID NO: 2015740 - RNA, 18 nt, Shigella flexneri 2a str. 301
aggccaaucagcaauaaa

SEQ ID NO: 2015741 - RNA, 16 nt, Shigella flexneri 2a str. 301
aggccaauccagcccu

SEQ ID NO: 2015742 - RNA, 21 nt, Shigella flexneri 2a str. 301
aggccaauccagcccugccag

SEQ ID NO: 2015743 - RNA, 17 nt, Shigella flexneri 2a str. 301
aggccaacggcccauac

SEQ ID NO: 2015744 - RNA, 15 nt, Shigella flexneri 2a str. 301
aggcauuuuuaucac

SEQ ID NO: 2015745 - RNA, 20 nt, Shigella flexneri 2a str. 301
aggccaaaaaacagccccug

SEQ ID NO: 2015746 - RNA, 22 nt, Shigella flexneri 2a str. 301
aggaugcacucgcauccucuuu

SEQ ID NO: 2015747 - RNA, 13 nt, Shigella flexneri 2a str. 301
aggaugcagaaac

SEQ ID NO: 2015748 - RNA, 15 nt, Shigella flexneri 2a str. 301
aggaugcagaaacca

SEQ ID NO: 2015749 - RNA, 22 nt, Shigella flexneri 2a str. 301
aggaucuggcuugccagcaggg

SEQ ID NO: 2015750 - RNA, 20 nt, Shigella flexneri 2a str. 301
aggaugggcaacgcgcaugg

SEQ ID NO: 2015751 - RNA, 20 nt, Shigella flexneri 2a str. 301
aggauguuacaaccuccucc

SEQ ID NO: 2015752 - RNA, 23 nt, Shigella flexneri 2a str. 301
aggaugcugcaauaaaauaucuu

SEQ ID NO: 2015753 - RNA, 21 nt, Shigella flexneri 2a str. 301
aggaugcgggucaggccagga

SEQ ID NO: 2015754 - RNA, 21 nt, Shigella flexneri 2a str. 301
aggcaaaauacguucucaccu

SEQ ID NO: 2015755 - RNA, 14 nt, Shigella flexneri 2a str. 301
aggcaaaaugccag

SEQ ID NO: 2015756 - RNA, 22 nt, Shigella flexneri 2a str. 301
aggcaaacuucucgccaucaaa

SEQ ID NO: 2015757 - RNA, 14 nt, Shigella flexneri 2a str. 301
aggauuucuccccc

SEQ ID NO: 2015758 - RNA, 20 nt, Shigella flexneri 2a str. 301
aggauuucuccccccucuga

SEQ ID NO: 2015759 - RNA, 15 nt, Shigella flexneri 2a str. 301
aggauuaauaaauuu

SEQ ID NO: 2015760 - RNA, 15 nt, Shigella flexneri 2a str. 301
aggcagaaacaaacg

SEQ ID NO: 2015761 - RNA, 16 nt, Shigella flexneri 2a str. 301
aggcagauccaguuac

SEQ ID NO: 2015762 - RNA, 11 nt, Shigella flexneri 2a str. 301
aggcaccuucg

SEQ ID NO: 2015763 - RNA, 15 nt, Shigella flexneri 2a str. 301
aggcaccuggaaauu

SEQ ID NO: 2015764 - RNA, 14 nt, Shigella flexneri 2a str. 301
aggcaccagccccu

SEQ ID NO: 2015765 - RNA, 18 nt, Shigella flexneri 2a str. 301
aggcacagcaggccaaga

SEQ ID NO: 2015766 - RNA, 18 nt, Shigella flexneri 2a str. 301
aggcaaguagcgccauac

SEQ ID NO: 2015767 - RNA, 19 nt, Shigella flexneri 2a str. 301
aggcaagagcgaucggcag

SEQ ID NO: 2015768 - RNA, 15 nt, Shigella flexneri 2a str. 301
aggcaaccagcacgc

SEQ ID NO: 2015769 - RNA, 21 nt, Shigella flexneri 2a str. 301
aggcaacaugaaacagaaaau

SEQ ID NO: 2015770 - RNA, 22 nt, Shigella flexneri 2a str. 301
auaagcccagaacaaauaaaua

SEQ ID NO: 2015771 - RNA, 20 nt, Shigella flexneri 2a str. 301
auaagcccagaacaaauaaa

SEQ ID NO: 2015772 - RNA, 15 nt, Shigella flexneri 2a str. 301
auaagccaccucaac

SEQ ID NO: 2015773 - RNA, 17 nt, Shigella flexneri 2a str. 301
auaagcaucuauuauug

SEQ ID NO: 2015774 - RNA, 22 nt, Shigella flexneri 2a str. 301
auaagcaucccuuuaauuaucc

SEQ ID NO: 2015775 - RNA, 14 nt, Shigella flexneri 2a str. 301
auaagcacuacucu

SEQ ID NO: 2015776 - RNA, 19 nt, Shigella flexneri 2a str. 301
auaagacagcgucacauca

SEQ ID NO: 2015777 - RNA, 21 nt, Shigella flexneri 2a str. 301
auaagacguaucaggcaaaau

SEQ ID NO: 2015778 - RNA, 19 nt, Shigella flexneri 2a str. 301
auaagacuggcaaaugaca

SEQ ID NO: 2015779 - RNA, 19 nt, Shigella flexneri 2a str. 301
auaagagcgggacaacaaa

SEQ ID NO: 2015780 - RNA, 17 nt, Shigella flexneri 2a str. 301
auaagaugcuacaacau

SEQ ID NO: 2015781 - RNA, 13 nt, Shigella flexneri 2a str. 301
auaagcaaggcaa

SEQ ID NO: 2015782 - RNA, 15 nt, Shigella flexneri 2a str. 301
auaaggcgcaauaau

SEQ ID NO: 2015783 - RNA, 20 nt, Shigella flexneri 2a str. 301
auaagguaucgcgaaaaaaa

SEQ ID NO: 2015784 - RNA, 22 nt, Shigella flexneri 2a str. 301
auaaggucacguccccugggga

SEQ ID NO: 2015785 - RNA, 13 nt, Shigella flexneri 2a str. 301
auaaguucaguau

SEQ ID NO: 2015786 - RNA, 22 nt, Shigella flexneri 2a str. 301
auaaguuaaccccaguaauuca

SEQ ID NO: 2015787 - RNA, 15 nt, Shigella flexneri 2a str. 301
auaaguuacacauca

SEQ ID NO: 2015788 - RNA, 13 nt, Shigella flexneri 2a str. 301
auaagugcuuuag

SEQ ID NO: 2015789 - RNA, 13 nt, Shigella flexneri 2a str. 301
auaauaaagcuac

SEQ ID NO: 2015790 - RNA, 17 nt, Shigella flexneri 2a str. 301
auaaucguaaucagcau

SEQ ID NO: 2015791 - RNA, 14 nt, Shigella flexneri 2a str. 301
auaaucguaaucag

SEQ ID NO: 2015792 - RNA, 20 nt, Shigella flexneri 2a str. 301
auaaucgcgaauagcuucaa

SEQ ID NO: 2015793 - RNA, 19 nt, Shigella flexneri 2a str. 301
auaaucgcgcuaauuccag

SEQ ID NO: 2015794 - RNA, 16 nt, Shigella flexneri 2a str. 301
auaaucgcaauuaccc

SEQ ID NO: 2015795 - RNA, 20 nt, Shigella flexneri 2a str. 301
auaaucgcaccgcuggcaga

SEQ ID NO: 2015796 - RNA, 14 nt, Shigella flexneri 2a str. 301
auaaucgggaauac

SEQ ID NO: 2015797 - RNA, 14 nt, Shigella flexneri 2a str. 301
auaaugaaggauga

SEQ ID NO: 2015798 - RNA, 17 nt, Shigella flexneri 2a str. 301
auaaugaaggaugaaac

SEQ ID NO: 2015799 - RNA, 19 nt, Shigella flexneri 2a str. 301
auaaugaacgccaccccac

SEQ ID NO: 2015800 - RNA, 23 nt, Shigella flexneri 2a str. 301
auaaugaacgccaccccacacca

SEQ ID NO: 2015801 - RNA, 13 nt, Shigella flexneri 2a str. 301
auaaucuuuaaaa

SEQ ID NO: 2015802 - RNA, 19 nt, Shigella flexneri 2a str. 301
auaaucgauugcacauucc

SEQ ID NO: 2015803 - RNA, 13 nt, Shigella flexneri 2a str. 301
auaaucgcauuca

SEQ ID NO: 2015804 - RNA, 16 nt, Shigella flexneri 2a str. 301
auaaucgcauucagga

SEQ ID NO: 2015805 - RNA, 17 nt, Shigella flexneri 2a str. 301
auaaucgauugcacauu

SEQ ID NO: 2015806 - RNA, 19 nt, Shigella flexneri 2a str. 301
auaaucacucuuccccgcu

SEQ ID NO: 2015807 - RNA, 20 nt, Shigella flexneri 2a str. 301
auaaucaccugccuucacuu

SEQ ID NO: 2015808 - RNA, 14 nt, Shigella flexneri 2a str. 301
auaaucacaauggu

SEQ ID NO: 2015809 - RNA, 15 nt, Shigella flexneri 2a str. 301
auaaucacaaugguc

SEQ ID NO: 2015810 - RNA, 22 nt, Shigella flexneri 2a str. 301
auaaugccguuuggcaaauaca

SEQ ID NO: 2015811 - RNA, 20 nt, Shigella flexneri 2a str. 301
auaaugcccgaaugcagcuc

SEQ ID NO: 2015812 - RNA, 19 nt, Shigella flexneri 2a str. 301
auaaugcccagcaacgaaa

SEQ ID NO: 2015813 - RNA, 19 nt, Shigella flexneri 2a str. 301
auaaugcgacaacagaaau

SEQ ID NO: 2015814 - RNA, 16 nt, Shigella flexneri 2a str. 301
auaaugcugacaaaac

SEQ ID NO: 2015815 - RNA, 15 nt, Shigella flexneri 2a str. 301
auaauuaaaaauagu

SEQ ID NO: 2015816 - RNA, 15 nt, Shigella flexneri 2a str. 301
auaauguguucaacu

SEQ ID NO: 2015817 - RNA, 17 nt, Shigella flexneri 2a str. 301
auaauguggccccugaa

SEQ ID NO: 2015818 - RNA, 14 nt, Shigella flexneri 2a str. 301
auaauggcugccga

SEQ ID NO: 2015819 - RNA, 18 nt, Shigella flexneri 2a str. 301
auaauggcguauuucaca

SEQ ID NO: 2015820 - RNA, 14 nt, Shigella flexneri 2a str. 301
auaauaaucaucac

SEQ ID NO: 2015821 - RNA, 13 nt, Shigella flexneri 2a str. 301
auaauaaucauca

SEQ ID NO: 2015822 - RNA, 15 nt, Shigella flexneri 2a str. 301
auaauacacuuaacu

SEQ ID NO: 2015823 - RNA, 15 nt, Shigella flexneri 2a str. 301
auaauacacacauca

SEQ ID NO: 2015824 - RNA, 13 nt, Shigella flexneri 2a str. 301
auaauaguauuaa

SEQ ID NO: 2015825 - RNA, 19 nt, Shigella flexneri 2a str. 301
auaauaguauuaagccagu

SEQ ID NO: 2015826 - RNA, 19 nt, Shigella flexneri 2a str. 301
auaauagguaaacauccgu

SEQ ID NO: 2015827 - RNA, 21 nt, Shigella flexneri 2a str. 301
auaauauccugccguuuuuua

SEQ ID NO: 2015828 - RNA, 15 nt, Shigella flexneri 2a str. 301
auaauaucuccagcu

SEQ ID NO: 2015829 - RNA, 11 nt, Shigella flexneri 2a str. 301
auaauaucuuu

SEQ ID NO: 2015830 - RNA, 14 nt, Shigella flexneri 2a str. 301
auaauaucuuuucu

SEQ ID NO: 2015831 - RNA, 20 nt, Shigella flexneri 2a str. 301
auaaucaaucuuuacacaca

SEQ ID NO: 2015832 - RNA, 23 nt, Shigella flexneri 2a str. 301
auaauauuuuugcguccuggcaa

SEQ ID NO: 2015833 - RNA, 15 nt, Shigella flexneri 2a str. 301
auaauauuuuugcgu

SEQ ID NO: 2015834 - RNA, 19 nt, Shigella flexneri 2a str. 301
auaaaggucgacagcagcc

SEQ ID NO: 2015835 - RNA, 22 nt, Shigella flexneri 2a str. 301
auaaaggucgacagcagccccg

SEQ ID NO: 2015836 - RNA, 15 nt, Shigella flexneri 2a str. 301
auaaaggucaucaca

SEQ ID NO: 2015837 - RNA, 23 nt, Shigella flexneri 2a str. 301
auaaaggucaucacaucccagca

SEQ ID NO: 2015838 - RNA, 23 nt, Shigella flexneri 2a str. 301
auaaagccugcuucaaacgcuga

SEQ ID NO: 2015839 - RNA, 14 nt, Shigella flexneri 2a str. 301
auaaagcgaggcua

SEQ ID NO: 2015840 - RNA, 16 nt, Shigella flexneri 2a str. 301
auaaagcacugucuaa

SEQ ID NO: 2015841 - RNA, 22 nt, Shigella flexneri 2a str. 301
auaaagcacugucuaacaacau

SEQ ID NO: 2015842 - RNA, 15 nt, Shigella flexneri 2a str. 301
auaaagcagccuauu

SEQ ID NO: 2015843 - RNA, 13 nt, Shigella flexneri 2a str. 301
auaaagcgauaaa

SEQ ID NO: 2015844 - RNA, 17 nt, Shigella flexneri 2a str. 301
auaaagcugaucacaua

SEQ ID NO: 2015845 - RNA, 19 nt, Shigella flexneri 2a str. 301
auaaagcugaucacauaac

SEQ ID NO: 2015846 - RNA, 22 nt, Shigella flexneri 2a str. 301
auaaagcguuuaucaauuaacu

SEQ ID NO: 2015847 - RNA, 23 nt, Shigella flexneri 2a str. 301
auaaauauggugaaaguaaaaaa

SEQ ID NO: 2015848 - RNA, 19 nt, Shigella flexneri 2a str. 301
auaaauauggugaaaguaa

SEQ ID NO: 2015849 - RNA, 18 nt, Shigella flexneri 2a str. 301
auaaauaacuuuuaucug

SEQ ID NO: 2015850 - RNA, 20 nt, Shigella flexneri 2a str. 301
auaaauaaacucucuauucc

SEQ ID NO: 2015851 - RNA, 22 nt, Shigella flexneri 2a str. 301
auaaauaauaagagcguccaga

SEQ ID NO: 2015852 - RNA, 22 nt, Shigella flexneri 2a str. 301
auaaauccuuuguacaggauau

SEQ ID NO: 2015853 - RNA, 16 nt, Shigella flexneri 2a str. 301
auaaacuccugcacgc

SEQ ID NO: 2015854 - RNA, 20 nt, Shigella flexneri 2a str. 301
auaaacgaaucugcaaaucu

SEQ ID NO: 2015855 - RNA, 16 nt, Shigella flexneri 2a str. 301
auaaacugagccaaac

SEQ ID NO: 2015856 - RNA, 16 nt, Shigella flexneri 2a str. 301
auaaacucaugggucu

SEQ ID NO: 2015857 - RNA, 22 nt, Shigella flexneri 2a str. 301
auaaacaaagcgcacuuugcca

SEQ ID NO: 2015858 - RNA, 23 nt, Shigella flexneri 2a str. 301
auaaacaacggcaagaucagcau

SEQ ID NO: 2015859 - RNA, 16 nt, Shigella flexneri 2a str. 301
auaaaccagcaaccaa

SEQ ID NO: 2015860 - RNA, 22 nt, Shigella flexneri 2a str. 301
auaaaccaccugggucugcaga

SEQ ID NO: 2015861 - RNA, 23 nt, Shigella flexneri 2a str. 301
auaaaccaccugggucugcagau

SEQ ID NO: 2015862 - RNA, 23 nt, Shigella flexneri 2a str. 301
auaaauuucugccauuuugcuuu

SEQ ID NO: 2015863 - RNA, 21 nt, Shigella flexneri 2a str. 301
auaaauuucugccauuuugcu

SEQ ID NO: 2015864 - RNA, 20 nt, Shigella flexneri 2a str. 301
auaacaccgauuuuguaaaa

SEQ ID NO: 2015865 - RNA, 11 nt, Shigella flexneri 2a str. 301
auaacagagcg

SEQ ID NO: 2015866 - RNA, 18 nt, Shigella flexneri 2a str. 301
auaacagagcgaaggaga

SEQ ID NO: 2015867 - RNA, 23 nt, Shigella flexneri 2a str. 301
auaacagaccuuucgaacccaac

SEQ ID NO: 2015868 - RNA, 10 nt, Shigella flexneri 2a str. 301
auaaccaaau

SEQ ID NO: 2015869 - RNA, 14 nt, Shigella flexneri 2a str. 301
auaaccaaaugacu

SEQ ID NO: 2015870 - RNA, 15 nt, Shigella flexneri 2a str. 301
auaacccagggguca

SEQ ID NO: 2015871 - RNA, 23 nt, Shigella flexneri 2a str. 301
auaaccaacggcgagccagcgca

SEQ ID NO: 2015872 - RNA, 21 nt, Shigella flexneri 2a str. 301
auaaccgcaucaacagugcca

SEQ ID NO: 2015873 - RNA, 12 nt, Shigella flexneri 2a str. 301
auaaccgagcau

SEQ ID NO: 2015874 - RNA, 16 nt, Shigella flexneri 2a str. 301
auaacuggucaucaaa

SEQ ID NO: 2015875 - RNA, 18 nt, Shigella flexneri 2a str. 301
auaacucuuugaugaaac

SEQ ID NO: 2015876 - RNA, 19 nt, Shigella flexneri 2a str. 301
auaacuucacuaaucaauu

SEQ ID NO: 2015877 - RNA, 21 nt, Shigella flexneri 2a str. 301
auaacuccccgagaaauacug

SEQ ID NO: 2015878 - RNA, 17 nt, Shigella flexneri 2a str. 301
auaacucccuauaaugc

SEQ ID NO: 2015879 - RNA, 16 nt, Shigella flexneri 2a str. 301
auaacugaauaauaca

SEQ ID NO: 2015880 - RNA, 12 nt, Shigella flexneri 2a str. 301
auaacuuccuga

SEQ ID NO: 2015881 - RNA, 19 nt, Shigella flexneri 2a str. 301
auaacguugaugcaggcag

SEQ ID NO: 2015882 - RNA, 16 nt, Shigella flexneri 2a str. 301
auaacguuugacauag

SEQ ID NO: 2015883 - RNA, 14 nt, Shigella flexneri 2a str. 301
auaacucaccauca

SEQ ID NO: 2015884 - RNA, 22 nt, Shigella flexneri 2a str. 301
auaacuauuguuuugaugaauc

SEQ ID NO: 2015885 - RNA, 19 nt, Shigella flexneri 2a str. 301
auaacgugacggcuuuuuu

SEQ ID NO: 2015886 - RNA, 17 nt, Shigella flexneri 2a str. 301
agucugccguugccacg

SEQ ID NO: 2015887 - RNA, 12 nt, Shigella flexneri 2a str. 301
agucuucccagc

SEQ ID NO: 2015888 - RNA, 16 nt, Shigella flexneri 2a str. 301
agucuucgccgacuuc

SEQ ID NO: 2015889 - RNA, 21 nt, Shigella flexneri 2a str. 301
agucuuaaaggggugaaaaaa

SEQ ID NO: 2015890 - RNA, 19 nt, Shigella flexneri 2a str. 301
agugaccaucuuccagcau

SEQ ID NO: 2015891 - RNA, 18 nt, Shigella flexneri 2a str. 301
agugaauuguuuuauaaa

SEQ ID NO: 2015892 - RNA, 13 nt, Shigella flexneri 2a str. 301
agucuugcuggau

SEQ ID NO: 2015893 - RNA, 16 nt, Shigella flexneri 2a str. 301
agucuuuuuucaacuu

SEQ ID NO: 2015894 - RNA, 23 nt, Shigella flexneri 2a str. 301
agucuuugcgaggcgcgucccag

SEQ ID NO: 2015895 - RNA, 18 nt, Shigella flexneri 2a str. 301
aguccgcgcuugccgccg

SEQ ID NO: 2015896 - RNA, 19 nt, Shigella flexneri 2a str. 301
aguccgcgcuugccgccgg

SEQ ID NO: 2015897 - RNA, 15 nt, Shigella flexneri 2a str. 301
agucgccugcuuuau

SEQ ID NO: 2015898 - RNA, 20 nt, Shigella flexneri 2a str. 301
agucgcgcaauugccagaca

SEQ ID NO: 2015899 - RNA, 20 nt, Shigella flexneri 2a str. 301
agucgcgguccgggccgcaa

SEQ ID NO: 2015900 - RNA, 17 nt, Shigella flexneri 2a str. 301
agucgccggcggauuca

SEQ ID NO: 2015901 - RNA, 18 nt, Shigella flexneri 2a str. 301
agucgcccauuuugccac

SEQ ID NO: 2015902 - RNA, 17 nt, Shigella flexneri 2a str. 301
agucguucaaccacuuc

SEQ ID NO: 2015903 - RNA, 20 nt, Shigella flexneri 2a str. 301
agucguguuaucgcgcugaa

SEQ ID NO: 2015904 - RNA, 17 nt, Shigella flexneri 2a str. 301
agucguuuuaguaacaa

SEQ ID NO: 2015905 - RNA, 20 nt, Shigella flexneri 2a str. 301
aguggaucccagaagaauau

SEQ ID NO: 2015906 - RNA, 15 nt, Shigella flexneri 2a str. 301
aguggcaaccagcag

SEQ ID NO: 2015907 - RNA, 17 nt, Shigella flexneri 2a str. 301
agugcguuauucaccuc

SEQ ID NO: 2015908 - RNA, 14 nt, Shigella flexneri 2a str. 301
agugcgcaacaaaa

SEQ ID NO: 2015909 - RNA, 21 nt, Shigella flexneri 2a str. 301
agugccggauguuugcauccg

SEQ ID NO: 2015910 - RNA, 14 nt, Shigella flexneri 2a str. 301
agugccaaagccag

SEQ ID NO: 2015911 - RNA, 14 nt, Shigella flexneri 2a str. 301
agugccgucagcag

SEQ ID NO: 2015912 - RNA, 21 nt, Shigella flexneri 2a str. 301
agugccucacgaucacagcag

SEQ ID NO: 2015913 - RNA, 19 nt, Shigella flexneri 2a str. 301
agugcauugagucccaucu

SEQ ID NO: 2015914 - RNA, 14 nt, Shigella flexneri 2a str. 301
agugcauugagucc

SEQ ID NO: 2015915 - RNA, 17 nt, Shigella flexneri 2a str. 301
agugccaaaaaaauaag

SEQ ID NO: 2015916 - RNA, 15 nt, Shigella flexneri 2a str. 301
agugcagcaugcacc

SEQ ID NO: 2015917 - RNA, 14 nt, Shigella flexneri 2a str. 301
agugagcacugaau

SEQ ID NO: 2015918 - RNA, 20 nt, Shigella flexneri 2a str. 301
agugacucuuuauuucauuu

SEQ ID NO: 2015919 - RNA, 14 nt, Shigella flexneri 2a str. 301
agugacucacgaau

SEQ ID NO: 2015920 - RNA, 12 nt, Shigella flexneri 2a str. 301
aguguaguucug

SEQ ID NO: 2015921 - RNA, 21 nt, Shigella flexneri 2a str. 301
agugguuagccggauaaacaa

SEQ ID NO: 2015922 - RNA, 18 nt, Shigella flexneri 2a str. 301
aguguaacgcuugcugau

SEQ ID NO: 2015923 - RNA, 15 nt, Shigella flexneri 2a str. 301
agugucauucagauc

SEQ ID NO: 2015924 - RNA, 21 nt, Shigella flexneri 2a str. 301
aguguccgccaauuucaucac

SEQ ID NO: 2015925 - RNA, 14 nt, Shigella flexneri 2a str. 301
aguggugaaaaaaa

SEQ ID NO: 2015926 - RNA, 18 nt, Shigella flexneri 2a str. 301
agugguaagaggaauuga

SEQ ID NO: 2015927 - RNA, 15 nt, Shigella flexneri 2a str. 301
aguggguuguaucaa

SEQ ID NO: 2015928 - RNA, 14 nt, Shigella flexneri 2a str. 301
aguggguuucugcc

SEQ ID NO: 2015929 - RNA, 18 nt, Shigella flexneri 2a str. 301
agugguuucgccagcacc

SEQ ID NO: 2015930 - RNA, 19 nt, Shigella flexneri 2a str. 301
aguggcugcguuucaugua

SEQ ID NO: 2015931 - RNA, 17 nt, Shigella flexneri 2a str. 301
aguggcucaggcucuca

SEQ ID NO: 2015932 - RNA, 18 nt, Shigella flexneri 2a str. 301
aguggcuauuuaccaaua

SEQ ID NO: 2015933 - RNA, 18 nt, Shigella flexneri 2a str. 301
aguggcucagacucucau

SEQ ID NO: 2015934 - RNA, 18 nt, Shigella flexneri 2a str. 301
aguggggcggagaugcgg

SEQ ID NO: 2015935 - RNA, 15 nt, Shigella flexneri 2a str. 301
agugggauucaccaa

SEQ ID NO: 2015936 - RNA, 13 nt, Shigella flexneri 2a str. 301
aguucugcgcauc

SEQ ID NO: 2015937 - RNA, 18 nt, Shigella flexneri 2a str. 301
aguucgucgcguuugccc

SEQ ID NO: 2015938 - RNA, 20 nt, Shigella flexneri 2a str. 301
aguucugcagcccgaacggu

SEQ ID NO: 2015939 - RNA, 16 nt, Shigella flexneri 2a str. 301
aguucugccaggcugg

SEQ ID NO: 2015940 - RNA, 12 nt, Shigella flexneri 2a str. 301
aguuccugcaac

SEQ ID NO: 2015941 - RNA, 22 nt, Shigella flexneri 2a str. 301
aguuccugcaacuucucuuucg

SEQ ID NO: 2015942 - RNA, 13 nt, Shigella flexneri 2a str. 301
aguucgagaaaaa

SEQ ID NO: 2015943 - RNA, 16 nt, Shigella flexneri 2a str. 301
aguuccuacugcuccu

SEQ ID NO: 2015944 - RNA, 20 nt, Shigella flexneri 2a str. 301
aguuccacauaaaguagcca

SEQ ID NO: 2015945 - RNA, 18 nt, Shigella flexneri 2a str. 301
aguuccacuauuucaaua

SEQ ID NO: 2015946 - RNA, 13 nt, Shigella flexneri 2a str. 301
aguuccagcauga

SEQ ID NO: 2015947 - RNA, 16 nt, Shigella flexneri 2a str. 301
aguucaagaugucugc

SEQ ID NO: 2015948 - RNA, 17 nt, Shigella flexneri 2a str. 301
aguucaacggugucgau

SEQ ID NO: 2015949 - RNA, 22 nt, Shigella flexneri 2a str. 301
aguucaacgcccgcuuucacca

SEQ ID NO: 2015950 - RNA, 23 nt, Shigella flexneri 2a str. 301
aguucaauuggccugauaagaca

SEQ ID NO: 2015951 - RNA, 15 nt, Shigella flexneri 2a str. 301
aguuagucugggcga

SEQ ID NO: 2015952 - RNA, 21 nt, Shigella flexneri 2a str. 301
aguuauacagacucaaaccaa

SEQ ID NO: 2015953 - RNA, 16 nt, Shigella flexneri 2a str. 301
agugugggaaaaauug

SEQ ID NO: 2015954 - RNA, 21 nt, Shigella flexneri 2a str. 301
agugugggaucacaucuucaa

SEQ ID NO: 2015955 - RNA, 22 nt, Shigella flexneri 2a str. 301
aguguggccagagugcguucac

SEQ ID NO: 2015956 - RNA, 21 nt, Shigella flexneri 2a str. 301
aguguguauggcauugucuga

SEQ ID NO: 2015957 - RNA, 16 nt, Shigella flexneri 2a str. 301
aguguuggaucugauc

SEQ ID NO: 2015958 - RNA, 15 nt, Shigella flexneri 2a str. 301
aguguuggcgucaga

SEQ ID NO: 2015959 - RNA, 21 nt, Shigella flexneri 2a str. 301
aguguuggcgucagaccggca

SEQ ID NO: 2015960 - RNA, 16 nt, Shigella flexneri 2a str. 301
aguguuucggucugau

SEQ ID NO: 2015961 - RNA, 18 nt, Shigella flexneri 2a str. 301
aguuacugccaucuuccg

SEQ ID NO: 2015962 - RNA, 16 nt, Shigella flexneri 2a str. 301
aguuagagccagggau

SEQ ID NO: 2015963 - RNA, 14 nt, Shigella flexneri 2a str. 301
aguuagaguagcca

SEQ ID NO: 2015964 - RNA, 17 nt, Shigella flexneri 2a str. 301
aguuagucgcuuucauu

SEQ ID NO: 2015965 - RNA, 15 nt, Shigella flexneri 2a str. 301
aguuagucgcuuuca

SEQ ID NO: 2015966 - RNA, 16 nt, Shigella flexneri 2a str. 301
aguguuuugaggugua

SEQ ID NO: 2015967 - RNA, 14 nt, Shigella flexneri 2a str. 301
aguuacgugcugcg

SEQ ID NO: 2015968 - RNA, 13 nt, Shigella flexneri 2a str. 301
aguuguugcugaa

SEQ ID NO: 2015969 - RNA, 15 nt, Shigella flexneri 2a str. 301
aguuguuuacaguau

SEQ ID NO: 2015970 - RNA, 15 nt, Shigella flexneri 2a str. 301
aguuuaauucuuuga

SEQ ID NO: 2015971 - RNA, 15 nt, Shigella flexneri 2a str. 301
aguuuaauugccauu

SEQ ID NO: 2015972 - RNA, 15 nt, Shigella flexneri 2a str. 301
aguugcuucaucuca

SEQ ID NO: 2015973 - RNA, 16 nt, Shigella flexneri 2a str. 301
aguuguucaacaguaa

SEQ ID NO: 2015974 - RNA, 19 nt, Shigella flexneri 2a str. 301
aguuguugagguucggagu

SEQ ID NO: 2015975 - RNA, 14 nt, Shigella flexneri 2a str. 301
aguugcuccacugc

SEQ ID NO: 2015976 - RNA, 21 nt, Shigella flexneri 2a str. 301
aguugcagcaacucuuuuucc

SEQ ID NO: 2015977 - RNA, 16 nt, Shigella flexneri 2a str. 301
aguugcagacugaaua

SEQ ID NO: 2015978 - RNA, 17 nt, Shigella flexneri 2a str. 301
aguugcagcgucaucaa

SEQ ID NO: 2015979 - RNA, 21 nt, Shigella flexneri 2a str. 301
aguugauuggcgcgaaccauc

SEQ ID NO: 2015980 - RNA, 23 nt, Shigella flexneri 2a str. 301
aguugauuacacaaauccagcac

SEQ ID NO: 2015981 - RNA, 17 nt, Shigella flexneri 2a str. 301
aguugauuaauuucauu

SEQ ID NO: 2015982 - RNA, 18 nt, Shigella flexneri 2a str. 301
aguugauucggccaguaa

SEQ ID NO: 2015983 - RNA, 14 nt, Shigella flexneri 2a str. 301
aguugaaaaccucu

SEQ ID NO: 2015984 - RNA, 16 nt, Shigella flexneri 2a str. 301
aguugaaaaccucucu

SEQ ID NO: 2015985 - RNA, 13 nt, Shigella flexneri 2a str. 301
aguugaaaaccuc

SEQ ID NO: 2015986 - RNA, 20 nt, Shigella flexneri 2a str. 301
aguugaccagcuccagcaga

SEQ ID NO: 2015987 - RNA, 12 nt, Shigella flexneri 2a str. 301
aguuuuuucuuc

SEQ ID NO: 2015988 - RNA, 24 nt, Shigella flexneri 2a str. 301
auaaaaaaaacgccagcaacacau

SEQ ID NO: 2015989 - RNA, 19 nt, Shigella flexneri 2a str. 301
aguuugucuggcaauccua

SEQ ID NO: 2015990 - RNA, 14 nt, Shigella flexneri 2a str. 301
aguuuguuuagcca

SEQ ID NO: 2015991 - RNA, 22 nt, Shigella flexneri 2a str. 301
aguuuucgccacuccccacuuc

SEQ ID NO: 2015992 - RNA, 17 nt, Shigella flexneri 2a str. 301
aguuuacgaaccuucac

SEQ ID NO: 2015993 - RNA, 13 nt, Shigella flexneri 2a str. 301
aguuucugcagcu

SEQ ID NO: 2015994 - RNA, 19 nt, Shigella flexneri 2a str. 301
aguuucggacgcggcacgc

SEQ ID NO: 2015995 - RNA, 21 nt, Shigella flexneri 2a str. 301
aguuugauuauucacaauuca

SEQ ID NO: 2015996 - RNA, 20 nt, Shigella flexneri 2a str. 301
aguuugcaccucugcugcug

SEQ ID NO: 2015997 - RNA, 15 nt, Shigella flexneri 2a str. 301
aguuugaucaguucu

SEQ ID NO: 2015998 - RNA, 20 nt, Shigella flexneri 2a str. 301
aguuucggcaucagcagaau

SEQ ID NO: 2015999 - RNA, 13 nt, Shigella flexneri 2a str. 301
aucacgcaucacu

SEQ ID NO: 2016000 - RNA, 20 nt, Shigella flexneri 2a str. 301
aucacgccaauaccgcccag

SEQ ID NO: 2016001 - RNA, 21 nt, Shigella flexneri 2a str. 301
aucacgccaauaccgcccaga

SEQ ID NO: 2016002 - RNA, 13 nt, Shigella flexneri 2a str. 301
aucacgcaucacc

SEQ ID NO: 2016003 - RNA, 15 nt, Shigella flexneri 2a str. 301
aucacgcgccugcca

SEQ ID NO: 2016004 - RNA, 16 nt, Shigella flexneri 2a str. 301
aucacgcgaccaucgc

SEQ ID NO: 2016005 - RNA, 14 nt, Shigella flexneri 2a str. 301
aucacgcugcugau

SEQ ID NO: 2016006 - RNA, 21 nt, Shigella flexneri 2a str. 301
aucacgcugaauuuaucgacu

SEQ ID NO: 2016007 - RNA, 17 nt, Shigella flexneri 2a str. 301
aucacgcugcugauuaa

SEQ ID NO: 2016008 - RNA, 18 nt, Shigella flexneri 2a str. 301
aucacgaugcuaaaaaca

SEQ ID NO: 2016009 - RNA, 14 nt, Shigella flexneri 2a str. 301
aucacgauugcugc

SEQ ID NO: 2016010 - RNA, 18 nt, Shigella flexneri 2a str. 301
aucacgcaaccacaacgc

SEQ ID NO: 2016011 - RNA, 14 nt, Shigella flexneri 2a str. 301
aucaccugcacaug

SEQ ID NO: 2016012 - RNA, 14 nt, Shigella flexneri 2a str. 301
aucaccugcuggac

SEQ ID NO: 2016013 - RNA, 17 nt, Shigella flexneri 2a str. 301
aucaccguucagcuugc

SEQ ID NO: 2016014 - RNA, 23 nt, Shigella flexneri 2a str. 301
aucaccuuacggcacuccucuuc

SEQ ID NO: 2016015 - RNA, 13 nt, Shigella flexneri 2a str. 301
aucacucacccgc

SEQ ID NO: 2016016 - RNA, 19 nt, Shigella flexneri 2a str. 301
aucacucggggcuuuucuc

SEQ ID NO: 2016017 - RNA, 17 nt, Shigella flexneri 2a str. 301
aucacuaccuucuuccc

SEQ ID NO: 2016018 - RNA, 15 nt, Shigella flexneri 2a str. 301
aucacuaugaaaaua

SEQ ID NO: 2016019 - RNA, 17 nt, Shigella flexneri 2a str. 301
aucacuaugaaaauaaa

SEQ ID NO: 2016020 - RNA, 19 nt, Shigella flexneri 2a str. 301
aucacgucggcguuuucug

SEQ ID NO: 2016021 - RNA, 21 nt, Shigella flexneri 2a str. 301
aucacguugcuguugguucag

SEQ ID NO: 2016022 - RNA, 14 nt, Shigella flexneri 2a str. 301
aucacguugauauu

SEQ ID NO: 2016023 - RNA, 16 nt, Shigella flexneri 2a str. 301
aucaccauaaaucaga

SEQ ID NO: 2016024 - RNA, 18 nt, Shigella flexneri 2a str. 301
aucaccauauucagcagc

SEQ ID NO: 2016025 - RNA, 16 nt, Shigella flexneri 2a str. 301
aucaccaucagcagca

SEQ ID NO: 2016026 - RNA, 17 nt, Shigella flexneri 2a str. 301
aucaccccgcccgauaa

SEQ ID NO: 2016027 - RNA, 20 nt, Shigella flexneri 2a str. 301
aucaccgccacuaccaucag

SEQ ID NO: 2016028 - RNA, 22 nt, Shigella flexneri 2a str. 301
aucaccgccacuaccaucaggu

SEQ ID NO: 2016029 - RNA, 15 nt, Shigella flexneri 2a str. 301
aucaccgccagcaag

SEQ ID NO: 2016030 - RNA, 16 nt, Shigella flexneri 2a str. 301
aucaccucuuuuucca

SEQ ID NO: 2016031 - RNA, 22 nt, Shigella flexneri 2a str. 301
aucaccucuuuuuccacuucca

SEQ ID NO: 2016032 - RNA, 12 nt, Shigella flexneri 2a str. 301
aucaccagcgca

SEQ ID NO: 2016033 - RNA, 18 nt, Shigella flexneri 2a str. 301
aucaccagaaguaucguu

SEQ ID NO: 2016034 - RNA, 15 nt, Shigella flexneri 2a str. 301
aucaccacagacaaa

SEQ ID NO: 2016035 - RNA, 22 nt, Shigella flexneri 2a str. 301
aucaccaauacgcauaugcauc

SEQ ID NO: 2016036 - RNA, 21 nt, Shigella flexneri 2a str. 301
aucacaugcuggaaccacagc

SEQ ID NO: 2016037 - RNA, 12 nt, Shigella flexneri 2a str. 301
aucacauccagc

SEQ ID NO: 2016038 - RNA, 13 nt, Shigella flexneri 2a str. 301
aucacaucccagc

SEQ ID NO: 2016039 - RNA, 16 nt, Shigella flexneri 2a str. 301
aucacaucccagcaga

SEQ ID NO: 2016040 - RNA, 18 nt, Shigella flexneri 2a str. 301
aucacaucaaauccccac

SEQ ID NO: 2016041 - RNA, 17 nt, Shigella flexneri 2a str. 301
aucacaguuaagcaaua

SEQ ID NO: 2016042 - RNA, 13 nt, Shigella flexneri 2a str. 301
aucacaggcgcga

SEQ ID NO: 2016043 - RNA, 11 nt, Shigella flexneri 2a str. 301
aucacagcaga

SEQ ID NO: 2016044 - RNA, 17 nt, Shigella flexneri 2a str. 301
aucacagcaguccagcg

SEQ ID NO: 2016045 - RNA, 15 nt, Shigella flexneri 2a str. 301
aucagcacaaaucgg

SEQ ID NO: 2016046 - RNA, 18 nt, Shigella flexneri 2a str. 301
aucagcaacucuggugga

SEQ ID NO: 2016047 - RNA, 19 nt, Shigella flexneri 2a str. 301
aucagcaaacuaucccagc

SEQ ID NO: 2016048 - RNA, 19 nt, Shigella flexneri 2a str. 301
aucagcagcggagaaaugu

SEQ ID NO: 2016049 - RNA, 15 nt, Shigella flexneri 2a str. 301
aucagcagcaacaaa

SEQ ID NO: 2016050 - RNA, 18 nt, Shigella flexneri 2a str. 301
aucagcagauaucccgcc

SEQ ID NO: 2016051 - RNA, 17 nt, Shigella flexneri 2a str. 301
aucagcaucucauccau

SEQ ID NO: 2016052 - RNA, 18 nt, Shigella flexneri 2a str. 301
aucagcaucccaccugaa

SEQ ID NO: 2016053 - RNA, 13 nt, Shigella flexneri 2a str. 301
aucagcaguucag

SEQ ID NO: 2016054 - RNA, 17 nt, Shigella flexneri 2a str. 301
aucagcauaaucaccag

SEQ ID NO: 2016055 - RNA, 16 nt, Shigella flexneri 2a str. 301
aucagcauaaucacca

SEQ ID NO: 2016056 - RNA, 21 nt, Shigella flexneri 2a str. 301
aucagcaguuuuuccccugcc

SEQ ID NO: 2016057 - RNA, 15 nt, Shigella flexneri 2a str. 301
aucagcauucucauc

SEQ ID NO: 2016058 - RNA, 19 nt, Shigella flexneri 2a str. 301
aucagcaugacaaaaaagc

SEQ ID NO: 2016059 - RNA, 19 nt, Shigella flexneri 2a str. 301
aucagcaucucauccauca

SEQ ID NO: 2016060 - RNA, 20 nt, Shigella flexneri 2a str. 301
aucagcauucucaucaccau

SEQ ID NO: 2016061 - RNA, 19 nt, Shigella flexneri 2a str. 301
aucagcauucucaucacca

SEQ ID NO: 2016062 - RNA, 15 nt, Shigella flexneri 2a str. 301
aucagcgccaccaca

SEQ ID NO: 2016063 - RNA, 13 nt, Shigella flexneri 2a str. 301
aucagcccagccc

SEQ ID NO: 2016064 - RNA, 15 nt, Shigella flexneri 2a str. 301
aucagcgccagcgcg

SEQ ID NO: 2016065 - RNA, 14 nt, Shigella flexneri 2a str. 301
aucagcgccagcgc

SEQ ID NO: 2016066 - RNA, 15 nt, Shigella flexneri 2a str. 301
aucagcgccaccagc

SEQ ID NO: 2016067 - RNA, 18 nt, Shigella flexneri 2a str. 301
aucagcgcauagagacuu

SEQ ID NO: 2016068 - RNA, 23 nt, Shigella flexneri 2a str. 301
aucagcguaggacacagaauguu

SEQ ID NO: 2016069 - RNA, 22 nt, Shigella flexneri 2a str. 301
aucagcggugccgcgauaccac

SEQ ID NO: 2016070 - RNA, 16 nt, Shigella flexneri 2a str. 301
aucagcggacgcugcu

SEQ ID NO: 2016071 - RNA, 18 nt, Shigella flexneri 2a str. 301
aucagaguugaaaaacau

SEQ ID NO: 2016072 - RNA, 16 nt, Shigella flexneri 2a str. 301
aucagaguugaaaaac

SEQ ID NO: 2016073 - RNA, 22 nt, Shigella flexneri 2a str. 301
aucagauucacgguauuauuca

SEQ ID NO: 2016074 - RNA, 15 nt, Shigella flexneri 2a str. 301
aucagauucagcagc

SEQ ID NO: 2016075 - RNA, 17 nt, Shigella flexneri 2a str. 301
aucagauugccacagga

SEQ ID NO: 2016076 - RNA, 19 nt, Shigella flexneri 2a str. 301
aucagauggcggcuggcgc

SEQ ID NO: 2016077 - RNA, 16 nt, Shigella flexneri 2a str. 301
aucagauggcggcugg

SEQ ID NO: 2016078 - RNA, 23 nt, Shigella flexneri 2a str. 301
aucagaucguugaacccggcauc

SEQ ID NO: 2016079 - RNA, 22 nt, Shigella flexneri 2a str. 301
aucagaauuuuucgcuaaaaaa

SEQ ID NO: 2016080 - RNA, 16 nt, Shigella flexneri 2a str. 301
aucagacaccagccag

SEQ ID NO: 2016081 - RNA, 21 nt, Shigella flexneri 2a str. 301
aucagacaaaugucacugcuu

SEQ ID NO: 2016082 - RNA, 14 nt, Shigella flexneri 2a str. 301
aucagacuggcggc

SEQ ID NO: 2016083 - RNA, 21 nt, Shigella flexneri 2a str. 301
aucacuguuugacaacucauc

SEQ ID NO: 2016084 - RNA, 13 nt, Shigella flexneri 2a str. 301
aucacuuaaccca

SEQ ID NO: 2016085 - RNA, 15 nt, Shigella flexneri 2a str. 301
aucacuuccagcagu

SEQ ID NO: 2016086 - RNA, 19 nt, Shigella flexneri 2a str. 301
aucacuuccagcaguucgc

SEQ ID NO: 2016087 - RNA, 17 nt, Shigella flexneri 2a str. 301
aucacuuuugaaaucaa

SEQ ID NO: 2016088 - RNA, 14 nt, Shigella flexneri 2a str. 301
aucacuucgccgau

SEQ ID NO: 2016089 - RNA, 17 nt, Shigella flexneri 2a str. 301
aucagaaacacacuuuc

SEQ ID NO: 2016090 - RNA, 13 nt, Shigella flexneri 2a str. 301
aucagaaggguug

SEQ ID NO: 2016091 - RNA, 14 nt, Shigella flexneri 2a str. 301
aucaagucagaugc

SEQ ID NO: 2016092 - RNA, 14 nt, Shigella flexneri 2a str. 301
aucaagucauugau

SEQ ID NO: 2016093 - RNA, 14 nt, Shigella flexneri 2a str. 301
aucaagcugugccu

SEQ ID NO: 2016094 - RNA, 13 nt, Shigella flexneri 2a str. 301
aucaagcacaauc

SEQ ID NO: 2016095 - RNA, 14 nt, Shigella flexneri 2a str. 301
aucaagcaacauaa

SEQ ID NO: 2016096 - RNA, 23 nt, Shigella flexneri 2a str. 301
aucaagcaaggccagguuuucuu

SEQ ID NO: 2016097 - RNA, 15 nt, Shigella flexneri 2a str. 301
aucaagauuaaaagu

SEQ ID NO: 2016098 - RNA, 15 nt, Shigella flexneri 2a str. 301
aucaagccagaaagu

SEQ ID NO: 2016099 - RNA, 18 nt, Shigella flexneri 2a str. 301
aucaagcgccgaguaaaa

SEQ ID NO: 2016100 - RNA, 19 nt, Shigella flexneri 2a str. 301
aucaacgcuggcaugcucu

SEQ ID NO: 2016101 - RNA, 15 nt, Shigella flexneri 2a str. 301
aucaacggcaacaau

SEQ ID NO: 2016102 - RNA, 22 nt, Shigella flexneri 2a str. 301
aucaacgcaccgacaaauuuca

SEQ ID NO: 2016103 - RNA, 15 nt, Shigella flexneri 2a str. 301
aucaaacaauuuuca

SEQ ID NO: 2016104 - RNA, 22 nt, Shigella flexneri 2a str. 301
aucaaacagaauauugugcuca

SEQ ID NO: 2016105 - RNA, 17 nt, Shigella flexneri 2a str. 301
aucaaaacgcucugagc

SEQ ID NO: 2016106 - RNA, 18 nt, Shigella flexneri 2a str. 301
aucaaaacgcucugagcu

SEQ ID NO: 2016107 - RNA, 20 nt, Shigella flexneri 2a str. 301
aucaaaacgcucugagcugc

SEQ ID NO: 2016108 - RNA, 13 nt, Shigella flexneri 2a str. 301
aucaaaacgcugg

SEQ ID NO: 2016109 - RNA, 20 nt, Shigella flexneri 2a str. 301
aucaaacgugacauucugac

SEQ ID NO: 2016110 - RNA, 19 nt, Shigella flexneri 2a str. 301
aucaaacgugacauucuga

SEQ ID NO: 2016111 - RNA, 16 nt, Shigella flexneri 2a str. 301
aucaaacggugguugu

SEQ ID NO: 2016112 - RNA, 22 nt, Shigella flexneri 2a str. 301
aucaaacgccugaccguugauu

SEQ ID NO: 2016113 - RNA, 19 nt, Shigella flexneri 2a str. 301
aucaaccgcuacauacuua

SEQ ID NO: 2016114 - RNA, 14 nt, Shigella flexneri 2a str. 301
aucaacauucagau

SEQ ID NO: 2016115 - RNA, 15 nt, Shigella flexneri 2a str. 301
aucaacccagcuggu

SEQ ID NO: 2016116 - RNA, 16 nt, Shigella flexneri 2a str. 301
aucaauggaugcaauc

SEQ ID NO: 2016117 - RNA, 22 nt, Shigella flexneri 2a str. 301
aucaaugugcugagaacaagau

SEQ ID NO: 2016118 - RNA, 16 nt, Shigella flexneri 2a str. 301
aucaaugaugaacgcc

SEQ ID NO: 2016119 - RNA, 15 nt, Shigella flexneri 2a str. 301
aucaaugccagcaua

SEQ ID NO: 2016120 - RNA, 21 nt, Shigella flexneri 2a str. 301
aucaaugccgcaacuuuagcc

SEQ ID NO: 2016121 - RNA, 15 nt, Shigella flexneri 2a str. 301
aucaauauccaccgg

SEQ ID NO: 2016122 - RNA, 14 nt, Shigella flexneri 2a str. 301
aucaaguugauuuu

SEQ ID NO: 2016123 - RNA, 22 nt, Shigella flexneri 2a str. 301
aucaauagcaacugauuuauag

SEQ ID NO: 2016124 - RNA, 18 nt, Shigella flexneri 2a str. 301
aucaauagugaacugacu

SEQ ID NO: 2016125 - RNA, 20 nt, Shigella flexneri 2a str. 301
aucaauagcaguaauuuuac

SEQ ID NO: 2016126 - RNA, 22 nt, Shigella flexneri 2a str. 301
aucaauagcuaacgaaagaaca

SEQ ID NO: 2016127 - RNA, 15 nt, Shigella flexneri 2a str. 301
aucacaauaaucgcc

SEQ ID NO: 2016128 - RNA, 16 nt, Shigella flexneri 2a str. 301
aucacaauagaaauau

SEQ ID NO: 2016129 - RNA, 18 nt, Shigella flexneri 2a str. 301
aucacaaucggcuuucac

SEQ ID NO: 2016130 - RNA, 23 nt, Shigella flexneri 2a str. 301
aucacaaucggcuuucaccgccu

SEQ ID NO: 2016131 - RNA, 23 nt, Shigella flexneri 2a str. 301
aucaauuuccggcuuaccaaaua

SEQ ID NO: 2016132 - RNA, 21 nt, Shigella flexneri 2a str. 301
aucaauuuauugaauuuacac

SEQ ID NO: 2016133 - RNA, 13 nt, Shigella flexneri 2a str. 301
aucaauuucacag

SEQ ID NO: 2016134 - RNA, 15 nt, Shigella flexneri 2a str. 301
aucaauugcuaccga

SEQ ID NO: 2016135 - RNA, 20 nt, Shigella flexneri 2a str. 301
aucaauugcguuaaaaucag

SEQ ID NO: 2016136 - RNA, 20 nt, Shigella flexneri 2a str. 301
aucaauuugcuucuggcugg

SEQ ID NO: 2016137 - RNA, 17 nt, Shigella flexneri 2a str. 301
auauucaacgucacugg

SEQ ID NO: 2016138 - RNA, 12 nt, Shigella flexneri 2a str. 301
auauucaccacg

SEQ ID NO: 2016139 - RNA, 13 nt, Shigella flexneri 2a str. 301
auauucaauugga

SEQ ID NO: 2016140 - RNA, 17 nt, Shigella flexneri 2a str. 301
auaugauaauuauuaua

SEQ ID NO: 2016141 - RNA, 20 nt, Shigella flexneri 2a str. 301
auaugagcgauuuuuuauag

SEQ ID NO: 2016142 - RNA, 15 nt, Shigella flexneri 2a str. 301
auauuauugaaauca

SEQ ID NO: 2016143 - RNA, 24 nt, Shigella flexneri 2a str. 301
auauuauuggcaucguauuucaga

SEQ ID NO: 2016144 - RNA, 17 nt, Shigella flexneri 2a str. 301
auauucucaaaauacag

SEQ ID NO: 2016145 - RNA, 14 nt, Shigella flexneri 2a str. 301
auauucagcagcag

SEQ ID NO: 2016146 - RNA, 20 nt, Shigella flexneri 2a str. 301
auauucaggcguugaaaaau

SEQ ID NO: 2016147 - RNA, 11 nt, Shigella flexneri 2a str. 301
auauuccugca

SEQ ID NO: 2016148 - RNA, 20 nt, Shigella flexneri 2a str. 301
auauuccuuuaucauuaaca

SEQ ID NO: 2016149 - RNA, 20 nt, Shigella flexneri 2a str. 301
auauucgacaccaucuuccu

SEQ ID NO: 2016150 - RNA, 23 nt, Shigella flexneri 2a str. 301
auauucgacaccaucuuccucac

SEQ ID NO: 2016151 - RNA, 14 nt, Shigella flexneri 2a str. 301
auauucgcuuucag

SEQ ID NO: 2016152 - RNA, 11 nt, Shigella flexneri 2a str. 301
auauucguuau

SEQ ID NO: 2016153 - RNA, 20 nt, Shigella flexneri 2a str. 301
auauuuuuuuccuaaacccu

SEQ ID NO: 2016154 - RNA, 21 nt, Shigella flexneri 2a str. 301
aucaaaaaaggcugacaaauc

SEQ ID NO: 2016155 - RNA, 15 nt, Shigella flexneri 2a str. 301
auauuuuuaaauaua

SEQ ID NO: 2016156 - RNA, 14 nt, Shigella flexneri 2a str. 301
auauuuuucccuga

SEQ ID NO: 2016157 - RNA, 20 nt, Shigella flexneri 2a str. 301
auauuuugcuuuaaguucag

SEQ ID NO: 2016158 - RNA, 19 nt, Shigella flexneri 2a str. 301
auauugucuucaagaucag

SEQ ID NO: 2016159 - RNA, 19 nt, Shigella flexneri 2a str. 301
auauugccgaagaccagau

SEQ ID NO: 2016160 - RNA, 21 nt, Shigella flexneri 2a str. 301
auauugcccgugacucccacu

SEQ ID NO: 2016161 - RNA, 22 nt, Shigella flexneri 2a str. 301
auauugccgauuacguaauuca

SEQ ID NO: 2016162 - RNA, 15 nt, Shigella flexneri 2a str. 301
auauuuuaaucagcg

SEQ ID NO: 2016163 - RNA, 23 nt, Shigella flexneri 2a str. 301
auauuuaaacggcguaaaauuca

SEQ ID NO: 2016164 - RNA, 13 nt, Shigella flexneri 2a str. 301
auacugcucagac

SEQ ID NO: 2016165 - RNA, 14 nt, Shigella flexneri 2a str. 301
auacugaucaucau

SEQ ID NO: 2016166 - RNA, 14 nt, Shigella flexneri 2a str. 301
auacugcaucagcg

SEQ ID NO: 2016167 - RNA, 14 nt, Shigella flexneri 2a str. 301
auacugacaucagc

SEQ ID NO: 2016168 - RNA, 21 nt, Shigella flexneri 2a str. 301
auacucuuugguauucaaccg

SEQ ID NO: 2016169 - RNA, 17 nt, Shigella flexneri 2a str. 301
auacugagcaaggcaua

SEQ ID NO: 2016170 - RNA, 17 nt, Shigella flexneri 2a str. 301
auacuggauuucauucg

SEQ ID NO: 2016171 - RNA, 23 nt, Shigella flexneri 2a str. 301
auacuggauagauauucuccagc

SEQ ID NO: 2016172 - RNA, 22 nt, Shigella flexneri 2a str. 301
auacugcuuaaaccauuccagc

SEQ ID NO: 2016173 - RNA, 16 nt, Shigella flexneri 2a str. 301
auacuggcuaagaagc

SEQ ID NO: 2016174 - RNA, 13 nt, Shigella flexneri 2a str. 301
auacugguuucug

SEQ ID NO: 2016175 - RNA, 19 nt, Shigella flexneri 2a str. 301
auacuguuuaucuucccag

SEQ ID NO: 2016176 - RNA, 15 nt, Shigella flexneri 2a str. 301
auacuuccacgcaga

SEQ ID NO: 2016177 - RNA, 20 nt, Shigella flexneri 2a str. 301
auacgugccgguaaugcuga

SEQ ID NO: 2016178 - RNA, 19 nt, Shigella flexneri 2a str. 301
auacucugucugaucuggu

SEQ ID NO: 2016179 - RNA, 13 nt, Shigella flexneri 2a str. 301
auacucuccucca

SEQ ID NO: 2016180 - RNA, 19 nt, Shigella flexneri 2a str. 301
auacucuuugacaacauca

SEQ ID NO: 2016181 - RNA, 13 nt, Shigella flexneri 2a str. 301
auacgcaccgcuc

SEQ ID NO: 2016182 - RNA, 16 nt, Shigella flexneri 2a str. 301
auaccuuacacucaaa

SEQ ID NO: 2016183 - RNA, 17 nt, Shigella flexneri 2a str. 301
auaccuuacacucaaau

SEQ ID NO: 2016184 - RNA, 15 nt, Shigella flexneri 2a str. 301
auacgucaucccaac

SEQ ID NO: 2016185 - RNA, 16 nt, Shigella flexneri 2a str. 301
auacguccaccccagc

SEQ ID NO: 2016186 - RNA, 21 nt, Shigella flexneri 2a str. 301
auaccggcgucccaucggcaa

SEQ ID NO: 2016187 - RNA, 15 nt, Shigella flexneri 2a str. 301
auaccgggaucaggu

SEQ ID NO: 2016188 - RNA, 20 nt, Shigella flexneri 2a str. 301
auaccgucaggauaaacucc

SEQ ID NO: 2016189 - RNA, 15 nt, Shigella flexneri 2a str. 301
auaccugguccuuca

SEQ ID NO: 2016190 - RNA, 17 nt, Shigella flexneri 2a str. 301
auaccuggcgcagcugc

SEQ ID NO: 2016191 - RNA, 13 nt, Shigella flexneri 2a str. 301
auaccugccuggu

SEQ ID NO: 2016192 - RNA, 23 nt, Shigella flexneri 2a str. 301
auaccugaguggcaauagaauaa

SEQ ID NO: 2016193 - RNA, 16 nt, Shigella flexneri 2a str. 301
auaauuacuuacaucu

SEQ ID NO: 2016194 - RNA, 19 nt, Shigella flexneri 2a str. 301
auaccggacacacuucauu

SEQ ID NO: 2016195 - RNA, 14 nt, Shigella flexneri 2a str. 301
auaccggacacacu

SEQ ID NO: 2016196 - RNA, 15 nt, Shigella flexneri 2a str. 301
auaccgcgaaucaua

SEQ ID NO: 2016197 - RNA, 17 nt, Shigella flexneri 2a str. 301
auagcacccgccagcgc

SEQ ID NO: 2016198 - RNA, 17 nt, Shigella flexneri 2a str. 301
auagcacgacguuucuu

SEQ ID NO: 2016199 - RNA, 19 nt, Shigella flexneri 2a str. 301
auagcaauauuuuguugca

SEQ ID NO: 2016200 - RNA, 12 nt, Shigella flexneri 2a str. 301
auagauuauuug

SEQ ID NO: 2016201 - RNA, 14 nt, Shigella flexneri 2a str. 301
auagagcgccugca

SEQ ID NO: 2016202 - RNA, 23 nt, Shigella flexneri 2a str. 301
auagaguaucggcucguuacuuu

SEQ ID NO: 2016203 - RNA, 15 nt, Shigella flexneri 2a str. 301
auagagauuuuuccc

SEQ ID NO: 2016204 - RNA, 23 nt, Shigella flexneri 2a str. 301
auacuuucaucaaacgaccaauc

SEQ ID NO: 2016205 - RNA, 19 nt, Shigella flexneri 2a str. 301
auacuuucacaaaaauaau

SEQ ID NO: 2016206 - RNA, 13 nt, Shigella flexneri 2a str. 301
auacuuucacaaa

SEQ ID NO: 2016207 - RNA, 18 nt, Shigella flexneri 2a str. 301
auagccacuugcuggaag

SEQ ID NO: 2016208 - RNA, 15 nt, Shigella flexneri 2a str. 301
auagccagcaacauu

SEQ ID NO: 2016209 - RNA, 19 nt, Shigella flexneri 2a str. 301
auagccccuggugagaguc

SEQ ID NO: 2016210 - RNA, 19 nt, Shigella flexneri 2a str. 301
auagccagcagagcaaaaa

SEQ ID NO: 2016211 - RNA, 15 nt, Shigella flexneri 2a str. 301
auagcggcugacggu

SEQ ID NO: 2016212 - RNA, 12 nt, Shigella flexneri 2a str. 301
auagcgucaaga

SEQ ID NO: 2016213 - RNA, 21 nt, Shigella flexneri 2a str. 301
auagcgguaagcaugaauauc

SEQ ID NO: 2016214 - RNA, 17 nt, Shigella flexneri 2a str. 301
auagcuuauucuuauua

SEQ ID NO: 2016215 - RNA, 14 nt, Shigella flexneri 2a str. 301
auagcuaaucaucu

SEQ ID NO: 2016216 - RNA, 19 nt, Shigella flexneri 2a str. 301
auagcuaaucaucuguugu

SEQ ID NO: 2016217 - RNA, 14 nt, Shigella flexneri 2a str. 301
auagcuggcaacgc

SEQ ID NO: 2016218 - RNA, 21 nt, Shigella flexneri 2a str. 301
auaucugccagauaauggcug

SEQ ID NO: 2016219 - RNA, 19 nt, Shigella flexneri 2a str. 301
auaucugccggaagacaca

SEQ ID NO: 2016220 - RNA, 20 nt, Shigella flexneri 2a str. 301
auaucuaugguuuuuucuac

SEQ ID NO: 2016221 - RNA, 23 nt, Shigella flexneri 2a str. 301
auaucuuucccuuucgauaagac

SEQ ID NO: 2016222 - RNA, 13 nt, Shigella flexneri 2a str. 301
auaucuuuucuua

SEQ ID NO: 2016223 - RNA, 12 nt, Shigella flexneri 2a str. 301
auaucuuuuuug

SEQ ID NO: 2016224 - RNA, 19 nt, Shigella flexneri 2a str. 301
auauccagcgccgagguug

SEQ ID NO: 2016225 - RNA, 12 nt, Shigella flexneri 2a str. 301
auauccaggcua

SEQ ID NO: 2016226 - RNA, 13 nt, Shigella flexneri 2a str. 301
auauccagauaga

SEQ ID NO: 2016227 - RNA, 21 nt, Shigella flexneri 2a str. 301
auaucgacgaaccauuucgau

SEQ ID NO: 2016228 - RNA, 14 nt, Shigella flexneri 2a str. 301
auaucgacgaccug

SEQ ID NO: 2016229 - RNA, 17 nt, Shigella flexneri 2a str. 301
auaucgacgaaccauuu

SEQ ID NO: 2016230 - RNA, 21 nt, Shigella flexneri 2a str. 301
auauccaccgggguaaaucca

SEQ ID NO: 2016231 - RNA, 17 nt, Shigella flexneri 2a str. 301
auaucgccauuaaacaa

SEQ ID NO: 2016232 - RNA, 22 nt, Shigella flexneri 2a str. 301
auaucgcauaccauccaggaga

SEQ ID NO: 2016233 - RNA, 16 nt, Shigella flexneri 2a str. 301
auaucuaaugucauaa

SEQ ID NO: 2016234 - RNA, 24 nt, Shigella flexneri 2a str. 301
auaucguucaagagacugcuggcu

SEQ ID NO: 2016235 - RNA, 23 nt, Shigella flexneri 2a str. 301
auaucguucugccagauagagua

SEQ ID NO: 2016236 - RNA, 14 nt, Shigella flexneri 2a str. 301
auaucaagcaugau

SEQ ID NO: 2016237 - RNA, 14 nt, Shigella flexneri 2a str. 301
auaucaagccaugc

SEQ ID NO: 2016238 - RNA, 19 nt, Shigella flexneri 2a str. 301
auaucaacguaauggaugc

SEQ ID NO: 2016239 - RNA, 20 nt, Shigella flexneri 2a str. 301
auaucaaaacgcucugagcu

SEQ ID NO: 2016240 - RNA, 22 nt, Shigella flexneri 2a str. 301
auaucagccugaaugcuuucau

SEQ ID NO: 2016241 - RNA, 19 nt, Shigella flexneri 2a str. 301
auauauugcaaucaucuug

SEQ ID NO: 2016242 - RNA, 17 nt, Shigella flexneri 2a str. 301
auauauugcugaaauaa

SEQ ID NO: 2016243 - RNA, 18 nt, Shigella flexneri 2a str. 301
auauauugggaucaaaaa

SEQ ID NO: 2016244 - RNA, 17 nt, Shigella flexneri 2a str. 301
auauauuucaucaacug

SEQ ID NO: 2016245 - RNA, 17 nt, Shigella flexneri 2a str. 301
auauauuuuuaaauaua

SEQ ID NO: 2016246 - RNA, 23 nt, Shigella flexneri 2a str. 301
auauauugaauuagcaauauuuu

SEQ ID NO: 2016247 - RNA, 17 nt, Shigella flexneri 2a str. 301
auauauugaauuugcau

SEQ ID NO: 2016248 - RNA, 21 nt, Shigella flexneri 2a str. 301
auauauucguuacuggcaugu

SEQ ID NO: 2016249 - RNA, 15 nt, Shigella flexneri 2a str. 301
auauagacaaaguaa

SEQ ID NO: 2016250 - RNA, 14 nt, Shigella flexneri 2a str. 301
auauauuaaucauc

SEQ ID NO: 2016251 - RNA, 15 nt, Shigella flexneri 2a str. 301
auauauuaaucauca

SEQ ID NO: 2016252 - RNA, 16 nt, Shigella flexneri 2a str. 301
auauauuaaucaucau

SEQ ID NO: 2016253 - RNA, 22 nt, Shigella flexneri 2a str. 301
auauauuacaacguauuauaua

SEQ ID NO: 2016254 - RNA, 13 nt, Shigella flexneri 2a str. 301
auauacaaucaca

SEQ ID NO: 2016255 - RNA, 18 nt, Shigella flexneri 2a str. 301
auauacaaucacacuaac

SEQ ID NO: 2016256 - RNA, 16 nt, Shigella flexneri 2a str. 301
auaguaauuucaucug

SEQ ID NO: 2016257 - RNA, 14 nt, Shigella flexneri 2a str. 301
auaggugucaacca

SEQ ID NO: 2016258 - RNA, 18 nt, Shigella flexneri 2a str. 301
auagguugaaauaaaccg

SEQ ID NO: 2016259 - RNA, 14 nt, Shigella flexneri 2a str. 301
auagguggcaaaga

SEQ ID NO: 2016260 - RNA, 13 nt, Shigella flexneri 2a str. 301
auagggacacauu

SEQ ID NO: 2016261 - RNA, 15 nt, Shigella flexneri 2a str. 301
auagguaaacaucac

SEQ ID NO: 2016262 - RNA, 19 nt, Shigella flexneri 2a str. 301
auaggcuuccaccguuucu

SEQ ID NO: 2016263 - RNA, 23 nt, Shigella flexneri 2a str. 301
auaggauuucugauuauggcggc

SEQ ID NO: 2016264 - RNA, 21 nt, Shigella flexneri 2a str. 301
auaggcaaaaaaaaugcccgc

SEQ ID NO: 2016265 - RNA, 20 nt, Shigella flexneri 2a str. 301
auaggcaggcaucaucagau

SEQ ID NO: 2016266 - RNA, 17 nt, Shigella flexneri 2a str. 301
auaggaauuaaaacccc

SEQ ID NO: 2016267 - RNA, 14 nt, Shigella flexneri 2a str. 301
auaggaauuaaaac

SEQ ID NO: 2016268 - RNA, 20 nt, Shigella flexneri 2a str. 301
auaguagguccugaccaaag

SEQ ID NO: 2016269 - RNA, 15 nt, Shigella flexneri 2a str. 301
auaguagccagccag

SEQ ID NO: 2016270 - RNA, 15 nt, Shigella flexneri 2a str. 301
auaguggcucagacu

SEQ ID NO: 2016271 - RNA, 20 nt, Shigella flexneri 2a str. 301
auaguugcauuccaguccac

SEQ ID NO: 2016272 - RNA, 20 nt, Shigella flexneri 2a str. 301
auaguuggcccgauagaaac

SEQ ID NO: 2016273 - RNA, 19 nt, Shigella flexneri 2a str. 301
auaguugauuaauuucauu

SEQ ID NO: 2016274 - RNA, 13 nt, Shigella flexneri 2a str. 301
auauaauuaaaaa

SEQ ID NO: 2016275 - RNA, 14 nt, Shigella flexneri 2a str. 301
auauaauuaaaaau

SEQ ID NO: 2016276 - RNA, 22 nt, Shigella flexneri 2a str. 301
auauaauuccauucaccauuuu

SEQ ID NO: 2016277 - RNA, 17 nt, Shigella flexneri 2a str. 301
auauaacagucauacaa

SEQ ID NO: 2016278 - RNA, 21 nt, Shigella flexneri 2a str. 301
auauaaauguuaagacuggca

SEQ ID NO: 2016279 - RNA, 15 nt, Shigella flexneri 2a str. 301
auuaucguagcagca

SEQ ID NO: 2016280 - RNA, 16 nt, Shigella flexneri 2a str. 301
auuaucggcaccauuu

SEQ ID NO: 2016281 - RNA, 19 nt, Shigella flexneri 2a str. 301
auuaucgcgucuaaauuuu

SEQ ID NO: 2016282 - RNA, 15 nt, Shigella flexneri 2a str. 301
auuaucccccagcac

SEQ ID NO: 2016283 - RNA, 17 nt, Shigella flexneri 2a str. 301
auuaucagagauucuuu

SEQ ID NO: 2016284 - RNA, 15 nt, Shigella flexneri 2a str. 301
auuaucagcaaagca

SEQ ID NO: 2016285 - RNA, 18 nt, Shigella flexneri 2a str. 301
auuaucagacaccgauug

SEQ ID NO: 2016286 - RNA, 14 nt, Shigella flexneri 2a str. 301
auuaucacucugcc

SEQ ID NO: 2016287 - RNA, 14 nt, Shigella flexneri 2a str. 301
auuaucucaacaca

SEQ ID NO: 2016288 - RNA, 20 nt, Shigella flexneri 2a str. 301
auuaucguuacgacgcaauc

SEQ ID NO: 2016289 - RNA, 21 nt, Shigella flexneri 2a str. 301
auuaucuggcaagccugaaaa

SEQ ID NO: 2016290 - RNA, 19 nt, Shigella flexneri 2a str. 301
auuaucuggaauuccuuuc

SEQ ID NO: 2016291 - RNA, 12 nt, Shigella flexneri 2a str. 301
auuaucuuuacu

SEQ ID NO: 2016292 - RNA, 16 nt, Shigella flexneri 2a str. 301
auuaugcagccuucau

SEQ ID NO: 2016293 - RNA, 22 nt, Shigella flexneri 2a str. 301
auuaugaucaaaaucauauaau

SEQ ID NO: 2016294 - RNA, 14 nt, Shigella flexneri 2a str. 301
auuauuauuuuugu

SEQ ID NO: 2016295 - RNA, 16 nt, Shigella flexneri 2a str. 301
auuauuccguuucguu

SEQ ID NO: 2016296 - RNA, 12 nt, Shigella flexneri 2a str. 301
auuauugccgca

SEQ ID NO: 2016297 - RNA, 16 nt, Shigella flexneri 2a str. 301
auuauugcgcacauca

SEQ ID NO: 2016298 - RNA, 23 nt, Shigella flexneri 2a str. 301
auuauuggcaucguauuucagac

SEQ ID NO: 2016299 - RNA, 14 nt, Shigella flexneri 2a str. 301
auuauugucgccgc

SEQ ID NO: 2016300 - RNA, 16 nt, Shigella flexneri 2a str. 301
auuauuaauauucagc

SEQ ID NO: 2016301 - RNA, 23 nt, Shigella flexneri 2a str. 301
auuaugccgccgacaguuaucaa

SEQ ID NO: 2016302 - RNA, 18 nt, Shigella flexneri 2a str. 301
auuaugcgaccauaugaa

SEQ ID NO: 2016303 - RNA, 21 nt, Shigella flexneri 2a str. 301
auuaugcgcggcauacagcca

SEQ ID NO: 2016304 - RNA, 19 nt, Shigella flexneri 2a str. 301
auuaugugguuaugccauu

SEQ ID NO: 2016305 - RNA, 13 nt, Shigella flexneri 2a str. 301
auucaaacgugaa

SEQ ID NO: 2016306 - RNA, 13 nt, Shigella flexneri 2a str. 301
auucaaacgugag

SEQ ID NO: 2016307 - RNA, 22 nt, Shigella flexneri 2a str. 301
auuauuuuugugaagaauaaau

SEQ ID NO: 2016308 - RNA, 19 nt, Shigella flexneri 2a str. 301
auuauuuuugugaagaaua

SEQ ID NO: 2016309 - RNA, 19 nt, Shigella flexneri 2a str. 301
auuauuugcgucagcucac

SEQ ID NO: 2016310 - RNA, 23 nt, Shigella flexneri 2a str. 301
auuauuucaaugcauuaucagag

SEQ ID NO: 2016311 - RNA, 21 nt, Shigella flexneri 2a str. 301
auuauuucccggcugauaaag

SEQ ID NO: 2016312 - RNA, 19 nt, Shigella flexneri 2a str. 301
auuauuuuuaaacaucaaa

SEQ ID NO: 2016313 - RNA, 15 nt, Shigella flexneri 2a str. 301
auucaagaaacagca

SEQ ID NO: 2016314 - RNA, 17 nt, Shigella flexneri 2a str. 301
auucaagaaacagcagu

SEQ ID NO: 2016315 - RNA, 15 nt, Shigella flexneri 2a str. 301
auucaaucucuucac

SEQ ID NO: 2016316 - RNA, 13 nt, Shigella flexneri 2a str. 301
auucaaucucuuc

SEQ ID NO: 2016317 - RNA, 13 nt, Shigella flexneri 2a str. 301
auucaaauuaugu

SEQ ID NO: 2016318 - RNA, 18 nt, Shigella flexneri 2a str. 301
auucaacaccgaugcaau

SEQ ID NO: 2016319 - RNA, 17 nt, Shigella flexneri 2a str. 301
auucaacgucacugggu

SEQ ID NO: 2016320 - RNA, 15 nt, Shigella flexneri 2a str. 301
auucaacgucacugg

SEQ ID NO: 2016321 - RNA, 17 nt, Shigella flexneri 2a str. 301
auucaccagaccugaaa

SEQ ID NO: 2016322 - RNA, 17 nt, Shigella flexneri 2a str. 301
auucaccagcaaaucca

SEQ ID NO: 2016323 - RNA, 18 nt, Shigella flexneri 2a str. 301
auucacaguuaaguuaau

SEQ ID NO: 2016324 - RNA, 14 nt, Shigella flexneri 2a str. 301
auucacauuuaaac

SEQ ID NO: 2016325 - RNA, 17 nt, Shigella flexneri 2a str. 301
auucacauuuuuaagcc

SEQ ID NO: 2016326 - RNA, 16 nt, Shigella flexneri 2a str. 301
auucaauuaauaacac

SEQ ID NO: 2016327 - RNA, 15 nt, Shigella flexneri 2a str. 301
auucaauuauaguau

SEQ ID NO: 2016328 - RNA, 19 nt, Shigella flexneri 2a str. 301
auucaauuauaguaucguu

SEQ ID NO: 2016329 - RNA, 16 nt, Shigella flexneri 2a str. 301
auucaaucucuucaca

SEQ ID NO: 2016330 - RNA, 18 nt, Shigella flexneri 2a str. 301
auucacacaguucuucuc

SEQ ID NO: 2016331 - RNA, 19 nt, Shigella flexneri 2a str. 301
auucacacaguucuucuca

SEQ ID NO: 2016332 - RNA, 14 nt, Shigella flexneri 2a str. 301
auucaauuugcaau

SEQ ID NO: 2016333 - RNA, 18 nt, Shigella flexneri 2a str. 301
auucaauuugcaauuuuc

SEQ ID NO: 2016334 - RNA, 20 nt, Shigella flexneri 2a str. 301
auucagaucuuuaaugaucu

SEQ ID NO: 2016335 - RNA, 23 nt, Shigella flexneri 2a str. 301
auucagauaauccccaaugaccu

SEQ ID NO: 2016336 - RNA, 23 nt, Shigella flexneri 2a str. 301
auucagagggcaaauucuucacg

SEQ ID NO: 2016337 - RNA, 22 nt, Shigella flexneri 2a str. 301
auucagacaggcgaaacccgcu

SEQ ID NO: 2016338 - RNA, 23 nt, Shigella flexneri 2a str. 301
auucagaacacaaaaccgauuaa

SEQ ID NO: 2016339 - RNA, 17 nt, Shigella flexneri 2a str. 301
auucacugccugcugau

SEQ ID NO: 2016340 - RNA, 14 nt, Shigella flexneri 2a str. 301
auucacugcgccuc

SEQ ID NO: 2016341 - RNA, 17 nt, Shigella flexneri 2a str. 301
auucagaaaaauacaau

SEQ ID NO: 2016342 - RNA, 16 nt, Shigella flexneri 2a str. 301
auucacuuucugaagg

SEQ ID NO: 2016343 - RNA, 20 nt, Shigella flexneri 2a str. 301
auucacgccacugucauauu

SEQ ID NO: 2016344 - RNA, 17 nt, Shigella flexneri 2a str. 301
auucacgaaucuauuca

SEQ ID NO: 2016345 - RNA, 21 nt, Shigella flexneri 2a str. 301
auucacgaaucuauucauuua

SEQ ID NO: 2016346 - RNA, 17 nt, Shigella flexneri 2a str. 301
auucacgaauauuuccc

SEQ ID NO: 2016347 - RNA, 18 nt, Shigella flexneri 2a str. 301
auucacgcuaucuuucaa

SEQ ID NO: 2016348 - RNA, 18 nt, Shigella flexneri 2a str. 301
auucacguucgugaacau

SEQ ID NO: 2016349 - RNA, 15 nt, Shigella flexneri 2a str. 301
auucacucuauaccg

SEQ ID NO: 2016350 - RNA, 21 nt, Shigella flexneri 2a str. 301
auucacucuauaccgcugaag

SEQ ID NO: 2016351 - RNA, 20 nt, Shigella flexneri 2a str. 301
auuacacgcgacauaaaacc

SEQ ID NO: 2016352 - RNA, 12 nt, Shigella flexneri 2a str. 301
auuacacagcca

SEQ ID NO: 2016353 - RNA, 18 nt, Shigella flexneri 2a str. 301
auuacaagaaucaugcca

SEQ ID NO: 2016354 - RNA, 20 nt, Shigella flexneri 2a str. 301
auuacaucgcgaagaaagcg

SEQ ID NO: 2016355 - RNA, 13 nt, Shigella flexneri 2a str. 301
auuacauaacacu

SEQ ID NO: 2016356 - RNA, 14 nt, Shigella flexneri 2a str. 301
auuacagagguuuu

SEQ ID NO: 2016357 - RNA, 17 nt, Shigella flexneri 2a str. 301
auuacagagguuuuaug

SEQ ID NO: 2016358 - RNA, 18 nt, Shigella flexneri 2a str. 301
auuacaggcaguaaccaa

SEQ ID NO: 2016359 - RNA, 22 nt, Shigella flexneri 2a str. 301
auuaauugccguuaaaacuaaa

SEQ ID NO: 2016360 - RNA, 18 nt, Shigella flexneri 2a str. 301
auuaauugcaacgcccau

SEQ ID NO: 2016361 - RNA, 20 nt, Shigella flexneri 2a str. 301
auuaauugccguuaaaacua

SEQ ID NO: 2016362 - RNA, 23 nt, Shigella flexneri 2a str. 301
auuaauggugauggucgucaauc

SEQ ID NO: 2016363 - RNA, 14 nt, Shigella flexneri 2a str. 301
auuacgcucacugc

SEQ ID NO: 2016364 - RNA, 18 nt, Shigella flexneri 2a str. 301
auuacgcucacugcaaaa

SEQ ID NO: 2016365 - RNA, 20 nt, Shigella flexneri 2a str. 301
auuacgcucacugcaaaaca

SEQ ID NO: 2016366 - RNA, 21 nt, Shigella flexneri 2a str. 301
auuacgcaaugcguacuucuu

SEQ ID NO: 2016367 - RNA, 22 nt, Shigella flexneri 2a str. 301
auuacgcaggcaauccauaacg

SEQ ID NO: 2016368 - RNA, 20 nt, Shigella flexneri 2a str. 301
auuacgagucacaaacauca

SEQ ID NO: 2016369 - RNA, 21 nt, Shigella flexneri 2a str. 301
auuacgggcgaaguucgccau

SEQ ID NO: 2016370 - RNA, 21 nt, Shigella flexneri 2a str. 301
auuacgugaaguaaaaggucu

SEQ ID NO: 2016371 - RNA, 14 nt, Shigella flexneri 2a str. 301
auuacuacgguaau

SEQ ID NO: 2016372 - RNA, 13 nt, Shigella flexneri 2a str. 301
auuacuacgguaa

SEQ ID NO: 2016373 - RNA, 15 nt, Shigella flexneri 2a str. 301
auuacucaacgucaa

SEQ ID NO: 2016374 - RNA, 16 nt, Shigella flexneri 2a str. 301
auuacuaaaugugcaa

SEQ ID NO: 2016375 - RNA, 21 nt, Shigella flexneri 2a str. 301
auuacguggguaggaucaauu

SEQ ID NO: 2016376 - RNA, 19 nt, Shigella flexneri 2a str. 301
auuaccugaaaaaacaaau

SEQ ID NO: 2016377 - RNA, 13 nt, Shigella flexneri 2a str. 301
auuaccuuaucaa

SEQ ID NO: 2016378 - RNA, 13 nt, Shigella flexneri 2a str. 301
auuaccuucaaca

SEQ ID NO: 2016379 - RNA, 14 nt, Shigella flexneri 2a str. 301
auuaccuuccucaa

SEQ ID NO: 2016380 - RNA, 17 nt, Shigella flexneri 2a str. 301
auuaccuuuuuacccau

SEQ ID NO: 2016381 - RNA, 19 nt, Shigella flexneri 2a str. 301
auuaccuuuuuacccaugg

SEQ ID NO: 2016382 - RNA, 15 nt, Shigella flexneri 2a str. 301
auuaccuuuuuuccc

SEQ ID NO: 2016383 - RNA, 12 nt, Shigella flexneri 2a str. 301
auuacccaaaac

SEQ ID NO: 2016384 - RNA, 21 nt, Shigella flexneri 2a str. 301
auuaccgcaccaccagcagcu

SEQ ID NO: 2016385 - RNA, 22 nt, Shigella flexneri 2a str. 301
auuaccgaugugaacccugauu

SEQ ID NO: 2016386 - RNA, 20 nt, Shigella flexneri 2a str. 301
auuacccguugcaauacuuc

SEQ ID NO: 2016387 - RNA, 17 nt, Shigella flexneri 2a str. 301
auuaccaacucaucgcc

SEQ ID NO: 2016388 - RNA, 19 nt, Shigella flexneri 2a str. 301
auuaccaauaucaaauaaa

SEQ ID NO: 2016389 - RNA, 19 nt, Shigella flexneri 2a str. 301
auuaccaacgugcucacca

SEQ ID NO: 2016390 - RNA, 22 nt, Shigella flexneri 2a str. 301
auuagcguccggcugccagcca

SEQ ID NO: 2016391 - RNA, 15 nt, Shigella flexneri 2a str. 301
auuagcacuuuucgu

SEQ ID NO: 2016392 - RNA, 14 nt, Shigella flexneri 2a str. 301
auuagcagcaugau

SEQ ID NO: 2016393 - RNA, 16 nt, Shigella flexneri 2a str. 301
auuagcagcccgcagc

SEQ ID NO: 2016394 - RNA, 23 nt, Shigella flexneri 2a str. 301
auuagcagcccgcagcgccuggc

SEQ ID NO: 2016395 - RNA, 14 nt, Shigella flexneri 2a str. 301
auuagcaauaccau

SEQ ID NO: 2016396 - RNA, 14 nt, Shigella flexneri 2a str. 301
auuagcaauauuuu

SEQ ID NO: 2016397 - RNA, 18 nt, Shigella flexneri 2a str. 301
auuagcaauauuuuuaug

SEQ ID NO: 2016398 - RNA, 14 nt, Shigella flexneri 2a str. 301
auuagcccaauaau

SEQ ID NO: 2016399 - RNA, 16 nt, Shigella flexneri 2a str. 301
auuagauaaaaaugaa

SEQ ID NO: 2016400 - RNA, 12 nt, Shigella flexneri 2a str. 301
auuagacuauuu

SEQ ID NO: 2016401 - RNA, 21 nt, Shigella flexneri 2a str. 301
auuacuuucggugacuucaaa

SEQ ID NO: 2016402 - RNA, 14 nt, Shigella flexneri 2a str. 301
auuacuuuauuuau

SEQ ID NO: 2016403 - RNA, 18 nt, Shigella flexneri 2a str. 301
auuacuuuaagccuuccg

SEQ ID NO: 2016404 - RNA, 16 nt, Shigella flexneri 2a str. 301
auuacuuuauuuauau

SEQ ID NO: 2016405 - RNA, 15 nt, Shigella flexneri 2a str. 301
auuacuuaacgucaa

SEQ ID NO: 2016406 - RNA, 15 nt, Shigella flexneri 2a str. 301
auuacuuccuucaug

SEQ ID NO: 2016407 - RNA, 16 nt, Shigella flexneri 2a str. 301
auuacugacaauuugc

SEQ ID NO: 2016408 - RNA, 12 nt, Shigella flexneri 2a str. 301
auuacugagaac

SEQ ID NO: 2016409 - RNA, 23 nt, Shigella flexneri 2a str. 301
auuacugagauggcuucauccca

SEQ ID NO: 2016410 - RNA, 15 nt, Shigella flexneri 2a str. 301
auuacuggcgauugu

SEQ ID NO: 2016411 - RNA, 23 nt, Shigella flexneri 2a str. 301
auuacugccuugaugaaaaaacc

SEQ ID NO: 2016412 - RNA, 12 nt, Shigella flexneri 2a str. 301
auuacugauugc

SEQ ID NO: 2016413 - RNA, 17 nt, Shigella flexneri 2a str. 301
auuauaucgcucucuuu

SEQ ID NO: 2016414 - RNA, 15 nt, Shigella flexneri 2a str. 301
auuauauggaaaaau

SEQ ID NO: 2016415 - RNA, 13 nt, Shigella flexneri 2a str. 301
auuauaugugcuu

SEQ ID NO: 2016416 - RNA, 22 nt, Shigella flexneri 2a str. 301
auuauaauaagcgcaaggguaa

SEQ ID NO: 2016417 - RNA, 20 nt, Shigella flexneri 2a str. 301
auuagggaucaucuuaacuu

SEQ ID NO: 2016418 - RNA, 18 nt, Shigella flexneri 2a str. 301
auuaguguguauauacug

SEQ ID NO: 2016419 - RNA, 18 nt, Shigella flexneri 2a str. 301
auuagucaauuaaaaaau

SEQ ID NO: 2016420 - RNA, 20 nt, Shigella flexneri 2a str. 301
auguucagaaagcgccagca

SEQ ID NO: 2016421 - RNA, 22 nt, Shigella flexneri 2a str. 301
auguucagccgucauccaggaa

SEQ ID NO: 2016422 - RNA, 19 nt, Shigella flexneri 2a str. 301
auguucagauaaugcccga

SEQ ID NO: 2016423 - RNA, 22 nt, Shigella flexneri 2a str. 301
auguucaauaagcgcagccaaa

SEQ ID NO: 2016424 - RNA, 13 nt, Shigella flexneri 2a str. 301
auguucacugccg

SEQ ID NO: 2016425 - RNA, 22 nt, Shigella flexneri 2a str. 301
auguuccagugcgguaacguaa

SEQ ID NO: 2016426 - RNA, 13 nt, Shigella flexneri 2a str. 301
auguugcuggaag

SEQ ID NO: 2016427 - RNA, 19 nt, Shigella flexneri 2a str. 301
auguugcgcggucggaaaa

SEQ ID NO: 2016428 - RNA, 21 nt, Shigella flexneri 2a str. 301
auguuguuccuuuuauuuaac

SEQ ID NO: 2016429 - RNA, 14 nt, Shigella flexneri 2a str. 301
auguuguuuuuaac

SEQ ID NO: 2016430 - RNA, 16 nt, Shigella flexneri 2a str. 301
auguuguggccaguaa

SEQ ID NO: 2016431 - RNA, 23 nt, Shigella flexneri 2a str. 301
auguuguacagcgaaacauacag

SEQ ID NO: 2016432 - RNA, 18 nt, Shigella flexneri 2a str. 301
auguuguacaugcugcuu

SEQ ID NO: 2016433 - RNA, 17 nt, Shigella flexneri 2a str. 301
auguuggagauaacaac

SEQ ID NO: 2016434 - RNA, 23 nt, Shigella flexneri 2a str. 301
auguuugaaucaacauauuaaaa

SEQ ID NO: 2016435 - RNA, 12 nt, Shigella flexneri 2a str. 301
auguuugcaaua

SEQ ID NO: 2016436 - RNA, 11 nt, Shigella flexneri 2a str. 301
auguuugccau

SEQ ID NO: 2016437 - RNA, 23 nt, Shigella flexneri 2a str. 301
auguuugucacugacuauuuccg

SEQ ID NO: 2016438 - RNA, 13 nt, Shigella flexneri 2a str. 301
auguuuuccagca

SEQ ID NO: 2016439 - RNA, 20 nt, Shigella flexneri 2a str. 301
auguuuucagaccagacugc

SEQ ID NO: 2016440 - RNA, 19 nt, Shigella flexneri 2a str. 301
auguuucaacggaccaaua

SEQ ID NO: 2016441 - RNA, 19 nt, Shigella flexneri 2a str. 301
auguuuccgcgcagguaaa

SEQ ID NO: 2016442 - RNA, 22 nt, Shigella flexneri 2a str. 301
auguuucuggucugcuggaacu

SEQ ID NO: 2016443 - RNA, 16 nt, Shigella flexneri 2a str. 301
auguuuaugccugguu

SEQ ID NO: 2016444 - RNA, 14 nt, Shigella flexneri 2a str. 301
auguuuaucuacag

SEQ ID NO: 2016445 - RNA, 18 nt, Shigella flexneri 2a str. 301
auguuucaacggaccaau

SEQ ID NO: 2016446 - RNA, 22 nt, Shigella flexneri 2a str. 301
auguuuaguauuguuaaauauu

SEQ ID NO: 2016447 - RNA, 17 nt, Shigella flexneri 2a str. 301
auguuguuucucuuucu

SEQ ID NO: 2016448 - RNA, 17 nt, Shigella flexneri 2a str. 301
auuaaaauuucaugcug

SEQ ID NO: 2016449 - RNA, 16 nt, Shigella flexneri 2a str. 301
auuaaacagccaacug

SEQ ID NO: 2016450 - RNA, 19 nt, Shigella flexneri 2a str. 301
auuaaagagaucgaacagc

SEQ ID NO: 2016451 - RNA, 18 nt, Shigella flexneri 2a str. 301
auuaaacuggauggcucu

SEQ ID NO: 2016452 - RNA, 16 nt, Shigella flexneri 2a str. 301
auuaaaggaaggucau

SEQ ID NO: 2016453 - RNA, 22 nt, Shigella flexneri 2a str. 301
auuaaaguaggccagauaagac

SEQ ID NO: 2016454 - RNA, 18 nt, Shigella flexneri 2a str. 301
auuaaauccugaaaccau

SEQ ID NO: 2016455 - RNA, 15 nt, Shigella flexneri 2a str. 301
auuaaaaaguaagaa

SEQ ID NO: 2016456 - RNA, 14 nt, Shigella flexneri 2a str. 301
auuaaaaaaacacc

SEQ ID NO: 2016457 - RNA, 21 nt, Shigella flexneri 2a str. 301
auuaaaaaaacaccacaaaac

SEQ ID NO: 2016458 - RNA, 13 nt, Shigella flexneri 2a str. 301
auguuuuuugaug

SEQ ID NO: 2016459 - RNA, 19 nt, Shigella flexneri 2a str. 301
auuaaaagcguugcggcua

SEQ ID NO: 2016460 - RNA, 20 nt, Shigella flexneri 2a str. 301
auuaagcgcaaaggccagca

SEQ ID NO: 2016461 - RNA, 16 nt, Shigella flexneri 2a str. 301
auuaaggcaagaaaau

SEQ ID NO: 2016462 - RNA, 11 nt, Shigella flexneri 2a str. 301
auuaauacaac

SEQ ID NO: 2016463 - RNA, 13 nt, Shigella flexneri 2a str. 301
auuaauaacacau

SEQ ID NO: 2016464 - RNA, 17 nt, Shigella flexneri 2a str. 301
auuaauaaaauuaucca

SEQ ID NO: 2016465 - RNA, 21 nt, Shigella flexneri 2a str. 301
auuaaucccugcuucggucag

SEQ ID NO: 2016466 - RNA, 19 nt, Shigella flexneri 2a str. 301
auuaauccagggaucaaca

SEQ ID NO: 2016467 - RNA, 15 nt, Shigella flexneri 2a str. 301
auuaaucaucauuaa

SEQ ID NO: 2016468 - RNA, 14 nt, Shigella flexneri 2a str. 301
auuaaucagcagau

SEQ ID NO: 2016469 - RNA, 18 nt, Shigella flexneri 2a str. 301
auuaauaugcucaacaau

SEQ ID NO: 2016470 - RNA, 22 nt, Shigella flexneri 2a str. 301
auuaaucgagauaccuaacauu

SEQ ID NO: 2016471 - RNA, 21 nt, Shigella flexneri 2a str. 301
auuaaugacauucaggccgcc

SEQ ID NO: 2016472 - RNA, 21 nt, Shigella flexneri 2a str. 301
auuaaugcgcccagcgucagc

SEQ ID NO: 2016473 - RNA, 22 nt, Shigella flexneri 2a str. 301
auuaaauucaaugaauuaaaaa

SEQ ID NO: 2016474 - RNA, 22 nt, Shigella flexneri 2a str. 301
auuaaauucgaacggugaauuc

SEQ ID NO: 2016475 - RNA, 15 nt, Shigella flexneri 2a str. 301
auuaacaacgggcua

SEQ ID NO: 2016476 - RNA, 21 nt, Shigella flexneri 2a str. 301
auuaaccagccacugcgccau

SEQ ID NO: 2016477 - RNA, 15 nt, Shigella flexneri 2a str. 301
auuaacagcaaacag

SEQ ID NO: 2016478 - RNA, 21 nt, Shigella flexneri 2a str. 301
auuaagaagucgcaaugagua

SEQ ID NO: 2016479 - RNA, 18 nt, Shigella flexneri 2a str. 301
auuaacuucccaccuuua

SEQ ID NO: 2016480 - RNA, 13 nt, Shigella flexneri 2a str. 301
auuaacuuuucau

SEQ ID NO: 2016481 - RNA, 17 nt, Shigella flexneri 2a str. 301
auuaagcccggucauca

SEQ ID NO: 2016482 - RNA, 20 nt, Shigella flexneri 2a str. 301
auuaacuuaauaaacaucag

SEQ ID NO: 2016483 - RNA, 15 nt, Shigella flexneri 2a str. 301
auuaacgaaaucuca

SEQ ID NO: 2016484 - RNA, 18 nt, Shigella flexneri 2a str. 301
auuaaccucaaccacuca

SEQ ID NO: 2016485 - RNA, 16 nt, Shigella flexneri 2a str. 301
auuaacgauacuucug

SEQ ID NO: 2016486 - RNA, 20 nt, Shigella flexneri 2a str. 301
auuaacgauacuucugguga

SEQ ID NO: 2016487 - RNA, 19 nt, Shigella flexneri 2a str. 301
auuaacgcuuguaaaugaa

SEQ ID NO: 2016488 - RNA, 23 nt, Shigella flexneri 2a str. 301
auuaacggcguuuccuucguuau

SEQ ID NO: 2016489 - RNA, 20 nt, Shigella flexneri 2a str. 301
auuaacgccagccuguucca

SEQ ID NO: 2016490 - RNA, 19 nt, Shigella flexneri 2a str. 301
augguggugggggaaggau

SEQ ID NO: 2016491 - RNA, 21 nt, Shigella flexneri 2a str. 301
augguggugggggaaggauuc

SEQ ID NO: 2016492 - RNA, 14 nt, Shigella flexneri 2a str. 301
auggugaaaguaaa

SEQ ID NO: 2016493 - RNA, 17 nt, Shigella flexneri 2a str. 301
augguguucaggcauag

SEQ ID NO: 2016494 - RNA, 18 nt, Shigella flexneri 2a str. 301
augguguuggcaaucagc

SEQ ID NO: 2016495 - RNA, 14 nt, Shigella flexneri 2a str. 301
augguguacucauu

SEQ ID NO: 2016496 - RNA, 21 nt, Shigella flexneri 2a str. 301
augguuacgcagauauucguu

SEQ ID NO: 2016497 - RNA, 14 nt, Shigella flexneri 2a str. 301
augguguuuuccac

SEQ ID NO: 2016498 - RNA, 12 nt, Shigella flexneri 2a str. 301
augguuaacaug

SEQ ID NO: 2016499 - RNA, 20 nt, Shigella flexneri 2a str. 301
auggucgcaucauuuaaaaa

SEQ ID NO: 2016500 - RNA, 20 nt, Shigella flexneri 2a str. 301
auggucucgccgauagucag

SEQ ID NO: 2016501 - RNA, 20 nt, Shigella flexneri 2a str. 301
augggaccgcuaccacggaa

SEQ ID NO: 2016502 - RNA, 11 nt, Shigella flexneri 2a str. 301
augggagcaga

SEQ ID NO: 2016503 - RNA, 22 nt, Shigella flexneri 2a str. 301
auggcugaaagcgccgggaaug

SEQ ID NO: 2016504 - RNA, 19 nt, Shigella flexneri 2a str. 301
auggcugaaagcgccggga

SEQ ID NO: 2016505 - RNA, 19 nt, Shigella flexneri 2a str. 301
auggcucgccauccaguga

SEQ ID NO: 2016506 - RNA, 13 nt, Shigella flexneri 2a str. 301
auggcuccgggug

SEQ ID NO: 2016507 - RNA, 16 nt, Shigella flexneri 2a str. 301
auggcucagauugaac

SEQ ID NO: 2016508 - RNA, 11 nt, Shigella flexneri 2a str. 301
auggcggcugg

SEQ ID NO: 2016509 - RNA, 16 nt, Shigella flexneri 2a str. 301
auggcgcgaaaacaac

SEQ ID NO: 2016510 - RNA, 15 nt, Shigella flexneri 2a str. 301
auggcgcgcagaaag

SEQ ID NO: 2016511 - RNA, 14 nt, Shigella flexneri 2a str. 301
auggcggaucacgc

SEQ ID NO: 2016512 - RNA, 17 nt, Shigella flexneri 2a str. 301
auggcccagcccacugg

SEQ ID NO: 2016513 - RNA, 12 nt, Shigella flexneri 2a str. 301
auggccagccag

SEQ ID NO: 2016514 - RNA, 13 nt, Shigella flexneri 2a str. 301
auggcagaagcau

SEQ ID NO: 2016515 - RNA, 16 nt, Shigella flexneri 2a str. 301
auggcaguaucggcaa

SEQ ID NO: 2016516 - RNA, 23 nt, Shigella flexneri 2a str. 301
auggcaguucaccauuggucuuu

SEQ ID NO: 2016517 - RNA, 20 nt, Shigella flexneri 2a str. 301
auggcauaccauccggcaua

SEQ ID NO: 2016518 - RNA, 16 nt, Shigella flexneri 2a str. 301
auggcauacuccggca

SEQ ID NO: 2016519 - RNA, 21 nt, Shigella flexneri 2a str. 301
auggcauccgccacuuuaugc

SEQ ID NO: 2016520 - RNA, 21 nt, Shigella flexneri 2a str. 301
auggcaucuacgcucucuuca

SEQ ID NO: 2016521 - RNA, 20 nt, Shigella flexneri 2a str. 301
auggcauucucacuccagcc

SEQ ID NO: 2016522 - RNA, 21 nt, Shigella flexneri 2a str. 301
auggcauuggccguugccauu

SEQ ID NO: 2016523 - RNA, 23 nt, Shigella flexneri 2a str. 301
auggcauuuuuauuugugguugg

SEQ ID NO: 2016524 - RNA, 14 nt, Shigella flexneri 2a str. 301
augcgaaaaaaaag

SEQ ID NO: 2016525 - RNA, 23 nt, Shigella flexneri 2a str. 301
augcgcaucaaagccaggcagaa

SEQ ID NO: 2016526 - RNA, 22 nt, Shigella flexneri 2a str. 301
augcgcaguugcagcaagccau

SEQ ID NO: 2016527 - RNA, 20 nt, Shigella flexneri 2a str. 301
auguauggcgauagcccaga

SEQ ID NO: 2016528 - RNA, 14 nt, Shigella flexneri 2a str. 301
auguccauuauuuc

SEQ ID NO: 2016529 - RNA, 21 nt, Shigella flexneri 2a str. 301
auguaaucuguugaaauaaug

SEQ ID NO: 2016530 - RNA, 18 nt, Shigella flexneri 2a str. 301
auguaaaaccaacaguau

SEQ ID NO: 2016531 - RNA, 21 nt, Shigella flexneri 2a str. 301
auguaggguacagcacgauga

SEQ ID NO: 2016532 - RNA, 21 nt, Shigella flexneri 2a str. 301
auguaauuaagcgcaaaggcc

SEQ ID NO: 2016533 - RNA, 14 nt, Shigella flexneri 2a str. 301
auguagcucaccuu

SEQ ID NO: 2016534 - RNA, 14 nt, Shigella flexneri 2a str. 301
auguaaaaauacug

SEQ ID NO: 2016535 - RNA, 20 nt, Shigella flexneri 2a str. 301
augguuuuuggguucagcau

SEQ ID NO: 2016536 - RNA, 16 nt, Shigella flexneri 2a str. 301
auguaagaugaaauag

SEQ ID NO: 2016537 - RNA, 16 nt, Shigella flexneri 2a str. 301
augguuuucaauuauc

SEQ ID NO: 2016538 - RNA, 22 nt, Shigella flexneri 2a str. 301
augguuucacggcaccagccau

SEQ ID NO: 2016539 - RNA, 13 nt, Shigella flexneri 2a str. 301
augguuucauucu

SEQ ID NO: 2016540 - RNA, 16 nt, Shigella flexneri 2a str. 301
auguccugcggacagu

SEQ ID NO: 2016541 - RNA, 21 nt, Shigella flexneri 2a str. 301
auguccugacgcccgaaggcg

SEQ ID NO: 2016542 - RNA, 20 nt, Shigella flexneri 2a str. 301
auguccuuuuaccacuacau

SEQ ID NO: 2016543 - RNA, 21 nt, Shigella flexneri 2a str. 301
augucgagugaauaauugagg

SEQ ID NO: 2016544 - RNA, 13 nt, Shigella flexneri 2a str. 301
augugaagaggaa

SEQ ID NO: 2016545 - RNA, 13 nt, Shigella flexneri 2a str. 301
augugaugccuag

SEQ ID NO: 2016546 - RNA, 18 nt, Shigella flexneri 2a str. 301
augugacuggaaaucaaa

SEQ ID NO: 2016547 - RNA, 14 nt, Shigella flexneri 2a str. 301
augugacgcugucu

SEQ ID NO: 2016548 - RNA, 14 nt, Shigella flexneri 2a str. 301
auguuaaauacaga

SEQ ID NO: 2016549 - RNA, 15 nt, Shigella flexneri 2a str. 301
auguuaagacuggca

SEQ ID NO: 2016550 - RNA, 12 nt, Shigella flexneri 2a str. 301
auguuauucaug

SEQ ID NO: 2016551 - RNA, 13 nt, Shigella flexneri 2a str. 301
auguucaaaaaaa

SEQ ID NO: 2016552 - RNA, 16 nt, Shigella flexneri 2a str. 301
augugggcugccccag

SEQ ID NO: 2016553 - RNA, 19 nt, Shigella flexneri 2a str. 301
augugggcaaucucacucc

SEQ ID NO: 2016554 - RNA, 11 nt, Shigella flexneri 2a str. 301
auguggguagc

SEQ ID NO: 2016555 - RNA, 15 nt, Shigella flexneri 2a str. 301
augugcaguuccugc

SEQ ID NO: 2016556 - RNA, 17 nt, Shigella flexneri 2a str. 301
augugcaguuccugcaa

SEQ ID NO: 2016557 - RNA, 18 nt, Shigella flexneri 2a str. 301
augugcaguuccugcaac

SEQ ID NO: 2016558 - RNA, 20 nt, Shigella flexneri 2a str. 301
augugcaggauuaauaaauu

SEQ ID NO: 2016559 - RNA, 12 nt, Shigella flexneri 2a str. 301
auguggaaacag

SEQ ID NO: 2016560 - RNA, 13 nt, Shigella flexneri 2a str. 301
auguggaaacagu

SEQ ID NO: 2016561 - RNA, 14 nt, Shigella flexneri 2a str. 301
augugcuucuacca

SEQ ID NO: 2016562 - RNA, 16 nt, Shigella flexneri 2a str. 301
aucucaccguugccaa

SEQ ID NO: 2016563 - RNA, 16 nt, Shigella flexneri 2a str. 301
aucucaaucuucacgu

SEQ ID NO: 2016564 - RNA, 16 nt, Shigella flexneri 2a str. 301
aucucaauuuucacuu

SEQ ID NO: 2016565 - RNA, 17 nt, Shigella flexneri 2a str. 301
aucuccagauaauuaug

SEQ ID NO: 2016566 - RNA, 12 nt, Shigella flexneri 2a str. 301
aucuccauuuca

SEQ ID NO: 2016567 - RNA, 16 nt, Shigella flexneri 2a str. 301
aucuccauucugagug

SEQ ID NO: 2016568 - RNA, 17 nt, Shigella flexneri 2a str. 301
aucuccguuaaaggcaa

SEQ ID NO: 2016569 - RNA, 21 nt, Shigella flexneri 2a str. 301
aucucccuguaucccaguucg

SEQ ID NO: 2016570 - RNA, 19 nt, Shigella flexneri 2a str. 301
aucucccuguaucccagau

SEQ ID NO: 2016571 - RNA, 13 nt, Shigella flexneri 2a str. 301
aucuccuugcugg

SEQ ID NO: 2016572 - RNA, 18 nt, Shigella flexneri 2a str. 301
aucuccugccaauacaaa

SEQ ID NO: 2016573 - RNA, 22 nt, Shigella flexneri 2a str. 301
aucuccugccaauacaaaauuu

SEQ ID NO: 2016574 - RNA, 15 nt, Shigella flexneri 2a str. 301
aucucgccagugacc

SEQ ID NO: 2016575 - RNA, 14 nt, Shigella flexneri 2a str. 301
aucucaaccgcuuc

SEQ ID NO: 2016576 - RNA, 23 nt, Shigella flexneri 2a str. 301
aucuaugguuuuuucuacacaga

SEQ ID NO: 2016577 - RNA, 15 nt, Shigella flexneri 2a str. 301
aucuauauacaauca

SEQ ID NO: 2016578 - RNA, 14 nt, Shigella flexneri 2a str. 301
aucuauccggcaua

SEQ ID NO: 2016579 - RNA, 15 nt, Shigella flexneri 2a str. 301
aucuauagcacccgc

SEQ ID NO: 2016580 - RNA, 19 nt, Shigella flexneri 2a str. 301
aucuacgcucucuucaaac

SEQ ID NO: 2016581 - RNA, 21 nt, Shigella flexneri 2a str. 301
aucuaccguuacggcuggaag

SEQ ID NO: 2016582 - RNA, 15 nt, Shigella flexneri 2a str. 301
aucuaccgccagcca

SEQ ID NO: 2016583 - RNA, 15 nt, Shigella flexneri 2a str. 301
aucucuaaggcauga

SEQ ID NO: 2016584 - RNA, 14 nt, Shigella flexneri 2a str. 301
aucucguugaucac

SEQ ID NO: 2016585 - RNA, 18 nt, Shigella flexneri 2a str. 301
aucucguugaucacccac

SEQ ID NO: 2016586 - RNA, 17 nt, Shigella flexneri 2a str. 301
aucucguggucaauauu

SEQ ID NO: 2016587 - RNA, 22 nt, Shigella flexneri 2a str. 301
aucucgguggaaaauagcauaa

SEQ ID NO: 2016588 - RNA, 15 nt, Shigella flexneri 2a str. 301
aucucgguggaaaau

SEQ ID NO: 2016589 - RNA, 16 nt, Shigella flexneri 2a str. 301
aucucgguggaaaaua

SEQ ID NO: 2016590 - RNA, 19 nt, Shigella flexneri 2a str. 301
aucucgcucaaaaauccag

SEQ ID NO: 2016591 - RNA, 16 nt, Shigella flexneri 2a str. 301
aucucugcgcuaucca

SEQ ID NO: 2016592 - RNA, 23 nt, Shigella flexneri 2a str. 301
aucucugacgcgcauacucuccu

SEQ ID NO: 2016593 - RNA, 20 nt, Shigella flexneri 2a str. 301
aucucuguuuugcauggggu

SEQ ID NO: 2016594 - RNA, 17 nt, Shigella flexneri 2a str. 301
aucucuuuccacaaugu

SEQ ID NO: 2016595 - RNA, 18 nt, Shigella flexneri 2a str. 301
aucucuucguuuucaacg

SEQ ID NO: 2016596 - RNA, 21 nt, Shigella flexneri 2a str. 301
aucucuucuucaagccaggcu

SEQ ID NO: 2016597 - RNA, 18 nt, Shigella flexneri 2a str. 301
aucucuucgccugccugc

SEQ ID NO: 2016598 - RNA, 14 nt, Shigella flexneri 2a str. 301
aucucuucgccugc

SEQ ID NO: 2016599 - RNA, 13 nt, Shigella flexneri 2a str. 301
aucucuucgccug

SEQ ID NO: 2016600 - RNA, 13 nt, Shigella flexneri 2a str. 301
aucucuuccagaa

SEQ ID NO: 2016601 - RNA, 21 nt, Shigella flexneri 2a str. 301
aucucuuaucauccaggugaa

SEQ ID NO: 2016602 - RNA, 22 nt, Shigella flexneri 2a str. 301
aucucuucacgcuuugcaggcu

SEQ ID NO: 2016603 - RNA, 17 nt, Shigella flexneri 2a str. 301
aucucuuccagcgauaa

SEQ ID NO: 2016604 - RNA, 22 nt, Shigella flexneri 2a str. 301
aucucuuccagugccucaagaa

SEQ ID NO: 2016605 - RNA, 24 nt, Shigella flexneri 2a str. 301
aucugaauggcugcauuccuuguu

SEQ ID NO: 2016606 - RNA, 22 nt, Shigella flexneri 2a str. 301
aucugacaacaccaauuucuga

SEQ ID NO: 2016607 - RNA, 14 nt, Shigella flexneri 2a str. 301
aucugaaucaaaau

SEQ ID NO: 2016608 - RNA, 15 nt, Shigella flexneri 2a str. 301
aucugaaucaaaauc

SEQ ID NO: 2016609 - RNA, 14 nt, Shigella flexneri 2a str. 301
aucugaucaauaua

SEQ ID NO: 2016610 - RNA, 22 nt, Shigella flexneri 2a str. 301
aucugauauaccgccgccagca

SEQ ID NO: 2016611 - RNA, 18 nt, Shigella flexneri 2a str. 301
aucugaugauauuuuucc

SEQ ID NO: 2016612 - RNA, 15 nt, Shigella flexneri 2a str. 301
aucugauuaauauug

SEQ ID NO: 2016613 - RNA, 13 nt, Shigella flexneri 2a str. 301
aucugauuuuccu

SEQ ID NO: 2016614 - RNA, 16 nt, Shigella flexneri 2a str. 301
aucugauuugauaaug

SEQ ID NO: 2016615 - RNA, 19 nt, Shigella flexneri 2a str. 301
aucugcaaaucgaucucaa

SEQ ID NO: 2016616 - RNA, 19 nt, Shigella flexneri 2a str. 301
aucugccuuauugaagcuc

SEQ ID NO: 2016617 - RNA, 21 nt, Shigella flexneri 2a str. 301
aucugccgauacgcuggaugg

SEQ ID NO: 2016618 - RNA, 22 nt, Shigella flexneri 2a str. 301
aucugcgggaacauaugcacau

SEQ ID NO: 2016619 - RNA, 19 nt, Shigella flexneri 2a str. 301
aucugcgcuggaacaacgc

SEQ ID NO: 2016620 - RNA, 22 nt, Shigella flexneri 2a str. 301
aucugcgccuacggcauucugc

SEQ ID NO: 2016621 - RNA, 14 nt, Shigella flexneri 2a str. 301
aucugccccauugc

SEQ ID NO: 2016622 - RNA, 12 nt, Shigella flexneri 2a str. 301
aucugcccgcac

SEQ ID NO: 2016623 - RNA, 16 nt, Shigella flexneri 2a str. 301
aucugccagcguaaau

SEQ ID NO: 2016624 - RNA, 15 nt, Shigella flexneri 2a str. 301
aucugcaauuacugc

SEQ ID NO: 2016625 - RNA, 22 nt, Shigella flexneri 2a str. 301
aucggccaucucaacuuucuug

SEQ ID NO: 2016626 - RNA, 17 nt, Shigella flexneri 2a str. 301
aucgggagagauaagau

SEQ ID NO: 2016627 - RNA, 18 nt, Shigella flexneri 2a str. 301
aucgggagagauaagaua

SEQ ID NO: 2016628 - RNA, 15 nt, Shigella flexneri 2a str. 301
aucgggaccagcauu

SEQ ID NO: 2016629 - RNA, 15 nt, Shigella flexneri 2a str. 301
aucgggaaauaacau

SEQ ID NO: 2016630 - RNA, 13 nt, Shigella flexneri 2a str. 301
aucggcuuuggca

SEQ ID NO: 2016631 - RNA, 22 nt, Shigella flexneri 2a str. 301
aucgggcagcaucgccaggaug

SEQ ID NO: 2016632 - RNA, 19 nt, Shigella flexneri 2a str. 301
aucggggauaagaauaucg

SEQ ID NO: 2016633 - RNA, 18 nt, Shigella flexneri 2a str. 301
aucggugaggaucaccag

SEQ ID NO: 2016634 - RNA, 15 nt, Shigella flexneri 2a str. 301
aucgguauuuccauu

SEQ ID NO: 2016635 - RNA, 18 nt, Shigella flexneri 2a str. 301
aucgguaccgccagcagg

SEQ ID NO: 2016636 - RNA, 15 nt, Shigella flexneri 2a str. 301
aucggauugcuccug

SEQ ID NO: 2016637 - RNA, 16 nt, Shigella flexneri 2a str. 301
aucggcaaaaugggua

SEQ ID NO: 2016638 - RNA, 22 nt, Shigella flexneri 2a str. 301
aucggcaacgguaugaaauuua

SEQ ID NO: 2016639 - RNA, 17 nt, Shigella flexneri 2a str. 301
aucgcggggaguucuga

SEQ ID NO: 2016640 - RNA, 13 nt, Shigella flexneri 2a str. 301
aucgcguaaggcu

SEQ ID NO: 2016641 - RNA, 18 nt, Shigella flexneri 2a str. 301
aucgcguacucaccgcuc

SEQ ID NO: 2016642 - RNA, 23 nt, Shigella flexneri 2a str. 301
aucgcguuugcgcuccggcggca

SEQ ID NO: 2016643 - RNA, 17 nt, Shigella flexneri 2a str. 301
aucguuacucuuaucaa

SEQ ID NO: 2016644 - RNA, 22 nt, Shigella flexneri 2a str. 301
aucguuaauuccucauuucccu

SEQ ID NO: 2016645 - RNA, 23 nt, Shigella flexneri 2a str. 301
aucguugcgaucgaccugcgccu

SEQ ID NO: 2016646 - RNA, 20 nt, Shigella flexneri 2a str. 301
aucuacacgcuaccaaaaaa

SEQ ID NO: 2016647 - RNA, 16 nt, Shigella flexneri 2a str. 301
aucgucgccagaccaa

SEQ ID NO: 2016648 - RNA, 21 nt, Shigella flexneri 2a str. 301
aucguccacuugaaaauuaua

SEQ ID NO: 2016649 - RNA, 17 nt, Shigella flexneri 2a str. 301
aucggugcggcaaugcc

SEQ ID NO: 2016650 - RNA, 18 nt, Shigella flexneri 2a str. 301
aucggugcacuccgccac

SEQ ID NO: 2016651 - RNA, 15 nt, Shigella flexneri 2a str. 301
aucggugcagagccc

SEQ ID NO: 2016652 - RNA, 21 nt, Shigella flexneri 2a str. 301
aucggugcuggccuauuauga

SEQ ID NO: 2016653 - RNA, 21 nt, Shigella flexneri 2a str. 301
aucguccgauuaaaaacccug

SEQ ID NO: 2016654 - RNA, 21 nt, Shigella flexneri 2a str. 301
aucguguggauaauccauccc

SEQ ID NO: 2016655 - RNA, 16 nt, Shigella flexneri 2a str. 301
aucgaaaugaauagag

SEQ ID NO: 2016656 - RNA, 17 nt, Shigella flexneri 2a str. 301
aucgaacagaccaaacu

SEQ ID NO: 2016657 - RNA, 12 nt, Shigella flexneri 2a str. 301
aucgaacagcag

SEQ ID NO: 2016658 - RNA, 18 nt, Shigella flexneri 2a str. 301
aucgagaucggccagcac

SEQ ID NO: 2016659 - RNA, 19 nt, Shigella flexneri 2a str. 301
aucagcuuuggugaaaaaa

SEQ ID NO: 2016660 - RNA, 12 nt, Shigella flexneri 2a str. 301
aucagcuucacc

SEQ ID NO: 2016661 - RNA, 19 nt, Shigella flexneri 2a str. 301
aucagcugguuauuuucug

SEQ ID NO: 2016662 - RNA, 19 nt, Shigella flexneri 2a str. 301
aucagcugugggcuaacac

SEQ ID NO: 2016663 - RNA, 19 nt, Shigella flexneri 2a str. 301
aucagcuccggcagcugcu

SEQ ID NO: 2016664 - RNA, 20 nt, Shigella flexneri 2a str. 301
aucagcguggcaucgggcac

SEQ ID NO: 2016665 - RNA, 15 nt, Shigella flexneri 2a str. 301
aucagcguccagccc

SEQ ID NO: 2016666 - RNA, 21 nt, Shigella flexneri 2a str. 301
aucgcaaauugacuacaccau

SEQ ID NO: 2016667 - RNA, 18 nt, Shigella flexneri 2a str. 301
aucgcaaauugacuacac

SEQ ID NO: 2016668 - RNA, 14 nt, Shigella flexneri 2a str. 301
aucgcaauccuuuc

SEQ ID NO: 2016669 - RNA, 22 nt, Shigella flexneri 2a str. 301
aucgauuuggcucaacaacugc

SEQ ID NO: 2016670 - RNA, 13 nt, Shigella flexneri 2a str. 301
aucgauuuucaaa

SEQ ID NO: 2016671 - RNA, 17 nt, Shigella flexneri 2a str. 301
aucgauuuucaaaauau

SEQ ID NO: 2016672 - RNA, 14 nt, Shigella flexneri 2a str. 301
aucgagccgauuaa

SEQ ID NO: 2016673 - RNA, 20 nt, Shigella flexneri 2a str. 301
aucgcgacguucagauuuug

SEQ ID NO: 2016674 - RNA, 15 nt, Shigella flexneri 2a str. 301
aucgcgaccaaucac

SEQ ID NO: 2016675 - RNA, 17 nt, Shigella flexneri 2a str. 301
aucgcgauacaccagau

SEQ ID NO: 2016676 - RNA, 15 nt, Shigella flexneri 2a str. 301
aucgccuccagcgcu

SEQ ID NO: 2016677 - RNA, 14 nt, Shigella flexneri 2a str. 301
aucgcgccagccag

SEQ ID NO: 2016678 - RNA, 22 nt, Shigella flexneri 2a str. 301
aucgcgcccaaaccacccagca

SEQ ID NO: 2016679 - RNA, 18 nt, Shigella flexneri 2a str. 301
aucgcgccaucaaaucug

SEQ ID NO: 2016680 - RNA, 16 nt, Shigella flexneri 2a str. 301
aucgcgcccaaaccac

SEQ ID NO: 2016681 - RNA, 21 nt, Shigella flexneri 2a str. 301
aucgcgcuuaucgccagcgcc

SEQ ID NO: 2016682 - RNA, 23 nt, Shigella flexneri 2a str. 301
aucgcggcuuauugcuucaagau

SEQ ID NO: 2016683 - RNA, 24 nt, Shigella flexneri 2a str. 301
aucgcggcgauauccagcgcggcg

SEQ ID NO: 2016684 - RNA, 15 nt, Shigella flexneri 2a str. 301
aucgcagcaaacgaa

SEQ ID NO: 2016685 - RNA, 20 nt, Shigella flexneri 2a str. 301
aucgcaggccaguugcgccg

SEQ ID NO: 2016686 - RNA, 16 nt, Shigella flexneri 2a str. 301
aucgcaguagcgggcg

SEQ ID NO: 2016687 - RNA, 21 nt, Shigella flexneri 2a str. 301
aucgcauggcugcgaaucgcu

SEQ ID NO: 2016688 - RNA, 15 nt, Shigella flexneri 2a str. 301
aucgcaucaggcaau

SEQ ID NO: 2016689 - RNA, 21 nt, Shigella flexneri 2a str. 301
aucgcccggauauccacccgc

SEQ ID NO: 2016690 - RNA, 22 nt, Shigella flexneri 2a str. 301
aucgcccgccaagcaguuggca

SEQ ID NO: 2016691 - RNA, 17 nt, Shigella flexneri 2a str. 301
aucgccccggucaucaa

SEQ ID NO: 2016692 - RNA, 16 nt, Shigella flexneri 2a str. 301
aucgcccugcuccagc

SEQ ID NO: 2016693 - RNA, 18 nt, Shigella flexneri 2a str. 301
aucgcccugcuccagcaa

SEQ ID NO: 2016694 - RNA, 18 nt, Shigella flexneri 2a str. 301
aucgcccuggauuucaau

SEQ ID NO: 2016695 - RNA, 13 nt, Shigella flexneri 2a str. 301
aucuuucacgccc

SEQ ID NO: 2016696 - RNA, 16 nt, Shigella flexneri 2a str. 301
aucuggcauuugcacu

SEQ ID NO: 2016697 - RNA, 19 nt, Shigella flexneri 2a str. 301
aucuggcaagccugaaaac

SEQ ID NO: 2016698 - RNA, 23 nt, Shigella flexneri 2a str. 301
aucugguaggacgaaaaaucaau

SEQ ID NO: 2016699 - RNA, 20 nt, Shigella flexneri 2a str. 301
aucuggcugugauccauucc

SEQ ID NO: 2016700 - RNA, 16 nt, Shigella flexneri 2a str. 301
aucuucuguugcaggg

SEQ ID NO: 2016701 - RNA, 14 nt, Shigella flexneri 2a str. 301
aucuucucuucccc

SEQ ID NO: 2016702 - RNA, 20 nt, Shigella flexneri 2a str. 301
augaaagccccaccagcaaa

SEQ ID NO: 2016703 - RNA, 18 nt, Shigella flexneri 2a str. 301
augaaagcgaucuuucug

SEQ ID NO: 2016704 - RNA, 17 nt, Shigella flexneri 2a str. 301
augaaaggucauugggg

SEQ ID NO: 2016705 - RNA, 17 nt, Shigella flexneri 2a str. 301
augaaacgcgaggaugc

SEQ ID NO: 2016706 - RNA, 15 nt, Shigella flexneri 2a str. 301
augaaacgcguucag

SEQ ID NO: 2016707 - RNA, 17 nt, Shigella flexneri 2a str. 301
augaaacaggggcugga

SEQ ID NO: 2016708 - RNA, 22 nt, Shigella flexneri 2a str. 301
augaaacaggggcuggaagaug

SEQ ID NO: 2016709 - RNA, 22 nt, Shigella flexneri 2a str. 301
aucuuucugcgaauugagauga

SEQ ID NO: 2016710 - RNA, 15 nt, Shigella flexneri 2a str. 301
aucuuuuacaagcaa

SEQ ID NO: 2016711 - RNA, 13 nt, Shigella flexneri 2a str. 301
augaagcacugca

SEQ ID NO: 2016712 - RNA, 13 nt, Shigella flexneri 2a str. 301
augaagaacugga

SEQ ID NO: 2016713 - RNA, 20 nt, Shigella flexneri 2a str. 301
augaaauaguugcauuccag

SEQ ID NO: 2016714 - RNA, 19 nt, Shigella flexneri 2a str. 301
augaaagugguuucaugau

SEQ ID NO: 2016715 - RNA, 17 nt, Shigella flexneri 2a str. 301
augaaauaaaaauaaga

SEQ ID NO: 2016716 - RNA, 22 nt, Shigella flexneri 2a str. 301
augacuugccgcaaaacccagg

SEQ ID NO: 2016717 - RNA, 18 nt, Shigella flexneri 2a str. 301
augacuuaauaaaauagc

SEQ ID NO: 2016718 - RNA, 19 nt, Shigella flexneri 2a str. 301
augaccuugucaugcagcu

SEQ ID NO: 2016719 - RNA, 15 nt, Shigella flexneri 2a str. 301
augaccuuucauucu

SEQ ID NO: 2016720 - RNA, 13 nt, Shigella flexneri 2a str. 301
augacgcccugug

SEQ ID NO: 2016721 - RNA, 22 nt, Shigella flexneri 2a str. 301
augacgccaccagcgguuuuug

SEQ ID NO: 2016722 - RNA, 15 nt, Shigella flexneri 2a str. 301
augagguuucccgcc

SEQ ID NO: 2016723 - RNA, 16 nt, Shigella flexneri 2a str. 301
augagagaaaaucaca

SEQ ID NO: 2016724 - RNA, 22 nt, Shigella flexneri 2a str. 301
augagaauaaucaccuuuaacc

SEQ ID NO: 2016725 - RNA, 12 nt, Shigella flexneri 2a str. 301
augagaauaauc

SEQ ID NO: 2016726 - RNA, 19 nt, Shigella flexneri 2a str. 301
augagauauuuaaaugauu

SEQ ID NO: 2016727 - RNA, 14 nt, Shigella flexneri 2a str. 301
augagauauuuaaa

SEQ ID NO: 2016728 - RNA, 13 nt, Shigella flexneri 2a str. 301
augaaguccacgc

SEQ ID NO: 2016729 - RNA, 23 nt, Shigella flexneri 2a str. 301
augaauaccaagucucaagagug

SEQ ID NO: 2016730 - RNA, 20 nt, Shigella flexneri 2a str. 301
augaauaaaauucuccagcg

SEQ ID NO: 2016731 - RNA, 21 nt, Shigella flexneri 2a str. 301
augaauaucaagaucaucaaa

SEQ ID NO: 2016732 - RNA, 19 nt, Shigella flexneri 2a str. 301
augaauauauaauuaaaaa

SEQ ID NO: 2016733 - RNA, 20 nt, Shigella flexneri 2a str. 301
augaauauauaauuaaaaau

SEQ ID NO: 2016734 - RNA, 19 nt, Shigella flexneri 2a str. 301
augaauauauccgaaaaag

SEQ ID NO: 2016735 - RNA, 14 nt, Shigella flexneri 2a str. 301
augaaucaccacag

SEQ ID NO: 2016736 - RNA, 22 nt, Shigella flexneri 2a str. 301
augacauucacgcugucggcac

SEQ ID NO: 2016737 - RNA, 12 nt, Shigella flexneri 2a str. 301
augacauuaucu

SEQ ID NO: 2016738 - RNA, 16 nt, Shigella flexneri 2a str. 301
augaccauaaaaggca

SEQ ID NO: 2016739 - RNA, 21 nt, Shigella flexneri 2a str. 301
augaccauaaaaggcaccugg

SEQ ID NO: 2016740 - RNA, 20 nt, Shigella flexneri 2a str. 301
augaauuuaucuuuaagcac

SEQ ID NO: 2016741 - RNA, 16 nt, Shigella flexneri 2a str. 301
augaauguuuuccugc

SEQ ID NO: 2016742 - RNA, 11 nt, Shigella flexneri 2a str. 301
augaauuacuu

SEQ ID NO: 2016743 - RNA, 14 nt, Shigella flexneri 2a str. 301
augaaugauaaaau

SEQ ID NO: 2016744 - RNA, 16 nt, Shigella flexneri 2a str. 301
augaaugcaaggcuca

SEQ ID NO: 2016745 - RNA, 21 nt, Shigella flexneri 2a str. 301
augaaugcaaggcucaccacc

SEQ ID NO: 2016746 - RNA, 15 nt, Shigella flexneri 2a str. 301
augaauggaguuguc

SEQ ID NO: 2016747 - RNA, 23 nt, Shigella flexneri 2a str. 301
augauuuccggcagcauguguaa

SEQ ID NO: 2016748 - RNA, 16 nt, Shigella flexneri 2a str. 301
augauuuaauggaugu

SEQ ID NO: 2016749 - RNA, 14 nt, Shigella flexneri 2a str. 301
augaugucgcuguc

SEQ ID NO: 2016750 - RNA, 21 nt, Shigella flexneri 2a str. 301
augauguuacguuucucugcu

SEQ ID NO: 2016751 - RNA, 20 nt, Shigella flexneri 2a str. 301
augcaacuguuuuaccaaau

SEQ ID NO: 2016752 - RNA, 15 nt, Shigella flexneri 2a str. 301
augcaacuguuuuac

SEQ ID NO: 2016753 - RNA, 14 nt, Shigella flexneri 2a str. 301
augauguaaaaaua

SEQ ID NO: 2016754 - RNA, 16 nt, Shigella flexneri 2a str. 301
augauguaaaaauacu

SEQ ID NO: 2016755 - RNA, 15 nt, Shigella flexneri 2a str. 301
augauggccuuuuug

SEQ ID NO: 2016756 - RNA, 19 nt, Shigella flexneri 2a str. 301
augauggcauucucacucc

SEQ ID NO: 2016757 - RNA, 20 nt, Shigella flexneri 2a str. 301
augaugacuugccuccagcg

SEQ ID NO: 2016758 - RNA, 15 nt, Shigella flexneri 2a str. 301
augaguugcuggacg

SEQ ID NO: 2016759 - RNA, 14 nt, Shigella flexneri 2a str. 301
augaguuccacugg

SEQ ID NO: 2016760 - RNA, 19 nt, Shigella flexneri 2a str. 301
augaguuauacagaguguu

SEQ ID NO: 2016761 - RNA, 18 nt, Shigella flexneri 2a str. 301
augagugccaaaaaaaua

SEQ ID NO: 2016762 - RNA, 22 nt, Shigella flexneri 2a str. 301
augaguuuggugccacgcgcau

SEQ ID NO: 2016763 - RNA, 18 nt, Shigella flexneri 2a str. 301
augauaaaauucauucaa

SEQ ID NO: 2016764 - RNA, 24 nt, Shigella flexneri 2a str. 301
augccaaauauuucuuuaucacca

SEQ ID NO: 2016765 - RNA, 23 nt, Shigella flexneri 2a str. 301
augcagugcggcuguagagcuac

SEQ ID NO: 2016766 - RNA, 18 nt, Shigella flexneri 2a str. 301
augcagucgcuguauuuu

SEQ ID NO: 2016767 - RNA, 15 nt, Shigella flexneri 2a str. 301
augccaaucuucaca

SEQ ID NO: 2016768 - RNA, 22 nt, Shigella flexneri 2a str. 301
augccaaucuucacaucaucau

SEQ ID NO: 2016769 - RNA, 20 nt, Shigella flexneri 2a str. 301
augccaauaaauccuuugua

SEQ ID NO: 2016770 - RNA, 18 nt, Shigella flexneri 2a str. 301
augccaacuggcauaacc

SEQ ID NO: 2016771 - RNA, 19 nt, Shigella flexneri 2a str. 301
augccacgugagcuuuucu

SEQ ID NO: 2016772 - RNA, 21 nt, Shigella flexneri 2a str. 301
augccacgugagcuuuucugc

SEQ ID NO: 2016773 - RNA, 23 nt, Shigella flexneri 2a str. 301
augccacauuagauaaaaaugaa

SEQ ID NO: 2016774 - RNA, 15 nt, Shigella flexneri 2a str. 301
augccaccaauaaug

SEQ ID NO: 2016775 - RNA, 17 nt, Shigella flexneri 2a str. 301
augccacauuagauaaa

SEQ ID NO: 2016776 - RNA, 16 nt, Shigella flexneri 2a str. 301
augccaaucagcagaa

SEQ ID NO: 2016777 - RNA, 16 nt, Shigella flexneri 2a str. 301
augccagauaagacac

SEQ ID NO: 2016778 - RNA, 24 nt, Shigella flexneri 2a str. 301
augccagaauccccacugcauggc

SEQ ID NO: 2016779 - RNA, 21 nt, Shigella flexneri 2a str. 301
augccagaauccccacugcau

SEQ ID NO: 2016780 - RNA, 17 nt, Shigella flexneri 2a str. 301
augccagaauccccacu

SEQ ID NO: 2016781 - RNA, 20 nt, Shigella flexneri 2a str. 301
augccagaauccccacugca

SEQ ID NO: 2016782 - RNA, 19 nt, Shigella flexneri 2a str. 301
augccagcacagaucgcac

SEQ ID NO: 2016783 - RNA, 13 nt, Shigella flexneri 2a str. 301
augcaauaaauau

SEQ ID NO: 2016784 - RNA, 18 nt, Shigella flexneri 2a str. 301
augcaauaaauauguuac

SEQ ID NO: 2016785 - RNA, 21 nt, Shigella flexneri 2a str. 301
augcacaccccgcgcagcuga

SEQ ID NO: 2016786 - RNA, 22 nt, Shigella flexneri 2a str. 301
augcaggcaucggugaugcucu

SEQ ID NO: 2016787 - RNA, 15 nt, Shigella flexneri 2a str. 301
augcaggcagcacug

SEQ ID NO: 2016788 - RNA, 18 nt, Shigella flexneri 2a str. 301
augcaggcguuuuuggca

SEQ ID NO: 2016789 - RNA, 13 nt, Shigella flexneri 2a str. 301
augcagccuucau

SEQ ID NO: 2016790 - RNA, 20 nt, Shigella flexneri 2a str. 301
augcagcggaucgccgccgg

SEQ ID NO: 2016791 - RNA, 16 nt, Shigella flexneri 2a str. 301
augcagcguuugcugu

SEQ ID NO: 2016792 - RNA, 15 nt, Shigella flexneri 2a str. 301
augcagggcaaacuc

SEQ ID NO: 2016793 - RNA, 15 nt, Shigella flexneri 2a str. 301
augcaguaccagaua

SEQ ID NO: 2016794 - RNA, 18 nt, Shigella flexneri 2a str. 301
augccauuuccagcgcuu

SEQ ID NO: 2016795 - RNA, 21 nt, Shigella flexneri 2a str. 301
augccccuguaucaugcagua

SEQ ID NO: 2016796 - RNA, 12 nt, Shigella flexneri 2a str. 301
augcccccagca

SEQ ID NO: 2016797 - RNA, 24 nt, Shigella flexneri 2a str. 301
augcccgacuugagcgcagucugg

SEQ ID NO: 2016798 - RNA, 16 nt, Shigella flexneri 2a str. 301
augccaguaacucauu

SEQ ID NO: 2016799 - RNA, 15 nt, Shigella flexneri 2a str. 301
augccagucaaugaa

SEQ ID NO: 2016800 - RNA, 18 nt, Shigella flexneri 2a str. 301
augccagucaaugaaauu

SEQ ID NO: 2016801 - RNA, 22 nt, Shigella flexneri 2a str. 301
augccagucccgcgacaaucgc

SEQ ID NO: 2016802 - RNA, 14 nt, Shigella flexneri 2a str. 301
augccagucaguua

SEQ ID NO: 2016803 - RNA, 13 nt, Shigella flexneri 2a str. 301
augccauccgcau

SEQ ID NO: 2016804 - RNA, 14 nt, Shigella flexneri 2a str. 301
augccgaguggcau

SEQ ID NO: 2016805 - RNA, 19 nt, Shigella flexneri 2a str. 301
augccgauuguauacgcug

SEQ ID NO: 2016806 - RNA, 18 nt, Shigella flexneri 2a str. 301
augccgccgcagaaaaag

SEQ ID NO: 2016807 - RNA, 20 nt, Shigella flexneri 2a str. 301
augcccucaauaucuuuccc

SEQ ID NO: 2016808 - RNA, 12 nt, Shigella flexneri 2a str. 301
augcccggacua

SEQ ID NO: 2016809 - RNA, 17 nt, Shigella flexneri 2a str. 301
augccuuguuugaucau

SEQ ID NO: 2016810 - RNA, 14 nt, Shigella flexneri 2a str. 301
augccuuguuugau

SEQ ID NO: 2016811 - RNA, 17 nt, Shigella flexneri 2a str. 301
augccuuucucagaagu

SEQ ID NO: 2016812 - RNA, 21 nt, Shigella flexneri 2a str. 301
augccuugugggccugaaagc

SEQ ID NO: 2016813 - RNA, 21 nt, Shigella flexneri 2a str. 301
augccugcacuuugugucagc

SEQ ID NO: 2016814 - RNA, 23 nt, Shigella flexneri 2a str. 301
augccugaugguguugcaccauc

SEQ ID NO: 2016815 - RNA, 19 nt, Shigella flexneri 2a str. 301
augccugauguacaaccau

SEQ ID NO: 2016816 - RNA, 16 nt, Shigella flexneri 2a str. 301
augccguuugcugcau

SEQ ID NO: 2016817 - RNA, 13 nt, Shigella flexneri 2a str. 301
augccuaccaaac

SEQ ID NO: 2016818 - RNA, 15 nt, Shigella flexneri 2a str. 301
augccggaugcggag

SEQ ID NO: 2016819 - RNA, 18 nt, Shigella flexneri 2a str. 301
augccggaugcgccagca

SEQ ID NO: 2016820 - RNA, 21 nt, Shigella flexneri 2a str. 301
augccgcuucaguugcgccug

SEQ ID NO: 2016821 - RNA, 11 nt, Shigella flexneri 2a str. 301
augccggugau

SEQ ID NO: 2016822 - RNA, 22 nt, Shigella flexneri 2a str. 301
augccggguuugccgugugccg

SEQ ID NO: 2016823 - RNA, 21 nt, Shigella flexneri 2a str. 301
augccggguaauuucauuaaa

SEQ ID NO: 2016824 - RNA, 15 nt, Shigella flexneri 2a str. 301
auucagcgucucacu

SEQ ID NO: 2016825 - RNA, 15 nt, Shigella flexneri 2a str. 301
auucagcucaagaau

SEQ ID NO: 2016826 - RNA, 20 nt, Shigella flexneri 2a str. 301
auucaggagcaggcugcacu

SEQ ID NO: 2016827 - RNA, 20 nt, Shigella flexneri 2a str. 301
auucaggcguugaaaaauca

SEQ ID NO: 2016828 - RNA, 20 nt, Shigella flexneri 2a str. 301
auucagcaauguuucucugg

SEQ ID NO: 2016829 - RNA, 20 nt, Shigella flexneri 2a str. 301
auucagcgucgucagcaguu

SEQ ID NO: 2016830 - RNA, 23 nt, Shigella flexneri 2a str. 301
auucagcgucgucagcaguucac

SEQ ID NO: 2016831 - RNA, 17 nt, Shigella flexneri 2a str. 301
auucagcguaucaauua

SEQ ID NO: 2016832 - RNA, 17 nt, Shigella flexneri 2a str. 301
auucagcccggcaacgu

SEQ ID NO: 2016833 - RNA, 20 nt, Shigella flexneri 2a str. 301
auucucccucaucauuugaa

SEQ ID NO: 2016834 - RNA, 16 nt, Shigella flexneri 2a str. 301
auucuccggcaggaaa

SEQ ID NO: 2016835 - RNA, 16 nt, Shigella flexneri 2a str. 301
auucuggccacuucug

SEQ ID NO: 2016836 - RNA, 12 nt, Shigella flexneri 2a str. 301
auucuguuuuau

SEQ ID NO: 2016837 - RNA, 16 nt, Shigella flexneri 2a str. 301
auugaaugaacgcaga

SEQ ID NO: 2016838 - RNA, 23 nt, Shigella flexneri 2a str. 301
auugacgcuguuguuuuuucaac

SEQ ID NO: 2016839 - RNA, 18 nt, Shigella flexneri 2a str. 301
auugaaucacgacaaaca

SEQ ID NO: 2016840 - RNA, 23 nt, Shigella flexneri 2a str. 301
auugagacguaguauccacacca

SEQ ID NO: 2016841 - RNA, 21 nt, Shigella flexneri 2a str. 301
auugagcauuggcaugcacgu

SEQ ID NO: 2016842 - RNA, 13 nt, Shigella flexneri 2a str. 301
auugagcaccgcg

SEQ ID NO: 2016843 - RNA, 20 nt, Shigella flexneri 2a str. 301
auugacuggaugccaguauu

SEQ ID NO: 2016844 - RNA, 23 nt, Shigella flexneri 2a str. 301
auugacucgccuucaggaauacg

SEQ ID NO: 2016845 - RNA, 21 nt, Shigella flexneri 2a str. 301
auugaagauuuugcugugcuu

SEQ ID NO: 2016846 - RNA, 15 nt, Shigella flexneri 2a str. 301
auugaagauuuugcu

SEQ ID NO: 2016847 - RNA, 20 nt, Shigella flexneri 2a str. 301
auugaaauagccaauacgau

SEQ ID NO: 2016848 - RNA, 19 nt, Shigella flexneri 2a str. 301
auugaagcaauccauacca

SEQ ID NO: 2016849 - RNA, 15 nt, Shigella flexneri 2a str. 301
auugaaggauaagac

SEQ ID NO: 2016850 - RNA, 19 nt, Shigella flexneri 2a str. 301
auugaaaaagugccaaaaa

SEQ ID NO: 2016851 - RNA, 12 nt, Shigella flexneri 2a str. 301
auucuucaacaa

SEQ ID NO: 2016852 - RNA, 16 nt, Shigella flexneri 2a str. 301
auugccgaagaccaga

SEQ ID NO: 2016853 - RNA, 18 nt, Shigella flexneri 2a str. 301
auugccgaagaccagauu

SEQ ID NO: 2016854 - RNA, 13 nt, Shigella flexneri 2a str. 301
auugccgaagccu

SEQ ID NO: 2016855 - RNA, 15 nt, Shigella flexneri 2a str. 301
auugccgccucugcc

SEQ ID NO: 2016856 - RNA, 20 nt, Shigella flexneri 2a str. 301
auugccggacagaucugccu

SEQ ID NO: 2016857 - RNA, 16 nt, Shigella flexneri 2a str. 301
auugccugauggccug

SEQ ID NO: 2016858 - RNA, 22 nt, Shigella flexneri 2a str. 301
auugccugaucgcgcaaacagu

SEQ ID NO: 2016859 - RNA, 22 nt, Shigella flexneri 2a str. 301
auugccguggauuuaaugccaa

SEQ ID NO: 2016860 - RNA, 18 nt, Shigella flexneri 2a str. 301
auugccgggcgcaucaga

SEQ ID NO: 2016861 - RNA, 20 nt, Shigella flexneri 2a str. 301
auugcccgaugcgcaaacuu

SEQ ID NO: 2016862 - RNA, 18 nt, Shigella flexneri 2a str. 301
auugcccggucagguggu

SEQ ID NO: 2016863 - RNA, 22 nt, Shigella flexneri 2a str. 301
auugcccuguuugucgaucauc

SEQ ID NO: 2016864 - RNA, 16 nt, Shigella flexneri 2a str. 301
auugcccgaagccaau

SEQ ID NO: 2016865 - RNA, 19 nt, Shigella flexneri 2a str. 301
auugcacguccgguggcau

SEQ ID NO: 2016866 - RNA, 16 nt, Shigella flexneri 2a str. 301
auugcaccgacuggcu

SEQ ID NO: 2016867 - RNA, 18 nt, Shigella flexneri 2a str. 301
auugcacuugcuuaaaau

SEQ ID NO: 2016868 - RNA, 21 nt, Shigella flexneri 2a str. 301
auugagcgauuuaugauauuu

SEQ ID NO: 2016869 - RNA, 15 nt, Shigella flexneri 2a str. 301
auugagcuggucuga

SEQ ID NO: 2016870 - RNA, 20 nt, Shigella flexneri 2a str. 301
auugagcuggucugaaucaa

SEQ ID NO: 2016871 - RNA, 17 nt, Shigella flexneri 2a str. 301
auugaggcgcugaaugu

SEQ ID NO: 2016872 - RNA, 17 nt, Shigella flexneri 2a str. 301
auugaguacggucugca

SEQ ID NO: 2016873 - RNA, 15 nt, Shigella flexneri 2a str. 301
auugauuuaucaggu

SEQ ID NO: 2016874 - RNA, 21 nt, Shigella flexneri 2a str. 301
auugcaaagagaacugagcga

SEQ ID NO: 2016875 - RNA, 17 nt, Shigella flexneri 2a str. 301
auugauuuucgaaaaaa

SEQ ID NO: 2016876 - RNA, 20 nt, Shigella flexneri 2a str. 301
auugcaccauccauuuuuca

SEQ ID NO: 2016877 - RNA, 21 nt, Shigella flexneri 2a str. 301
auugcaccacaucgguuugcg

SEQ ID NO: 2016878 - RNA, 16 nt, Shigella flexneri 2a str. 301
auugcaacauguugaa

SEQ ID NO: 2016879 - RNA, 19 nt, Shigella flexneri 2a str. 301
auugggaugccgaaaaaag

SEQ ID NO: 2016880 - RNA, 15 nt, Shigella flexneri 2a str. 301
auuggcuucauugau

SEQ ID NO: 2016881 - RNA, 17 nt, Shigella flexneri 2a str. 301
auugggcgaaagaaaag

SEQ ID NO: 2016882 - RNA, 17 nt, Shigella flexneri 2a str. 301
auuggagacugaugaca

SEQ ID NO: 2016883 - RNA, 20 nt, Shigella flexneri 2a str. 301
auuggagacugaugacaaac

SEQ ID NO: 2016884 - RNA, 20 nt, Shigella flexneri 2a str. 301
auuggagaguugcaccagca

SEQ ID NO: 2016885 - RNA, 15 nt, Shigella flexneri 2a str. 301
auugcuucaguugcc

SEQ ID NO: 2016886 - RNA, 14 nt, Shigella flexneri 2a str. 301
auugcgacgagaaa

SEQ ID NO: 2016887 - RNA, 22 nt, Shigella flexneri 2a str. 301
auugccuuccaccagauggcuu

SEQ ID NO: 2016888 - RNA, 16 nt, Shigella flexneri 2a str. 301
auugccuggcuugccg

SEQ ID NO: 2016889 - RNA, 16 nt, Shigella flexneri 2a str. 301
auugcgcaccagcuug

SEQ ID NO: 2016890 - RNA, 21 nt, Shigella flexneri 2a str. 301
auugcgcaccagcuugcgaca

SEQ ID NO: 2016891 - RNA, 19 nt, Shigella flexneri 2a str. 301
auugcguuuaguuacacca

SEQ ID NO: 2016892 - RNA, 23 nt, Shigella flexneri 2a str. 301
auugcgcaacugaggcaauaaug

SEQ ID NO: 2016893 - RNA, 14 nt, Shigella flexneri 2a str. 301
auugcuguuuuaca

SEQ ID NO: 2016894 - RNA, 17 nt, Shigella flexneri 2a str. 301
auugcuauuuccaccuc

SEQ ID NO: 2016895 - RNA, 12 nt, Shigella flexneri 2a str. 301
auugcucaaagu

SEQ ID NO: 2016896 - RNA, 14 nt, Shigella flexneri 2a str. 301
auugcuagcggguu

SEQ ID NO: 2016897 - RNA, 15 nt, Shigella flexneri 2a str. 301
auuucaucaccagcu

SEQ ID NO: 2016898 - RNA, 19 nt, Shigella flexneri 2a str. 301
auuucagaauagacaaaaa

SEQ ID NO: 2016899 - RNA, 18 nt, Shigella flexneri 2a str. 301
auuucagaccuguugccc

SEQ ID NO: 2016900 - RNA, 22 nt, Shigella flexneri 2a str. 301
auuucaaugcauuaucagagau

SEQ ID NO: 2016901 - RNA, 21 nt, Shigella flexneri 2a str. 301
auuucaaugcgcguaauuugc

SEQ ID NO: 2016902 - RNA, 16 nt, Shigella flexneri 2a str. 301
auuucagcaagacaau

SEQ ID NO: 2016903 - RNA, 22 nt, Shigella flexneri 2a str. 301
auuucaacagguuuuguugccc

SEQ ID NO: 2016904 - RNA, 15 nt, Shigella flexneri 2a str. 301
auuucaacagguuuu

SEQ ID NO: 2016905 - RNA, 13 nt, Shigella flexneri 2a str. 301
auuucaacagauu

SEQ ID NO: 2016906 - RNA, 16 nt, Shigella flexneri 2a str. 301
auuucaauaugauaaa

SEQ ID NO: 2016907 - RNA, 19 nt, Shigella flexneri 2a str. 301
auuucaauaugauaaaccu

SEQ ID NO: 2016908 - RNA, 14 nt, Shigella flexneri 2a str. 301
auuuauugacaauc

SEQ ID NO: 2016909 - RNA, 18 nt, Shigella flexneri 2a str. 301
auuuauuaccuuuuuacc

SEQ ID NO: 2016910 - RNA, 18 nt, Shigella flexneri 2a str. 301
auuuauuuuccaaaauaa

SEQ ID NO: 2016911 - RNA, 21 nt, Shigella flexneri 2a str. 301
auuuauuuuccaaaauaaaaa

SEQ ID NO: 2016912 - RNA, 13 nt, Shigella flexneri 2a str. 301
auuuauuugcaaa

SEQ ID NO: 2016913 - RNA, 15 nt, Shigella flexneri 2a str. 301
auuuauagauuuacu

SEQ ID NO: 2016914 - RNA, 15 nt, Shigella flexneri 2a str. 301
auuuaucgacugcca

SEQ ID NO: 2016915 - RNA, 14 nt, Shigella flexneri 2a str. 301
auuuauaaaagaaa

SEQ ID NO: 2016916 - RNA, 15 nt, Shigella flexneri 2a str. 301
auuuaauaauaagua

SEQ ID NO: 2016917 - RNA, 15 nt, Shigella flexneri 2a str. 301
auugugcgccauuuu

SEQ ID NO: 2016918 - RNA, 14 nt, Shigella flexneri 2a str. 301
auuguguaaauuca

SEQ ID NO: 2016919 - RNA, 21 nt, Shigella flexneri 2a str. 301
auugugguccgcuuguaggcc

SEQ ID NO: 2016920 - RNA, 22 nt, Shigella flexneri 2a str. 301
auugugggucgauuaaauucac

SEQ ID NO: 2016921 - RNA, 22 nt, Shigella flexneri 2a str. 301
auugucuucaagaucagcggca

SEQ ID NO: 2016922 - RNA, 15 nt, Shigella flexneri 2a str. 301
auugugauaaaaauc

SEQ ID NO: 2016923 - RNA, 17 nt, Shigella flexneri 2a str. 301
auugucgcagaagccac

SEQ ID NO: 2016924 - RNA, 23 nt, Shigella flexneri 2a str. 301
auugucuuaaaccggacaauaaa

SEQ ID NO: 2016925 - RNA, 16 nt, Shigella flexneri 2a str. 301
auugguuuuuugguaa

SEQ ID NO: 2016926 - RNA, 14 nt, Shigella flexneri 2a str. 301
auuggguucaucug

SEQ ID NO: 2016927 - RNA, 14 nt, Shigella flexneri 2a str. 301
auuggguauucauu

SEQ ID NO: 2016928 - RNA, 14 nt, Shigella flexneri 2a str. 301
auuguagaaaaucu

SEQ ID NO: 2016929 - RNA, 17 nt, Shigella flexneri 2a str. 301
auuguugauaaggaaau

SEQ ID NO: 2016930 - RNA, 22 nt, Shigella flexneri 2a str. 301
auuguugauaaggaaauucagc

SEQ ID NO: 2016931 - RNA, 13 nt, Shigella flexneri 2a str. 301
auuguugaugagc

SEQ ID NO: 2016932 - RNA, 16 nt, Shigella flexneri 2a str. 301
auuguugauaaggaaa

SEQ ID NO: 2016933 - RNA, 14 nt, Shigella flexneri 2a str. 301
auuguucugcgcug

SEQ ID NO: 2016934 - RNA, 21 nt, Shigella flexneri 2a str. 301
auuguucuguaugccggauaa

SEQ ID NO: 2016935 - RNA, 17 nt, Shigella flexneri 2a str. 301
auuguuauaccagucca

SEQ ID NO: 2016936 - RNA, 18 nt, Shigella flexneri 2a str. 301
auuguuauaccaguccac

SEQ ID NO: 2016937 - RNA, 21 nt, Shigella flexneri 2a str. 301
auuguuaucguuugcauuauc

SEQ ID NO: 2016938 - RNA, 22 nt, Shigella flexneri 2a str. 301
auuuaaaucaaacggugguugu

SEQ ID NO: 2016939 - RNA, 21 nt, Shigella flexneri 2a str. 301
auuuaaagcggccagauuuac

SEQ ID NO: 2016940 - RNA, 13 nt, Shigella flexneri 2a str. 301
auuuaacccugcg

SEQ ID NO: 2016941 - RNA, 14 nt, Shigella flexneri 2a str. 301
auuuaacggcagca

SEQ ID NO: 2016942 - RNA, 18 nt, Shigella flexneri 2a str. 301
auuuaacccuucaagaau

SEQ ID NO: 2016943 - RNA, 20 nt, Shigella flexneri 2a str. 301
auuuaacccuucaagaauua

SEQ ID NO: 2016944 - RNA, 16 nt, Shigella flexneri 2a str. 301
auuuaaccugagcuug

SEQ ID NO: 2016945 - RNA, 16 nt, Shigella flexneri 2a str. 301
auuuaacgauaaauaa

SEQ ID NO: 2016946 - RNA, 20 nt, Shigella flexneri 2a str. 301
auuuucaauaaccugcaaaa

SEQ ID NO: 2016947 - RNA, 22 nt, Shigella flexneri 2a str. 301
auuuuauugcguaaucuuuuca

SEQ ID NO: 2016948 - RNA, 21 nt, Shigella flexneri 2a str. 301
auuuucagcgugcccacguuc

SEQ ID NO: 2016949 - RNA, 22 nt, Shigella flexneri 2a str. 301
auuuucagcgugcccacguuca

SEQ ID NO: 2016950 - RNA, 18 nt, Shigella flexneri 2a str. 301
auuuuaaauuuccucuug

SEQ ID NO: 2016951 - RNA, 21 nt, Shigella flexneri 2a str. 301
auuuuaaauuuccucuuguca

SEQ ID NO: 2016952 - RNA, 15 nt, Shigella flexneri 2a str. 301
auuuuaauaaaucac

SEQ ID NO: 2016953 - RNA, 23 nt, Shigella flexneri 2a str. 301
auuuugugcagcaugcacccuca

SEQ ID NO: 2016954 - RNA, 14 nt, Shigella flexneri 2a str. 301
auuuucuucauucg

SEQ ID NO: 2016955 - RNA, 20 nt, Shigella flexneri 2a str. 301
auuuugacuuuuacagcuua

SEQ ID NO: 2016956 - RNA, 19 nt, Shigella flexneri 2a str. 301
auuuucugcgcauuuccca

SEQ ID NO: 2016957 - RNA, 21 nt, Shigella flexneri 2a str. 301
auuuucucgugccgccagcac

SEQ ID NO: 2016958 - RNA, 14 nt, Shigella flexneri 2a str. 301
auuuucgccacuuc

SEQ ID NO: 2016959 - RNA, 14 nt, Shigella flexneri 2a str. 301
auuuucauccauua

SEQ ID NO: 2016960 - RNA, 21 nt, Shigella flexneri 2a str. 301
auuuucauugccgcaucgaau

SEQ ID NO: 2016961 - RNA, 15 nt, Shigella flexneri 2a str. 301
auuuuccggguucuc

SEQ ID NO: 2016962 - RNA, 14 nt, Shigella flexneri 2a str. 301
auuuuccuccagca

SEQ ID NO: 2016963 - RNA, 20 nt, Shigella flexneri 2a str. 301
auuuuccuccagcagcacaa

SEQ ID NO: 2016964 - RNA, 22 nt, Shigella flexneri 2a str. 301
auuuuccuccagcagcacaauc

SEQ ID NO: 2016965 - RNA, 18 nt, Shigella flexneri 2a str. 301
auuuuccuugaaaaagag

SEQ ID NO: 2016966 - RNA, 13 nt, Shigella flexneri 2a str. 301
auuucguuguguc

SEQ ID NO: 2016967 - RNA, 11 nt, Shigella flexneri 2a str. 301
auuucuccccc

SEQ ID NO: 2016968 - RNA, 14 nt, Shigella flexneri 2a str. 301
auuucuccccccuc

SEQ ID NO: 2016969 - RNA, 17 nt, Shigella flexneri 2a str. 301
auuucuccccccucuga

SEQ ID NO: 2016970 - RNA, 21 nt, Shigella flexneri 2a str. 301
auuucuccccccucugauugg

SEQ ID NO: 2016971 - RNA, 15 nt, Shigella flexneri 2a str. 301
auuucuaauagccau

SEQ ID NO: 2016972 - RNA, 20 nt, Shigella flexneri 2a str. 301
auuucucguuggucaucacu

SEQ ID NO: 2016973 - RNA, 17 nt, Shigella flexneri 2a str. 301
auuucuucauacuaccu

SEQ ID NO: 2016974 - RNA, 22 nt, Shigella flexneri 2a str. 301
auuucuucaucgguauaaccaa

SEQ ID NO: 2016975 - RNA, 16 nt, Shigella flexneri 2a str. 301
auuugaguucacugcc

SEQ ID NO: 2016976 - RNA, 15 nt, Shigella flexneri 2a str. 301
auuugaguucacugc

SEQ ID NO: 2016977 - RNA, 17 nt, Shigella flexneri 2a str. 301
auuugaguucacugccg

SEQ ID NO: 2016978 - RNA, 15 nt, Shigella flexneri 2a str. 301
auuugugcaaauuca

SEQ ID NO: 2016979 - RNA, 18 nt, Shigella flexneri 2a str. 301
auuuguggugaagccacc

SEQ ID NO: 2016980 - RNA, 23 nt, Shigella flexneri 2a str. 301
auuuuaaacgucaacccuuuauc

SEQ ID NO: 2016981 - RNA, 16 nt, Shigella flexneri 2a str. 301
auuuguucagcaaaug

SEQ ID NO: 2016982 - RNA, 20 nt, Shigella flexneri 2a str. 301
auuuggcugccgagcaaauc

SEQ ID NO: 2016983 - RNA, 20 nt, Shigella flexneri 2a str. 301
auuuggcugagugaaucaga

SEQ ID NO: 2016984 - RNA, 22 nt, Shigella flexneri 2a str. 301
auuugcggaaguaguucaucaa

SEQ ID NO: 2016985 - RNA, 17 nt, Shigella flexneri 2a str. 301
auuugauugcagauucg

SEQ ID NO: 2016986 - RNA, 23 nt, Shigella flexneri 2a str. 301
auuugcgcgaugccgccguagaa

SEQ ID NO: 2016987 - RNA, 20 nt, Shigella flexneri 2a str. 301
auuugccuaauaaaucuaaa

SEQ ID NO: 2016988 - RNA, 16 nt, Shigella flexneri 2a str. 301
auuugccccuguugaa

SEQ ID NO: 2016989 - RNA, 23 nt, Shigella flexneri 2a str. 301
caaaacacucuucaacacacuga

SEQ ID NO: 2016990 - RNA, 20 nt, Shigella flexneri 2a str. 301
caaaacagggcuuacugaaa

SEQ ID NO: 2016991 - RNA, 20 nt, Shigella flexneri 2a str. 301
caaaaccacagugacccgca

SEQ ID NO: 2016992 - RNA, 18 nt, Shigella flexneri 2a str. 301
caaaacaaugggaaaaca

SEQ ID NO: 2016993 - RNA, 22 nt, Shigella flexneri 2a str. 301
caaaaccugguugguacugugg

SEQ ID NO: 2016994 - RNA, 16 nt, Shigella flexneri 2a str. 301
caaaacgcaccacuuc

SEQ ID NO: 2016995 - RNA, 19 nt, Shigella flexneri 2a str. 301
caaaacgccgguugcgaca

SEQ ID NO: 2016996 - RNA, 18 nt, Shigella flexneri 2a str. 301
caaaacgcgacugcaaaa

SEQ ID NO: 2016997 - RNA, 19 nt, Shigella flexneri 2a str. 301
caaaacgcgacugcaaaaa

SEQ ID NO: 2016998 - RNA, 13 nt, Shigella flexneri 2a str. 301
caaaacgcucuga

SEQ ID NO: 2016999 - RNA, 20 nt, Shigella flexneri 2a str. 301
caaaaccguucgaacuggau

SEQ ID NO: 2017000 - RNA, 20 nt, Shigella flexneri 2a str. 301
caaaaccgagaagcuuaccg

SEQ ID NO: 2017001 - RNA, 14 nt, Shigella flexneri 2a str. 301
caaaaccucuucca

SEQ ID NO: 2017002 - RNA, 15 nt, Shigella flexneri 2a str. 301
caaaacccaggcuua

SEQ ID NO: 2017003 - RNA, 21 nt, Shigella flexneri 2a str. 301
caaaacguggccuccaaaaaa

SEQ ID NO: 2017004 - RNA, 18 nt, Shigella flexneri 2a str. 301
caaaagaugagaaaaauc

SEQ ID NO: 2017005 - RNA, 18 nt, Shigella flexneri 2a str. 301
caaaagauuauugcuuga

SEQ ID NO: 2017006 - RNA, 18 nt, Shigella flexneri 2a str. 301
caaaagcaauaauuucaa

SEQ ID NO: 2017007 - RNA, 20 nt, Shigella flexneri 2a str. 301
caaaaacaacgagccaauaa

SEQ ID NO: 2017008 - RNA, 13 nt, Shigella flexneri 2a str. 301
caaaaaauagcaa

SEQ ID NO: 2017009 - RNA, 16 nt, Shigella flexneri 2a str. 301
caaaaaaggugcugaa

SEQ ID NO: 2017010 - RNA, 18 nt, Shigella flexneri 2a str. 301
caaaaagcucaaucgaga

SEQ ID NO: 2017011 - RNA, 21 nt, Shigella flexneri 2a str. 301
caaaaacuaauucaccuugcu

SEQ ID NO: 2017012 - RNA, 18 nt, Shigella flexneri 2a str. 301
caaaaacucauaaauuca

SEQ ID NO: 2017013 - RNA, 15 nt, Shigella flexneri 2a str. 301
caaaaacccugccgu

SEQ ID NO: 2017014 - RNA, 19 nt, Shigella flexneri 2a str. 301
caaaaacauugccguaagc

SEQ ID NO: 2017015 - RNA, 18 nt, Shigella flexneri 2a str. 301
caaaaaucggcaacauua

SEQ ID NO: 2017016 - RNA, 15 nt, Shigella flexneri 2a str. 301
caaaaaucggcaaca

SEQ ID NO: 2017017 - RNA, 21 nt, Shigella flexneri 2a str. 301
caaaaaucggcaacauuaaau

SEQ ID NO: 2017018 - RNA, 19 nt, Shigella flexneri 2a str. 301
caaaaaucgcaaauugacu

SEQ ID NO: 2017019 - RNA, 17 nt, Shigella flexneri 2a str. 301
caaaaaguccaaaaggu

SEQ ID NO: 2017020 - RNA, 15 nt, Shigella flexneri 2a str. 301
caaaaaguccaaaag

SEQ ID NO: 2017021 - RNA, 14 nt, Shigella flexneri 2a str. 301
caaaaauaaucauc

SEQ ID NO: 2017022 - RNA, 15 nt, Shigella flexneri 2a str. 301
caaaaauaaucaucu

SEQ ID NO: 2017023 - RNA, 21 nt, Shigella flexneri 2a str. 301
caaaaauaccaccaaugucga

SEQ ID NO: 2017024 - RNA, 13 nt, Shigella flexneri 2a str. 301
caaaaauaaaugc

SEQ ID NO: 2017025 - RNA, 19 nt, Shigella flexneri 2a str. 301
caaaaaaggccgcaggcug

SEQ ID NO: 2017026 - RNA, 12 nt, Shigella flexneri 2a str. 301
caaaaaaaaauc

SEQ ID NO: 2017027 - RNA, 12 nt, Shigella flexneri 2a str. 301
caaaaaaauaag

SEQ ID NO: 2017028 - RNA, 12 nt, Shigella flexneri 2a str. 301
auuuuuuuuccg

SEQ ID NO: 2017029 - RNA, 20 nt, Shigella flexneri 2a str. 301
auuuuuuuucaggaaauaaa

SEQ ID NO: 2017030 - RNA, 17 nt, Shigella flexneri 2a str. 301
auuuuuuuucaaccuaa

SEQ ID NO: 2017031 - RNA, 20 nt, Shigella flexneri 2a str. 301
auuuuuuccgcaaaaacgac

SEQ ID NO: 2017032 - RNA, 21 nt, Shigella flexneri 2a str. 301
auuuuuuauuguccgguuuaa

SEQ ID NO: 2017033 - RNA, 20 nt, Shigella flexneri 2a str. 301
auuuuuugcucauaaaauca

SEQ ID NO: 2017034 - RNA, 18 nt, Shigella flexneri 2a str. 301
auuuuuuuauugauaaac

SEQ ID NO: 2017035 - RNA, 17 nt, Shigella flexneri 2a str. 301
auuuuucugcacuacgc

SEQ ID NO: 2017036 - RNA, 13 nt, Shigella flexneri 2a str. 301
auuuuucauaauc

SEQ ID NO: 2017037 - RNA, 20 nt, Shigella flexneri 2a str. 301
auuuuucacuuaaugaauca

SEQ ID NO: 2017038 - RNA, 17 nt, Shigella flexneri 2a str. 301
auuuuuaaacaucaaac

SEQ ID NO: 2017039 - RNA, 15 nt, Shigella flexneri 2a str. 301
auuuuugcagcaaac

SEQ ID NO: 2017040 - RNA, 23 nt, Shigella flexneri 2a str. 301
auuuuuuaacugacuuucguuug

SEQ ID NO: 2017041 - RNA, 14 nt, Shigella flexneri 2a str. 301
auuuuugugaagaa

SEQ ID NO: 2017042 - RNA, 16 nt, Shigella flexneri 2a str. 301
auuuuugugaagaaua

SEQ ID NO: 2017043 - RNA, 16 nt, Shigella flexneri 2a str. 301
caaucucgcgcccguc

SEQ ID NO: 2017044 - RNA, 15 nt, Shigella flexneri 2a str. 301
caaucucuuccagaa

SEQ ID NO: 2017045 - RNA, 23 nt, Shigella flexneri 2a str. 301
caaucucugguuuguuuucagau

SEQ ID NO: 2017046 - RNA, 14 nt, Shigella flexneri 2a str. 301
caaucucuucacag

SEQ ID NO: 2017047 - RNA, 15 nt, Shigella flexneri 2a str. 301
caaucucuuuuucca

SEQ ID NO: 2017048 - RNA, 17 nt, Shigella flexneri 2a str. 301
caaucugcgcuucucgc

SEQ ID NO: 2017049 - RNA, 16 nt, Shigella flexneri 2a str. 301
caaucugcuccauuag

SEQ ID NO: 2017050 - RNA, 20 nt, Shigella flexneri 2a str. 301
caaucucauaccagguaccg

SEQ ID NO: 2017051 - RNA, 12 nt, Shigella flexneri 2a str. 301
caaucucagcga

SEQ ID NO: 2017052 - RNA, 13 nt, Shigella flexneri 2a str. 301
caaucucaccaau

SEQ ID NO: 2017053 - RNA, 14 nt, Shigella flexneri 2a str. 301
caaucucaccaauc

SEQ ID NO: 2017054 - RNA, 12 nt, Shigella flexneri 2a str. 301
caaucucacucc

SEQ ID NO: 2017055 - RNA, 17 nt, Shigella flexneri 2a str. 301
caaucguuucaugccau

SEQ ID NO: 2017056 - RNA, 21 nt, Shigella flexneri 2a str. 301
caaucgcccccgucaccggca

SEQ ID NO: 2017057 - RNA, 18 nt, Shigella flexneri 2a str. 301
caaucgccuccagcgcug

SEQ ID NO: 2017058 - RNA, 21 nt, Shigella flexneri 2a str. 301
caaucgaaaaagaaucgauua

SEQ ID NO: 2017059 - RNA, 19 nt, Shigella flexneri 2a str. 301
caaucgaccaggccaucag

SEQ ID NO: 2017060 - RNA, 19 nt, Shigella flexneri 2a str. 301
caaucgcugcggcaauaau

SEQ ID NO: 2017061 - RNA, 15 nt, Shigella flexneri 2a str. 301
caaucgcuucaucgc

SEQ ID NO: 2017062 - RNA, 20 nt, Shigella flexneri 2a str. 301
caaucgcuucgucaagacgu

SEQ ID NO: 2017063 - RNA, 19 nt, Shigella flexneri 2a str. 301
caaucgccuccagcgcugg

SEQ ID NO: 2017064 - RNA, 21 nt, Shigella flexneri 2a str. 301
caaucgcgccagaacacgcuc

SEQ ID NO: 2017065 - RNA, 22 nt, Shigella flexneri 2a str. 301
caaucgcggcgauauccagcgc

SEQ ID NO: 2017066 - RNA, 19 nt, Shigella flexneri 2a str. 301
caaucggcaauucaguacg

SEQ ID NO: 2017067 - RNA, 14 nt, Shigella flexneri 2a str. 301
caaucggugcaaau

SEQ ID NO: 2017068 - RNA, 16 nt, Shigella flexneri 2a str. 301
caaucgggaaaaucug

SEQ ID NO: 2017069 - RNA, 17 nt, Shigella flexneri 2a str. 301
caaucguaugaucaucc

SEQ ID NO: 2017070 - RNA, 21 nt, Shigella flexneri 2a str. 301
caaucguaugaucauccgccu

SEQ ID NO: 2017071 - RNA, 13 nt, Shigella flexneri 2a str. 301
caaucauccauau

SEQ ID NO: 2017072 - RNA, 21 nt, Shigella flexneri 2a str. 301
caaucaucgcggcacacagca

SEQ ID NO: 2017073 - RNA, 18 nt, Shigella flexneri 2a str. 301
caaucaucgccuuaugcu

SEQ ID NO: 2017074 - RNA, 16 nt, Shigella flexneri 2a str. 301
caaucaaauagccugc

SEQ ID NO: 2017075 - RNA, 14 nt, Shigella flexneri 2a str. 301
caaucaaaaaaggc

SEQ ID NO: 2017076 - RNA, 22 nt, Shigella flexneri 2a str. 301
caaucaaaaaaggcugacaaau

SEQ ID NO: 2017077 - RNA, 19 nt, Shigella flexneri 2a str. 301
caauauugaugcucacugc

SEQ ID NO: 2017078 - RNA, 15 nt, Shigella flexneri 2a str. 301
caauauuuucaaucu

SEQ ID NO: 2017079 - RNA, 11 nt, Shigella flexneri 2a str. 301
caauauuugca

SEQ ID NO: 2017080 - RNA, 19 nt, Shigella flexneri 2a str. 301
caaucaucucucgcaucag

SEQ ID NO: 2017081 - RNA, 14 nt, Shigella flexneri 2a str. 301
caaucauucccauu

SEQ ID NO: 2017082 - RNA, 18 nt, Shigella flexneri 2a str. 301
caauccauaccagcacau

SEQ ID NO: 2017083 - RNA, 15 nt, Shigella flexneri 2a str. 301
caauccagcccugcc

SEQ ID NO: 2017084 - RNA, 18 nt, Shigella flexneri 2a str. 301
caaucccaaaauaauaaa

SEQ ID NO: 2017085 - RNA, 15 nt, Shigella flexneri 2a str. 301
caaucccaaaauaau

SEQ ID NO: 2017086 - RNA, 19 nt, Shigella flexneri 2a str. 301
caaucccggaagccaccac

SEQ ID NO: 2017087 - RNA, 20 nt, Shigella flexneri 2a str. 301
caaucccuuucucuucaaac

SEQ ID NO: 2017088 - RNA, 19 nt, Shigella flexneri 2a str. 301
caaucccuuucucuucaaa

SEQ ID NO: 2017089 - RNA, 20 nt, Shigella flexneri 2a str. 301
caauccgccaaaacaucuuc

SEQ ID NO: 2017090 - RNA, 20 nt, Shigella flexneri 2a str. 301
caauccggccuacaaauuca

SEQ ID NO: 2017091 - RNA, 15 nt, Shigella flexneri 2a str. 301
caaugauuucugcca

SEQ ID NO: 2017092 - RNA, 19 nt, Shigella flexneri 2a str. 301
caaugaguggugaaaaaaa

SEQ ID NO: 2017093 - RNA, 21 nt, Shigella flexneri 2a str. 301
caaugaguucgcgcgcugcca

SEQ ID NO: 2017094 - RNA, 13 nt, Shigella flexneri 2a str. 301
caaugauaagccu

SEQ ID NO: 2017095 - RNA, 19 nt, Shigella flexneri 2a str. 301
caaugauuuugauggaaga

SEQ ID NO: 2017096 - RNA, 17 nt, Shigella flexneri 2a str. 301
caaugcaucgcgaccaa

SEQ ID NO: 2017097 - RNA, 19 nt, Shigella flexneri 2a str. 301
caaugcaucgcgaccaauc

SEQ ID NO: 2017098 - RNA, 15 nt, Shigella flexneri 2a str. 301
caaugccacgccaca

SEQ ID NO: 2017099 - RNA, 17 nt, Shigella flexneri 2a str. 301
caaugcauuaucagaga

SEQ ID NO: 2017100 - RNA, 18 nt, Shigella flexneri 2a str. 301
caaugcauuaucagagau

SEQ ID NO: 2017101 - RNA, 17 nt, Shigella flexneri 2a str. 301
caaugcaguuccauaug

SEQ ID NO: 2017102 - RNA, 18 nt, Shigella flexneri 2a str. 301
caaucuuuacacacaagc

SEQ ID NO: 2017103 - RNA, 19 nt, Shigella flexneri 2a str. 301
caaugaaagccccaccagc

SEQ ID NO: 2017104 - RNA, 20 nt, Shigella flexneri 2a str. 301
caaugaaacgcaaauacuga

SEQ ID NO: 2017105 - RNA, 21 nt, Shigella flexneri 2a str. 301
caaugaaagccccaccagcaa

SEQ ID NO: 2017106 - RNA, 18 nt, Shigella flexneri 2a str. 301
caaugaaaggcuucccaa

SEQ ID NO: 2017107 - RNA, 17 nt, Shigella flexneri 2a str. 301
caaugacguuaauaaaa

SEQ ID NO: 2017108 - RNA, 19 nt, Shigella flexneri 2a str. 301
caaugaagaaccgcaccag

SEQ ID NO: 2017109 - RNA, 19 nt, Shigella flexneri 2a str. 301
caaugcuuuuugcauuucc

SEQ ID NO: 2017110 - RNA, 11 nt, Shigella flexneri 2a str. 301
caaugcgcauc

SEQ ID NO: 2017111 - RNA, 19 nt, Shigella flexneri 2a str. 301
caaugccgucaccagcauc

SEQ ID NO: 2017112 - RNA, 15 nt, Shigella flexneri 2a str. 301
caaugccauccagcu

SEQ ID NO: 2017113 - RNA, 16 nt, Shigella flexneri 2a str. 301
caaugcccaucacuau

SEQ ID NO: 2017114 - RNA, 20 nt, Shigella flexneri 2a str. 301
caaugcccagaaaccaguuu

SEQ ID NO: 2017115 - RNA, 18 nt, Shigella flexneri 2a str. 301
caaugccgcggcgcggcg

SEQ ID NO: 2017116 - RNA, 12 nt, Shigella flexneri 2a str. 301
caauggcacugu

SEQ ID NO: 2017117 - RNA, 20 nt, Shigella flexneri 2a str. 301
caauggcaggcucagacuga

SEQ ID NO: 2017118 - RNA, 17 nt, Shigella flexneri 2a str. 301
caauggccugcgcgacc

SEQ ID NO: 2017119 - RNA, 22 nt, Shigella flexneri 2a str. 301
caauggcugcaaagcauuuuuu

SEQ ID NO: 2017120 - RNA, 22 nt, Shigella flexneri 2a str. 301
caauggcuggccccgucagcaa

SEQ ID NO: 2017121 - RNA, 23 nt, Shigella flexneri 2a str. 301
caauggcuccgggugugacaaca

SEQ ID NO: 2017122 - RNA, 14 nt, Shigella flexneri 2a str. 301
caauggcuggccug

SEQ ID NO: 2017123 - RNA, 23 nt, Shigella flexneri 2a str. 301
caauggucagcgccaggcuuucc

SEQ ID NO: 2017124 - RNA, 17 nt, Shigella flexneri 2a str. 301
caauggucccuugcugg

SEQ ID NO: 2017125 - RNA, 16 nt, Shigella flexneri 2a str. 301
caauggucagccacag

SEQ ID NO: 2017126 - RNA, 15 nt, Shigella flexneri 2a str. 301
caauggucagccaca

SEQ ID NO: 2017127 - RNA, 16 nt, Shigella flexneri 2a str. 301
caauguaggccugaua

SEQ ID NO: 2017128 - RNA, 14 nt, Shigella flexneri 2a str. 301
caauguagcgcugc

SEQ ID NO: 2017129 - RNA, 13 nt, Shigella flexneri 2a str. 301
caaguaucuauuc

SEQ ID NO: 2017130 - RNA, 12 nt, Shigella flexneri 2a str. 301
caaguauaucaa

SEQ ID NO: 2017131 - RNA, 15 nt, Shigella flexneri 2a str. 301
caaguauucacucug

SEQ ID NO: 2017132 - RNA, 19 nt, Shigella flexneri 2a str. 301
caagucaacgucauuaucu

SEQ ID NO: 2017133 - RNA, 12 nt, Shigella flexneri 2a str. 301
caauaaacuggc

SEQ ID NO: 2017134 - RNA, 16 nt, Shigella flexneri 2a str. 301
caauaacaauacuuau

SEQ ID NO: 2017135 - RNA, 18 nt, Shigella flexneri 2a str. 301
caauaacacauugcugua

SEQ ID NO: 2017136 - RNA, 15 nt, Shigella flexneri 2a str. 301
caauaauacccagca

SEQ ID NO: 2017137 - RNA, 19 nt, Shigella flexneri 2a str. 301
caauauccgguucacuuca

SEQ ID NO: 2017138 - RNA, 20 nt, Shigella flexneri 2a str. 301
caauauccugcgcuuccugc

SEQ ID NO: 2017139 - RNA, 14 nt, Shigella flexneri 2a str. 301
caauaucggcacca

SEQ ID NO: 2017140 - RNA, 23 nt, Shigella flexneri 2a str. 301
caauaucggcaccagcgcagaag

SEQ ID NO: 2017141 - RNA, 15 nt, Shigella flexneri 2a str. 301
caauaucaucauuug

SEQ ID NO: 2017142 - RNA, 16 nt, Shigella flexneri 2a str. 301
caauaucuuccuggcg

SEQ ID NO: 2017143 - RNA, 22 nt, Shigella flexneri 2a str. 301
caauaguucuguugcugaaauu

SEQ ID NO: 2017144 - RNA, 14 nt, Shigella flexneri 2a str. 301
caauaauaucuuuu

SEQ ID NO: 2017145 - RNA, 22 nt, Shigella flexneri 2a str. 301
caauaaucaaucuuuacacaca

SEQ ID NO: 2017146 - RNA, 20 nt, Shigella flexneri 2a str. 301
caauacgauccugagcagcc

SEQ ID NO: 2017147 - RNA, 20 nt, Shigella flexneri 2a str. 301
caauacaccuccggcugggc

SEQ ID NO: 2017148 - RNA, 18 nt, Shigella flexneri 2a str. 301
caauaauuuacagccugc

SEQ ID NO: 2017149 - RNA, 21 nt, Shigella flexneri 2a str. 301
caauacaaaauuuaacaccau

SEQ ID NO: 2017150 - RNA, 16 nt, Shigella flexneri 2a str. 301
caauacuuaaccccag

SEQ ID NO: 2017151 - RNA, 18 nt, Shigella flexneri 2a str. 301
caauagcgccugcugcug

SEQ ID NO: 2017152 - RNA, 17 nt, Shigella flexneri 2a str. 301
caauagcgccugcugcu

SEQ ID NO: 2017153 - RNA, 19 nt, Shigella flexneri 2a str. 301
caauacuuucacaaaaaua

SEQ ID NO: 2017154 - RNA, 18 nt, Shigella flexneri 2a str. 301
caacuucaaggucaacau

SEQ ID NO: 2017155 - RNA, 15 nt, Shigella flexneri 2a str. 301
caacuucagcaacaa

SEQ ID NO: 2017156 - RNA, 23 nt, Shigella flexneri 2a str. 301
caacuucgaguacauccacugca

SEQ ID NO: 2017157 - RNA, 21 nt, Shigella flexneri 2a str. 301
caagcaguugguuaaucuuuu

SEQ ID NO: 2017158 - RNA, 19 nt, Shigella flexneri 2a str. 301
caagcagcgcgcagaacau

SEQ ID NO: 2017159 - RNA, 16 nt, Shigella flexneri 2a str. 301
caagcacaugcugaca

SEQ ID NO: 2017160 - RNA, 13 nt, Shigella flexneri 2a str. 301
caagcagagagac

SEQ ID NO: 2017161 - RNA, 12 nt, Shigella flexneri 2a str. 301
caagcagagaga

SEQ ID NO: 2017162 - RNA, 20 nt, Shigella flexneri 2a str. 301
caagcauuaaggcaagaaaa

SEQ ID NO: 2017163 - RNA, 19 nt, Shigella flexneri 2a str. 301
caagccaggacgcagucca

SEQ ID NO: 2017164 - RNA, 18 nt, Shigella flexneri 2a str. 301
caagccaggcuuuaaauu

SEQ ID NO: 2017165 - RNA, 20 nt, Shigella flexneri 2a str. 301
caagcccugguaacugccag

SEQ ID NO: 2017166 - RNA, 22 nt, Shigella flexneri 2a str. 301
caagccaugcuuugcaucccag

SEQ ID NO: 2017167 - RNA, 16 nt, Shigella flexneri 2a str. 301
caagccccagcaggau

SEQ ID NO: 2017168 - RNA, 21 nt, Shigella flexneri 2a str. 301
caagccggaauuauccgguga

SEQ ID NO: 2017169 - RNA, 22 nt, Shigella flexneri 2a str. 301
caagccgcuaacagcagcagcg

SEQ ID NO: 2017170 - RNA, 16 nt, Shigella flexneri 2a str. 301
caaggaaggcguaaag

SEQ ID NO: 2017171 - RNA, 11 nt, Shigella flexneri 2a str. 301
caaggaagcga

SEQ ID NO: 2017172 - RNA, 17 nt, Shigella flexneri 2a str. 301
caagcguuucaucuuca

SEQ ID NO: 2017173 - RNA, 20 nt, Shigella flexneri 2a str. 301
caagcguuucaucuucaguc

SEQ ID NO: 2017174 - RNA, 23 nt, Shigella flexneri 2a str. 301
caagcggcauccagguuucuucc

SEQ ID NO: 2017175 - RNA, 22 nt, Shigella flexneri 2a str. 301
caagcgcugagacgcgcuugcu

SEQ ID NO: 2017176 - RNA, 20 nt, Shigella flexneri 2a str. 301
caagggugucggcacacaca

SEQ ID NO: 2017177 - RNA, 16 nt, Shigella flexneri 2a str. 301
caagguacgaaaaaaa

SEQ ID NO: 2017178 - RNA, 14 nt, Shigella flexneri 2a str. 301
caagguauugcacg

SEQ ID NO: 2017179 - RNA, 20 nt, Shigella flexneri 2a str. 301
caaggugauugccuuuuucg

SEQ ID NO: 2017180 - RNA, 23 nt, Shigella flexneri 2a str. 301
caaggugugggcaaucacuuugu

SEQ ID NO: 2017181 - RNA, 20 nt, Shigella flexneri 2a str. 301
caaggcgaggggaccgcccc

SEQ ID NO: 2017182 - RNA, 21 nt, Shigella flexneri 2a str. 301
caaggcgaggggaccgccccu

SEQ ID NO: 2017183 - RNA, 20 nt, Shigella flexneri 2a str. 301
caaggcgcggguuucaacau

SEQ ID NO: 2017184 - RNA, 19 nt, Shigella flexneri 2a str. 301
caagggcggcgagaaacuu

SEQ ID NO: 2017185 - RNA, 21 nt, Shigella flexneri 2a str. 301
caaggcgcggguuucaacauu

SEQ ID NO: 2017186 - RNA, 16 nt, Shigella flexneri 2a str. 301
caagggugagggagga

SEQ ID NO: 2017187 - RNA, 17 nt, Shigella flexneri 2a str. 301
caaggguaagggaggau

SEQ ID NO: 2017188 - RNA, 22 nt, Shigella flexneri 2a str. 301
caaagguaauggucaguacgcc

SEQ ID NO: 2017189 - RNA, 17 nt, Shigella flexneri 2a str. 301
caaagguaauggucagu

SEQ ID NO: 2017190 - RNA, 14 nt, Shigella flexneri 2a str. 301
caaagccuuucacu

SEQ ID NO: 2017191 - RNA, 19 nt, Shigella flexneri 2a str. 301
caaagugaauacagaacag

SEQ ID NO: 2017192 - RNA, 16 nt, Shigella flexneri 2a str. 301
caaagugaauacagaa

SEQ ID NO: 2017193 - RNA, 17 nt, Shigella flexneri 2a str. 301
caaagugaauacagaac

SEQ ID NO: 2017194 - RNA, 17 nt, Shigella flexneri 2a str. 301
caaagugcaucucaccg

SEQ ID NO: 2017195 - RNA, 20 nt, Shigella flexneri 2a str. 301
caaagugccuguguuuaugc

SEQ ID NO: 2017196 - RNA, 22 nt, Shigella flexneri 2a str. 301
caaagugcgcguuuuuuaugcc

SEQ ID NO: 2017197 - RNA, 20 nt, Shigella flexneri 2a str. 301
caaaguuugugaucuuuuuc

SEQ ID NO: 2017198 - RNA, 13 nt, Shigella flexneri 2a str. 301
caaaguuugcacc

SEQ ID NO: 2017199 - RNA, 18 nt, Shigella flexneri 2a str. 301
caaauaaacgaaucugca

SEQ ID NO: 2017200 - RNA, 21 nt, Shigella flexneri 2a str. 301
caaauacauugauauacagcc

SEQ ID NO: 2017201 - RNA, 14 nt, Shigella flexneri 2a str. 301
caaauacaccuaua

SEQ ID NO: 2017202 - RNA, 17 nt, Shigella flexneri 2a str. 301
caaauagccaauuccca

SEQ ID NO: 2017203 - RNA, 21 nt, Shigella flexneri 2a str. 301
caaauagugccuggcugcgug

SEQ ID NO: 2017204 - RNA, 18 nt, Shigella flexneri 2a str. 301
caaagaaauccacaaauu

SEQ ID NO: 2017205 - RNA, 16 nt, Shigella flexneri 2a str. 301
caaaagcuaacagagc

SEQ ID NO: 2017206 - RNA, 14 nt, Shigella flexneri 2a str. 301
caaaagggagcuau

SEQ ID NO: 2017207 - RNA, 13 nt, Shigella flexneri 2a str. 301
caaacuuuuaaau

SEQ ID NO: 2017208 - RNA, 15 nt, Shigella flexneri 2a str. 301
caaaagguccuucag

SEQ ID NO: 2017209 - RNA, 18 nt, Shigella flexneri 2a str. 301
caaagcauuuuuucacau

SEQ ID NO: 2017210 - RNA, 21 nt, Shigella flexneri 2a str. 301
caaagcauucguaaugaaugu

SEQ ID NO: 2017211 - RNA, 13 nt, Shigella flexneri 2a str. 301
caaagcagggcug

SEQ ID NO: 2017212 - RNA, 12 nt, Shigella flexneri 2a str. 301
caaagacaaauu

SEQ ID NO: 2017213 - RNA, 23 nt, Shigella flexneri 2a str. 301
caaagacaaauuuugaacagaac

SEQ ID NO: 2017214 - RNA, 15 nt, Shigella flexneri 2a str. 301
caaagcaccacuccu

SEQ ID NO: 2017215 - RNA, 13 nt, Shigella flexneri 2a str. 301
caaagcacgcugu

SEQ ID NO: 2017216 - RNA, 18 nt, Shigella flexneri 2a str. 301
caaaucgucgguguccac

SEQ ID NO: 2017217 - RNA, 18 nt, Shigella flexneri 2a str. 301
caaaucgcccagcaaaua

SEQ ID NO: 2017218 - RNA, 15 nt, Shigella flexneri 2a str. 301
caaaucgcggcagug

SEQ ID NO: 2017219 - RNA, 19 nt, Shigella flexneri 2a str. 301
caaaucgauaaaacuuccc

SEQ ID NO: 2017220 - RNA, 14 nt, Shigella flexneri 2a str. 301
caaaucaucaguac

SEQ ID NO: 2017221 - RNA, 17 nt, Shigella flexneri 2a str. 301
caaaucaaugguguuau

SEQ ID NO: 2017222 - RNA, 20 nt, Shigella flexneri 2a str. 301
caaauauacauaaagucuuu

SEQ ID NO: 2017223 - RNA, 16 nt, Shigella flexneri 2a str. 301
caaaucagaggcuguu

SEQ ID NO: 2017224 - RNA, 13 nt, Shigella flexneri 2a str. 301
caaaucacuauua

SEQ ID NO: 2017225 - RNA, 12 nt, Shigella flexneri 2a str. 301
caaauucuuaau

SEQ ID NO: 2017226 - RNA, 21 nt, Shigella flexneri 2a str. 301
caaauucuggcggcaauaacu

SEQ ID NO: 2017227 - RNA, 18 nt, Shigella flexneri 2a str. 301
caaauuauuaccaucggu

SEQ ID NO: 2017228 - RNA, 14 nt, Shigella flexneri 2a str. 301
caaauuauccccca

SEQ ID NO: 2017229 - RNA, 13 nt, Shigella flexneri 2a str. 301
caaaugcgcagcc

SEQ ID NO: 2017230 - RNA, 18 nt, Shigella flexneri 2a str. 301
caaaugccagauaagaca

SEQ ID NO: 2017231 - RNA, 17 nt, Shigella flexneri 2a str. 301
caaaugccagauaagac

SEQ ID NO: 2017232 - RNA, 22 nt, Shigella flexneri 2a str. 301
caacagaaauaaucgcaauuac

SEQ ID NO: 2017233 - RNA, 14 nt, Shigella flexneri 2a str. 301
caacagaaacgcca

SEQ ID NO: 2017234 - RNA, 17 nt, Shigella flexneri 2a str. 301
caacacuuucacuacaa

SEQ ID NO: 2017235 - RNA, 13 nt, Shigella flexneri 2a str. 301
caacacauaaccg

SEQ ID NO: 2017236 - RNA, 22 nt, Shigella flexneri 2a str. 301
caacacauuacugcuugcucug

SEQ ID NO: 2017237 - RNA, 13 nt, Shigella flexneri 2a str. 301
caacaccacugcc

SEQ ID NO: 2017238 - RNA, 19 nt, Shigella flexneri 2a str. 301
caacacauucaauaacaca

SEQ ID NO: 2017239 - RNA, 14 nt, Shigella flexneri 2a str. 301
caacacgccuggcu

SEQ ID NO: 2017240 - RNA, 16 nt, Shigella flexneri 2a str. 301
caaauuuaaacgacaa

SEQ ID NO: 2017241 - RNA, 15 nt, Shigella flexneri 2a str. 301
caaauugcaccaucc

SEQ ID NO: 2017242 - RNA, 16 nt, Shigella flexneri 2a str. 301
caaauugcugguauuu

SEQ ID NO: 2017243 - RNA, 19 nt, Shigella flexneri 2a str. 301
caacacacugaauaaaaau

SEQ ID NO: 2017244 - RNA, 23 nt, Shigella flexneri 2a str. 301
caacaauugcgggccaaagacca

SEQ ID NO: 2017245 - RNA, 14 nt, Shigella flexneri 2a str. 301
caacaauugucgcc

SEQ ID NO: 2017246 - RNA, 16 nt, Shigella flexneri 2a str. 301
caacaauucguuguuu

SEQ ID NO: 2017247 - RNA, 14 nt, Shigella flexneri 2a str. 301
caacaauggcauuu

SEQ ID NO: 2017248 - RNA, 20 nt, Shigella flexneri 2a str. 301
caacaaucugcaaaucgauc

SEQ ID NO: 2017249 - RNA, 14 nt, Shigella flexneri 2a str. 301
caacaauacaaaug

SEQ ID NO: 2017250 - RNA, 15 nt, Shigella flexneri 2a str. 301
caacucugguggaca

SEQ ID NO: 2017251 - RNA, 21 nt, Shigella flexneri 2a str. 301
caacgugaccaguaccaccgc

SEQ ID NO: 2017252 - RNA, 21 nt, Shigella flexneri 2a str. 301
caacgugacucaauggcaucc

SEQ ID NO: 2017253 - RNA, 17 nt, Shigella flexneri 2a str. 301
caacugauaaaccuuca

SEQ ID NO: 2017254 - RNA, 21 nt, Shigella flexneri 2a str. 301
caacugacugacuucaacagg

SEQ ID NO: 2017255 - RNA, 15 nt, Shigella flexneri 2a str. 301
caacugacuggcucu

SEQ ID NO: 2017256 - RNA, 14 nt, Shigella flexneri 2a str. 301
caacugcauuuuca

SEQ ID NO: 2017257 - RNA, 19 nt, Shigella flexneri 2a str. 301
caacuggcgcgcguauuca

SEQ ID NO: 2017258 - RNA, 20 nt, Shigella flexneri 2a str. 301
caacuggcaaccagaagaga

SEQ ID NO: 2017259 - RNA, 16 nt, Shigella flexneri 2a str. 301
caacuggagcaggaac

SEQ ID NO: 2017260 - RNA, 18 nt, Shigella flexneri 2a str. 301
caacugcuucaaaaaaau

SEQ ID NO: 2017261 - RNA, 15 nt, Shigella flexneri 2a str. 301
caacugccugaugcg

SEQ ID NO: 2017262 - RNA, 20 nt, Shigella flexneri 2a str. 301
caacugccugaugcgaugcu

SEQ ID NO: 2017263 - RNA, 23 nt, Shigella flexneri 2a str. 301
caacugcugacgcagauccugau

SEQ ID NO: 2017264 - RNA, 17 nt, Shigella flexneri 2a str. 301
caacuguugauccagga

SEQ ID NO: 2017265 - RNA, 20 nt, Shigella flexneri 2a str. 301
caacuuaaucaucaaugcca

SEQ ID NO: 2017266 - RNA, 22 nt, Shigella flexneri 2a str. 301
caacuguacgccgacgcccugc

SEQ ID NO: 2017267 - RNA, 19 nt, Shigella flexneri 2a str. 301
caacgccgcauagcgacag

SEQ ID NO: 2017268 - RNA, 16 nt, Shigella flexneri 2a str. 301
caacgcccaucaacau

SEQ ID NO: 2017269 - RNA, 17 nt, Shigella flexneri 2a str. 301
caaccguucggaaaaau

SEQ ID NO: 2017270 - RNA, 23 nt, Shigella flexneri 2a str. 301
caaccguccuccguauccuguca

SEQ ID NO: 2017271 - RNA, 17 nt, Shigella flexneri 2a str. 301
caaccuacaaacguugc

SEQ ID NO: 2017272 - RNA, 18 nt, Shigella flexneri 2a str. 301
caaccguuugauauaaac

SEQ ID NO: 2017273 - RNA, 14 nt, Shigella flexneri 2a str. 301
caaccuaaaguaaa

SEQ ID NO: 2017274 - RNA, 13 nt, Shigella flexneri 2a str. 301
caacgcugccagc

SEQ ID NO: 2017275 - RNA, 17 nt, Shigella flexneri 2a str. 301
caacgcugccagccgcc

SEQ ID NO: 2017276 - RNA, 19 nt, Shigella flexneri 2a str. 301
caacgcugccagccgccgc

SEQ ID NO: 2017277 - RNA, 20 nt, Shigella flexneri 2a str. 301
caacgcuucauugcugaagu

SEQ ID NO: 2017278 - RNA, 19 nt, Shigella flexneri 2a str. 301
caacggaggauuuuucgcg

SEQ ID NO: 2017279 - RNA, 18 nt, Shigella flexneri 2a str. 301
caacggaacgaaaaaaau

SEQ ID NO: 2017280 - RNA, 19 nt, Shigella flexneri 2a str. 301
caacggaacgaaaaaaauc

SEQ ID NO: 2017281 - RNA, 14 nt, Shigella flexneri 2a str. 301
caacgcuuucccug

SEQ ID NO: 2017282 - RNA, 23 nt, Shigella flexneri 2a str. 301
caacgcuuucccugaagcaguuu

SEQ ID NO: 2017283 - RNA, 22 nt, Shigella flexneri 2a str. 301
caacggaccaauaaacgccagg

SEQ ID NO: 2017284 - RNA, 19 nt, Shigella flexneri 2a str. 301
caacguauuacgaucaaga

SEQ ID NO: 2017285 - RNA, 22 nt, Shigella flexneri 2a str. 301
caacguccugcaacguccugca

SEQ ID NO: 2017286 - RNA, 19 nt, Shigella flexneri 2a str. 301
caacgucauuaucugcaga

SEQ ID NO: 2017287 - RNA, 22 nt, Shigella flexneri 2a str. 301
caacggcggaucaccgcgucuu

SEQ ID NO: 2017288 - RNA, 23 nt, Shigella flexneri 2a str. 301
caacggcgaaagcuggcacuggg

SEQ ID NO: 2017289 - RNA, 21 nt, Shigella flexneri 2a str. 301
caacggcguaaauaguccgga

SEQ ID NO: 2017290 - RNA, 17 nt, Shigella flexneri 2a str. 301
caacguagccugccauu

SEQ ID NO: 2017291 - RNA, 17 nt, Shigella flexneri 2a str. 301
caacguaggcacauucg

SEQ ID NO: 2017292 - RNA, 20 nt, Shigella flexneri 2a str. 301
caacauuuugaauuagcacg

SEQ ID NO: 2017293 - RNA, 20 nt, Shigella flexneri 2a str. 301
caaccaaagcguaaaguggc

SEQ ID NO: 2017294 - RNA, 21 nt, Shigella flexneri 2a str. 301
caacauuucccccuuccugcu

SEQ ID NO: 2017295 - RNA, 19 nt, Shigella flexneri 2a str. 301
caacaugucagcaaucacc

SEQ ID NO: 2017296 - RNA, 16 nt, Shigella flexneri 2a str. 301
caacaugaaacagaaa

SEQ ID NO: 2017297 - RNA, 18 nt, Shigella flexneri 2a str. 301
caacaugaaacagaaaau

SEQ ID NO: 2017298 - RNA, 21 nt, Shigella flexneri 2a str. 301
caacaugacuaaucugacaac

SEQ ID NO: 2017299 - RNA, 21 nt, Shigella flexneri 2a str. 301
caacaggcccaacuguugauc

SEQ ID NO: 2017300 - RNA, 23 nt, Shigella flexneri 2a str. 301
caacaggcccaacuguugaucca

SEQ ID NO: 2017301 - RNA, 15 nt, Shigella flexneri 2a str. 301
caacaugaaaauaac

SEQ ID NO: 2017302 - RNA, 22 nt, Shigella flexneri 2a str. 301
caacaugaaaauaaccauauau

SEQ ID NO: 2017303 - RNA, 18 nt, Shigella flexneri 2a str. 301
caaccagaaagaugcauc

SEQ ID NO: 2017304 - RNA, 16 nt, Shigella flexneri 2a str. 301
caaccagaaagaugca

SEQ ID NO: 2017305 - RNA, 22 nt, Shigella flexneri 2a str. 301
caaccacuuuaucgagaauacu

SEQ ID NO: 2017306 - RNA, 18 nt, Shigella flexneri 2a str. 301
caaccacuuuaucgagaa

SEQ ID NO: 2017307 - RNA, 15 nt, Shigella flexneri 2a str. 301
caaccagaagagaac

SEQ ID NO: 2017308 - RNA, 20 nt, Shigella flexneri 2a str. 301
caaccagcaccgaaauauua

SEQ ID NO: 2017309 - RNA, 14 nt, Shigella flexneri 2a str. 301
caaccagccagcgc

SEQ ID NO: 2017310 - RNA, 21 nt, Shigella flexneri 2a str. 301
caaccagcuucaacgauucaa

SEQ ID NO: 2017311 - RNA, 16 nt, Shigella flexneri 2a str. 301
caaccaaucgcggcga

SEQ ID NO: 2017312 - RNA, 19 nt, Shigella flexneri 2a str. 301
caaccacaaucucgcgccc

SEQ ID NO: 2017313 - RNA, 14 nt, Shigella flexneri 2a str. 301
caaccacacccaca

SEQ ID NO: 2017314 - RNA, 20 nt, Shigella flexneri 2a str. 301
caaccacuacgugaucgucu

SEQ ID NO: 2017315 - RNA, 21 nt, Shigella flexneri 2a str. 301
caaccacuucaguaucuuuua

SEQ ID NO: 2017316 - RNA, 15 nt, Shigella flexneri 2a str. 301
caaccacucaccgcu

SEQ ID NO: 2017317 - RNA, 19 nt, Shigella flexneri 2a str. 301
caaccaccucaguacccgc

SEQ ID NO: 2017318 - RNA, 21 nt, Shigella flexneri 2a str. 301
caaccgcgacugggaggacag

SEQ ID NO: 2017319 - RNA, 20 nt, Shigella flexneri 2a str. 301
caaccgagcgccccagaccu

SEQ ID NO: 2017320 - RNA, 16 nt, Shigella flexneri 2a str. 301
caaccgaacccagcag

SEQ ID NO: 2017321 - RNA, 20 nt, Shigella flexneri 2a str. 301
caacccuuuccagcgccgcg

SEQ ID NO: 2017322 - RNA, 17 nt, Shigella flexneri 2a str. 301
caaccggcgggaaaaau

SEQ ID NO: 2017323 - RNA, 20 nt, Shigella flexneri 2a str. 301
caaccggcacaauaucuuuu

SEQ ID NO: 2017324 - RNA, 23 nt, Shigella flexneri 2a str. 301
caaccgguggcaguagcgccucu

SEQ ID NO: 2017325 - RNA, 17 nt, Shigella flexneri 2a str. 301
caaccguccuccguauc

SEQ ID NO: 2017326 - RNA, 12 nt, Shigella flexneri 2a str. 301
caaccccagcca

SEQ ID NO: 2017327 - RNA, 22 nt, Shigella flexneri 2a str. 301
caaccccgcacggugcaccgca

SEQ ID NO: 2017328 - RNA, 20 nt, Shigella flexneri 2a str. 301
caacccuaaagcacccagca

SEQ ID NO: 2017329 - RNA, 17 nt, Shigella flexneri 2a str. 301
caacccgugaagguugc

SEQ ID NO: 2017330 - RNA, 22 nt, Shigella flexneri 2a str. 301
caacccgugaagguugcgccuu

SEQ ID NO: 2017331 - RNA, 14 nt, Shigella flexneri 2a str. 301
caacccagaagaaa

SEQ ID NO: 2017332 - RNA, 19 nt, Shigella flexneri 2a str. 301
caacccagcggaugaccca

SEQ ID NO: 2017333 - RNA, 13 nt, Shigella flexneri 2a str. 301
caacccacacauu

SEQ ID NO: 2017334 - RNA, 13 nt, Shigella flexneri 2a str. 301
caaccauuugugc

SEQ ID NO: 2017335 - RNA, 18 nt, Shigella flexneri 2a str. 301
caaccauuugugcuggca

SEQ ID NO: 2017336 - RNA, 20 nt, Shigella flexneri 2a str. 301
cagcgcugcgaaaguaccau

SEQ ID NO: 2017337 - RNA, 23 nt, Shigella flexneri 2a str. 301
cagcgcugcgaaaguaccauuaa

SEQ ID NO: 2017338 - RNA, 13 nt, Shigella flexneri 2a str. 301
cagcgcuaaccgc

SEQ ID NO: 2017339 - RNA, 17 nt, Shigella flexneri 2a str. 301
cagcgcuaaccgccuga

SEQ ID NO: 2017340 - RNA, 15 nt, Shigella flexneri 2a str. 301
cagcgcuaccgccga

SEQ ID NO: 2017341 - RNA, 21 nt, Shigella flexneri 2a str. 301
cagcgcuuuuggcgcguuccc

SEQ ID NO: 2017342 - RNA, 23 nt, Shigella flexneri 2a str. 301
cagcggaaccgcuguugucugaa

SEQ ID NO: 2017343 - RNA, 19 nt, Shigella flexneri 2a str. 301
cagcggacaaugccuaccg

SEQ ID NO: 2017344 - RNA, 16 nt, Shigella flexneri 2a str. 301
cagcgcuuacccgucc

SEQ ID NO: 2017345 - RNA, 17 nt, Shigella flexneri 2a str. 301
cagcggauacaggaagc

SEQ ID NO: 2017346 - RNA, 15 nt, Shigella flexneri 2a str. 301
cagcggaugacccag

SEQ ID NO: 2017347 - RNA, 20 nt, Shigella flexneri 2a str. 301
cagcggauaaagcagagcag

SEQ ID NO: 2017348 - RNA, 21 nt, Shigella flexneri 2a str. 301
cagcggagaaacuucugccgg

SEQ ID NO: 2017349 - RNA, 18 nt, Shigella flexneri 2a str. 301
cagcggcaaccagcccau

SEQ ID NO: 2017350 - RNA, 14 nt, Shigella flexneri 2a str. 301
cagcggccagccau

SEQ ID NO: 2017351 - RNA, 15 nt, Shigella flexneri 2a str. 301
cagcggccaaccauc

SEQ ID NO: 2017352 - RNA, 13 nt, Shigella flexneri 2a str. 301
cagcgcgcagaac

SEQ ID NO: 2017353 - RNA, 18 nt, Shigella flexneri 2a str. 301
cagcgcgccagccaccac

SEQ ID NO: 2017354 - RNA, 19 nt, Shigella flexneri 2a str. 301
cagcgcgccugaaugccac

SEQ ID NO: 2017355 - RNA, 13 nt, Shigella flexneri 2a str. 301
cagcgccugauac

SEQ ID NO: 2017356 - RNA, 19 nt, Shigella flexneri 2a str. 301
cagcgccugauacagccaa

SEQ ID NO: 2017357 - RNA, 18 nt, Shigella flexneri 2a str. 301
cagcgccugacgcggggu

SEQ ID NO: 2017358 - RNA, 20 nt, Shigella flexneri 2a str. 301
cagcgcggaagggaugaaau

SEQ ID NO: 2017359 - RNA, 20 nt, Shigella flexneri 2a str. 301
cagcgcggugauaaccguuu

SEQ ID NO: 2017360 - RNA, 17 nt, Shigella flexneri 2a str. 301
cagcgcgggcuggcgua

SEQ ID NO: 2017361 - RNA, 20 nt, Shigella flexneri 2a str. 301
cagcgaguuuuucaguccac

SEQ ID NO: 2017362 - RNA, 21 nt, Shigella flexneri 2a str. 301
cagcgauaaugaaugaugcgg

SEQ ID NO: 2017363 - RNA, 20 nt, Shigella flexneri 2a str. 301
cagcgaucuuucgcggcagg

SEQ ID NO: 2017364 - RNA, 19 nt, Shigella flexneri 2a str. 301
cagcgauuuugccagccgc

SEQ ID NO: 2017365 - RNA, 16 nt, Shigella flexneri 2a str. 301
cagcgcaccagaaaca

SEQ ID NO: 2017366 - RNA, 14 nt, Shigella flexneri 2a str. 301
cagcgcaccagaaa

SEQ ID NO: 2017367 - RNA, 19 nt, Shigella flexneri 2a str. 301
cagcgcaauuaacgcccca

SEQ ID NO: 2017368 - RNA, 15 nt, Shigella flexneri 2a str. 301
cagcgcaaucaccgg

SEQ ID NO: 2017369 - RNA, 15 nt, Shigella flexneri 2a str. 301
cagcgcaucugccgg

SEQ ID NO: 2017370 - RNA, 15 nt, Shigella flexneri 2a str. 301
cagcgcauucguaau

SEQ ID NO: 2017371 - RNA, 17 nt, Shigella flexneri 2a str. 301
cagcgcauggcggcagc

SEQ ID NO: 2017372 - RNA, 21 nt, Shigella flexneri 2a str. 301
cagcgcauggcggcagcgugc

SEQ ID NO: 2017373 - RNA, 20 nt, Shigella flexneri 2a str. 301
cagcgcauugcuaaugcugg

SEQ ID NO: 2017374 - RNA, 20 nt, Shigella flexneri 2a str. 301
cagcgcauagagacuuuucc

SEQ ID NO: 2017375 - RNA, 14 nt, Shigella flexneri 2a str. 301
cagcgcauccuggc

SEQ ID NO: 2017376 - RNA, 19 nt, Shigella flexneri 2a str. 301
cagcgcacgggcgguuaau

SEQ ID NO: 2017377 - RNA, 15 nt, Shigella flexneri 2a str. 301
cagcgcagcacccag

SEQ ID NO: 2017378 - RNA, 12 nt, Shigella flexneri 2a str. 301
cagcgcaggaaa

SEQ ID NO: 2017379 - RNA, 15 nt, Shigella flexneri 2a str. 301
cagcgcagcucuggc

SEQ ID NO: 2017380 - RNA, 14 nt, Shigella flexneri 2a str. 301
cagcgcccaacacu

SEQ ID NO: 2017381 - RNA, 16 nt, Shigella flexneri 2a str. 301
cagcgccaucugcagg

SEQ ID NO: 2017382 - RNA, 15 nt, Shigella flexneri 2a str. 301
cagcgccagaaggga

SEQ ID NO: 2017383 - RNA, 17 nt, Shigella flexneri 2a str. 301
cagcgccagacaaacca

SEQ ID NO: 2017384 - RNA, 15 nt, Shigella flexneri 2a str. 301
cagcgccagacacug

SEQ ID NO: 2017385 - RNA, 23 nt, Shigella flexneri 2a str. 301
cagcgccgcuuuccaggcugugu

SEQ ID NO: 2017386 - RNA, 19 nt, Shigella flexneri 2a str. 301
cagcgccgagcaccgaccc

SEQ ID NO: 2017387 - RNA, 17 nt, Shigella flexneri 2a str. 301
cagccuacaaaaacuca

SEQ ID NO: 2017388 - RNA, 21 nt, Shigella flexneri 2a str. 301
cagccucaagcacccgccgcu

SEQ ID NO: 2017389 - RNA, 20 nt, Shigella flexneri 2a str. 301
cagccucaagcacccgccgc

SEQ ID NO: 2017390 - RNA, 16 nt, Shigella flexneri 2a str. 301
cagccucccagccauu

SEQ ID NO: 2017391 - RNA, 22 nt, Shigella flexneri 2a str. 301
cagccugaccgcacaccccggc

SEQ ID NO: 2017392 - RNA, 21 nt, Shigella flexneri 2a str. 301
cagccugaccgcacaccccgg

SEQ ID NO: 2017393 - RNA, 19 nt, Shigella flexneri 2a str. 301
cagccugacagcacgcccc

SEQ ID NO: 2017394 - RNA, 13 nt, Shigella flexneri 2a str. 301
cagccucugccgc

SEQ ID NO: 2017395 - RNA, 14 nt, Shigella flexneri 2a str. 301
cagccucugccgcg

SEQ ID NO: 2017396 - RNA, 20 nt, Shigella flexneri 2a str. 301
cagccgucacgacagaacuc

SEQ ID NO: 2017397 - RNA, 21 nt, Shigella flexneri 2a str. 301
cagccguuuaccccagucagg

SEQ ID NO: 2017398 - RNA, 11 nt, Shigella flexneri 2a str. 301
cagccugagcg

SEQ ID NO: 2017399 - RNA, 15 nt, Shigella flexneri 2a str. 301
cagccugcgcuucuu

SEQ ID NO: 2017400 - RNA, 19 nt, Shigella flexneri 2a str. 301
cagccuguuccagacgcug

SEQ ID NO: 2017401 - RNA, 14 nt, Shigella flexneri 2a str. 301
cagccuuaaacuca

SEQ ID NO: 2017402 - RNA, 21 nt, Shigella flexneri 2a str. 301
cagccuggcggaaagccagaa

SEQ ID NO: 2017403 - RNA, 17 nt, Shigella flexneri 2a str. 301
cagccuuaacaagauau

SEQ ID NO: 2017404 - RNA, 15 nt, Shigella flexneri 2a str. 301
cagccuuaccggaga

SEQ ID NO: 2017405 - RNA, 23 nt, Shigella flexneri 2a str. 301
cagccuucacgauagccacgcuc

SEQ ID NO: 2017406 - RNA, 19 nt, Shigella flexneri 2a str. 301
cagccuucauucaggcauu

SEQ ID NO: 2017407 - RNA, 15 nt, Shigella flexneri 2a str. 301
cagccuugcgugccu

SEQ ID NO: 2017408 - RNA, 18 nt, Shigella flexneri 2a str. 301
cagccuuucucagagacu

SEQ ID NO: 2017409 - RNA, 14 nt, Shigella flexneri 2a str. 301
cagccuuuccugca

SEQ ID NO: 2017410 - RNA, 13 nt, Shigella flexneri 2a str. 301
cagccuuucucag

SEQ ID NO: 2017411 - RNA, 14 nt, Shigella flexneri 2a str. 301
cagccuuucucaga

SEQ ID NO: 2017412 - RNA, 13 nt, Shigella flexneri 2a str. 301
cagccuuuuucuc

SEQ ID NO: 2017413 - RNA, 14 nt, Shigella flexneri 2a str. 301
cagcgaauccagca

SEQ ID NO: 2017414 - RNA, 22 nt, Shigella flexneri 2a str. 301
cagcgaagcccacgccgcccag

SEQ ID NO: 2017415 - RNA, 17 nt, Shigella flexneri 2a str. 301
cagcgacaccagccauc

SEQ ID NO: 2017416 - RNA, 18 nt, Shigella flexneri 2a str. 301
cagcgacaggaacgccgc

SEQ ID NO: 2017417 - RNA, 22 nt, Shigella flexneri 2a str. 301
cagcgaaaaagucccuucccag

SEQ ID NO: 2017418 - RNA, 22 nt, Shigella flexneri 2a str. 301
cagcgaaauacagguccccgcu

SEQ ID NO: 2017419 - RNA, 20 nt, Shigella flexneri 2a str. 301
cagcgaaaucaccgccacca

SEQ ID NO: 2017420 - RNA, 16 nt, Shigella flexneri 2a str. 301
cagcgaaaucgccuuu

SEQ ID NO: 2017421 - RNA, 22 nt, Shigella flexneri 2a str. 301
cagcgaaaguaacaccauccau

SEQ ID NO: 2017422 - RNA, 22 nt, Shigella flexneri 2a str. 301
cagcgaagccagcucccacagu

SEQ ID NO: 2017423 - RNA, 15 nt, Shigella flexneri 2a str. 301
cagcgaacaccagca

SEQ ID NO: 2017424 - RNA, 18 nt, Shigella flexneri 2a str. 301
cagcgagauaacgcugau

SEQ ID NO: 2017425 - RNA, 17 nt, Shigella flexneri 2a str. 301
cagcgagguacaaccau

SEQ ID NO: 2017426 - RNA, 16 nt, Shigella flexneri 2a str. 301
cagcgacuucuuccca

SEQ ID NO: 2017427 - RNA, 21 nt, Shigella flexneri 2a str. 301
cagcgacuucuucccaccaua

SEQ ID NO: 2017428 - RNA, 21 nt, Shigella flexneri 2a str. 301
cagccggacccacacccccgc

SEQ ID NO: 2017429 - RNA, 14 nt, Shigella flexneri 2a str. 301
cagccggaauaauc

SEQ ID NO: 2017430 - RNA, 15 nt, Shigella flexneri 2a str. 301
cagccgcuaccagcg

SEQ ID NO: 2017431 - RNA, 18 nt, Shigella flexneri 2a str. 301
cagccgggaugaaaggca

SEQ ID NO: 2017432 - RNA, 22 nt, Shigella flexneri 2a str. 301
cagccgccgcuaucggcaagga

SEQ ID NO: 2017433 - RNA, 16 nt, Shigella flexneri 2a str. 301
cagccgccgcuccuca

SEQ ID NO: 2017434 - RNA, 22 nt, Shigella flexneri 2a str. 301
cagccgccagggcaagcgccua

SEQ ID NO: 2017435 - RNA, 13 nt, Shigella flexneri 2a str. 301
cagccgccagaaa

SEQ ID NO: 2017436 - RNA, 20 nt, Shigella flexneri 2a str. 301
cagccgcaaaccuggcaaca

SEQ ID NO: 2017437 - RNA, 19 nt, Shigella flexneri 2a str. 301
cagccgcaaaccuggcaac

SEQ ID NO: 2017438 - RNA, 16 nt, Shigella flexneri 2a str. 301
cagccgcacuuuuuaa

SEQ ID NO: 2017439 - RNA, 17 nt, Shigella flexneri 2a str. 301
cagccgacaaugccaca

SEQ ID NO: 2017440 - RNA, 16 nt, Shigella flexneri 2a str. 301
cagccgacgaauugac

SEQ ID NO: 2017441 - RNA, 22 nt, Shigella flexneri 2a str. 301
cagccgaugcagguuggcgacg

SEQ ID NO: 2017442 - RNA, 13 nt, Shigella flexneri 2a str. 301
cagcccugccagg

SEQ ID NO: 2017443 - RNA, 14 nt, Shigella flexneri 2a str. 301
cagcccuucuuuca

SEQ ID NO: 2017444 - RNA, 19 nt, Shigella flexneri 2a str. 301
cagcccuucuuucacuuca

SEQ ID NO: 2017445 - RNA, 18 nt, Shigella flexneri 2a str. 301
cagcccggcauguuucaa

SEQ ID NO: 2017446 - RNA, 14 nt, Shigella flexneri 2a str. 301
cagcccggcggcgu

SEQ ID NO: 2017447 - RNA, 14 nt, Shigella flexneri 2a str. 301
cagcccgccgccau

SEQ ID NO: 2017448 - RNA, 18 nt, Shigella flexneri 2a str. 301
cagcccgaucggcuggca

SEQ ID NO: 2017449 - RNA, 15 nt, Shigella flexneri 2a str. 301
cagcccgagguuauu

SEQ ID NO: 2017450 - RNA, 15 nt, Shigella flexneri 2a str. 301
cagcccgcagcgccu

SEQ ID NO: 2017451 - RNA, 21 nt, Shigella flexneri 2a str. 301
cagcacgaucagugccgcacc

SEQ ID NO: 2017452 - RNA, 14 nt, Shigella flexneri 2a str. 301
cagcacgccccggc

SEQ ID NO: 2017453 - RNA, 14 nt, Shigella flexneri 2a str. 301
cagcaccuuuugcu

SEQ ID NO: 2017454 - RNA, 14 nt, Shigella flexneri 2a str. 301
cagcaccgucaaac

SEQ ID NO: 2017455 - RNA, 17 nt, Shigella flexneri 2a str. 301
cagcaccgcgacaauca

SEQ ID NO: 2017456 - RNA, 18 nt, Shigella flexneri 2a str. 301
cagcaccgcgacaaucag

SEQ ID NO: 2017457 - RNA, 21 nt, Shigella flexneri 2a str. 301
cagcaccgcacagaccaucaa

SEQ ID NO: 2017458 - RNA, 23 nt, Shigella flexneri 2a str. 301
cagcacugauuuuuuccaacagg

SEQ ID NO: 2017459 - RNA, 15 nt, Shigella flexneri 2a str. 301
cagcacuggugcugu

SEQ ID NO: 2017460 - RNA, 16 nt, Shigella flexneri 2a str. 301
cagcacuggugcugua

SEQ ID NO: 2017461 - RNA, 20 nt, Shigella flexneri 2a str. 301
cagcacuucacccaucgcca

SEQ ID NO: 2017462 - RNA, 16 nt, Shigella flexneri 2a str. 301
cagcagaccagcaaaa

SEQ ID NO: 2017463 - RNA, 11 nt, Shigella flexneri 2a str. 301
cagcagaccag

SEQ ID NO: 2017464 - RNA, 20 nt, Shigella flexneri 2a str. 301
cagcagacagccuaccagac

SEQ ID NO: 2017465 - RNA, 16 nt, Shigella flexneri 2a str. 301
cagcagacagccuacc

SEQ ID NO: 2017466 - RNA, 16 nt, Shigella flexneri 2a str. 301
cagcagagcaugguua

SEQ ID NO: 2017467 - RNA, 19 nt, Shigella flexneri 2a str. 301
cagcagagauacaggccac

SEQ ID NO: 2017468 - RNA, 23 nt, Shigella flexneri 2a str. 301
cagcagauaucccgccagcacca

SEQ ID NO: 2017469 - RNA, 22 nt, Shigella flexneri 2a str. 301
cagcagauauugccccacaccg

SEQ ID NO: 2017470 - RNA, 17 nt, Shigella flexneri 2a str. 301
cagcagauuaaccgcuu

SEQ ID NO: 2017471 - RNA, 13 nt, Shigella flexneri 2a str. 301
cagcacggagaga

SEQ ID NO: 2017472 - RNA, 14 nt, Shigella flexneri 2a str. 301
cagcacgcugaagg

SEQ ID NO: 2017473 - RNA, 23 nt, Shigella flexneri 2a str. 301
cagcacgucgccuuuuacggcuu

SEQ ID NO: 2017474 - RNA, 22 nt, Shigella flexneri 2a str. 301
cagcacggugaagaagcggaaa

SEQ ID NO: 2017475 - RNA, 15 nt, Shigella flexneri 2a str. 301
cagcacuaugacugc

SEQ ID NO: 2017476 - RNA, 16 nt, Shigella flexneri 2a str. 301
cagcacuacaccccag

SEQ ID NO: 2017477 - RNA, 13 nt, Shigella flexneri 2a str. 301
cagcacguuaauc

SEQ ID NO: 2017478 - RNA, 23 nt, Shigella flexneri 2a str. 301
cagcacguuaaucaaaucaacaa

SEQ ID NO: 2017479 - RNA, 22 nt, Shigella flexneri 2a str. 301
cagcagccgcgcuuucuucuuc

SEQ ID NO: 2017480 - RNA, 23 nt, Shigella flexneri 2a str. 301
cagcagccugcgcuucuuuuuac

SEQ ID NO: 2017481 - RNA, 22 nt, Shigella flexneri 2a str. 301
cagcagcccugccggaacgugc

SEQ ID NO: 2017482 - RNA, 13 nt, Shigella flexneri 2a str. 301
cagcagcgccgcg

SEQ ID NO: 2017483 - RNA, 11 nt, Shigella flexneri 2a str. 301
cagcagcaggu

SEQ ID NO: 2017484 - RNA, 14 nt, Shigella flexneri 2a str. 301
cagcagcaggucac

SEQ ID NO: 2017485 - RNA, 18 nt, Shigella flexneri 2a str. 301
cagcagcggcucggucag

SEQ ID NO: 2017486 - RNA, 19 nt, Shigella flexneri 2a str. 301
cagcagcucaucaagcugu

SEQ ID NO: 2017487 - RNA, 17 nt, Shigella flexneri 2a str. 301
cagcaggaucuccagcu

SEQ ID NO: 2017488 - RNA, 17 nt, Shigella flexneri 2a str. 301
cagcaggauggcuggcc

SEQ ID NO: 2017489 - RNA, 22 nt, Shigella flexneri 2a str. 301
cagcaggauguuccggcaaagu

SEQ ID NO: 2017490 - RNA, 19 nt, Shigella flexneri 2a str. 301
cagcagggcaaacagcacg

SEQ ID NO: 2017491 - RNA, 23 nt, Shigella flexneri 2a str. 301
cagcaggcgaugaaaaaccguau

SEQ ID NO: 2017492 - RNA, 15 nt, Shigella flexneri 2a str. 301
cagcaggcucagaag

SEQ ID NO: 2017493 - RNA, 15 nt, Shigella flexneri 2a str. 301
cagcaggcagaucca

SEQ ID NO: 2017494 - RNA, 16 nt, Shigella flexneri 2a str. 301
cagcaguaaaccaccc

SEQ ID NO: 2017495 - RNA, 18 nt, Shigella flexneri 2a str. 301
cagcaguaaaccacccac

SEQ ID NO: 2017496 - RNA, 22 nt, Shigella flexneri 2a str. 301
cagcaguaaaccacccaccagc

SEQ ID NO: 2017497 - RNA, 14 nt, Shigella flexneri 2a str. 301
cagcaguaaaccgc

SEQ ID NO: 2017498 - RNA, 19 nt, Shigella flexneri 2a str. 301
cagcaggucaccgaaaucg

SEQ ID NO: 2017499 - RNA, 14 nt, Shigella flexneri 2a str. 301
cagcaguucugcca

SEQ ID NO: 2017500 - RNA, 23 nt, Shigella flexneri 2a str. 301
cagcaguccagcgcgaacgugac

SEQ ID NO: 2017501 - RNA, 16 nt, Shigella flexneri 2a str. 301
cagcaguucacgcagc

SEQ ID NO: 2017502 - RNA, 17 nt, Shigella flexneri 2a str. 301
cagcaguucagcacgag

SEQ ID NO: 2017503 - RNA, 15 nt, Shigella flexneri 2a str. 301
cagcaguucagucag

SEQ ID NO: 2017504 - RNA, 13 nt, Shigella flexneri 2a str. 301
cagcaguucacgc

SEQ ID NO: 2017505 - RNA, 20 nt, Shigella flexneri 2a str. 301
cagccagccgaacagcgcca

SEQ ID NO: 2017506 - RNA, 22 nt, Shigella flexneri 2a str. 301
cagccagccgaacagcgccaga

SEQ ID NO: 2017507 - RNA, 14 nt, Shigella flexneri 2a str. 301
cagccagaugccuu

SEQ ID NO: 2017508 - RNA, 15 nt, Shigella flexneri 2a str. 301
cagccagacgccagc

SEQ ID NO: 2017509 - RNA, 15 nt, Shigella flexneri 2a str. 301
cagccagagccacca

SEQ ID NO: 2017510 - RNA, 12 nt, Shigella flexneri 2a str. 301
cagccacugcgg

SEQ ID NO: 2017511 - RNA, 13 nt, Shigella flexneri 2a str. 301
cagccacuccuua

SEQ ID NO: 2017512 - RNA, 12 nt, Shigella flexneri 2a str. 301
cagccacuuccu

SEQ ID NO: 2017513 - RNA, 17 nt, Shigella flexneri 2a str. 301
cagccagaaagaaccgu

SEQ ID NO: 2017514 - RNA, 17 nt, Shigella flexneri 2a str. 301
cagccacggcuccagca

SEQ ID NO: 2017515 - RNA, 14 nt, Shigella flexneri 2a str. 301
cagccagcgcgccu

SEQ ID NO: 2017516 - RNA, 16 nt, Shigella flexneri 2a str. 301
cagccagcgcuggcaa

SEQ ID NO: 2017517 - RNA, 17 nt, Shigella flexneri 2a str. 301
cagccagcgcuggcaau

SEQ ID NO: 2017518 - RNA, 16 nt, Shigella flexneri 2a str. 301
cagccagcgucaccca

SEQ ID NO: 2017519 - RNA, 19 nt, Shigella flexneri 2a str. 301
cagccagcgucacccagac

SEQ ID NO: 2017520 - RNA, 11 nt, Shigella flexneri 2a str. 301
cagccagccgg

SEQ ID NO: 2017521 - RNA, 14 nt, Shigella flexneri 2a str. 301
cagccaggccgcca

SEQ ID NO: 2017522 - RNA, 20 nt, Shigella flexneri 2a str. 301
cagccauaaagaaaucaccu

SEQ ID NO: 2017523 - RNA, 22 nt, Shigella flexneri 2a str. 301
cagccauaaagaaaucaccugc

SEQ ID NO: 2017524 - RNA, 12 nt, Shigella flexneri 2a str. 301
cagccauaaccc

SEQ ID NO: 2017525 - RNA, 22 nt, Shigella flexneri 2a str. 301
cagccauaaccccaccagcaug

SEQ ID NO: 2017526 - RNA, 19 nt, Shigella flexneri 2a str. 301
cagccaguucgagaaaaau

SEQ ID NO: 2017527 - RNA, 14 nt, Shigella flexneri 2a str. 301
cagccagguuuugu

SEQ ID NO: 2017528 - RNA, 15 nt, Shigella flexneri 2a str. 301
cagccccgcgcggcg

SEQ ID NO: 2017529 - RNA, 16 nt, Shigella flexneri 2a str. 301
cagccccagcgucagc

SEQ ID NO: 2017530 - RNA, 16 nt, Shigella flexneri 2a str. 301
cagccccugcgccagc

SEQ ID NO: 2017531 - RNA, 12 nt, Shigella flexneri 2a str. 301
cagccccagcac

SEQ ID NO: 2017532 - RNA, 13 nt, Shigella flexneri 2a str. 301
cagccccagcacu

SEQ ID NO: 2017533 - RNA, 14 nt, Shigella flexneri 2a str. 301
cagcccagacaaau

SEQ ID NO: 2017534 - RNA, 16 nt, Shigella flexneri 2a str. 301
cagcccagcaucagac

SEQ ID NO: 2017535 - RNA, 12 nt, Shigella flexneri 2a str. 301
cagcccagcccu

SEQ ID NO: 2017536 - RNA, 18 nt, Shigella flexneri 2a str. 301
cagcccagcccugaacca

SEQ ID NO: 2017537 - RNA, 20 nt, Shigella flexneri 2a str. 301
cagcccaaagcagaguugcu

SEQ ID NO: 2017538 - RNA, 14 nt, Shigella flexneri 2a str. 301
cagcccaaucaucg

SEQ ID NO: 2017539 - RNA, 13 nt, Shigella flexneri 2a str. 301
cagcccaaccacg

SEQ ID NO: 2017540 - RNA, 15 nt, Shigella flexneri 2a str. 301
cagcccaaagcagag

SEQ ID NO: 2017541 - RNA, 23 nt, Shigella flexneri 2a str. 301
cagccauugugaccuuugacuca

SEQ ID NO: 2017542 - RNA, 20 nt, Shigella flexneri 2a str. 301
cagccauucgaugguuuuau

SEQ ID NO: 2017543 - RNA, 22 nt, Shigella flexneri 2a str. 301
cagccauucaaucuucgacagc

SEQ ID NO: 2017544 - RNA, 21 nt, Shigella flexneri 2a str. 301
cagccauuaaccagccacugc

SEQ ID NO: 2017545 - RNA, 12 nt, Shigella flexneri 2a str. 301
cagccaucaucc

SEQ ID NO: 2017546 - RNA, 15 nt, Shigella flexneri 2a str. 301
cagccaucauccauu

SEQ ID NO: 2017547 - RNA, 11 nt, Shigella flexneri 2a str. 301
cagccaucuga

SEQ ID NO: 2017548 - RNA, 21 nt, Shigella flexneri 2a str. 301
cagccauaaucacucuucccc

SEQ ID NO: 2017549 - RNA, 19 nt, Shigella flexneri 2a str. 301
cagccauaccgggaucagg

SEQ ID NO: 2017550 - RNA, 18 nt, Shigella flexneri 2a str. 301
cagccauacguugcauaa

SEQ ID NO: 2017551 - RNA, 16 nt, Shigella flexneri 2a str. 301
cagcaucgucaucagc

SEQ ID NO: 2017552 - RNA, 19 nt, Shigella flexneri 2a str. 301
cagcaucgucaucagcucc

SEQ ID NO: 2017553 - RNA, 16 nt, Shigella flexneri 2a str. 301
cagcaucggcagcgcc

SEQ ID NO: 2017554 - RNA, 20 nt, Shigella flexneri 2a str. 301
cagcaucuccugcaacaggu

SEQ ID NO: 2017555 - RNA, 16 nt, Shigella flexneri 2a str. 301
cagcaucucgcgcucu

SEQ ID NO: 2017556 - RNA, 17 nt, Shigella flexneri 2a str. 301
cagcaucgucaucauuc

SEQ ID NO: 2017557 - RNA, 11 nt, Shigella flexneri 2a str. 301
cagcaucuccu

SEQ ID NO: 2017558 - RNA, 13 nt, Shigella flexneri 2a str. 301
cagcaucuggaug

SEQ ID NO: 2017559 - RNA, 19 nt, Shigella flexneri 2a str. 301
cagcaugcacccucaacaa

SEQ ID NO: 2017560 - RNA, 19 nt, Shigella flexneri 2a str. 301
cagcaugcacccucaauaa

SEQ ID NO: 2017561 - RNA, 20 nt, Shigella flexneri 2a str. 301
cagcaugacguccuguacug

SEQ ID NO: 2017562 - RNA, 20 nt, Shigella flexneri 2a str. 301
cagcaucaagauaaaccccu

SEQ ID NO: 2017563 - RNA, 14 nt, Shigella flexneri 2a str. 301
cagcaucauagugg

SEQ ID NO: 2017564 - RNA, 14 nt, Shigella flexneri 2a str. 301
cagcaucaucgcaa

SEQ ID NO: 2017565 - RNA, 18 nt, Shigella flexneri 2a str. 301
cagcauaauuauuacuac

SEQ ID NO: 2017566 - RNA, 20 nt, Shigella flexneri 2a str. 301
cagcauaaucaccaguaccg

SEQ ID NO: 2017567 - RNA, 17 nt, Shigella flexneri 2a str. 301
cagcauaguacgggcaa

SEQ ID NO: 2017568 - RNA, 19 nt, Shigella flexneri 2a str. 301
cagcauauaggaggccucg

SEQ ID NO: 2017569 - RNA, 15 nt, Shigella flexneri 2a str. 301
cagcauaccuucaca

SEQ ID NO: 2017570 - RNA, 21 nt, Shigella flexneri 2a str. 301
cagcauacgcugccagccauc

SEQ ID NO: 2017571 - RNA, 23 nt, Shigella flexneri 2a str. 301
cagcauugcucaccgccagcauc

SEQ ID NO: 2017572 - RNA, 22 nt, Shigella flexneri 2a str. 301
cagcauugcucaccgccagcau

SEQ ID NO: 2017573 - RNA, 14 nt, Shigella flexneri 2a str. 301
cagcauuucuucca

SEQ ID NO: 2017574 - RNA, 15 nt, Shigella flexneri 2a str. 301
cagcauucucggccc

SEQ ID NO: 2017575 - RNA, 19 nt, Shigella flexneri 2a str. 301
cagcauucucaucaccauu

SEQ ID NO: 2017576 - RNA, 17 nt, Shigella flexneri 2a str. 301
cagcauucucaucacca

SEQ ID NO: 2017577 - RNA, 20 nt, Shigella flexneri 2a str. 301
cagcauucccgccagcggcc

SEQ ID NO: 2017578 - RNA, 20 nt, Shigella flexneri 2a str. 301
cagcauuccagauacgaccg

SEQ ID NO: 2017579 - RNA, 17 nt, Shigella flexneri 2a str. 301
cagcauucccgccagcg

SEQ ID NO: 2017580 - RNA, 15 nt, Shigella flexneri 2a str. 301
cagcauuccagauac

SEQ ID NO: 2017581 - RNA, 23 nt, Shigella flexneri 2a str. 301
cagcauuauuuuuaaacaucaaa

SEQ ID NO: 2017582 - RNA, 14 nt, Shigella flexneri 2a str. 301
cagcauguuuauau

SEQ ID NO: 2017583 - RNA, 17 nt, Shigella flexneri 2a str. 301
cagcauguagaugccgg

SEQ ID NO: 2017584 - RNA, 13 nt, Shigella flexneri 2a str. 301
cagcauggcaaua

SEQ ID NO: 2017585 - RNA, 15 nt, Shigella flexneri 2a str. 301
cagccaccgccagcg

SEQ ID NO: 2017586 - RNA, 22 nt, Shigella flexneri 2a str. 301
cagccaccgcguuccacgggga

SEQ ID NO: 2017587 - RNA, 12 nt, Shigella flexneri 2a str. 301
cagccacagggu

SEQ ID NO: 2017588 - RNA, 20 nt, Shigella flexneri 2a str. 301
cagccacagggugaucacca

SEQ ID NO: 2017589 - RNA, 15 nt, Shigella flexneri 2a str. 301
cagccacaccaauca

SEQ ID NO: 2017590 - RNA, 17 nt, Shigella flexneri 2a str. 301
cagccaaugcaggcauc

SEQ ID NO: 2017591 - RNA, 14 nt, Shigella flexneri 2a str. 301
cagccaaaaaugac

SEQ ID NO: 2017592 - RNA, 15 nt, Shigella flexneri 2a str. 301
cagccaaauccagcg

SEQ ID NO: 2017593 - RNA, 21 nt, Shigella flexneri 2a str. 301
cagccaaaucccgugaugcgg

SEQ ID NO: 2017594 - RNA, 23 nt, Shigella flexneri 2a str. 301
cagaugcgcgguugccugcugug

SEQ ID NO: 2017595 - RNA, 15 nt, Shigella flexneri 2a str. 301
cagaugcgcuucaag

SEQ ID NO: 2017596 - RNA, 18 nt, Shigella flexneri 2a str. 301
cagaugcgucuucugcag

SEQ ID NO: 2017597 - RNA, 20 nt, Shigella flexneri 2a str. 301
cagaugauuagucuuuaucu

SEQ ID NO: 2017598 - RNA, 14 nt, Shigella flexneri 2a str. 301
cagaucuucaucac

SEQ ID NO: 2017599 - RNA, 16 nt, Shigella flexneri 2a str. 301
cagaugaaaacgcuga

SEQ ID NO: 2017600 - RNA, 19 nt, Shigella flexneri 2a str. 301
cagaugaagcuggcaaagu

SEQ ID NO: 2017601 - RNA, 22 nt, Shigella flexneri 2a str. 301
cagaugauuagucuuuaucugc

SEQ ID NO: 2017602 - RNA, 22 nt, Shigella flexneri 2a str. 301
cagaugccaaucaguucaccac

SEQ ID NO: 2017603 - RNA, 19 nt, Shigella flexneri 2a str. 301
cagaugccagaauccccac

SEQ ID NO: 2017604 - RNA, 23 nt, Shigella flexneri 2a str. 301
cagaugcaggauuucuucaccag

SEQ ID NO: 2017605 - RNA, 18 nt, Shigella flexneri 2a str. 301
cagaucggucagugccag

SEQ ID NO: 2017606 - RNA, 17 nt, Shigella flexneri 2a str. 301
cagaucggccaucagua

SEQ ID NO: 2017607 - RNA, 13 nt, Shigella flexneri 2a str. 301
cagaucucaccac

SEQ ID NO: 2017608 - RNA, 16 nt, Shigella flexneri 2a str. 301
cagaucguuuuccugc

SEQ ID NO: 2017609 - RNA, 17 nt, Shigella flexneri 2a str. 301
cagaucgugcaucuccu

SEQ ID NO: 2017610 - RNA, 22 nt, Shigella flexneri 2a str. 301
cagaucuuucacgaacacagug

SEQ ID NO: 2017611 - RNA, 21 nt, Shigella flexneri 2a str. 301
cagaucuggcgauuauuuucc

SEQ ID NO: 2017612 - RNA, 23 nt, Shigella flexneri 2a str. 301
cagaucugaauauucggcuccag

SEQ ID NO: 2017613 - RNA, 20 nt, Shigella flexneri 2a str. 301
cagauccgccauuucuccuc

SEQ ID NO: 2017614 - RNA, 15 nt, Shigella flexneri 2a str. 301
cagauccugaaauuc

SEQ ID NO: 2017615 - RNA, 14 nt, Shigella flexneri 2a str. 301
cagaucgccaauau

SEQ ID NO: 2017616 - RNA, 17 nt, Shigella flexneri 2a str. 301
cagaucgccaauaucaa

SEQ ID NO: 2017617 - RNA, 14 nt, Shigella flexneri 2a str. 301
cagaucggcagggc

SEQ ID NO: 2017618 - RNA, 16 nt, Shigella flexneri 2a str. 301
cagaucgcucaucugc

SEQ ID NO: 2017619 - RNA, 16 nt, Shigella flexneri 2a str. 301
cagaucgcuuucccag

SEQ ID NO: 2017620 - RNA, 21 nt, Shigella flexneri 2a str. 301
cagaucggacuucaugcgcag

SEQ ID NO: 2017621 - RNA, 20 nt, Shigella flexneri 2a str. 301
cagaucgccccggucaucaa

SEQ ID NO: 2017622 - RNA, 18 nt, Shigella flexneri 2a str. 301
cagauugcagacaaagug

SEQ ID NO: 2017623 - RNA, 17 nt, Shigella flexneri 2a str. 301
cagauucggguucaugu

SEQ ID NO: 2017624 - RNA, 21 nt, Shigella flexneri 2a str. 301
cagauuauaagccaguaagac

SEQ ID NO: 2017625 - RNA, 12 nt, Shigella flexneri 2a str. 301
cagauucaggcg

SEQ ID NO: 2017626 - RNA, 16 nt, Shigella flexneri 2a str. 301
cagauucagccacauu

SEQ ID NO: 2017627 - RNA, 21 nt, Shigella flexneri 2a str. 301
cagauuaugucgcucaaugcg

SEQ ID NO: 2017628 - RNA, 15 nt, Shigella flexneri 2a str. 301
cagauguugucucag

SEQ ID NO: 2017629 - RNA, 23 nt, Shigella flexneri 2a str. 301
cagauuauugacaaagugcgcuu

SEQ ID NO: 2017630 - RNA, 17 nt, Shigella flexneri 2a str. 301
cagauguagcucaccuu

SEQ ID NO: 2017631 - RNA, 15 nt, Shigella flexneri 2a str. 301
cagauggcuuuccac

SEQ ID NO: 2017632 - RNA, 20 nt, Shigella flexneri 2a str. 301
cagaugugcaccuuuuccac

SEQ ID NO: 2017633 - RNA, 18 nt, Shigella flexneri 2a str. 301
cagaugugcuucugccac

SEQ ID NO: 2017634 - RNA, 20 nt, Shigella flexneri 2a str. 301
cagauguugucucagcuuca

SEQ ID NO: 2017635 - RNA, 17 nt, Shigella flexneri 2a str. 301
cagauuuauaaaagaaa

SEQ ID NO: 2017636 - RNA, 19 nt, Shigella flexneri 2a str. 301
cagauuuauaaaagaaaaa

SEQ ID NO: 2017637 - RNA, 13 nt, Shigella flexneri 2a str. 301
cagauuguugauu

SEQ ID NO: 2017638 - RNA, 23 nt, Shigella flexneri 2a str. 301
cagauugugaaucgccuggacau

SEQ ID NO: 2017639 - RNA, 15 nt, Shigella flexneri 2a str. 301
cagcaaaacacccgc

SEQ ID NO: 2017640 - RNA, 15 nt, Shigella flexneri 2a str. 301
cagcaaaaugcauaa

SEQ ID NO: 2017641 - RNA, 15 nt, Shigella flexneri 2a str. 301
cagcaaaaucaccau

SEQ ID NO: 2017642 - RNA, 16 nt, Shigella flexneri 2a str. 301
cagcaaaaucaccauc

SEQ ID NO: 2017643 - RNA, 22 nt, Shigella flexneri 2a str. 301
cagcaaaaauuugcgcgaugcc

SEQ ID NO: 2017644 - RNA, 21 nt, Shigella flexneri 2a str. 301
cagauuuuaagguugauacga

SEQ ID NO: 2017645 - RNA, 22 nt, Shigella flexneri 2a str. 301
cagcacaccacaucgccgaccg

SEQ ID NO: 2017646 - RNA, 15 nt, Shigella flexneri 2a str. 301
cagcacacauaagag

SEQ ID NO: 2017647 - RNA, 21 nt, Shigella flexneri 2a str. 301
cagcacaaucaaaucgacagc

SEQ ID NO: 2017648 - RNA, 15 nt, Shigella flexneri 2a str. 301
cagcacaaaucggca

SEQ ID NO: 2017649 - RNA, 19 nt, Shigella flexneri 2a str. 301
cagcaauuguaaaucuuug

SEQ ID NO: 2017650 - RNA, 23 nt, Shigella flexneri 2a str. 301
cagcaauuuacgcuuuucuuccg

SEQ ID NO: 2017651 - RNA, 18 nt, Shigella flexneri 2a str. 301
cagcaauugucgcagaag

SEQ ID NO: 2017652 - RNA, 21 nt, Shigella flexneri 2a str. 301
cagcaauuuacgcuuuucuuc

SEQ ID NO: 2017653 - RNA, 15 nt, Shigella flexneri 2a str. 301
cagcaauggaaaaag

SEQ ID NO: 2017654 - RNA, 14 nt, Shigella flexneri 2a str. 301
cagcaauguuucuc

SEQ ID NO: 2017655 - RNA, 15 nt, Shigella flexneri 2a str. 301
cagcaauguuucucu

SEQ ID NO: 2017656 - RNA, 15 nt, Shigella flexneri 2a str. 301
cagcaauccccagac

SEQ ID NO: 2017657 - RNA, 21 nt, Shigella flexneri 2a str. 301
cagcaaucugaagccgcaccu

SEQ ID NO: 2017658 - RNA, 16 nt, Shigella flexneri 2a str. 301
cagcaaucacugccag

SEQ ID NO: 2017659 - RNA, 18 nt, Shigella flexneri 2a str. 301
cagcaauaaucagauggc

SEQ ID NO: 2017660 - RNA, 19 nt, Shigella flexneri 2a str. 301
cagcacaucagccagaugc

SEQ ID NO: 2017661 - RNA, 15 nt, Shigella flexneri 2a str. 301
cagcacaucaucaaa

SEQ ID NO: 2017662 - RNA, 23 nt, Shigella flexneri 2a str. 301
cagcacauuucagaaaguauaua

SEQ ID NO: 2017663 - RNA, 22 nt, Shigella flexneri 2a str. 301
cagcacauaacucauacugagc

SEQ ID NO: 2017664 - RNA, 15 nt, Shigella flexneri 2a str. 301
cagcacaucagccag

SEQ ID NO: 2017665 - RNA, 13 nt, Shigella flexneri 2a str. 301
cagcaccacuucc

SEQ ID NO: 2017666 - RNA, 19 nt, Shigella flexneri 2a str. 301
cagcaccacuuccggcaac

SEQ ID NO: 2017667 - RNA, 14 nt, Shigella flexneri 2a str. 301
cagcaccagagaac

SEQ ID NO: 2017668 - RNA, 16 nt, Shigella flexneri 2a str. 301
cagcaccaccgcccgu

SEQ ID NO: 2017669 - RNA, 14 nt, Shigella flexneri 2a str. 301
cagcaccagcuccg

SEQ ID NO: 2017670 - RNA, 12 nt, Shigella flexneri 2a str. 301
cagcaccagaua

SEQ ID NO: 2017671 - RNA, 17 nt, Shigella flexneri 2a str. 301
cagcaccagagaacuga

SEQ ID NO: 2017672 - RNA, 14 nt, Shigella flexneri 2a str. 301
cagcaccagcaacg

SEQ ID NO: 2017673 - RNA, 19 nt, Shigella flexneri 2a str. 301
cagcaccagcgauuguuca

SEQ ID NO: 2017674 - RNA, 22 nt, Shigella flexneri 2a str. 301
cagcaacaucaaaugcgcagcc

SEQ ID NO: 2017675 - RNA, 17 nt, Shigella flexneri 2a str. 301
cagcaaauccaucauau

SEQ ID NO: 2017676 - RNA, 20 nt, Shigella flexneri 2a str. 301
cagcaaagcgugcaaauaua

SEQ ID NO: 2017677 - RNA, 14 nt, Shigella flexneri 2a str. 301
cagcaaagcaaauu

SEQ ID NO: 2017678 - RNA, 21 nt, Shigella flexneri 2a str. 301
cagcaaauggcccauuuucuc

SEQ ID NO: 2017679 - RNA, 18 nt, Shigella flexneri 2a str. 301
cagcaacaaaauggcaaa

SEQ ID NO: 2017680 - RNA, 20 nt, Shigella flexneri 2a str. 301
cagcaacaaaauggcaaagc

SEQ ID NO: 2017681 - RNA, 14 nt, Shigella flexneri 2a str. 301
cagcaacagcgccg

SEQ ID NO: 2017682 - RNA, 18 nt, Shigella flexneri 2a str. 301
cagcaagagcaaauaaaa

SEQ ID NO: 2017683 - RNA, 16 nt, Shigella flexneri 2a str. 301
cagcaagagcaaauaa

SEQ ID NO: 2017684 - RNA, 16 nt, Shigella flexneri 2a str. 301
cagcaagccacuggcg

SEQ ID NO: 2017685 - RNA, 20 nt, Shigella flexneri 2a str. 301
cagcaaggggcugaugccgg

SEQ ID NO: 2017686 - RNA, 19 nt, Shigella flexneri 2a str. 301
cagcaaggguucaccggug

SEQ ID NO: 2017687 - RNA, 12 nt, Shigella flexneri 2a str. 301
cagcaagaacca

SEQ ID NO: 2017688 - RNA, 24 nt, Shigella flexneri 2a str. 301
cagcaacucuuuuuccugcugcau

SEQ ID NO: 2017689 - RNA, 17 nt, Shigella flexneri 2a str. 301
cagcaacugacugacuu

SEQ ID NO: 2017690 - RNA, 18 nt, Shigella flexneri 2a str. 301
cagcaacucuuuuuccug

SEQ ID NO: 2017691 - RNA, 17 nt, Shigella flexneri 2a str. 301
cagcaacucugguggac

SEQ ID NO: 2017692 - RNA, 21 nt, Shigella flexneri 2a str. 301
cagcaacgggcugaagaagua

SEQ ID NO: 2017693 - RNA, 22 nt, Shigella flexneri 2a str. 301
cagcaacgcuucguagaagcca

SEQ ID NO: 2017694 - RNA, 15 nt, Shigella flexneri 2a str. 301
cagagccugaauaaa

SEQ ID NO: 2017695 - RNA, 16 nt, Shigella flexneri 2a str. 301
cagagcgaaggagagc

SEQ ID NO: 2017696 - RNA, 20 nt, Shigella flexneri 2a str. 301
cagagcugaauaucacgggc

SEQ ID NO: 2017697 - RNA, 22 nt, Shigella flexneri 2a str. 301
cagagcuuuguugcgcugaagu

SEQ ID NO: 2017698 - RNA, 22 nt, Shigella flexneri 2a str. 301
cagaggaaucgcuguugaggca

SEQ ID NO: 2017699 - RNA, 14 nt, Shigella flexneri 2a str. 301
cagaggagccauca

SEQ ID NO: 2017700 - RNA, 15 nt, Shigella flexneri 2a str. 301
cagagcugaauauca

SEQ ID NO: 2017701 - RNA, 22 nt, Shigella flexneri 2a str. 301
cagagcuucaaccguugcugga

SEQ ID NO: 2017702 - RNA, 14 nt, Shigella flexneri 2a str. 301
cagaggcccgcccc

SEQ ID NO: 2017703 - RNA, 12 nt, Shigella flexneri 2a str. 301
cagagugaaaau

SEQ ID NO: 2017704 - RNA, 12 nt, Shigella flexneri 2a str. 301
cagaguugcuga

SEQ ID NO: 2017705 - RNA, 20 nt, Shigella flexneri 2a str. 301
cagauaaaaugcgaaaaaaa

SEQ ID NO: 2017706 - RNA, 22 nt, Shigella flexneri 2a str. 301
cagauaaaauacacuuuaaugc

SEQ ID NO: 2017707 - RNA, 18 nt, Shigella flexneri 2a str. 301
cagagucauuucugccuu

SEQ ID NO: 2017708 - RNA, 19 nt, Shigella flexneri 2a str. 301
cagaguauuuccagcucaa

SEQ ID NO: 2017709 - RNA, 13 nt, Shigella flexneri 2a str. 301
cagaguauccaaa

SEQ ID NO: 2017710 - RNA, 14 nt, Shigella flexneri 2a str. 301
cagaggucuuuucu

SEQ ID NO: 2017711 - RNA, 18 nt, Shigella flexneri 2a str. 301
cagagggcaaauucuuca

SEQ ID NO: 2017712 - RNA, 22 nt, Shigella flexneri 2a str. 301
cagauacugaugaacgcgcagg

SEQ ID NO: 2017713 - RNA, 20 nt, Shigella flexneri 2a str. 301
cagauacaguuuuugcgcuu

SEQ ID NO: 2017714 - RNA, 14 nt, Shigella flexneri 2a str. 301
cagauaccacauca

SEQ ID NO: 2017715 - RNA, 15 nt, Shigella flexneri 2a str. 301
cagauagcaacagca

SEQ ID NO: 2017716 - RNA, 14 nt, Shigella flexneri 2a str. 301
cagauaagacacug

SEQ ID NO: 2017717 - RNA, 23 nt, Shigella flexneri 2a str. 301
cagauaagacgcgucagugucuu

SEQ ID NO: 2017718 - RNA, 23 nt, Shigella flexneri 2a str. 301
cagauaagacgcguuagugucuu

SEQ ID NO: 2017719 - RNA, 15 nt, Shigella flexneri 2a str. 301
cagauaacccagcag

SEQ ID NO: 2017720 - RNA, 17 nt, Shigella flexneri 2a str. 301
cagauaacccagcagcc

SEQ ID NO: 2017721 - RNA, 13 nt, Shigella flexneri 2a str. 301
cagauaacccagc

SEQ ID NO: 2017722 - RNA, 15 nt, Shigella flexneri 2a str. 301
cagauaaaucauaau

SEQ ID NO: 2017723 - RNA, 20 nt, Shigella flexneri 2a str. 301
cagauaaaucauaauaaaga

SEQ ID NO: 2017724 - RNA, 21 nt, Shigella flexneri 2a str. 301
cagauaaaucauaauaaagau

SEQ ID NO: 2017725 - RNA, 18 nt, Shigella flexneri 2a str. 301
cagauaaucaccugccuu

SEQ ID NO: 2017726 - RNA, 13 nt, Shigella flexneri 2a str. 301
cagauaagacacu

SEQ ID NO: 2017727 - RNA, 14 nt, Shigella flexneri 2a str. 301
cagauaagacacua

SEQ ID NO: 2017728 - RNA, 19 nt, Shigella flexneri 2a str. 301
cagauaagccugcgcgccc

SEQ ID NO: 2017729 - RNA, 23 nt, Shigella flexneri 2a str. 301
cagauaaugcccgaaugcagcuc

SEQ ID NO: 2017730 - RNA, 13 nt, Shigella flexneri 2a str. 301
cagauaaucaccu

SEQ ID NO: 2017731 - RNA, 17 nt, Shigella flexneri 2a str. 301
cagaucacgcaucaccc

SEQ ID NO: 2017732 - RNA, 23 nt, Shigella flexneri 2a str. 301
cagaucagggaagggucuuuuaa

SEQ ID NO: 2017733 - RNA, 13 nt, Shigella flexneri 2a str. 301
cagaucauccugc

SEQ ID NO: 2017734 - RNA, 13 nt, Shigella flexneri 2a str. 301
cagauccgccauu

SEQ ID NO: 2017735 - RNA, 15 nt, Shigella flexneri 2a str. 301
cagaucccuucaccu

SEQ ID NO: 2017736 - RNA, 21 nt, Shigella flexneri 2a str. 301
cagaucccaauucauuccugg

SEQ ID NO: 2017737 - RNA, 14 nt, Shigella flexneri 2a str. 301
cagauccagugcuc

SEQ ID NO: 2017738 - RNA, 23 nt, Shigella flexneri 2a str. 301
cagauccagugcucauccuucag

SEQ ID NO: 2017739 - RNA, 14 nt, Shigella flexneri 2a str. 301
cagauccagcaccu

SEQ ID NO: 2017740 - RNA, 14 nt, Shigella flexneri 2a str. 301
cagauauugauuga

SEQ ID NO: 2017741 - RNA, 21 nt, Shigella flexneri 2a str. 301
cagauauuuauuucagaacag

SEQ ID NO: 2017742 - RNA, 15 nt, Shigella flexneri 2a str. 301
cagauauucaugcag

SEQ ID NO: 2017743 - RNA, 17 nt, Shigella flexneri 2a str. 301
cagauaucgcggauaug

SEQ ID NO: 2017744 - RNA, 18 nt, Shigella flexneri 2a str. 301
cagauaguugauuaauuu

SEQ ID NO: 2017745 - RNA, 14 nt, Shigella flexneri 2a str. 301
cagauaguuaccgu

SEQ ID NO: 2017746 - RNA, 20 nt, Shigella flexneri 2a str. 301
cagauaggcaucagcaauug

SEQ ID NO: 2017747 - RNA, 13 nt, Shigella flexneri 2a str. 301
cagacgagggaaa

SEQ ID NO: 2017748 - RNA, 18 nt, Shigella flexneri 2a str. 301
cagacgagggaaaauaaa

SEQ ID NO: 2017749 - RNA, 19 nt, Shigella flexneri 2a str. 301
cagacgaauaaaacagaaa

SEQ ID NO: 2017750 - RNA, 20 nt, Shigella flexneri 2a str. 301
cagaccugaauuugcuccag

SEQ ID NO: 2017751 - RNA, 12 nt, Shigella flexneri 2a str. 301
cagaccugaauu

SEQ ID NO: 2017752 - RNA, 23 nt, Shigella flexneri 2a str. 301
cagaccuucauagguaaacauca

SEQ ID NO: 2017753 - RNA, 15 nt, Shigella flexneri 2a str. 301
cagaccuucugccag

SEQ ID NO: 2017754 - RNA, 23 nt, Shigella flexneri 2a str. 301
cagaccuuucgaacccaacccua

SEQ ID NO: 2017755 - RNA, 21 nt, Shigella flexneri 2a str. 301
cagacgcugaaucaacaggcg

SEQ ID NO: 2017756 - RNA, 17 nt, Shigella flexneri 2a str. 301
cagacgcucguuaaaac

SEQ ID NO: 2017757 - RNA, 16 nt, Shigella flexneri 2a str. 301
cagacggagcugccag

SEQ ID NO: 2017758 - RNA, 23 nt, Shigella flexneri 2a str. 301
cagacgcgcagcuucacuucuua

SEQ ID NO: 2017759 - RNA, 20 nt, Shigella flexneri 2a str. 301
cagacgcgcagcuucacuuc

SEQ ID NO: 2017760 - RNA, 22 nt, Shigella flexneri 2a str. 301
cagacgcuacuuuuuucaccca

SEQ ID NO: 2017761 - RNA, 19 nt, Shigella flexneri 2a str. 301
cagacgcaguacgccaccu

SEQ ID NO: 2017762 - RNA, 18 nt, Shigella flexneri 2a str. 301
cagacgcaguacgccacc

SEQ ID NO: 2017763 - RNA, 16 nt, Shigella flexneri 2a str. 301
cagacgcgcagcuuca

SEQ ID NO: 2017764 - RNA, 18 nt, Shigella flexneri 2a str. 301
cagacgcgcagcuucacu

SEQ ID NO: 2017765 - RNA, 21 nt, Shigella flexneri 2a str. 301
cagacucauauaaaaaccggu

SEQ ID NO: 2017766 - RNA, 23 nt, Shigella flexneri 2a str. 301
cagacucuuuuucgaaccacaaa

SEQ ID NO: 2017767 - RNA, 21 nt, Shigella flexneri 2a str. 301
cagacucuuuuucgaaccaca

SEQ ID NO: 2017768 - RNA, 18 nt, Shigella flexneri 2a str. 301
cagacucucauuuuucag

SEQ ID NO: 2017769 - RNA, 15 nt, Shigella flexneri 2a str. 301
cagacguuuuuucug

SEQ ID NO: 2017770 - RNA, 15 nt, Shigella flexneri 2a str. 301
cagacguugauaacc

SEQ ID NO: 2017771 - RNA, 15 nt, Shigella flexneri 2a str. 301
cagacguucuuccug

SEQ ID NO: 2017772 - RNA, 17 nt, Shigella flexneri 2a str. 301
cagacggcucaucaccc

SEQ ID NO: 2017773 - RNA, 12 nt, Shigella flexneri 2a str. 301
cagacggcagaa

SEQ ID NO: 2017774 - RNA, 15 nt, Shigella flexneri 2a str. 301
cagacggcucaucuc

SEQ ID NO: 2017775 - RNA, 18 nt, Shigella flexneri 2a str. 301
cagacggguacaguuuuc

SEQ ID NO: 2017776 - RNA, 20 nt, Shigella flexneri 2a str. 301
cagacggcugucauccagca

SEQ ID NO: 2017777 - RNA, 16 nt, Shigella flexneri 2a str. 301
cagacggcugucuucc

SEQ ID NO: 2017778 - RNA, 17 nt, Shigella flexneri 2a str. 301
cagacggcugucuuccu

SEQ ID NO: 2017779 - RNA, 18 nt, Shigella flexneri 2a str. 301
cagacguccggcgcugca

SEQ ID NO: 2017780 - RNA, 14 nt, Shigella flexneri 2a str. 301
cagacguucuuccu

SEQ ID NO: 2017781 - RNA, 16 nt, Shigella flexneri 2a str. 301
cagacgguacccgcug

SEQ ID NO: 2017782 - RNA, 16 nt, Shigella flexneri 2a str. 301
cagacggucagcgaga

SEQ ID NO: 2017783 - RNA, 18 nt, Shigella flexneri 2a str. 301
cagacgguuuuucaaguc

SEQ ID NO: 2017784 - RNA, 23 nt, Shigella flexneri 2a str. 301
cagagcaaaaaucgacagcagga

SEQ ID NO: 2017785 - RNA, 13 nt, Shigella flexneri 2a str. 301
cagagcagcaaca

SEQ ID NO: 2017786 - RNA, 15 nt, Shigella flexneri 2a str. 301
cagagccgacgccag

SEQ ID NO: 2017787 - RNA, 23 nt, Shigella flexneri 2a str. 301
cagagagacguucgcguacugcu

SEQ ID NO: 2017788 - RNA, 14 nt, Shigella flexneri 2a str. 301
cagagagcgaauau

SEQ ID NO: 2017789 - RNA, 19 nt, Shigella flexneri 2a str. 301
cagagauagaacugcauug

SEQ ID NO: 2017790 - RNA, 21 nt, Shigella flexneri 2a str. 301
cagagauaaccacguucauuu

SEQ ID NO: 2017791 - RNA, 19 nt, Shigella flexneri 2a str. 301
cagagaucagauaauauuu

SEQ ID NO: 2017792 - RNA, 20 nt, Shigella flexneri 2a str. 301
cagagauagaacugcauugu

SEQ ID NO: 2017793 - RNA, 23 nt, Shigella flexneri 2a str. 301
cagagaucgccccggcaagaaau

SEQ ID NO: 2017794 - RNA, 21 nt, Shigella flexneri 2a str. 301
cagagaauuuagcaaccaaaa

SEQ ID NO: 2017795 - RNA, 20 nt, Shigella flexneri 2a str. 301
cagagaacaucaauccaaac

SEQ ID NO: 2017796 - RNA, 19 nt, Shigella flexneri 2a str. 301
cagagaacgaccaucagcu

SEQ ID NO: 2017797 - RNA, 22 nt, Shigella flexneri 2a str. 301
cagacuuuuugcggcagcaaug

SEQ ID NO: 2017798 - RNA, 15 nt, Shigella flexneri 2a str. 301
cagacugaugugauc

SEQ ID NO: 2017799 - RNA, 22 nt, Shigella flexneri 2a str. 301
cagaccaauaauccccaauacg

SEQ ID NO: 2017800 - RNA, 11 nt, Shigella flexneri 2a str. 301
cagaccaauag

SEQ ID NO: 2017801 - RNA, 20 nt, Shigella flexneri 2a str. 301
cagaccaaucccgccauaac

SEQ ID NO: 2017802 - RNA, 16 nt, Shigella flexneri 2a str. 301
cagacacgccgccaga

SEQ ID NO: 2017803 - RNA, 17 nt, Shigella flexneri 2a str. 301
cagacaccgauugcccc

SEQ ID NO: 2017804 - RNA, 21 nt, Shigella flexneri 2a str. 301
cagacacaguucuucaaaaau

SEQ ID NO: 2017805 - RNA, 18 nt, Shigella flexneri 2a str. 301
cagacacggcguauacaa

SEQ ID NO: 2017806 - RNA, 21 nt, Shigella flexneri 2a str. 301
cagacacggcguauacaagaa

SEQ ID NO: 2017807 - RNA, 13 nt, Shigella flexneri 2a str. 301
cagacacuuuccc

SEQ ID NO: 2017808 - RNA, 12 nt, Shigella flexneri 2a str. 301
cagaccagcaaa

SEQ ID NO: 2017809 - RNA, 14 nt, Shigella flexneri 2a str. 301
cagaccacuuuccu

SEQ ID NO: 2017810 - RNA, 13 nt, Shigella flexneri 2a str. 301
cagaccacuuucc

SEQ ID NO: 2017811 - RNA, 20 nt, Shigella flexneri 2a str. 301
cagaccagcuaccacgccga

SEQ ID NO: 2017812 - RNA, 20 nt, Shigella flexneri 2a str. 301
cagaccaggcgggcgaagcu

SEQ ID NO: 2017813 - RNA, 19 nt, Shigella flexneri 2a str. 301
cagaccauauuuucauuau

SEQ ID NO: 2017814 - RNA, 11 nt, Shigella flexneri 2a str. 301
cagacccaguu

SEQ ID NO: 2017815 - RNA, 19 nt, Shigella flexneri 2a str. 301
cagacccacggauagauuu

SEQ ID NO: 2017816 - RNA, 23 nt, Shigella flexneri 2a str. 301
cagacccugcucuuucagcaccg

SEQ ID NO: 2017817 - RNA, 14 nt, Shigella flexneri 2a str. 301
cagaccgcagaagc

SEQ ID NO: 2017818 - RNA, 15 nt, Shigella flexneri 2a str. 301
cagaccgccaaccac

SEQ ID NO: 2017819 - RNA, 18 nt, Shigella flexneri 2a str. 301
cagaccuccguuuuucug

SEQ ID NO: 2017820 - RNA, 12 nt, Shigella flexneri 2a str. 301
cagaccggcaau

SEQ ID NO: 2017821 - RNA, 13 nt, Shigella flexneri 2a str. 301
cagaaucguaaag

SEQ ID NO: 2017822 - RNA, 15 nt, Shigella flexneri 2a str. 301
cagaaucgccagcau

SEQ ID NO: 2017823 - RNA, 20 nt, Shigella flexneri 2a str. 301
cagaaucgccagcaucggca

SEQ ID NO: 2017824 - RNA, 23 nt, Shigella flexneri 2a str. 301
cagaaucuaagaucccugccauu

SEQ ID NO: 2017825 - RNA, 17 nt, Shigella flexneri 2a str. 301
cagaaucuucuucucag

SEQ ID NO: 2017826 - RNA, 19 nt, Shigella flexneri 2a str. 301
cagaaucuucuucucagcc

SEQ ID NO: 2017827 - RNA, 22 nt, Shigella flexneri 2a str. 301
cagaaucagguugaugcgagua

SEQ ID NO: 2017828 - RNA, 17 nt, Shigella flexneri 2a str. 301
cagaauccaggaaagcc

SEQ ID NO: 2017829 - RNA, 14 nt, Shigella flexneri 2a str. 301
cagaauccaggaaa

SEQ ID NO: 2017830 - RNA, 15 nt, Shigella flexneri 2a str. 301
cagaauagacaaaaa

SEQ ID NO: 2017831 - RNA, 17 nt, Shigella flexneri 2a str. 301
cagaauagcgccgccaa

SEQ ID NO: 2017832 - RNA, 16 nt, Shigella flexneri 2a str. 301
cagaaucacgccaaca

SEQ ID NO: 2017833 - RNA, 21 nt, Shigella flexneri 2a str. 301
cagaauauugccgaagaccag

SEQ ID NO: 2017834 - RNA, 17 nt, Shigella flexneri 2a str. 301
cagaauauacggaauga

SEQ ID NO: 2017835 - RNA, 14 nt, Shigella flexneri 2a str. 301
cagacaaaacauac

SEQ ID NO: 2017836 - RNA, 19 nt, Shigella flexneri 2a str. 301
cagacaaaugaacaccaaa

SEQ ID NO: 2017837 - RNA, 13 nt, Shigella flexneri 2a str. 301
cagaauuuuucgc

SEQ ID NO: 2017838 - RNA, 17 nt, Shigella flexneri 2a str. 301
cagacaaccgcucaaca

SEQ ID NO: 2017839 - RNA, 12 nt, Shigella flexneri 2a str. 301
cagacaacauga

SEQ ID NO: 2017840 - RNA, 20 nt, Shigella flexneri 2a str. 301
cagacaaccauauuuaugca

SEQ ID NO: 2017841 - RNA, 15 nt, Shigella flexneri 2a str. 301
cagacaacccacaca

SEQ ID NO: 2017842 - RNA, 17 nt, Shigella flexneri 2a str. 301
cagacaauuuguuggcg

SEQ ID NO: 2017843 - RNA, 19 nt, Shigella flexneri 2a str. 301
cagaauuucgacuuuuuuc

SEQ ID NO: 2017844 - RNA, 20 nt, Shigella flexneri 2a str. 301
cagaauuugaggaagcugcc

SEQ ID NO: 2017845 - RNA, 21 nt, Shigella flexneri 2a str. 301
cagaauggcgcacucaaaacu

SEQ ID NO: 2017846 - RNA, 15 nt, Shigella flexneri 2a str. 301
cagaauuaacgcuga

SEQ ID NO: 2017847 - RNA, 19 nt, Shigella flexneri 2a str. 301
cagaaugcgggcgaaaaca

SEQ ID NO: 2017848 - RNA, 14 nt, Shigella flexneri 2a str. 301
cagaaugccccauu

SEQ ID NO: 2017849 - RNA, 17 nt, Shigella flexneri 2a str. 301
cagaaugccgcaaaacu

SEQ ID NO: 2017850 - RNA, 22 nt, Shigella flexneri 2a str. 301
cagaagguaaauuguuggcgua

SEQ ID NO: 2017851 - RNA, 20 nt, Shigella flexneri 2a str. 301
cagaaggccgcaguaaagcg

SEQ ID NO: 2017852 - RNA, 22 nt, Shigella flexneri 2a str. 301
cagaaggccgcaguaaagcgca

SEQ ID NO: 2017853 - RNA, 15 nt, Shigella flexneri 2a str. 301
cagaaguugcaccca

SEQ ID NO: 2017854 - RNA, 16 nt, Shigella flexneri 2a str. 301
cagaaguugcacccag

SEQ ID NO: 2017855 - RNA, 19 nt, Shigella flexneri 2a str. 301
cagaaguugcucaagcuga

SEQ ID NO: 2017856 - RNA, 18 nt, Shigella flexneri 2a str. 301
cagaagcugcaggaccau

SEQ ID NO: 2017857 - RNA, 20 nt, Shigella flexneri 2a str. 301
cagaagcugcaggaccauac

SEQ ID NO: 2017858 - RNA, 20 nt, Shigella flexneri 2a str. 301
cagaagcguucggcaacugg

SEQ ID NO: 2017859 - RNA, 22 nt, Shigella flexneri 2a str. 301
cagaaggauaauuaaucuuucu

SEQ ID NO: 2017860 - RNA, 19 nt, Shigella flexneri 2a str. 301
cagaaggagcuaauaauga

SEQ ID NO: 2017861 - RNA, 23 nt, Shigella flexneri 2a str. 301
cagaaggagcuaauaaugagcag

SEQ ID NO: 2017862 - RNA, 18 nt, Shigella flexneri 2a str. 301
cagaagaugcguucaccu

SEQ ID NO: 2017863 - RNA, 18 nt, Shigella flexneri 2a str. 301
cagaagcaaucaucccag

SEQ ID NO: 2017864 - RNA, 20 nt, Shigella flexneri 2a str. 301
cagaagcauuuuacauccug

SEQ ID NO: 2017865 - RNA, 22 nt, Shigella flexneri 2a str. 301
cagaagcauuuuacauccugau

SEQ ID NO: 2017866 - RNA, 16 nt, Shigella flexneri 2a str. 301
cagaacuaaaaucggu

SEQ ID NO: 2017867 - RNA, 23 nt, Shigella flexneri 2a str. 301
cagaacuucugguaacagcggac

SEQ ID NO: 2017868 - RNA, 15 nt, Shigella flexneri 2a str. 301
cagaagacgcuccag

SEQ ID NO: 2017869 - RNA, 13 nt, Shigella flexneri 2a str. 301
cagaacuucgcua

SEQ ID NO: 2017870 - RNA, 17 nt, Shigella flexneri 2a str. 301
cagaacgcuuucgcaca

SEQ ID NO: 2017871 - RNA, 17 nt, Shigella flexneri 2a str. 301
cagaacgaccaguucac

SEQ ID NO: 2017872 - RNA, 20 nt, Shigella flexneri 2a str. 301
cagaaccacggaauaaccag

SEQ ID NO: 2017873 - RNA, 20 nt, Shigella flexneri 2a str. 301
cagaaccguaccaaaaugac

SEQ ID NO: 2017874 - RNA, 13 nt, Shigella flexneri 2a str. 301
cagaaacagccau

SEQ ID NO: 2017875 - RNA, 16 nt, Shigella flexneri 2a str. 301
cagaaaauuuucauca

SEQ ID NO: 2017876 - RNA, 20 nt, Shigella flexneri 2a str. 301
cagaaaauuuucaucaguaa

SEQ ID NO: 2017877 - RNA, 15 nt, Shigella flexneri 2a str. 301
cagaaacaaacgcaa

SEQ ID NO: 2017878 - RNA, 18 nt, Shigella flexneri 2a str. 301
cagaaaauggcacaaugg

SEQ ID NO: 2017879 - RNA, 16 nt, Shigella flexneri 2a str. 301
cagaaacgcucauaaa

SEQ ID NO: 2017880 - RNA, 16 nt, Shigella flexneri 2a str. 301
cagaaacgccaccauu

SEQ ID NO: 2017881 - RNA, 19 nt, Shigella flexneri 2a str. 301
cagaaacgccaucucuuua

SEQ ID NO: 2017882 - RNA, 16 nt, Shigella flexneri 2a str. 301
cagaaacaguuguaaa

SEQ ID NO: 2017883 - RNA, 23 nt, Shigella flexneri 2a str. 301
cagaaagcggaucaguuccagca

SEQ ID NO: 2017884 - RNA, 21 nt, Shigella flexneri 2a str. 301
cagaaaguuuuucaacaccau

SEQ ID NO: 2017885 - RNA, 23 nt, Shigella flexneri 2a str. 301
cagaaaguuuuucaacaccauga

SEQ ID NO: 2017886 - RNA, 20 nt, Shigella flexneri 2a str. 301
cagaaagggggaguuaaccu

SEQ ID NO: 2017887 - RNA, 21 nt, Shigella flexneri 2a str. 301
cagaaagucaaaagccuccga

SEQ ID NO: 2017888 - RNA, 13 nt, Shigella flexneri 2a str. 301
cagaaagggaaga

SEQ ID NO: 2017889 - RNA, 19 nt, Shigella flexneri 2a str. 301
cagaaauugucuccaccaa

SEQ ID NO: 2017890 - RNA, 18 nt, Shigella flexneri 2a str. 301
cagaaauuuggcuccucu

SEQ ID NO: 2017891 - RNA, 18 nt, Shigella flexneri 2a str. 301
cagaaauucguaauccau

SEQ ID NO: 2017892 - RNA, 19 nt, Shigella flexneri 2a str. 301
cagaaauuuggcuccucug

SEQ ID NO: 2017893 - RNA, 20 nt, Shigella flexneri 2a str. 301
cagaacacgcucccagcaga

SEQ ID NO: 2017894 - RNA, 17 nt, Shigella flexneri 2a str. 301
cagaacagcuacagcau

SEQ ID NO: 2017895 - RNA, 22 nt, Shigella flexneri 2a str. 301
cagaacacuguuaccgcugcug

SEQ ID NO: 2017896 - RNA, 13 nt, Shigella flexneri 2a str. 301
cagaaaucagcuu

SEQ ID NO: 2017897 - RNA, 16 nt, Shigella flexneri 2a str. 301
cagaaaucggccuucc

SEQ ID NO: 2017898 - RNA, 20 nt, Shigella flexneri 2a str. 301
cagaaauggcccaaaaggca

SEQ ID NO: 2017899 - RNA, 20 nt, Shigella flexneri 2a str. 301
cagaaaugguaaagaaggca

SEQ ID NO: 2017900 - RNA, 18 nt, Shigella flexneri 2a str. 301
cagaaauagaaagugacu

SEQ ID NO: 2017901 - RNA, 15 nt, Shigella flexneri 2a str. 301
cacugcaucaaugcc

SEQ ID NO: 2017902 - RNA, 16 nt, Shigella flexneri 2a str. 301
cacugcauggcggcgu

SEQ ID NO: 2017903 - RNA, 20 nt, Shigella flexneri 2a str. 301
cacugccagaauagccgcag

SEQ ID NO: 2017904 - RNA, 16 nt, Shigella flexneri 2a str. 301
cacugcccgagaacag

SEQ ID NO: 2017905 - RNA, 17 nt, Shigella flexneri 2a str. 301
cacugccguacaggcag

SEQ ID NO: 2017906 - RNA, 16 nt, Shigella flexneri 2a str. 301
cacugccguacaggca

SEQ ID NO: 2017907 - RNA, 13 nt, Shigella flexneri 2a str. 301
cacugcgagaaaa

SEQ ID NO: 2017908 - RNA, 18 nt, Shigella flexneri 2a str. 301
cacugcgagaaaaagccu

SEQ ID NO: 2017909 - RNA, 18 nt, Shigella flexneri 2a str. 301
cacugcgcauaauccacu

SEQ ID NO: 2017910 - RNA, 14 nt, Shigella flexneri 2a str. 301
caauguuucucugg

SEQ ID NO: 2017911 - RNA, 20 nt, Shigella flexneri 2a str. 301
caauguuucucuggcgcgcu

SEQ ID NO: 2017912 - RNA, 20 nt, Shigella flexneri 2a str. 301
caauguuguggccaguaauc

SEQ ID NO: 2017913 - RNA, 12 nt, Shigella flexneri 2a str. 301
caauuaaaaaau

SEQ ID NO: 2017914 - RNA, 13 nt, Shigella flexneri 2a str. 301
caauuaaaaaauu

SEQ ID NO: 2017915 - RNA, 14 nt, Shigella flexneri 2a str. 301
caauuaaaaaauua

SEQ ID NO: 2017916 - RNA, 21 nt, Shigella flexneri 2a str. 301
cacugcaaugaccaucauucg

SEQ ID NO: 2017917 - RNA, 22 nt, Shigella flexneri 2a str. 301
cacugcaacagcuguugaaaag

SEQ ID NO: 2017918 - RNA, 13 nt, Shigella flexneri 2a str. 301
cacugcaaaacag

SEQ ID NO: 2017919 - RNA, 19 nt, Shigella flexneri 2a str. 301
caaugucauggcagucuua

SEQ ID NO: 2017920 - RNA, 23 nt, Shigella flexneri 2a str. 301
caaugucugucauauuaucuauc

SEQ ID NO: 2017921 - RNA, 19 nt, Shigella flexneri 2a str. 301
caauguggguagccaaugc

SEQ ID NO: 2017922 - RNA, 21 nt, Shigella flexneri 2a str. 301
caaugugcuaaucagugccug

SEQ ID NO: 2017923 - RNA, 14 nt, Shigella flexneri 2a str. 301
caauguuaccgauc

SEQ ID NO: 2017924 - RNA, 16 nt, Shigella flexneri 2a str. 301
caauguugcgggggcu

SEQ ID NO: 2017925 - RNA, 20 nt, Shigella flexneri 2a str. 301
caauguugcguuugucauca

SEQ ID NO: 2017926 - RNA, 13 nt, Shigella flexneri 2a str. 301
cacuguugaagcc

SEQ ID NO: 2017927 - RNA, 15 nt, Shigella flexneri 2a str. 301
cacuguucacuuuug

SEQ ID NO: 2017928 - RNA, 14 nt, Shigella flexneri 2a str. 301
cacuguucauuaaa

SEQ ID NO: 2017929 - RNA, 20 nt, Shigella flexneri 2a str. 301
cacugugggauugcuucagu

SEQ ID NO: 2017930 - RNA, 15 nt, Shigella flexneri 2a str. 301
cacugucuaacaaca

SEQ ID NO: 2017931 - RNA, 14 nt, Shigella flexneri 2a str. 301
cacuguaugaaaca

SEQ ID NO: 2017932 - RNA, 18 nt, Shigella flexneri 2a str. 301
cacuggugccaugaauga

SEQ ID NO: 2017933 - RNA, 19 nt, Shigella flexneri 2a str. 301
cacugguucccaacaacag

SEQ ID NO: 2017934 - RNA, 21 nt, Shigella flexneri 2a str. 301
cacugguuccgguuuauccau

SEQ ID NO: 2017935 - RNA, 22 nt, Shigella flexneri 2a str. 301
cacugguuuccgccagcgggcc

SEQ ID NO: 2017936 - RNA, 14 nt, Shigella flexneri 2a str. 301
cacuggcaaaauca

SEQ ID NO: 2017937 - RNA, 21 nt, Shigella flexneri 2a str. 301
cacuggcccaacaacggcuuu

SEQ ID NO: 2017938 - RNA, 18 nt, Shigella flexneri 2a str. 301
cacugcugauaauccagu

SEQ ID NO: 2017939 - RNA, 17 nt, Shigella flexneri 2a str. 301
cacugcucgcagaaaua

SEQ ID NO: 2017940 - RNA, 15 nt, Shigella flexneri 2a str. 301
cacuggguucaaaaa

SEQ ID NO: 2017941 - RNA, 22 nt, Shigella flexneri 2a str. 301
cacuggguucaaaaacuaauuc

SEQ ID NO: 2017942 - RNA, 23 nt, Shigella flexneri 2a str. 301
cacuggguuggguucacuuuccc

SEQ ID NO: 2017943 - RNA, 15 nt, Shigella flexneri 2a str. 301
cacuggucgcccugg

SEQ ID NO: 2017944 - RNA, 17 nt, Shigella flexneri 2a str. 301
cacuggucugacgcuga

SEQ ID NO: 2017945 - RNA, 20 nt, Shigella flexneri 2a str. 301
cacuggucugacgcugaaua

SEQ ID NO: 2017946 - RNA, 20 nt, Shigella flexneri 2a str. 301
cacugggcgaagguggcgga

SEQ ID NO: 2017947 - RNA, 15 nt, Shigella flexneri 2a str. 301
cacuucaucaagcaa

SEQ ID NO: 2017948 - RNA, 12 nt, Shigella flexneri 2a str. 301
cacuucaucaag

SEQ ID NO: 2017949 - RNA, 20 nt, Shigella flexneri 2a str. 301
cacuucauagugcgcggugu

SEQ ID NO: 2017950 - RNA, 18 nt, Shigella flexneri 2a str. 301
cacuucaucgccguugcg

SEQ ID NO: 2017951 - RNA, 19 nt, Shigella flexneri 2a str. 301
cacuucauccggauacagc

SEQ ID NO: 2017952 - RNA, 15 nt, Shigella flexneri 2a str. 301
cacuuccagcggcca

SEQ ID NO: 2017953 - RNA, 16 nt, Shigella flexneri 2a str. 301
cacuucaucgucauaa

SEQ ID NO: 2017954 - RNA, 20 nt, Shigella flexneri 2a str. 301
cacuuccaccacuuccugcu

SEQ ID NO: 2017955 - RNA, 16 nt, Shigella flexneri 2a str. 301
cacuuccaccagcaac

SEQ ID NO: 2017956 - RNA, 22 nt, Shigella flexneri 2a str. 301
cacuuccaccagcggcugaaua

SEQ ID NO: 2017957 - RNA, 14 nt, Shigella flexneri 2a str. 301
cacuuccaccagcg

SEQ ID NO: 2017958 - RNA, 15 nt, Shigella flexneri 2a str. 301
cacuucaauauuaau

SEQ ID NO: 2017959 - RNA, 12 nt, Shigella flexneri 2a str. 301
cacuucacaguu

SEQ ID NO: 2017960 - RNA, 21 nt, Shigella flexneri 2a str. 301
cacuucaccgcgaauauaagc

SEQ ID NO: 2017961 - RNA, 17 nt, Shigella flexneri 2a str. 301
cacuucaaccacauuca

SEQ ID NO: 2017962 - RNA, 14 nt, Shigella flexneri 2a str. 301
cacuucuucagcca

SEQ ID NO: 2017963 - RNA, 16 nt, Shigella flexneri 2a str. 301
cacuucuucagccagu

SEQ ID NO: 2017964 - RNA, 12 nt, Shigella flexneri 2a str. 301
cacuucuuccuu

SEQ ID NO: 2017965 - RNA, 20 nt, Shigella flexneri 2a str. 301
cacuugaccaacuucagcaa

SEQ ID NO: 2017966 - RNA, 12 nt, Shigella flexneri 2a str. 301
cacuucuucagc

SEQ ID NO: 2017967 - RNA, 19 nt, Shigella flexneri 2a str. 301
cacuucuguuacuccagcg

SEQ ID NO: 2017968 - RNA, 11 nt, Shigella flexneri 2a str. 301
cacuucugccu

SEQ ID NO: 2017969 - RNA, 16 nt, Shigella flexneri 2a str. 301
cacuucgucagaaaug

SEQ ID NO: 2017970 - RNA, 21 nt, Shigella flexneri 2a str. 301
cacuucgcgcaaccaguccuc

SEQ ID NO: 2017971 - RNA, 18 nt, Shigella flexneri 2a str. 301
cacuucgcuuacgccugc

SEQ ID NO: 2017972 - RNA, 15 nt, Shigella flexneri 2a str. 301
cacuuccucaagcgu

SEQ ID NO: 2017973 - RNA, 22 nt, Shigella flexneri 2a str. 301
cacuuccggugccgguuucacg

SEQ ID NO: 2017974 - RNA, 16 nt, Shigella flexneri 2a str. 301
cacuuugaucugcguc

SEQ ID NO: 2017975 - RNA, 13 nt, Shigella flexneri 2a str. 301
cacuuugugucag

SEQ ID NO: 2017976 - RNA, 17 nt, Shigella flexneri 2a str. 301
cacuuucucgacaucca

SEQ ID NO: 2017977 - RNA, 12 nt, Shigella flexneri 2a str. 301
cacuuucugcgc

SEQ ID NO: 2017978 - RNA, 22 nt, Shigella flexneri 2a str. 301
cacuuuuauuaacucagcauua

SEQ ID NO: 2017979 - RNA, 19 nt, Shigella flexneri 2a str. 301
cacuuuuucgaacgcugca

SEQ ID NO: 2017980 - RNA, 18 nt, Shigella flexneri 2a str. 301
cagaaaacgguugauaua

SEQ ID NO: 2017981 - RNA, 19 nt, Shigella flexneri 2a str. 301
cagaaaacucacgccugaa

SEQ ID NO: 2017982 - RNA, 14 nt, Shigella flexneri 2a str. 301
cagaaaaagaagcc

SEQ ID NO: 2017983 - RNA, 13 nt, Shigella flexneri 2a str. 301
cagaaaaagagca

SEQ ID NO: 2017984 - RNA, 22 nt, Shigella flexneri 2a str. 301
cacuugcggcacccauuuaucc

SEQ ID NO: 2017985 - RNA, 20 nt, Shigella flexneri 2a str. 301
cacuugcaggaacagugccu

SEQ ID NO: 2017986 - RNA, 19 nt, Shigella flexneri 2a str. 301
cacuugcagcucauauucc

SEQ ID NO: 2017987 - RNA, 15 nt, Shigella flexneri 2a str. 301
cacuuuccaguuccg

SEQ ID NO: 2017988 - RNA, 12 nt, Shigella flexneri 2a str. 301
cacuuucaguuu

SEQ ID NO: 2017989 - RNA, 17 nt, Shigella flexneri 2a str. 301
cacuuucacgcccauaa

SEQ ID NO: 2017990 - RNA, 12 nt, Shigella flexneri 2a str. 301
cacuuucgcggc

SEQ ID NO: 2017991 - RNA, 17 nt, Shigella flexneri 2a str. 301
cacuuguucagcgaugu

SEQ ID NO: 2017992 - RNA, 20 nt, Shigella flexneri 2a str. 301
cacuuguucucgcgcuucau

SEQ ID NO: 2017993 - RNA, 14 nt, Shigella flexneri 2a str. 301
caggcagauacaac

SEQ ID NO: 2017994 - RNA, 16 nt, Shigella flexneri 2a str. 301
caggcagcacugcuua

SEQ ID NO: 2017995 - RNA, 15 nt, Shigella flexneri 2a str. 301
caggcaguaaaccgu

SEQ ID NO: 2017996 - RNA, 15 nt, Shigella flexneri 2a str. 301
caggcaggucuuuca

SEQ ID NO: 2017997 - RNA, 18 nt, Shigella flexneri 2a str. 301
caggccggagccagccgu

SEQ ID NO: 2017998 - RNA, 16 nt, Shigella flexneri 2a str. 301
caggcggcuaugcugg

SEQ ID NO: 2017999 - RNA, 16 nt, Shigella flexneri 2a str. 301
caggcggcuucgcauc

SEQ ID NO: 2018000 - RNA, 22 nt, Shigella flexneri 2a str. 301
caggcuaccgcagugaaauuuc

SEQ ID NO: 2018001 - RNA, 15 nt, Shigella flexneri 2a str. 301
caggcuaaagaaaac

SEQ ID NO: 2018002 - RNA, 15 nt, Shigella flexneri 2a str. 301
caggcuacucccagu

SEQ ID NO: 2018003 - RNA, 13 nt, Shigella flexneri 2a str. 301
caggcuacuccca

SEQ ID NO: 2018004 - RNA, 17 nt, Shigella flexneri 2a str. 301
caggcuacucccaguag

SEQ ID NO: 2018005 - RNA, 14 nt, Shigella flexneri 2a str. 301
caggcuacuuuucc

SEQ ID NO: 2018006 - RNA, 23 nt, Shigella flexneri 2a str. 301
caggcucagaagacgcuccagug

SEQ ID NO: 2018007 - RNA, 15 nt, Shigella flexneri 2a str. 301
caggcguucugccug

SEQ ID NO: 2018008 - RNA, 15 nt, Shigella flexneri 2a str. 301
caggcguuuacccuu

SEQ ID NO: 2018009 - RNA, 20 nt, Shigella flexneri 2a str. 301
caggcguuuguaacccacca

SEQ ID NO: 2018010 - RNA, 20 nt, Shigella flexneri 2a str. 301
caggcguuuacccuucgcac

SEQ ID NO: 2018011 - RNA, 22 nt, Shigella flexneri 2a str. 301
caggcgcgaauggaaagcccgc

SEQ ID NO: 2018012 - RNA, 16 nt, Shigella flexneri 2a str. 301
caggcgcucauaacca

SEQ ID NO: 2018013 - RNA, 21 nt, Shigella flexneri 2a str. 301
caggccuacaagucugugcug

SEQ ID NO: 2018014 - RNA, 23 nt, Shigella flexneri 2a str. 301
caggccuacagcauauaaugcaa

SEQ ID NO: 2018015 - RNA, 19 nt, Shigella flexneri 2a str. 301
caggccuacauuuucuccg

SEQ ID NO: 2018016 - RNA, 14 nt, Shigella flexneri 2a str. 301
caggccguggauca

SEQ ID NO: 2018017 - RNA, 22 nt, Shigella flexneri 2a str. 301
caggguaauuuguaacugucgg

SEQ ID NO: 2018018 - RNA, 21 nt, Shigella flexneri 2a str. 301
caggguauggaucccucuuuc

SEQ ID NO: 2018019 - RNA, 17 nt, Shigella flexneri 2a str. 301
caggguguauucaugcc

SEQ ID NO: 2018020 - RNA, 17 nt, Shigella flexneri 2a str. 301
caggguggugacaccau

SEQ ID NO: 2018021 - RNA, 18 nt, Shigella flexneri 2a str. 301
cagggugaucaccaguaa

SEQ ID NO: 2018022 - RNA, 24 nt, Shigella flexneri 2a str. 301
cagggcuuuaccugucagcucuuu

SEQ ID NO: 2018023 - RNA, 14 nt, Shigella flexneri 2a str. 301
caggggcagcacca

SEQ ID NO: 2018024 - RNA, 14 nt, Shigella flexneri 2a str. 301
caggggcuggaaga

SEQ ID NO: 2018025 - RNA, 14 nt, Shigella flexneri 2a str. 301
cagggcggccgcca

SEQ ID NO: 2018026 - RNA, 20 nt, Shigella flexneri 2a str. 301
cagggccucuccuuuaccac

SEQ ID NO: 2018027 - RNA, 18 nt, Shigella flexneri 2a str. 301
cagggcgaauucuugccu

SEQ ID NO: 2018028 - RNA, 19 nt, Shigella flexneri 2a str. 301
cagcuccaccgauuuugag

SEQ ID NO: 2018029 - RNA, 17 nt, Shigella flexneri 2a str. 301
cagcucauucagccggg

SEQ ID NO: 2018030 - RNA, 19 nt, Shigella flexneri 2a str. 301
cagcuccgggcucaugcug

SEQ ID NO: 2018031 - RNA, 13 nt, Shigella flexneri 2a str. 301
cagcuccggcacc

SEQ ID NO: 2018032 - RNA, 22 nt, Shigella flexneri 2a str. 301
cagcucccacaguuucagcccc

SEQ ID NO: 2018033 - RNA, 17 nt, Shigella flexneri 2a str. 301
cagcuccguccagccac

SEQ ID NO: 2018034 - RNA, 16 nt, Shigella flexneri 2a str. 301
cagcggcuuccaccgc

SEQ ID NO: 2018035 - RNA, 20 nt, Shigella flexneri 2a str. 301
cagcucaaacggcguuuucu

SEQ ID NO: 2018036 - RNA, 19 nt, Shigella flexneri 2a str. 301
cagcuauucuuauaaagaa

SEQ ID NO: 2018037 - RNA, 15 nt, Shigella flexneri 2a str. 301
cagcggcggcaaaau

SEQ ID NO: 2018038 - RNA, 14 nt, Shigella flexneri 2a str. 301
cagcuuagcgccuu

SEQ ID NO: 2018039 - RNA, 19 nt, Shigella flexneri 2a str. 301
cagcuuaugccuguccucu

SEQ ID NO: 2018040 - RNA, 22 nt, Shigella flexneri 2a str. 301
cagcuuauuagggaucaucuua

SEQ ID NO: 2018041 - RNA, 23 nt, Shigella flexneri 2a str. 301
cagcuuacgagugcgcucuucaa

SEQ ID NO: 2018042 - RNA, 13 nt, Shigella flexneri 2a str. 301
cagcuuacgcuga

SEQ ID NO: 2018043 - RNA, 16 nt, Shigella flexneri 2a str. 301
cagcuuagaaauucac

SEQ ID NO: 2018044 - RNA, 19 nt, Shigella flexneri 2a str. 301
cagcuuacgagugcgcucu

SEQ ID NO: 2018045 - RNA, 19 nt, Shigella flexneri 2a str. 301
cagcuguccgauuuguucu

SEQ ID NO: 2018046 - RNA, 18 nt, Shigella flexneri 2a str. 301
cagcuucacgcgccagcu

SEQ ID NO: 2018047 - RNA, 15 nt, Shigella flexneri 2a str. 301
cagcuucaccuucca

SEQ ID NO: 2018048 - RNA, 19 nt, Shigella flexneri 2a str. 301
cagcuucacgcgccagcuu

SEQ ID NO: 2018049 - RNA, 10 nt, Shigella flexneri 2a str. 301
cagcuucaga

SEQ ID NO: 2018050 - RNA, 13 nt, Shigella flexneri 2a str. 301
cagcuucagauug

SEQ ID NO: 2018051 - RNA, 18 nt, Shigella flexneri 2a str. 301
cagcuucagauugcacca

SEQ ID NO: 2018052 - RNA, 15 nt, Shigella flexneri 2a str. 301
cagcugcucccagcg

SEQ ID NO: 2018053 - RNA, 19 nt, Shigella flexneri 2a str. 301
cagcugguugaugcgcccu

SEQ ID NO: 2018054 - RNA, 17 nt, Shigella flexneri 2a str. 301
caggaauucagaaaaau

SEQ ID NO: 2018055 - RNA, 15 nt, Shigella flexneri 2a str. 301
caggaauacgcccgu

SEQ ID NO: 2018056 - RNA, 12 nt, Shigella flexneri 2a str. 301
caggaauauacc

SEQ ID NO: 2018057 - RNA, 17 nt, Shigella flexneri 2a str. 301
caggacgaguacggauu

SEQ ID NO: 2018058 - RNA, 18 nt, Shigella flexneri 2a str. 301
caggaccugcucugccag

SEQ ID NO: 2018059 - RNA, 14 nt, Shigella flexneri 2a str. 301
caggacgcagucca

SEQ ID NO: 2018060 - RNA, 14 nt, Shigella flexneri 2a str. 301
caggacgauaaacc

SEQ ID NO: 2018061 - RNA, 16 nt, Shigella flexneri 2a str. 301
caggaccucacggaac

SEQ ID NO: 2018062 - RNA, 15 nt, Shigella flexneri 2a str. 301
caggaccguucgcua

SEQ ID NO: 2018063 - RNA, 20 nt, Shigella flexneri 2a str. 301
caggaccauacugacggauc

SEQ ID NO: 2018064 - RNA, 13 nt, Shigella flexneri 2a str. 301
caggaacugcuca

SEQ ID NO: 2018065 - RNA, 14 nt, Shigella flexneri 2a str. 301
caggaacugcucau

SEQ ID NO: 2018066 - RNA, 18 nt, Shigella flexneri 2a str. 301
caggaacgggauugccag

SEQ ID NO: 2018067 - RNA, 19 nt, Shigella flexneri 2a str. 301
caggaaccugugacagcag

SEQ ID NO: 2018068 - RNA, 15 nt, Shigella flexneri 2a str. 301
caggaacgccgcgcc

SEQ ID NO: 2018069 - RNA, 16 nt, Shigella flexneri 2a str. 301
cagcuugccgcgcucu

SEQ ID NO: 2018070 - RNA, 16 nt, Shigella flexneri 2a str. 301
caggaagaccugcagc

SEQ ID NO: 2018071 - RNA, 14 nt, Shigella flexneri 2a str. 301
caggaagccccagc

SEQ ID NO: 2018072 - RNA, 15 nt, Shigella flexneri 2a str. 301
caggaagccccagcu

SEQ ID NO: 2018073 - RNA, 15 nt, Shigella flexneri 2a str. 301
caggacuuugaaagc

SEQ ID NO: 2018074 - RNA, 12 nt, Shigella flexneri 2a str. 301
caggagcacgcu

SEQ ID NO: 2018075 - RNA, 15 nt, Shigella flexneri 2a str. 301
caggagcagcagguu

SEQ ID NO: 2018076 - RNA, 13 nt, Shigella flexneri 2a str. 301
caggagcaggcug

SEQ ID NO: 2018077 - RNA, 15 nt, Shigella flexneri 2a str. 301
caggagcaggcugca

SEQ ID NO: 2018078 - RNA, 22 nt, Shigella flexneri 2a str. 301
caggagacgcgcaaaucagauu

SEQ ID NO: 2018079 - RNA, 16 nt, Shigella flexneri 2a str. 301
caggaguagcucuggg

SEQ ID NO: 2018080 - RNA, 17 nt, Shigella flexneri 2a str. 301
caggaguagcucugggu

SEQ ID NO: 2018081 - RNA, 15 nt, Shigella flexneri 2a str. 301
caggagucaugucau

SEQ ID NO: 2018082 - RNA, 22 nt, Shigella flexneri 2a str. 301
caggagcuccagguccuccugu

SEQ ID NO: 2018083 - RNA, 21 nt, Shigella flexneri 2a str. 301
caggaucuggcuugccagcag

SEQ ID NO: 2018084 - RNA, 23 nt, Shigella flexneri 2a str. 301
caggaucuggcuugccagcaggg

SEQ ID NO: 2018085 - RNA, 17 nt, Shigella flexneri 2a str. 301
caggaucugguauuaaa

SEQ ID NO: 2018086 - RNA, 17 nt, Shigella flexneri 2a str. 301
caggaucggugcugcca

SEQ ID NO: 2018087 - RNA, 17 nt, Shigella flexneri 2a str. 301
caggaucuccagcuccc

SEQ ID NO: 2018088 - RNA, 18 nt, Shigella flexneri 2a str. 301
caggcacuacguucucac

SEQ ID NO: 2018089 - RNA, 12 nt, Shigella flexneri 2a str. 301
caggauuauguu

SEQ ID NO: 2018090 - RNA, 16 nt, Shigella flexneri 2a str. 301
caggauuaauaaauuu

SEQ ID NO: 2018091 - RNA, 21 nt, Shigella flexneri 2a str. 301
caggauucacaauauuaauac

SEQ ID NO: 2018092 - RNA, 19 nt, Shigella flexneri 2a str. 301
caggauuuccagcucaaag

SEQ ID NO: 2018093 - RNA, 14 nt, Shigella flexneri 2a str. 301
cagucucaaaccgg

SEQ ID NO: 2018094 - RNA, 23 nt, Shigella flexneri 2a str. 301
cagucuuccaucacaaagugggg

SEQ ID NO: 2018095 - RNA, 17 nt, Shigella flexneri 2a str. 301
cagucuggcuucgcugu

SEQ ID NO: 2018096 - RNA, 21 nt, Shigella flexneri 2a str. 301
cagucugcgcccugggcuuca

SEQ ID NO: 2018097 - RNA, 14 nt, Shigella flexneri 2a str. 301
cagucuggagcaaa

SEQ ID NO: 2018098 - RNA, 22 nt, Shigella flexneri 2a str. 301
cagucuggacaaagagcuuuca

SEQ ID NO: 2018099 - RNA, 15 nt, Shigella flexneri 2a str. 301
cagucgucaucccag

SEQ ID NO: 2018100 - RNA, 13 nt, Shigella flexneri 2a str. 301
cagucggcuuucu

SEQ ID NO: 2018101 - RNA, 21 nt, Shigella flexneri 2a str. 301
cagucggcuuucucauuuuuu

SEQ ID NO: 2018102 - RNA, 23 nt, Shigella flexneri 2a str. 301
cagucgcguagguaaucauauug

SEQ ID NO: 2018103 - RNA, 20 nt, Shigella flexneri 2a str. 301
cagucgcuguauuuugcguu

SEQ ID NO: 2018104 - RNA, 17 nt, Shigella flexneri 2a str. 301
cagucgcaaaccuggca

SEQ ID NO: 2018105 - RNA, 12 nt, Shigella flexneri 2a str. 301
cagucgcccccg

SEQ ID NO: 2018106 - RNA, 16 nt, Shigella flexneri 2a str. 301
cagucgccagcgccag

SEQ ID NO: 2018107 - RNA, 23 nt, Shigella flexneri 2a str. 301
cagucacggcgcgguugcggguu

SEQ ID NO: 2018108 - RNA, 16 nt, Shigella flexneri 2a str. 301
cagucacgacaaagac

SEQ ID NO: 2018109 - RNA, 15 nt, Shigella flexneri 2a str. 301
cagucaccugcccuc

SEQ ID NO: 2018110 - RNA, 16 nt, Shigella flexneri 2a str. 301
cagucacuacgcgacc

SEQ ID NO: 2018111 - RNA, 19 nt, Shigella flexneri 2a str. 301
cagucauaaccaguccauu

SEQ ID NO: 2018112 - RNA, 17 nt, Shigella flexneri 2a str. 301
cagucaguuaagcaacu

SEQ ID NO: 2018113 - RNA, 17 nt, Shigella flexneri 2a str. 301
cagucauaaccagucca

SEQ ID NO: 2018114 - RNA, 17 nt, Shigella flexneri 2a str. 301
cagucagcgaacaccag

SEQ ID NO: 2018115 - RNA, 23 nt, Shigella flexneri 2a str. 301
cagucaggcgauuguuuagaucc

SEQ ID NO: 2018116 - RNA, 12 nt, Shigella flexneri 2a str. 301
cagucaggcugu

SEQ ID NO: 2018117 - RNA, 18 nt, Shigella flexneri 2a str. 301
caguggcgagcuuccugu

SEQ ID NO: 2018118 - RNA, 19 nt, Shigella flexneri 2a str. 301
caguggacgauaagcaccg

SEQ ID NO: 2018119 - RNA, 17 nt, Shigella flexneri 2a str. 301
caguggacgauaagcac

SEQ ID NO: 2018120 - RNA, 13 nt, Shigella flexneri 2a str. 301
caguguccaacca

SEQ ID NO: 2018121 - RNA, 14 nt, Shigella flexneri 2a str. 301
caguguaaaacagc

SEQ ID NO: 2018122 - RNA, 15 nt, Shigella flexneri 2a str. 301
caguguaaaacagca

SEQ ID NO: 2018123 - RNA, 20 nt, Shigella flexneri 2a str. 301
caguguacuuaucuuuuaca

SEQ ID NO: 2018124 - RNA, 17 nt, Shigella flexneri 2a str. 301
cagugcaggcaccagcc

SEQ ID NO: 2018125 - RNA, 22 nt, Shigella flexneri 2a str. 301
cagugcacgaaccagagacaga

SEQ ID NO: 2018126 - RNA, 15 nt, Shigella flexneri 2a str. 301
cagugccaaagccag

SEQ ID NO: 2018127 - RNA, 16 nt, Shigella flexneri 2a str. 301
cagugccagcaccacu

SEQ ID NO: 2018128 - RNA, 12 nt, Shigella flexneri 2a str. 301
cagugcugaagg

SEQ ID NO: 2018129 - RNA, 15 nt, Shigella flexneri 2a str. 301
cagugcuucgcggac

SEQ ID NO: 2018130 - RNA, 21 nt, Shigella flexneri 2a str. 301
cagugaacgcccccucacccu

SEQ ID NO: 2018131 - RNA, 21 nt, Shigella flexneri 2a str. 301
cagugaagucgggcagaaugc

SEQ ID NO: 2018132 - RNA, 22 nt, Shigella flexneri 2a str. 301
cagugaagucgggcagaaugcc

SEQ ID NO: 2018133 - RNA, 14 nt, Shigella flexneri 2a str. 301
cagucuucccagcc

SEQ ID NO: 2018134 - RNA, 19 nt, Shigella flexneri 2a str. 301
cagucuucaucauccucuu

SEQ ID NO: 2018135 - RNA, 13 nt, Shigella flexneri 2a str. 301
cagugaaaguuuu

SEQ ID NO: 2018136 - RNA, 13 nt, Shigella flexneri 2a str. 301
cagucuuccugcg

SEQ ID NO: 2018137 - RNA, 20 nt, Shigella flexneri 2a str. 301
cagugacuuccgucccagcc

SEQ ID NO: 2018138 - RNA, 14 nt, Shigella flexneri 2a str. 301
cagugauaacucaa

SEQ ID NO: 2018139 - RNA, 14 nt, Shigella flexneri 2a str. 301
cagugauauauuuu

SEQ ID NO: 2018140 - RNA, 20 nt, Shigella flexneri 2a str. 301
cagugauauauuuuuaaaua

SEQ ID NO: 2018141 - RNA, 16 nt, Shigella flexneri 2a str. 301
cagugcaccggacacu

SEQ ID NO: 2018142 - RNA, 22 nt, Shigella flexneri 2a str. 301
cagugacagguugcucauaaaa

SEQ ID NO: 2018143 - RNA, 14 nt, Shigella flexneri 2a str. 301
cagugaccaccguc

SEQ ID NO: 2018144 - RNA, 22 nt, Shigella flexneri 2a str. 301
cagugaccaccgucccaguaau

SEQ ID NO: 2018145 - RNA, 23 nt, Shigella flexneri 2a str. 301
cagugaccaccgucccaguaauu

SEQ ID NO: 2018146 - RNA, 21 nt, Shigella flexneri 2a str. 301
cagugaccaucuuccagcauc

SEQ ID NO: 2018147 - RNA, 20 nt, Shigella flexneri 2a str. 301
cagugaccgaaccuguuuuc

SEQ ID NO: 2018148 - RNA, 16 nt, Shigella flexneri 2a str. 301
cagucaccagcaucag

SEQ ID NO: 2018149 - RNA, 14 nt, Shigella flexneri 2a str. 301
caguauacgccaca

SEQ ID NO: 2018150 - RNA, 16 nt, Shigella flexneri 2a str. 301
caguagucgauaacga

SEQ ID NO: 2018151 - RNA, 16 nt, Shigella flexneri 2a str. 301
caguaguucauccagu

SEQ ID NO: 2018152 - RNA, 19 nt, Shigella flexneri 2a str. 301
caguaguucgagaaucgca

SEQ ID NO: 2018153 - RNA, 15 nt, Shigella flexneri 2a str. 301
caguagacagcaaag

SEQ ID NO: 2018154 - RNA, 18 nt, Shigella flexneri 2a str. 301
caguaagcaguccagcgc

SEQ ID NO: 2018155 - RNA, 21 nt, Shigella flexneri 2a str. 301
caguaagcugugcgauagcaa

SEQ ID NO: 2018156 - RNA, 19 nt, Shigella flexneri 2a str. 301
caguaagggaucacgcggu

SEQ ID NO: 2018157 - RNA, 20 nt, Shigella flexneri 2a str. 301
caguaaggucaucaaucauu

SEQ ID NO: 2018158 - RNA, 17 nt, Shigella flexneri 2a str. 301
caguaauaccagaccuu

SEQ ID NO: 2018159 - RNA, 16 nt, Shigella flexneri 2a str. 301
caguaaacgcuuuuuu

SEQ ID NO: 2018160 - RNA, 23 nt, Shigella flexneri 2a str. 301
caguaccgccgccauaaacagca

SEQ ID NO: 2018161 - RNA, 22 nt, Shigella flexneri 2a str. 301
caguaccgccgccauaaacagc

SEQ ID NO: 2018162 - RNA, 14 nt, Shigella flexneri 2a str. 301
caguaccagcagcg

SEQ ID NO: 2018163 - RNA, 20 nt, Shigella flexneri 2a str. 301
caguaccauuuucgcuggca

SEQ ID NO: 2018164 - RNA, 16 nt, Shigella flexneri 2a str. 301
caguacaguaccgaac

SEQ ID NO: 2018165 - RNA, 13 nt, Shigella flexneri 2a str. 301
cagguugcucaua

SEQ ID NO: 2018166 - RNA, 17 nt, Shigella flexneri 2a str. 301
caguaaaccgucagcac

SEQ ID NO: 2018167 - RNA, 15 nt, Shigella flexneri 2a str. 301
cagguugcccagcgc

SEQ ID NO: 2018168 - RNA, 18 nt, Shigella flexneri 2a str. 301
cagguugcccagcgcgcc

SEQ ID NO: 2018169 - RNA, 21 nt, Shigella flexneri 2a str. 301
cagguugcccagcgcgccgcc

SEQ ID NO: 2018170 - RNA, 22 nt, Shigella flexneri 2a str. 301
caggugucuaacccgcgacugg

SEQ ID NO: 2018171 - RNA, 22 nt, Shigella flexneri 2a str. 301
cagguaaagaccauaaauaugg

SEQ ID NO: 2018172 - RNA, 15 nt, Shigella flexneri 2a str. 301
cagguaacagggaac

SEQ ID NO: 2018173 - RNA, 19 nt, Shigella flexneri 2a str. 301
cagguaaacaccuucaucc

SEQ ID NO: 2018174 - RNA, 17 nt, Shigella flexneri 2a str. 301
caggguugcagacccgc

SEQ ID NO: 2018175 - RNA, 15 nt, Shigella flexneri 2a str. 301
caggguugcagaccc

SEQ ID NO: 2018176 - RNA, 19 nt, Shigella flexneri 2a str. 301
cagguggcguuugccaccu

SEQ ID NO: 2018177 - RNA, 15 nt, Shigella flexneri 2a str. 301
caggugcgccagcga

SEQ ID NO: 2018178 - RNA, 14 nt, Shigella flexneri 2a str. 301
cauaaccaguccau

SEQ ID NO: 2018179 - RNA, 13 nt, Shigella flexneri 2a str. 301
cauaaccagucca

SEQ ID NO: 2018180 - RNA, 16 nt, Shigella flexneri 2a str. 301
cauaaccaacaauugu

SEQ ID NO: 2018181 - RNA, 14 nt, Shigella flexneri 2a str. 301
cauaaccccaccag

SEQ ID NO: 2018182 - RNA, 16 nt, Shigella flexneri 2a str. 301
cauaaccccaccagca

SEQ ID NO: 2018183 - RNA, 22 nt, Shigella flexneri 2a str. 301
cauaaccgcgaccacaguauca

SEQ ID NO: 2018184 - RNA, 22 nt, Shigella flexneri 2a str. 301
cauaaauuucugccauuuugcu

SEQ ID NO: 2018185 - RNA, 11 nt, Shigella flexneri 2a str. 301
cauaacagaau

SEQ ID NO: 2018186 - RNA, 14 nt, Shigella flexneri 2a str. 301
cauaacagauaaau

SEQ ID NO: 2018187 - RNA, 18 nt, Shigella flexneri 2a str. 301
cauaacacagguaacuua

SEQ ID NO: 2018188 - RNA, 21 nt, Shigella flexneri 2a str. 301
cauaacacaauaccuucugcg

SEQ ID NO: 2018189 - RNA, 16 nt, Shigella flexneri 2a str. 301
cauaaaucagaucgac

SEQ ID NO: 2018190 - RNA, 17 nt, Shigella flexneri 2a str. 301
cauaaauccaacaacac

SEQ ID NO: 2018191 - RNA, 18 nt, Shigella flexneri 2a str. 301
cauaaauccaacaacaca

SEQ ID NO: 2018192 - RNA, 12 nt, Shigella flexneri 2a str. 301
cauaaaaccagc

SEQ ID NO: 2018193 - RNA, 13 nt, Shigella flexneri 2a str. 301
cauaaacagcagg

SEQ ID NO: 2018194 - RNA, 10 nt, Shigella flexneri 2a str. 301
cauaaacagg

SEQ ID NO: 2018195 - RNA, 17 nt, Shigella flexneri 2a str. 301
cauaaacugagccaaac

SEQ ID NO: 2018196 - RNA, 15 nt, Shigella flexneri 2a str. 301
cauaaauacagagca

SEQ ID NO: 2018197 - RNA, 17 nt, Shigella flexneri 2a str. 301
caguuuaaccgggagau

SEQ ID NO: 2018198 - RNA, 18 nt, Shigella flexneri 2a str. 301
caguuaaccugcuccuca

SEQ ID NO: 2018199 - RNA, 15 nt, Shigella flexneri 2a str. 301
caguucuucaaaaau

SEQ ID NO: 2018200 - RNA, 18 nt, Shigella flexneri 2a str. 301
caguucuggaagagauga

SEQ ID NO: 2018201 - RNA, 20 nt, Shigella flexneri 2a str. 301
caguucuggcaccggacgcu

SEQ ID NO: 2018202 - RNA, 22 nt, Shigella flexneri 2a str. 301
caguucuggcaccggacgcuug

SEQ ID NO: 2018203 - RNA, 13 nt, Shigella flexneri 2a str. 301
caguucugcagcg

SEQ ID NO: 2018204 - RNA, 21 nt, Shigella flexneri 2a str. 301
caguuaacgcggauccccugc

SEQ ID NO: 2018205 - RNA, 22 nt, Shigella flexneri 2a str. 301
caguuaaccugcuccucaguuu

SEQ ID NO: 2018206 - RNA, 13 nt, Shigella flexneri 2a str. 301
caguucuucucaa

SEQ ID NO: 2018207 - RNA, 17 nt, Shigella flexneri 2a str. 301
caguucuuccaguuccg

SEQ ID NO: 2018208 - RNA, 21 nt, Shigella flexneri 2a str. 301
caguugaccugcgaccggcgu

SEQ ID NO: 2018209 - RNA, 16 nt, Shigella flexneri 2a str. 301
caguugauucgcgcgu

SEQ ID NO: 2018210 - RNA, 21 nt, Shigella flexneri 2a str. 301
caguugaugaaucugcuucgc

SEQ ID NO: 2018211 - RNA, 19 nt, Shigella flexneri 2a str. 301
caguugcagcaagccaucg

SEQ ID NO: 2018212 - RNA, 14 nt, Shigella flexneri 2a str. 301
caguugcauaauuu

SEQ ID NO: 2018213 - RNA, 18 nt, Shigella flexneri 2a str. 301
caguugcauaauuucuuc

SEQ ID NO: 2018214 - RNA, 21 nt, Shigella flexneri 2a str. 301
caguugcaucgucuguuuuau

SEQ ID NO: 2018215 - RNA, 21 nt, Shigella flexneri 2a str. 301
caguugcggcuuauucauuac

SEQ ID NO: 2018216 - RNA, 14 nt, Shigella flexneri 2a str. 301
caguugcuucaucu

SEQ ID NO: 2018217 - RNA, 12 nt, Shigella flexneri 2a str. 301
caguugcuucau

SEQ ID NO: 2018218 - RNA, 20 nt, Shigella flexneri 2a str. 301
caguuggaugcugcauauga

SEQ ID NO: 2018219 - RNA, 14 nt, Shigella flexneri 2a str. 301
caguugcugcguga

SEQ ID NO: 2018220 - RNA, 14 nt, Shigella flexneri 2a str. 301
caguuguugcugcc

SEQ ID NO: 2018221 - RNA, 13 nt, Shigella flexneri 2a str. 301
caguuguugcuga

SEQ ID NO: 2018222 - RNA, 22 nt, Shigella flexneri 2a str. 301
caguuguugcauaggaauuucu

SEQ ID NO: 2018223 - RNA, 20 nt, Shigella flexneri 2a str. 301
caguugucagcccuuuuuca

SEQ ID NO: 2018224 - RNA, 20 nt, Shigella flexneri 2a str. 301
caguugguuagagcacauca

SEQ ID NO: 2018225 - RNA, 20 nt, Shigella flexneri 2a str. 301
caguugguagguccagccgc

SEQ ID NO: 2018226 - RNA, 21 nt, Shigella flexneri 2a str. 301
caguuggcagaauuugaggaa

SEQ ID NO: 2018227 - RNA, 14 nt, Shigella flexneri 2a str. 301
caguuggcugacaa

SEQ ID NO: 2018228 - RNA, 15 nt, Shigella flexneri 2a str. 301
caguuggcugacaaa

SEQ ID NO: 2018229 - RNA, 22 nt, Shigella flexneri 2a str. 301
cauaacuccccgagaaauacug

SEQ ID NO: 2018230 - RNA, 21 nt, Shigella flexneri 2a str. 301
cauaaucgggaugcguaacag

SEQ ID NO: 2018231 - RNA, 22 nt, Shigella flexneri 2a str. 301
cauaaugauggggucacagguu

SEQ ID NO: 2018232 - RNA, 19 nt, Shigella flexneri 2a str. 301
cauaacucuccuguuuaau

SEQ ID NO: 2018233 - RNA, 15 nt, Shigella flexneri 2a str. 301
cauaacuccccgaga

SEQ ID NO: 2018234 - RNA, 15 nt, Shigella flexneri 2a str. 301
cauaacucaccauca

SEQ ID NO: 2018235 - RNA, 22 nt, Shigella flexneri 2a str. 301
cauacaugguuugaucgcuaag

SEQ ID NO: 2018236 - RNA, 17 nt, Shigella flexneri 2a str. 301
cauacauaaaaaagccg

SEQ ID NO: 2018237 - RNA, 15 nt, Shigella flexneri 2a str. 301
cauacagcggacagc

SEQ ID NO: 2018238 - RNA, 16 nt, Shigella flexneri 2a str. 301
cauacccggaaguaaa

SEQ ID NO: 2018239 - RNA, 21 nt, Shigella flexneri 2a str. 301
cauacccgccagugcugaagg

SEQ ID NO: 2018240 - RNA, 21 nt, Shigella flexneri 2a str. 301
cauacccaacguaacaaaacu

SEQ ID NO: 2018241 - RNA, 22 nt, Shigella flexneri 2a str. 301
cauaccuuccacuuucacgccc

SEQ ID NO: 2018242 - RNA, 20 nt, Shigella flexneri 2a str. 301
cauacgcguaaaacagccag

SEQ ID NO: 2018243 - RNA, 19 nt, Shigella flexneri 2a str. 301
cauacgcguaaaacagcca

SEQ ID NO: 2018244 - RNA, 18 nt, Shigella flexneri 2a str. 301
cauacggguuuuccccuu

SEQ ID NO: 2018245 - RNA, 18 nt, Shigella flexneri 2a str. 301
cauaccuccgcaauaugc

SEQ ID NO: 2018246 - RNA, 13 nt, Shigella flexneri 2a str. 301
cauaccugagugg

SEQ ID NO: 2018247 - RNA, 16 nt, Shigella flexneri 2a str. 301
cauaccuaaaaaaucc

SEQ ID NO: 2018248 - RNA, 16 nt, Shigella flexneri 2a str. 301
cauacucagcgccugc

SEQ ID NO: 2018249 - RNA, 15 nt, Shigella flexneri 2a str. 301
cauacguugcauaaa

SEQ ID NO: 2018250 - RNA, 17 nt, Shigella flexneri 2a str. 301
cauacguuucaccagca

SEQ ID NO: 2018251 - RNA, 16 nt, Shigella flexneri 2a str. 301
cauacguacaaacgcu

SEQ ID NO: 2018252 - RNA, 21 nt, Shigella flexneri 2a str. 301
cauacguacaaacgcuuuacu

SEQ ID NO: 2018253 - RNA, 22 nt, Shigella flexneri 2a str. 301
cauacguacaaacgcuuuacuc

SEQ ID NO: 2018254 - RNA, 21 nt, Shigella flexneri 2a str. 301
cauacugggggcacugaaagc

SEQ ID NO: 2018255 - RNA, 16 nt, Shigella flexneri 2a str. 301
cauacugucuccacua

SEQ ID NO: 2018256 - RNA, 17 nt, Shigella flexneri 2a str. 301
cauacuuaaauaaugcu

SEQ ID NO: 2018257 - RNA, 14 nt, Shigella flexneri 2a str. 301
cauacuuauuauga

SEQ ID NO: 2018258 - RNA, 16 nt, Shigella flexneri 2a str. 301
cauacuuccacgcaga

SEQ ID NO: 2018259 - RNA, 12 nt, Shigella flexneri 2a str. 301
cauacugacgga

SEQ ID NO: 2018260 - RNA, 19 nt, Shigella flexneri 2a str. 301
cauacucuuugacaacauc

SEQ ID NO: 2018261 - RNA, 14 nt, Shigella flexneri 2a str. 301
cauacucuuugaca

SEQ ID NO: 2018262 - RNA, 19 nt, Shigella flexneri 2a str. 301
cauacucuuucccggcaau

SEQ ID NO: 2018263 - RNA, 13 nt, Shigella flexneri 2a str. 301
cauacucuuucca

SEQ ID NO: 2018264 - RNA, 16 nt, Shigella flexneri 2a str. 301
caugcguuuguaggcg

SEQ ID NO: 2018265 - RNA, 15 nt, Shigella flexneri 2a str. 301
caugcgcucucccau

SEQ ID NO: 2018266 - RNA, 17 nt, Shigella flexneri 2a str. 301
caugcgcucucccaugg

SEQ ID NO: 2018267 - RNA, 17 nt, Shigella flexneri 2a str. 301
caugcggguauucaucc

SEQ ID NO: 2018268 - RNA, 17 nt, Shigella flexneri 2a str. 301
cauggacauacgcaccu

SEQ ID NO: 2018269 - RNA, 16 nt, Shigella flexneri 2a str. 301
cauggaaaccaucauc

SEQ ID NO: 2018270 - RNA, 16 nt, Shigella flexneri 2a str. 301
cauggagaacgccugu

SEQ ID NO: 2018271 - RNA, 16 nt, Shigella flexneri 2a str. 301
cauggauacauuccac

SEQ ID NO: 2018272 - RNA, 19 nt, Shigella flexneri 2a str. 301
caugggugccagauacaaa

SEQ ID NO: 2018273 - RNA, 16 nt, Shigella flexneri 2a str. 301
caugggguuuuucgag

SEQ ID NO: 2018274 - RNA, 19 nt, Shigella flexneri 2a str. 301
cauggggaugcugaaaaga

SEQ ID NO: 2018275 - RNA, 14 nt, Shigella flexneri 2a str. 301
cauggcaagaauaa

SEQ ID NO: 2018276 - RNA, 16 nt, Shigella flexneri 2a str. 301
cauggcaacuaacuga

SEQ ID NO: 2018277 - RNA, 23 nt, Shigella flexneri 2a str. 301
caugcgaauacacccugaacuga

SEQ ID NO: 2018278 - RNA, 23 nt, Shigella flexneri 2a str. 301
caugcgaucccacgccgaaugcc

SEQ ID NO: 2018279 - RNA, 16 nt, Shigella flexneri 2a str. 301
caugccgugaugcgca

SEQ ID NO: 2018280 - RNA, 17 nt, Shigella flexneri 2a str. 301
caugccugcauaaagga

SEQ ID NO: 2018281 - RNA, 23 nt, Shigella flexneri 2a str. 301
caugcccgcgcaaaccaccuggc

SEQ ID NO: 2018282 - RNA, 17 nt, Shigella flexneri 2a str. 301
caugcccggcauccggg

SEQ ID NO: 2018283 - RNA, 17 nt, Shigella flexneri 2a str. 301
caugaaagcgaugcuga

SEQ ID NO: 2018284 - RNA, 14 nt, Shigella flexneri 2a str. 301
caugaaacagaaaa

SEQ ID NO: 2018285 - RNA, 12 nt, Shigella flexneri 2a str. 301
caugauuucugc

SEQ ID NO: 2018286 - RNA, 14 nt, Shigella flexneri 2a str. 301
caugaaaugaaaau

SEQ ID NO: 2018287 - RNA, 15 nt, Shigella flexneri 2a str. 301
caugaaauaaaaaua

SEQ ID NO: 2018288 - RNA, 15 nt, Shigella flexneri 2a str. 301
caugcaacgucauca

SEQ ID NO: 2018289 - RNA, 12 nt, Shigella flexneri 2a str. 301
caugcacccuca

SEQ ID NO: 2018290 - RNA, 12 nt, Shigella flexneri 2a str. 301
cauguugcugac

SEQ ID NO: 2018291 - RNA, 17 nt, Shigella flexneri 2a str. 301
cauguuguacaugcugc

SEQ ID NO: 2018292 - RNA, 13 nt, Shigella flexneri 2a str. 301
cauguugccuggg

SEQ ID NO: 2018293 - RNA, 18 nt, Shigella flexneri 2a str. 301
cauguuuaccaucugcgc

SEQ ID NO: 2018294 - RNA, 22 nt, Shigella flexneri 2a str. 301
cauguuuuccagcacauauuca

SEQ ID NO: 2018295 - RNA, 15 nt, Shigella flexneri 2a str. 301
cauuaaaguuaucgc

SEQ ID NO: 2018296 - RNA, 12 nt, Shigella flexneri 2a str. 301
cauuaaaauucu

SEQ ID NO: 2018297 - RNA, 16 nt, Shigella flexneri 2a str. 301
cauuaaaauucuuacg

SEQ ID NO: 2018298 - RNA, 14 nt, Shigella flexneri 2a str. 301
cauuaaaccagugc

SEQ ID NO: 2018299 - RNA, 20 nt, Shigella flexneri 2a str. 301
cauuaaaacugauacgucau

SEQ ID NO: 2018300 - RNA, 16 nt, Shigella flexneri 2a str. 301
caugugcuuuuguuau

SEQ ID NO: 2018301 - RNA, 18 nt, Shigella flexneri 2a str. 301
cauguuccugccagucuu

SEQ ID NO: 2018302 - RNA, 20 nt, Shigella flexneri 2a str. 301
caugugcaggauuaauaaau

SEQ ID NO: 2018303 - RNA, 23 nt, Shigella flexneri 2a str. 301
cauggugaauaucaguuauuaca

SEQ ID NO: 2018304 - RNA, 21 nt, Shigella flexneri 2a str. 301
caugguguucagauggccaau

SEQ ID NO: 2018305 - RNA, 23 nt, Shigella flexneri 2a str. 301
caugguggaaaucgaacuucccg

SEQ ID NO: 2018306 - RNA, 13 nt, Shigella flexneri 2a str. 301
cauggugucacca

SEQ ID NO: 2018307 - RNA, 14 nt, Shigella flexneri 2a str. 301
cauuaccgaacaac

SEQ ID NO: 2018308 - RNA, 16 nt, Shigella flexneri 2a str. 301
cauuaccgaacaacaa

SEQ ID NO: 2018309 - RNA, 14 nt, Shigella flexneri 2a str. 301
cauuaccacgauuu

SEQ ID NO: 2018310 - RNA, 18 nt, Shigella flexneri 2a str. 301
cauuaccacgauuuugac

SEQ ID NO: 2018311 - RNA, 11 nt, Shigella flexneri 2a str. 301
cauuagcccaa

SEQ ID NO: 2018312 - RNA, 15 nt, Shigella flexneri 2a str. 301
cauuacuuacacauc

SEQ ID NO: 2018313 - RNA, 18 nt, Shigella flexneri 2a str. 301
cauuaauuuccugauggc

SEQ ID NO: 2018314 - RNA, 14 nt, Shigella flexneri 2a str. 301
cauuacaaccgcug

SEQ ID NO: 2018315 - RNA, 18 nt, Shigella flexneri 2a str. 301
cauuacaagcccgcugcc

SEQ ID NO: 2018316 - RNA, 13 nt, Shigella flexneri 2a str. 301
cauuacaagcccg

SEQ ID NO: 2018317 - RNA, 18 nt, Shigella flexneri 2a str. 301
cauuacaagaaucaugcc

SEQ ID NO: 2018318 - RNA, 17 nt, Shigella flexneri 2a str. 301
cauuacaagaaucaugc

SEQ ID NO: 2018319 - RNA, 19 nt, Shigella flexneri 2a str. 301
cauuacaccaauaccgccc

SEQ ID NO: 2018320 - RNA, 13 nt, Shigella flexneri 2a str. 301
cauuaagaugcau

SEQ ID NO: 2018321 - RNA, 21 nt, Shigella flexneri 2a str. 301
cauuaagauuaccuuccucaa

SEQ ID NO: 2018322 - RNA, 15 nt, Shigella flexneri 2a str. 301
cauuaacuccagcuc

SEQ ID NO: 2018323 - RNA, 18 nt, Shigella flexneri 2a str. 301
cauuaacaggugucacau

SEQ ID NO: 2018324 - RNA, 23 nt, Shigella flexneri 2a str. 301
cauuaaugccguuauacaucgcu

SEQ ID NO: 2018325 - RNA, 21 nt, Shigella flexneri 2a str. 301
cauuaaucgauaaaccagcaa

SEQ ID NO: 2018326 - RNA, 17 nt, Shigella flexneri 2a str. 301
cauuaaggucauaucuu

SEQ ID NO: 2018327 - RNA, 14 nt, Shigella flexneri 2a str. 301
cauuuuucaugauc

SEQ ID NO: 2018328 - RNA, 19 nt, Shigella flexneri 2a str. 301
cauuuuucagcguucccca

SEQ ID NO: 2018329 - RNA, 20 nt, Shigella flexneri 2a str. 301
cauuuuucggcgucagaacu

SEQ ID NO: 2018330 - RNA, 20 nt, Shigella flexneri 2a str. 301
cauuuuuucacauguucauu

SEQ ID NO: 2018331 - RNA, 19 nt, Shigella flexneri 2a str. 301
cauuuugagggaaacggag

SEQ ID NO: 2018332 - RNA, 18 nt, Shigella flexneri 2a str. 301
cauuuugccgguucccaa

SEQ ID NO: 2018333 - RNA, 18 nt, Shigella flexneri 2a str. 301
cauuuuggacaaugcagu

SEQ ID NO: 2018334 - RNA, 15 nt, Shigella flexneri 2a str. 301
cauuuuguuauuuau

SEQ ID NO: 2018335 - RNA, 21 nt, Shigella flexneri 2a str. 301
cauuuucauccauuaccaguc

SEQ ID NO: 2018336 - RNA, 16 nt, Shigella flexneri 2a str. 301
cauuuuaaucaucuga

SEQ ID NO: 2018337 - RNA, 14 nt, Shigella flexneri 2a str. 301
cauuuuacguugca

SEQ ID NO: 2018338 - RNA, 19 nt, Shigella flexneri 2a str. 301
cauuuuacguugcauuucc

SEQ ID NO: 2018339 - RNA, 19 nt, Shigella flexneri 2a str. 301
cauuuggcggggauuuuuu

SEQ ID NO: 2018340 - RNA, 21 nt, Shigella flexneri 2a str. 301
cauuuggauugauaauuguua

SEQ ID NO: 2018341 - RNA, 14 nt, Shigella flexneri 2a str. 301
cauuugcaccgauu

SEQ ID NO: 2018342 - RNA, 19 nt, Shigella flexneri 2a str. 301
cauuugcuccagacgccag

SEQ ID NO: 2018343 - RNA, 15 nt, Shigella flexneri 2a str. 301
cauuugugacauuaa

SEQ ID NO: 2018344 - RNA, 17 nt, Shigella flexneri 2a str. 301
cauuuaacccuucaaga

SEQ ID NO: 2018345 - RNA, 23 nt, Shigella flexneri 2a str. 301
cauuucuuacuguagugcuccca

SEQ ID NO: 2018346 - RNA, 13 nt, Shigella flexneri 2a str. 301
cauuuacagaaac

SEQ ID NO: 2018347 - RNA, 13 nt, Shigella flexneri 2a str. 301
cauuuaauuuaac

SEQ ID NO: 2018348 - RNA, 14 nt, Shigella flexneri 2a str. 301
cauuugauucacaa

SEQ ID NO: 2018349 - RNA, 12 nt, Shigella flexneri 2a str. 301
cauuugcacaag

SEQ ID NO: 2018350 - RNA, 15 nt, Shigella flexneri 2a str. 301
cauugagguugaucu

SEQ ID NO: 2018351 - RNA, 21 nt, Shigella flexneri 2a str. 301
cauugagucccaucuuuuuaa

SEQ ID NO: 2018352 - RNA, 19 nt, Shigella flexneri 2a str. 301
cauugagcuggucugaauc

SEQ ID NO: 2018353 - RNA, 14 nt, Shigella flexneri 2a str. 301
cauugaguuuacgc

SEQ ID NO: 2018354 - RNA, 23 nt, Shigella flexneri 2a str. 301
cauugaguuugaugaccagauca

SEQ ID NO: 2018355 - RNA, 14 nt, Shigella flexneri 2a str. 301
cauugacguuccuu

SEQ ID NO: 2018356 - RNA, 14 nt, Shigella flexneri 2a str. 301
cauugagauagcau

SEQ ID NO: 2018357 - RNA, 23 nt, Shigella flexneri 2a str. 301
cauugagcuugcguguuuuauau

SEQ ID NO: 2018358 - RNA, 22 nt, Shigella flexneri 2a str. 301
cauucuuaccgggucgcacugg

SEQ ID NO: 2018359 - RNA, 15 nt, Shigella flexneri 2a str. 301
cauucugcgcugacu

SEQ ID NO: 2018360 - RNA, 18 nt, Shigella flexneri 2a str. 301
cauucugcuggccuggcu

SEQ ID NO: 2018361 - RNA, 14 nt, Shigella flexneri 2a str. 301
cauugaccagauca

SEQ ID NO: 2018362 - RNA, 15 nt, Shigella flexneri 2a str. 301
cauugaccagcugcc

SEQ ID NO: 2018363 - RNA, 14 nt, Shigella flexneri 2a str. 301
cauuaucagagauu

SEQ ID NO: 2018364 - RNA, 23 nt, Shigella flexneri 2a str. 301
cauuaucacaucagcgcauuuac

SEQ ID NO: 2018365 - RNA, 19 nt, Shigella flexneri 2a str. 301
cauuaugagauugagcgau

SEQ ID NO: 2018366 - RNA, 18 nt, Shigella flexneri 2a str. 301
cauucucgcgacccauga

SEQ ID NO: 2018367 - RNA, 12 nt, Shigella flexneri 2a str. 301
cauucuccgagg

SEQ ID NO: 2018368 - RNA, 17 nt, Shigella flexneri 2a str. 301
cauucguucuucagacu

SEQ ID NO: 2018369 - RNA, 22 nt, Shigella flexneri 2a str. 301
cauucuacuuugcgagucugcu

SEQ ID NO: 2018370 - RNA, 20 nt, Shigella flexneri 2a str. 301
cauuuaaacaauuucagaau

SEQ ID NO: 2018371 - RNA, 15 nt, Shigella flexneri 2a str. 301
cauuuaaaaagaaaa

SEQ ID NO: 2018372 - RNA, 20 nt, Shigella flexneri 2a str. 301
cauugugguucucaauuaca

SEQ ID NO: 2018373 - RNA, 16 nt, Shigella flexneri 2a str. 301
cauuggcagccagcau

SEQ ID NO: 2018374 - RNA, 18 nt, Shigella flexneri 2a str. 301
cauuggagaguugaaagc

SEQ ID NO: 2018375 - RNA, 18 nt, Shigella flexneri 2a str. 301
cauugcaaccacacaggc

SEQ ID NO: 2018376 - RNA, 14 nt, Shigella flexneri 2a str. 301
cauugcaacguggu

SEQ ID NO: 2018377 - RNA, 15 nt, Shigella flexneri 2a str. 301
cauugccgccucugc

SEQ ID NO: 2018378 - RNA, 20 nt, Shigella flexneri 2a str. 301
cauugaugcguuagaugaug

SEQ ID NO: 2018379 - RNA, 16 nt, Shigella flexneri 2a str. 301
cauugauauacagccc

SEQ ID NO: 2018380 - RNA, 21 nt, Shigella flexneri 2a str. 301
cauugccgggcgcaucagauc

SEQ ID NO: 2018381 - RNA, 20 nt, Shigella flexneri 2a str. 301
cauugccggugauugcaaag

SEQ ID NO: 2018382 - RNA, 21 nt, Shigella flexneri 2a str. 301
cauugccugaucgcgcaaaca

SEQ ID NO: 2018383 - RNA, 12 nt, Shigella flexneri 2a str. 301
cauugccugaug

SEQ ID NO: 2018384 - RNA, 11 nt, Shigella flexneri 2a str. 301
cauugccuggc

SEQ ID NO: 2018385 - RNA, 17 nt, Shigella flexneri 2a str. 301
cauugcgacgagaaaau

SEQ ID NO: 2018386 - RNA, 21 nt, Shigella flexneri 2a str. 301
cauugcugcugaagcaacagu

SEQ ID NO: 2018387 - RNA, 13 nt, Shigella flexneri 2a str. 301
cauugcuguauca

SEQ ID NO: 2018388 - RNA, 23 nt, Shigella flexneri 2a str. 301
cauugcuguaucacuaugaaaau

SEQ ID NO: 2018389 - RNA, 20 nt, Shigella flexneri 2a str. 301
cauaugcagcauccaacuga

SEQ ID NO: 2018390 - RNA, 17 nt, Shigella flexneri 2a str. 301
cauaugauucauauugc

SEQ ID NO: 2018391 - RNA, 13 nt, Shigella flexneri 2a str. 301
cauaugccccugu

SEQ ID NO: 2018392 - RNA, 14 nt, Shigella flexneri 2a str. 301
cauaugcaucagau

SEQ ID NO: 2018393 - RNA, 13 nt, Shigella flexneri 2a str. 301
cauauguuuacgc

SEQ ID NO: 2018394 - RNA, 17 nt, Shigella flexneri 2a str. 301
cauauggaagaaacgcu

SEQ ID NO: 2018395 - RNA, 20 nt, Shigella flexneri 2a str. 301
cauauaaccggcaacagaac

SEQ ID NO: 2018396 - RNA, 19 nt, Shigella flexneri 2a str. 301
cauauaaccggcaacagaa

SEQ ID NO: 2018397 - RNA, 18 nt, Shigella flexneri 2a str. 301
cauauaguggguaacaau

SEQ ID NO: 2018398 - RNA, 18 nt, Shigella flexneri 2a str. 301
cauaucacccuuuucugc

SEQ ID NO: 2018399 - RNA, 21 nt, Shigella flexneri 2a str. 301
cauauucaccacgaaaccgac

SEQ ID NO: 2018400 - RNA, 23 nt, Shigella flexneri 2a str. 301
cauauucaccacgaaaccgacug

SEQ ID NO: 2018401 - RNA, 16 nt, Shigella flexneri 2a str. 301
cauauuugugagcuac

SEQ ID NO: 2018402 - RNA, 22 nt, Shigella flexneri 2a str. 301
cauauuuuucauauuuuacauc

SEQ ID NO: 2018403 - RNA, 14 nt, Shigella flexneri 2a str. 301
caucaaacaacggc

SEQ ID NO: 2018404 - RNA, 17 nt, Shigella flexneri 2a str. 301
caucaaacaacggcacu

SEQ ID NO: 2018405 - RNA, 12 nt, Shigella flexneri 2a str. 301
caucaaccagca

SEQ ID NO: 2018406 - RNA, 14 nt, Shigella flexneri 2a str. 301
caucaaccaacacc

SEQ ID NO: 2018407 - RNA, 21 nt, Shigella flexneri 2a str. 301
caucaaccaacaccuguucca

SEQ ID NO: 2018408 - RNA, 14 nt, Shigella flexneri 2a str. 301
caucaaacccuucc

SEQ ID NO: 2018409 - RNA, 23 nt, Shigella flexneri 2a str. 301
caucaccgaugcccucaauaucu

SEQ ID NO: 2018410 - RNA, 21 nt, Shigella flexneri 2a str. 301
caucaccgcaccacaccugau

SEQ ID NO: 2018411 - RNA, 23 nt, Shigella flexneri 2a str. 301
caucaauaccauuaucauugaga

SEQ ID NO: 2018412 - RNA, 17 nt, Shigella flexneri 2a str. 301
caucaccauugcaucga

SEQ ID NO: 2018413 - RNA, 16 nt, Shigella flexneri 2a str. 301
caucaccccgccgggc

SEQ ID NO: 2018414 - RNA, 14 nt, Shigella flexneri 2a str. 301
caucaaguagcagg

SEQ ID NO: 2018415 - RNA, 22 nt, Shigella flexneri 2a str. 301
caucaaguagcagguaaucugc

SEQ ID NO: 2018416 - RNA, 22 nt, Shigella flexneri 2a str. 301
caucaaguagcgcuuguaggaa

SEQ ID NO: 2018417 - RNA, 15 nt, Shigella flexneri 2a str. 301
caucaagucagaugc

SEQ ID NO: 2018418 - RNA, 17 nt, Shigella flexneri 2a str. 301
caucaagucauugauuc

SEQ ID NO: 2018419 - RNA, 20 nt, Shigella flexneri 2a str. 301
caucaacccgcccagugccg

SEQ ID NO: 2018420 - RNA, 18 nt, Shigella flexneri 2a str. 301
caucaagcuguucuuccc

SEQ ID NO: 2018421 - RNA, 18 nt, Shigella flexneri 2a str. 301
caucaagcugugccugaa

SEQ ID NO: 2018422 - RNA, 13 nt, Shigella flexneri 2a str. 301
caucaacugacua

SEQ ID NO: 2018423 - RNA, 17 nt, Shigella flexneri 2a str. 301
caucaacugaccgauuu

SEQ ID NO: 2018424 - RNA, 19 nt, Shigella flexneri 2a str. 301
caucaagauaaaccccuuu

SEQ ID NO: 2018425 - RNA, 13 nt, Shigella flexneri 2a str. 301
caucaucagauuc

SEQ ID NO: 2018426 - RNA, 20 nt, Shigella flexneri 2a str. 301
caucauccggcaccuuuuca

SEQ ID NO: 2018427 - RNA, 19 nt, Shigella flexneri 2a str. 301
caucauccggcaccuuuuc

SEQ ID NO: 2018428 - RNA, 13 nt, Shigella flexneri 2a str. 301
caucaucgcuuuc

SEQ ID NO: 2018429 - RNA, 17 nt, Shigella flexneri 2a str. 301
caucaucgcaaugauuu

SEQ ID NO: 2018430 - RNA, 15 nt, Shigella flexneri 2a str. 301
caucaucgcagauuu

SEQ ID NO: 2018431 - RNA, 16 nt, Shigella flexneri 2a str. 301
caucaucagaaaugcc

SEQ ID NO: 2018432 - RNA, 15 nt, Shigella flexneri 2a str. 301
caucaucacugccag

SEQ ID NO: 2018433 - RNA, 19 nt, Shigella flexneri 2a str. 301
caucauagacuucccuccc

SEQ ID NO: 2018434 - RNA, 19 nt, Shigella flexneri 2a str. 301
caucauaguggguuucugc

SEQ ID NO: 2018435 - RNA, 20 nt, Shigella flexneri 2a str. 301
caucauaucacccuuuucug

SEQ ID NO: 2018436 - RNA, 14 nt, Shigella flexneri 2a str. 301
caucauaauaauug

SEQ ID NO: 2018437 - RNA, 22 nt, Shigella flexneri 2a str. 301
caucauacccaacguaacaaaa

SEQ ID NO: 2018438 - RNA, 21 nt, Shigella flexneri 2a str. 301
caucauacgauggccaaccau

SEQ ID NO: 2018439 - RNA, 22 nt, Shigella flexneri 2a str. 301
caucaucuggcugugauccauu

SEQ ID NO: 2018440 - RNA, 19 nt, Shigella flexneri 2a str. 301
caucaucucugucgcugaa

SEQ ID NO: 2018441 - RNA, 17 nt, Shigella flexneri 2a str. 301
caucaugaauauauaau

SEQ ID NO: 2018442 - RNA, 14 nt, Shigella flexneri 2a str. 301
caucauucccgccc

SEQ ID NO: 2018443 - RNA, 23 nt, Shigella flexneri 2a str. 301
cauccaccuuaaaacaauauaac

SEQ ID NO: 2018444 - RNA, 17 nt, Shigella flexneri 2a str. 301
cauccaccgccacgccg

SEQ ID NO: 2018445 - RNA, 12 nt, Shigella flexneri 2a str. 301
caucagggcgcu

SEQ ID NO: 2018446 - RNA, 18 nt, Shigella flexneri 2a str. 301
caucagggcggccgccag

SEQ ID NO: 2018447 - RNA, 12 nt, Shigella flexneri 2a str. 301
caucaggggcag

SEQ ID NO: 2018448 - RNA, 17 nt, Shigella flexneri 2a str. 301
caucaggccuacaaaau

SEQ ID NO: 2018449 - RNA, 13 nt, Shigella flexneri 2a str. 301
caucaggcaucug

SEQ ID NO: 2018450 - RNA, 21 nt, Shigella flexneri 2a str. 301
caucaggcaucgugcaccaau

SEQ ID NO: 2018451 - RNA, 21 nt, Shigella flexneri 2a str. 301
caucaggcagauacaaccaau

SEQ ID NO: 2018452 - RNA, 16 nt, Shigella flexneri 2a str. 301
caucagugaacccaua

SEQ ID NO: 2018453 - RNA, 14 nt, Shigella flexneri 2a str. 301
caucagugccagua

SEQ ID NO: 2018454 - RNA, 15 nt, Shigella flexneri 2a str. 301
caucagucucaaacc

SEQ ID NO: 2018455 - RNA, 20 nt, Shigella flexneri 2a str. 301
caucagucucaaaccggcuc

SEQ ID NO: 2018456 - RNA, 17 nt, Shigella flexneri 2a str. 301
caucaguuucaaauggc

SEQ ID NO: 2018457 - RNA, 14 nt, Shigella flexneri 2a str. 301
caucauaaauaaga

SEQ ID NO: 2018458 - RNA, 22 nt, Shigella flexneri 2a str. 301
caucaguugcaccugauccagc

SEQ ID NO: 2018459 - RNA, 17 nt, Shigella flexneri 2a str. 301
caucagccagaugcacc

SEQ ID NO: 2018460 - RNA, 18 nt, Shigella flexneri 2a str. 301
caucagcaugacaaaaaa

SEQ ID NO: 2018461 - RNA, 22 nt, Shigella flexneri 2a str. 301
caucagcaugacaaaaaagcca

SEQ ID NO: 2018462 - RNA, 16 nt, Shigella flexneri 2a str. 301
caucacggcagccuga

SEQ ID NO: 2018463 - RNA, 21 nt, Shigella flexneri 2a str. 301
caucagcgauucauugaguaa

SEQ ID NO: 2018464 - RNA, 20 nt, Shigella flexneri 2a str. 301
caucagcgauucauugagua

SEQ ID NO: 2018465 - RNA, 15 nt, Shigella flexneri 2a str. 301
caucagcgccaccag

SEQ ID NO: 2018466 - RNA, 22 nt, Shigella flexneri 2a str. 301
caucacgccaauaauggccuuu

SEQ ID NO: 2018467 - RNA, 21 nt, Shigella flexneri 2a str. 301
caucacgaaaucccacauccu

SEQ ID NO: 2018468 - RNA, 13 nt, Shigella flexneri 2a str. 301
caucaccggcuuc

SEQ ID NO: 2018469 - RNA, 16 nt, Shigella flexneri 2a str. 301
caucuauagcacccgc

SEQ ID NO: 2018470 - RNA, 22 nt, Shigella flexneri 2a str. 301
caucuauagugaggcuauucca

SEQ ID NO: 2018471 - RNA, 12 nt, Shigella flexneri 2a str. 301
caucuauuauug

SEQ ID NO: 2018472 - RNA, 17 nt, Shigella flexneri 2a str. 301
caucuacgcucucuuca

SEQ ID NO: 2018473 - RNA, 23 nt, Shigella flexneri 2a str. 301
caucggcuuuggcaaauggcgcu

SEQ ID NO: 2018474 - RNA, 22 nt, Shigella flexneri 2a str. 301
caucgggaagaggaucugcucu

SEQ ID NO: 2018475 - RNA, 19 nt, Shigella flexneri 2a str. 301
caucgggcagcaucgccag

SEQ ID NO: 2018476 - RNA, 13 nt, Shigella flexneri 2a str. 301
caucgggaugcug

SEQ ID NO: 2018477 - RNA, 22 nt, Shigella flexneri 2a str. 301
caucgguaucuucccagccaau

SEQ ID NO: 2018478 - RNA, 16 nt, Shigella flexneri 2a str. 301
caucgguaucuuccca

SEQ ID NO: 2018479 - RNA, 19 nt, Shigella flexneri 2a str. 301
caucgguauaaccaaauga

SEQ ID NO: 2018480 - RNA, 16 nt, Shigella flexneri 2a str. 301
caucugccugauccug

SEQ ID NO: 2018481 - RNA, 13 nt, Shigella flexneri 2a str. 301
caucugcgccgcc

SEQ ID NO: 2018482 - RNA, 14 nt, Shigella flexneri 2a str. 301
caucugccccauug

SEQ ID NO: 2018483 - RNA, 17 nt, Shigella flexneri 2a str. 301
caucugccggaaccagc

SEQ ID NO: 2018484 - RNA, 19 nt, Shigella flexneri 2a str. 301
caucugcauggugccgcca

SEQ ID NO: 2018485 - RNA, 20 nt, Shigella flexneri 2a str. 301
caucugcguggcgcgcguca

SEQ ID NO: 2018486 - RNA, 21 nt, Shigella flexneri 2a str. 301
caucugaccacggccacagcc

SEQ ID NO: 2018487 - RNA, 13 nt, Shigella flexneri 2a str. 301
caucugaccagau

SEQ ID NO: 2018488 - RNA, 20 nt, Shigella flexneri 2a str. 301
caucugagcaugaugccuga

SEQ ID NO: 2018489 - RNA, 14 nt, Shigella flexneri 2a str. 301
caucugccacuucu

SEQ ID NO: 2018490 - RNA, 14 nt, Shigella flexneri 2a str. 301
caucucuucuuccg

SEQ ID NO: 2018491 - RNA, 13 nt, Shigella flexneri 2a str. 301
caucucuucuucc

SEQ ID NO: 2018492 - RNA, 15 nt, Shigella flexneri 2a str. 301
caucucgcucaaaaa

SEQ ID NO: 2018493 - RNA, 16 nt, Shigella flexneri 2a str. 301
caucuccuuacugccc

SEQ ID NO: 2018494 - RNA, 23 nt, Shigella flexneri 2a str. 301
caucuccuuacugcccccggcgu

SEQ ID NO: 2018495 - RNA, 23 nt, Shigella flexneri 2a str. 301
caucuccugcaacagguugcgcu

SEQ ID NO: 2018496 - RNA, 12 nt, Shigella flexneri 2a str. 301
caucuuccagca

SEQ ID NO: 2018497 - RNA, 13 nt, Shigella flexneri 2a str. 301
caucuuccagcgu

SEQ ID NO: 2018498 - RNA, 13 nt, Shigella flexneri 2a str. 301
caucuucacuuca

SEQ ID NO: 2018499 - RNA, 19 nt, Shigella flexneri 2a str. 301
caucuucacacugaugaca

SEQ ID NO: 2018500 - RNA, 17 nt, Shigella flexneri 2a str. 301
caucuucaacugccaug

SEQ ID NO: 2018501 - RNA, 19 nt, Shigella flexneri 2a str. 301
caucuuauccagcaaccag

SEQ ID NO: 2018502 - RNA, 19 nt, Shigella flexneri 2a str. 301
caucuuaacuucgcagcuu

SEQ ID NO: 2018503 - RNA, 21 nt, Shigella flexneri 2a str. 301
caucuguucugccguccagcc

SEQ ID NO: 2018504 - RNA, 20 nt, Shigella flexneri 2a str. 301
caucuguuucgaucagcaau

SEQ ID NO: 2018505 - RNA, 23 nt, Shigella flexneri 2a str. 301
caucuguucuuuuaacgcaugca

SEQ ID NO: 2018506 - RNA, 23 nt, Shigella flexneri 2a str. 301
caucugucaguggacgauaagca

SEQ ID NO: 2018507 - RNA, 15 nt, Shigella flexneri 2a str. 301
caucuggcugacggu

SEQ ID NO: 2018508 - RNA, 13 nt, Shigella flexneri 2a str. 301
caucuggaugaaa

SEQ ID NO: 2018509 - RNA, 15 nt, Shigella flexneri 2a str. 301
caucuuucagaauca

SEQ ID NO: 2018510 - RNA, 21 nt, Shigella flexneri 2a str. 301
caucuuuccaaaccucagagu

SEQ ID NO: 2018511 - RNA, 11 nt, Shigella flexneri 2a str. 301
caucuuuaacg

SEQ ID NO: 2018512 - RNA, 14 nt, Shigella flexneri 2a str. 301
caucuugauaccaa

SEQ ID NO: 2018513 - RNA, 22 nt, Shigella flexneri 2a str. 301
caucuucggcguuguaagguua

SEQ ID NO: 2018514 - RNA, 12 nt, Shigella flexneri 2a str. 301
caucuucuccac

SEQ ID NO: 2018515 - RNA, 16 nt, Shigella flexneri 2a str. 301
caucuucuccacgcca

SEQ ID NO: 2018516 - RNA, 15 nt, Shigella flexneri 2a str. 301
caucuucuccagcga

SEQ ID NO: 2018517 - RNA, 21 nt, Shigella flexneri 2a str. 301
caucuuccaguugcacgccac

SEQ ID NO: 2018518 - RNA, 12 nt, Shigella flexneri 2a str. 301
caucuucuucac

SEQ ID NO: 2018519 - RNA, 23 nt, Shigella flexneri 2a str. 301
caucuucuugcagcuuaaucaua

SEQ ID NO: 2018520 - RNA, 19 nt, Shigella flexneri 2a str. 301
caucuucuugcagcuuaau

SEQ ID NO: 2018521 - RNA, 16 nt, Shigella flexneri 2a str. 301
caucuugaacgcaaau

SEQ ID NO: 2018522 - RNA, 20 nt, Shigella flexneri 2a str. 301
caucgcuacaccaaucguca

SEQ ID NO: 2018523 - RNA, 14 nt, Shigella flexneri 2a str. 301
caucgcuacaccaa

SEQ ID NO: 2018524 - RNA, 16 nt, Shigella flexneri 2a str. 301
caucgcggucagcugc

SEQ ID NO: 2018525 - RNA, 20 nt, Shigella flexneri 2a str. 301
caucggcggugaccagcagc

SEQ ID NO: 2018526 - RNA, 21 nt, Shigella flexneri 2a str. 301
caucggcggugaccagcagca

SEQ ID NO: 2018527 - RNA, 14 nt, Shigella flexneri 2a str. 301
caucggcgcuggcg

SEQ ID NO: 2018528 - RNA, 19 nt, Shigella flexneri 2a str. 301
caucgcgauuaugccgccg

SEQ ID NO: 2018529 - RNA, 19 nt, Shigella flexneri 2a str. 301
caucgcgcccaaaccaccc

SEQ ID NO: 2018530 - RNA, 15 nt, Shigella flexneri 2a str. 301
caucgcgccaacaaa

SEQ ID NO: 2018531 - RNA, 14 nt, Shigella flexneri 2a str. 301
caucgccuucuuga

SEQ ID NO: 2018532 - RNA, 19 nt, Shigella flexneri 2a str. 301
caucgccugaucgcgcagu

SEQ ID NO: 2018533 - RNA, 15 nt, Shigella flexneri 2a str. 301
caucgccuuccagcg

SEQ ID NO: 2018534 - RNA, 13 nt, Shigella flexneri 2a str. 301
caucgcgcuggug

SEQ ID NO: 2018535 - RNA, 18 nt, Shigella flexneri 2a str. 301
caucgcgcccgccgccau

SEQ ID NO: 2018536 - RNA, 13 nt, Shigella flexneri 2a str. 301
caucgacccagaa

SEQ ID NO: 2018537 - RNA, 23 nt, Shigella flexneri 2a str. 301
caucgacguagugaaaucgccaa

SEQ ID NO: 2018538 - RNA, 17 nt, Shigella flexneri 2a str. 301
caucgauauuaucuuca

SEQ ID NO: 2018539 - RNA, 16 nt, Shigella flexneri 2a str. 301
caucgauaaucaccga

SEQ ID NO: 2018540 - RNA, 16 nt, Shigella flexneri 2a str. 301
caucgccagcucaagg

SEQ ID NO: 2018541 - RNA, 20 nt, Shigella flexneri 2a str. 301
caucgccauaauaagcgcca

SEQ ID NO: 2018542 - RNA, 18 nt, Shigella flexneri 2a str. 301
caucgccagugccgccca

SEQ ID NO: 2018543 - RNA, 21 nt, Shigella flexneri 2a str. 301
caucgcccaguugaucaccag

SEQ ID NO: 2018544 - RNA, 14 nt, Shigella flexneri 2a str. 301
caucgacagcaaau

SEQ ID NO: 2018545 - RNA, 17 nt, Shigella flexneri 2a str. 301
caucgaaaacgccaccg

SEQ ID NO: 2018546 - RNA, 16 nt, Shigella flexneri 2a str. 301
caucgaaaacgccacc

SEQ ID NO: 2018547 - RNA, 15 nt, Shigella flexneri 2a str. 301
cauccuugcuaacca

SEQ ID NO: 2018548 - RNA, 16 nt, Shigella flexneri 2a str. 301
cauccuucauuauccu

SEQ ID NO: 2018549 - RNA, 17 nt, Shigella flexneri 2a str. 301
cauccuucacacugccu

SEQ ID NO: 2018550 - RNA, 16 nt, Shigella flexneri 2a str. 301
cauccuguuccacugg

SEQ ID NO: 2018551 - RNA, 14 nt, Shigella flexneri 2a str. 301
cauccucuuuacgc

SEQ ID NO: 2018552 - RNA, 16 nt, Shigella flexneri 2a str. 301
cauccugauaggauuu

SEQ ID NO: 2018553 - RNA, 16 nt, Shigella flexneri 2a str. 301
cauccugacccagcaa

SEQ ID NO: 2018554 - RNA, 14 nt, Shigella flexneri 2a str. 301
cauccgccauccac

SEQ ID NO: 2018555 - RNA, 20 nt, Shigella flexneri 2a str. 301
cauccgccccggcuucaaag

SEQ ID NO: 2018556 - RNA, 20 nt, Shigella flexneri 2a str. 301
cauccgcugaugcaacguca

SEQ ID NO: 2018557 - RNA, 12 nt, Shigella flexneri 2a str. 301
cauccgcucacu

SEQ ID NO: 2018558 - RNA, 13 nt, Shigella flexneri 2a str. 301
cauccacugccug

SEQ ID NO: 2018559 - RNA, 20 nt, Shigella flexneri 2a str. 301
cauccagacugcucagcucc

SEQ ID NO: 2018560 - RNA, 22 nt, Shigella flexneri 2a str. 301
cauccggaucgagaauauucac

SEQ ID NO: 2018561 - RNA, 21 nt, Shigella flexneri 2a str. 301
cauccuaaaggcaaaaugcca

SEQ ID NO: 2018562 - RNA, 16 nt, Shigella flexneri 2a str. 301
cauccuaaaggcaaaa

SEQ ID NO: 2018563 - RNA, 22 nt, Shigella flexneri 2a str. 301
cauccguuucccuguucagccu

SEQ ID NO: 2018564 - RNA, 22 nt, Shigella flexneri 2a str. 301
cauccguuucucuguucagccu

SEQ ID NO: 2018565 - RNA, 16 nt, Shigella flexneri 2a str. 301
cauccguuuuguggug

SEQ ID NO: 2018566 - RNA, 20 nt, Shigella flexneri 2a str. 301
cauccguggcgacagaggug

SEQ ID NO: 2018567 - RNA, 22 nt, Shigella flexneri 2a str. 301
cauccgguuaucgucugcgcca

SEQ ID NO: 2018568 - RNA, 23 nt, Shigella flexneri 2a str. 301
cauccgguuuacgcaaugccagu

SEQ ID NO: 2018569 - RNA, 18 nt, Shigella flexneri 2a str. 301
cauccgucauccauacca

SEQ ID NO: 2018570 - RNA, 23 nt, Shigella flexneri 2a str. 301
cauccgugaauaaugcaaaaagg

SEQ ID NO: 2018571 - RNA, 14 nt, Shigella flexneri 2a str. 301
ccgccaucgacaac

SEQ ID NO: 2018572 - RNA, 15 nt, Shigella flexneri 2a str. 301
ccgccaguucuucca

SEQ ID NO: 2018573 - RNA, 18 nt, Shigella flexneri 2a str. 301
ccgccaguuacugccacc

SEQ ID NO: 2018574 - RNA, 17 nt, Shigella flexneri 2a str. 301
ccgccaguaaucuggcc

SEQ ID NO: 2018575 - RNA, 17 nt, Shigella flexneri 2a str. 301
ccgccagugccaaagcc

SEQ ID NO: 2018576 - RNA, 18 nt, Shigella flexneri 2a str. 301
ccgccagugccaaagcca

SEQ ID NO: 2018577 - RNA, 18 nt, Shigella flexneri 2a str. 301
ccgccaguuuugugcccg

SEQ ID NO: 2018578 - RNA, 13 nt, Shigella flexneri 2a str. 301
ccgccauaaacag

SEQ ID NO: 2018579 - RNA, 11 nt, Shigella flexneri 2a str. 301
ccgccaucauc

SEQ ID NO: 2018580 - RNA, 20 nt, Shigella flexneri 2a str. 301
ccgccgaggauacagccgaa

SEQ ID NO: 2018581 - RNA, 17 nt, Shigella flexneri 2a str. 301
ccgccacgaccugcaga

SEQ ID NO: 2018582 - RNA, 23 nt, Shigella flexneri 2a str. 301
ccgccacuugagccuccagcgga

SEQ ID NO: 2018583 - RNA, 19 nt, Shigella flexneri 2a str. 301
ccgccacuugagccuccag

SEQ ID NO: 2018584 - RNA, 19 nt, Shigella flexneri 2a str. 301
ccgccagaacgacgacugc

SEQ ID NO: 2018585 - RNA, 13 nt, Shigella flexneri 2a str. 301
ccgccacugccac

SEQ ID NO: 2018586 - RNA, 19 nt, Shigella flexneri 2a str. 301
ccgccagcuucgcuuccca

SEQ ID NO: 2018587 - RNA, 14 nt, Shigella flexneri 2a str. 301
ccgccagcggcggc

SEQ ID NO: 2018588 - RNA, 12 nt, Shigella flexneri 2a str. 301
ccgccagcgggc

SEQ ID NO: 2018589 - RNA, 22 nt, Shigella flexneri 2a str. 301
ccgccagcucacgggcggcagg

SEQ ID NO: 2018590 - RNA, 15 nt, Shigella flexneri 2a str. 301
ccgcaccugccagcg

SEQ ID NO: 2018591 - RNA, 18 nt, Shigella flexneri 2a str. 301
ccgcaccugaguaauuaa

SEQ ID NO: 2018592 - RNA, 18 nt, Shigella flexneri 2a str. 301
ccgcacaauacauagaaa

SEQ ID NO: 2018593 - RNA, 13 nt, Shigella flexneri 2a str. 301
ccgcaaugugcuc

SEQ ID NO: 2018594 - RNA, 18 nt, Shigella flexneri 2a str. 301
ccgauggucacggacagg

SEQ ID NO: 2018595 - RNA, 23 nt, Shigella flexneri 2a str. 301
ccgcaaucaucgaccccaggccg

SEQ ID NO: 2018596 - RNA, 15 nt, Shigella flexneri 2a str. 301
ccgcagaucagacca

SEQ ID NO: 2018597 - RNA, 22 nt, Shigella flexneri 2a str. 301
ccgcacgcagaaucucugcgcu

SEQ ID NO: 2018598 - RNA, 20 nt, Shigella flexneri 2a str. 301
ccgcagaagccgaucgugcu

SEQ ID NO: 2018599 - RNA, 22 nt, Shigella flexneri 2a str. 301
ccgccaccaggaacgcgccaag

SEQ ID NO: 2018600 - RNA, 12 nt, Shigella flexneri 2a str. 301
ccgccaauuucu

SEQ ID NO: 2018601 - RNA, 14 nt, Shigella flexneri 2a str. 301
ccgccaaacgcggu

SEQ ID NO: 2018602 - RNA, 20 nt, Shigella flexneri 2a str. 301
ccgcaucaacagugccaauc

SEQ ID NO: 2018603 - RNA, 23 nt, Shigella flexneri 2a str. 301
ccgcauaugcgggcguuuugcuu

SEQ ID NO: 2018604 - RNA, 20 nt, Shigella flexneri 2a str. 301
ccgcauccggcaauugugau

SEQ ID NO: 2018605 - RNA, 21 nt, Shigella flexneri 2a str. 301
ccgcauccggugauuuucauc

SEQ ID NO: 2018606 - RNA, 19 nt, Shigella flexneri 2a str. 301
ccgcauccggcaauaagca

SEQ ID NO: 2018607 - RNA, 11 nt, Shigella flexneri 2a str. 301
ccgcauccaga

SEQ ID NO: 2018608 - RNA, 14 nt, Shigella flexneri 2a str. 301
ccgcaucacgacag

SEQ ID NO: 2018609 - RNA, 23 nt, Shigella flexneri 2a str. 301
ccgcaucaggcaucugagcauga

SEQ ID NO: 2018610 - RNA, 21 nt, Shigella flexneri 2a str. 301
ccgcaucacuccacaccauau

SEQ ID NO: 2018611 - RNA, 18 nt, Shigella flexneri 2a str. 301
cccuugcugacuccccga

SEQ ID NO: 2018612 - RNA, 14 nt, Shigella flexneri 2a str. 301
cccucgccccuccg

SEQ ID NO: 2018613 - RNA, 19 nt, Shigella flexneri 2a str. 301
cccucgaucggcucuuccg

SEQ ID NO: 2018614 - RNA, 16 nt, Shigella flexneri 2a str. 301
cccuuggggagagggu

SEQ ID NO: 2018615 - RNA, 19 nt, Shigella flexneri 2a str. 301
cccuuuaauuauccccuca

SEQ ID NO: 2018616 - RNA, 12 nt, Shigella flexneri 2a str. 301
cccuuuccuucu

SEQ ID NO: 2018617 - RNA, 15 nt, Shigella flexneri 2a str. 301
cccuuuccugacuca

SEQ ID NO: 2018618 - RNA, 17 nt, Shigella flexneri 2a str. 301
cccuuucucuucaaacc

SEQ ID NO: 2018619 - RNA, 16 nt, Shigella flexneri 2a str. 301
ccgaaccgggcgcgag

SEQ ID NO: 2018620 - RNA, 14 nt, Shigella flexneri 2a str. 301
ccgaaccgggcgcg

SEQ ID NO: 2018621 - RNA, 14 nt, Shigella flexneri 2a str. 301
ccgaaccggacgau

SEQ ID NO: 2018622 - RNA, 22 nt, Shigella flexneri 2a str. 301
ccgaagcccaucaguacaccac

SEQ ID NO: 2018623 - RNA, 19 nt, Shigella flexneri 2a str. 301
ccgaacucaucucucguug

SEQ ID NO: 2018624 - RNA, 17 nt, Shigella flexneri 2a str. 301
ccgaacaacaagaagcg

SEQ ID NO: 2018625 - RNA, 13 nt, Shigella flexneri 2a str. 301
ccgacacuggcag

SEQ ID NO: 2018626 - RNA, 13 nt, Shigella flexneri 2a str. 301
ccgaccacuucca

SEQ ID NO: 2018627 - RNA, 17 nt, Shigella flexneri 2a str. 301
ccgaccaucccaccacc

SEQ ID NO: 2018628 - RNA, 12 nt, Shigella flexneri 2a str. 301
ccgacauugaag

SEQ ID NO: 2018629 - RNA, 21 nt, Shigella flexneri 2a str. 301
ccgaagcggcguuccaccgcu

SEQ ID NO: 2018630 - RNA, 16 nt, Shigella flexneri 2a str. 301
ccgaaggaggcgugcu

SEQ ID NO: 2018631 - RNA, 19 nt, Shigella flexneri 2a str. 301
ccgaaugaccgccccugcg

SEQ ID NO: 2018632 - RNA, 17 nt, Shigella flexneri 2a str. 301
ccgacaaugccacaaac

SEQ ID NO: 2018633 - RNA, 14 nt, Shigella flexneri 2a str. 301
ccgaccauugccag

SEQ ID NO: 2018634 - RNA, 12 nt, Shigella flexneri 2a str. 301
ccgaccucaaca

SEQ ID NO: 2018635 - RNA, 14 nt, Shigella flexneri 2a str. 301
ccgagcagccacug

SEQ ID NO: 2018636 - RNA, 11 nt, Shigella flexneri 2a str. 301
ccgagcagcca

SEQ ID NO: 2018637 - RNA, 17 nt, Shigella flexneri 2a str. 301
ccgacugcgccaauacc

SEQ ID NO: 2018638 - RNA, 12 nt, Shigella flexneri 2a str. 301
ccgacugccugc

SEQ ID NO: 2018639 - RNA, 20 nt, Shigella flexneri 2a str. 301
ccgagcguucaaaacggcug

SEQ ID NO: 2018640 - RNA, 16 nt, Shigella flexneri 2a str. 301
ccgaggcauucagcca

SEQ ID NO: 2018641 - RNA, 17 nt, Shigella flexneri 2a str. 301
ccgaggcauucagccag

SEQ ID NO: 2018642 - RNA, 15 nt, Shigella flexneri 2a str. 301
ccgaggccaaaacca

SEQ ID NO: 2018643 - RNA, 18 nt, Shigella flexneri 2a str. 301
ccgaggaucacaaugcca

SEQ ID NO: 2018644 - RNA, 14 nt, Shigella flexneri 2a str. 301
ccgauccggcacca

SEQ ID NO: 2018645 - RNA, 23 nt, Shigella flexneri 2a str. 301
ccgaugcgggauucccccaggcc

SEQ ID NO: 2018646 - RNA, 21 nt, Shigella flexneri 2a str. 301
ccgauaccaauguagccgcgg

SEQ ID NO: 2018647 - RNA, 17 nt, Shigella flexneri 2a str. 301
ccgauaauuccucccgu

SEQ ID NO: 2018648 - RNA, 20 nt, Shigella flexneri 2a str. 301
ccgcgucguugaaaugcggc

SEQ ID NO: 2018649 - RNA, 18 nt, Shigella flexneri 2a str. 301
ccgcgugcgcuggacgcc

SEQ ID NO: 2018650 - RNA, 14 nt, Shigella flexneri 2a str. 301
ccgcgugacgcugg

SEQ ID NO: 2018651 - RNA, 15 nt, Shigella flexneri 2a str. 301
ccgcuaucaguucag

SEQ ID NO: 2018652 - RNA, 12 nt, Shigella flexneri 2a str. 301
ccgcucccagca

SEQ ID NO: 2018653 - RNA, 23 nt, Shigella flexneri 2a str. 301
ccgcuccgccaucuucuugcagc

SEQ ID NO: 2018654 - RNA, 11 nt, Shigella flexneri 2a str. 301
ccgcucccugg

SEQ ID NO: 2018655 - RNA, 13 nt, Shigella flexneri 2a str. 301
ccgcucccagcau

SEQ ID NO: 2018656 - RNA, 18 nt, Shigella flexneri 2a str. 301
ccgcucgaaguuuuccuc

SEQ ID NO: 2018657 - RNA, 11 nt, Shigella flexneri 2a str. 301
ccgcugauuca

SEQ ID NO: 2018658 - RNA, 15 nt, Shigella flexneri 2a str. 301
ccgcugcugacuuug

SEQ ID NO: 2018659 - RNA, 22 nt, Shigella flexneri 2a str. 301
ccgcugcuggggccaauaccug

SEQ ID NO: 2018660 - RNA, 15 nt, Shigella flexneri 2a str. 301
ccgcugggccgucag

SEQ ID NO: 2018661 - RNA, 16 nt, Shigella flexneri 2a str. 301
ccgcuucgcccgccag

SEQ ID NO: 2018662 - RNA, 16 nt, Shigella flexneri 2a str. 301
ccgcugugauuucagc

SEQ ID NO: 2018663 - RNA, 17 nt, Shigella flexneri 2a str. 301
ccgcugucuaccagcac

SEQ ID NO: 2018664 - RNA, 19 nt, Shigella flexneri 2a str. 301
ccgcuguaaaugcugcucc

SEQ ID NO: 2018665 - RNA, 15 nt, Shigella flexneri 2a str. 301
ccgcgauagcaagcg

SEQ ID NO: 2018666 - RNA, 16 nt, Shigella flexneri 2a str. 301
ccgcgacgacgacagg

SEQ ID NO: 2018667 - RNA, 23 nt, Shigella flexneri 2a str. 301
ccgcgaccucaaaggccgacagc

SEQ ID NO: 2018668 - RNA, 21 nt, Shigella flexneri 2a str. 301
ccgcgaucgccugcagggcuu

SEQ ID NO: 2018669 - RNA, 13 nt, Shigella flexneri 2a str. 301
ccgcgcaaaccac

SEQ ID NO: 2018670 - RNA, 17 nt, Shigella flexneri 2a str. 301
ccgcgaaccggaccagc

SEQ ID NO: 2018671 - RNA, 19 nt, Shigella flexneri 2a str. 301
ccgccuuugaucucaaacg

SEQ ID NO: 2018672 - RNA, 23 nt, Shigella flexneri 2a str. 301
ccgccuggcgcugcucaggcgag

SEQ ID NO: 2018673 - RNA, 11 nt, Shigella flexneri 2a str. 301
ccgccgcccgg

SEQ ID NO: 2018674 - RNA, 20 nt, Shigella flexneri 2a str. 301
ccgccgccauuugggcggcu

SEQ ID NO: 2018675 - RNA, 17 nt, Shigella flexneri 2a str. 301
ccgccgauguugcauga

SEQ ID NO: 2018676 - RNA, 13 nt, Shigella flexneri 2a str. 301
ccgccgccgccac

SEQ ID NO: 2018677 - RNA, 16 nt, Shigella flexneri 2a str. 301
ccgcgcuuucuucuuc

SEQ ID NO: 2018678 - RNA, 20 nt, Shigella flexneri 2a str. 301
ccgcgcgguaucaccaccca

SEQ ID NO: 2018679 - RNA, 20 nt, Shigella flexneri 2a str. 301
ccgcgcggguaauugcucca

SEQ ID NO: 2018680 - RNA, 23 nt, Shigella flexneri 2a str. 301
ccgcgcguuuuucuucagccccu

SEQ ID NO: 2018681 - RNA, 19 nt, Shigella flexneri 2a str. 301
ccgcgcuaucagcauuguu

SEQ ID NO: 2018682 - RNA, 16 nt, Shigella flexneri 2a str. 301
ccgcgccacgcggagc

SEQ ID NO: 2018683 - RNA, 15 nt, Shigella flexneri 2a str. 301
ccggccuggauggcu

SEQ ID NO: 2018684 - RNA, 19 nt, Shigella flexneri 2a str. 301
ccggcgacacaucuaaugc

SEQ ID NO: 2018685 - RNA, 17 nt, Shigella flexneri 2a str. 301
ccggccuacaagaacca

SEQ ID NO: 2018686 - RNA, 22 nt, Shigella flexneri 2a str. 301
ccggccugcacugcaggccgga

SEQ ID NO: 2018687 - RNA, 19 nt, Shigella flexneri 2a str. 301
ccggcgcuaauucaacgcc

SEQ ID NO: 2018688 - RNA, 19 nt, Shigella flexneri 2a str. 301
ccggcggaauggucggcgc

SEQ ID NO: 2018689 - RNA, 16 nt, Shigella flexneri 2a str. 301
ccggaugcgacgccgg

SEQ ID NO: 2018690 - RNA, 17 nt, Shigella flexneri 2a str. 301
ccggaugcgccagcauc

SEQ ID NO: 2018691 - RNA, 15 nt, Shigella flexneri 2a str. 301
ccggauuuuuuuucc

SEQ ID NO: 2018692 - RNA, 16 nt, Shigella flexneri 2a str. 301
ccggauuuuuuuuccg

SEQ ID NO: 2018693 - RNA, 19 nt, Shigella flexneri 2a str. 301
ccggaugauucacaucauc

SEQ ID NO: 2018694 - RNA, 16 nt, Shigella flexneri 2a str. 301
ccggaugcaccaucuc

SEQ ID NO: 2018695 - RNA, 16 nt, Shigella flexneri 2a str. 301
ccggaugacagacucc

SEQ ID NO: 2018696 - RNA, 16 nt, Shigella flexneri 2a str. 301
ccggauaugcggggau

SEQ ID NO: 2018697 - RNA, 15 nt, Shigella flexneri 2a str. 301
ccggaucccaccaga

SEQ ID NO: 2018698 - RNA, 23 nt, Shigella flexneri 2a str. 301
ccggagcagcagucaggcgcgcg

SEQ ID NO: 2018699 - RNA, 13 nt, Shigella flexneri 2a str. 301
ccggagccagccg

SEQ ID NO: 2018700 - RNA, 16 nt, Shigella flexneri 2a str. 301
ccggacgcaucgccgg

SEQ ID NO: 2018701 - RNA, 13 nt, Shigella flexneri 2a str. 301
ccggacccacacc

SEQ ID NO: 2018702 - RNA, 19 nt, Shigella flexneri 2a str. 301
ccggacauugcgccccggc

SEQ ID NO: 2018703 - RNA, 19 nt, Shigella flexneri 2a str. 301
ccggaccugucggggccag

SEQ ID NO: 2018704 - RNA, 13 nt, Shigella flexneri 2a str. 301
ccggaccgucauc

SEQ ID NO: 2018705 - RNA, 17 nt, Shigella flexneri 2a str. 301
ccggccagcgccgcgcg

SEQ ID NO: 2018706 - RNA, 13 nt, Shigella flexneri 2a str. 301
ccggccagcgccg

SEQ ID NO: 2018707 - RNA, 20 nt, Shigella flexneri 2a str. 301
ccggcccuaaacucuuuacc

SEQ ID NO: 2018708 - RNA, 22 nt, Shigella flexneri 2a str. 301
ccggccccugaucggccaugau

SEQ ID NO: 2018709 - RNA, 17 nt, Shigella flexneri 2a str. 301
ccggcaucaaccagcac

SEQ ID NO: 2018710 - RNA, 14 nt, Shigella flexneri 2a str. 301
ccggcauauaccuc

SEQ ID NO: 2018711 - RNA, 15 nt, Shigella flexneri 2a str. 301
ccggcauacuuugau

SEQ ID NO: 2018712 - RNA, 15 nt, Shigella flexneri 2a str. 301
ccggcaggugggcgc

SEQ ID NO: 2018713 - RNA, 16 nt, Shigella flexneri 2a str. 301
ccggcaaccacaccca

SEQ ID NO: 2018714 - RNA, 20 nt, Shigella flexneri 2a str. 301
ccggcaaucugcuggcaaac

SEQ ID NO: 2018715 - RNA, 23 nt, Shigella flexneri 2a str. 301
ccggcaaucggugcaaaugccag

SEQ ID NO: 2018716 - RNA, 23 nt, Shigella flexneri 2a str. 301
ccggcaaagugaauacagaacag

SEQ ID NO: 2018717 - RNA, 14 nt, Shigella flexneri 2a str. 301
ccggcaaauaacag

SEQ ID NO: 2018718 - RNA, 19 nt, Shigella flexneri 2a str. 301
ccggcaacaaugccacgcc

SEQ ID NO: 2018719 - RNA, 20 nt, Shigella flexneri 2a str. 301
ccggcaccaauguaggccug

SEQ ID NO: 2018720 - RNA, 18 nt, Shigella flexneri 2a str. 301
ccggcacacguaggccaa

SEQ ID NO: 2018721 - RNA, 20 nt, Shigella flexneri 2a str. 301
ccguuggcguaaaucaaacc

SEQ ID NO: 2018722 - RNA, 23 nt, Shigella flexneri 2a str. 301
ccguugguuaauuuuucaaacuc

SEQ ID NO: 2018723 - RNA, 17 nt, Shigella flexneri 2a str. 301
ccguugucgacacccuc

SEQ ID NO: 2018724 - RNA, 19 nt, Shigella flexneri 2a str. 301
ccguugugcgauccacgcc

SEQ ID NO: 2018725 - RNA, 18 nt, Shigella flexneri 2a str. 301
ccguuuuuuaguuagcaa

SEQ ID NO: 2018726 - RNA, 20 nt, Shigella flexneri 2a str. 301
ccguuuucuuuuacaucuac

SEQ ID NO: 2018727 - RNA, 13 nt, Shigella flexneri 2a str. 301
ccguuuaauauua

SEQ ID NO: 2018728 - RNA, 11 nt, Shigella flexneri 2a str. 301
ccuaaaaaauu

SEQ ID NO: 2018729 - RNA, 17 nt, Shigella flexneri 2a str. 301
ccuaaauggaaaauugg

SEQ ID NO: 2018730 - RNA, 14 nt, Shigella flexneri 2a str. 301
ccuacaaaaucuug

SEQ ID NO: 2018731 - RNA, 15 nt, Shigella flexneri 2a str. 301
ccuaaggaauccagc

SEQ ID NO: 2018732 - RNA, 12 nt, Shigella flexneri 2a str. 301
ccuaagcuuucg

SEQ ID NO: 2018733 - RNA, 22 nt, Shigella flexneri 2a str. 301
ccguucgcuaccuuucagugcg

SEQ ID NO: 2018734 - RNA, 15 nt, Shigella flexneri 2a str. 301
ccguucgcuggaagc

SEQ ID NO: 2018735 - RNA, 21 nt, Shigella flexneri 2a str. 301
ccguuauacaucgcuuuccag

SEQ ID NO: 2018736 - RNA, 13 nt, Shigella flexneri 2a str. 301
ccguuaucacagc

SEQ ID NO: 2018737 - RNA, 15 nt, Shigella flexneri 2a str. 301
ccguuaagaugguua

SEQ ID NO: 2018738 - RNA, 21 nt, Shigella flexneri 2a str. 301
ccgucgcaauacccugaccca

SEQ ID NO: 2018739 - RNA, 18 nt, Shigella flexneri 2a str. 301
ccgugaucguggccauga

SEQ ID NO: 2018740 - RNA, 17 nt, Shigella flexneri 2a str. 301
ccgucgcgcccuccugc

SEQ ID NO: 2018741 - RNA, 17 nt, Shigella flexneri 2a str. 301
ccgugcaacugcggcgc

SEQ ID NO: 2018742 - RNA, 23 nt, Shigella flexneri 2a str. 301
ccgugcagcgcaaucgccuccag

SEQ ID NO: 2018743 - RNA, 18 nt, Shigella flexneri 2a str. 301
ccuaugcaacaacugaaa

SEQ ID NO: 2018744 - RNA, 13 nt, Shigella flexneri 2a str. 301
ccuauaguucaau

SEQ ID NO: 2018745 - RNA, 18 nt, Shigella flexneri 2a str. 301
ccuauauuccuuuaucau

SEQ ID NO: 2018746 - RNA, 22 nt, Shigella flexneri 2a str. 301
ccuagugcgguaaauuuuuuga

SEQ ID NO: 2018747 - RNA, 15 nt, Shigella flexneri 2a str. 301
ccuagaaaucauuca

SEQ ID NO: 2018748 - RNA, 13 nt, Shigella flexneri 2a str. 301
ccuacugcuccua

SEQ ID NO: 2018749 - RNA, 17 nt, Shigella flexneri 2a str. 301
ccucaaccccuuccuga

SEQ ID NO: 2018750 - RNA, 16 nt, Shigella flexneri 2a str. 301
ccucaacauacaaaua

SEQ ID NO: 2018751 - RNA, 20 nt, Shigella flexneri 2a str. 301
ccucacagcuaaucaucauc

SEQ ID NO: 2018752 - RNA, 16 nt, Shigella flexneri 2a str. 301
ccucacaugaguugcu

SEQ ID NO: 2018753 - RNA, 19 nt, Shigella flexneri 2a str. 301
ccucaagcucgccaccauu

SEQ ID NO: 2018754 - RNA, 19 nt, Shigella flexneri 2a str. 301
ccucacgcauucucuuuuc

SEQ ID NO: 2018755 - RNA, 21 nt, Shigella flexneri 2a str. 301
ccucacgaucacagcagucca

SEQ ID NO: 2018756 - RNA, 22 nt, Shigella flexneri 2a str. 301
ccucacgaucacagcaguccag

SEQ ID NO: 2018757 - RNA, 16 nt, Shigella flexneri 2a str. 301
ccucacggcuuagcaa

SEQ ID NO: 2018758 - RNA, 20 nt, Shigella flexneri 2a str. 301
ccucacggcuuagcaaggcu

SEQ ID NO: 2018759 - RNA, 10 nt, Shigella flexneri 2a str. 301
ccucagagcu

SEQ ID NO: 2018760 - RNA, 20 nt, Shigella flexneri 2a str. 301
ccgggaugaaaggcaagcac

SEQ ID NO: 2018761 - RNA, 18 nt, Shigella flexneri 2a str. 301
ccgggaucagacgaccca

SEQ ID NO: 2018762 - RNA, 14 nt, Shigella flexneri 2a str. 301
ccgggcauaaacac

SEQ ID NO: 2018763 - RNA, 17 nt, Shigella flexneri 2a str. 301
ccgggguagaccgcgcu

SEQ ID NO: 2018764 - RNA, 13 nt, Shigella flexneri 2a str. 301
ccgggcgcggcug

SEQ ID NO: 2018765 - RNA, 16 nt, Shigella flexneri 2a str. 301
ccgguaccuuugaacu

SEQ ID NO: 2018766 - RNA, 13 nt, Shigella flexneri 2a str. 301
ccgguacgccgcg

SEQ ID NO: 2018767 - RNA, 15 nt, Shigella flexneri 2a str. 301
ccgggucauccagga

SEQ ID NO: 2018768 - RNA, 14 nt, Shigella flexneri 2a str. 301
ccggucguuaccag

SEQ ID NO: 2018769 - RNA, 17 nt, Shigella flexneri 2a str. 301
ccgguacggaugcgaau

SEQ ID NO: 2018770 - RNA, 13 nt, Shigella flexneri 2a str. 301
ccggucagcagca

SEQ ID NO: 2018771 - RNA, 18 nt, Shigella flexneri 2a str. 301
ccggugccgguuucacgu

SEQ ID NO: 2018772 - RNA, 16 nt, Shigella flexneri 2a str. 301
ccggugcgccagaccu

SEQ ID NO: 2018773 - RNA, 14 nt, Shigella flexneri 2a str. 301
ccgguggaagggcu

SEQ ID NO: 2018774 - RNA, 13 nt, Shigella flexneri 2a str. 301
ccggugucgaugu

SEQ ID NO: 2018775 - RNA, 15 nt, Shigella flexneri 2a str. 301
ccgguuucaaaacug

SEQ ID NO: 2018776 - RNA, 16 nt, Shigella flexneri 2a str. 301
ccguaauuuuuacucc

SEQ ID NO: 2018777 - RNA, 19 nt, Shigella flexneri 2a str. 301
ccguaauccguggucuguu

SEQ ID NO: 2018778 - RNA, 23 nt, Shigella flexneri 2a str. 301
ccguaaucaccacaugccgcgcg

SEQ ID NO: 2018779 - RNA, 19 nt, Shigella flexneri 2a str. 301
ccguaauagauccuuuuuc

SEQ ID NO: 2018780 - RNA, 21 nt, Shigella flexneri 2a str. 301
ccguaaguaagauaaaagcaa

SEQ ID NO: 2018781 - RNA, 21 nt, Shigella flexneri 2a str. 301
ccgguuggcgacugaugaagu

SEQ ID NO: 2018782 - RNA, 18 nt, Shigella flexneri 2a str. 301
ccgguucgucauacucca

SEQ ID NO: 2018783 - RNA, 16 nt, Shigella flexneri 2a str. 301
ccgguucggccauauc

SEQ ID NO: 2018784 - RNA, 15 nt, Shigella flexneri 2a str. 301
ccgguuaaccuuuaa

SEQ ID NO: 2018785 - RNA, 22 nt, Shigella flexneri 2a str. 301
ccgguuaaguaaaauccgaacu

SEQ ID NO: 2018786 - RNA, 17 nt, Shigella flexneri 2a str. 301
ccgguuacgccaccagc

SEQ ID NO: 2018787 - RNA, 18 nt, Shigella flexneri 2a str. 301
ccgguuaucggcgcgcca

SEQ ID NO: 2018788 - RNA, 13 nt, Shigella flexneri 2a str. 301
ccgguuccacauc

SEQ ID NO: 2018789 - RNA, 14 nt, Shigella flexneri 2a str. 301
ccguauguucucug

SEQ ID NO: 2018790 - RNA, 19 nt, Shigella flexneri 2a str. 301
ccguauuacugagauggcu

SEQ ID NO: 2018791 - RNA, 13 nt, Shigella flexneri 2a str. 301
ccguacccagcaa

SEQ ID NO: 2018792 - RNA, 21 nt, Shigella flexneri 2a str. 301
ccguacaaagugccgccagcu

SEQ ID NO: 2018793 - RNA, 23 nt, Shigella flexneri 2a str. 301
ccguaauuuuuacuccacuuccu

SEQ ID NO: 2018794 - RNA, 15 nt, Shigella flexneri 2a str. 301
ccguaccacgccacu

SEQ ID NO: 2018795 - RNA, 18 nt, Shigella flexneri 2a str. 301
ccgucaccggaauaauga

SEQ ID NO: 2018796 - RNA, 19 nt, Shigella flexneri 2a str. 301
ccgucaccggcacaaagcu

SEQ ID NO: 2018797 - RNA, 23 nt, Shigella flexneri 2a str. 301
ccgucacgcguugcuaugcugaa

SEQ ID NO: 2018798 - RNA, 23 nt, Shigella flexneri 2a str. 301
ccgucaucgacaaaaacccugcc

SEQ ID NO: 2018799 - RNA, 17 nt, Shigella flexneri 2a str. 301
ccgucaucacgcaggcu

SEQ ID NO: 2018800 - RNA, 21 nt, Shigella flexneri 2a str. 301
ccgucaguuuuucacccgcaa

SEQ ID NO: 2018801 - RNA, 20 nt, Shigella flexneri 2a str. 301
ccguccaggcggucaccgaa

SEQ ID NO: 2018802 - RNA, 16 nt, Shigella flexneri 2a str. 301
ccugaccuuuuuucag

SEQ ID NO: 2018803 - RNA, 17 nt, Shigella flexneri 2a str. 301
ccugaccugcgaccagu

SEQ ID NO: 2018804 - RNA, 18 nt, Shigella flexneri 2a str. 301
ccugacgcccguuuucac

SEQ ID NO: 2018805 - RNA, 12 nt, Shigella flexneri 2a str. 301
ccugacugguua

SEQ ID NO: 2018806 - RNA, 19 nt, Shigella flexneri 2a str. 301
ccugacucagcaucugcaa

SEQ ID NO: 2018807 - RNA, 16 nt, Shigella flexneri 2a str. 301
ccugacgguuuaccug

SEQ ID NO: 2018808 - RNA, 19 nt, Shigella flexneri 2a str. 301
ccugacguaacgaccacca

SEQ ID NO: 2018809 - RNA, 16 nt, Shigella flexneri 2a str. 301
ccugaauuugcuccag

SEQ ID NO: 2018810 - RNA, 19 nt, Shigella flexneri 2a str. 301
ccucuuccauuucaucgcc

SEQ ID NO: 2018811 - RNA, 16 nt, Shigella flexneri 2a str. 301
ccucuuccauuucauc

SEQ ID NO: 2018812 - RNA, 21 nt, Shigella flexneri 2a str. 301
ccucuuccauuucaucgccag

SEQ ID NO: 2018813 - RNA, 16 nt, Shigella flexneri 2a str. 301
ccugacccagcaccag

SEQ ID NO: 2018814 - RNA, 15 nt, Shigella flexneri 2a str. 301
ccugacccagcaagg

SEQ ID NO: 2018815 - RNA, 13 nt, Shigella flexneri 2a str. 301
ccugaccaaagcc

SEQ ID NO: 2018816 - RNA, 19 nt, Shigella flexneri 2a str. 301
ccugaccaaagccccgcuu

SEQ ID NO: 2018817 - RNA, 12 nt, Shigella flexneri 2a str. 301
ccugacaacaaa

SEQ ID NO: 2018818 - RNA, 22 nt, Shigella flexneri 2a str. 301
ccugagcgguuaacacggcagc

SEQ ID NO: 2018819 - RNA, 16 nt, Shigella flexneri 2a str. 301
ccugagcagccaccac

SEQ ID NO: 2018820 - RNA, 17 nt, Shigella flexneri 2a str. 301
ccugagacagacagccu

SEQ ID NO: 2018821 - RNA, 19 nt, Shigella flexneri 2a str. 301
ccugagacagacagccuca

SEQ ID NO: 2018822 - RNA, 13 nt, Shigella flexneri 2a str. 301
ccugagaggauga

SEQ ID NO: 2018823 - RNA, 17 nt, Shigella flexneri 2a str. 301
ccugacuuugccccagc

SEQ ID NO: 2018824 - RNA, 19 nt, Shigella flexneri 2a str. 301
ccugauagcccgcacaaag

SEQ ID NO: 2018825 - RNA, 22 nt, Shigella flexneri 2a str. 301
ccugauagcccgcacaaagcac

SEQ ID NO: 2018826 - RNA, 17 nt, Shigella flexneri 2a str. 301
ccugauacaugaaugau

SEQ ID NO: 2018827 - RNA, 21 nt, Shigella flexneri 2a str. 301
ccugauacgcgccaaucggca

SEQ ID NO: 2018828 - RNA, 12 nt, Shigella flexneri 2a str. 301
ccugaguaauua

SEQ ID NO: 2018829 - RNA, 19 nt, Shigella flexneri 2a str. 301
ccugaguuaccgcuauuug

SEQ ID NO: 2018830 - RNA, 22 nt, Shigella flexneri 2a str. 301
ccugagugaauauuuaaccuga

SEQ ID NO: 2018831 - RNA, 17 nt, Shigella flexneri 2a str. 301
ccugagucagaaacugu

SEQ ID NO: 2018832 - RNA, 21 nt, Shigella flexneri 2a str. 301
ccugauaagacgcgacaagcg

SEQ ID NO: 2018833 - RNA, 20 nt, Shigella flexneri 2a str. 301
ccugaugugaaagauaaaac

SEQ ID NO: 2018834 - RNA, 14 nt, Shigella flexneri 2a str. 301
ccugauggcgcgcc

SEQ ID NO: 2018835 - RNA, 12 nt, Shigella flexneri 2a str. 301
ccugaugcguug

SEQ ID NO: 2018836 - RNA, 19 nt, Shigella flexneri 2a str. 301
ccugaugcgacgcuugacg

SEQ ID NO: 2018837 - RNA, 21 nt, Shigella flexneri 2a str. 301
ccugaugcagcguaaaccccu

SEQ ID NO: 2018838 - RNA, 19 nt, Shigella flexneri 2a str. 301
ccugaugcaucagucacga

SEQ ID NO: 2018839 - RNA, 16 nt, Shigella flexneri 2a str. 301
ccugaugcgacgcuua

SEQ ID NO: 2018840 - RNA, 21 nt, Shigella flexneri 2a str. 301
ccugaucggcgagauaaugcg

SEQ ID NO: 2018841 - RNA, 19 nt, Shigella flexneri 2a str. 301
ccugaucgccauauuucuc

SEQ ID NO: 2018842 - RNA, 15 nt, Shigella flexneri 2a str. 301
ccugaucgacgcgcu

SEQ ID NO: 2018843 - RNA, 21 nt, Shigella flexneri 2a str. 301
ccugaucuuccgcgucauuca

SEQ ID NO: 2018844 - RNA, 21 nt, Shigella flexneri 2a str. 301
ccugaucgacaaaaucccggc

SEQ ID NO: 2018845 - RNA, 13 nt, Shigella flexneri 2a str. 301
ccugauccauacu

SEQ ID NO: 2018846 - RNA, 22 nt, Shigella flexneri 2a str. 301
ccugauccagcucuucuucacu

SEQ ID NO: 2018847 - RNA, 19 nt, Shigella flexneri 2a str. 301
ccugauccagcucuucuuc

SEQ ID NO: 2018848 - RNA, 14 nt, Shigella flexneri 2a str. 301
ccugcaaauaaaua

SEQ ID NO: 2018849 - RNA, 22 nt, Shigella flexneri 2a str. 301
ccugcaacgagugcaucuggua

SEQ ID NO: 2018850 - RNA, 16 nt, Shigella flexneri 2a str. 301
ccugcagggcuuucac

SEQ ID NO: 2018851 - RNA, 16 nt, Shigella flexneri 2a str. 301
ccugcagcuggucgcc

SEQ ID NO: 2018852 - RNA, 12 nt, Shigella flexneri 2a str. 301
ccugcagcuuca

SEQ ID NO: 2018853 - RNA, 19 nt, Shigella flexneri 2a str. 301
ccucguaaugcuccggcuc

SEQ ID NO: 2018854 - RNA, 18 nt, Shigella flexneri 2a str. 301
ccucgucccaaaagcucg

SEQ ID NO: 2018855 - RNA, 14 nt, Shigella flexneri 2a str. 301
ccucugcucccggc

SEQ ID NO: 2018856 - RNA, 20 nt, Shigella flexneri 2a str. 301
ccucuucagccgcaaaccug

SEQ ID NO: 2018857 - RNA, 14 nt, Shigella flexneri 2a str. 301
ccucuucagcgucc

SEQ ID NO: 2018858 - RNA, 21 nt, Shigella flexneri 2a str. 301
ccucuucagcguccauccaca

SEQ ID NO: 2018859 - RNA, 13 nt, Shigella flexneri 2a str. 301
ccucuucauuaaa

SEQ ID NO: 2018860 - RNA, 15 nt, Shigella flexneri 2a str. 301
ccucuucaauuaaca

SEQ ID NO: 2018861 - RNA, 18 nt, Shigella flexneri 2a str. 301
ccucuuaaugcaggcagc

SEQ ID NO: 2018862 - RNA, 15 nt, Shigella flexneri 2a str. 301
ccucuuacacuugac

SEQ ID NO: 2018863 - RNA, 15 nt, Shigella flexneri 2a str. 301
ccucuuacgccgcca

SEQ ID NO: 2018864 - RNA, 16 nt, Shigella flexneri 2a str. 301
ccucuuacgccgccac

SEQ ID NO: 2018865 - RNA, 17 nt, Shigella flexneri 2a str. 301
ccucuuacgccgccaca

SEQ ID NO: 2018866 - RNA, 22 nt, Shigella flexneri 2a str. 301
ccucuuacgcgaauaguuuccg

SEQ ID NO: 2018867 - RNA, 18 nt, Shigella flexneri 2a str. 301
ccucuaacagaucaucca

SEQ ID NO: 2018868 - RNA, 13 nt, Shigella flexneri 2a str. 301
ccucugccagcug

SEQ ID NO: 2018869 - RNA, 17 nt, Shigella flexneri 2a str. 301
ccucgccccuccgggga

SEQ ID NO: 2018870 - RNA, 14 nt, Shigella flexneri 2a str. 301
ccucgcauuuuugu

SEQ ID NO: 2018871 - RNA, 15 nt, Shigella flexneri 2a str. 301
ccucgccguuuucug

SEQ ID NO: 2018872 - RNA, 19 nt, Shigella flexneri 2a str. 301
ccucgcuggucagcgccag

SEQ ID NO: 2018873 - RNA, 23 nt, Shigella flexneri 2a str. 301
ccucggagaacggauucagugag

SEQ ID NO: 2018874 - RNA, 14 nt, Shigella flexneri 2a str. 301
ccucgcuccauacu

SEQ ID NO: 2018875 - RNA, 16 nt, Shigella flexneri 2a str. 301
ccucagcgaacaggac

SEQ ID NO: 2018876 - RNA, 22 nt, Shigella flexneri 2a str. 301
ccucagcgaacaggaccuugac

SEQ ID NO: 2018877 - RNA, 15 nt, Shigella flexneri 2a str. 301
ccucgaucagagugg

SEQ ID NO: 2018878 - RNA, 15 nt, Shigella flexneri 2a str. 301
ccugugacaacacuu

SEQ ID NO: 2018879 - RNA, 15 nt, Shigella flexneri 2a str. 301
ccugucucucagcac

SEQ ID NO: 2018880 - RNA, 22 nt, Shigella flexneri 2a str. 301
ccugucucucagcacaccauaa

SEQ ID NO: 2018881 - RNA, 22 nt, Shigella flexneri 2a str. 301
ccuguaaaacgcgcccucagcc

SEQ ID NO: 2018882 - RNA, 17 nt, Shigella flexneri 2a str. 301
ccuguugaaaaaccaga

SEQ ID NO: 2018883 - RNA, 16 nt, Shigella flexneri 2a str. 301
ccuguucugcgcgcca

SEQ ID NO: 2018884 - RNA, 23 nt, Shigella flexneri 2a str. 301
ccuguucaucgacagaacggaua

SEQ ID NO: 2018885 - RNA, 19 nt, Shigella flexneri 2a str. 301
ccugugcaaccuuuuccau

SEQ ID NO: 2018886 - RNA, 22 nt, Shigella flexneri 2a str. 301
ccugugccagcucgugcagaac

SEQ ID NO: 2018887 - RNA, 15 nt, Shigella flexneri 2a str. 301
ccugugacagcagcg

SEQ ID NO: 2018888 - RNA, 13 nt, Shigella flexneri 2a str. 301
ccuguuaugccuc

SEQ ID NO: 2018889 - RNA, 22 nt, Shigella flexneri 2a str. 301
ccuuaaagcauuuucauccauu

SEQ ID NO: 2018890 - RNA, 18 nt, Shigella flexneri 2a str. 301
ccuuaacgguaucuuucc

SEQ ID NO: 2018891 - RNA, 15 nt, Shigella flexneri 2a str. 301
ccuuaacucuuccug

SEQ ID NO: 2018892 - RNA, 16 nt, Shigella flexneri 2a str. 301
ccuuaacucuuccuga

SEQ ID NO: 2018893 - RNA, 18 nt, Shigella flexneri 2a str. 301
ccuuaaguaugcaauaac

SEQ ID NO: 2018894 - RNA, 19 nt, Shigella flexneri 2a str. 301
ccuuaauaaaauacuuuua

SEQ ID NO: 2018895 - RNA, 13 nt, Shigella flexneri 2a str. 301
ccuuaauaaccca

SEQ ID NO: 2018896 - RNA, 18 nt, Shigella flexneri 2a str. 301
ccuuaccccugacgcuua

SEQ ID NO: 2018897 - RNA, 13 nt, Shigella flexneri 2a str. 301
ccuguuuucgauu

SEQ ID NO: 2018898 - RNA, 21 nt, Shigella flexneri 2a str. 301
ccuguuugguugccagccaca

SEQ ID NO: 2018899 - RNA, 23 nt, Shigella flexneri 2a str. 301
ccuguuuugucuuuuuaaugacu

SEQ ID NO: 2018900 - RNA, 21 nt, Shigella flexneri 2a str. 301
ccuguugugcgagcaaagcgc

SEQ ID NO: 2018901 - RNA, 22 nt, Shigella flexneri 2a str. 301
ccuguugugcgagcaaagcgca

SEQ ID NO: 2018902 - RNA, 16 nt, Shigella flexneri 2a str. 301
ccuguugucuuuccag

SEQ ID NO: 2018903 - RNA, 21 nt, Shigella flexneri 2a str. 301
ccuguugcgcuccgcgaccca

SEQ ID NO: 2018904 - RNA, 18 nt, Shigella flexneri 2a str. 301
ccuguugcgucgccgccu

SEQ ID NO: 2018905 - RNA, 21 nt, Shigella flexneri 2a str. 301
ccuguugauggggguccugag

SEQ ID NO: 2018906 - RNA, 13 nt, Shigella flexneri 2a str. 301
ccuguugcccuuu

SEQ ID NO: 2018907 - RNA, 20 nt, Shigella flexneri 2a str. 301
ccuucaaucccagacguuuc

SEQ ID NO: 2018908 - RNA, 19 nt, Shigella flexneri 2a str. 301
ccuucacccauugccgccu

SEQ ID NO: 2018909 - RNA, 14 nt, Shigella flexneri 2a str. 301
ccuucacacugccu

SEQ ID NO: 2018910 - RNA, 15 nt, Shigella flexneri 2a str. 301
ccuucaacccaucaa

SEQ ID NO: 2018911 - RNA, 13 nt, Shigella flexneri 2a str. 301
ccuucaacgcggc

SEQ ID NO: 2018912 - RNA, 15 nt, Shigella flexneri 2a str. 301
ccuucaagaauuaaa

SEQ ID NO: 2018913 - RNA, 20 nt, Shigella flexneri 2a str. 301
ccuucaacacuggcaaaauc

SEQ ID NO: 2018914 - RNA, 17 nt, Shigella flexneri 2a str. 301
ccuucacgcgcuccagg

SEQ ID NO: 2018915 - RNA, 13 nt, Shigella flexneri 2a str. 301
ccuucacuuuugc

SEQ ID NO: 2018916 - RNA, 16 nt, Shigella flexneri 2a str. 301
ccuucacuuuugccag

SEQ ID NO: 2018917 - RNA, 17 nt, Shigella flexneri 2a str. 301
ccuucagcaacuuguuc

SEQ ID NO: 2018918 - RNA, 19 nt, Shigella flexneri 2a str. 301
ccuucaggugguuagcugc

SEQ ID NO: 2018919 - RNA, 17 nt, Shigella flexneri 2a str. 301
ccuucaggcgugauuca

SEQ ID NO: 2018920 - RNA, 23 nt, Shigella flexneri 2a str. 301
ccuuagcaaaauagcuguuuauu

SEQ ID NO: 2018921 - RNA, 19 nt, Shigella flexneri 2a str. 301
ccuuacuuacacaucaaga

SEQ ID NO: 2018922 - RNA, 12 nt, Shigella flexneri 2a str. 301
ccuuacugcccc

SEQ ID NO: 2018923 - RNA, 17 nt, Shigella flexneri 2a str. 301
ccuuagcuaauuuuugu

SEQ ID NO: 2018924 - RNA, 17 nt, Shigella flexneri 2a str. 301
ccuuagccacaaagcag

SEQ ID NO: 2018925 - RNA, 21 nt, Shigella flexneri 2a str. 301
ccuuacgcguucauacuuuuc

SEQ ID NO: 2018926 - RNA, 23 nt, Shigella flexneri 2a str. 301
ccuuacccgcgacgcgcuuuuac

SEQ ID NO: 2018927 - RNA, 20 nt, Shigella flexneri 2a str. 301
ccuuacccuuacucacuaaa

SEQ ID NO: 2018928 - RNA, 17 nt, Shigella flexneri 2a str. 301
ccuuauugucuuuaaau

SEQ ID NO: 2018929 - RNA, 21 nt, Shigella flexneri 2a str. 301
ccuuaugacuacgacauugaa

SEQ ID NO: 2018930 - RNA, 19 nt, Shigella flexneri 2a str. 301
ccuuauccgacauuucugc

SEQ ID NO: 2018931 - RNA, 22 nt, Shigella flexneri 2a str. 301
ccuuauccgaccuacaaaaccu

SEQ ID NO: 2018932 - RNA, 20 nt, Shigella flexneri 2a str. 301
ccuuauccggcuuaccgcuc

SEQ ID NO: 2018933 - RNA, 18 nt, Shigella flexneri 2a str. 301
ccugcuuuugccagcgug

SEQ ID NO: 2018934 - RNA, 15 nt, Shigella flexneri 2a str. 301
ccugcuuuaaaagcu

SEQ ID NO: 2018935 - RNA, 12 nt, Shigella flexneri 2a str. 301
ccugcuggcccc

SEQ ID NO: 2018936 - RNA, 12 nt, Shigella flexneri 2a str. 301
ccugccagcuug

SEQ ID NO: 2018937 - RNA, 17 nt, Shigella flexneri 2a str. 301
ccugccagcgccgacag

SEQ ID NO: 2018938 - RNA, 20 nt, Shigella flexneri 2a str. 301
ccugccagagcugaauauca

SEQ ID NO: 2018939 - RNA, 14 nt, Shigella flexneri 2a str. 301
ccugccagcaugca

SEQ ID NO: 2018940 - RNA, 15 nt, Shigella flexneri 2a str. 301
ccugcccacuccagc

SEQ ID NO: 2018941 - RNA, 13 nt, Shigella flexneri 2a str. 301
ccugcccacucca

SEQ ID NO: 2018942 - RNA, 19 nt, Shigella flexneri 2a str. 301
ccugccaucuggcaggcuu

SEQ ID NO: 2018943 - RNA, 13 nt, Shigella flexneri 2a str. 301
ccugccaguccug

SEQ ID NO: 2018944 - RNA, 23 nt, Shigella flexneri 2a str. 301
ccugcuccagcaacucaaucgcc

SEQ ID NO: 2018945 - RNA, 19 nt, Shigella flexneri 2a str. 301
ccugcucccgaaccuuuuc

SEQ ID NO: 2018946 - RNA, 13 nt, Shigella flexneri 2a str. 301
ccugcucaucagc

SEQ ID NO: 2018947 - RNA, 22 nt, Shigella flexneri 2a str. 301
ccuggacagcucguuaaucaga

SEQ ID NO: 2018948 - RNA, 16 nt, Shigella flexneri 2a str. 301
ccuggcccaucgccag

SEQ ID NO: 2018949 - RNA, 16 nt, Shigella flexneri 2a str. 301
ccuggcuaccauccgc

SEQ ID NO: 2018950 - RNA, 21 nt, Shigella flexneri 2a str. 301
ccuggcgagcauuaauacacc

SEQ ID NO: 2018951 - RNA, 20 nt, Shigella flexneri 2a str. 301
ccuggcgaugcccccagcag

SEQ ID NO: 2018952 - RNA, 16 nt, Shigella flexneri 2a str. 301
ccuggccgugaagaag

SEQ ID NO: 2018953 - RNA, 13 nt, Shigella flexneri 2a str. 301
ccugguucucacu

SEQ ID NO: 2018954 - RNA, 19 nt, Shigella flexneri 2a str. 301
ccugguuauuucacuucaa

SEQ ID NO: 2018955 - RNA, 17 nt, Shigella flexneri 2a str. 301
ccuggugaauauuccuu

SEQ ID NO: 2018956 - RNA, 23 nt, Shigella flexneri 2a str. 301
ccugggcaccgacguucagcgca

SEQ ID NO: 2018957 - RNA, 14 nt, Shigella flexneri 2a str. 301
ccuggcugcagaau

SEQ ID NO: 2018958 - RNA, 13 nt, Shigella flexneri 2a str. 301
ccuggcugcccau

SEQ ID NO: 2018959 - RNA, 19 nt, Shigella flexneri 2a str. 301
ccuggcucaagcaccaucc

SEQ ID NO: 2018960 - RNA, 15 nt, Shigella flexneri 2a str. 301
ccacucuuucagcac

SEQ ID NO: 2018961 - RNA, 23 nt, Shigella flexneri 2a str. 301
ccacucggcacaucgacggugac

SEQ ID NO: 2018962 - RNA, 11 nt, Shigella flexneri 2a str. 301
ccacucugccu

SEQ ID NO: 2018963 - RNA, 22 nt, Shigella flexneri 2a str. 301
ccacugacgggaaacucugcug

SEQ ID NO: 2018964 - RNA, 13 nt, Shigella flexneri 2a str. 301
ccacugacuucuc

SEQ ID NO: 2018965 - RNA, 16 nt, Shigella flexneri 2a str. 301
ccacugacuucucugg

SEQ ID NO: 2018966 - RNA, 18 nt, Shigella flexneri 2a str. 301
ccacuauuauggcgcagg

SEQ ID NO: 2018967 - RNA, 21 nt, Shigella flexneri 2a str. 301
ccacucaccgccguuaccuuc

SEQ ID NO: 2018968 - RNA, 17 nt, Shigella flexneri 2a str. 301
ccacguugacaaacugc

SEQ ID NO: 2018969 - RNA, 13 nt, Shigella flexneri 2a str. 301
ccacuacccauau

SEQ ID NO: 2018970 - RNA, 15 nt, Shigella flexneri 2a str. 301
ccacgcuccaucaug

SEQ ID NO: 2018971 - RNA, 22 nt, Shigella flexneri 2a str. 301
ccacuuccugccaguuuuuccg

SEQ ID NO: 2018972 - RNA, 14 nt, Shigella flexneri 2a str. 301
ccacuuccccucau

SEQ ID NO: 2018973 - RNA, 20 nt, Shigella flexneri 2a str. 301
ccacuuccggcaacaaugcc

SEQ ID NO: 2018974 - RNA, 14 nt, Shigella flexneri 2a str. 301
ccacuuccaccagc

SEQ ID NO: 2018975 - RNA, 13 nt, Shigella flexneri 2a str. 301
ccacuucugccag

SEQ ID NO: 2018976 - RNA, 20 nt, Shigella flexneri 2a str. 301
ccagaacacgcucccagcag

SEQ ID NO: 2018977 - RNA, 15 nt, Shigella flexneri 2a str. 301
ccagaacaaauaaau

SEQ ID NO: 2018978 - RNA, 12 nt, Shigella flexneri 2a str. 301
ccagaacaaccc

SEQ ID NO: 2018979 - RNA, 20 nt, Shigella flexneri 2a str. 301
ccagaaaucggccuuccaua

SEQ ID NO: 2018980 - RNA, 19 nt, Shigella flexneri 2a str. 301
ccagaaauggcccaaaagg

SEQ ID NO: 2018981 - RNA, 20 nt, Shigella flexneri 2a str. 301
ccagaaauggcccaaaaggc

SEQ ID NO: 2018982 - RNA, 16 nt, Shigella flexneri 2a str. 301
ccagaaaucagcagcu

SEQ ID NO: 2018983 - RNA, 15 nt, Shigella flexneri 2a str. 301
ccagaaaguuuuuca

SEQ ID NO: 2018984 - RNA, 18 nt, Shigella flexneri 2a str. 301
ccagaaaguacggccacu

SEQ ID NO: 2018985 - RNA, 15 nt, Shigella flexneri 2a str. 301
ccagaaagugaguuu

SEQ ID NO: 2018986 - RNA, 21 nt, Shigella flexneri 2a str. 301
ccagaacacgcucccagcaga

SEQ ID NO: 2018987 - RNA, 20 nt, Shigella flexneri 2a str. 301
ccacuggcgcgaauagcuuc

SEQ ID NO: 2018988 - RNA, 15 nt, Shigella flexneri 2a str. 301
ccacugucaaaucca

SEQ ID NO: 2018989 - RNA, 21 nt, Shigella flexneri 2a str. 301
ccacugguuccgguuuaucca

SEQ ID NO: 2018990 - RNA, 16 nt, Shigella flexneri 2a str. 301
ccacuggucgcccugg

SEQ ID NO: 2018991 - RNA, 15 nt, Shigella flexneri 2a str. 301
ccacuucaucaagca

SEQ ID NO: 2018992 - RNA, 18 nt, Shigella flexneri 2a str. 301
ccacuucacgaugcagcg

SEQ ID NO: 2018993 - RNA, 16 nt, Shigella flexneri 2a str. 301
ccacugugcgcgccag

SEQ ID NO: 2018994 - RNA, 15 nt, Shigella flexneri 2a str. 301
ccacugcaaaucacc

SEQ ID NO: 2018995 - RNA, 12 nt, Shigella flexneri 2a str. 301
ccacugcaauga

SEQ ID NO: 2018996 - RNA, 19 nt, Shigella flexneri 2a str. 301
ccacugcauggcggcgucu

SEQ ID NO: 2018997 - RNA, 18 nt, Shigella flexneri 2a str. 301
ccacgcacagaacaaaau

SEQ ID NO: 2018998 - RNA, 18 nt, Shigella flexneri 2a str. 301
ccacgcacgccugcaucu

SEQ ID NO: 2018999 - RNA, 13 nt, Shigella flexneri 2a str. 301
ccacgacuucugu

SEQ ID NO: 2019000 - RNA, 15 nt, Shigella flexneri 2a str. 301
ccacgacuucugugg

SEQ ID NO: 2019001 - RNA, 22 nt, Shigella flexneri 2a str. 301
ccacgccgaaccaugucaucaa

SEQ ID NO: 2019002 - RNA, 15 nt, Shigella flexneri 2a str. 301
ccacgccggaugaaa

SEQ ID NO: 2019003 - RNA, 24 nt, Shigella flexneri 2a str. 301
ccacgccgauaaucaacgcgccgc

SEQ ID NO: 2019004 - RNA, 17 nt, Shigella flexneri 2a str. 301
ccacgcgauacuuuuuc

SEQ ID NO: 2019005 - RNA, 20 nt, Shigella flexneri 2a str. 301
ccacgccguuuuuacccagc

SEQ ID NO: 2019006 - RNA, 22 nt, Shigella flexneri 2a str. 301
ccaccugccggagcgccaccac

SEQ ID NO: 2019007 - RNA, 23 nt, Shigella flexneri 2a str. 301
ccaccugaaauggucgccccgga

SEQ ID NO: 2019008 - RNA, 18 nt, Shigella flexneri 2a str. 301
ccaccugauugcugcugc

SEQ ID NO: 2019009 - RNA, 16 nt, Shigella flexneri 2a str. 301
ccaccgguacaaacau

SEQ ID NO: 2019010 - RNA, 16 nt, Shigella flexneri 2a str. 301
ccaccgguuuauuauu

SEQ ID NO: 2019011 - RNA, 16 nt, Shigella flexneri 2a str. 301
ccacgacguguuccug

SEQ ID NO: 2019012 - RNA, 12 nt, Shigella flexneri 2a str. 301
ccacgaccgcag

SEQ ID NO: 2019013 - RNA, 15 nt, Shigella flexneri 2a str. 301
ccacccgcagcaagc

SEQ ID NO: 2019014 - RNA, 18 nt, Shigella flexneri 2a str. 301
ccacccgaucgcucauau

SEQ ID NO: 2019015 - RNA, 14 nt, Shigella flexneri 2a str. 301
ccacccgcagccau

SEQ ID NO: 2019016 - RNA, 13 nt, Shigella flexneri 2a str. 301
ccacccgcagcca

SEQ ID NO: 2019017 - RNA, 12 nt, Shigella flexneri 2a str. 301
ccaaaaaaauaa

SEQ ID NO: 2019018 - RNA, 15 nt, Shigella flexneri 2a str. 301
ccaccgcaaaguggg

SEQ ID NO: 2019019 - RNA, 14 nt, Shigella flexneri 2a str. 301
ccaccgcaaaaggc

SEQ ID NO: 2019020 - RNA, 16 nt, Shigella flexneri 2a str. 301
ccaccgaugcacagca

SEQ ID NO: 2019021 - RNA, 21 nt, Shigella flexneri 2a str. 301
ccaccgcaauaaccaucagcu

SEQ ID NO: 2019022 - RNA, 16 nt, Shigella flexneri 2a str. 301
ccaccgcacuucuucc

SEQ ID NO: 2019023 - RNA, 14 nt, Shigella flexneri 2a str. 301
ccaccgcagcccag

SEQ ID NO: 2019024 - RNA, 16 nt, Shigella flexneri 2a str. 301
ccaccgcccagagaau

SEQ ID NO: 2019025 - RNA, 13 nt, Shigella flexneri 2a str. 301
ccaccgcucugcg

SEQ ID NO: 2019026 - RNA, 16 nt, Shigella flexneri 2a str. 301
ccagccccagaauuca

SEQ ID NO: 2019027 - RNA, 19 nt, Shigella flexneri 2a str. 301
ccagcccuuuugacgcgug

SEQ ID NO: 2019028 - RNA, 14 nt, Shigella flexneri 2a str. 301
ccagccgaacagcg

SEQ ID NO: 2019029 - RNA, 17 nt, Shigella flexneri 2a str. 301
ccagccgaacagcgcca

SEQ ID NO: 2019030 - RNA, 17 nt, Shigella flexneri 2a str. 301
ccagccgcuaacuuccu

SEQ ID NO: 2019031 - RNA, 19 nt, Shigella flexneri 2a str. 301
ccagccgcuaacuuccugc

SEQ ID NO: 2019032 - RNA, 23 nt, Shigella flexneri 2a str. 301
ccagccgauuuuaaugcggcagu

SEQ ID NO: 2019033 - RNA, 19 nt, Shigella flexneri 2a str. 301
ccagcccaugaaucagcaa

SEQ ID NO: 2019034 - RNA, 13 nt, Shigella flexneri 2a str. 301
ccagcccacaugc

SEQ ID NO: 2019035 - RNA, 21 nt, Shigella flexneri 2a str. 301
ccagccauuaaccagccacug

SEQ ID NO: 2019036 - RNA, 13 nt, Shigella flexneri 2a str. 301
ccagcauaaucac

SEQ ID NO: 2019037 - RNA, 17 nt, Shigella flexneri 2a str. 301
ccagcauaaucaccauc

SEQ ID NO: 2019038 - RNA, 19 nt, Shigella flexneri 2a str. 301
ccagcauacgcugccagcc

SEQ ID NO: 2019039 - RNA, 20 nt, Shigella flexneri 2a str. 301
ccagcauacgcugccagcca

SEQ ID NO: 2019040 - RNA, 21 nt, Shigella flexneri 2a str. 301
ccagcauacgcugccagccau

SEQ ID NO: 2019041 - RNA, 14 nt, Shigella flexneri 2a str. 301
ccagcaguucgccc

SEQ ID NO: 2019042 - RNA, 16 nt, Shigella flexneri 2a str. 301
ccagcaguucuacugg

SEQ ID NO: 2019043 - RNA, 20 nt, Shigella flexneri 2a str. 301
ccagcauaaccuugcaauag

SEQ ID NO: 2019044 - RNA, 18 nt, Shigella flexneri 2a str. 301
ccagcagugacucacgaa

SEQ ID NO: 2019045 - RNA, 23 nt, Shigella flexneri 2a str. 301
ccagcagguuuaaccaucaggca

SEQ ID NO: 2019046 - RNA, 16 nt, Shigella flexneri 2a str. 301
ccagcagguuuaacca

SEQ ID NO: 2019047 - RNA, 15 nt, Shigella flexneri 2a str. 301
ccagccgugaauggu

SEQ ID NO: 2019048 - RNA, 16 nt, Shigella flexneri 2a str. 301
ccagccuacaggaaac

SEQ ID NO: 2019049 - RNA, 22 nt, Shigella flexneri 2a str. 301
ccagccugaacgagaaaagcca

SEQ ID NO: 2019050 - RNA, 24 nt, Shigella flexneri 2a str. 301
ccagccuugccagauguugucuca

SEQ ID NO: 2019051 - RNA, 20 nt, Shigella flexneri 2a str. 301
ccagcgaaccguugaggaug

SEQ ID NO: 2019052 - RNA, 16 nt, Shigella flexneri 2a str. 301
ccagccuuuuucucug

SEQ ID NO: 2019053 - RNA, 15 nt, Shigella flexneri 2a str. 301
ccagcgcagacacca

SEQ ID NO: 2019054 - RNA, 17 nt, Shigella flexneri 2a str. 301
ccagcgcagacaccaga

SEQ ID NO: 2019055 - RNA, 15 nt, Shigella flexneri 2a str. 301
ccagcgcaucaggca

SEQ ID NO: 2019056 - RNA, 13 nt, Shigella flexneri 2a str. 301
ccagcgcauggcg

SEQ ID NO: 2019057 - RNA, 20 nt, Shigella flexneri 2a str. 301
ccagcgcagaagagcugggg

SEQ ID NO: 2019058 - RNA, 22 nt, Shigella flexneri 2a str. 301
ccagcgauuacuguacagaucc

SEQ ID NO: 2019059 - RNA, 18 nt, Shigella flexneri 2a str. 301
ccagcagcugcucccagc

SEQ ID NO: 2019060 - RNA, 18 nt, Shigella flexneri 2a str. 301
ccagcagcugcguggcgc

SEQ ID NO: 2019061 - RNA, 17 nt, Shigella flexneri 2a str. 301
ccagcagcggucggcuu

SEQ ID NO: 2019062 - RNA, 17 nt, Shigella flexneri 2a str. 301
ccagcaggccgucgcgc

SEQ ID NO: 2019063 - RNA, 14 nt, Shigella flexneri 2a str. 301
ccagcagcggcaga

SEQ ID NO: 2019064 - RNA, 16 nt, Shigella flexneri 2a str. 301
ccagcagauggcagug

SEQ ID NO: 2019065 - RNA, 12 nt, Shigella flexneri 2a str. 301
ccagcagauggc

SEQ ID NO: 2019066 - RNA, 17 nt, Shigella flexneri 2a str. 301
ccagcaccacuuccggc

SEQ ID NO: 2019067 - RNA, 12 nt, Shigella flexneri 2a str. 301
ccagcaccagca

SEQ ID NO: 2019068 - RNA, 16 nt, Shigella flexneri 2a str. 301
ccagcaacaaauaacc

SEQ ID NO: 2019069 - RNA, 20 nt, Shigella flexneri 2a str. 301
ccagcaacaaauaaccgccu

SEQ ID NO: 2019070 - RNA, 14 nt, Shigella flexneri 2a str. 301
ccagcaaauccagc

SEQ ID NO: 2019071 - RNA, 15 nt, Shigella flexneri 2a str. 301
ccagcaacagcgccg

SEQ ID NO: 2019072 - RNA, 17 nt, Shigella flexneri 2a str. 301
ccagcaacacaaacgaa

SEQ ID NO: 2019073 - RNA, 14 nt, Shigella flexneri 2a str. 301
ccagcaacaacagc

SEQ ID NO: 2019074 - RNA, 23 nt, Shigella flexneri 2a str. 301
ccagcaacaagccaguccagaaa

SEQ ID NO: 2019075 - RNA, 18 nt, Shigella flexneri 2a str. 301
ccagaucacgcagcaagc

SEQ ID NO: 2019076 - RNA, 14 nt, Shigella flexneri 2a str. 301
ccagaucacgcagc

SEQ ID NO: 2019077 - RNA, 20 nt, Shigella flexneri 2a str. 301
ccagauauuuuucaauccgc

SEQ ID NO: 2019078 - RNA, 16 nt, Shigella flexneri 2a str. 301
ccagauaugaucgaaa

SEQ ID NO: 2019079 - RNA, 18 nt, Shigella flexneri 2a str. 301
ccagauaaugagaaacac

SEQ ID NO: 2019080 - RNA, 18 nt, Shigella flexneri 2a str. 301
ccagauacaaaaaaggcc

SEQ ID NO: 2019081 - RNA, 16 nt, Shigella flexneri 2a str. 301
ccagauaauggcuguu

SEQ ID NO: 2019082 - RNA, 15 nt, Shigella flexneri 2a str. 301
ccagauagccagguu

SEQ ID NO: 2019083 - RNA, 19 nt, Shigella flexneri 2a str. 301
ccagauagcaacagcagcc

SEQ ID NO: 2019084 - RNA, 23 nt, Shigella flexneri 2a str. 301
ccagauagccaauuacgcaggca

SEQ ID NO: 2019085 - RNA, 19 nt, Shigella flexneri 2a str. 301
ccagauagagccgguuuug

SEQ ID NO: 2019086 - RNA, 15 nt, Shigella flexneri 2a str. 301
ccagauaagacacua

SEQ ID NO: 2019087 - RNA, 17 nt, Shigella flexneri 2a str. 301
ccagauaaggcguucac

SEQ ID NO: 2019088 - RNA, 15 nt, Shigella flexneri 2a str. 301
ccagauaaauauuau

SEQ ID NO: 2019089 - RNA, 21 nt, Shigella flexneri 2a str. 301
ccagaguggauuaucuucacc

SEQ ID NO: 2019090 - RNA, 14 nt, Shigella flexneri 2a str. 301
ccagagugaccgcc

SEQ ID NO: 2019091 - RNA, 15 nt, Shigella flexneri 2a str. 301
ccagaauaaacaacu

SEQ ID NO: 2019092 - RNA, 12 nt, Shigella flexneri 2a str. 301
ccagaauaccuu

SEQ ID NO: 2019093 - RNA, 19 nt, Shigella flexneri 2a str. 301
ccagaauaccuugcugcuc

SEQ ID NO: 2019094 - RNA, 23 nt, Shigella flexneri 2a str. 301
ccagaauauugccgaagaccaga

SEQ ID NO: 2019095 - RNA, 23 nt, Shigella flexneri 2a str. 301
ccagauuuaccgccauggccuga

SEQ ID NO: 2019096 - RNA, 23 nt, Shigella flexneri 2a str. 301
ccagauugugugauacuucuucg

SEQ ID NO: 2019097 - RNA, 18 nt, Shigella flexneri 2a str. 301
ccagauuuuucaguauuu

SEQ ID NO: 2019098 - RNA, 23 nt, Shigella flexneri 2a str. 301
ccagauuggguuuuugaugcugu

SEQ ID NO: 2019099 - RNA, 20 nt, Shigella flexneri 2a str. 301
ccagauugccgauauaaacc

SEQ ID NO: 2019100 - RNA, 18 nt, Shigella flexneri 2a str. 301
ccagauugccgauauaaa

SEQ ID NO: 2019101 - RNA, 23 nt, Shigella flexneri 2a str. 301
ccagauugugaaucgccuggaca

SEQ ID NO: 2019102 - RNA, 17 nt, Shigella flexneri 2a str. 301
ccagauucuccaacauc

SEQ ID NO: 2019103 - RNA, 15 nt, Shigella flexneri 2a str. 301
ccagaucagcuucac

SEQ ID NO: 2019104 - RNA, 21 nt, Shigella flexneri 2a str. 301
ccagauguugucucagcuuca

SEQ ID NO: 2019105 - RNA, 18 nt, Shigella flexneri 2a str. 301
ccagauguugucucagau

SEQ ID NO: 2019106 - RNA, 15 nt, Shigella flexneri 2a str. 301
ccagauguugucuca

SEQ ID NO: 2019107 - RNA, 22 nt, Shigella flexneri 2a str. 301
ccaucaaguagcagguaaucug

SEQ ID NO: 2019108 - RNA, 18 nt, Shigella flexneri 2a str. 301
ccauauguugaaaagcca

SEQ ID NO: 2019109 - RNA, 22 nt, Shigella flexneri 2a str. 301
ccauauuagccgccagcucuuu

SEQ ID NO: 2019110 - RNA, 19 nt, Shigella flexneri 2a str. 301
ccauaucgccauugccggu

SEQ ID NO: 2019111 - RNA, 19 nt, Shigella flexneri 2a str. 301
ccauacaguguccaaccaa

SEQ ID NO: 2019112 - RNA, 21 nt, Shigella flexneri 2a str. 301
ccauacauaaaaaagccgggg

SEQ ID NO: 2019113 - RNA, 13 nt, Shigella flexneri 2a str. 301
ccauacagacacc

SEQ ID NO: 2019114 - RNA, 20 nt, Shigella flexneri 2a str. 301
ccauaccacuuccagcagac

SEQ ID NO: 2019115 - RNA, 16 nt, Shigella flexneri 2a str. 301
ccauaccagcacauaa

SEQ ID NO: 2019116 - RNA, 15 nt, Shigella flexneri 2a str. 301
ccauaucaggcacau

SEQ ID NO: 2019117 - RNA, 18 nt, Shigella flexneri 2a str. 301
ccauaucaggcacauuac

SEQ ID NO: 2019118 - RNA, 23 nt, Shigella flexneri 2a str. 301
ccaucaaguagcagguaaucugc

SEQ ID NO: 2019119 - RNA, 13 nt, Shigella flexneri 2a str. 301
ccaucaauugcuc

SEQ ID NO: 2019120 - RNA, 18 nt, Shigella flexneri 2a str. 301
ccaucaauugcucacucc

SEQ ID NO: 2019121 - RNA, 23 nt, Shigella flexneri 2a str. 301
ccaucaggcagauacaaccaauc

SEQ ID NO: 2019122 - RNA, 15 nt, Shigella flexneri 2a str. 301
ccaucaggcagucug

SEQ ID NO: 2019123 - RNA, 19 nt, Shigella flexneri 2a str. 301
ccaucaggcagucugcgcc

SEQ ID NO: 2019124 - RNA, 21 nt, Shigella flexneri 2a str. 301
ccaucaggcagucugcgcccu

SEQ ID NO: 2019125 - RNA, 18 nt, Shigella flexneri 2a str. 301
ccaucagcgccugaugga

SEQ ID NO: 2019126 - RNA, 15 nt, Shigella flexneri 2a str. 301
ccaucggcuuuggca

SEQ ID NO: 2019127 - RNA, 19 nt, Shigella flexneri 2a str. 301
ccaucgggcuagacugaug

SEQ ID NO: 2019128 - RNA, 16 nt, Shigella flexneri 2a str. 301
ccaucgucacaccuuc

SEQ ID NO: 2019129 - RNA, 21 nt, Shigella flexneri 2a str. 301
ccaucuucuugcagcuuaauc

SEQ ID NO: 2019130 - RNA, 19 nt, Shigella flexneri 2a str. 301
ccaucuucuucacuucuuc

SEQ ID NO: 2019131 - RNA, 15 nt, Shigella flexneri 2a str. 301
ccaucuuuccucacu

SEQ ID NO: 2019132 - RNA, 15 nt, Shigella flexneri 2a str. 301
ccaucggcagcgcca

SEQ ID NO: 2019133 - RNA, 18 nt, Shigella flexneri 2a str. 301
ccaucgccauuuaacgca

SEQ ID NO: 2019134 - RNA, 14 nt, Shigella flexneri 2a str. 301
ccaucgccagugcc

SEQ ID NO: 2019135 - RNA, 15 nt, Shigella flexneri 2a str. 301
ccaucgccagcagcc

SEQ ID NO: 2019136 - RNA, 20 nt, Shigella flexneri 2a str. 301
ccaucgccagcagccauucc

SEQ ID NO: 2019137 - RNA, 14 nt, Shigella flexneri 2a str. 301
ccaucgccagcagc

SEQ ID NO: 2019138 - RNA, 13 nt, Shigella flexneri 2a str. 301
ccaucgcauacug

SEQ ID NO: 2019139 - RNA, 14 nt, Shigella flexneri 2a str. 301
ccaucgauaaucac

SEQ ID NO: 2019140 - RNA, 23 nt, Shigella flexneri 2a str. 301
ccaucgcaaacaguacaucuucc

SEQ ID NO: 2019141 - RNA, 21 nt, Shigella flexneri 2a str. 301
ccaucgacgaaauggugugca

SEQ ID NO: 2019142 - RNA, 16 nt, Shigella flexneri 2a str. 301
ccauccgcccacacca

SEQ ID NO: 2019143 - RNA, 14 nt, Shigella flexneri 2a str. 301
ccauccgcccacac

SEQ ID NO: 2019144 - RNA, 13 nt, Shigella flexneri 2a str. 301
ccauccgaguugu

SEQ ID NO: 2019145 - RNA, 13 nt, Shigella flexneri 2a str. 301
ccaucccuccugu

SEQ ID NO: 2019146 - RNA, 22 nt, Shigella flexneri 2a str. 301
ccaucauaucacccuuuucugc

SEQ ID NO: 2019147 - RNA, 19 nt, Shigella flexneri 2a str. 301
ccaucauaugcgccagcgg

SEQ ID NO: 2019148 - RNA, 17 nt, Shigella flexneri 2a str. 301
ccaucagugccaguacg

SEQ ID NO: 2019149 - RNA, 20 nt, Shigella flexneri 2a str. 301
ccaucagggcggccgccaga

SEQ ID NO: 2019150 - RNA, 14 nt, Shigella flexneri 2a str. 301
ccaucagugccagu

SEQ ID NO: 2019151 - RNA, 16 nt, Shigella flexneri 2a str. 301
ccaucaguacgcauuc

SEQ ID NO: 2019152 - RNA, 18 nt, Shigella flexneri 2a str. 301
ccaucaguugaugaaucu

SEQ ID NO: 2019153 - RNA, 22 nt, Shigella flexneri 2a str. 301
ccaucaugcacacuaucgcuua

SEQ ID NO: 2019154 - RNA, 16 nt, Shigella flexneri 2a str. 301
ccaucaucggcaaaca

SEQ ID NO: 2019155 - RNA, 15 nt, Shigella flexneri 2a str. 301
ccaucauucgccgcu

SEQ ID NO: 2019156 - RNA, 22 nt, Shigella flexneri 2a str. 301
ccaguuucaugauauguuuuaa

SEQ ID NO: 2019157 - RNA, 23 nt, Shigella flexneri 2a str. 301
ccaguugugaugauuuugugcca

SEQ ID NO: 2019158 - RNA, 17 nt, Shigella flexneri 2a str. 301
ccauaaagggaauaaau

SEQ ID NO: 2019159 - RNA, 13 nt, Shigella flexneri 2a str. 301
ccaguuucacagg

SEQ ID NO: 2019160 - RNA, 14 nt, Shigella flexneri 2a str. 301
ccauaaacagggcu

SEQ ID NO: 2019161 - RNA, 21 nt, Shigella flexneri 2a str. 301
ccauaaacagggcuuuaccug

SEQ ID NO: 2019162 - RNA, 20 nt, Shigella flexneri 2a str. 301
ccauaaauccaacaacacau

SEQ ID NO: 2019163 - RNA, 17 nt, Shigella flexneri 2a str. 301
ccaguugcauaauuucu

SEQ ID NO: 2019164 - RNA, 12 nt, Shigella flexneri 2a str. 301
ccaguugcgccg

SEQ ID NO: 2019165 - RNA, 14 nt, Shigella flexneri 2a str. 301
ccaguugcgccguc

SEQ ID NO: 2019166 - RNA, 18 nt, Shigella flexneri 2a str. 301
ccaguuuacugucugcuu

SEQ ID NO: 2019167 - RNA, 19 nt, Shigella flexneri 2a str. 301
ccaguuguugcugaauuug

SEQ ID NO: 2019168 - RNA, 20 nt, Shigella flexneri 2a str. 301
ccaguugugucagugcgcga

SEQ ID NO: 2019169 - RNA, 22 nt, Shigella flexneri 2a str. 301
ccaguugucgguaauugcgccg

SEQ ID NO: 2019170 - RNA, 16 nt, Shigella flexneri 2a str. 301
ccaguuguucgcgcac

SEQ ID NO: 2019171 - RNA, 21 nt, Shigella flexneri 2a str. 301
ccagugcaggcaccagccccu

SEQ ID NO: 2019172 - RNA, 17 nt, Shigella flexneri 2a str. 301
ccagugccgcccaccac

SEQ ID NO: 2019173 - RNA, 16 nt, Shigella flexneri 2a str. 301
ccagugccgcccacca

SEQ ID NO: 2019174 - RNA, 18 nt, Shigella flexneri 2a str. 301
ccagugccggaugauuca

SEQ ID NO: 2019175 - RNA, 22 nt, Shigella flexneri 2a str. 301
ccagugcccgaccacuucaugc

SEQ ID NO: 2019176 - RNA, 15 nt, Shigella flexneri 2a str. 301
ccagugccagcacca

SEQ ID NO: 2019177 - RNA, 22 nt, Shigella flexneri 2a str. 301
ccagugccacacgcucuuccag

SEQ ID NO: 2019178 - RNA, 21 nt, Shigella flexneri 2a str. 301
ccagugccacacgcucuucca

SEQ ID NO: 2019179 - RNA, 19 nt, Shigella flexneri 2a str. 301
ccagugccguuccagccag

SEQ ID NO: 2019180 - RNA, 21 nt, Shigella flexneri 2a str. 301
ccagugccguuccagccagug

SEQ ID NO: 2019181 - RNA, 21 nt, Shigella flexneri 2a str. 301
ccagugccggaugauucacau

SEQ ID NO: 2019182 - RNA, 17 nt, Shigella flexneri 2a str. 301
ccagugcguacccagcg

SEQ ID NO: 2019183 - RNA, 16 nt, Shigella flexneri 2a str. 301
ccaguucuacaaucug

SEQ ID NO: 2019184 - RNA, 13 nt, Shigella flexneri 2a str. 301
ccaguucuacaau

SEQ ID NO: 2019185 - RNA, 13 nt, Shigella flexneri 2a str. 301
ccaguucgcgcac

SEQ ID NO: 2019186 - RNA, 14 nt, Shigella flexneri 2a str. 301
ccaguucgcgcacg

SEQ ID NO: 2019187 - RNA, 21 nt, Shigella flexneri 2a str. 301
ccaguucgcgcacguuucccg

SEQ ID NO: 2019188 - RNA, 12 nt, Shigella flexneri 2a str. 301
ccagugcuucaa

SEQ ID NO: 2019189 - RNA, 19 nt, Shigella flexneri 2a str. 301
ccaguggaugcgccauacc

SEQ ID NO: 2019190 - RNA, 17 nt, Shigella flexneri 2a str. 301
ccagucagaaagugcca

SEQ ID NO: 2019191 - RNA, 14 nt, Shigella flexneri 2a str. 301
ccagucaguuaagc

SEQ ID NO: 2019192 - RNA, 14 nt, Shigella flexneri 2a str. 301
ccagucaggcauga

SEQ ID NO: 2019193 - RNA, 21 nt, Shigella flexneri 2a str. 301
ccaguaucuuauagaaagcaa

SEQ ID NO: 2019194 - RNA, 18 nt, Shigella flexneri 2a str. 301
ccaguaugaggcaaaccu

SEQ ID NO: 2019195 - RNA, 23 nt, Shigella flexneri 2a str. 301
ccaguaugcauguaaaucaagcg

SEQ ID NO: 2019196 - RNA, 22 nt, Shigella flexneri 2a str. 301
ccaguauguaacuggguuuguc

SEQ ID NO: 2019197 - RNA, 17 nt, Shigella flexneri 2a str. 301
ccaguauuucauagauu

SEQ ID NO: 2019198 - RNA, 15 nt, Shigella flexneri 2a str. 301
ccagucaaucaucca

SEQ ID NO: 2019199 - RNA, 13 nt, Shigella flexneri 2a str. 301
ccagugaauacug

SEQ ID NO: 2019200 - RNA, 17 nt, Shigella flexneri 2a str. 301
ccagugaauacugcgcg

SEQ ID NO: 2019201 - RNA, 12 nt, Shigella flexneri 2a str. 301
ccagucugcugg

SEQ ID NO: 2019202 - RNA, 22 nt, Shigella flexneri 2a str. 301
ccagucguaguggaucagcaaa

SEQ ID NO: 2019203 - RNA, 15 nt, Shigella flexneri 2a str. 301
ccagucguucaacca

SEQ ID NO: 2019204 - RNA, 12 nt, Shigella flexneri 2a str. 301
ccaguccuccgg

SEQ ID NO: 2019205 - RNA, 13 nt, Shigella flexneri 2a str. 301
ccagucgccgacg

SEQ ID NO: 2019206 - RNA, 13 nt, Shigella flexneri 2a str. 301
ccagucccuuuca

SEQ ID NO: 2019207 - RNA, 15 nt, Shigella flexneri 2a str. 301
ccaggcucgccgccg

SEQ ID NO: 2019208 - RNA, 15 nt, Shigella flexneri 2a str. 301
ccaggcguucugccu

SEQ ID NO: 2019209 - RNA, 17 nt, Shigella flexneri 2a str. 301
ccaggcguucugccugg

SEQ ID NO: 2019210 - RNA, 14 nt, Shigella flexneri 2a str. 301
ccaggcguucugcc

SEQ ID NO: 2019211 - RNA, 18 nt, Shigella flexneri 2a str. 301
ccaggccgguaacgcuuu

SEQ ID NO: 2019212 - RNA, 18 nt, Shigella flexneri 2a str. 301
ccaggccggugaugaugc

SEQ ID NO: 2019213 - RNA, 19 nt, Shigella flexneri 2a str. 301
ccaggccgcguaccgcagc

SEQ ID NO: 2019214 - RNA, 15 nt, Shigella flexneri 2a str. 301
ccaggucaccagaca

SEQ ID NO: 2019215 - RNA, 19 nt, Shigella flexneri 2a str. 301
ccaggucagagagccagcc

SEQ ID NO: 2019216 - RNA, 21 nt, Shigella flexneri 2a str. 301
ccagguauucggugugcagcg

SEQ ID NO: 2019217 - RNA, 16 nt, Shigella flexneri 2a str. 301
ccaggcuggucgcgcg

SEQ ID NO: 2019218 - RNA, 13 nt, Shigella flexneri 2a str. 301
ccaggcaaaccag

SEQ ID NO: 2019219 - RNA, 20 nt, Shigella flexneri 2a str. 301
ccaggauugauagaaauauc

SEQ ID NO: 2019220 - RNA, 14 nt, Shigella flexneri 2a str. 301
ccaggcaaaccagu

SEQ ID NO: 2019221 - RNA, 19 nt, Shigella flexneri 2a str. 301
ccaggccaguucuucuuca

SEQ ID NO: 2019222 - RNA, 23 nt, Shigella flexneri 2a str. 301
ccaggaucuggcuugccagcagg

SEQ ID NO: 2019223 - RNA, 16 nt, Shigella flexneri 2a str. 301
ccaggacgcaguccag

SEQ ID NO: 2019224 - RNA, 18 nt, Shigella flexneri 2a str. 301
ccaggaauuugguccuga

SEQ ID NO: 2019225 - RNA, 19 nt, Shigella flexneri 2a str. 301
ccagcugccgaaccacuga

SEQ ID NO: 2019226 - RNA, 17 nt, Shigella flexneri 2a str. 301
ccagcugccgacgccag

SEQ ID NO: 2019227 - RNA, 17 nt, Shigella flexneri 2a str. 301
ccagcugccguccccau

SEQ ID NO: 2019228 - RNA, 18 nt, Shigella flexneri 2a str. 301
ccagcugcucgcgagaac

SEQ ID NO: 2019229 - RNA, 19 nt, Shigella flexneri 2a str. 301
ccagcgccuggcugauuaa

SEQ ID NO: 2019230 - RNA, 13 nt, Shigella flexneri 2a str. 301
ccagcgccuggga

SEQ ID NO: 2019231 - RNA, 14 nt, Shigella flexneri 2a str. 301
ccagcgccugcgcg

SEQ ID NO: 2019232 - RNA, 19 nt, Shigella flexneri 2a str. 301
ccagcgcgaggaucacgca

SEQ ID NO: 2019233 - RNA, 18 nt, Shigella flexneri 2a str. 301
ccagcgcgaugcaggcca

SEQ ID NO: 2019234 - RNA, 20 nt, Shigella flexneri 2a str. 301
ccagcgcgaugcaggccacc

SEQ ID NO: 2019235 - RNA, 12 nt, Shigella flexneri 2a str. 301
ccagcgcgcgca

SEQ ID NO: 2019236 - RNA, 17 nt, Shigella flexneri 2a str. 301
ccagcgccaguaauucu

SEQ ID NO: 2019237 - RNA, 21 nt, Shigella flexneri 2a str. 301
ccagcgccaguuuuuguuucu

SEQ ID NO: 2019238 - RNA, 16 nt, Shigella flexneri 2a str. 301
ccagcgccaguaauuc

SEQ ID NO: 2019239 - RNA, 15 nt, Shigella flexneri 2a str. 301
ccagcgccaucucuu

SEQ ID NO: 2019240 - RNA, 19 nt, Shigella flexneri 2a str. 301
ccagcgccgacagcagccc

SEQ ID NO: 2019241 - RNA, 19 nt, Shigella flexneri 2a str. 301
ccagcgcauggcggcagcg

SEQ ID NO: 2019242 - RNA, 13 nt, Shigella flexneri 2a str. 301
ccagcgccgcgcc

SEQ ID NO: 2019243 - RNA, 13 nt, Shigella flexneri 2a str. 301
ccagcgccgccag

SEQ ID NO: 2019244 - RNA, 18 nt, Shigella flexneri 2a str. 301
ccagcguuuccagcacca

SEQ ID NO: 2019245 - RNA, 19 nt, Shigella flexneri 2a str. 301
ccagcguuuccagcaccag

SEQ ID NO: 2019246 - RNA, 21 nt, Shigella flexneri 2a str. 301
ccagcguuuccagcaccaguu

SEQ ID NO: 2019247 - RNA, 17 nt, Shigella flexneri 2a str. 301
ccagcguuuccagcacc

SEQ ID NO: 2019248 - RNA, 15 nt, Shigella flexneri 2a str. 301
ccagcguugagcccu

SEQ ID NO: 2019249 - RNA, 19 nt, Shigella flexneri 2a str. 301
ccagcguguugaggaagcg

SEQ ID NO: 2019250 - RNA, 14 nt, Shigella flexneri 2a str. 301
ccagcguguugccg

SEQ ID NO: 2019251 - RNA, 15 nt, Shigella flexneri 2a str. 301
ccagcguuaccggcu

SEQ ID NO: 2019252 - RNA, 17 nt, Shigella flexneri 2a str. 301
ccagcgucgcacccggc

SEQ ID NO: 2019253 - RNA, 22 nt, Shigella flexneri 2a str. 301
ccagcgucaucauagacuuccc

SEQ ID NO: 2019254 - RNA, 13 nt, Shigella flexneri 2a str. 301
ccagcgucagcau

SEQ ID NO: 2019255 - RNA, 18 nt, Shigella flexneri 2a str. 301
ccagcggguugcugagau

SEQ ID NO: 2019256 - RNA, 22 nt, Shigella flexneri 2a str. 301
ccagcgcguuauguaacaacug

SEQ ID NO: 2019257 - RNA, 13 nt, Shigella flexneri 2a str. 301
ccagcgcuucacu

SEQ ID NO: 2019258 - RNA, 15 nt, Shigella flexneri 2a str. 301
ccagcggaugaccca

SEQ ID NO: 2019259 - RNA, 20 nt, Shigella flexneri 2a str. 301
ccagcggauaaagcagagca

SEQ ID NO: 2019260 - RNA, 17 nt, Shigella flexneri 2a str. 301
ccagcggauaaagcaga

SEQ ID NO: 2019261 - RNA, 20 nt, Shigella flexneri 2a str. 301
ccagcggagaaacuucugcc

SEQ ID NO: 2019262 - RNA, 22 nt, Shigella flexneri 2a str. 301
ccagcggagaaacuucugccgg

SEQ ID NO: 2019263 - RNA, 15 nt, Shigella flexneri 2a str. 301
cccgaaugaccgccc

SEQ ID NO: 2019264 - RNA, 15 nt, Shigella flexneri 2a str. 301
ccccuuugaccagcc

SEQ ID NO: 2019265 - RNA, 13 nt, Shigella flexneri 2a str. 301
cccgaccaccauu

SEQ ID NO: 2019266 - RNA, 22 nt, Shigella flexneri 2a str. 301
ccccgcgcaacgcuuucccuga

SEQ ID NO: 2019267 - RNA, 22 nt, Shigella flexneri 2a str. 301
ccccgcucacgcagcggcggca

SEQ ID NO: 2019268 - RNA, 22 nt, Shigella flexneri 2a str. 301
ccccugcgauugugacacgcgc

SEQ ID NO: 2019269 - RNA, 17 nt, Shigella flexneri 2a str. 301
ccccuuucgaaaucauu

SEQ ID NO: 2019270 - RNA, 12 nt, Shigella flexneri 2a str. 301
ccccuuuaaaua

SEQ ID NO: 2019271 - RNA, 16 nt, Shigella flexneri 2a str. 301
ccccuucuucuacugc

SEQ ID NO: 2019272 - RNA, 19 nt, Shigella flexneri 2a str. 301
ccccugacgcuuaucuucu

SEQ ID NO: 2019273 - RNA, 17 nt, Shigella flexneri 2a str. 301
ccccugauaaccgcauc

SEQ ID NO: 2019274 - RNA, 14 nt, Shigella flexneri 2a str. 301
ccccucgcaccaaa

SEQ ID NO: 2019275 - RNA, 23 nt, Shigella flexneri 2a str. 301
cccgaugaccuugucaugcagcu

SEQ ID NO: 2019276 - RNA, 13 nt, Shigella flexneri 2a str. 301
cccgaugaccuug

SEQ ID NO: 2019277 - RNA, 14 nt, Shigella flexneri 2a str. 301
cccgauaaccgcaa

SEQ ID NO: 2019278 - RNA, 16 nt, Shigella flexneri 2a str. 301
cccgagcucaauacaa

SEQ ID NO: 2019279 - RNA, 20 nt, Shigella flexneri 2a str. 301
cccgagcugcucgucagccg

SEQ ID NO: 2019280 - RNA, 14 nt, Shigella flexneri 2a str. 301
cccgagcacaugca

SEQ ID NO: 2019281 - RNA, 16 nt, Shigella flexneri 2a str. 301
cccgcacaaagcacgc

SEQ ID NO: 2019282 - RNA, 20 nt, Shigella flexneri 2a str. 301
cccgcaaguccccaguaauc

SEQ ID NO: 2019283 - RNA, 13 nt, Shigella flexneri 2a str. 301
cccgaugcaaaaa

SEQ ID NO: 2019284 - RNA, 11 nt, Shigella flexneri 2a str. 301
cccgauggcuu

SEQ ID NO: 2019285 - RNA, 13 nt, Shigella flexneri 2a str. 301
cccgcaagcugcg

SEQ ID NO: 2019286 - RNA, 14 nt, Shigella flexneri 2a str. 301
ccccaaccgcccug

SEQ ID NO: 2019287 - RNA, 21 nt, Shigella flexneri 2a str. 301
ccccaacaugacuaaucugac

SEQ ID NO: 2019288 - RNA, 15 nt, Shigella flexneri 2a str. 301
ccccaauguagccgc

SEQ ID NO: 2019289 - RNA, 20 nt, Shigella flexneri 2a str. 301
ccccaaggaucgucgcccga

SEQ ID NO: 2019290 - RNA, 17 nt, Shigella flexneri 2a str. 301
ccccacaaacccgccag

SEQ ID NO: 2019291 - RNA, 21 nt, Shigella flexneri 2a str. 301
ccccacaaacccgccagacca

SEQ ID NO: 2019292 - RNA, 20 nt, Shigella flexneri 2a str. 301
ccccacaaucagccagaaca

SEQ ID NO: 2019293 - RNA, 21 nt, Shigella flexneri 2a str. 301
ccccacagugcugauuuugca

SEQ ID NO: 2019294 - RNA, 21 nt, Shigella flexneri 2a str. 301
ccccacacuaccaucggcgcu

SEQ ID NO: 2019295 - RNA, 15 nt, Shigella flexneri 2a str. 301
cccauuccucaugga

SEQ ID NO: 2019296 - RNA, 17 nt, Shigella flexneri 2a str. 301
cccauuagacuauuuuu

SEQ ID NO: 2019297 - RNA, 23 nt, Shigella flexneri 2a str. 301
cccauggacauacgcaccuuuac

SEQ ID NO: 2019298 - RNA, 23 nt, Shigella flexneri 2a str. 301
cccagguaucguugaugcucuug

SEQ ID NO: 2019299 - RNA, 23 nt, Shigella flexneri 2a str. 301
ccccgcacaacggcuacuucuuc

SEQ ID NO: 2019300 - RNA, 18 nt, Shigella flexneri 2a str. 301
cccccauugggccacuca

SEQ ID NO: 2019301 - RNA, 13 nt, Shigella flexneri 2a str. 301
cccccaccccggc

SEQ ID NO: 2019302 - RNA, 19 nt, Shigella flexneri 2a str. 301
cccccacuaagcaccaaau

SEQ ID NO: 2019303 - RNA, 20 nt, Shigella flexneri 2a str. 301
cccccagacgacggcugcca

SEQ ID NO: 2019304 - RNA, 15 nt, Shigella flexneri 2a str. 301
cccccagcagcgccg

SEQ ID NO: 2019305 - RNA, 16 nt, Shigella flexneri 2a str. 301
ccccagauugccgaua

SEQ ID NO: 2019306 - RNA, 22 nt, Shigella flexneri 2a str. 301
ccccagaucccauaaccaacaa

SEQ ID NO: 2019307 - RNA, 11 nt, Shigella flexneri 2a str. 301
ccccagaugcc

SEQ ID NO: 2019308 - RNA, 22 nt, Shigella flexneri 2a str. 301
ccccagaauucacgcacuuccg

SEQ ID NO: 2019309 - RNA, 20 nt, Shigella flexneri 2a str. 301
ccccagaagcuuuccaucgg

SEQ ID NO: 2019310 - RNA, 22 nt, Shigella flexneri 2a str. 301
ccccagacgacggcugccauca

SEQ ID NO: 2019311 - RNA, 14 nt, Shigella flexneri 2a str. 301
ccccacugcauggc

SEQ ID NO: 2019312 - RNA, 17 nt, Shigella flexneri 2a str. 301
cccagcgguaaaauggu

SEQ ID NO: 2019313 - RNA, 17 nt, Shigella flexneri 2a str. 301
cccagcguugcacaugu

SEQ ID NO: 2019314 - RNA, 13 nt, Shigella flexneri 2a str. 301
cccaggcagaagc

SEQ ID NO: 2019315 - RNA, 21 nt, Shigella flexneri 2a str. 301
cccaggcuucaggugcccaac

SEQ ID NO: 2019316 - RNA, 21 nt, Shigella flexneri 2a str. 301
cccagcgcgaucgcaccacca

SEQ ID NO: 2019317 - RNA, 20 nt, Shigella flexneri 2a str. 301
cccagcgcggugacgcacag

SEQ ID NO: 2019318 - RNA, 16 nt, Shigella flexneri 2a str. 301
cccagcgcgccgccaa

SEQ ID NO: 2019319 - RNA, 14 nt, Shigella flexneri 2a str. 301
cccagcggaaaaua

SEQ ID NO: 2019320 - RNA, 19 nt, Shigella flexneri 2a str. 301
cccagcgaauccagcaugc

SEQ ID NO: 2019321 - RNA, 23 nt, Shigella flexneri 2a str. 301
cccagcgcccccacaacaguggc

SEQ ID NO: 2019322 - RNA, 16 nt, Shigella flexneri 2a str. 301
cccagcgcaucaggca

SEQ ID NO: 2019323 - RNA, 22 nt, Shigella flexneri 2a str. 301
cccacgucaucugucauaacac

SEQ ID NO: 2019324 - RNA, 23 nt, Shigella flexneri 2a str. 301
cccacguuaguguggccaguucc

SEQ ID NO: 2019325 - RNA, 21 nt, Shigella flexneri 2a str. 301
cccacggcggugucgccagaa

SEQ ID NO: 2019326 - RNA, 19 nt, Shigella flexneri 2a str. 301
cccacgggugaucuucaua

SEQ ID NO: 2019327 - RNA, 16 nt, Shigella flexneri 2a str. 301
cccagcacuucgcugg

SEQ ID NO: 2019328 - RNA, 21 nt, Shigella flexneri 2a str. 301
cccagcacuuuucgcacugca

SEQ ID NO: 2019329 - RNA, 15 nt, Shigella flexneri 2a str. 301
cccagcagagaucuu

SEQ ID NO: 2019330 - RNA, 13 nt, Shigella flexneri 2a str. 301
cccagcacuucgc

SEQ ID NO: 2019331 - RNA, 16 nt, Shigella flexneri 2a str. 301
cccagcaccgcagaga

SEQ ID NO: 2019332 - RNA, 17 nt, Shigella flexneri 2a str. 301
cccagcgaagcaaacca

SEQ ID NO: 2019333 - RNA, 17 nt, Shigella flexneri 2a str. 301
cccagccuuuccugcaa

SEQ ID NO: 2019334 - RNA, 16 nt, Shigella flexneri 2a str. 301
cccagccuaagccauu

SEQ ID NO: 2019335 - RNA, 12 nt, Shigella flexneri 2a str. 301
cccagccgcccu

SEQ ID NO: 2019336 - RNA, 23 nt, Shigella flexneri 2a str. 301
cccagccgcgucugaauaucauc

SEQ ID NO: 2019337 - RNA, 21 nt, Shigella flexneri 2a str. 301
cccagcaggauguuccggcaa

SEQ ID NO: 2019338 - RNA, 15 nt, Shigella flexneri 2a str. 301
cccacagaaacaaua

SEQ ID NO: 2019339 - RNA, 20 nt, Shigella flexneri 2a str. 301
cccacagacccagguagaca

SEQ ID NO: 2019340 - RNA, 14 nt, Shigella flexneri 2a str. 301
cccacaccaccaug

SEQ ID NO: 2019341 - RNA, 11 nt, Shigella flexneri 2a str. 301
cccacacauuu

SEQ ID NO: 2019342 - RNA, 19 nt, Shigella flexneri 2a str. 301
cccaaccauuucaucuucu

SEQ ID NO: 2019343 - RNA, 15 nt, Shigella flexneri 2a str. 301
cccaaccgcccugcg

SEQ ID NO: 2019344 - RNA, 19 nt, Shigella flexneri 2a str. 301
cccaaccgcccugcggcug

SEQ ID NO: 2019345 - RNA, 21 nt, Shigella flexneri 2a str. 301
cccaacaaauugguuuugaau

SEQ ID NO: 2019346 - RNA, 18 nt, Shigella flexneri 2a str. 301
cccaaaccacccagcagc

SEQ ID NO: 2019347 - RNA, 19 nt, Shigella flexneri 2a str. 301
cccacgccgcccagagaac

SEQ ID NO: 2019348 - RNA, 12 nt, Shigella flexneri 2a str. 301
cccacgccgccc

SEQ ID NO: 2019349 - RNA, 20 nt, Shigella flexneri 2a str. 301
cccacggauagauuuuuaau

SEQ ID NO: 2019350 - RNA, 14 nt, Shigella flexneri 2a str. 301
cccaccagcaaaua

SEQ ID NO: 2019351 - RNA, 12 nt, Shigella flexneri 2a str. 301
cccaccaccagc

SEQ ID NO: 2019352 - RNA, 13 nt, Shigella flexneri 2a str. 301
cccaccagcgccg

SEQ ID NO: 2019353 - RNA, 14 nt, Shigella flexneri 2a str. 301
cccaccagcugaug

SEQ ID NO: 2019354 - RNA, 22 nt, Shigella flexneri 2a str. 301
ccauuuuucagacguucuuccu

SEQ ID NO: 2019355 - RNA, 16 nt, Shigella flexneri 2a str. 301
ccauuuuuaauaauac

SEQ ID NO: 2019356 - RNA, 17 nt, Shigella flexneri 2a str. 301
ccauuuuuaauaauacu

SEQ ID NO: 2019357 - RNA, 18 nt, Shigella flexneri 2a str. 301
ccauuuuuaauaauacuc

SEQ ID NO: 2019358 - RNA, 19 nt, Shigella flexneri 2a str. 301
ccauuucugccagugcugc

SEQ ID NO: 2019359 - RNA, 15 nt, Shigella flexneri 2a str. 301
ccauuuccuguaaca

SEQ ID NO: 2019360 - RNA, 21 nt, Shigella flexneri 2a str. 301
ccauuugugcauagcacacuu

SEQ ID NO: 2019361 - RNA, 23 nt, Shigella flexneri 2a str. 301
ccauuuggcggggauuuuuuuau

SEQ ID NO: 2019362 - RNA, 21 nt, Shigella flexneri 2a str. 301
ccauugacgcaucgcccgguu

SEQ ID NO: 2019363 - RNA, 22 nt, Shigella flexneri 2a str. 301
ccauugagaaagcccuggcgca

SEQ ID NO: 2019364 - RNA, 19 nt, Shigella flexneri 2a str. 301
ccauugagagcaacggcga

SEQ ID NO: 2019365 - RNA, 16 nt, Shigella flexneri 2a str. 301
ccauugacguuccuuu

SEQ ID NO: 2019366 - RNA, 14 nt, Shigella flexneri 2a str. 301
ccauugaccagcug

SEQ ID NO: 2019367 - RNA, 23 nt, Shigella flexneri 2a str. 301
ccauugcccgaugcgcaaacuua

SEQ ID NO: 2019368 - RNA, 18 nt, Shigella flexneri 2a str. 301
ccauuguuagcaacgaca

SEQ ID NO: 2019369 - RNA, 18 nt, Shigella flexneri 2a str. 301
ccauugccgccucugccg

SEQ ID NO: 2019370 - RNA, 23 nt, Shigella flexneri 2a str. 301
ccauuguuguuggauccccugcc

SEQ ID NO: 2019371 - RNA, 18 nt, Shigella flexneri 2a str. 301
ccauuuaacguuaucuga

SEQ ID NO: 2019372 - RNA, 14 nt, Shigella flexneri 2a str. 301
ccauuuccagcgcu

SEQ ID NO: 2019373 - RNA, 19 nt, Shigella flexneri 2a str. 301
ccauuuccagcgcuuucau

SEQ ID NO: 2019374 - RNA, 18 nt, Shigella flexneri 2a str. 301
cccggcgucgcauccgac

SEQ ID NO: 2019375 - RNA, 16 nt, Shigella flexneri 2a str. 301
cccggcgguauaccau

SEQ ID NO: 2019376 - RNA, 15 nt, Shigella flexneri 2a str. 301
cccggcuucaaagca

SEQ ID NO: 2019377 - RNA, 13 nt, Shigella flexneri 2a str. 301
cccggucccuuca

SEQ ID NO: 2019378 - RNA, 14 nt, Shigella flexneri 2a str. 301
cccgguccgcgcag

SEQ ID NO: 2019379 - RNA, 16 nt, Shigella flexneri 2a str. 301
cccgguccgcgcagcg

SEQ ID NO: 2019380 - RNA, 22 nt, Shigella flexneri 2a str. 301
cccgguauccaucagacuuugc

SEQ ID NO: 2019381 - RNA, 17 nt, Shigella flexneri 2a str. 301
cccggucuuuucucauu

SEQ ID NO: 2019382 - RNA, 19 nt, Shigella flexneri 2a str. 301
cccggcuuuuuuacgccug

SEQ ID NO: 2019383 - RNA, 23 nt, Shigella flexneri 2a str. 301
cccucgaccaaaugaaacagggg

SEQ ID NO: 2019384 - RNA, 19 nt, Shigella flexneri 2a str. 301
cccucccguuucccugucu

SEQ ID NO: 2019385 - RNA, 22 nt, Shigella flexneri 2a str. 301
cccucacccuaacccucucccc

SEQ ID NO: 2019386 - RNA, 15 nt, Shigella flexneri 2a str. 301
cccucauaauuuccc

SEQ ID NO: 2019387 - RNA, 16 nt, Shigella flexneri 2a str. 301
cccuaaucccgugccg

SEQ ID NO: 2019388 - RNA, 21 nt, Shigella flexneri 2a str. 301
cccguuuucuccagcgccgcc

SEQ ID NO: 2019389 - RNA, 14 nt, Shigella flexneri 2a str. 301
cccuaacaucaucc

SEQ ID NO: 2019390 - RNA, 20 nt, Shigella flexneri 2a str. 301
cccuaacugacgggcggcuu

SEQ ID NO: 2019391 - RNA, 14 nt, Shigella flexneri 2a str. 301
cccuaacucuuuca

SEQ ID NO: 2019392 - RNA, 15 nt, Shigella flexneri 2a str. 301
cccucaaacaacaca

SEQ ID NO: 2019393 - RNA, 16 nt, Shigella flexneri 2a str. 301
cccguuaaccacuuca

SEQ ID NO: 2019394 - RNA, 18 nt, Shigella flexneri 2a str. 301
cccguuacgauucucugc

SEQ ID NO: 2019395 - RNA, 13 nt, Shigella flexneri 2a str. 301
cccguuuucucca

SEQ ID NO: 2019396 - RNA, 19 nt, Shigella flexneri 2a str. 301
cccguuucagccccuugcu

SEQ ID NO: 2019397 - RNA, 17 nt, Shigella flexneri 2a str. 301
cccgugagucuccuuua

SEQ ID NO: 2019398 - RNA, 22 nt, Shigella flexneri 2a str. 301
cccgugacacacugaaccgcgc

SEQ ID NO: 2019399 - RNA, 17 nt, Shigella flexneri 2a str. 301
cccgugggcaggccugg

SEQ ID NO: 2019400 - RNA, 21 nt, Shigella flexneri 2a str. 301
cccgugcuguuaauaucuuuc

SEQ ID NO: 2019401 - RNA, 14 nt, Shigella flexneri 2a str. 301
cccgguugacugcu

SEQ ID NO: 2019402 - RNA, 23 nt, Shigella flexneri 2a str. 301
cccgguuaauugcgccagcacau

SEQ ID NO: 2019403 - RNA, 19 nt, Shigella flexneri 2a str. 301
cccgguguucccgcgccag

SEQ ID NO: 2019404 - RNA, 15 nt, Shigella flexneri 2a str. 301
cccgguuucucuucu

SEQ ID NO: 2019405 - RNA, 14 nt, Shigella flexneri 2a str. 301
cccgucagcaaaau

SEQ ID NO: 2019406 - RNA, 22 nt, Shigella flexneri 2a str. 301
cccgucaauuaccacuggccca

SEQ ID NO: 2019407 - RNA, 13 nt, Shigella flexneri 2a str. 301
cccgcucaaacac

SEQ ID NO: 2019408 - RNA, 22 nt, Shigella flexneri 2a str. 301
cccgcuaccugccgccaccaug

SEQ ID NO: 2019409 - RNA, 13 nt, Shigella flexneri 2a str. 301
cccgcucauaaua

SEQ ID NO: 2019410 - RNA, 20 nt, Shigella flexneri 2a str. 301
cccgcugccgcagauauucc

SEQ ID NO: 2019411 - RNA, 13 nt, Shigella flexneri 2a str. 301
cccgcugaaaagc

SEQ ID NO: 2019412 - RNA, 15 nt, Shigella flexneri 2a str. 301
cccgcuuccugcagc

SEQ ID NO: 2019413 - RNA, 12 nt, Shigella flexneri 2a str. 301
cccgcguucugg

SEQ ID NO: 2019414 - RNA, 18 nt, Shigella flexneri 2a str. 301
cccgcguuaagacacacu

SEQ ID NO: 2019415 - RNA, 19 nt, Shigella flexneri 2a str. 301
cccgcguuaagacacacua

SEQ ID NO: 2019416 - RNA, 21 nt, Shigella flexneri 2a str. 301
cccgcgcgguaucaccaccca

SEQ ID NO: 2019417 - RNA, 20 nt, Shigella flexneri 2a str. 301
cccgcuucguuuucagcuuc

SEQ ID NO: 2019418 - RNA, 18 nt, Shigella flexneri 2a str. 301
cccgcuuccugcagcgug

SEQ ID NO: 2019419 - RNA, 23 nt, Shigella flexneri 2a str. 301
cccgcuuuggcgucuucugccgg

SEQ ID NO: 2019420 - RNA, 23 nt, Shigella flexneri 2a str. 301
cccggaacgggagaaacccggcc

SEQ ID NO: 2019421 - RNA, 23 nt, Shigella flexneri 2a str. 301
cccggaagccaccacgccaagaa

SEQ ID NO: 2019422 - RNA, 13 nt, Shigella flexneri 2a str. 301
cccggaagccacc

SEQ ID NO: 2019423 - RNA, 14 nt, Shigella flexneri 2a str. 301
cccggaacgggaga

SEQ ID NO: 2019424 - RNA, 20 nt, Shigella flexneri 2a str. 301
cccggacaguccccucgccc

SEQ ID NO: 2019425 - RNA, 15 nt, Shigella flexneri 2a str. 301
cccggauaucaccac

SEQ ID NO: 2019426 - RNA, 16 nt, Shigella flexneri 2a str. 301
cccggaucguucacau

SEQ ID NO: 2019427 - RNA, 12 nt, Shigella flexneri 2a str. 301
cccggagcagca

SEQ ID NO: 2019428 - RNA, 17 nt, Shigella flexneri 2a str. 301
cccggcauucaccucug

SEQ ID NO: 2019429 - RNA, 21 nt, Shigella flexneri 2a str. 301
cccggcaaucaccgccagcgg

SEQ ID NO: 2019430 - RNA, 21 nt, Shigella flexneri 2a str. 301
cccggcaccaaucaccgccag

SEQ ID NO: 2019431 - RNA, 16 nt, Shigella flexneri 2a str. 301
cccggcaccaaucacc

SEQ ID NO: 2019432 - RNA, 12 nt, Shigella flexneri 2a str. 301
cccgccacccca

SEQ ID NO: 2019433 - RNA, 16 nt, Shigella flexneri 2a str. 301
cccgcauccgcugaug

SEQ ID NO: 2019434 - RNA, 17 nt, Shigella flexneri 2a str. 301
cccgcauccgcugaugc

SEQ ID NO: 2019435 - RNA, 16 nt, Shigella flexneri 2a str. 301
cccgcauuuacucuca

SEQ ID NO: 2019436 - RNA, 16 nt, Shigella flexneri 2a str. 301
cccgccaaccaccgcc

SEQ ID NO: 2019437 - RNA, 18 nt, Shigella flexneri 2a str. 301
cccgcagccagcacugcc

SEQ ID NO: 2019438 - RNA, 12 nt, Shigella flexneri 2a str. 301
cccgcagccacg

SEQ ID NO: 2019439 - RNA, 13 nt, Shigella flexneri 2a str. 301
cccgcccaaucga

SEQ ID NO: 2019440 - RNA, 14 nt, Shigella flexneri 2a str. 301
cccgccagcagaau

SEQ ID NO: 2019441 - RNA, 15 nt, Shigella flexneri 2a str. 301
cccgccccugacagg

SEQ ID NO: 2019442 - RNA, 21 nt, Shigella flexneri 2a str. 301
cccgccuguugcgucgccgcc

SEQ ID NO: 2019443 - RNA, 18 nt, Shigella flexneri 2a str. 301
cccgcgauaaaaauccug

SEQ ID NO: 2019444 - RNA, 13 nt, Shigella flexneri 2a str. 301
cccgcgaccacca

SEQ ID NO: 2019445 - RNA, 15 nt, Shigella flexneri 2a str. 301
cccgcgaccaccagc

SEQ ID NO: 2019446 - RNA, 17 nt, Shigella flexneri 2a str. 301
cccgcgccauauaauac

SEQ ID NO: 2019447 - RNA, 16 nt, Shigella flexneri 2a str. 301
cccgccguugccgcag

SEQ ID NO: 2019448 - RNA, 16 nt, Shigella flexneri 2a str. 301
cccgccugagucacuu

SEQ ID NO: 2019449 - RNA, 15 nt, Shigella flexneri 2a str. 301
cccgccugauagacc

SEQ ID NO: 2019450 - RNA, 12 nt, Shigella flexneri 2a str. 301
cccgccggcgua

SEQ ID NO: 2019451 - RNA, 21 nt, Shigella flexneri 2a str. 301
cccgccgcgacuauucacugc

SEQ ID NO: 2019452 - RNA, 15 nt, Shigella flexneri 2a str. 301
cccgccgccauccug

SEQ ID NO: 2019453 - RNA, 18 nt, Shigella flexneri 2a str. 301
cgguugcuuuucacaacc

SEQ ID NO: 2019454 - RNA, 22 nt, Shigella flexneri 2a str. 301
cgguuggcaucagaggaaugau

SEQ ID NO: 2019455 - RNA, 12 nt, Shigella flexneri 2a str. 301
cgguugccauaa

SEQ ID NO: 2019456 - RNA, 23 nt, Shigella flexneri 2a str. 301
cgguucaauaucuuccuggcgcu

SEQ ID NO: 2019457 - RNA, 15 nt, Shigella flexneri 2a str. 301
cgguugcugaacagc

SEQ ID NO: 2019458 - RNA, 19 nt, Shigella flexneri 2a str. 301
cgguugcggaacccagcgc

SEQ ID NO: 2019459 - RNA, 14 nt, Shigella flexneri 2a str. 301
cgguuuauccccaa

SEQ ID NO: 2019460 - RNA, 15 nt, Shigella flexneri 2a str. 301
cgguuuaucucaucu

SEQ ID NO: 2019461 - RNA, 18 nt, Shigella flexneri 2a str. 301
cgguuuaucaucggucag

SEQ ID NO: 2019462 - RNA, 18 nt, Shigella flexneri 2a str. 301
cgguuucaauuucccgcu

SEQ ID NO: 2019463 - RNA, 22 nt, Shigella flexneri 2a str. 301
cgguuguucaaccaccggcacc

SEQ ID NO: 2019464 - RNA, 23 nt, Shigella flexneri 2a str. 301
cgguuguucaaccaccggcacca

SEQ ID NO: 2019465 - RNA, 14 nt, Shigella flexneri 2a str. 301
cgguuucucuucug

SEQ ID NO: 2019466 - RNA, 16 nt, Shigella flexneri 2a str. 301
cgguuucucuucugcu

SEQ ID NO: 2019467 - RNA, 16 nt, Shigella flexneri 2a str. 301
cgguuugccauuuucu

SEQ ID NO: 2019468 - RNA, 13 nt, Shigella flexneri 2a str. 301
cgguuugccauuu

SEQ ID NO: 2019469 - RNA, 19 nt, Shigella flexneri 2a str. 301
cgguuuguaggccugauaa

SEQ ID NO: 2019470 - RNA, 20 nt, Shigella flexneri 2a str. 301
cgguuuucgcgccagccagu

SEQ ID NO: 2019471 - RNA, 17 nt, Shigella flexneri 2a str. 301
cguaaaccacugacaca

SEQ ID NO: 2019472 - RNA, 18 nt, Shigella flexneri 2a str. 301
cguaaaccacugacacag

SEQ ID NO: 2019473 - RNA, 13 nt, Shigella flexneri 2a str. 301
cguaacgacugac

SEQ ID NO: 2019474 - RNA, 23 nt, Shigella flexneri 2a str. 301
cguaacgccacgauagagagcag

SEQ ID NO: 2019475 - RNA, 15 nt, Shigella flexneri 2a str. 301
cguaacgaccaccac

SEQ ID NO: 2019476 - RNA, 20 nt, Shigella flexneri 2a str. 301
cguaaaggcggcagaacaga

SEQ ID NO: 2019477 - RNA, 14 nt, Shigella flexneri 2a str. 301
cguaacccaccacc

SEQ ID NO: 2019478 - RNA, 18 nt, Shigella flexneri 2a str. 301
cguaaagcgucgcaucag

SEQ ID NO: 2019479 - RNA, 14 nt, Shigella flexneri 2a str. 301
cgguuaaaaauaau

SEQ ID NO: 2019480 - RNA, 17 nt, Shigella flexneri 2a str. 301
cgguuaacaguuuguuu

SEQ ID NO: 2019481 - RNA, 17 nt, Shigella flexneri 2a str. 301
cgguuagcucaacgcau

SEQ ID NO: 2019482 - RNA, 20 nt, Shigella flexneri 2a str. 301
cgguuagaauaccugccugu

SEQ ID NO: 2019483 - RNA, 23 nt, Shigella flexneri 2a str. 301
cgguuagaacaauuaacccgcga

SEQ ID NO: 2019484 - RNA, 13 nt, Shigella flexneri 2a str. 301
cggugggcugaca

SEQ ID NO: 2019485 - RNA, 15 nt, Shigella flexneri 2a str. 301
cgguguccacuuccg

SEQ ID NO: 2019486 - RNA, 18 nt, Shigella flexneri 2a str. 301
cgguccuggcgaucgggc

SEQ ID NO: 2019487 - RNA, 20 nt, Shigella flexneri 2a str. 301
cggucacggcuguagccagc

SEQ ID NO: 2019488 - RNA, 19 nt, Shigella flexneri 2a str. 301
cggucgaggcaaccagcac

SEQ ID NO: 2019489 - RNA, 16 nt, Shigella flexneri 2a str. 301
cggucgaugcgcaacg

SEQ ID NO: 2019490 - RNA, 19 nt, Shigella flexneri 2a str. 301
cggucgccgucaggcaagc

SEQ ID NO: 2019491 - RNA, 21 nt, Shigella flexneri 2a str. 301
cggugauuuccgccgccagca

SEQ ID NO: 2019492 - RNA, 19 nt, Shigella flexneri 2a str. 301
cggugauguuuaucgucug

SEQ ID NO: 2019493 - RNA, 14 nt, Shigella flexneri 2a str. 301
cggugaccagcagc

SEQ ID NO: 2019494 - RNA, 20 nt, Shigella flexneri 2a str. 301
cggugaccgaucgcccgcca

SEQ ID NO: 2019495 - RNA, 22 nt, Shigella flexneri 2a str. 301
cggucguuaccaguaaaugcgg

SEQ ID NO: 2019496 - RNA, 23 nt, Shigella flexneri 2a str. 301
cggucguaaucgcccgcuuccag

SEQ ID NO: 2019497 - RNA, 17 nt, Shigella flexneri 2a str. 301
cguagcuguucaggaga

SEQ ID NO: 2019498 - RNA, 21 nt, Shigella flexneri 2a str. 301
cguagcuggcggcaaugaaag

SEQ ID NO: 2019499 - RNA, 14 nt, Shigella flexneri 2a str. 301
cguagcucaucuuc

SEQ ID NO: 2019500 - RNA, 17 nt, Shigella flexneri 2a str. 301
cguagcucaucuucaua

SEQ ID NO: 2019501 - RNA, 21 nt, Shigella flexneri 2a str. 301
cguaggccagcggcuccccgc

SEQ ID NO: 2019502 - RNA, 13 nt, Shigella flexneri 2a str. 301
cguaggccugaua

SEQ ID NO: 2019503 - RNA, 24 nt, Shigella flexneri 2a str. 301
cguagcaccgacgucgauauaauu

SEQ ID NO: 2019504 - RNA, 15 nt, Shigella flexneri 2a str. 301
cguagccagauuguu

SEQ ID NO: 2019505 - RNA, 17 nt, Shigella flexneri 2a str. 301
cguagcaguucaccgcc

SEQ ID NO: 2019506 - RNA, 16 nt, Shigella flexneri 2a str. 301
cguacuugccaauacg

SEQ ID NO: 2019507 - RNA, 19 nt, Shigella flexneri 2a str. 301
cguagaagccauuaaacac

SEQ ID NO: 2019508 - RNA, 19 nt, Shigella flexneri 2a str. 301
cguaguguggggaaugaua

SEQ ID NO: 2019509 - RNA, 16 nt, Shigella flexneri 2a str. 301
cguaguucuuucucug

SEQ ID NO: 2019510 - RNA, 17 nt, Shigella flexneri 2a str. 301
cguaggucggauaagac

SEQ ID NO: 2019511 - RNA, 21 nt, Shigella flexneri 2a str. 301
cguauccgaugaaucaccaca

SEQ ID NO: 2019512 - RNA, 13 nt, Shigella flexneri 2a str. 301
cguauccggcaug

SEQ ID NO: 2019513 - RNA, 20 nt, Shigella flexneri 2a str. 301
cguauccggcaugucacaaa

SEQ ID NO: 2019514 - RNA, 13 nt, Shigella flexneri 2a str. 301
cguauccggcauu

SEQ ID NO: 2019515 - RNA, 20 nt, Shigella flexneri 2a str. 301
cguauccagcauaccuucca

SEQ ID NO: 2019516 - RNA, 18 nt, Shigella flexneri 2a str. 301
cguaugcagccaggccau

SEQ ID NO: 2019517 - RNA, 14 nt, Shigella flexneri 2a str. 301
cguaugcauaauuu

SEQ ID NO: 2019518 - RNA, 14 nt, Shigella flexneri 2a str. 301
cguaugcccagcgc

SEQ ID NO: 2019519 - RNA, 15 nt, Shigella flexneri 2a str. 301
cguaugcgucagcaa

SEQ ID NO: 2019520 - RNA, 12 nt, Shigella flexneri 2a str. 301
cguauccaucac

SEQ ID NO: 2019521 - RNA, 14 nt, Shigella flexneri 2a str. 301
cguaucuuccaggg

SEQ ID NO: 2019522 - RNA, 23 nt, Shigella flexneri 2a str. 301
cguauuccgcguuacccauucaa

SEQ ID NO: 2019523 - RNA, 23 nt, Shigella flexneri 2a str. 301
cguauuuuuugcucauaaaauca

SEQ ID NO: 2019524 - RNA, 13 nt, Shigella flexneri 2a str. 301
cgucaaaaucauc

SEQ ID NO: 2019525 - RNA, 15 nt, Shigella flexneri 2a str. 301
cguauuuauuuucca

SEQ ID NO: 2019526 - RNA, 14 nt, Shigella flexneri 2a str. 301
cgucaggauaaacu

SEQ ID NO: 2019527 - RNA, 14 nt, Shigella flexneri 2a str. 301
cgucaggccgccac

SEQ ID NO: 2019528 - RNA, 16 nt, Shigella flexneri 2a str. 301
cgucagcucgcugcca

SEQ ID NO: 2019529 - RNA, 14 nt, Shigella flexneri 2a str. 301
cgucagcuucagau

SEQ ID NO: 2019530 - RNA, 21 nt, Shigella flexneri 2a str. 301
cgucagcggcaauucuuucuc

SEQ ID NO: 2019531 - RNA, 23 nt, Shigella flexneri 2a str. 301
cgucagcaguucacgcagcuucu

SEQ ID NO: 2019532 - RNA, 20 nt, Shigella flexneri 2a str. 301
cgucagccacuucuuccagc

SEQ ID NO: 2019533 - RNA, 23 nt, Shigella flexneri 2a str. 301
cgucagccacuucuuccagcggc

SEQ ID NO: 2019534 - RNA, 17 nt, Shigella flexneri 2a str. 301
cgucagccacuccacug

SEQ ID NO: 2019535 - RNA, 15 nt, Shigella flexneri 2a str. 301
cgucagccugcucag

SEQ ID NO: 2019536 - RNA, 17 nt, Shigella flexneri 2a str. 301
cgucagcaaaauacuga

SEQ ID NO: 2019537 - RNA, 13 nt, Shigella flexneri 2a str. 301
cgucagcaacaug

SEQ ID NO: 2019538 - RNA, 23 nt, Shigella flexneri 2a str. 301
cgucagaaaaaucaauauuuuca

SEQ ID NO: 2019539 - RNA, 21 nt, Shigella flexneri 2a str. 301
cgucagaccggcaaccagcac

SEQ ID NO: 2019540 - RNA, 23 nt, Shigella flexneri 2a str. 301
cgucagaccggcaaccagcaccg

SEQ ID NO: 2019541 - RNA, 16 nt, Shigella flexneri 2a str. 301
cgucagauccgccagu

SEQ ID NO: 2019542 - RNA, 15 nt, Shigella flexneri 2a str. 301
cgucaucagcaauuu

SEQ ID NO: 2019543 - RNA, 16 nt, Shigella flexneri 2a str. 301
cgucauauuacugcaa

SEQ ID NO: 2019544 - RNA, 18 nt, Shigella flexneri 2a str. 301
cgucauauuacugcaacu

SEQ ID NO: 2019545 - RNA, 17 nt, Shigella flexneri 2a str. 301
cgucauacugcucagac

SEQ ID NO: 2019546 - RNA, 15 nt, Shigella flexneri 2a str. 301
cgucauacuccaguc

SEQ ID NO: 2019547 - RNA, 19 nt, Shigella flexneri 2a str. 301
cgucaguacauagccaucu

SEQ ID NO: 2019548 - RNA, 17 nt, Shigella flexneri 2a str. 301
cgucaguaaccgcuuuu

SEQ ID NO: 2019549 - RNA, 13 nt, Shigella flexneri 2a str. 301
cgucagguuuugu

SEQ ID NO: 2019550 - RNA, 19 nt, Shigella flexneri 2a str. 301
cgucaggucacccaacaug

SEQ ID NO: 2019551 - RNA, 23 nt, Shigella flexneri 2a str. 301
cgucagugucuuaucuggcauuu

SEQ ID NO: 2019552 - RNA, 18 nt, Shigella flexneri 2a str. 301
cgucagugucuuaucugg

SEQ ID NO: 2019553 - RNA, 21 nt, Shigella flexneri 2a str. 301
cgucaguacauagccaucugc

SEQ ID NO: 2019554 - RNA, 18 nt, Shigella flexneri 2a str. 301
cgucauccauaccacgac

SEQ ID NO: 2019555 - RNA, 15 nt, Shigella flexneri 2a str. 301
cgucaucccagucuu

SEQ ID NO: 2019556 - RNA, 18 nt, Shigella flexneri 2a str. 301
cgucauccggaaagcaca

SEQ ID NO: 2019557 - RNA, 22 nt, Shigella flexneri 2a str. 301
cgucaucauucaucgccuucuu

SEQ ID NO: 2019558 - RNA, 19 nt, Shigella flexneri 2a str. 301
cgucaucggcguugcccau

SEQ ID NO: 2019559 - RNA, 19 nt, Shigella flexneri 2a str. 301
cgucaucgguaugcaacau

SEQ ID NO: 2019560 - RNA, 13 nt, Shigella flexneri 2a str. 301
cgucaaucugccc

SEQ ID NO: 2019561 - RNA, 22 nt, Shigella flexneri 2a str. 301
cgucaauuuuaagcagaucggc

SEQ ID NO: 2019562 - RNA, 20 nt, Shigella flexneri 2a str. 301
cgucaauuuguuccgccagc

SEQ ID NO: 2019563 - RNA, 13 nt, Shigella flexneri 2a str. 301
cgucacaggccau

SEQ ID NO: 2019564 - RNA, 13 nt, Shigella flexneri 2a str. 301
cgucacaccuuca

SEQ ID NO: 2019565 - RNA, 23 nt, Shigella flexneri 2a str. 301
cgucaacuuuguuagcgaauaaa

SEQ ID NO: 2019566 - RNA, 18 nt, Shigella flexneri 2a str. 301
cgucaacggugccauuga

SEQ ID NO: 2019567 - RNA, 18 nt, Shigella flexneri 2a str. 301
cgucaagcgucgcaucag

SEQ ID NO: 2019568 - RNA, 17 nt, Shigella flexneri 2a str. 301
cgucaaggguugccgga

SEQ ID NO: 2019569 - RNA, 17 nt, Shigella flexneri 2a str. 301
cgucaaccugaccaaau

SEQ ID NO: 2019570 - RNA, 17 nt, Shigella flexneri 2a str. 301
cgucacgcucauccugg

SEQ ID NO: 2019571 - RNA, 16 nt, Shigella flexneri 2a str. 301
cgucacggacucggcg

SEQ ID NO: 2019572 - RNA, 17 nt, Shigella flexneri 2a str. 301
cgucacguucugcgccg

SEQ ID NO: 2019573 - RNA, 23 nt, Shigella flexneri 2a str. 301
cgucacgguaauaacacucggcg

SEQ ID NO: 2019574 - RNA, 20 nt, Shigella flexneri 2a str. 301
cgucacuggugugucaucug

SEQ ID NO: 2019575 - RNA, 16 nt, Shigella flexneri 2a str. 301
cggcgcuaauggcacg

SEQ ID NO: 2019576 - RNA, 22 nt, Shigella flexneri 2a str. 301
cggcggaauagcguacggcaug

SEQ ID NO: 2019577 - RNA, 18 nt, Shigella flexneri 2a str. 301
cggcguaaccgcccagug

SEQ ID NO: 2019578 - RNA, 22 nt, Shigella flexneri 2a str. 301
cggcggcgauguccagacgcgc

SEQ ID NO: 2019579 - RNA, 17 nt, Shigella flexneri 2a str. 301
cggcguucauccugcug

SEQ ID NO: 2019580 - RNA, 18 nt, Shigella flexneri 2a str. 301
cggcguacuaucugcugc

SEQ ID NO: 2019581 - RNA, 15 nt, Shigella flexneri 2a str. 301
cggcguacuggcaau

SEQ ID NO: 2019582 - RNA, 21 nt, Shigella flexneri 2a str. 301
cggcuaucuacgcguaaaugc

SEQ ID NO: 2019583 - RNA, 13 nt, Shigella flexneri 2a str. 301
cggcuaucuacgc

SEQ ID NO: 2019584 - RNA, 17 nt, Shigella flexneri 2a str. 301
cggcucaccccgcgcac

SEQ ID NO: 2019585 - RNA, 17 nt, Shigella flexneri 2a str. 301
cggcuacacuauuuccu

SEQ ID NO: 2019586 - RNA, 15 nt, Shigella flexneri 2a str. 301
cggcuccguuccgcu

SEQ ID NO: 2019587 - RNA, 23 nt, Shigella flexneri 2a str. 301
cggcuccgguuaacgccgcgccc

SEQ ID NO: 2019588 - RNA, 24 nt, Shigella flexneri 2a str. 301
cggcuccgguuaacgccgcgcccg

SEQ ID NO: 2019589 - RNA, 19 nt, Shigella flexneri 2a str. 301
cggcuccgcugacgccugc

SEQ ID NO: 2019590 - RNA, 15 nt, Shigella flexneri 2a str. 301
cggcugcagugcaau

SEQ ID NO: 2019591 - RNA, 15 nt, Shigella flexneri 2a str. 301
cggcuggcugaccug

SEQ ID NO: 2019592 - RNA, 16 nt, Shigella flexneri 2a str. 301
cggcuggcugaccuga

SEQ ID NO: 2019593 - RNA, 17 nt, Shigella flexneri 2a str. 301
cggcuuugcagguucug

SEQ ID NO: 2019594 - RNA, 13 nt, Shigella flexneri 2a str. 301
cggcuuucaaggc

SEQ ID NO: 2019595 - RNA, 20 nt, Shigella flexneri 2a str. 301
cggcuucgccuccuguucug

SEQ ID NO: 2019596 - RNA, 18 nt, Shigella flexneri 2a str. 301
cggcuucgccuccuguuc

SEQ ID NO: 2019597 - RNA, 18 nt, Shigella flexneri 2a str. 301
cggcuuguucaucaccau

SEQ ID NO: 2019598 - RNA, 15 nt, Shigella flexneri 2a str. 301
cggcuuguggugaaa

SEQ ID NO: 2019599 - RNA, 14 nt, Shigella flexneri 2a str. 301
cggcuguccggcac

SEQ ID NO: 2019600 - RNA, 18 nt, Shigella flexneri 2a str. 301
cggcuguccggcaccauc

SEQ ID NO: 2019601 - RNA, 16 nt, Shigella flexneri 2a str. 301
cggcugucuuccugug

SEQ ID NO: 2019602 - RNA, 14 nt, Shigella flexneri 2a str. 301
cggcuuauauauua

SEQ ID NO: 2019603 - RNA, 19 nt, Shigella flexneri 2a str. 301
cggcuucauuggcgcgcgu

SEQ ID NO: 2019604 - RNA, 16 nt, Shigella flexneri 2a str. 301
cgggcgauccggcaaa

SEQ ID NO: 2019605 - RNA, 14 nt, Shigella flexneri 2a str. 301
cgggcgaccaauca

SEQ ID NO: 2019606 - RNA, 18 nt, Shigella flexneri 2a str. 301
cgggcgaauuuacccggu

SEQ ID NO: 2019607 - RNA, 16 nt, Shigella flexneri 2a str. 301
cgggcgaaagcagaaa

SEQ ID NO: 2019608 - RNA, 15 nt, Shigella flexneri 2a str. 301
cgggccgcaaaccag

SEQ ID NO: 2019609 - RNA, 21 nt, Shigella flexneri 2a str. 301
cgggccgcaaaccagcgcaug

SEQ ID NO: 2019610 - RNA, 15 nt, Shigella flexneri 2a str. 301
cgggccugaacaagc

SEQ ID NO: 2019611 - RNA, 17 nt, Shigella flexneri 2a str. 301
cgggccguaacugugcc

SEQ ID NO: 2019612 - RNA, 18 nt, Shigella flexneri 2a str. 301
cgggccaucagagcugga

SEQ ID NO: 2019613 - RNA, 21 nt, Shigella flexneri 2a str. 301
cgggccauaaaaggaagaggc

SEQ ID NO: 2019614 - RNA, 17 nt, Shigella flexneri 2a str. 301
cgggccaguuucauagu

SEQ ID NO: 2019615 - RNA, 14 nt, Shigella flexneri 2a str. 301
cgggcauauuuccg

SEQ ID NO: 2019616 - RNA, 21 nt, Shigella flexneri 2a str. 301
cgggcacagauuuccaagcgc

SEQ ID NO: 2019617 - RNA, 15 nt, Shigella flexneri 2a str. 301
cgggcaccgccgccg

SEQ ID NO: 2019618 - RNA, 18 nt, Shigella flexneri 2a str. 301
cggcuuuuuuacgccugu

SEQ ID NO: 2019619 - RNA, 16 nt, Shigella flexneri 2a str. 301
cggcuuuuuugucucc

SEQ ID NO: 2019620 - RNA, 24 nt, Shigella flexneri 2a str. 301
cggcuuuuuacuucucagcgucag

SEQ ID NO: 2019621 - RNA, 15 nt, Shigella flexneri 2a str. 301
cgggaauaaaagcca

SEQ ID NO: 2019622 - RNA, 18 nt, Shigella flexneri 2a str. 301
cggggcggcuaucccaaa

SEQ ID NO: 2019623 - RNA, 22 nt, Shigella flexneri 2a str. 301
cgggggcggcaaucgcugcuaa

SEQ ID NO: 2019624 - RNA, 15 nt, Shigella flexneri 2a str. 301
cgggcuuccggcaau

SEQ ID NO: 2019625 - RNA, 14 nt, Shigella flexneri 2a str. 301
cggggucgugcaga

SEQ ID NO: 2019626 - RNA, 13 nt, Shigella flexneri 2a str. 301
cgggcucaugcug

SEQ ID NO: 2019627 - RNA, 15 nt, Shigella flexneri 2a str. 301
cgggcuaaucgucau

SEQ ID NO: 2019628 - RNA, 14 nt, Shigella flexneri 2a str. 301
cgggcguccugcuu

SEQ ID NO: 2019629 - RNA, 15 nt, Shigella flexneri 2a str. 301
cgggcggccucuuca

SEQ ID NO: 2019630 - RNA, 11 nt, Shigella flexneri 2a str. 301
cgcucugagcu

SEQ ID NO: 2019631 - RNA, 22 nt, Shigella flexneri 2a str. 301
cgcugaacugauugccacccug

SEQ ID NO: 2019632 - RNA, 19 nt, Shigella flexneri 2a str. 301
cgcugaauaaacucaccaa

SEQ ID NO: 2019633 - RNA, 20 nt, Shigella flexneri 2a str. 301
cgcucucccaguaaccacgc

SEQ ID NO: 2019634 - RNA, 19 nt, Shigella flexneri 2a str. 301
cgcucaggguaccgauaga

SEQ ID NO: 2019635 - RNA, 20 nt, Shigella flexneri 2a str. 301
cgcucggcuguuucuggaug

SEQ ID NO: 2019636 - RNA, 22 nt, Shigella flexneri 2a str. 301
cgcucguuaaaacgcgcggcgu

SEQ ID NO: 2019637 - RNA, 13 nt, Shigella flexneri 2a str. 301
cgcugaugccagg

SEQ ID NO: 2019638 - RNA, 17 nt, Shigella flexneri 2a str. 301
cgcugccagccgccgcu

SEQ ID NO: 2019639 - RNA, 23 nt, Shigella flexneri 2a str. 301
cgcugacauuacgcgcuucguug

SEQ ID NO: 2019640 - RNA, 18 nt, Shigella flexneri 2a str. 301
cgcugaauaauggugaau

SEQ ID NO: 2019641 - RNA, 16 nt, Shigella flexneri 2a str. 301
cgcugagguccggcca

SEQ ID NO: 2019642 - RNA, 19 nt, Shigella flexneri 2a str. 301
cgcugcgcuuauccggccc

SEQ ID NO: 2019643 - RNA, 15 nt, Shigella flexneri 2a str. 301
cgcugcugcacauac

SEQ ID NO: 2019644 - RNA, 17 nt, Shigella flexneri 2a str. 301
cgcugcgguuuacgcca

SEQ ID NO: 2019645 - RNA, 19 nt, Shigella flexneri 2a str. 301
cgcuggacguugcguugca

SEQ ID NO: 2019646 - RNA, 19 nt, Shigella flexneri 2a str. 301
cgcugcuguagcaguucca

SEQ ID NO: 2019647 - RNA, 19 nt, Shigella flexneri 2a str. 301
cgcugcuuguuccacuuca

SEQ ID NO: 2019648 - RNA, 14 nt, Shigella flexneri 2a str. 301
cgcuggcaccgcag

SEQ ID NO: 2019649 - RNA, 22 nt, Shigella flexneri 2a str. 301
cgcuggcagcguauucgcgcag

SEQ ID NO: 2019650 - RNA, 19 nt, Shigella flexneri 2a str. 301
cgcuuuuuuagguacaaag

SEQ ID NO: 2019651 - RNA, 15 nt, Shigella flexneri 2a str. 301
cgcuuuuauaaaggg

SEQ ID NO: 2019652 - RNA, 13 nt, Shigella flexneri 2a str. 301
cgcuuuuaccagc

SEQ ID NO: 2019653 - RNA, 14 nt, Shigella flexneri 2a str. 301
cggaaagcacaaaa

SEQ ID NO: 2019654 - RNA, 17 nt, Shigella flexneri 2a str. 301
cggaaagcacaaaauca

SEQ ID NO: 2019655 - RNA, 14 nt, Shigella flexneri 2a str. 301
cggaaacagugcug

SEQ ID NO: 2019656 - RNA, 13 nt, Shigella flexneri 2a str. 301
cggaaacccugcg

SEQ ID NO: 2019657 - RNA, 21 nt, Shigella flexneri 2a str. 301
cggaaaauuauuuuaaauuuc

SEQ ID NO: 2019658 - RNA, 19 nt, Shigella flexneri 2a str. 301
cgcuugauucuguucagua

SEQ ID NO: 2019659 - RNA, 14 nt, Shigella flexneri 2a str. 301
cgcuugauuucucg

SEQ ID NO: 2019660 - RNA, 23 nt, Shigella flexneri 2a str. 301
cgcuuacgcgucuuaucaugccu

SEQ ID NO: 2019661 - RNA, 16 nt, Shigella flexneri 2a str. 301
cgcuuacacacccggc

SEQ ID NO: 2019662 - RNA, 17 nt, Shigella flexneri 2a str. 301
cgcuuacacacccggcc

SEQ ID NO: 2019663 - RNA, 17 nt, Shigella flexneri 2a str. 301
cgcuuacccuaaauccg

SEQ ID NO: 2019664 - RNA, 14 nt, Shigella flexneri 2a str. 301
cgcuuuacguuccu

SEQ ID NO: 2019665 - RNA, 18 nt, Shigella flexneri 2a str. 301
cgcuuuaucgccuaccaa

SEQ ID NO: 2019666 - RNA, 16 nt, Shigella flexneri 2a str. 301
cgcuuuaucgccgcug

SEQ ID NO: 2019667 - RNA, 20 nt, Shigella flexneri 2a str. 301
cgcuuuauagggugccauuu

SEQ ID NO: 2019668 - RNA, 14 nt, Shigella flexneri 2a str. 301
cgcuuucaggucag

SEQ ID NO: 2019669 - RNA, 14 nt, Shigella flexneri 2a str. 301
cgcuuuaugugcuu

SEQ ID NO: 2019670 - RNA, 17 nt, Shigella flexneri 2a str. 301
cgcugguuaccaccugc

SEQ ID NO: 2019671 - RNA, 14 nt, Shigella flexneri 2a str. 301
cgcugguguacugc

SEQ ID NO: 2019672 - RNA, 15 nt, Shigella flexneri 2a str. 301
cgcuguaauauccaa

SEQ ID NO: 2019673 - RNA, 19 nt, Shigella flexneri 2a str. 301
cgcuggugauugcaccgac

SEQ ID NO: 2019674 - RNA, 23 nt, Shigella flexneri 2a str. 301
cgcuggcgggcguuaucacguug

SEQ ID NO: 2019675 - RNA, 22 nt, Shigella flexneri 2a str. 301
cgcuguggaacaucaccccgcc

SEQ ID NO: 2019676 - RNA, 17 nt, Shigella flexneri 2a str. 301
cgcuguugcguaacuga

SEQ ID NO: 2019677 - RNA, 20 nt, Shigella flexneri 2a str. 301
cgcuguugaggcacaucuua

SEQ ID NO: 2019678 - RNA, 22 nt, Shigella flexneri 2a str. 301
cgcuuaagguuacccgcacggc

SEQ ID NO: 2019679 - RNA, 23 nt, Shigella flexneri 2a str. 301
cgcuuaaucaauugcaggaaggu

SEQ ID NO: 2019680 - RNA, 18 nt, Shigella flexneri 2a str. 301
cgcuuaaauuuccaccgc

SEQ ID NO: 2019681 - RNA, 18 nt, Shigella flexneri 2a str. 301
cgcuguaauuaccagcgc

SEQ ID NO: 2019682 - RNA, 16 nt, Shigella flexneri 2a str. 301
cgcuguauuuugcguu

SEQ ID NO: 2019683 - RNA, 23 nt, Shigella flexneri 2a str. 301
cgcugucgggcagcguuugaaca

SEQ ID NO: 2019684 - RNA, 20 nt, Shigella flexneri 2a str. 301
cgcugucuggcgucuccugc

SEQ ID NO: 2019685 - RNA, 14 nt, Shigella flexneri 2a str. 301
cgcggcccaggcgg

SEQ ID NO: 2019686 - RNA, 14 nt, Shigella flexneri 2a str. 301
cgcggauccccugc

SEQ ID NO: 2019687 - RNA, 13 nt, Shigella flexneri 2a str. 301
cgcggauccccug

SEQ ID NO: 2019688 - RNA, 21 nt, Shigella flexneri 2a str. 301
cgcgccgcgguacagcucggu

SEQ ID NO: 2019689 - RNA, 16 nt, Shigella flexneri 2a str. 301
cgcggcauacagccag

SEQ ID NO: 2019690 - RNA, 20 nt, Shigella flexneri 2a str. 301
cgcggcauuuuuacugcgcg

SEQ ID NO: 2019691 - RNA, 19 nt, Shigella flexneri 2a str. 301
cgcggauuuuauucagcag

SEQ ID NO: 2019692 - RNA, 15 nt, Shigella flexneri 2a str. 301
cgcggauggccucug

SEQ ID NO: 2019693 - RNA, 22 nt, Shigella flexneri 2a str. 301
cgcggauggccucugccagcug

SEQ ID NO: 2019694 - RNA, 23 nt, Shigella flexneri 2a str. 301
cgcggauggccucugccagcugc

SEQ ID NO: 2019695 - RNA, 17 nt, Shigella flexneri 2a str. 301
cgcgguaaagcgcggca

SEQ ID NO: 2019696 - RNA, 18 nt, Shigella flexneri 2a str. 301
cgcgggccauccaccagu

SEQ ID NO: 2019697 - RNA, 16 nt, Shigella flexneri 2a str. 301
cgcgugcgcggcagcc

SEQ ID NO: 2019698 - RNA, 22 nt, Shigella flexneri 2a str. 301
cgcgugccuaacaauucgccag

SEQ ID NO: 2019699 - RNA, 19 nt, Shigella flexneri 2a str. 301
cgcuaaaaaagguaacauu

SEQ ID NO: 2019700 - RNA, 21 nt, Shigella flexneri 2a str. 301
cgcguuuccacgcugauugca

SEQ ID NO: 2019701 - RNA, 13 nt, Shigella flexneri 2a str. 301
cgcuaaauguuua

SEQ ID NO: 2019702 - RNA, 12 nt, Shigella flexneri 2a str. 301
cgcuaaauguuu

SEQ ID NO: 2019703 - RNA, 16 nt, Shigella flexneri 2a str. 301
cgcuaacggugcacgc

SEQ ID NO: 2019704 - RNA, 14 nt, Shigella flexneri 2a str. 301
cgcuaccgcccuga

SEQ ID NO: 2019705 - RNA, 13 nt, Shigella flexneri 2a str. 301
cgcuaacccgcgu

SEQ ID NO: 2019706 - RNA, 13 nt, Shigella flexneri 2a str. 301
cgcuaacagcagc

SEQ ID NO: 2019707 - RNA, 14 nt, Shigella flexneri 2a str. 301
cgcuaacagcagca

SEQ ID NO: 2019708 - RNA, 13 nt, Shigella flexneri 2a str. 301
cgcuacuggcaau

SEQ ID NO: 2019709 - RNA, 15 nt, Shigella flexneri 2a str. 301
cgcuacuucaaacaa

SEQ ID NO: 2019710 - RNA, 15 nt, Shigella flexneri 2a str. 301
cgcuauccagcgcau

SEQ ID NO: 2019711 - RNA, 14 nt, Shigella flexneri 2a str. 301
cgcucagcuccucu

SEQ ID NO: 2019712 - RNA, 17 nt, Shigella flexneri 2a str. 301
cgcucacgcgcugccuc

SEQ ID NO: 2019713 - RNA, 19 nt, Shigella flexneri 2a str. 301
cgcuauucgaaccaacacu

SEQ ID NO: 2019714 - RNA, 12 nt, Shigella flexneri 2a str. 301
cgcucacgcagc

SEQ ID NO: 2019715 - RNA, 18 nt, Shigella flexneri 2a str. 301
cgcucacgcagcggcggc

SEQ ID NO: 2019716 - RNA, 18 nt, Shigella flexneri 2a str. 301
cgcgguagcgggcaguaa

SEQ ID NO: 2019717 - RNA, 12 nt, Shigella flexneri 2a str. 301
cgcgguagcacg

SEQ ID NO: 2019718 - RNA, 19 nt, Shigella flexneri 2a str. 301
cgcgguaucaccacccagc

SEQ ID NO: 2019719 - RNA, 21 nt, Shigella flexneri 2a str. 301
cgcggucgccgucaggcaagc

SEQ ID NO: 2019720 - RNA, 16 nt, Shigella flexneri 2a str. 301
cgcguaaaacagccag

SEQ ID NO: 2019721 - RNA, 17 nt, Shigella flexneri 2a str. 301
cgcguaaaacagccagc

SEQ ID NO: 2019722 - RNA, 15 nt, Shigella flexneri 2a str. 301
cgcgguuugugcucu

SEQ ID NO: 2019723 - RNA, 21 nt, Shigella flexneri 2a str. 301
cgcguccccugcaauauuuug

SEQ ID NO: 2019724 - RNA, 19 nt, Shigella flexneri 2a str. 301
cgcguccggcgucgcuucu

SEQ ID NO: 2019725 - RNA, 12 nt, Shigella flexneri 2a str. 301
cggccaguaacc

SEQ ID NO: 2019726 - RNA, 18 nt, Shigella flexneri 2a str. 301
cggcccaccuggcugagc

SEQ ID NO: 2019727 - RNA, 19 nt, Shigella flexneri 2a str. 301
cggcaucgcauucaccaga

SEQ ID NO: 2019728 - RNA, 12 nt, Shigella flexneri 2a str. 301
cggccagcagcu

SEQ ID NO: 2019729 - RNA, 14 nt, Shigella flexneri 2a str. 301
cggccagcgcaccu

SEQ ID NO: 2019730 - RNA, 15 nt, Shigella flexneri 2a str. 301
cggcccggcgacgac

SEQ ID NO: 2019731 - RNA, 15 nt, Shigella flexneri 2a str. 301
cggcccggaggaugc

SEQ ID NO: 2019732 - RNA, 22 nt, Shigella flexneri 2a str. 301
cggcccgcucggcggcuggcug

SEQ ID NO: 2019733 - RNA, 14 nt, Shigella flexneri 2a str. 301
cggcccggcuuucu

SEQ ID NO: 2019734 - RNA, 19 nt, Shigella flexneri 2a str. 301
cggccucgcuacgccagca

SEQ ID NO: 2019735 - RNA, 22 nt, Shigella flexneri 2a str. 301
cggccuacaaaagcaauaauuu

SEQ ID NO: 2019736 - RNA, 13 nt, Shigella flexneri 2a str. 301
cggcagcgcgcuc

SEQ ID NO: 2019737 - RNA, 13 nt, Shigella flexneri 2a str. 301
cggcagccuccug

SEQ ID NO: 2019738 - RNA, 19 nt, Shigella flexneri 2a str. 301
cggcaggccuaacacaugc

SEQ ID NO: 2019739 - RNA, 23 nt, Shigella flexneri 2a str. 301
cggcauagccaccuggcugcguu

SEQ ID NO: 2019740 - RNA, 21 nt, Shigella flexneri 2a str. 301
cggcauauccaccacccagcg

SEQ ID NO: 2019741 - RNA, 13 nt, Shigella flexneri 2a str. 301
cggcaucaaccag

SEQ ID NO: 2019742 - RNA, 23 nt, Shigella flexneri 2a str. 301
cggcauauuaaccaugacgccga

SEQ ID NO: 2019743 - RNA, 21 nt, Shigella flexneri 2a str. 301
cggcaguggcuaagcaggcug

SEQ ID NO: 2019744 - RNA, 19 nt, Shigella flexneri 2a str. 301
cggcaguuggcgcacaaug

SEQ ID NO: 2019745 - RNA, 16 nt, Shigella flexneri 2a str. 301
cggcaguuugagauug

SEQ ID NO: 2019746 - RNA, 23 nt, Shigella flexneri 2a str. 301
cggcauacguugcaggaaccgca

SEQ ID NO: 2019747 - RNA, 21 nt, Shigella flexneri 2a str. 301
cggcauaccacggucauugac

SEQ ID NO: 2019748 - RNA, 11 nt, Shigella flexneri 2a str. 301
cggcagugcca

SEQ ID NO: 2019749 - RNA, 17 nt, Shigella flexneri 2a str. 301
cggcagugccaguucuu

SEQ ID NO: 2019750 - RNA, 17 nt, Shigella flexneri 2a str. 301
cggcagguugaugauga

SEQ ID NO: 2019751 - RNA, 18 nt, Shigella flexneri 2a str. 301
cggcaccagcgcagaaga

SEQ ID NO: 2019752 - RNA, 12 nt, Shigella flexneri 2a str. 301
cggcaccaccaa

SEQ ID NO: 2019753 - RNA, 15 nt, Shigella flexneri 2a str. 301
cggcaccaccaaaaa

SEQ ID NO: 2019754 - RNA, 13 nt, Shigella flexneri 2a str. 301
cggcaccacauuc

SEQ ID NO: 2019755 - RNA, 13 nt, Shigella flexneri 2a str. 301
cggcaccacaaac

SEQ ID NO: 2019756 - RNA, 17 nt, Shigella flexneri 2a str. 301
cggcaaauaacagaccu

SEQ ID NO: 2019757 - RNA, 19 nt, Shigella flexneri 2a str. 301
cggcaacaaauucacgccu

SEQ ID NO: 2019758 - RNA, 23 nt, Shigella flexneri 2a str. 301
cggcaaagugaauacagaacagu

SEQ ID NO: 2019759 - RNA, 19 nt, Shigella flexneri 2a str. 301
cggcaaccacacccacauc

SEQ ID NO: 2019760 - RNA, 15 nt, Shigella flexneri 2a str. 301
cggcaaccagcaccg

SEQ ID NO: 2019761 - RNA, 13 nt, Shigella flexneri 2a str. 301
cggcaaccgcauc

SEQ ID NO: 2019762 - RNA, 14 nt, Shigella flexneri 2a str. 301
cggcacuccucuuc

SEQ ID NO: 2019763 - RNA, 14 nt, Shigella flexneri 2a str. 301
cggcagaagcaauc

SEQ ID NO: 2019764 - RNA, 13 nt, Shigella flexneri 2a str. 301
cggcagaacggug

SEQ ID NO: 2019765 - RNA, 19 nt, Shigella flexneri 2a str. 301
cggcagaacagaacauccc

SEQ ID NO: 2019766 - RNA, 15 nt, Shigella flexneri 2a str. 301
cggcaaaaaucggca

SEQ ID NO: 2019767 - RNA, 16 nt, Shigella flexneri 2a str. 301
cggcaaaacagggcuu

SEQ ID NO: 2019768 - RNA, 18 nt, Shigella flexneri 2a str. 301
cggcaaacagcugcuggu

SEQ ID NO: 2019769 - RNA, 16 nt, Shigella flexneri 2a str. 301
cggauugcuccugcuc

SEQ ID NO: 2019770 - RNA, 22 nt, Shigella flexneri 2a str. 301
cggauguuucaccggaugccgg

SEQ ID NO: 2019771 - RNA, 18 nt, Shigella flexneri 2a str. 301
cggauuacgacucaaccc

SEQ ID NO: 2019772 - RNA, 17 nt, Shigella flexneri 2a str. 301
cggauguagcaacggag

SEQ ID NO: 2019773 - RNA, 18 nt, Shigella flexneri 2a str. 301
cggauucagauugcagac

SEQ ID NO: 2019774 - RNA, 17 nt, Shigella flexneri 2a str. 301
cggauucaguaaaucca

SEQ ID NO: 2019775 - RNA, 15 nt, Shigella flexneri 2a str. 301
cggaugcgccgucag

SEQ ID NO: 2019776 - RNA, 17 nt, Shigella flexneri 2a str. 301
cggaugcggugcaagca

SEQ ID NO: 2019777 - RNA, 14 nt, Shigella flexneri 2a str. 301
cggaugcgccagca

SEQ ID NO: 2019778 - RNA, 11 nt, Shigella flexneri 2a str. 301
cggaugacaga

SEQ ID NO: 2019779 - RNA, 13 nt, Shigella flexneri 2a str. 301
cggaaaucuccag

SEQ ID NO: 2019780 - RNA, 18 nt, Shigella flexneri 2a str. 301
cggaaaucuccagauaau

SEQ ID NO: 2019781 - RNA, 21 nt, Shigella flexneri 2a str. 301
cggaaagcaccugcgcaggca

SEQ ID NO: 2019782 - RNA, 16 nt, Shigella flexneri 2a str. 301
cggaacgaaaaaaauc

SEQ ID NO: 2019783 - RNA, 12 nt, Shigella flexneri 2a str. 301
cggagcaaccug

SEQ ID NO: 2019784 - RNA, 22 nt, Shigella flexneri 2a str. 301
cggagcaaaaaaccgccauuca

SEQ ID NO: 2019785 - RNA, 16 nt, Shigella flexneri 2a str. 301
cggaacugugcugccg

SEQ ID NO: 2019786 - RNA, 23 nt, Shigella flexneri 2a str. 301
cggagcucccaggcuccgccaga

SEQ ID NO: 2019787 - RNA, 21 nt, Shigella flexneri 2a str. 301
cggagccaaacaugcaaacca

SEQ ID NO: 2019788 - RNA, 16 nt, Shigella flexneri 2a str. 301
cggagcgccaccaccc

SEQ ID NO: 2019789 - RNA, 15 nt, Shigella flexneri 2a str. 301
cggaucggaggcagc

SEQ ID NO: 2019790 - RNA, 16 nt, Shigella flexneri 2a str. 301
cggauaaucggcaaua

SEQ ID NO: 2019791 - RNA, 18 nt, Shigella flexneri 2a str. 301
cggauaaacuuggcuaua

SEQ ID NO: 2019792 - RNA, 14 nt, Shigella flexneri 2a str. 301
cggauaaagcugcc

SEQ ID NO: 2019793 - RNA, 21 nt, Shigella flexneri 2a str. 301
cggauaagacgccccggcguc

SEQ ID NO: 2019794 - RNA, 23 nt, Shigella flexneri 2a str. 301
cgcaguaaucggcgaaaccgcgc

SEQ ID NO: 2019795 - RNA, 15 nt, Shigella flexneri 2a str. 301
cgcagucacaccagc

SEQ ID NO: 2019796 - RNA, 19 nt, Shigella flexneri 2a str. 301
cgcaguuuaucgaccgcuu

SEQ ID NO: 2019797 - RNA, 13 nt, Shigella flexneri 2a str. 301
cgcagucaccagc

SEQ ID NO: 2019798 - RNA, 17 nt, Shigella flexneri 2a str. 301
cgcaggcuguuaccccu

SEQ ID NO: 2019799 - RNA, 22 nt, Shigella flexneri 2a str. 301
cgcagggacacucgcugacuga

SEQ ID NO: 2019800 - RNA, 15 nt, Shigella flexneri 2a str. 301
cgcaggcgguggaag

SEQ ID NO: 2019801 - RNA, 20 nt, Shigella flexneri 2a str. 301
cgcaggagcgccgaauggau

SEQ ID NO: 2019802 - RNA, 19 nt, Shigella flexneri 2a str. 301
cgcaggauaucguggcacg

SEQ ID NO: 2019803 - RNA, 14 nt, Shigella flexneri 2a str. 301
cgcaggaugggcaa

SEQ ID NO: 2019804 - RNA, 18 nt, Shigella flexneri 2a str. 301
cgcagcuucacuucuuac

SEQ ID NO: 2019805 - RNA, 22 nt, Shigella flexneri 2a str. 301
cgcagcuuugugcuucaguucc

SEQ ID NO: 2019806 - RNA, 13 nt, Shigella flexneri 2a str. 301
cgcagccaucagc

SEQ ID NO: 2019807 - RNA, 11 nt, Shigella flexneri 2a str. 301
cgcagccauca

SEQ ID NO: 2019808 - RNA, 16 nt, Shigella flexneri 2a str. 301
cgcagccagcgcgccu

SEQ ID NO: 2019809 - RNA, 23 nt, Shigella flexneri 2a str. 301
cgcagccagcgucgcacccggca

SEQ ID NO: 2019810 - RNA, 12 nt, Shigella flexneri 2a str. 301
cgcagccagcac

SEQ ID NO: 2019811 - RNA, 21 nt, Shigella flexneri 2a str. 301
cgcagccacgucaccugcccg

SEQ ID NO: 2019812 - RNA, 18 nt, Shigella flexneri 2a str. 301
cgcacuuugccagaaauc

SEQ ID NO: 2019813 - RNA, 12 nt, Shigella flexneri 2a str. 301
cgcacuugccag

SEQ ID NO: 2019814 - RNA, 13 nt, Shigella flexneri 2a str. 301
cgcagaaagaggc

SEQ ID NO: 2019815 - RNA, 15 nt, Shigella flexneri 2a str. 301
cgcagaaccagaagc

SEQ ID NO: 2019816 - RNA, 14 nt, Shigella flexneri 2a str. 301
cgcagcagcgcgcc

SEQ ID NO: 2019817 - RNA, 19 nt, Shigella flexneri 2a str. 301
cgcagcagccaagcaccgc

SEQ ID NO: 2019818 - RNA, 13 nt, Shigella flexneri 2a str. 301
cgcacucgcagac

SEQ ID NO: 2019819 - RNA, 14 nt, Shigella flexneri 2a str. 301
cgcacucgcccuga

SEQ ID NO: 2019820 - RNA, 16 nt, Shigella flexneri 2a str. 301
cgcacuucuuccgggc

SEQ ID NO: 2019821 - RNA, 21 nt, Shigella flexneri 2a str. 301
cgcacuguuggcgaaaauccu

SEQ ID NO: 2019822 - RNA, 14 nt, Shigella flexneri 2a str. 301
cgcacccguaacau

SEQ ID NO: 2019823 - RNA, 18 nt, Shigella flexneri 2a str. 301
cgcaccccugauaaccgc

SEQ ID NO: 2019824 - RNA, 12 nt, Shigella flexneri 2a str. 301
cgcaccagcagg

SEQ ID NO: 2019825 - RNA, 17 nt, Shigella flexneri 2a str. 301
cgcaccagaaacaauaa

SEQ ID NO: 2019826 - RNA, 15 nt, Shigella flexneri 2a str. 301
cgcacacgccgugca

SEQ ID NO: 2019827 - RNA, 17 nt, Shigella flexneri 2a str. 301
cgcacaccgagauaaug

SEQ ID NO: 2019828 - RNA, 20 nt, Shigella flexneri 2a str. 301
cgcacaggcggaggaaaaaa

SEQ ID NO: 2019829 - RNA, 13 nt, Shigella flexneri 2a str. 301
cgcaccugccagc

SEQ ID NO: 2019830 - RNA, 16 nt, Shigella flexneri 2a str. 301
cgcaccugccagcgcc

SEQ ID NO: 2019831 - RNA, 12 nt, Shigella flexneri 2a str. 301
cgcaccuuuacc

SEQ ID NO: 2019832 - RNA, 16 nt, Shigella flexneri 2a str. 301
cgcaccugaguaauua

SEQ ID NO: 2019833 - RNA, 14 nt, Shigella flexneri 2a str. 301
cgcacgcugguaac

SEQ ID NO: 2019834 - RNA, 16 nt, Shigella flexneri 2a str. 301
cgcacgcugucaccag

SEQ ID NO: 2019835 - RNA, 19 nt, Shigella flexneri 2a str. 301
cgcacgcucuauggcaccu

SEQ ID NO: 2019836 - RNA, 16 nt, Shigella flexneri 2a str. 301
cgcacgcgcuucacau

SEQ ID NO: 2019837 - RNA, 22 nt, Shigella flexneri 2a str. 301
cgcacgccuggcagucacggcg

SEQ ID NO: 2019838 - RNA, 17 nt, Shigella flexneri 2a str. 301
cgcacggccgcaagcag

SEQ ID NO: 2019839 - RNA, 19 nt, Shigella flexneri 2a str. 301
cgcaauauccugcgcuucc

SEQ ID NO: 2019840 - RNA, 14 nt, Shigella flexneri 2a str. 301
cgcacaccccggcg

SEQ ID NO: 2019841 - RNA, 18 nt, Shigella flexneri 2a str. 301
cgcaacugguccagcccc

SEQ ID NO: 2019842 - RNA, 23 nt, Shigella flexneri 2a str. 301
cgcaacgcgcgugaaguggcaca

SEQ ID NO: 2019843 - RNA, 20 nt, Shigella flexneri 2a str. 301
cgcaacgguugcggaaccca

SEQ ID NO: 2019844 - RNA, 16 nt, Shigella flexneri 2a str. 301
cgcaacgcuuucccug

SEQ ID NO: 2019845 - RNA, 14 nt, Shigella flexneri 2a str. 301
cgauuauuuauucc

SEQ ID NO: 2019846 - RNA, 19 nt, Shigella flexneri 2a str. 301
cgauucaaaagaugagaaa

SEQ ID NO: 2019847 - RNA, 20 nt, Shigella flexneri 2a str. 301
cgcaaacaguacaucuucca

SEQ ID NO: 2019848 - RNA, 16 nt, Shigella flexneri 2a str. 301
cgcaaaauucacgcca

SEQ ID NO: 2019849 - RNA, 21 nt, Shigella flexneri 2a str. 301
cgauuaauaaaauuauccagc

SEQ ID NO: 2019850 - RNA, 19 nt, Shigella flexneri 2a str. 301
cgauuaaauucaccaguuu

SEQ ID NO: 2019851 - RNA, 16 nt, Shigella flexneri 2a str. 301
cgauuaccauuucacc

SEQ ID NO: 2019852 - RNA, 15 nt, Shigella flexneri 2a str. 301
cgauuagcagcauga

SEQ ID NO: 2019853 - RNA, 18 nt, Shigella flexneri 2a str. 301
cgauuauagcuaacucua

SEQ ID NO: 2019854 - RNA, 20 nt, Shigella flexneri 2a str. 301
cgcaaacguggggugaauaa

SEQ ID NO: 2019855 - RNA, 20 nt, Shigella flexneri 2a str. 301
cgcaaaguagcugaaaauca

SEQ ID NO: 2019856 - RNA, 20 nt, Shigella flexneri 2a str. 301
cgcaaauauuucacccgcga

SEQ ID NO: 2019857 - RNA, 16 nt, Shigella flexneri 2a str. 301
cgcaaacgcccgucca

SEQ ID NO: 2019858 - RNA, 23 nt, Shigella flexneri 2a str. 301
cgcaaacgcccguccaucaacaa

SEQ ID NO: 2019859 - RNA, 19 nt, Shigella flexneri 2a str. 301
cgcaaaccuggcaacaauc

SEQ ID NO: 2019860 - RNA, 14 nt, Shigella flexneri 2a str. 301
cgauguaauucagc

SEQ ID NO: 2019861 - RNA, 13 nt, Shigella flexneri 2a str. 301
cgauggugguggg

SEQ ID NO: 2019862 - RNA, 16 nt, Shigella flexneri 2a str. 301
cgaugucaaucagggc

SEQ ID NO: 2019863 - RNA, 19 nt, Shigella flexneri 2a str. 301
cgaugguugcccugcuggu

SEQ ID NO: 2019864 - RNA, 20 nt, Shigella flexneri 2a str. 301
cgaugguugcugucaacuga

SEQ ID NO: 2019865 - RNA, 14 nt, Shigella flexneri 2a str. 301
cgauggcaucacca

SEQ ID NO: 2019866 - RNA, 13 nt, Shigella flexneri 2a str. 301
cgauggccaacca

SEQ ID NO: 2019867 - RNA, 14 nt, Shigella flexneri 2a str. 301
cgauggcccgcuug

SEQ ID NO: 2019868 - RNA, 13 nt, Shigella flexneri 2a str. 301
cgaugaucgccau

SEQ ID NO: 2019869 - RNA, 21 nt, Shigella flexneri 2a str. 301
cgaugcagcguuugcuguucc

SEQ ID NO: 2019870 - RNA, 14 nt, Shigella flexneri 2a str. 301
cgaugccaguaauc

SEQ ID NO: 2019871 - RNA, 22 nt, Shigella flexneri 2a str. 301
cgaugcgcucgccaggaugggc

SEQ ID NO: 2019872 - RNA, 22 nt, Shigella flexneri 2a str. 301
cgaucgcuuucgcuuucucuuc

SEQ ID NO: 2019873 - RNA, 20 nt, Shigella flexneri 2a str. 301
cgaucgcgccaaucagcgca

SEQ ID NO: 2019874 - RNA, 23 nt, Shigella flexneri 2a str. 301
cgaucgugauacaacugccgcgc

SEQ ID NO: 2019875 - RNA, 21 nt, Shigella flexneri 2a str. 301
cgaucuaggaucgggcauuuu

SEQ ID NO: 2019876 - RNA, 19 nt, Shigella flexneri 2a str. 301
cgaucucuucgccugccug

SEQ ID NO: 2019877 - RNA, 18 nt, Shigella flexneri 2a str. 301
cgaucucgccagugacca

SEQ ID NO: 2019878 - RNA, 19 nt, Shigella flexneri 2a str. 301
cgaugaaaaagaagcaaau

SEQ ID NO: 2019879 - RNA, 14 nt, Shigella flexneri 2a str. 301
cgaugaaucaccac

SEQ ID NO: 2019880 - RNA, 23 nt, Shigella flexneri 2a str. 301
cgaugaacuacggcaaaagaaua

SEQ ID NO: 2019881 - RNA, 17 nt, Shigella flexneri 2a str. 301
cgaucuuccacgccugc

SEQ ID NO: 2019882 - RNA, 19 nt, Shigella flexneri 2a str. 301
cgaucugcgcgucauuuuc

SEQ ID NO: 2019883 - RNA, 17 nt, Shigella flexneri 2a str. 301
cgaucacuuucugcgcc

SEQ ID NO: 2019884 - RNA, 15 nt, Shigella flexneri 2a str. 301
cgauaucgaugacgc

SEQ ID NO: 2019885 - RNA, 19 nt, Shigella flexneri 2a str. 301
cgauauccugaaacgcggc

SEQ ID NO: 2019886 - RNA, 21 nt, Shigella flexneri 2a str. 301
cgaucaggaacuguugcaaaa

SEQ ID NO: 2019887 - RNA, 15 nt, Shigella flexneri 2a str. 301
cgaucaucauccagc

SEQ ID NO: 2019888 - RNA, 19 nt, Shigella flexneri 2a str. 301
cgauccccaaagagagcac

SEQ ID NO: 2019889 - RNA, 17 nt, Shigella flexneri 2a str. 301
cgaucgcccgccaagca

SEQ ID NO: 2019890 - RNA, 22 nt, Shigella flexneri 2a str. 301
ccuucaucacgcagcgucagca

SEQ ID NO: 2019891 - RNA, 13 nt, Shigella flexneri 2a str. 301
ccuucauccagca

SEQ ID NO: 2019892 - RNA, 19 nt, Shigella flexneri 2a str. 301
ccuucagucauauuucugu

SEQ ID NO: 2019893 - RNA, 19 nt, Shigella flexneri 2a str. 301
ccuucaucguuucugcugg

SEQ ID NO: 2019894 - RNA, 16 nt, Shigella flexneri 2a str. 301
ccuucaucgcuccugc

SEQ ID NO: 2019895 - RNA, 14 nt, Shigella flexneri 2a str. 301
cgauaaaccagcaa

SEQ ID NO: 2019896 - RNA, 20 nt, Shigella flexneri 2a str. 301
cgauaaauggcgcauccagc

SEQ ID NO: 2019897 - RNA, 21 nt, Shigella flexneri 2a str. 301
cgauaaauacagcguuaaaaa

SEQ ID NO: 2019898 - RNA, 13 nt, Shigella flexneri 2a str. 301
cgauaaagcuggg

SEQ ID NO: 2019899 - RNA, 14 nt, Shigella flexneri 2a str. 301
cgauacgcugcaca

SEQ ID NO: 2019900 - RNA, 15 nt, Shigella flexneri 2a str. 301
cgauacggucgagga

SEQ ID NO: 2019901 - RNA, 21 nt, Shigella flexneri 2a str. 301
cgauaacggaucggaacgcga

SEQ ID NO: 2019902 - RNA, 17 nt, Shigella flexneri 2a str. 301
cgauaaccuucuucauu

SEQ ID NO: 2019903 - RNA, 18 nt, Shigella flexneri 2a str. 301
cgauaacacgcuucaagu

SEQ ID NO: 2019904 - RNA, 23 nt, Shigella flexneri 2a str. 301
cgauauaaaccaucggcgcuggc

SEQ ID NO: 2019905 - RNA, 18 nt, Shigella flexneri 2a str. 301
cgauaguggaacaaagaa

SEQ ID NO: 2019906 - RNA, 15 nt, Shigella flexneri 2a str. 301
cgccccacaccacca

SEQ ID NO: 2019907 - RNA, 13 nt, Shigella flexneri 2a str. 301
cgcccauugagcc

SEQ ID NO: 2019908 - RNA, 14 nt, Shigella flexneri 2a str. 301
cgcccauuccagua

SEQ ID NO: 2019909 - RNA, 18 nt, Shigella flexneri 2a str. 301
cgcccccgggccuccccg

SEQ ID NO: 2019910 - RNA, 14 nt, Shigella flexneri 2a str. 301
cgcccccacaacag

SEQ ID NO: 2019911 - RNA, 13 nt, Shigella flexneri 2a str. 301
cgccccgcucgcu

SEQ ID NO: 2019912 - RNA, 15 nt, Shigella flexneri 2a str. 301
cgccccgcucacgca

SEQ ID NO: 2019913 - RNA, 17 nt, Shigella flexneri 2a str. 301
cgccccggccuugccug

SEQ ID NO: 2019914 - RNA, 14 nt, Shigella flexneri 2a str. 301
cgccccggccuugc

SEQ ID NO: 2019915 - RNA, 16 nt, Shigella flexneri 2a str. 301
cgccccgguuucucuu

SEQ ID NO: 2019916 - RNA, 22 nt, Shigella flexneri 2a str. 301
cgccccgguuaauugcgccagc

SEQ ID NO: 2019917 - RNA, 19 nt, Shigella flexneri 2a str. 301
cgccccggcuggcugaccg

SEQ ID NO: 2019918 - RNA, 14 nt, Shigella flexneri 2a str. 301
cgccccggcuucaa

SEQ ID NO: 2019919 - RNA, 22 nt, Shigella flexneri 2a str. 301
cgccccugcacuuaacaggauc

SEQ ID NO: 2019920 - RNA, 20 nt, Shigella flexneri 2a str. 301
cgccccuucuucuacugcgc

SEQ ID NO: 2019921 - RNA, 21 nt, Shigella flexneri 2a str. 301
cgcccgaauugaagccaaauc

SEQ ID NO: 2019922 - RNA, 16 nt, Shigella flexneri 2a str. 301
cgcccgacgaggcgcu

SEQ ID NO: 2019923 - RNA, 16 nt, Shigella flexneri 2a str. 301
cgcccgcuaugagcag

SEQ ID NO: 2019924 - RNA, 18 nt, Shigella flexneri 2a str. 301
cgcccgcuguaagccaag

SEQ ID NO: 2019925 - RNA, 14 nt, Shigella flexneri 2a str. 301
cgccauccuuacgc

SEQ ID NO: 2019926 - RNA, 14 nt, Shigella flexneri 2a str. 301
cgccauccggcagc

SEQ ID NO: 2019927 - RNA, 14 nt, Shigella flexneri 2a str. 301
cgccaucgccagca

SEQ ID NO: 2019928 - RNA, 14 nt, Shigella flexneri 2a str. 301
cgccaugaagaugg

SEQ ID NO: 2019929 - RNA, 18 nt, Shigella flexneri 2a str. 301
cgccaugagcggacugaa

SEQ ID NO: 2019930 - RNA, 14 nt, Shigella flexneri 2a str. 301
cgccaucucuucca

SEQ ID NO: 2019931 - RNA, 23 nt, Shigella flexneri 2a str. 301
cgccaugaacgcgaaggccagaa

SEQ ID NO: 2019932 - RNA, 14 nt, Shigella flexneri 2a str. 301
cgccauuucuccuc

SEQ ID NO: 2019933 - RNA, 20 nt, Shigella flexneri 2a str. 301
cgccauuucuucuccggcau

SEQ ID NO: 2019934 - RNA, 17 nt, Shigella flexneri 2a str. 301
cgccauuucgucgucgg

SEQ ID NO: 2019935 - RNA, 16 nt, Shigella flexneri 2a str. 301
cgccauuuugcgcggc

SEQ ID NO: 2019936 - RNA, 18 nt, Shigella flexneri 2a str. 301
cgccauuuugcgcggcau

SEQ ID NO: 2019937 - RNA, 15 nt, Shigella flexneri 2a str. 301
cgcccaaaccaccca

SEQ ID NO: 2019938 - RNA, 20 nt, Shigella flexneri 2a str. 301
cgccaugugcgacgggccaa

SEQ ID NO: 2019939 - RNA, 21 nt, Shigella flexneri 2a str. 301
cgccauuaaacaacccaagcg

SEQ ID NO: 2019940 - RNA, 14 nt, Shigella flexneri 2a str. 301
cgcccaccaccagc

SEQ ID NO: 2019941 - RNA, 15 nt, Shigella flexneri 2a str. 301
cgcccaccaccagcg

SEQ ID NO: 2019942 - RNA, 16 nt, Shigella flexneri 2a str. 301
cgcccagaccagaaug

SEQ ID NO: 2019943 - RNA, 19 nt, Shigella flexneri 2a str. 301
cgcccacgccagccugcuu

SEQ ID NO: 2019944 - RNA, 18 nt, Shigella flexneri 2a str. 301
cgcccagcuaaucgagcc

SEQ ID NO: 2019945 - RNA, 21 nt, Shigella flexneri 2a str. 301
cgcccagcguacguaacuucu

SEQ ID NO: 2019946 - RNA, 17 nt, Shigella flexneri 2a str. 301
cgcccaguggaugcgcc

SEQ ID NO: 2019947 - RNA, 15 nt, Shigella flexneri 2a str. 301
cgcccaucgcauaac

SEQ ID NO: 2019948 - RNA, 14 nt, Shigella flexneri 2a str. 301
cgccagccauucaa

SEQ ID NO: 2019949 - RNA, 21 nt, Shigella flexneri 2a str. 301
cgccagccaauugccauauac

SEQ ID NO: 2019950 - RNA, 13 nt, Shigella flexneri 2a str. 301
cgccagccaccau

SEQ ID NO: 2019951 - RNA, 15 nt, Shigella flexneri 2a str. 301
cgccagccaccaugc

SEQ ID NO: 2019952 - RNA, 16 nt, Shigella flexneri 2a str. 301
cgccagccagccaagc

SEQ ID NO: 2019953 - RNA, 17 nt, Shigella flexneri 2a str. 301
cgccagcauucccgcca

SEQ ID NO: 2019954 - RNA, 22 nt, Shigella flexneri 2a str. 301
cgccagcauucccgccagcggc

SEQ ID NO: 2019955 - RNA, 20 nt, Shigella flexneri 2a str. 301
cgccacgaaauugaggaugc

SEQ ID NO: 2019956 - RNA, 22 nt, Shigella flexneri 2a str. 301
cgccacgacucaaaucacgcag

SEQ ID NO: 2019957 - RNA, 23 nt, Shigella flexneri 2a str. 301
cgccacgguaucaagcccgccgg

SEQ ID NO: 2019958 - RNA, 22 nt, Shigella flexneri 2a str. 301
cgccacuaucgccaucaggcag

SEQ ID NO: 2019959 - RNA, 11 nt, Shigella flexneri 2a str. 301
cgccagcaccg

SEQ ID NO: 2019960 - RNA, 20 nt, Shigella flexneri 2a str. 301
cgccagcagcagcguaccuc

SEQ ID NO: 2019961 - RNA, 22 nt, Shigella flexneri 2a str. 301
cgccagcagaguuuuuuaugcg

SEQ ID NO: 2019962 - RNA, 19 nt, Shigella flexneri 2a str. 301
cgccacaacuucaacguug

SEQ ID NO: 2019963 - RNA, 16 nt, Shigella flexneri 2a str. 301
cgccacaaacgccaga

SEQ ID NO: 2019964 - RNA, 22 nt, Shigella flexneri 2a str. 301
cgccaauuaaugcaccaacaaa

SEQ ID NO: 2019965 - RNA, 19 nt, Shigella flexneri 2a str. 301
cgccaauuacgcgcaauac

SEQ ID NO: 2019966 - RNA, 13 nt, Shigella flexneri 2a str. 301
cgcauaacagccc

SEQ ID NO: 2019967 - RNA, 12 nt, Shigella flexneri 2a str. 301
cgcauaaaacaa

SEQ ID NO: 2019968 - RNA, 21 nt, Shigella flexneri 2a str. 301
cgcauaccaaaauccaccagu

SEQ ID NO: 2019969 - RNA, 14 nt, Shigella flexneri 2a str. 301
cgcauaagccaccu

SEQ ID NO: 2019970 - RNA, 17 nt, Shigella flexneri 2a str. 301
cgcauaccccaucagcg

SEQ ID NO: 2019971 - RNA, 22 nt, Shigella flexneri 2a str. 301
cgcauaccauccaggagauauu

SEQ ID NO: 2019972 - RNA, 18 nt, Shigella flexneri 2a str. 301
cgccacaccacugcgcau

SEQ ID NO: 2019973 - RNA, 17 nt, Shigella flexneri 2a str. 301
cgccacauccggcacaa

SEQ ID NO: 2019974 - RNA, 22 nt, Shigella flexneri 2a str. 301
cgccacauaagaucaucggcca

SEQ ID NO: 2019975 - RNA, 13 nt, Shigella flexneri 2a str. 301
cgccaccacaaca

SEQ ID NO: 2019976 - RNA, 18 nt, Shigella flexneri 2a str. 301
cgccaccucuuucaccaa

SEQ ID NO: 2019977 - RNA, 18 nt, Shigella flexneri 2a str. 301
cgccaccauucccuggcg

SEQ ID NO: 2019978 - RNA, 18 nt, Shigella flexneri 2a str. 301
cgccaccauguugcgcag

SEQ ID NO: 2019979 - RNA, 22 nt, Shigella flexneri 2a str. 301
cgccaccaggaacgcgccaaga

SEQ ID NO: 2019980 - RNA, 13 nt, Shigella flexneri 2a str. 301
cgccaccaccagc

SEQ ID NO: 2019981 - RNA, 13 nt, Shigella flexneri 2a str. 301
cgccaccacccug

SEQ ID NO: 2019982 - RNA, 23 nt, Shigella flexneri 2a str. 301
cgccaccacccugacgaccaccc

SEQ ID NO: 2019983 - RNA, 20 nt, Shigella flexneri 2a str. 301
cgccaccagcaacagcgccg

SEQ ID NO: 2019984 - RNA, 16 nt, Shigella flexneri 2a str. 301
cgccaguaccagcagc

SEQ ID NO: 2019985 - RNA, 23 nt, Shigella flexneri 2a str. 301
cgccagguuuuagaucccacggc

SEQ ID NO: 2019986 - RNA, 15 nt, Shigella flexneri 2a str. 301
cgccagguucaucaa

SEQ ID NO: 2019987 - RNA, 22 nt, Shigella flexneri 2a str. 301
cgccagugauugcuugccccuu

SEQ ID NO: 2019988 - RNA, 19 nt, Shigella flexneri 2a str. 301
cgccagugccgcccaccac

SEQ ID NO: 2019989 - RNA, 16 nt, Shigella flexneri 2a str. 301
cgccagggccgcgaau

SEQ ID NO: 2019990 - RNA, 22 nt, Shigella flexneri 2a str. 301
cgccaggucagagagccagccc

SEQ ID NO: 2019991 - RNA, 19 nt, Shigella flexneri 2a str. 301
cgccagguaacgaagaugg

SEQ ID NO: 2019992 - RNA, 20 nt, Shigella flexneri 2a str. 301
cgccaggugaaauccggcau

SEQ ID NO: 2019993 - RNA, 12 nt, Shigella flexneri 2a str. 301
cgccauauuucu

SEQ ID NO: 2019994 - RNA, 13 nt, Shigella flexneri 2a str. 301
cgccauaucggca

SEQ ID NO: 2019995 - RNA, 16 nt, Shigella flexneri 2a str. 301
cgccauaucauucgac

SEQ ID NO: 2019996 - RNA, 20 nt, Shigella flexneri 2a str. 301
cgccaguuuacugucugcuu

SEQ ID NO: 2019997 - RNA, 14 nt, Shigella flexneri 2a str. 301
cgccaguuuugcca

SEQ ID NO: 2019998 - RNA, 19 nt, Shigella flexneri 2a str. 301
cgccaguuuacugucugcu

SEQ ID NO: 2019999 - RNA, 15 nt, Shigella flexneri 2a str. 301
cgccagugcgcccca

SEQ ID NO: 2020000 - RNA, 15 nt, Shigella flexneri 2a str. 301
cgccagugccaaagc

SEQ ID NO: 2020001 - RNA, 19 nt, Shigella flexneri 2a str. 301
cgccaggccagccugguua

SEQ ID NO: 2020002 - RNA, 16 nt, Shigella flexneri 2a str. 301
cgccaggccagccugg

SEQ ID NO: 2020003 - RNA, 19 nt, Shigella flexneri 2a str. 301
cgccaggcaccgcacuggc

SEQ ID NO: 2020004 - RNA, 18 nt, Shigella flexneri 2a str. 301
cgccaggcguuugaaaaa

SEQ ID NO: 2020005 - RNA, 18 nt, Shigella flexneri 2a str. 301
cgccagcguuaucccauc

SEQ ID NO: 2020006 - RNA, 22 nt, Shigella flexneri 2a str. 301
cgccagcguuacuucaccuucu

SEQ ID NO: 2020007 - RNA, 18 nt, Shigella flexneri 2a str. 301
cgccagcucacgggcggc

SEQ ID NO: 2020008 - RNA, 22 nt, Shigella flexneri 2a str. 301
cgccagcucacgggcggcaggu

SEQ ID NO: 2020009 - RNA, 20 nt, Shigella flexneri 2a str. 301
cgccaggaauuugguccuga

SEQ ID NO: 2020010 - RNA, 19 nt, Shigella flexneri 2a str. 301
cgccagcuucgcuucccaa

SEQ ID NO: 2020011 - RNA, 20 nt, Shigella flexneri 2a str. 301
cgccagcggguucccggcgu

SEQ ID NO: 2020012 - RNA, 13 nt, Shigella flexneri 2a str. 301
cgccagcgucuga

SEQ ID NO: 2020013 - RNA, 17 nt, Shigella flexneri 2a str. 301
cgccagcgucucuucaa

SEQ ID NO: 2020014 - RNA, 15 nt, Shigella flexneri 2a str. 301
cgccagcgucugagc

SEQ ID NO: 2020015 - RNA, 18 nt, Shigella flexneri 2a str. 301
cgccagcguagucggcag

SEQ ID NO: 2020016 - RNA, 13 nt, Shigella flexneri 2a str. 301
cgccagcgcgcgu

SEQ ID NO: 2020017 - RNA, 14 nt, Shigella flexneri 2a str. 301
cgccagcggcagcu

SEQ ID NO: 2020018 - RNA, 13 nt, Shigella flexneri 2a str. 301
cgccagcggcagc

SEQ ID NO: 2020019 - RNA, 14 nt, Shigella flexneri 2a str. 301
cgccagcggcggca

SEQ ID NO: 2020020 - RNA, 17 nt, Shigella flexneri 2a str. 301
cgccagcggcccggaga

SEQ ID NO: 2020021 - RNA, 20 nt, Shigella flexneri 2a str. 301
cgccagcgaaccaccaaacu

SEQ ID NO: 2020022 - RNA, 13 nt, Shigella flexneri 2a str. 301
cgccagcgccugg

SEQ ID NO: 2020023 - RNA, 19 nt, Shigella flexneri 2a str. 301
cgccgauaucgcuggcaga

SEQ ID NO: 2020024 - RNA, 12 nt, Shigella flexneri 2a str. 301
cgccgagcugga

SEQ ID NO: 2020025 - RNA, 14 nt, Shigella flexneri 2a str. 301
cgccgcaucuuccc

SEQ ID NO: 2020026 - RNA, 16 nt, Shigella flexneri 2a str. 301
cgccgccaacccuucu

SEQ ID NO: 2020027 - RNA, 19 nt, Shigella flexneri 2a str. 301
cgccgcacuuucuccuccc

SEQ ID NO: 2020028 - RNA, 22 nt, Shigella flexneri 2a str. 301
cgccgcaaaucguauccggcau

SEQ ID NO: 2020029 - RNA, 21 nt, Shigella flexneri 2a str. 301
cgccgauuuugccuucauacu

SEQ ID NO: 2020030 - RNA, 20 nt, Shigella flexneri 2a str. 301
cgccgcaaccguaguggcca

SEQ ID NO: 2020031 - RNA, 16 nt, Shigella flexneri 2a str. 301
cgccgccgcugaacug

SEQ ID NO: 2020032 - RNA, 14 nt, Shigella flexneri 2a str. 301
cgccgccacugcca

SEQ ID NO: 2020033 - RNA, 14 nt, Shigella flexneri 2a str. 301
cgccgccacugcaa

SEQ ID NO: 2020034 - RNA, 13 nt, Shigella flexneri 2a str. 301
cgccgcccagaga

SEQ ID NO: 2020035 - RNA, 13 nt, Shigella flexneri 2a str. 301
cgccgacugucaa

SEQ ID NO: 2020036 - RNA, 19 nt, Shigella flexneri 2a str. 301
cgccgagcaguugcuucau

SEQ ID NO: 2020037 - RNA, 15 nt, Shigella flexneri 2a str. 301
cgccgagcaccacgu

SEQ ID NO: 2020038 - RNA, 16 nt, Shigella flexneri 2a str. 301
cgccgacaaagaugca

SEQ ID NO: 2020039 - RNA, 17 nt, Shigella flexneri 2a str. 301
cgccgaaaccgcgcagc

SEQ ID NO: 2020040 - RNA, 18 nt, Shigella flexneri 2a str. 301
cgcccgguuuucgcgcgc

SEQ ID NO: 2020041 - RNA, 19 nt, Shigella flexneri 2a str. 301
cgcccguugcgccaaccag

SEQ ID NO: 2020042 - RNA, 15 nt, Shigella flexneri 2a str. 301
cgcccguuuucucca

SEQ ID NO: 2020043 - RNA, 12 nt, Shigella flexneri 2a str. 301
cgcccuccugca

SEQ ID NO: 2020044 - RNA, 16 nt, Shigella flexneri 2a str. 301
cgcccuuucagcgccu

SEQ ID NO: 2020045 - RNA, 20 nt, Shigella flexneri 2a str. 301
cgcccugcgucgcacucuca

SEQ ID NO: 2020046 - RNA, 16 nt, Shigella flexneri 2a str. 301
cgcccugcggcugacc

SEQ ID NO: 2020047 - RNA, 23 nt, Shigella flexneri 2a str. 301
cgcccugcggcugaccaccaccg

SEQ ID NO: 2020048 - RNA, 17 nt, Shigella flexneri 2a str. 301
cgccgcgguacagcucg

SEQ ID NO: 2020049 - RNA, 15 nt, Shigella flexneri 2a str. 301
cgccgcggacaauaa

SEQ ID NO: 2020050 - RNA, 15 nt, Shigella flexneri 2a str. 301
cgccgcuuaccauaa

SEQ ID NO: 2020051 - RNA, 13 nt, Shigella flexneri 2a str. 301
cgccgcuaccggc

SEQ ID NO: 2020052 - RNA, 22 nt, Shigella flexneri 2a str. 301
cgccgcugaacugauugccacc

SEQ ID NO: 2020053 - RNA, 23 nt, Shigella flexneri 2a str. 301
cgccggaugacacaucaccucca

SEQ ID NO: 2020054 - RNA, 18 nt, Shigella flexneri 2a str. 301
cgccggaugacacaucac

SEQ ID NO: 2020055 - RNA, 18 nt, Shigella flexneri 2a str. 301
cgccggucaacgcgcggc

SEQ ID NO: 2020056 - RNA, 19 nt, Shigella flexneri 2a str. 301
cgccggucaacgcgcggcu

SEQ ID NO: 2020057 - RNA, 14 nt, Shigella flexneri 2a str. 301
cgccgggguuaugu

SEQ ID NO: 2020058 - RNA, 21 nt, Shigella flexneri 2a str. 301
cgccguacggcguaccgccgc

SEQ ID NO: 2020059 - RNA, 20 nt, Shigella flexneri 2a str. 301
cgccgucaucacgcaggcug

SEQ ID NO: 2020060 - RNA, 15 nt, Shigella flexneri 2a str. 301
cgccgucaucacgca

SEQ ID NO: 2020061 - RNA, 18 nt, Shigella flexneri 2a str. 301
cgccgggaugcuggggcc

SEQ ID NO: 2020062 - RNA, 21 nt, Shigella flexneri 2a str. 301
cgcgcaaucagcaccgcgcgu

SEQ ID NO: 2020063 - RNA, 18 nt, Shigella flexneri 2a str. 301
cgcgcaaccaacggccuu

SEQ ID NO: 2020064 - RNA, 20 nt, Shigella flexneri 2a str. 301
cgcgcaaccaacggccuugc

SEQ ID NO: 2020065 - RNA, 18 nt, Shigella flexneri 2a str. 301
cgcgcaaagaaacgccga

SEQ ID NO: 2020066 - RNA, 15 nt, Shigella flexneri 2a str. 301
cgcgauaccacccgc

SEQ ID NO: 2020067 - RNA, 15 nt, Shigella flexneri 2a str. 301
cgcgauacaccagau

SEQ ID NO: 2020068 - RNA, 22 nt, Shigella flexneri 2a str. 301
cgcgauaucgcgguacuucuca

SEQ ID NO: 2020069 - RNA, 15 nt, Shigella flexneri 2a str. 301
cgcgauagccgcuuu

SEQ ID NO: 2020070 - RNA, 14 nt, Shigella flexneri 2a str. 301
cgcgauauugcugc

SEQ ID NO: 2020071 - RNA, 14 nt, Shigella flexneri 2a str. 301
cgcgaugaccaaaa

SEQ ID NO: 2020072 - RNA, 14 nt, Shigella flexneri 2a str. 301
cgcgacuuuuuccu

SEQ ID NO: 2020073 - RNA, 22 nt, Shigella flexneri 2a str. 301
cgcgacuuuaaucaccugccag

SEQ ID NO: 2020074 - RNA, 16 nt, Shigella flexneri 2a str. 301
cgcgacucccugacug

SEQ ID NO: 2020075 - RNA, 21 nt, Shigella flexneri 2a str. 301
cgcgaggcaaaucgcauugcg

SEQ ID NO: 2020076 - RNA, 10 nt, Shigella flexneri 2a str. 301
cgcgagcugg

SEQ ID NO: 2020077 - RNA, 13 nt, Shigella flexneri 2a str. 301
cgcgaccaccagc

SEQ ID NO: 2020078 - RNA, 12 nt, Shigella flexneri 2a str. 301
cgcgaccaccac

SEQ ID NO: 2020079 - RNA, 14 nt, Shigella flexneri 2a str. 301
cgcgaccaccacca

SEQ ID NO: 2020080 - RNA, 16 nt, Shigella flexneri 2a str. 301
cgcgacauaaaacccg

SEQ ID NO: 2020081 - RNA, 20 nt, Shigella flexneri 2a str. 301
cgcgacacaauccaugccaa

SEQ ID NO: 2020082 - RNA, 20 nt, Shigella flexneri 2a str. 301
cgcgaccaucggaucggcca

SEQ ID NO: 2020083 - RNA, 23 nt, Shigella flexneri 2a str. 301
cgcgaccucaagcucgccaccau

SEQ ID NO: 2020084 - RNA, 15 nt, Shigella flexneri 2a str. 301
cgcgcaucagcuccg

SEQ ID NO: 2020085 - RNA, 20 nt, Shigella flexneri 2a str. 301
cgcgcaguuaaacgccuugc

SEQ ID NO: 2020086 - RNA, 22 nt, Shigella flexneri 2a str. 301
cgcgccaaucagcgcagcaccc

SEQ ID NO: 2020087 - RNA, 18 nt, Shigella flexneri 2a str. 301
cgcgccaagauagaacca

SEQ ID NO: 2020088 - RNA, 16 nt, Shigella flexneri 2a str. 301
cgcgccagccuucacg

SEQ ID NO: 2020089 - RNA, 12 nt, Shigella flexneri 2a str. 301
cgcgccagccag

SEQ ID NO: 2020090 - RNA, 22 nt, Shigella flexneri 2a str. 301
cgcgccagaacacgcucccagc

SEQ ID NO: 2020091 - RNA, 12 nt, Shigella flexneri 2a str. 301
cgcgcagcuuca

SEQ ID NO: 2020092 - RNA, 20 nt, Shigella flexneri 2a str. 301
cgcgcaccggaacaacccag

SEQ ID NO: 2020093 - RNA, 16 nt, Shigella flexneri 2a str. 301
cgcgcacgucagccuc

SEQ ID NO: 2020094 - RNA, 22 nt, Shigella flexneri 2a str. 301
cgcgcacguacaucccgcgaac

SEQ ID NO: 2020095 - RNA, 19 nt, Shigella flexneri 2a str. 301
cgcgcacgcccaucagcgg

SEQ ID NO: 2020096 - RNA, 20 nt, Shigella flexneri 2a str. 301
cgcgccgccaacccuucugc

SEQ ID NO: 2020097 - RNA, 14 nt, Shigella flexneri 2a str. 301
cgcgccgccaaccc

SEQ ID NO: 2020098 - RNA, 13 nt, Shigella flexneri 2a str. 301
cgcgccgccgccc

SEQ ID NO: 2020099 - RNA, 21 nt, Shigella flexneri 2a str. 301
cgcgccgcgcugcuguagcag

SEQ ID NO: 2020100 - RNA, 16 nt, Shigella flexneri 2a str. 301
cgcgccgccucccuuc

SEQ ID NO: 2020101 - RNA, 18 nt, Shigella flexneri 2a str. 301
cgcgccccacggauugcc

SEQ ID NO: 2020102 - RNA, 14 nt, Shigella flexneri 2a str. 301
cgcgcccgcgcagc

SEQ ID NO: 2020103 - RNA, 14 nt, Shigella flexneri 2a str. 301
cgccucgcgccagc

SEQ ID NO: 2020104 - RNA, 14 nt, Shigella flexneri 2a str. 301
cgccucagccagaa

SEQ ID NO: 2020105 - RNA, 17 nt, Shigella flexneri 2a str. 301
cgccugauagcccgcac

SEQ ID NO: 2020106 - RNA, 18 nt, Shigella flexneri 2a str. 301
cgccugaaauacccgcuc

SEQ ID NO: 2020107 - RNA, 12 nt, Shigella flexneri 2a str. 301
cgccucuucaua

SEQ ID NO: 2020108 - RNA, 14 nt, Shigella flexneri 2a str. 301
cgccugaauuacug

SEQ ID NO: 2020109 - RNA, 24 nt, Shigella flexneri 2a str. 301
cgccucguaaugcuccggcuccgc

SEQ ID NO: 2020110 - RNA, 20 nt, Shigella flexneri 2a str. 301
cgccguuagcuucagccggg

SEQ ID NO: 2020111 - RNA, 18 nt, Shigella flexneri 2a str. 301
cgccgugcacaccgaaga

SEQ ID NO: 2020112 - RNA, 21 nt, Shigella flexneri 2a str. 301
cgccgugcacuucugcgguga

SEQ ID NO: 2020113 - RNA, 20 nt, Shigella flexneri 2a str. 301
cgccgugcaacugcggcgca

SEQ ID NO: 2020114 - RNA, 14 nt, Shigella flexneri 2a str. 301
cgccgugaacgugg

SEQ ID NO: 2020115 - RNA, 15 nt, Shigella flexneri 2a str. 301
cgccgucuuccccuc

SEQ ID NO: 2020116 - RNA, 15 nt, Shigella flexneri 2a str. 301
cgccuaauuacauaa

SEQ ID NO: 2020117 - RNA, 13 nt, Shigella flexneri 2a str. 301
cgccucagccaga

SEQ ID NO: 2020118 - RNA, 15 nt, Shigella flexneri 2a str. 301
cgccucacagggcuc

SEQ ID NO: 2020119 - RNA, 20 nt, Shigella flexneri 2a str. 301
cgccucaacgccuaaugcca

SEQ ID NO: 2020120 - RNA, 14 nt, Shigella flexneri 2a str. 301
cgccucaacccauu

SEQ ID NO: 2020121 - RNA, 20 nt, Shigella flexneri 2a str. 301
cgccguuuuuacccagcagc

SEQ ID NO: 2020122 - RNA, 19 nt, Shigella flexneri 2a str. 301
cgccuggacaucaugcugc

SEQ ID NO: 2020123 - RNA, 12 nt, Shigella flexneri 2a str. 301
cgccugcagguu

SEQ ID NO: 2020124 - RNA, 14 nt, Shigella flexneri 2a str. 301
cgccugcauacguu

SEQ ID NO: 2020125 - RNA, 22 nt, Shigella flexneri 2a str. 301
cgccuguuuaccgcucaccgga

SEQ ID NO: 2020126 - RNA, 17 nt, Shigella flexneri 2a str. 301
cgccuguucccuucuca

SEQ ID NO: 2020127 - RNA, 14 nt, Shigella flexneri 2a str. 301
cgccuuacgcugcg

SEQ ID NO: 2020128 - RNA, 16 nt, Shigella flexneri 2a str. 301
cgccuguguccuguug

SEQ ID NO: 2020129 - RNA, 11 nt, Shigella flexneri 2a str. 301
cgccuguuaau

SEQ ID NO: 2020130 - RNA, 22 nt, Shigella flexneri 2a str. 301
cgccuucauucaggccaaagcc

SEQ ID NO: 2020131 - RNA, 15 nt, Shigella flexneri 2a str. 301
cgccuucauucaggc

SEQ ID NO: 2020132 - RNA, 13 nt, Shigella flexneri 2a str. 301
cgccuucaugcca

SEQ ID NO: 2020133 - RNA, 16 nt, Shigella flexneri 2a str. 301
cgccuucacgguuauu

SEQ ID NO: 2020134 - RNA, 16 nt, Shigella flexneri 2a str. 301
cgccugguaccagcac

SEQ ID NO: 2020135 - RNA, 20 nt, Shigella flexneri 2a str. 301
cgccuuuaauauuaacgcca

SEQ ID NO: 2020136 - RNA, 20 nt, Shigella flexneri 2a str. 301
cgccuuuaaaucccgcuuca

SEQ ID NO: 2020137 - RNA, 17 nt, Shigella flexneri 2a str. 301
cgccuuguuccugcuug

SEQ ID NO: 2020138 - RNA, 14 nt, Shigella flexneri 2a str. 301
cgccuuucuuaaac

SEQ ID NO: 2020139 - RNA, 15 nt, Shigella flexneri 2a str. 301
cgccuuuuacgcauu

SEQ ID NO: 2020140 - RNA, 19 nt, Shigella flexneri 2a str. 301
cgccuugcggaaauuccag

SEQ ID NO: 2020141 - RNA, 18 nt, Shigella flexneri 2a str. 301
cgcgaacagcacaucagc

SEQ ID NO: 2020142 - RNA, 19 nt, Shigella flexneri 2a str. 301
cgcgaaauaaucaaaugaa

SEQ ID NO: 2020143 - RNA, 19 nt, Shigella flexneri 2a str. 301
cgcgaaaguuaccgcgcca

SEQ ID NO: 2020144 - RNA, 17 nt, Shigella flexneri 2a str. 301
cgcgaaaaugccccagc

SEQ ID NO: 2020145 - RNA, 15 nt, Shigella flexneri 2a str. 301
cgcgaaagaggcgca

SEQ ID NO: 2020146 - RNA, 13 nt, Shigella flexneri 2a str. 301
cgcgaagaaacga

SEQ ID NO: 2020147 - RNA, 12 nt, Shigella flexneri 2a str. 301
cgcgaagcuggu

SEQ ID NO: 2020148 - RNA, 21 nt, Shigella flexneri 2a str. 301
cuugacgcgucuuaucaggcc

SEQ ID NO: 2020149 - RNA, 23 nt, Shigella flexneri 2a str. 301
cuugacgcgucuuaucaggccua

SEQ ID NO: 2020150 - RNA, 16 nt, Shigella flexneri 2a str. 301
cuugacaucaccgccg

SEQ ID NO: 2020151 - RNA, 15 nt, Shigella flexneri 2a str. 301
cuugaagugucuggu

SEQ ID NO: 2020152 - RNA, 15 nt, Shigella flexneri 2a str. 301
cuugaagccuucgcc

SEQ ID NO: 2020153 - RNA, 22 nt, Shigella flexneri 2a str. 301
cuucuuuugucgugcccugcgc

SEQ ID NO: 2020154 - RNA, 17 nt, Shigella flexneri 2a str. 301
cuucucaaucccuuucu

SEQ ID NO: 2020155 - RNA, 15 nt, Shigella flexneri 2a str. 301
cuucucaaucccuuu

SEQ ID NO: 2020156 - RNA, 13 nt, Shigella flexneri 2a str. 301
cuucucagccaaa

SEQ ID NO: 2020157 - RNA, 21 nt, Shigella flexneri 2a str. 301
cuucucacccggaggaaagca

SEQ ID NO: 2020158 - RNA, 14 nt, Shigella flexneri 2a str. 301
cuucucauccuucc

SEQ ID NO: 2020159 - RNA, 12 nt, Shigella flexneri 2a str. 301
cuucuccacgcc

SEQ ID NO: 2020160 - RNA, 13 nt, Shigella flexneri 2a str. 301
cuugaugaaaaaa

SEQ ID NO: 2020161 - RNA, 18 nt, Shigella flexneri 2a str. 301
cuugacucuguagcggga

SEQ ID NO: 2020162 - RNA, 16 nt, Shigella flexneri 2a str. 301
cuugagacauuguuuc

SEQ ID NO: 2020163 - RNA, 15 nt, Shigella flexneri 2a str. 301
cuugccauuccacaa

SEQ ID NO: 2020164 - RNA, 21 nt, Shigella flexneri 2a str. 301
cuugcccagcaaaaagcgggc

SEQ ID NO: 2020165 - RNA, 15 nt, Shigella flexneri 2a str. 301
cuugcccaggugugu

SEQ ID NO: 2020166 - RNA, 23 nt, Shigella flexneri 2a str. 301
cuugcccaggugugucucaaguc

SEQ ID NO: 2020167 - RNA, 13 nt, Shigella flexneri 2a str. 301
cuugccccuuccc

SEQ ID NO: 2020168 - RNA, 23 nt, Shigella flexneri 2a str. 301
cuugcaacuccggcgaaaauccc

SEQ ID NO: 2020169 - RNA, 18 nt, Shigella flexneri 2a str. 301
cuugcaagccuguaguac

SEQ ID NO: 2020170 - RNA, 22 nt, Shigella flexneri 2a str. 301
cuugcaauaauuuacagccugc

SEQ ID NO: 2020171 - RNA, 14 nt, Shigella flexneri 2a str. 301
cuugccaacgcaaa

SEQ ID NO: 2020172 - RNA, 16 nt, Shigella flexneri 2a str. 301
cuugccagcaggguuu

SEQ ID NO: 2020173 - RNA, 12 nt, Shigella flexneri 2a str. 301
cuuggcuuccau

SEQ ID NO: 2020174 - RNA, 22 nt, Shigella flexneri 2a str. 301
cuuggcgggcaacguuccagca

SEQ ID NO: 2020175 - RNA, 17 nt, Shigella flexneri 2a str. 301
cuuguaggaaucaggca

SEQ ID NO: 2020176 - RNA, 16 nt, Shigella flexneri 2a str. 301
cuuguaggccugauaa

SEQ ID NO: 2020177 - RNA, 13 nt, Shigella flexneri 2a str. 301
cuugguucuccaa

SEQ ID NO: 2020178 - RNA, 16 nt, Shigella flexneri 2a str. 301
cuugucacgucucauc

SEQ ID NO: 2020179 - RNA, 18 nt, Shigella flexneri 2a str. 301
cuugcuggucacugacca

SEQ ID NO: 2020180 - RNA, 16 nt, Shigella flexneri 2a str. 301
cuugcuguuugcgauu

SEQ ID NO: 2020181 - RNA, 15 nt, Shigella flexneri 2a str. 301
cuuggcaucuugaac

SEQ ID NO: 2020182 - RNA, 21 nt, Shigella flexneri 2a str. 301
cuugcugcuccagcgggcgaa

SEQ ID NO: 2020183 - RNA, 15 nt, Shigella flexneri 2a str. 301
cuugcugcuccagcg

SEQ ID NO: 2020184 - RNA, 20 nt, Shigella flexneri 2a str. 301
cuugcgagacggcggaaagg

SEQ ID NO: 2020185 - RNA, 20 nt, Shigella flexneri 2a str. 301
cuugcgauauucuucaguau

SEQ ID NO: 2020186 - RNA, 16 nt, Shigella flexneri 2a str. 301
cuugcgauccugcaga

SEQ ID NO: 2020187 - RNA, 17 nt, Shigella flexneri 2a str. 301
cuugccgcgucuuauca

SEQ ID NO: 2020188 - RNA, 19 nt, Shigella flexneri 2a str. 301
cuugccggacaugcugccu

SEQ ID NO: 2020189 - RNA, 17 nt, Shigella flexneri 2a str. 301
cuuucagcaccagcccg

SEQ ID NO: 2020190 - RNA, 19 nt, Shigella flexneri 2a str. 301
cuuucagagaagcaccgcc

SEQ ID NO: 2020191 - RNA, 15 nt, Shigella flexneri 2a str. 301
cuuucagcaccagcc

SEQ ID NO: 2020192 - RNA, 18 nt, Shigella flexneri 2a str. 301
cuuucagcgccuucagau

SEQ ID NO: 2020193 - RNA, 18 nt, Shigella flexneri 2a str. 301
cuuucagaaucagguuga

SEQ ID NO: 2020194 - RNA, 15 nt, Shigella flexneri 2a str. 301
cuuucagcaaaccac

SEQ ID NO: 2020195 - RNA, 13 nt, Shigella flexneri 2a str. 301
cuuucaacaaccu

SEQ ID NO: 2020196 - RNA, 22 nt, Shigella flexneri 2a str. 301
cuuucaacagguuaacuccccc

SEQ ID NO: 2020197 - RNA, 23 nt, Shigella flexneri 2a str. 301
cuuuauccugcccacuccagcua

SEQ ID NO: 2020198 - RNA, 14 nt, Shigella flexneri 2a str. 301
cuuuauccugacuc

SEQ ID NO: 2020199 - RNA, 14 nt, Shigella flexneri 2a str. 301
cuuuauccugccca

SEQ ID NO: 2020200 - RNA, 15 nt, Shigella flexneri 2a str. 301
cuuuaucccuggugg

SEQ ID NO: 2020201 - RNA, 19 nt, Shigella flexneri 2a str. 301
cuuuauaaucccuccagca

SEQ ID NO: 2020202 - RNA, 15 nt, Shigella flexneri 2a str. 301
cuuuagggcuggcuu

SEQ ID NO: 2020203 - RNA, 21 nt, Shigella flexneri 2a str. 301
cuuuauucggcauacauaauc

SEQ ID NO: 2020204 - RNA, 23 nt, Shigella flexneri 2a str. 301
cuuuauucugacgccaccauuca

SEQ ID NO: 2020205 - RNA, 17 nt, Shigella flexneri 2a str. 301
cuuuauugcaaacauuu

SEQ ID NO: 2020206 - RNA, 23 nt, Shigella flexneri 2a str. 301
cuuuaucugauuugauaaugcca

SEQ ID NO: 2020207 - RNA, 21 nt, Shigella flexneri 2a str. 301
cuuuaucugccggacuuaagg

SEQ ID NO: 2020208 - RNA, 15 nt, Shigella flexneri 2a str. 301
cuuuacucuuuuuug

SEQ ID NO: 2020209 - RNA, 19 nt, Shigella flexneri 2a str. 301
cuuuaauuuugugcagcau

SEQ ID NO: 2020210 - RNA, 16 nt, Shigella flexneri 2a str. 301
cuuuacgccaggcauc

SEQ ID NO: 2020211 - RNA, 22 nt, Shigella flexneri 2a str. 301
cuuuaauuggaauacauauauu

SEQ ID NO: 2020212 - RNA, 13 nt, Shigella flexneri 2a str. 301
cuugucuacgccu

SEQ ID NO: 2020213 - RNA, 15 nt, Shigella flexneri 2a str. 301
cuugucgucccaggc

SEQ ID NO: 2020214 - RNA, 16 nt, Shigella flexneri 2a str. 301
cuugucugagccgaaa

SEQ ID NO: 2020215 - RNA, 18 nt, Shigella flexneri 2a str. 301
cuugucacuucugccucu

SEQ ID NO: 2020216 - RNA, 13 nt, Shigella flexneri 2a str. 301
cuuugcaagcguu

SEQ ID NO: 2020217 - RNA, 13 nt, Shigella flexneri 2a str. 301
cuuugcaccccaa

SEQ ID NO: 2020218 - RNA, 13 nt, Shigella flexneri 2a str. 301
cuuugcaggcugg

SEQ ID NO: 2020219 - RNA, 14 nt, Shigella flexneri 2a str. 301
cuuugcaugacgau

SEQ ID NO: 2020220 - RNA, 21 nt, Shigella flexneri 2a str. 301
cuuugaucugcgucgcuuucc

SEQ ID NO: 2020221 - RNA, 18 nt, Shigella flexneri 2a str. 301
cuuugaucgcguuuuuug

SEQ ID NO: 2020222 - RNA, 22 nt, Shigella flexneri 2a str. 301
cuuugaucgguugcugaacagc

SEQ ID NO: 2020223 - RNA, 24 nt, Shigella flexneri 2a str. 301
cuuugcccgcagauccagugcuca

SEQ ID NO: 2020224 - RNA, 15 nt, Shigella flexneri 2a str. 301
cuuugccccagcggg

SEQ ID NO: 2020225 - RNA, 23 nt, Shigella flexneri 2a str. 301
cuuugcccacgcuuuucaucaga

SEQ ID NO: 2020226 - RNA, 17 nt, Shigella flexneri 2a str. 301
cuuugccgucagccacu

SEQ ID NO: 2020227 - RNA, 20 nt, Shigella flexneri 2a str. 301
cuuugccgucagccacuucu

SEQ ID NO: 2020228 - RNA, 21 nt, Shigella flexneri 2a str. 301
cuuugccgugaacaauuucag

SEQ ID NO: 2020229 - RNA, 17 nt, Shigella flexneri 2a str. 301
cuuugcugcaaugaagg

SEQ ID NO: 2020230 - RNA, 12 nt, Shigella flexneri 2a str. 301
cuuugcuguaca

SEQ ID NO: 2020231 - RNA, 20 nt, Shigella flexneri 2a str. 301
cuuugcuuuguaaagcgcca

SEQ ID NO: 2020232 - RNA, 14 nt, Shigella flexneri 2a str. 301
cuuugcuacagccu

SEQ ID NO: 2020233 - RNA, 19 nt, Shigella flexneri 2a str. 301
cuuugcuacagccugguga

SEQ ID NO: 2020234 - RNA, 13 nt, Shigella flexneri 2a str. 301
cuuuggcaaaccg

SEQ ID NO: 2020235 - RNA, 21 nt, Shigella flexneri 2a str. 301
cuuugaauaucuccucugcuu

SEQ ID NO: 2020236 - RNA, 14 nt, Shigella flexneri 2a str. 301
cuuugaauaucucc

SEQ ID NO: 2020237 - RNA, 21 nt, Shigella flexneri 2a str. 301
cuuucuuaccccugauuuugu

SEQ ID NO: 2020238 - RNA, 23 nt, Shigella flexneri 2a str. 301
cuuugagcaucaaacuuuuaaau

SEQ ID NO: 2020239 - RNA, 15 nt, Shigella flexneri 2a str. 301
cuuuccagccacagu

SEQ ID NO: 2020240 - RNA, 20 nt, Shigella flexneri 2a str. 301
cuuuccagcaaccaaugcca

SEQ ID NO: 2020241 - RNA, 18 nt, Shigella flexneri 2a str. 301
cuuucguacgagcucuuc

SEQ ID NO: 2020242 - RNA, 14 nt, Shigella flexneri 2a str. 301
cuuucgugaagcug

SEQ ID NO: 2020243 - RNA, 11 nt, Shigella flexneri 2a str. 301
cuuuccacgca

SEQ ID NO: 2020244 - RNA, 18 nt, Shigella flexneri 2a str. 301
cuuucauuucaauaaauu

SEQ ID NO: 2020245 - RNA, 23 nt, Shigella flexneri 2a str. 301
cuuucugcaauuaaggucggcuu

SEQ ID NO: 2020246 - RNA, 23 nt, Shigella flexneri 2a str. 301
cuuucugcccgcguuuccacgcu

SEQ ID NO: 2020247 - RNA, 23 nt, Shigella flexneri 2a str. 301
cuuucugcgauagcagcagauau

SEQ ID NO: 2020248 - RNA, 15 nt, Shigella flexneri 2a str. 301
cuuucugugcaucug

SEQ ID NO: 2020249 - RNA, 23 nt, Shigella flexneri 2a str. 301
cuuucguuaaauucuucugaaug

SEQ ID NO: 2020250 - RNA, 14 nt, Shigella flexneri 2a str. 301
cuuucguuaaauuc

SEQ ID NO: 2020251 - RNA, 19 nt, Shigella flexneri 2a str. 301
cuuucguuugaaaacuggc

SEQ ID NO: 2020252 - RNA, 17 nt, Shigella flexneri 2a str. 301
cuuagguaaugacucca

SEQ ID NO: 2020253 - RNA, 18 nt, Shigella flexneri 2a str. 301
cuuaggggguaucuuuga

SEQ ID NO: 2020254 - RNA, 15 nt, Shigella flexneri 2a str. 301
cuuaggggacauuua

SEQ ID NO: 2020255 - RNA, 16 nt, Shigella flexneri 2a str. 301
cuuaggggacauuuag

SEQ ID NO: 2020256 - RNA, 22 nt, Shigella flexneri 2a str. 301
cuuacccggaccgucuuuuuuc

SEQ ID NO: 2020257 - RNA, 17 nt, Shigella flexneri 2a str. 301
cuuaccgcgucuuauca

SEQ ID NO: 2020258 - RNA, 17 nt, Shigella flexneri 2a str. 301
cuuaccaaauaaacgaa

SEQ ID NO: 2020259 - RNA, 18 nt, Shigella flexneri 2a str. 301
cuuacuuuuaaugcuuua

SEQ ID NO: 2020260 - RNA, 21 nt, Shigella flexneri 2a str. 301
cuuaaugcccaucucuucuuc

SEQ ID NO: 2020261 - RNA, 14 nt, Shigella flexneri 2a str. 301
cuuaaucugccaga

SEQ ID NO: 2020262 - RNA, 19 nt, Shigella flexneri 2a str. 301
cuuaaucugccagaaggau

SEQ ID NO: 2020263 - RNA, 18 nt, Shigella flexneri 2a str. 301
cuuaauggaaaacuguuu

SEQ ID NO: 2020264 - RNA, 21 nt, Shigella flexneri 2a str. 301
cuuaacuguaugcaugcagcg

SEQ ID NO: 2020265 - RNA, 18 nt, Shigella flexneri 2a str. 301
cuuaacugucgcugaagu

SEQ ID NO: 2020266 - RNA, 17 nt, Shigella flexneri 2a str. 301
cuuaacucgcugaauaa

SEQ ID NO: 2020267 - RNA, 14 nt, Shigella flexneri 2a str. 301
cuuaacucuuccug

SEQ ID NO: 2020268 - RNA, 18 nt, Shigella flexneri 2a str. 301
cuuaacgcgggcuucuuc

SEQ ID NO: 2020269 - RNA, 19 nt, Shigella flexneri 2a str. 301
cuuaacgcgggcuucuucu

SEQ ID NO: 2020270 - RNA, 23 nt, Shigella flexneri 2a str. 301
cuuaacgguguuuaguuucguuc

SEQ ID NO: 2020271 - RNA, 20 nt, Shigella flexneri 2a str. 301
cuuaacggcgaaaaauauuu

SEQ ID NO: 2020272 - RNA, 22 nt, Shigella flexneri 2a str. 301
cuuaacgcgggcuucuucuuuc

SEQ ID NO: 2020273 - RNA, 14 nt, Shigella flexneri 2a str. 301
cuuaaucgcuucuu

SEQ ID NO: 2020274 - RNA, 22 nt, Shigella flexneri 2a str. 301
cuuaaguuagucgcuuucauuc

SEQ ID NO: 2020275 - RNA, 17 nt, Shigella flexneri 2a str. 301
cuuaagguucacuuaau

SEQ ID NO: 2020276 - RNA, 16 nt, Shigella flexneri 2a str. 301
cuuaaggcuguuccca

SEQ ID NO: 2020277 - RNA, 20 nt, Shigella flexneri 2a str. 301
cuuaaggcuguucccacgca

SEQ ID NO: 2020278 - RNA, 21 nt, Shigella flexneri 2a str. 301
cuguucgcaaccuaaaccaaa

SEQ ID NO: 2020279 - RNA, 16 nt, Shigella flexneri 2a str. 301
cuguuccggcggcagg

SEQ ID NO: 2020280 - RNA, 15 nt, Shigella flexneri 2a str. 301
cuguuccggcuuugu

SEQ ID NO: 2020281 - RNA, 15 nt, Shigella flexneri 2a str. 301
cuguuccuaucuuca

SEQ ID NO: 2020282 - RNA, 21 nt, Shigella flexneri 2a str. 301
cuguuccagacgcugcauuga

SEQ ID NO: 2020283 - RNA, 11 nt, Shigella flexneri 2a str. 301
cuguuccagca

SEQ ID NO: 2020284 - RNA, 16 nt, Shigella flexneri 2a str. 301
cuguuccagcaaaucc

SEQ ID NO: 2020285 - RNA, 15 nt, Shigella flexneri 2a str. 301
cuguuccccucaccc

SEQ ID NO: 2020286 - RNA, 12 nt, Shigella flexneri 2a str. 301
cuguucccuucu

SEQ ID NO: 2020287 - RNA, 15 nt, Shigella flexneri 2a str. 301
cuuaacgcaccaugc

SEQ ID NO: 2020288 - RNA, 19 nt, Shigella flexneri 2a str. 301
cuuaacauccaucgccagc

SEQ ID NO: 2020289 - RNA, 22 nt, Shigella flexneri 2a str. 301
cuuaaauuucuuaccacugccg

SEQ ID NO: 2020290 - RNA, 12 nt, Shigella flexneri 2a str. 301
cuuaaauggccc

SEQ ID NO: 2020291 - RNA, 20 nt, Shigella flexneri 2a str. 301
cuuaacaacgggcaccgccg

SEQ ID NO: 2020292 - RNA, 16 nt, Shigella flexneri 2a str. 301
cuuauaaagaaaaucu

SEQ ID NO: 2020293 - RNA, 18 nt, Shigella flexneri 2a str. 301
cuuauaaagaaaaucuga

SEQ ID NO: 2020294 - RNA, 13 nt, Shigella flexneri 2a str. 301
cuuauaagucuca

SEQ ID NO: 2020295 - RNA, 16 nt, Shigella flexneri 2a str. 301
cuuaugauguaaauaa

SEQ ID NO: 2020296 - RNA, 17 nt, Shigella flexneri 2a str. 301
cuuaugauguaaauaac

SEQ ID NO: 2020297 - RNA, 22 nt, Shigella flexneri 2a str. 301
cuuauggcucgccauccaguga

SEQ ID NO: 2020298 - RNA, 20 nt, Shigella flexneri 2a str. 301
cuuaugcugcgccaguugcu

SEQ ID NO: 2020299 - RNA, 18 nt, Shigella flexneri 2a str. 301
cuuaugcaaaauuuuuuu

SEQ ID NO: 2020300 - RNA, 13 nt, Shigella flexneri 2a str. 301
cuuaugguucacu

SEQ ID NO: 2020301 - RNA, 19 nt, Shigella flexneri 2a str. 301
cuuauucuucaacaauuga

SEQ ID NO: 2020302 - RNA, 12 nt, Shigella flexneri 2a str. 301
cuucaaaaauaa

SEQ ID NO: 2020303 - RNA, 20 nt, Shigella flexneri 2a str. 301
cuucaaaaauaaguugccac

SEQ ID NO: 2020304 - RNA, 15 nt, Shigella flexneri 2a str. 301
cuuauuucugugacu

SEQ ID NO: 2020305 - RNA, 20 nt, Shigella flexneri 2a str. 301
cuucaaucaauaacagcgca

SEQ ID NO: 2020306 - RNA, 22 nt, Shigella flexneri 2a str. 301
cuucaauauuaaugcugaccga

SEQ ID NO: 2020307 - RNA, 18 nt, Shigella flexneri 2a str. 301
cuucaauggucagccaca

SEQ ID NO: 2020308 - RNA, 19 nt, Shigella flexneri 2a str. 301
cuucaauggucagccacag

SEQ ID NO: 2020309 - RNA, 12 nt, Shigella flexneri 2a str. 301
cuucaaugcugc

SEQ ID NO: 2020310 - RNA, 22 nt, Shigella flexneri 2a str. 301
cuucacccucacgcauucucuu

SEQ ID NO: 2020311 - RNA, 15 nt, Shigella flexneri 2a str. 301
cuucacccgcagcac

SEQ ID NO: 2020312 - RNA, 20 nt, Shigella flexneri 2a str. 301
cuucaccgauauccgccagg

SEQ ID NO: 2020313 - RNA, 17 nt, Shigella flexneri 2a str. 301
cuucacucucaccacgc

SEQ ID NO: 2020314 - RNA, 18 nt, Shigella flexneri 2a str. 301
cuucaccuuucagaacgg

SEQ ID NO: 2020315 - RNA, 18 nt, Shigella flexneri 2a str. 301
cuucaagaauuaaaauau

SEQ ID NO: 2020316 - RNA, 18 nt, Shigella flexneri 2a str. 301
cuucaagccaggcuuuaa

SEQ ID NO: 2020317 - RNA, 23 nt, Shigella flexneri 2a str. 301
cuucaaccgucgcgcccuccugc

SEQ ID NO: 2020318 - RNA, 22 nt, Shigella flexneri 2a str. 301
cuucaaccguugcuggaaaacc

SEQ ID NO: 2020319 - RNA, 18 nt, Shigella flexneri 2a str. 301
cuucaaccgucaccagcc

SEQ ID NO: 2020320 - RNA, 20 nt, Shigella flexneri 2a str. 301
cuucaaccaggcggauaauu

SEQ ID NO: 2020321 - RNA, 18 nt, Shigella flexneri 2a str. 301
cuucaacgauuucucagc

SEQ ID NO: 2020322 - RNA, 21 nt, Shigella flexneri 2a str. 301
cuucaacacggcgcauugcca

SEQ ID NO: 2020323 - RNA, 16 nt, Shigella flexneri 2a str. 301
cuucaacacuggcaaa

SEQ ID NO: 2020324 - RNA, 17 nt, Shigella flexneri 2a str. 301
cuucaacacaggccggc

SEQ ID NO: 2020325 - RNA, 14 nt, Shigella flexneri 2a str. 301
cuucggucagcacg

SEQ ID NO: 2020326 - RNA, 12 nt, Shigella flexneri 2a str. 301
cuucgguagcag

SEQ ID NO: 2020327 - RNA, 12 nt, Shigella flexneri 2a str. 301
cuucgcuucauu

SEQ ID NO: 2020328 - RNA, 16 nt, Shigella flexneri 2a str. 301
cuucgcuuuacccugg

SEQ ID NO: 2020329 - RNA, 16 nt, Shigella flexneri 2a str. 301
cuucgcugcugguucu

SEQ ID NO: 2020330 - RNA, 19 nt, Shigella flexneri 2a str. 301
cuucgcuuaucaggccuac

SEQ ID NO: 2020331 - RNA, 16 nt, Shigella flexneri 2a str. 301
cuucgcugcagcucug

SEQ ID NO: 2020332 - RNA, 17 nt, Shigella flexneri 2a str. 301
cuucgcugcagcucugc

SEQ ID NO: 2020333 - RNA, 18 nt, Shigella flexneri 2a str. 301
cuucgcucccuagaagga

SEQ ID NO: 2020334 - RNA, 19 nt, Shigella flexneri 2a str. 301
cuucgauauugacgaucuc

SEQ ID NO: 2020335 - RNA, 16 nt, Shigella flexneri 2a str. 301
cuucgauaaaagccau

SEQ ID NO: 2020336 - RNA, 16 nt, Shigella flexneri 2a str. 301
cuucgaguacauccac

SEQ ID NO: 2020337 - RNA, 16 nt, Shigella flexneri 2a str. 301
cuucgagauucuuaaa

SEQ ID NO: 2020338 - RNA, 20 nt, Shigella flexneri 2a str. 301
cuucgacagcguuucgccac

SEQ ID NO: 2020339 - RNA, 19 nt, Shigella flexneri 2a str. 301
cuucuagugcuugcacaac

SEQ ID NO: 2020340 - RNA, 22 nt, Shigella flexneri 2a str. 301
cuucuaccgucuguaaccagau

SEQ ID NO: 2020341 - RNA, 23 nt, Shigella flexneri 2a str. 301
cuucuaacgacauuuucugccca

SEQ ID NO: 2020342 - RNA, 23 nt, Shigella flexneri 2a str. 301
cuucguuaaacagcuuggauucu

SEQ ID NO: 2020343 - RNA, 22 nt, Shigella flexneri 2a str. 301
cuucguuaacgugucauaacug

SEQ ID NO: 2020344 - RNA, 18 nt, Shigella flexneri 2a str. 301
cuucguucaucucaaaca

SEQ ID NO: 2020345 - RNA, 17 nt, Shigella flexneri 2a str. 301
cuucguuuucagcuucg

SEQ ID NO: 2020346 - RNA, 23 nt, Shigella flexneri 2a str. 301
cuucgguuuuguugccgcccguu

SEQ ID NO: 2020347 - RNA, 16 nt, Shigella flexneri 2a str. 301
cuucgguucaaguccc

SEQ ID NO: 2020348 - RNA, 22 nt, Shigella flexneri 2a str. 301
cuucgucccagucgucauccca

SEQ ID NO: 2020349 - RNA, 13 nt, Shigella flexneri 2a str. 301
cuucgucccaguc

SEQ ID NO: 2020350 - RNA, 15 nt, Shigella flexneri 2a str. 301
cuucccggcaaucgc

SEQ ID NO: 2020351 - RNA, 17 nt, Shigella flexneri 2a str. 301
cuucccgucuacaaaaa

SEQ ID NO: 2020352 - RNA, 14 nt, Shigella flexneri 2a str. 301
cuucccgcauccag

SEQ ID NO: 2020353 - RNA, 16 nt, Shigella flexneri 2a str. 301
cuuccccgcuucagcc

SEQ ID NO: 2020354 - RNA, 17 nt, Shigella flexneri 2a str. 301
cuuccccgcuucagccc

SEQ ID NO: 2020355 - RNA, 12 nt, Shigella flexneri 2a str. 301
cuuccccgagcg

SEQ ID NO: 2020356 - RNA, 15 nt, Shigella flexneri 2a str. 301
cuuccccgcagccca

SEQ ID NO: 2020357 - RNA, 14 nt, Shigella flexneri 2a str. 301
cuuccccuucucgu

SEQ ID NO: 2020358 - RNA, 17 nt, Shigella flexneri 2a str. 301
cuuccccguucugccag

SEQ ID NO: 2020359 - RNA, 18 nt, Shigella flexneri 2a str. 301
cuuccccguucugccagu

SEQ ID NO: 2020360 - RNA, 15 nt, Shigella flexneri 2a str. 301
cuuccagcuccagcc

SEQ ID NO: 2020361 - RNA, 20 nt, Shigella flexneri 2a str. 301
cuuccagcguucgccaaacc

SEQ ID NO: 2020362 - RNA, 22 nt, Shigella flexneri 2a str. 301
cuuccagcguucgccaaaccca

SEQ ID NO: 2020363 - RNA, 15 nt, Shigella flexneri 2a str. 301
cuuccaggguaaaca

SEQ ID NO: 2020364 - RNA, 14 nt, Shigella flexneri 2a str. 301
cuuccgucacaggc

SEQ ID NO: 2020365 - RNA, 15 nt, Shigella flexneri 2a str. 301
cuuccguagcggcuc

SEQ ID NO: 2020366 - RNA, 17 nt, Shigella flexneri 2a str. 301
cuuccguuuaaagagca

SEQ ID NO: 2020367 - RNA, 17 nt, Shigella flexneri 2a str. 301
cuuccucaauuaacauu

SEQ ID NO: 2020368 - RNA, 20 nt, Shigella flexneri 2a str. 301
cuuccucaauuaacauugca

SEQ ID NO: 2020369 - RNA, 21 nt, Shigella flexneri 2a str. 301
cuuccuccagcgguuuaucaa

SEQ ID NO: 2020370 - RNA, 13 nt, Shigella flexneri 2a str. 301
cuuccuccagcgg

SEQ ID NO: 2020371 - RNA, 15 nt, Shigella flexneri 2a str. 301
cuuccugccagaucc

SEQ ID NO: 2020372 - RNA, 12 nt, Shigella flexneri 2a str. 301
cuuccuucagcu

SEQ ID NO: 2020373 - RNA, 14 nt, Shigella flexneri 2a str. 301
cuuccuucagcucc

SEQ ID NO: 2020374 - RNA, 18 nt, Shigella flexneri 2a str. 301
cuuccuucagcucccgcu

SEQ ID NO: 2020375 - RNA, 16 nt, Shigella flexneri 2a str. 301
cuuccuuaaucccugg

SEQ ID NO: 2020376 - RNA, 20 nt, Shigella flexneri 2a str. 301
cuuccuuaugcuaagccgug

SEQ ID NO: 2020377 - RNA, 21 nt, Shigella flexneri 2a str. 301
cuuccugggauaugagcgauu

SEQ ID NO: 2020378 - RNA, 19 nt, Shigella flexneri 2a str. 301
cuuccugcggcagacgcuc

SEQ ID NO: 2020379 - RNA, 16 nt, Shigella flexneri 2a str. 301
cuuccacaauggcaua

SEQ ID NO: 2020380 - RNA, 14 nt, Shigella flexneri 2a str. 301
cuuccaccagcggc

SEQ ID NO: 2020381 - RNA, 16 nt, Shigella flexneri 2a str. 301
cuuccaccacuuccug

SEQ ID NO: 2020382 - RNA, 16 nt, Shigella flexneri 2a str. 301
cuuccacuuccugcgg

SEQ ID NO: 2020383 - RNA, 16 nt, Shigella flexneri 2a str. 301
cuuccagaauaaacaa

SEQ ID NO: 2020384 - RNA, 22 nt, Shigella flexneri 2a str. 301
cuuccagagcagcgaauuucuc

SEQ ID NO: 2020385 - RNA, 17 nt, Shigella flexneri 2a str. 301
cuuccagcaaauccauc

SEQ ID NO: 2020386 - RNA, 20 nt, Shigella flexneri 2a str. 301
cuuccagcagaccuucugcc

SEQ ID NO: 2020387 - RNA, 19 nt, Shigella flexneri 2a str. 301
cuuccagcagaccuucugc

SEQ ID NO: 2020388 - RNA, 22 nt, Shigella flexneri 2a str. 301
cuuccagcagaccagcaauaac

SEQ ID NO: 2020389 - RNA, 11 nt, Shigella flexneri 2a str. 301
cuuccagcauc

SEQ ID NO: 2020390 - RNA, 18 nt, Shigella flexneri 2a str. 301
cuuccagcaguucgcccg

SEQ ID NO: 2020391 - RNA, 15 nt, Shigella flexneri 2a str. 301
cuuccagcggcaggc

SEQ ID NO: 2020392 - RNA, 12 nt, Shigella flexneri 2a str. 301
cuuccagcgcca

SEQ ID NO: 2020393 - RNA, 14 nt, Shigella flexneri 2a str. 301
cuucacuggcgaca

SEQ ID NO: 2020394 - RNA, 14 nt, Shigella flexneri 2a str. 301
cuucacucucuuuu

SEQ ID NO: 2020395 - RNA, 15 nt, Shigella flexneri 2a str. 301
cuucacuuuugccag

SEQ ID NO: 2020396 - RNA, 16 nt, Shigella flexneri 2a str. 301
cuucacuucuucuuca

SEQ ID NO: 2020397 - RNA, 23 nt, Shigella flexneri 2a str. 301
cuucagaauauucgaaaucuguu

SEQ ID NO: 2020398 - RNA, 17 nt, Shigella flexneri 2a str. 301
cuucaucucagugagau

SEQ ID NO: 2020399 - RNA, 15 nt, Shigella flexneri 2a str. 301
cuucaucucagugag

SEQ ID NO: 2020400 - RNA, 18 nt, Shigella flexneri 2a str. 301
cuucaucgugcucgcuuu

SEQ ID NO: 2020401 - RNA, 13 nt, Shigella flexneri 2a str. 301
cuucaucgucaua

SEQ ID NO: 2020402 - RNA, 23 nt, Shigella flexneri 2a str. 301
cuucagacggucagcgagauaac

SEQ ID NO: 2020403 - RNA, 15 nt, Shigella flexneri 2a str. 301
cuucagacuccugaa

SEQ ID NO: 2020404 - RNA, 15 nt, Shigella flexneri 2a str. 301
cugccagcguggcga

SEQ ID NO: 2020405 - RNA, 17 nt, Shigella flexneri 2a str. 301
cugccagcgugagggaa

SEQ ID NO: 2020406 - RNA, 21 nt, Shigella flexneri 2a str. 301
cugccauuggcaggcucuggu

SEQ ID NO: 2020407 - RNA, 15 nt, Shigella flexneri 2a str. 301
cugccauuguuguug

SEQ ID NO: 2020408 - RNA, 20 nt, Shigella flexneri 2a str. 301
cugccauuguuguuggaucc

SEQ ID NO: 2020409 - RNA, 13 nt, Shigella flexneri 2a str. 301
cugcccacuccag

SEQ ID NO: 2020410 - RNA, 17 nt, Shigella flexneri 2a str. 301
cugcccacgcgcacgcu

SEQ ID NO: 2020411 - RNA, 17 nt, Shigella flexneri 2a str. 301
cugcccccgcucuucca

SEQ ID NO: 2020412 - RNA, 12 nt, Shigella flexneri 2a str. 301
cugccagaugca

SEQ ID NO: 2020413 - RNA, 14 nt, Shigella flexneri 2a str. 301
cugccagcaaauag

SEQ ID NO: 2020414 - RNA, 21 nt, Shigella flexneri 2a str. 301
cugccagaucggccaucagua

SEQ ID NO: 2020415 - RNA, 15 nt, Shigella flexneri 2a str. 301
cugccagccgccgcu

SEQ ID NO: 2020416 - RNA, 17 nt, Shigella flexneri 2a str. 301
cugccagcgccgacagc

SEQ ID NO: 2020417 - RNA, 13 nt, Shigella flexneri 2a str. 301
cugccagcgccga

SEQ ID NO: 2020418 - RNA, 14 nt, Shigella flexneri 2a str. 301
cugccagccauaaa

SEQ ID NO: 2020419 - RNA, 15 nt, Shigella flexneri 2a str. 301
cugccagccauaaau

SEQ ID NO: 2020420 - RNA, 17 nt, Shigella flexneri 2a str. 301
cugccagcaugcauaac

SEQ ID NO: 2020421 - RNA, 18 nt, Shigella flexneri 2a str. 301
cugccagcaugcauaaca

SEQ ID NO: 2020422 - RNA, 16 nt, Shigella flexneri 2a str. 301
cugccgcaguuucuga

SEQ ID NO: 2020423 - RNA, 22 nt, Shigella flexneri 2a str. 301
cugccgcaauggccguuccggc

SEQ ID NO: 2020424 - RNA, 18 nt, Shigella flexneri 2a str. 301
cugcccgugggcaggccu

SEQ ID NO: 2020425 - RNA, 16 nt, Shigella flexneri 2a str. 301
cugcaucaaccaacac

SEQ ID NO: 2020426 - RNA, 21 nt, Shigella flexneri 2a str. 301
cugcauccgcuuaaucugguc

SEQ ID NO: 2020427 - RNA, 19 nt, Shigella flexneri 2a str. 301
cugcaucagcgccuuacca

SEQ ID NO: 2020428 - RNA, 13 nt, Shigella flexneri 2a str. 301
cugcauacaaaua

SEQ ID NO: 2020429 - RNA, 18 nt, Shigella flexneri 2a str. 301
cugcagccagggucaaca

SEQ ID NO: 2020430 - RNA, 21 nt, Shigella flexneri 2a str. 301
cugcagcggucacauguucca

SEQ ID NO: 2020431 - RNA, 17 nt, Shigella flexneri 2a str. 301
cugcagcgucacucgcu

SEQ ID NO: 2020432 - RNA, 18 nt, Shigella flexneri 2a str. 301
cugcaggaacggcaauac

SEQ ID NO: 2020433 - RNA, 13 nt, Shigella flexneri 2a str. 301
cugcauugacaag

SEQ ID NO: 2020434 - RNA, 14 nt, Shigella flexneri 2a str. 301
cugcauucaccagu

SEQ ID NO: 2020435 - RNA, 23 nt, Shigella flexneri 2a str. 301
cugcauucccaucgcaucgucac

SEQ ID NO: 2020436 - RNA, 18 nt, Shigella flexneri 2a str. 301
cugcauguaaccuaauuu

SEQ ID NO: 2020437 - RNA, 13 nt, Shigella flexneri 2a str. 301
cugcauugucgga

SEQ ID NO: 2020438 - RNA, 18 nt, Shigella flexneri 2a str. 301
cugccaaacgcucccugc

SEQ ID NO: 2020439 - RNA, 13 nt, Shigella flexneri 2a str. 301
cugcauuuucucg

SEQ ID NO: 2020440 - RNA, 14 nt, Shigella flexneri 2a str. 301
cugccaauacaaaa

SEQ ID NO: 2020441 - RNA, 17 nt, Shigella flexneri 2a str. 301
cugccaaucaccuggau

SEQ ID NO: 2020442 - RNA, 13 nt, Shigella flexneri 2a str. 301
cugcaacagcugu

SEQ ID NO: 2020443 - RNA, 23 nt, Shigella flexneri 2a str. 301
cugcaaccauuugugcuggcaaa

SEQ ID NO: 2020444 - RNA, 13 nt, Shigella flexneri 2a str. 301
cugcaacgagugc

SEQ ID NO: 2020445 - RNA, 14 nt, Shigella flexneri 2a str. 301
cugcaaauucaaua

SEQ ID NO: 2020446 - RNA, 14 nt, Shigella flexneri 2a str. 301
cugcaaauuauuug

SEQ ID NO: 2020447 - RNA, 22 nt, Shigella flexneri 2a str. 301
cugcaaaauaccaauaaucaau

SEQ ID NO: 2020448 - RNA, 17 nt, Shigella flexneri 2a str. 301
cugcaaaauaccaauaa

SEQ ID NO: 2020449 - RNA, 17 nt, Shigella flexneri 2a str. 301
cugcaccauugcugccg

SEQ ID NO: 2020450 - RNA, 19 nt, Shigella flexneri 2a str. 301
cugcacaccaaccgcuucc

SEQ ID NO: 2020451 - RNA, 17 nt, Shigella flexneri 2a str. 301
cugcaccgauaauacac

SEQ ID NO: 2020452 - RNA, 13 nt, Shigella flexneri 2a str. 301
cugcacgcccuga

SEQ ID NO: 2020453 - RNA, 14 nt, Shigella flexneri 2a str. 301
cugcacgccaggau

SEQ ID NO: 2020454 - RNA, 13 nt, Shigella flexneri 2a str. 301
cugcacgaaacca

SEQ ID NO: 2020455 - RNA, 20 nt, Shigella flexneri 2a str. 301
cugcagcagccugcgcuucu

SEQ ID NO: 2020456 - RNA, 15 nt, Shigella flexneri 2a str. 301
cugcagcaucaccgg

SEQ ID NO: 2020457 - RNA, 18 nt, Shigella flexneri 2a str. 301
cugaugucagcacuucca

SEQ ID NO: 2020458 - RNA, 15 nt, Shigella flexneri 2a str. 301
cugaugucagcacuu

SEQ ID NO: 2020459 - RNA, 17 nt, Shigella flexneri 2a str. 301
cugauuaugucaucauc

SEQ ID NO: 2020460 - RNA, 13 nt, Shigella flexneri 2a str. 301
cugauguagucac

SEQ ID NO: 2020461 - RNA, 21 nt, Shigella flexneri 2a str. 301
cugauguagucacgcuuuauc

SEQ ID NO: 2020462 - RNA, 21 nt, Shigella flexneri 2a str. 301
cugaugguugugcuaacucau

SEQ ID NO: 2020463 - RNA, 19 nt, Shigella flexneri 2a str. 301
cugauggcccaucgucaca

SEQ ID NO: 2020464 - RNA, 14 nt, Shigella flexneri 2a str. 301
cugauucagauaau

SEQ ID NO: 2020465 - RNA, 13 nt, Shigella flexneri 2a str. 301
cugauucagauaa

SEQ ID NO: 2020466 - RNA, 20 nt, Shigella flexneri 2a str. 301
cugauucaaaaccgguucug

SEQ ID NO: 2020467 - RNA, 22 nt, Shigella flexneri 2a str. 301
cugaugucagcacuuccagcuc

SEQ ID NO: 2020468 - RNA, 22 nt, Shigella flexneri 2a str. 301
cugauuauugauauccaccucc

SEQ ID NO: 2020469 - RNA, 15 nt, Shigella flexneri 2a str. 301
cugcaaaaagcaggu

SEQ ID NO: 2020470 - RNA, 23 nt, Shigella flexneri 2a str. 301
cugauugacgcguucgcuaaaga

SEQ ID NO: 2020471 - RNA, 13 nt, Shigella flexneri 2a str. 301
cugauuuuauugc

SEQ ID NO: 2020472 - RNA, 15 nt, Shigella flexneri 2a str. 301
cugauuuucaucuuc

SEQ ID NO: 2020473 - RNA, 13 nt, Shigella flexneri 2a str. 301
cugauuuuccucc

SEQ ID NO: 2020474 - RNA, 16 nt, Shigella flexneri 2a str. 301
cugauugaaauagcca

SEQ ID NO: 2020475 - RNA, 17 nt, Shigella flexneri 2a str. 301
cugauugaacuguggcg

SEQ ID NO: 2020476 - RNA, 22 nt, Shigella flexneri 2a str. 301
cugaugcgacgcuggcgcgucu

SEQ ID NO: 2020477 - RNA, 22 nt, Shigella flexneri 2a str. 301
cugaugcgacgcuugcgcgucu

SEQ ID NO: 2020478 - RNA, 22 nt, Shigella flexneri 2a str. 301
cugaugcgacgcugauagcguc

SEQ ID NO: 2020479 - RNA, 15 nt, Shigella flexneri 2a str. 301
cugaugcgacgcuga

SEQ ID NO: 2020480 - RNA, 12 nt, Shigella flexneri 2a str. 301
cugaugagcaaa

SEQ ID NO: 2020481 - RNA, 19 nt, Shigella flexneri 2a str. 301
cugauggaagacauagcac

SEQ ID NO: 2020482 - RNA, 23 nt, Shigella flexneri 2a str. 301
cugaugcugugaauauucauuuc

SEQ ID NO: 2020483 - RNA, 16 nt, Shigella flexneri 2a str. 301
cugaugcgcugcgcuu

SEQ ID NO: 2020484 - RNA, 19 nt, Shigella flexneri 2a str. 301
cugaugcgcugggcaacaa

SEQ ID NO: 2020485 - RNA, 18 nt, Shigella flexneri 2a str. 301
cugaugacgcgcuagugc

SEQ ID NO: 2020486 - RNA, 15 nt, Shigella flexneri 2a str. 301
cugaugauauuuuuc

SEQ ID NO: 2020487 - RNA, 20 nt, Shigella flexneri 2a str. 301
cugaugauaaguuaacccca

SEQ ID NO: 2020488 - RNA, 18 nt, Shigella flexneri 2a str. 301
cugaugagcaaaucgcgg

SEQ ID NO: 2020489 - RNA, 20 nt, Shigella flexneri 2a str. 301
cugaugacaaacacaaaacu

SEQ ID NO: 2020490 - RNA, 17 nt, Shigella flexneri 2a str. 301
cugaugaagacagaccu

SEQ ID NO: 2020491 - RNA, 15 nt, Shigella flexneri 2a str. 301
cugaugaaugguugu

SEQ ID NO: 2020492 - RNA, 21 nt, Shigella flexneri 2a str. 301
cugaugacaaacacaaaacug

SEQ ID NO: 2020493 - RNA, 13 nt, Shigella flexneri 2a str. 301
cugaugacaaagu

SEQ ID NO: 2020494 - RNA, 19 nt, Shigella flexneri 2a str. 301
cugaugacaagcguaugau

SEQ ID NO: 2020495 - RNA, 16 nt, Shigella flexneri 2a str. 301
cugaugacaaacacaa

SEQ ID NO: 2020496 - RNA, 18 nt, Shigella flexneri 2a str. 301
cugaugacaaacacaaaa

SEQ ID NO: 2020497 - RNA, 22 nt, Shigella flexneri 2a str. 301
cugaugaauaaauacauugcag

SEQ ID NO: 2020498 - RNA, 20 nt, Shigella flexneri 2a str. 301
cugagcgugccccugaauaa

SEQ ID NO: 2020499 - RNA, 18 nt, Shigella flexneri 2a str. 301
cugcguaucgcccugcca

SEQ ID NO: 2020500 - RNA, 12 nt, Shigella flexneri 2a str. 301
cugcggcugacc

SEQ ID NO: 2020501 - RNA, 14 nt, Shigella flexneri 2a str. 301
cugcguauuuccug

SEQ ID NO: 2020502 - RNA, 14 nt, Shigella flexneri 2a str. 301
cugcggccagcagc

SEQ ID NO: 2020503 - RNA, 16 nt, Shigella flexneri 2a str. 301
cugcggauuuccccac

SEQ ID NO: 2020504 - RNA, 21 nt, Shigella flexneri 2a str. 301
cugcgcuaaacaggaucuggu

SEQ ID NO: 2020505 - RNA, 14 nt, Shigella flexneri 2a str. 301
cugcgcuaccagga

SEQ ID NO: 2020506 - RNA, 19 nt, Shigella flexneri 2a str. 301
cugcgcuaaacaggaucug

SEQ ID NO: 2020507 - RNA, 21 nt, Shigella flexneri 2a str. 301
cugcgcuuaucaggccugcaa

SEQ ID NO: 2020508 - RNA, 18 nt, Shigella flexneri 2a str. 301
cugcgcuuauccggccca

SEQ ID NO: 2020509 - RNA, 16 nt, Shigella flexneri 2a str. 301
cugcgcuuccagcucc

SEQ ID NO: 2020510 - RNA, 14 nt, Shigella flexneri 2a str. 301
cugcgccgccuucu

SEQ ID NO: 2020511 - RNA, 16 nt, Shigella flexneri 2a str. 301
cugcgccagcggcagu

SEQ ID NO: 2020512 - RNA, 13 nt, Shigella flexneri 2a str. 301
cugcgccaccaca

SEQ ID NO: 2020513 - RNA, 12 nt, Shigella flexneri 2a str. 301
cugcgccaauac

SEQ ID NO: 2020514 - RNA, 18 nt, Shigella flexneri 2a str. 301
cugcgccacuucccagcc

SEQ ID NO: 2020515 - RNA, 16 nt, Shigella flexneri 2a str. 301
cugcgccaccacaaca

SEQ ID NO: 2020516 - RNA, 14 nt, Shigella flexneri 2a str. 301
cugcgaugucugau

SEQ ID NO: 2020517 - RNA, 15 nt, Shigella flexneri 2a str. 301
cugcgacauauuccc

SEQ ID NO: 2020518 - RNA, 19 nt, Shigella flexneri 2a str. 301
cugcgaaucgcuucauuua

SEQ ID NO: 2020519 - RNA, 18 nt, Shigella flexneri 2a str. 301
cugcgaaucgcuucauuu

SEQ ID NO: 2020520 - RNA, 19 nt, Shigella flexneri 2a str. 301
cugcgaacgcaaucaaaua

SEQ ID NO: 2020521 - RNA, 21 nt, Shigella flexneri 2a str. 301
cugcgauaguggaacaaagaa

SEQ ID NO: 2020522 - RNA, 14 nt, Shigella flexneri 2a str. 301
cugcgauagcagca

SEQ ID NO: 2020523 - RNA, 20 nt, Shigella flexneri 2a str. 301
cugccgccaguucuuccagu

SEQ ID NO: 2020524 - RNA, 23 nt, Shigella flexneri 2a str. 301
cugccgccaccauguugcgcaga

SEQ ID NO: 2020525 - RNA, 14 nt, Shigella flexneri 2a str. 301
cugccgccaccaug

SEQ ID NO: 2020526 - RNA, 13 nt, Shigella flexneri 2a str. 301
cugccgcgccuga

SEQ ID NO: 2020527 - RNA, 21 nt, Shigella flexneri 2a str. 301
cugccuugaguuuuucauccc

SEQ ID NO: 2020528 - RNA, 16 nt, Shigella flexneri 2a str. 301
cugcgaaaguaccauu

SEQ ID NO: 2020529 - RNA, 17 nt, Shigella flexneri 2a str. 301
cugccuuucagcgcaug

SEQ ID NO: 2020530 - RNA, 18 nt, Shigella flexneri 2a str. 301
cugcuggguaaagacauc

SEQ ID NO: 2020531 - RNA, 16 nt, Shigella flexneri 2a str. 301
cugcugguucugcggg

SEQ ID NO: 2020532 - RNA, 20 nt, Shigella flexneri 2a str. 301
cugcugugccguaaauccca

SEQ ID NO: 2020533 - RNA, 17 nt, Shigella flexneri 2a str. 301
cugcuggggccaauacc

SEQ ID NO: 2020534 - RNA, 22 nt, Shigella flexneri 2a str. 301
cugcuggggccaauaccuguca

SEQ ID NO: 2020535 - RNA, 19 nt, Shigella flexneri 2a str. 301
cugcuggcgaaauugcuga

SEQ ID NO: 2020536 - RNA, 20 nt, Shigella flexneri 2a str. 301
cugcugcuguagccgaugcc

SEQ ID NO: 2020537 - RNA, 16 nt, Shigella flexneri 2a str. 301
cugcuggaucugcggg

SEQ ID NO: 2020538 - RNA, 18 nt, Shigella flexneri 2a str. 301
cugcugauccagcuucca

SEQ ID NO: 2020539 - RNA, 18 nt, Shigella flexneri 2a str. 301
cugcugauuaacccgacc

SEQ ID NO: 2020540 - RNA, 20 nt, Shigella flexneri 2a str. 301
cugcugacgcuacuggacau

SEQ ID NO: 2020541 - RNA, 19 nt, Shigella flexneri 2a str. 301
cugcugacggcacuaccau

SEQ ID NO: 2020542 - RNA, 20 nt, Shigella flexneri 2a str. 301
cugcugacuuugauccagcc

SEQ ID NO: 2020543 - RNA, 23 nt, Shigella flexneri 2a str. 301
cugcugccggcacaggcaucacu

SEQ ID NO: 2020544 - RNA, 15 nt, Shigella flexneri 2a str. 301
cugcucuucaguagu

SEQ ID NO: 2020545 - RNA, 15 nt, Shigella flexneri 2a str. 301
cugcucuuccggcgu

SEQ ID NO: 2020546 - RNA, 13 nt, Shigella flexneri 2a str. 301
cugcucuucagua

SEQ ID NO: 2020547 - RNA, 16 nt, Shigella flexneri 2a str. 301
cugcucguucagcacu

SEQ ID NO: 2020548 - RNA, 17 nt, Shigella flexneri 2a str. 301
cugcugaccaccagcac

SEQ ID NO: 2020549 - RNA, 19 nt, Shigella flexneri 2a str. 301
cugcucuuucagcaccgcg

SEQ ID NO: 2020550 - RNA, 16 nt, Shigella flexneri 2a str. 301
cugcucggaaauauuc

SEQ ID NO: 2020551 - RNA, 15 nt, Shigella flexneri 2a str. 301
cugcucgguucgcug

SEQ ID NO: 2020552 - RNA, 22 nt, Shigella flexneri 2a str. 301
cugcucguauaaugacugcccu

SEQ ID NO: 2020553 - RNA, 15 nt, Shigella flexneri 2a str. 301
cugcucgucagccgg

SEQ ID NO: 2020554 - RNA, 15 nt, Shigella flexneri 2a str. 301
cugcuccagugcauc

SEQ ID NO: 2020555 - RNA, 16 nt, Shigella flexneri 2a str. 301
cugcuccagaaaauaa

SEQ ID NO: 2020556 - RNA, 23 nt, Shigella flexneri 2a str. 301
cugcucccgaaccuuuucucaau

SEQ ID NO: 2020557 - RNA, 18 nt, Shigella flexneri 2a str. 301
cugcucccuuuggccgcu

SEQ ID NO: 2020558 - RNA, 18 nt, Shigella flexneri 2a str. 301
cugcuccguaaaacucag

SEQ ID NO: 2020559 - RNA, 16 nt, Shigella flexneri 2a str. 301
cugcucgcaucaggga

SEQ ID NO: 2020560 - RNA, 21 nt, Shigella flexneri 2a str. 301
cugcucgcagaaauaccccgc

SEQ ID NO: 2020561 - RNA, 13 nt, Shigella flexneri 2a str. 301
cuggaugccagcg

SEQ ID NO: 2020562 - RNA, 18 nt, Shigella flexneri 2a str. 301
cuggaugaaaaaauccca

SEQ ID NO: 2020563 - RNA, 13 nt, Shigella flexneri 2a str. 301
cuggaugaacaua

SEQ ID NO: 2020564 - RNA, 20 nt, Shigella flexneri 2a str. 301
cuggaugaacauaaucugca

SEQ ID NO: 2020565 - RNA, 15 nt, Shigella flexneri 2a str. 301
cuggcaaacgucagc

SEQ ID NO: 2020566 - RNA, 15 nt, Shigella flexneri 2a str. 301
cuggcaaaugacaua

SEQ ID NO: 2020567 - RNA, 18 nt, Shigella flexneri 2a str. 301
cuggcaaauucaggagca

SEQ ID NO: 2020568 - RNA, 15 nt, Shigella flexneri 2a str. 301
cuggcaaaguagagc

SEQ ID NO: 2020569 - RNA, 13 nt, Shigella flexneri 2a str. 301
cuggcaaaaauaa

SEQ ID NO: 2020570 - RNA, 14 nt, Shigella flexneri 2a str. 301
cuggcaaaaauaag

SEQ ID NO: 2020571 - RNA, 17 nt, Shigella flexneri 2a str. 301
cuggauuaacgcugggg

SEQ ID NO: 2020572 - RNA, 16 nt, Shigella flexneri 2a str. 301
cuggauuacaaauaaa

SEQ ID NO: 2020573 - RNA, 13 nt, Shigella flexneri 2a str. 301
cuggauuucaaua

SEQ ID NO: 2020574 - RNA, 16 nt, Shigella flexneri 2a str. 301
cuggauuuauauaaau

SEQ ID NO: 2020575 - RNA, 22 nt, Shigella flexneri 2a str. 301
cuggauuuggcugccgagcaaa

SEQ ID NO: 2020576 - RNA, 12 nt, Shigella flexneri 2a str. 301
cugcuuaauauu

SEQ ID NO: 2020577 - RNA, 13 nt, Shigella flexneri 2a str. 301
cugcuuacaggcu

SEQ ID NO: 2020578 - RNA, 22 nt, Shigella flexneri 2a str. 301
cugcuuacaggcugguuucucu

SEQ ID NO: 2020579 - RNA, 15 nt, Shigella flexneri 2a str. 301
cugcuuacaggcugg

SEQ ID NO: 2020580 - RNA, 23 nt, Shigella flexneri 2a str. 301
cugcuucagccgcacuuuuuaaa

SEQ ID NO: 2020581 - RNA, 22 nt, Shigella flexneri 2a str. 301
cugcuucagccgcacuuuuuaa

SEQ ID NO: 2020582 - RNA, 20 nt, Shigella flexneri 2a str. 301
cugcuucacgcccagaucca

SEQ ID NO: 2020583 - RNA, 20 nt, Shigella flexneri 2a str. 301
cugcuucaaaaaaauucuga

SEQ ID NO: 2020584 - RNA, 16 nt, Shigella flexneri 2a str. 301
cuggauagagcucauu

SEQ ID NO: 2020585 - RNA, 15 nt, Shigella flexneri 2a str. 301
cugcuucggucagca

SEQ ID NO: 2020586 - RNA, 16 nt, Shigella flexneri 2a str. 301
cuggaucccagaagau

SEQ ID NO: 2020587 - RNA, 15 nt, Shigella flexneri 2a str. 301
cuggaucagacgcag

SEQ ID NO: 2020588 - RNA, 23 nt, Shigella flexneri 2a str. 301
cuggaucaaggauugcagcacug

SEQ ID NO: 2020589 - RNA, 20 nt, Shigella flexneri 2a str. 301
cuggauagauauucuccagc

SEQ ID NO: 2020590 - RNA, 18 nt, Shigella flexneri 2a str. 301
cuggccuuuaauaugcca

SEQ ID NO: 2020591 - RNA, 17 nt, Shigella flexneri 2a str. 301
cuggcgaaccaggaaga

SEQ ID NO: 2020592 - RNA, 18 nt, Shigella flexneri 2a str. 301
cuggcgaacauccagcag

SEQ ID NO: 2020593 - RNA, 19 nt, Shigella flexneri 2a str. 301
cuggcgacgccucuauuaa

SEQ ID NO: 2020594 - RNA, 15 nt, Shigella flexneri 2a str. 301
cuggcgacauuuucu

SEQ ID NO: 2020595 - RNA, 14 nt, Shigella flexneri 2a str. 301
cuggcgacagcgaa

SEQ ID NO: 2020596 - RNA, 13 nt, Shigella flexneri 2a str. 301
cuggcacgaccug

SEQ ID NO: 2020597 - RNA, 14 nt, Shigella flexneri 2a str. 301
cuggcacugggauc

SEQ ID NO: 2020598 - RNA, 21 nt, Shigella flexneri 2a str. 301
cuggcagagaaagaaacgcca

SEQ ID NO: 2020599 - RNA, 17 nt, Shigella flexneri 2a str. 301
cuggcagcaagugcggc

SEQ ID NO: 2020600 - RNA, 21 nt, Shigella flexneri 2a str. 301
cuggccacuucuguuacucca

SEQ ID NO: 2020601 - RNA, 13 nt, Shigella flexneri 2a str. 301
cuggccacuucug

SEQ ID NO: 2020602 - RNA, 17 nt, Shigella flexneri 2a str. 301
cuggcagccauaaucac

SEQ ID NO: 2020603 - RNA, 21 nt, Shigella flexneri 2a str. 301
cuggcugagcaaacaguucug

SEQ ID NO: 2020604 - RNA, 22 nt, Shigella flexneri 2a str. 301
cuggcugaccguacccgcugcu

SEQ ID NO: 2020605 - RNA, 16 nt, Shigella flexneri 2a str. 301
cuggcugaacgacaaa

SEQ ID NO: 2020606 - RNA, 14 nt, Shigella flexneri 2a str. 301
cuggcucugcacua

SEQ ID NO: 2020607 - RNA, 23 nt, Shigella flexneri 2a str. 301
cuggcugcguaagcgccaucuga

SEQ ID NO: 2020608 - RNA, 23 nt, Shigella flexneri 2a str. 301
cuggcugcgugguuuguuccgca

SEQ ID NO: 2020609 - RNA, 15 nt, Shigella flexneri 2a str. 301
cuggcuggcaucuug

SEQ ID NO: 2020610 - RNA, 13 nt, Shigella flexneri 2a str. 301
cuggcuucccggc

SEQ ID NO: 2020611 - RNA, 23 nt, Shigella flexneri 2a str. 301
cuggcuguaaaauuauccucuuc

SEQ ID NO: 2020612 - RNA, 15 nt, Shigella flexneri 2a str. 301
cuggcugggcgucau

SEQ ID NO: 2020613 - RNA, 14 nt, Shigella flexneri 2a str. 301
cuggcuaagaagcc

SEQ ID NO: 2020614 - RNA, 15 nt, Shigella flexneri 2a str. 301
cuggcucguggcuga

SEQ ID NO: 2020615 - RNA, 12 nt, Shigella flexneri 2a str. 301
cuggcucaagca

SEQ ID NO: 2020616 - RNA, 24 nt, Shigella flexneri 2a str. 301
cuggcucaagcaccauccuguucc

SEQ ID NO: 2020617 - RNA, 18 nt, Shigella flexneri 2a str. 301
cuggcgcaggugauacug

SEQ ID NO: 2020618 - RNA, 13 nt, Shigella flexneri 2a str. 301
cuggcgucugggc

SEQ ID NO: 2020619 - RNA, 15 nt, Shigella flexneri 2a str. 301
cuggcgucugggcgu

SEQ ID NO: 2020620 - RNA, 21 nt, Shigella flexneri 2a str. 301
cuggcgucuggcccaugccag

SEQ ID NO: 2020621 - RNA, 22 nt, Shigella flexneri 2a str. 301
cugggaaaucaccaccagcacc

SEQ ID NO: 2020622 - RNA, 17 nt, Shigella flexneri 2a str. 301
cugggaaaccuggauau

SEQ ID NO: 2020623 - RNA, 15 nt, Shigella flexneri 2a str. 301
cugggagaacgcugc

SEQ ID NO: 2020624 - RNA, 22 nt, Shigella flexneri 2a str. 301
cugggagaugauaaccccgcaa

SEQ ID NO: 2020625 - RNA, 20 nt, Shigella flexneri 2a str. 301
cugggagauuaccucgaccc

SEQ ID NO: 2020626 - RNA, 16 nt, Shigella flexneri 2a str. 301
cugggcaauggugaac

SEQ ID NO: 2020627 - RNA, 19 nt, Shigella flexneri 2a str. 301
cugggaugaucaccugcau

SEQ ID NO: 2020628 - RNA, 17 nt, Shigella flexneri 2a str. 301
cugggaugaaagugaug

SEQ ID NO: 2020629 - RNA, 15 nt, Shigella flexneri 2a str. 301
cugggaugugaaaau

SEQ ID NO: 2020630 - RNA, 17 nt, Shigella flexneri 2a str. 301
cugggauggcaaaaccu

SEQ ID NO: 2020631 - RNA, 19 nt, Shigella flexneri 2a str. 301
cugggcauugaaggcagca

SEQ ID NO: 2020632 - RNA, 23 nt, Shigella flexneri 2a str. 301
cuggggcuuugaugucgcuucca

SEQ ID NO: 2020633 - RNA, 18 nt, Shigella flexneri 2a str. 301
cuggggcuugccagagca

SEQ ID NO: 2020634 - RNA, 19 nt, Shigella flexneri 2a str. 301
cuggggcuugccagagcag

SEQ ID NO: 2020635 - RNA, 17 nt, Shigella flexneri 2a str. 301
cuggggguucaucacca

SEQ ID NO: 2020636 - RNA, 14 nt, Shigella flexneri 2a str. 301
cugggguaccugga

SEQ ID NO: 2020637 - RNA, 15 nt, Shigella flexneri 2a str. 301
cugggguaccuggau

SEQ ID NO: 2020638 - RNA, 19 nt, Shigella flexneri 2a str. 301
cuggguagaguuugaacuc

SEQ ID NO: 2020639 - RNA, 19 nt, Shigella flexneri 2a str. 301
cugggcgcgcucagcgcca

SEQ ID NO: 2020640 - RNA, 16 nt, Shigella flexneri 2a str. 301
cugguuuccgcuguug

SEQ ID NO: 2020641 - RNA, 19 nt, Shigella flexneri 2a str. 301
cugguuucgaucuggcagc

SEQ ID NO: 2020642 - RNA, 12 nt, Shigella flexneri 2a str. 301
cugguucuugcu

SEQ ID NO: 2020643 - RNA, 16 nt, Shigella flexneri 2a str. 301
cugguucccaacaaca

SEQ ID NO: 2020644 - RNA, 16 nt, Shigella flexneri 2a str. 301
cugguuccugacuccu

SEQ ID NO: 2020645 - RNA, 16 nt, Shigella flexneri 2a str. 301
cugguucaagagagaa

SEQ ID NO: 2020646 - RNA, 22 nt, Shigella flexneri 2a str. 301
cugguguucggcauucugcugg

SEQ ID NO: 2020647 - RNA, 23 nt, Shigella flexneri 2a str. 301
cugguguucuuuuacgcuaccau

SEQ ID NO: 2020648 - RNA, 20 nt, Shigella flexneri 2a str. 301
cugguguugaaaccgcuggg

SEQ ID NO: 2020649 - RNA, 19 nt, Shigella flexneri 2a str. 301
cuggguuucgccugccaga

SEQ ID NO: 2020650 - RNA, 14 nt, Shigella flexneri 2a str. 301
cuggguuuucacag

SEQ ID NO: 2020651 - RNA, 16 nt, Shigella flexneri 2a str. 301
cugguaaaccuuccac

SEQ ID NO: 2020652 - RNA, 21 nt, Shigella flexneri 2a str. 301
cugguaaccgaccuucacgcu

SEQ ID NO: 2020653 - RNA, 22 nt, Shigella flexneri 2a str. 301
cuggugcggcaaaaacccuucu

SEQ ID NO: 2020654 - RNA, 14 nt, Shigella flexneri 2a str. 301
cuggugcugaaaga

SEQ ID NO: 2020655 - RNA, 23 nt, Shigella flexneri 2a str. 301
cuggugcuaacagcaaucccaaa

SEQ ID NO: 2020656 - RNA, 17 nt, Shigella flexneri 2a str. 301
cugguguauuguuggca

SEQ ID NO: 2020657 - RNA, 20 nt, Shigella flexneri 2a str. 301
cugguggugcgugcggcaaa

SEQ ID NO: 2020658 - RNA, 22 nt, Shigella flexneri 2a str. 301
cugguguaagucggucacaguc

SEQ ID NO: 2020659 - RNA, 14 nt, Shigella flexneri 2a str. 301
cuguaucccagccc

SEQ ID NO: 2020660 - RNA, 13 nt, Shigella flexneri 2a str. 301
cuguaucccagcc

SEQ ID NO: 2020661 - RNA, 20 nt, Shigella flexneri 2a str. 301
cuguaucaggcugaaaaucu

SEQ ID NO: 2020662 - RNA, 23 nt, Shigella flexneri 2a str. 301
cuguaucccaguucgauuuccca

SEQ ID NO: 2020663 - RNA, 18 nt, Shigella flexneri 2a str. 301
cuguaggccagauaagac

SEQ ID NO: 2020664 - RNA, 19 nt, Shigella flexneri 2a str. 301
cuguaggccagauaagacg

SEQ ID NO: 2020665 - RNA, 19 nt, Shigella flexneri 2a str. 301
cuguccaaauccuucagca

SEQ ID NO: 2020666 - RNA, 16 nt, Shigella flexneri 2a str. 301
cuguaucgucacuggu

SEQ ID NO: 2020667 - RNA, 13 nt, Shigella flexneri 2a str. 301
cuguaugcaugca

SEQ ID NO: 2020668 - RNA, 18 nt, Shigella flexneri 2a str. 301
cuguauggccuggaagcu

SEQ ID NO: 2020669 - RNA, 13 nt, Shigella flexneri 2a str. 301
cuguaaugagaau

SEQ ID NO: 2020670 - RNA, 23 nt, Shigella flexneri 2a str. 301
cuguaauaccagccuucuucauc

SEQ ID NO: 2020671 - RNA, 21 nt, Shigella flexneri 2a str. 301
cuguaacggugucguauucuc

SEQ ID NO: 2020672 - RNA, 21 nt, Shigella flexneri 2a str. 301
cuguaacguugcugcgccgag

SEQ ID NO: 2020673 - RNA, 16 nt, Shigella flexneri 2a str. 301
cuguaacgccuuuucc

SEQ ID NO: 2020674 - RNA, 17 nt, Shigella flexneri 2a str. 301
cuguacuugagcccugg

SEQ ID NO: 2020675 - RNA, 16 nt, Shigella flexneri 2a str. 301
cuguacuuucaacagg

SEQ ID NO: 2020676 - RNA, 15 nt, Shigella flexneri 2a str. 301
cuguacgucagcguc

SEQ ID NO: 2020677 - RNA, 14 nt, Shigella flexneri 2a str. 301
cuguagccagcucg

SEQ ID NO: 2020678 - RNA, 19 nt, Shigella flexneri 2a str. 301
cuguagauaaaacacucuu

SEQ ID NO: 2020679 - RNA, 18 nt, Shigella flexneri 2a str. 301
cugugacaacacuucaua

SEQ ID NO: 2020680 - RNA, 19 nt, Shigella flexneri 2a str. 301
cugugaagauggcuaacua

SEQ ID NO: 2020681 - RNA, 18 nt, Shigella flexneri 2a str. 301
cugugaacucaggcugcc

SEQ ID NO: 2020682 - RNA, 16 nt, Shigella flexneri 2a str. 301
cugugacgacuuuuuc

SEQ ID NO: 2020683 - RNA, 18 nt, Shigella flexneri 2a str. 301
cugugacucaaugaaauc

SEQ ID NO: 2020684 - RNA, 18 nt, Shigella flexneri 2a str. 301
cugucgaacgcuaugacg

SEQ ID NO: 2020685 - RNA, 19 nt, Shigella flexneri 2a str. 301
cuguccgcuucaccaccgc

SEQ ID NO: 2020686 - RNA, 23 nt, Shigella flexneri 2a str. 301
cuguccgcgucuuaucaggccua

SEQ ID NO: 2020687 - RNA, 22 nt, Shigella flexneri 2a str. 301
cugucuucccugcugaaucccc

SEQ ID NO: 2020688 - RNA, 23 nt, Shigella flexneri 2a str. 301
cugugccagcguuucgcucucua

SEQ ID NO: 2020689 - RNA, 17 nt, Shigella flexneri 2a str. 301
cugugcaauauuacuuc

SEQ ID NO: 2020690 - RNA, 12 nt, Shigella flexneri 2a str. 301
cugugcaccaga

SEQ ID NO: 2020691 - RNA, 15 nt, Shigella flexneri 2a str. 301
cugugcacccgcuuc

SEQ ID NO: 2020692 - RNA, 19 nt, Shigella flexneri 2a str. 301
cugugccugagccggaguu

SEQ ID NO: 2020693 - RNA, 19 nt, Shigella flexneri 2a str. 301
cuguuaauguuguaagcuu

SEQ ID NO: 2020694 - RNA, 22 nt, Shigella flexneri 2a str. 301
cuguuaauaucuuucugccacc

SEQ ID NO: 2020695 - RNA, 13 nt, Shigella flexneri 2a str. 301
cuguuaaccggag

SEQ ID NO: 2020696 - RNA, 21 nt, Shigella flexneri 2a str. 301
cuguuaagaagggcuggccaa

SEQ ID NO: 2020697 - RNA, 11 nt, Shigella flexneri 2a str. 301
cuguguuuaug

SEQ ID NO: 2020698 - RNA, 15 nt, Shigella flexneri 2a str. 301
cuguuacucaacuga

SEQ ID NO: 2020699 - RNA, 16 nt, Shigella flexneri 2a str. 301
cuguucaucgacagaa

SEQ ID NO: 2020700 - RNA, 11 nt, Shigella flexneri 2a str. 301
cuguucagcaa

SEQ ID NO: 2020701 - RNA, 14 nt, Shigella flexneri 2a str. 301
cuguucauagccac

SEQ ID NO: 2020702 - RNA, 16 nt, Shigella flexneri 2a str. 301
cuguucacuuuugcug

SEQ ID NO: 2020703 - RNA, 16 nt, Shigella flexneri 2a str. 301
cuguguaaugcggcug

SEQ ID NO: 2020704 - RNA, 16 nt, Shigella flexneri 2a str. 301
cuguguggccugcuuu

SEQ ID NO: 2020705 - RNA, 21 nt, Shigella flexneri 2a str. 301
cuguguaaugaauggaguugu

SEQ ID NO: 2020706 - RNA, 11 nt, Shigella flexneri 2a str. 301
cugugcugccg

SEQ ID NO: 2020707 - RNA, 17 nt, Shigella flexneri 2a str. 301
cucccggauaucccagc

SEQ ID NO: 2020708 - RNA, 19 nt, Shigella flexneri 2a str. 301
cuccccuuucuuauuuuuc

SEQ ID NO: 2020709 - RNA, 23 nt, Shigella flexneri 2a str. 301
cuccccuuucuuauuuuucugca

SEQ ID NO: 2020710 - RNA, 13 nt, Shigella flexneri 2a str. 301
cucccgaaaaacc

SEQ ID NO: 2020711 - RNA, 14 nt, Shigella flexneri 2a str. 301
cuccccugcaaucc

SEQ ID NO: 2020712 - RNA, 17 nt, Shigella flexneri 2a str. 301
cuccccgccguugcucu

SEQ ID NO: 2020713 - RNA, 23 nt, Shigella flexneri 2a str. 301
cuccccgcauuuacucucaucaa

SEQ ID NO: 2020714 - RNA, 14 nt, Shigella flexneri 2a str. 301
cuccacaagcuccg

SEQ ID NO: 2020715 - RNA, 14 nt, Shigella flexneri 2a str. 301
cuccgaucccugcg

SEQ ID NO: 2020716 - RNA, 21 nt, Shigella flexneri 2a str. 301
cuccgccucgguaagcaaagc

SEQ ID NO: 2020717 - RNA, 18 nt, Shigella flexneri 2a str. 301
cuccgccugugcgcguca

SEQ ID NO: 2020718 - RNA, 15 nt, Shigella flexneri 2a str. 301
cucccgugccagagc

SEQ ID NO: 2020719 - RNA, 16 nt, Shigella flexneri 2a str. 301
cucccguuucccuguc

SEQ ID NO: 2020720 - RNA, 18 nt, Shigella flexneri 2a str. 301
cucccguucauucaacuu

SEQ ID NO: 2020721 - RNA, 22 nt, Shigella flexneri 2a str. 301
cucccguuccugguuuuccaga

SEQ ID NO: 2020722 - RNA, 19 nt, Shigella flexneri 2a str. 301
cucccggcgguaaaucgcc

SEQ ID NO: 2020723 - RNA, 14 nt, Shigella flexneri 2a str. 301
cucccgguagguga

SEQ ID NO: 2020724 - RNA, 16 nt, Shigella flexneri 2a str. 301
cuccguuaucacagca

SEQ ID NO: 2020725 - RNA, 17 nt, Shigella flexneri 2a str. 301
cuccucaacaaucguca

SEQ ID NO: 2020726 - RNA, 16 nt, Shigella flexneri 2a str. 301
cuccucaacaaucguc

SEQ ID NO: 2020727 - RNA, 21 nt, Shigella flexneri 2a str. 301
cuccgcuucgguaagcaaagc

SEQ ID NO: 2020728 - RNA, 21 nt, Shigella flexneri 2a str. 301
cuccgcguucaauacgcaguu

SEQ ID NO: 2020729 - RNA, 14 nt, Shigella flexneri 2a str. 301
cuccugaaacaauu

SEQ ID NO: 2020730 - RNA, 17 nt, Shigella flexneri 2a str. 301
cuccugcggaaugcugu

SEQ ID NO: 2020731 - RNA, 19 nt, Shigella flexneri 2a str. 301
cuccucuucacguuuuucg

SEQ ID NO: 2020732 - RNA, 18 nt, Shigella flexneri 2a str. 301
cuccucuuucaucucccg

SEQ ID NO: 2020733 - RNA, 16 nt, Shigella flexneri 2a str. 301
cucgaacgccucugca

SEQ ID NO: 2020734 - RNA, 15 nt, Shigella flexneri 2a str. 301
cucgaacauccccac

SEQ ID NO: 2020735 - RNA, 11 nt, Shigella flexneri 2a str. 301
cucgaacccgu

SEQ ID NO: 2020736 - RNA, 17 nt, Shigella flexneri 2a str. 301
cucgacgcccagcuuca

SEQ ID NO: 2020737 - RNA, 13 nt, Shigella flexneri 2a str. 301
cucgacaaaauga

SEQ ID NO: 2020738 - RNA, 19 nt, Shigella flexneri 2a str. 301
cuccuuucugagcaucaca

SEQ ID NO: 2020739 - RNA, 17 nt, Shigella flexneri 2a str. 301
cuccuuuaccgugguug

SEQ ID NO: 2020740 - RNA, 17 nt, Shigella flexneri 2a str. 301
cucgaaaaccacuccug

SEQ ID NO: 2020741 - RNA, 14 nt, Shigella flexneri 2a str. 301
cuccuuccugaaau

SEQ ID NO: 2020742 - RNA, 14 nt, Shigella flexneri 2a str. 301
cuccuguucugcgc

SEQ ID NO: 2020743 - RNA, 16 nt, Shigella flexneri 2a str. 301
cuccugucuucccugc

SEQ ID NO: 2020744 - RNA, 14 nt, Shigella flexneri 2a str. 301
cuccugucuucccu

SEQ ID NO: 2020745 - RNA, 19 nt, Shigella flexneri 2a str. 301
cuccugucaguauaacuac

SEQ ID NO: 2020746 - RNA, 20 nt, Shigella flexneri 2a str. 301
cuccuguaccuucacgcgcu

SEQ ID NO: 2020747 - RNA, 22 nt, Shigella flexneri 2a str. 301
cuccuguaucgucacugguuca

SEQ ID NO: 2020748 - RNA, 15 nt, Shigella flexneri 2a str. 301
cucgccgcagagauc

SEQ ID NO: 2020749 - RNA, 18 nt, Shigella flexneri 2a str. 301
cucgccccugcccuuuca

SEQ ID NO: 2020750 - RNA, 21 nt, Shigella flexneri 2a str. 301
cucgccccgagaaaaauagca

SEQ ID NO: 2020751 - RNA, 20 nt, Shigella flexneri 2a str. 301
cucgcccccuuggggagagg

SEQ ID NO: 2020752 - RNA, 16 nt, Shigella flexneri 2a str. 301
cucgccccgugaugaa

SEQ ID NO: 2020753 - RNA, 14 nt, Shigella flexneri 2a str. 301
cucgcauccucuuu

SEQ ID NO: 2020754 - RNA, 21 nt, Shigella flexneri 2a str. 301
cucgcccauuuuucaugaucu

SEQ ID NO: 2020755 - RNA, 23 nt, Shigella flexneri 2a str. 301
cucgcccauuuuucaugaucuuu

SEQ ID NO: 2020756 - RNA, 13 nt, Shigella flexneri 2a str. 301
cucgcccccuugg

SEQ ID NO: 2020757 - RNA, 18 nt, Shigella flexneri 2a str. 301
cucgcccccgaagagggg

SEQ ID NO: 2020758 - RNA, 16 nt, Shigella flexneri 2a str. 301
cucgcagucaacaagc

SEQ ID NO: 2020759 - RNA, 20 nt, Shigella flexneri 2a str. 301
cucgcagucaacaagcaaau

SEQ ID NO: 2020760 - RNA, 20 nt, Shigella flexneri 2a str. 301
cucgcagaaauaccccgcca

SEQ ID NO: 2020761 - RNA, 19 nt, Shigella flexneri 2a str. 301
cucggucacugacaccagc

SEQ ID NO: 2020762 - RNA, 14 nt, Shigella flexneri 2a str. 301
cucggggccacagg

SEQ ID NO: 2020763 - RNA, 20 nt, Shigella flexneri 2a str. 301
cucgcgaaccgccuggcgcu

SEQ ID NO: 2020764 - RNA, 20 nt, Shigella flexneri 2a str. 301
cucgcgaaucuccacgccuu

SEQ ID NO: 2020765 - RNA, 21 nt, Shigella flexneri 2a str. 301
cucgcgacccaugaacaaaau

SEQ ID NO: 2020766 - RNA, 17 nt, Shigella flexneri 2a str. 301
cucgcgaaccgccuggc

SEQ ID NO: 2020767 - RNA, 17 nt, Shigella flexneri 2a str. 301
cucgccuaccauccaua

SEQ ID NO: 2020768 - RNA, 15 nt, Shigella flexneri 2a str. 301
cucgccuuucacacg

SEQ ID NO: 2020769 - RNA, 23 nt, Shigella flexneri 2a str. 301
cucguacuccaucucgccauccu

SEQ ID NO: 2020770 - RNA, 16 nt, Shigella flexneri 2a str. 301
cucguacuccaucucg

SEQ ID NO: 2020771 - RNA, 19 nt, Shigella flexneri 2a str. 301
cucguagcugguaccuuga

SEQ ID NO: 2020772 - RNA, 21 nt, Shigella flexneri 2a str. 301
cucgucgcgacgaccacccac

SEQ ID NO: 2020773 - RNA, 20 nt, Shigella flexneri 2a str. 301
cucgucgcgacgaccaccca

SEQ ID NO: 2020774 - RNA, 19 nt, Shigella flexneri 2a str. 301
cucgucgcgcacgcccauc

SEQ ID NO: 2020775 - RNA, 23 nt, Shigella flexneri 2a str. 301
cucguauuccgcguuacccauuc

SEQ ID NO: 2020776 - RNA, 18 nt, Shigella flexneri 2a str. 301
cucgucacaucaccaaca

SEQ ID NO: 2020777 - RNA, 21 nt, Shigella flexneri 2a str. 301
cucgucgguaauuucacaagu

SEQ ID NO: 2020778 - RNA, 16 nt, Shigella flexneri 2a str. 301
cucuacaauauccuca

SEQ ID NO: 2020779 - RNA, 19 nt, Shigella flexneri 2a str. 301
cucguugacgaccaggccg

SEQ ID NO: 2020780 - RNA, 20 nt, Shigella flexneri 2a str. 301
cucuaacccuuccagauuca

SEQ ID NO: 2020781 - RNA, 22 nt, Shigella flexneri 2a str. 301
cucguugccugcgaagcucuuu

SEQ ID NO: 2020782 - RNA, 21 nt, Shigella flexneri 2a str. 301
cucugccguaccaucgccagc

SEQ ID NO: 2020783 - RNA, 13 nt, Shigella flexneri 2a str. 301
cucugcuaauuua

SEQ ID NO: 2020784 - RNA, 18 nt, Shigella flexneri 2a str. 301
cucugcgucauuccggag

SEQ ID NO: 2020785 - RNA, 12 nt, Shigella flexneri 2a str. 301
cucugcugccac

SEQ ID NO: 2020786 - RNA, 19 nt, Shigella flexneri 2a str. 301
cucugcucccggcaaugcg

SEQ ID NO: 2020787 - RNA, 12 nt, Shigella flexneri 2a str. 301
cucugcggcaag

SEQ ID NO: 2020788 - RNA, 19 nt, Shigella flexneri 2a str. 301
cucugcguaacccacugac

SEQ ID NO: 2020789 - RNA, 14 nt, Shigella flexneri 2a str. 301
cucugcgcuuugug

SEQ ID NO: 2020790 - RNA, 23 nt, Shigella flexneri 2a str. 301
cucugcuguaguuguucaacagu

SEQ ID NO: 2020791 - RNA, 17 nt, Shigella flexneri 2a str. 301
cucuggauuuauauaaa

SEQ ID NO: 2020792 - RNA, 20 nt, Shigella flexneri 2a str. 301
cucugacgcgcauacucucc

SEQ ID NO: 2020793 - RNA, 18 nt, Shigella flexneri 2a str. 301
cucucuuucuccagcgua

SEQ ID NO: 2020794 - RNA, 18 nt, Shigella flexneri 2a str. 301
cucugcaacgucuucccg

SEQ ID NO: 2020795 - RNA, 15 nt, Shigella flexneri 2a str. 301
cucugcaaauauuaa

SEQ ID NO: 2020796 - RNA, 16 nt, Shigella flexneri 2a str. 301
cucugcaaauauuaau

SEQ ID NO: 2020797 - RNA, 19 nt, Shigella flexneri 2a str. 301
cucugccagacuccaggcg

SEQ ID NO: 2020798 - RNA, 19 nt, Shigella flexneri 2a str. 301
cucucgggaaggcccuucc

SEQ ID NO: 2020799 - RNA, 14 nt, Shigella flexneri 2a str. 301
cucucgggcaguaa

SEQ ID NO: 2020800 - RNA, 17 nt, Shigella flexneri 2a str. 301
cucucgggcaguaaauc

SEQ ID NO: 2020801 - RNA, 18 nt, Shigella flexneri 2a str. 301
cucucgcauggggagacc

SEQ ID NO: 2020802 - RNA, 14 nt, Shigella flexneri 2a str. 301
cucucgccagcacu

SEQ ID NO: 2020803 - RNA, 22 nt, Shigella flexneri 2a str. 301
cucucgccccuucuucuacugc

SEQ ID NO: 2020804 - RNA, 12 nt, Shigella flexneri 2a str. 301
cucuccuuuacc

SEQ ID NO: 2020805 - RNA, 23 nt, Shigella flexneri 2a str. 301
cucuccuguuuaauaugcaauuc

SEQ ID NO: 2020806 - RNA, 17 nt, Shigella flexneri 2a str. 301
cucucgaucgauaggaa

SEQ ID NO: 2020807 - RNA, 11 nt, Shigella flexneri 2a str. 301
cucucugagcc

SEQ ID NO: 2020808 - RNA, 18 nt, Shigella flexneri 2a str. 301
cucucuucaaacgcuucu

SEQ ID NO: 2020809 - RNA, 12 nt, Shigella flexneri 2a str. 301
cucucuucgcug

SEQ ID NO: 2020810 - RNA, 21 nt, Shigella flexneri 2a str. 301
cucucugaaguagccaguacc

SEQ ID NO: 2020811 - RNA, 22 nt, Shigella flexneri 2a str. 301
cucucccgaaugaccgccccug

SEQ ID NO: 2020812 - RNA, 21 nt, Shigella flexneri 2a str. 301
cucucccgaaugaccgccccu

SEQ ID NO: 2020813 - RNA, 18 nt, Shigella flexneri 2a str. 301
cucucaaccgagagggcu

SEQ ID NO: 2020814 - RNA, 19 nt, Shigella flexneri 2a str. 301
cucucaccacgcuccauca

SEQ ID NO: 2020815 - RNA, 22 nt, Shigella flexneri 2a str. 301
cucucaaucucuuuuuccaccg

SEQ ID NO: 2020816 - RNA, 13 nt, Shigella flexneri 2a str. 301
cucucaaaccccg

SEQ ID NO: 2020817 - RNA, 13 nt, Shigella flexneri 2a str. 301
cucuauaaaaaag

SEQ ID NO: 2020818 - RNA, 14 nt, Shigella flexneri 2a str. 301
cugacaauuugccc

SEQ ID NO: 2020819 - RNA, 18 nt, Shigella flexneri 2a str. 301
cugacacaggcagcaauc

SEQ ID NO: 2020820 - RNA, 15 nt, Shigella flexneri 2a str. 301
cugacaccaucaccc

SEQ ID NO: 2020821 - RNA, 16 nt, Shigella flexneri 2a str. 301
cugaauuugcuccaga

SEQ ID NO: 2020822 - RNA, 14 nt, Shigella flexneri 2a str. 301
cugaauuugcucca

SEQ ID NO: 2020823 - RNA, 12 nt, Shigella flexneri 2a str. 301
cugacaaaucag

SEQ ID NO: 2020824 - RNA, 20 nt, Shigella flexneri 2a str. 301
cugacaacgcugaauggcga

SEQ ID NO: 2020825 - RNA, 23 nt, Shigella flexneri 2a str. 301
cugacaaucgcugcggcaauaau

SEQ ID NO: 2020826 - RNA, 19 nt, Shigella flexneri 2a str. 301
cugacauauuuuuguugaa

SEQ ID NO: 2020827 - RNA, 13 nt, Shigella flexneri 2a str. 301
cugacauagucau

SEQ ID NO: 2020828 - RNA, 21 nt, Shigella flexneri 2a str. 301
cugacagggugagcagggcac

SEQ ID NO: 2020829 - RNA, 23 nt, Shigella flexneri 2a str. 301
cugacaguugucagcccuuuuuc

SEQ ID NO: 2020830 - RNA, 17 nt, Shigella flexneri 2a str. 301
cugacauaaccacucac

SEQ ID NO: 2020831 - RNA, 21 nt, Shigella flexneri 2a str. 301
cugacagcgcgucuuguacuu

SEQ ID NO: 2020832 - RNA, 19 nt, Shigella flexneri 2a str. 301
cugacagcgcgcgccgcca

SEQ ID NO: 2020833 - RNA, 20 nt, Shigella flexneri 2a str. 301
cugaccacggccacagccag

SEQ ID NO: 2020834 - RNA, 15 nt, Shigella flexneri 2a str. 301
cugaccacuucggua

SEQ ID NO: 2020835 - RNA, 11 nt, Shigella flexneri 2a str. 301
cugaccagaau

SEQ ID NO: 2020836 - RNA, 22 nt, Shigella flexneri 2a str. 301
cugaccauaacccgcuuccaga

SEQ ID NO: 2020837 - RNA, 19 nt, Shigella flexneri 2a str. 301
cugacauuuuggacaaugc

SEQ ID NO: 2020838 - RNA, 15 nt, Shigella flexneri 2a str. 301
cugaccaaagccccg

SEQ ID NO: 2020839 - RNA, 17 nt, Shigella flexneri 2a str. 301
cugaccaaauacacgca

SEQ ID NO: 2020840 - RNA, 17 nt, Shigella flexneri 2a str. 301
cugaccaccagcacgcu

SEQ ID NO: 2020841 - RNA, 12 nt, Shigella flexneri 2a str. 301
cugaccaccaua

SEQ ID NO: 2020842 - RNA, 13 nt, Shigella flexneri 2a str. 301
cugaccaccacca

SEQ ID NO: 2020843 - RNA, 13 nt, Shigella flexneri 2a str. 301
cugaccaccaccg

SEQ ID NO: 2020844 - RNA, 15 nt, Shigella flexneri 2a str. 301
cugaccaccagcacg

SEQ ID NO: 2020845 - RNA, 13 nt, Shigella flexneri 2a str. 301
cugaccacggcca

SEQ ID NO: 2020846 - RNA, 18 nt, Shigella flexneri 2a str. 301
cugacccaguagacgagc

SEQ ID NO: 2020847 - RNA, 13 nt, Shigella flexneri 2a str. 301
cugacccagcaag

SEQ ID NO: 2020848 - RNA, 13 nt, Shigella flexneri 2a str. 301
cugaccgaccaga

SEQ ID NO: 2020849 - RNA, 23 nt, Shigella flexneri 2a str. 301
cugaccgcccgcuaugagcagau

SEQ ID NO: 2020850 - RNA, 13 nt, Shigella flexneri 2a str. 301
cugaccgucgccu

SEQ ID NO: 2020851 - RNA, 18 nt, Shigella flexneri 2a str. 301
cugaauuucaucaccagc

SEQ ID NO: 2020852 - RNA, 12 nt, Shigella flexneri 2a str. 301
cugaauuuaucg

SEQ ID NO: 2020853 - RNA, 15 nt, Shigella flexneri 2a str. 301
cugaauuugaccuug

SEQ ID NO: 2020854 - RNA, 14 nt, Shigella flexneri 2a str. 301
cugaaucaaaauca

SEQ ID NO: 2020855 - RNA, 20 nt, Shigella flexneri 2a str. 301
cugaauaugagucguaaaca

SEQ ID NO: 2020856 - RNA, 20 nt, Shigella flexneri 2a str. 301
cugaauauucggcuccagau

SEQ ID NO: 2020857 - RNA, 23 nt, Shigella flexneri 2a str. 301
cugaauaucaucccccugcgauu

SEQ ID NO: 2020858 - RNA, 23 nt, Shigella flexneri 2a str. 301
cugaauacgcaccgcuccaucgc

SEQ ID NO: 2020859 - RNA, 14 nt, Shigella flexneri 2a str. 301
cugaauacgcuggc

SEQ ID NO: 2020860 - RNA, 18 nt, Shigella flexneri 2a str. 301
cugaauaacaccagccag

SEQ ID NO: 2020861 - RNA, 20 nt, Shigella flexneri 2a str. 301
cugaauaacaccagccagaa

SEQ ID NO: 2020862 - RNA, 11 nt, Shigella flexneri 2a str. 301
cugaauaaucc

SEQ ID NO: 2020863 - RNA, 22 nt, Shigella flexneri 2a str. 301
cugaagcuuacguaacccacca

SEQ ID NO: 2020864 - RNA, 15 nt, Shigella flexneri 2a str. 301
cugaaggcugccggg

SEQ ID NO: 2020865 - RNA, 15 nt, Shigella flexneri 2a str. 301
cugaaggcacagaaa

SEQ ID NO: 2020866 - RNA, 18 nt, Shigella flexneri 2a str. 301
cugaaguaagaaauaacg

SEQ ID NO: 2020867 - RNA, 13 nt, Shigella flexneri 2a str. 301
cugaagugcguca

SEQ ID NO: 2020868 - RNA, 20 nt, Shigella flexneri 2a str. 301
cugacguugcuguuuuucgu

SEQ ID NO: 2020869 - RNA, 14 nt, Shigella flexneri 2a str. 301
cugacguuuuuuag

SEQ ID NO: 2020870 - RNA, 20 nt, Shigella flexneri 2a str. 301
cugacuagaugugcaguucc

SEQ ID NO: 2020871 - RNA, 22 nt, Shigella flexneri 2a str. 301
cugacuagaugugcaguuccug

SEQ ID NO: 2020872 - RNA, 14 nt, Shigella flexneri 2a str. 301
cugacuauauaaau

SEQ ID NO: 2020873 - RNA, 20 nt, Shigella flexneri 2a str. 301
cugacggccguugugacuuu

SEQ ID NO: 2020874 - RNA, 21 nt, Shigella flexneri 2a str. 301
cugacgcucucuacgcccugu

SEQ ID NO: 2020875 - RNA, 16 nt, Shigella flexneri 2a str. 301
cugacgcgucuuaucu

SEQ ID NO: 2020876 - RNA, 20 nt, Shigella flexneri 2a str. 301
cugacgcgucuuaucuggcc

SEQ ID NO: 2020877 - RNA, 21 nt, Shigella flexneri 2a str. 301
cugacgcgucuuaucuggccu

SEQ ID NO: 2020878 - RNA, 22 nt, Shigella flexneri 2a str. 301
cugacgcgucuuaucuggccua

SEQ ID NO: 2020879 - RNA, 21 nt, Shigella flexneri 2a str. 301
cugacggugauacagcaaaau

SEQ ID NO: 2020880 - RNA, 22 nt, Shigella flexneri 2a str. 301
cugacguaacgaccaccaccgc

SEQ ID NO: 2020881 - RNA, 21 nt, Shigella flexneri 2a str. 301
cugacggugauaaucauccca

SEQ ID NO: 2020882 - RNA, 16 nt, Shigella flexneri 2a str. 301
cugacggcguucuuua

SEQ ID NO: 2020883 - RNA, 20 nt, Shigella flexneri 2a str. 301
cugaccgugcgggcgaaagc

SEQ ID NO: 2020884 - RNA, 22 nt, Shigella flexneri 2a str. 301
cugaccgugcgggcgaaagcag

SEQ ID NO: 2020885 - RNA, 19 nt, Shigella flexneri 2a str. 301
cugaccucuucuaccacau

SEQ ID NO: 2020886 - RNA, 15 nt, Shigella flexneri 2a str. 301
cugaccuuuuuucag

SEQ ID NO: 2020887 - RNA, 13 nt, Shigella flexneri 2a str. 301
cugaccuuuuuuc

SEQ ID NO: 2020888 - RNA, 16 nt, Shigella flexneri 2a str. 301
cugacgccugcgggca

SEQ ID NO: 2020889 - RNA, 21 nt, Shigella flexneri 2a str. 301
cugacgccaccauucaccaag

SEQ ID NO: 2020890 - RNA, 13 nt, Shigella flexneri 2a str. 301
cugacgcaucuuc

SEQ ID NO: 2020891 - RNA, 21 nt, Shigella flexneri 2a str. 301
cugacgaggcgucagcguucc

SEQ ID NO: 2020892 - RNA, 21 nt, Shigella flexneri 2a str. 301
cugacgaccaaugacagccag

SEQ ID NO: 2020893 - RNA, 20 nt, Shigella flexneri 2a str. 301
cugacgaaucaaauaaaaau

SEQ ID NO: 2020894 - RNA, 17 nt, Shigella flexneri 2a str. 301
cugacuguuccagcacg

SEQ ID NO: 2020895 - RNA, 14 nt, Shigella flexneri 2a str. 301
cugacuuccacuuc

SEQ ID NO: 2020896 - RNA, 16 nt, Shigella flexneri 2a str. 301
cugacuuccacuuccu

SEQ ID NO: 2020897 - RNA, 20 nt, Shigella flexneri 2a str. 301
cugacuuucguuugaaaacu

SEQ ID NO: 2020898 - RNA, 15 nt, Shigella flexneri 2a str. 301
cugacuguuccagca

SEQ ID NO: 2020899 - RNA, 16 nt, Shigella flexneri 2a str. 301
cugacuguuccagcac

SEQ ID NO: 2020900 - RNA, 17 nt, Shigella flexneri 2a str. 301
cugacuggcucuuuuuc

SEQ ID NO: 2020901 - RNA, 13 nt, Shigella flexneri 2a str. 301
cugacuauuuccg

SEQ ID NO: 2020902 - RNA, 22 nt, Shigella flexneri 2a str. 301
cugacugacuucaacaggaaaa

SEQ ID NO: 2020903 - RNA, 19 nt, Shigella flexneri 2a str. 301
cugacugauaacgcggcag

SEQ ID NO: 2020904 - RNA, 20 nt, Shigella flexneri 2a str. 301
cugacugauaacgcggcagc

SEQ ID NO: 2020905 - RNA, 18 nt, Shigella flexneri 2a str. 301
cugacugccggaugcauc

SEQ ID NO: 2020906 - RNA, 17 nt, Shigella flexneri 2a str. 301
cugagaauuccggcaga

SEQ ID NO: 2020907 - RNA, 14 nt, Shigella flexneri 2a str. 301
cugagagaaaaaaa

SEQ ID NO: 2020908 - RNA, 22 nt, Shigella flexneri 2a str. 301
cugagaacaagauugccugaug

SEQ ID NO: 2020909 - RNA, 19 nt, Shigella flexneri 2a str. 301
cugagaaacucaguugauu

SEQ ID NO: 2020910 - RNA, 14 nt, Shigella flexneri 2a str. 301
cugacuuugcccca

SEQ ID NO: 2020911 - RNA, 18 nt, Shigella flexneri 2a str. 301
cugacuucucugggagau

SEQ ID NO: 2020912 - RNA, 15 nt, Shigella flexneri 2a str. 301
cugagaagcuggaag

SEQ ID NO: 2020913 - RNA, 13 nt, Shigella flexneri 2a str. 301
cugagcaaacagu

SEQ ID NO: 2020914 - RNA, 21 nt, Shigella flexneri 2a str. 301
cugagcaaacaguucugcagc

SEQ ID NO: 2020915 - RNA, 20 nt, Shigella flexneri 2a str. 301
cugagcgauaaaaucagaaa

SEQ ID NO: 2020916 - RNA, 19 nt, Shigella flexneri 2a str. 301
cugagcggcgggcuuuaau

SEQ ID NO: 2020917 - RNA, 18 nt, Shigella flexneri 2a str. 301
cugagccaguuuuucuuu

SEQ ID NO: 2020918 - RNA, 14 nt, Shigella flexneri 2a str. 301
cugagcaucacaua

SEQ ID NO: 2020919 - RNA, 18 nt, Shigella flexneri 2a str. 301
cugagccugccauuggca

SEQ ID NO: 2020920 - RNA, 18 nt, Shigella flexneri 2a str. 301
cugagccaaacgcccagc

SEQ ID NO: 2020921 - RNA, 12 nt, Shigella flexneri 2a str. 301
cucuguucugcg

SEQ ID NO: 2020922 - RNA, 23 nt, Shigella flexneri 2a str. 301
cucuguaauuggaguaucaccau

SEQ ID NO: 2020923 - RNA, 13 nt, Shigella flexneri 2a str. 301
cucuguaauugga

SEQ ID NO: 2020924 - RNA, 19 nt, Shigella flexneri 2a str. 301
cucuguaaacuccuuucug

SEQ ID NO: 2020925 - RNA, 15 nt, Shigella flexneri 2a str. 301
cucugguguucuuuu

SEQ ID NO: 2020926 - RNA, 16 nt, Shigella flexneri 2a str. 301
cucuuacacuugacca

SEQ ID NO: 2020927 - RNA, 18 nt, Shigella flexneri 2a str. 301
cucuuaaugcaggcagca

SEQ ID NO: 2020928 - RNA, 21 nt, Shigella flexneri 2a str. 301
cucuuaaaugcacaauaauau

SEQ ID NO: 2020929 - RNA, 22 nt, Shigella flexneri 2a str. 301
cucuucaacacacugaauaaaa

SEQ ID NO: 2020930 - RNA, 19 nt, Shigella flexneri 2a str. 301
cucuucagccgcaaaccug

SEQ ID NO: 2020931 - RNA, 19 nt, Shigella flexneri 2a str. 301
cucuucaucgcuaaaauac

SEQ ID NO: 2020932 - RNA, 17 nt, Shigella flexneri 2a str. 301
cucuucaauuaacaaca

SEQ ID NO: 2020933 - RNA, 18 nt, Shigella flexneri 2a str. 301
cucuucaaacgcuucugg

SEQ ID NO: 2020934 - RNA, 16 nt, Shigella flexneri 2a str. 301
cucuucaacuucagca

SEQ ID NO: 2020935 - RNA, 15 nt, Shigella flexneri 2a str. 301
cucuucccagaccca

SEQ ID NO: 2020936 - RNA, 11 nt, Shigella flexneri 2a str. 301
cucuucccaga

SEQ ID NO: 2020937 - RNA, 13 nt, Shigella flexneri 2a str. 301
cucuuccaguucg

SEQ ID NO: 2020938 - RNA, 17 nt, Shigella flexneri 2a str. 301
cucuuccuucagcuccc

SEQ ID NO: 2020939 - RNA, 15 nt, Shigella flexneri 2a str. 301
cucuuuaaaaaguaa

SEQ ID NO: 2020940 - RNA, 18 nt, Shigella flexneri 2a str. 301
cucuuuaaaaaguaaaac

SEQ ID NO: 2020941 - RNA, 13 nt, Shigella flexneri 2a str. 301
cucuuuaaacaga

SEQ ID NO: 2020942 - RNA, 18 nt, Shigella flexneri 2a str. 301
cucuuuaacccauuuugu

SEQ ID NO: 2020943 - RNA, 22 nt, Shigella flexneri 2a str. 301
cucuugcuggcauuacaagaau

SEQ ID NO: 2020944 - RNA, 17 nt, Shigella flexneri 2a str. 301
cucuuguaaauuuccca

SEQ ID NO: 2020945 - RNA, 21 nt, Shigella flexneri 2a str. 301
cucuuguaaauuucccacucu

SEQ ID NO: 2020946 - RNA, 17 nt, Shigella flexneri 2a str. 301
cucuucguuuucaacgu

SEQ ID NO: 2020947 - RNA, 12 nt, Shigella flexneri 2a str. 301
cucuucuccuug

SEQ ID NO: 2020948 - RNA, 13 nt, Shigella flexneri 2a str. 301
cucuucugcuuug

SEQ ID NO: 2020949 - RNA, 22 nt, Shigella flexneri 2a str. 301
cucuucugcuuugcccacgcuu

SEQ ID NO: 2020950 - RNA, 16 nt, Shigella flexneri 2a str. 301
cucuucugccugucca

SEQ ID NO: 2020951 - RNA, 14 nt, Shigella flexneri 2a str. 301
cucuucuggcacca

SEQ ID NO: 2020952 - RNA, 17 nt, Shigella flexneri 2a str. 301
cucuucgguuggcauca

SEQ ID NO: 2020953 - RNA, 15 nt, Shigella flexneri 2a str. 301
cugaacgcaccuucc

SEQ ID NO: 2020954 - RNA, 17 nt, Shigella flexneri 2a str. 301
cugaacgagaaaagcca

SEQ ID NO: 2020955 - RNA, 16 nt, Shigella flexneri 2a str. 301
cugaacauuguuauuc

SEQ ID NO: 2020956 - RNA, 23 nt, Shigella flexneri 2a str. 301
cugaacauuguuauucuccuuca

SEQ ID NO: 2020957 - RNA, 22 nt, Shigella flexneri 2a str. 301
cugaacaacaguuuuaucucca

SEQ ID NO: 2020958 - RNA, 20 nt, Shigella flexneri 2a str. 301
cugaacaauaaauuucaccg

SEQ ID NO: 2020959 - RNA, 11 nt, Shigella flexneri 2a str. 301
cugaaaucauc

SEQ ID NO: 2020960 - RNA, 18 nt, Shigella flexneri 2a str. 301
cugaaauguuugcaauaa

SEQ ID NO: 2020961 - RNA, 19 nt, Shigella flexneri 2a str. 301
cugaacguugcgcuucccg

SEQ ID NO: 2020962 - RNA, 22 nt, Shigella flexneri 2a str. 301
cugaacgugcucugcgccgccu

SEQ ID NO: 2020963 - RNA, 16 nt, Shigella flexneri 2a str. 301
cugaacugaacaaaaa

SEQ ID NO: 2020964 - RNA, 21 nt, Shigella flexneri 2a str. 301
cugaacucgacgcccuggaag

SEQ ID NO: 2020965 - RNA, 21 nt, Shigella flexneri 2a str. 301
cugaacucgccagccaccaug

SEQ ID NO: 2020966 - RNA, 21 nt, Shigella flexneri 2a str. 301
cugaagcaguuucaccagcag

SEQ ID NO: 2020967 - RNA, 19 nt, Shigella flexneri 2a str. 301
cugaagcaguuuugccuuc

SEQ ID NO: 2020968 - RNA, 15 nt, Shigella flexneri 2a str. 301
cugaagaucaacguc

SEQ ID NO: 2020969 - RNA, 14 nt, Shigella flexneri 2a str. 301
cugaagaugcugca

SEQ ID NO: 2020970 - RNA, 19 nt, Shigella flexneri 2a str. 301
cugaagauugaacagcaga

SEQ ID NO: 2020971 - RNA, 20 nt, Shigella flexneri 2a str. 301
cugaaacucgcguaaaucca

SEQ ID NO: 2020972 - RNA, 19 nt, Shigella flexneri 2a str. 301
cugaaagcgccgggaaugc

SEQ ID NO: 2020973 - RNA, 16 nt, Shigella flexneri 2a str. 301
cugaaagcgugucaug

SEQ ID NO: 2020974 - RNA, 20 nt, Shigella flexneri 2a str. 301
cugaaaguggaaaaauaaca

SEQ ID NO: 2020975 - RNA, 20 nt, Shigella flexneri 2a str. 301
cugaaacaauuuaccgaccu

SEQ ID NO: 2020976 - RNA, 21 nt, Shigella flexneri 2a str. 301
cugaaaagcgggcugagacug

SEQ ID NO: 2020977 - RNA, 16 nt, Shigella flexneri 2a str. 301
cucuuucuucagcacg

SEQ ID NO: 2020978 - RNA, 18 nt, Shigella flexneri 2a str. 301
cucuuucuaugagaaaau

SEQ ID NO: 2020979 - RNA, 15 nt, Shigella flexneri 2a str. 301
cucuuucuggcauca

SEQ ID NO: 2020980 - RNA, 15 nt, Shigella flexneri 2a str. 301
cugaaaagaguagua

SEQ ID NO: 2020981 - RNA, 21 nt, Shigella flexneri 2a str. 301
cugaaaagaguaguaauugcu

SEQ ID NO: 2020982 - RNA, 19 nt, Shigella flexneri 2a str. 301
cugaaaaaaaauuacaaaa

SEQ ID NO: 2020983 - RNA, 16 nt, Shigella flexneri 2a str. 301
cugaaaaaacaaauau

SEQ ID NO: 2020984 - RNA, 18 nt, Shigella flexneri 2a str. 301
cucuuuuuuguucaguuc

SEQ ID NO: 2020985 - RNA, 13 nt, Shigella flexneri 2a str. 301
cuacuccaguucc

SEQ ID NO: 2020986 - RNA, 16 nt, Shigella flexneri 2a str. 301
cuacucugacccagua

SEQ ID NO: 2020987 - RNA, 21 nt, Shigella flexneri 2a str. 301
cuacucuauacaggauaauua

SEQ ID NO: 2020988 - RNA, 22 nt, Shigella flexneri 2a str. 301
cuacuuugcgagucugcuccag

SEQ ID NO: 2020989 - RNA, 23 nt, Shigella flexneri 2a str. 301
cuagacagcgacucucugagcca

SEQ ID NO: 2020990 - RNA, 14 nt, Shigella flexneri 2a str. 301
cuagacgaugaaaa

SEQ ID NO: 2020991 - RNA, 18 nt, Shigella flexneri 2a str. 301
cuacuuuuuucacccaca

SEQ ID NO: 2020992 - RNA, 21 nt, Shigella flexneri 2a str. 301
cuacuuuuccagguuauuuua

SEQ ID NO: 2020993 - RNA, 21 nt, Shigella flexneri 2a str. 301
cuacuuuuuucacccacacuu

SEQ ID NO: 2020994 - RNA, 12 nt, Shigella flexneri 2a str. 301
cuaguauuuauu

SEQ ID NO: 2020995 - RNA, 15 nt, Shigella flexneri 2a str. 301
cuagcggcuuuuuac

SEQ ID NO: 2020996 - RNA, 21 nt, Shigella flexneri 2a str. 301
cuagcuucagguguuaguguc

SEQ ID NO: 2020997 - RNA, 14 nt, Shigella flexneri 2a str. 301
cuagcucaauaaaa

SEQ ID NO: 2020998 - RNA, 17 nt, Shigella flexneri 2a str. 301
cuagcucaauaaaagaa

SEQ ID NO: 2020999 - RNA, 22 nt, Shigella flexneri 2a str. 301
cuagcucaauaaaagaaaucag

SEQ ID NO: 2021000 - RNA, 15 nt, Shigella flexneri 2a str. 301
cuaucguccacguca

SEQ ID NO: 2021001 - RNA, 20 nt, Shigella flexneri 2a str. 301
cuaucgcugauauacccuuc

SEQ ID NO: 2021002 - RNA, 17 nt, Shigella flexneri 2a str. 301
cuaugcggaugccauuc

SEQ ID NO: 2021003 - RNA, 16 nt, Shigella flexneri 2a str. 301
cuauguaauccugaug

SEQ ID NO: 2021004 - RNA, 22 nt, Shigella flexneri 2a str. 301
cuaugcaacaacugaaaaaaaa

SEQ ID NO: 2021005 - RNA, 17 nt, Shigella flexneri 2a str. 301
cuaugauuuuccugagg

SEQ ID NO: 2021006 - RNA, 12 nt, Shigella flexneri 2a str. 301
cuauuccacgca

SEQ ID NO: 2021007 - RNA, 19 nt, Shigella flexneri 2a str. 301
cuauuccguuacucuccgg

SEQ ID NO: 2021008 - RNA, 17 nt, Shigella flexneri 2a str. 301
cuauucuuauaaagaaa

SEQ ID NO: 2021009 - RNA, 18 nt, Shigella flexneri 2a str. 301
cuauuaaaaagcuucuca

SEQ ID NO: 2021010 - RNA, 21 nt, Shigella flexneri 2a str. 301
cuauuauuuuucauauggaua

SEQ ID NO: 2021011 - RNA, 22 nt, Shigella flexneri 2a str. 301
cuauucaccgcaucaauauuaa

SEQ ID NO: 2021012 - RNA, 16 nt, Shigella flexneri 2a str. 301
cuauucacgaaucuau

SEQ ID NO: 2021013 - RNA, 11 nt, Shigella flexneri 2a str. 301
cuauccagcuc

SEQ ID NO: 2021014 - RNA, 23 nt, Shigella flexneri 2a str. 301
cuaucauugcgugguuuuugcug

SEQ ID NO: 2021015 - RNA, 17 nt, Shigella flexneri 2a str. 301
cuaucccagccuauaac

SEQ ID NO: 2021016 - RNA, 14 nt, Shigella flexneri 2a str. 301
cuaucauacucauu

SEQ ID NO: 2021017 - RNA, 13 nt, Shigella flexneri 2a str. 301
cuaucauacucau

SEQ ID NO: 2021018 - RNA, 12 nt, Shigella flexneri 2a str. 301
cuaucagcgcca

SEQ ID NO: 2021019 - RNA, 21 nt, Shigella flexneri 2a str. 301
cuaucacgccaccagcaacag

SEQ ID NO: 2021020 - RNA, 23 nt, Shigella flexneri 2a str. 301
cuaucacgccaccagcaacagcg

SEQ ID NO: 2021021 - RNA, 15 nt, Shigella flexneri 2a str. 301
cuaucaaacugaccu

SEQ ID NO: 2021022 - RNA, 18 nt, Shigella flexneri 2a str. 301
cuaguuuugccgacuggc

SEQ ID NO: 2021023 - RNA, 16 nt, Shigella flexneri 2a str. 301
cuauagauuauuugcg

SEQ ID NO: 2021024 - RNA, 22 nt, Shigella flexneri 2a str. 301
cuauauuacgagucacaaacau

SEQ ID NO: 2021025 - RNA, 23 nt, Shigella flexneri 2a str. 301
cuauauuugaggaguuuaauaaa

SEQ ID NO: 2021026 - RNA, 14 nt, Shigella flexneri 2a str. 301
cuauagucuuuucg

SEQ ID NO: 2021027 - RNA, 16 nt, Shigella flexneri 2a str. 301
cucacccgcuucauaa

SEQ ID NO: 2021028 - RNA, 14 nt, Shigella flexneri 2a str. 301
cucacgcagcggcg

SEQ ID NO: 2021029 - RNA, 22 nt, Shigella flexneri 2a str. 301
cucacuaauugcaaacagagcg

SEQ ID NO: 2021030 - RNA, 21 nt, Shigella flexneri 2a str. 301
cucacuauccgccccauuuuu

SEQ ID NO: 2021031 - RNA, 14 nt, Shigella flexneri 2a str. 301
cucacucaccgcag

SEQ ID NO: 2021032 - RNA, 12 nt, Shigella flexneri 2a str. 301
cucacuccagcc

SEQ ID NO: 2021033 - RNA, 18 nt, Shigella flexneri 2a str. 301
cucacuccagccagagcc

SEQ ID NO: 2021034 - RNA, 19 nt, Shigella flexneri 2a str. 301
cucacgccguuaacuucac

SEQ ID NO: 2021035 - RNA, 17 nt, Shigella flexneri 2a str. 301
cucaauaucaucauuug

SEQ ID NO: 2021036 - RNA, 17 nt, Shigella flexneri 2a str. 301
cucaauauuagcauuaa

SEQ ID NO: 2021037 - RNA, 15 nt, Shigella flexneri 2a str. 301
cucaauacaacccac

SEQ ID NO: 2021038 - RNA, 14 nt, Shigella flexneri 2a str. 301
cucaaguugcgaaa

SEQ ID NO: 2021039 - RNA, 24 nt, Shigella flexneri 2a str. 301
cucaagcucguugguuccacggca

SEQ ID NO: 2021040 - RNA, 21 nt, Shigella flexneri 2a str. 301
cucaagcucguugguuccacg

SEQ ID NO: 2021041 - RNA, 22 nt, Shigella flexneri 2a str. 301
cucaagcguugcuucacgcggg

SEQ ID NO: 2021042 - RNA, 21 nt, Shigella flexneri 2a str. 301
cucacaucaugcgucaccaac

SEQ ID NO: 2021043 - RNA, 19 nt, Shigella flexneri 2a str. 301
cucacagaguauuuccagc

SEQ ID NO: 2021044 - RNA, 23 nt, Shigella flexneri 2a str. 301
cucaaaauuucuccuucacucua

SEQ ID NO: 2021045 - RNA, 21 nt, Shigella flexneri 2a str. 301
cucaaauaucuauauacaauc

SEQ ID NO: 2021046 - RNA, 22 nt, Shigella flexneri 2a str. 301
cucaaauaucuauauacaauca

SEQ ID NO: 2021047 - RNA, 13 nt, Shigella flexneri 2a str. 301
cucaaaacuacaa

SEQ ID NO: 2021048 - RNA, 13 nt, Shigella flexneri 2a str. 301
cucaaaacaacac

SEQ ID NO: 2021049 - RNA, 21 nt, Shigella flexneri 2a str. 301
cuauuguaguuggaugacauu

SEQ ID NO: 2021050 - RNA, 17 nt, Shigella flexneri 2a str. 301
cuauuguugauaaggaa

SEQ ID NO: 2021051 - RNA, 19 nt, Shigella flexneri 2a str. 301
cuauugcgcuaaaaaguuc

SEQ ID NO: 2021052 - RNA, 12 nt, Shigella flexneri 2a str. 301
cuauugcaacau

SEQ ID NO: 2021053 - RNA, 16 nt, Shigella flexneri 2a str. 301
cuauugauuuaacagc

SEQ ID NO: 2021054 - RNA, 22 nt, Shigella flexneri 2a str. 301
cucaagcaguugguuaaucuuu

SEQ ID NO: 2021055 - RNA, 14 nt, Shigella flexneri 2a str. 301
cucaagacaauuag

SEQ ID NO: 2021056 - RNA, 16 nt, Shigella flexneri 2a str. 301
cucaagaaucacuuca

SEQ ID NO: 2021057 - RNA, 14 nt, Shigella flexneri 2a str. 301
cucaacucacgccc

SEQ ID NO: 2021058 - RNA, 16 nt, Shigella flexneri 2a str. 301
cucaacuuuaccuuca

SEQ ID NO: 2021059 - RNA, 21 nt, Shigella flexneri 2a str. 301
cucaacugacugacgugauga

SEQ ID NO: 2021060 - RNA, 12 nt, Shigella flexneri 2a str. 301
cucaacaggccc

SEQ ID NO: 2021061 - RNA, 21 nt, Shigella flexneri 2a str. 301
cucaacaggcccaacuguuga

SEQ ID NO: 2021062 - RNA, 22 nt, Shigella flexneri 2a str. 301
cucaacaggcccaacuguugau

SEQ ID NO: 2021063 - RNA, 16 nt, Shigella flexneri 2a str. 301
cucaacacauuacugc

SEQ ID NO: 2021064 - RNA, 14 nt, Shigella flexneri 2a str. 301
cuccaacuuacuga

SEQ ID NO: 2021065 - RNA, 13 nt, Shigella flexneri 2a str. 301
cucauuuaauauu

SEQ ID NO: 2021066 - RNA, 14 nt, Shigella flexneri 2a str. 301
cucauucaccaguu

SEQ ID NO: 2021067 - RNA, 12 nt, Shigella flexneri 2a str. 301
cucauugccagu

SEQ ID NO: 2021068 - RNA, 23 nt, Shigella flexneri 2a str. 301
cucauugcuauuuccaccucccc

SEQ ID NO: 2021069 - RNA, 12 nt, Shigella flexneri 2a str. 301
cucaucaggccu

SEQ ID NO: 2021070 - RNA, 14 nt, Shigella flexneri 2a str. 301
cucauaugcagcau

SEQ ID NO: 2021071 - RNA, 19 nt, Shigella flexneri 2a str. 301
cucauauuccugcauugcu

SEQ ID NO: 2021072 - RNA, 12 nt, Shigella flexneri 2a str. 301
cucauccaucaa

SEQ ID NO: 2021073 - RNA, 14 nt, Shigella flexneri 2a str. 301
cucauccaucaaau

SEQ ID NO: 2021074 - RNA, 18 nt, Shigella flexneri 2a str. 301
cucauccauaaauaccug

SEQ ID NO: 2021075 - RNA, 19 nt, Shigella flexneri 2a str. 301
cucaugcaucaggaccugc

SEQ ID NO: 2021076 - RNA, 18 nt, Shigella flexneri 2a str. 301
cucacuccggccagagca

SEQ ID NO: 2021077 - RNA, 16 nt, Shigella flexneri 2a str. 301
cucagcgccugcugca

SEQ ID NO: 2021078 - RNA, 14 nt, Shigella flexneri 2a str. 301
cucagcgccacauc

SEQ ID NO: 2021079 - RNA, 15 nt, Shigella flexneri 2a str. 301
cucagcgccugcugc

SEQ ID NO: 2021080 - RNA, 20 nt, Shigella flexneri 2a str. 301
cucagcgucagccugcucag

SEQ ID NO: 2021081 - RNA, 15 nt, Shigella flexneri 2a str. 301
cucaggcacuucuuc

SEQ ID NO: 2021082 - RNA, 19 nt, Shigella flexneri 2a str. 301
cucaggccuacaaaaucuu

SEQ ID NO: 2021083 - RNA, 22 nt, Shigella flexneri 2a str. 301
cucaggcgcacgccgacaaaga

SEQ ID NO: 2021084 - RNA, 19 nt, Shigella flexneri 2a str. 301
cucaguugguuagagcaca

SEQ ID NO: 2021085 - RNA, 17 nt, Shigella flexneri 2a str. 301
cucagugaccgaaccug

SEQ ID NO: 2021086 - RNA, 19 nt, Shigella flexneri 2a str. 301
cucauaccuuccacuuuca

SEQ ID NO: 2021087 - RNA, 19 nt, Shigella flexneri 2a str. 301
cucauagggugugacgaca

SEQ ID NO: 2021088 - RNA, 22 nt, Shigella flexneri 2a str. 301
cucauagggugugacgacacca

SEQ ID NO: 2021089 - RNA, 16 nt, Shigella flexneri 2a str. 301
cucauacuuccacgca

SEQ ID NO: 2021090 - RNA, 15 nt, Shigella flexneri 2a str. 301
cucauagcgcccuuu

SEQ ID NO: 2021091 - RNA, 17 nt, Shigella flexneri 2a str. 301
cuacauauuuuucauau

SEQ ID NO: 2021092 - RNA, 23 nt, Shigella flexneri 2a str. 301
cuacaggcaacgaccagaaaugc

SEQ ID NO: 2021093 - RNA, 14 nt, Shigella flexneri 2a str. 301
cuacagccugguga

SEQ ID NO: 2021094 - RNA, 18 nt, Shigella flexneri 2a str. 301
cuacagcgcccgccagca

SEQ ID NO: 2021095 - RNA, 20 nt, Shigella flexneri 2a str. 301
cuacagccaugcgaaugcca

SEQ ID NO: 2021096 - RNA, 23 nt, Shigella flexneri 2a str. 301
cuacagagcgagggagaaaaccc

SEQ ID NO: 2021097 - RNA, 18 nt, Shigella flexneri 2a str. 301
cuacacuauuuccuuggu

SEQ ID NO: 2021098 - RNA, 19 nt, Shigella flexneri 2a str. 301
cuacacuauuuccuugguc

SEQ ID NO: 2021099 - RNA, 23 nt, Shigella flexneri 2a str. 301
cuaccaucagguaauaggcaggc

SEQ ID NO: 2021100 - RNA, 23 nt, Shigella flexneri 2a str. 301
cuaccaugaccugcaaauucaau

SEQ ID NO: 2021101 - RNA, 17 nt, Shigella flexneri 2a str. 301
cuaccacugccugaguu

SEQ ID NO: 2021102 - RNA, 17 nt, Shigella flexneri 2a str. 301
cuaccacgccgauaauc

SEQ ID NO: 2021103 - RNA, 13 nt, Shigella flexneri 2a str. 301
cuaccaaaccugc

SEQ ID NO: 2021104 - RNA, 14 nt, Shigella flexneri 2a str. 301
cuacaugauuucug

SEQ ID NO: 2021105 - RNA, 18 nt, Shigella flexneri 2a str. 301
cuaauuuccuuugguuau

SEQ ID NO: 2021106 - RNA, 23 nt, Shigella flexneri 2a str. 301
cuacaaaaucgugcaaauucaau

SEQ ID NO: 2021107 - RNA, 23 nt, Shigella flexneri 2a str. 301
cuacaaaaucuugcaaauucaau

SEQ ID NO: 2021108 - RNA, 23 nt, Shigella flexneri 2a str. 301
cuacaaaaccaauuaaauucaau

SEQ ID NO: 2021109 - RNA, 14 nt, Shigella flexneri 2a str. 301
cuacaaaaccugca

SEQ ID NO: 2021110 - RNA, 17 nt, Shigella flexneri 2a str. 301
cuacaaaaacugccgca

SEQ ID NO: 2021111 - RNA, 19 nt, Shigella flexneri 2a str. 301
cuacaaacguugcugacug

SEQ ID NO: 2021112 - RNA, 20 nt, Shigella flexneri 2a str. 301
cuacaaaugggcacaauuca

SEQ ID NO: 2021113 - RNA, 23 nt, Shigella flexneri 2a str. 301
cuacaaaauuguguaaauucaau

SEQ ID NO: 2021114 - RNA, 20 nt, Shigella flexneri 2a str. 301
cuaauuuuucccucuucaau

SEQ ID NO: 2021115 - RNA, 18 nt, Shigella flexneri 2a str. 301
cuacaagcagagagacaa

SEQ ID NO: 2021116 - RNA, 22 nt, Shigella flexneri 2a str. 301
cuacaaguccguugaaaaugcu

SEQ ID NO: 2021117 - RNA, 19 nt, Shigella flexneri 2a str. 301
cuacaaugucgggauuuuc

SEQ ID NO: 2021118 - RNA, 16 nt, Shigella flexneri 2a str. 301
cuacaauguuucugca

SEQ ID NO: 2021119 - RNA, 13 nt, Shigella flexneri 2a str. 301
cuacaagcagaga

SEQ ID NO: 2021120 - RNA, 14 nt, Shigella flexneri 2a str. 301
cuacaccccagcgu

SEQ ID NO: 2021121 - RNA, 22 nt, Shigella flexneri 2a str. 301
cuacacgcuaccaaaaaaucaa

SEQ ID NO: 2021122 - RNA, 15 nt, Shigella flexneri 2a str. 301
cuacacccagccccg

SEQ ID NO: 2021123 - RNA, 18 nt, Shigella flexneri 2a str. 301
cuaaugagucaggacagu

SEQ ID NO: 2021124 - RNA, 21 nt, Shigella flexneri 2a str. 301
cuaaugagucaggacaguaaa

SEQ ID NO: 2021125 - RNA, 14 nt, Shigella flexneri 2a str. 301
cuaauuacauaaca

SEQ ID NO: 2021126 - RNA, 17 nt, Shigella flexneri 2a str. 301
cuaaucgcacaaaauca

SEQ ID NO: 2021127 - RNA, 17 nt, Shigella flexneri 2a str. 301
cuaaucgcuuuauagca

SEQ ID NO: 2021128 - RNA, 17 nt, Shigella flexneri 2a str. 301
cuaaucuugaaaccaga

SEQ ID NO: 2021129 - RNA, 20 nt, Shigella flexneri 2a str. 301
cuaaucagcuuuuccauauc

SEQ ID NO: 2021130 - RNA, 13 nt, Shigella flexneri 2a str. 301
cuaaucagugccu

SEQ ID NO: 2021131 - RNA, 14 nt, Shigella flexneri 2a str. 301
cuaaucaucaucag

SEQ ID NO: 2021132 - RNA, 23 nt, Shigella flexneri 2a str. 301
cuaauauuagucaauuaaaaaau

SEQ ID NO: 2021133 - RNA, 16 nt, Shigella flexneri 2a str. 301
cuaaaucacaccauug

SEQ ID NO: 2021134 - RNA, 18 nt, Shigella flexneri 2a str. 301
cuaacgucuaguaaagca

SEQ ID NO: 2021135 - RNA, 21 nt, Shigella flexneri 2a str. 301
cuaaggguaaaacgacuggcc

SEQ ID NO: 2021136 - RNA, 14 nt, Shigella flexneri 2a str. 301
cuaaggcagccaga

SEQ ID NO: 2021137 - RNA, 13 nt, Shigella flexneri 2a str. 301
cuaaggcaugaau

SEQ ID NO: 2021138 - RNA, 15 nt, Shigella flexneri 2a str. 301
cuaagcaggcuggcu

SEQ ID NO: 2021139 - RNA, 19 nt, Shigella flexneri 2a str. 301
cguuguuccuuccagcugg

SEQ ID NO: 2021140 - RNA, 16 nt, Shigella flexneri 2a str. 301
cguuuaugcagguucu

SEQ ID NO: 2021141 - RNA, 15 nt, Shigella flexneri 2a str. 301
cguuuaugaguauuu

SEQ ID NO: 2021142 - RNA, 18 nt, Shigella flexneri 2a str. 301
cguuuaugaucaucaagg

SEQ ID NO: 2021143 - RNA, 14 nt, Shigella flexneri 2a str. 301
cguuucaaaaacaa

SEQ ID NO: 2021144 - RNA, 15 nt, Shigella flexneri 2a str. 301
cguuucaaaaacaaa

SEQ ID NO: 2021145 - RNA, 20 nt, Shigella flexneri 2a str. 301
cguuucuacaagcagagaga

SEQ ID NO: 2021146 - RNA, 20 nt, Shigella flexneri 2a str. 301
cguuucacauucgccgccga

SEQ ID NO: 2021147 - RNA, 13 nt, Shigella flexneri 2a str. 301
cguugcucuucuc

SEQ ID NO: 2021148 - RNA, 16 nt, Shigella flexneri 2a str. 301
cguuguuaaggguaaa

SEQ ID NO: 2021149 - RNA, 23 nt, Shigella flexneri 2a str. 301
cguugugcaucaggcaaacuuca

SEQ ID NO: 2021150 - RNA, 22 nt, Shigella flexneri 2a str. 301
cguuugauuaacgccagauuac

SEQ ID NO: 2021151 - RNA, 15 nt, Shigella flexneri 2a str. 301
cguuucuuucaucag

SEQ ID NO: 2021152 - RNA, 13 nt, Shigella flexneri 2a str. 301
cguuucugcuggu

SEQ ID NO: 2021153 - RNA, 16 nt, Shigella flexneri 2a str. 301
cguuuugccgccauca

SEQ ID NO: 2021154 - RNA, 20 nt, Shigella flexneri 2a str. 301
cguuuuggugaagugagaau

SEQ ID NO: 2021155 - RNA, 16 nt, Shigella flexneri 2a str. 301
cguuuuggcagacaac

SEQ ID NO: 2021156 - RNA, 19 nt, Shigella flexneri 2a str. 301
cguuuugcggaugcagcgg

SEQ ID NO: 2021157 - RNA, 19 nt, Shigella flexneri 2a str. 301
cguuuugugguguuuuuuu

SEQ ID NO: 2021158 - RNA, 23 nt, Shigella flexneri 2a str. 301
cguuuugugguguuuuuuuaauc

SEQ ID NO: 2021159 - RNA, 17 nt, Shigella flexneri 2a str. 301
cguuuuuacccagcagc

SEQ ID NO: 2021160 - RNA, 17 nt, Shigella flexneri 2a str. 301
cuaaacguuuaaaaacu

SEQ ID NO: 2021161 - RNA, 19 nt, Shigella flexneri 2a str. 301
cuaaagccugcuuugacaa

SEQ ID NO: 2021162 - RNA, 16 nt, Shigella flexneri 2a str. 301
cuaaaggcaaaaugcc

SEQ ID NO: 2021163 - RNA, 17 nt, Shigella flexneri 2a str. 301
cuaaaggcaaaaugcca

SEQ ID NO: 2021164 - RNA, 13 nt, Shigella flexneri 2a str. 301
cuaaaguaaagga

SEQ ID NO: 2021165 - RNA, 16 nt, Shigella flexneri 2a str. 301
cuaaaguaaaggaaca

SEQ ID NO: 2021166 - RNA, 20 nt, Shigella flexneri 2a str. 301
cuaaaguaaaggaacaaggg

SEQ ID NO: 2021167 - RNA, 16 nt, Shigella flexneri 2a str. 301
cuaaacguuuaaaaac

SEQ ID NO: 2021168 - RNA, 22 nt, Shigella flexneri 2a str. 301
cuaaaaucauucgugagcuggu

SEQ ID NO: 2021169 - RNA, 21 nt, Shigella flexneri 2a str. 301
cguugaucacccacaucagcg

SEQ ID NO: 2021170 - RNA, 20 nt, Shigella flexneri 2a str. 301
cguugaugccgugcagcacg

SEQ ID NO: 2021171 - RNA, 16 nt, Shigella flexneri 2a str. 301
cguugaucucuccggu

SEQ ID NO: 2021172 - RNA, 21 nt, Shigella flexneri 2a str. 301
cguugaccugaauacccgcau

SEQ ID NO: 2021173 - RNA, 21 nt, Shigella flexneri 2a str. 301
cguugaggaacucaaaccauu

SEQ ID NO: 2021174 - RNA, 19 nt, Shigella flexneri 2a str. 301
cguugagagguaaaaccug

SEQ ID NO: 2021175 - RNA, 19 nt, Shigella flexneri 2a str. 301
cguucguagaaaaaacagc

SEQ ID NO: 2021176 - RNA, 17 nt, Shigella flexneri 2a str. 301
cguugcgcuucucaggc

SEQ ID NO: 2021177 - RNA, 17 nt, Shigella flexneri 2a str. 301
cguugcgcgucaacugu

SEQ ID NO: 2021178 - RNA, 20 nt, Shigella flexneri 2a str. 301
cguugccggauauacccgcc

SEQ ID NO: 2021179 - RNA, 17 nt, Shigella flexneri 2a str. 301
cguucaguucaaaguua

SEQ ID NO: 2021180 - RNA, 22 nt, Shigella flexneri 2a str. 301
cguucauaaauacagagcacgc

SEQ ID NO: 2021181 - RNA, 24 nt, Shigella flexneri 2a str. 301
cguucaucgggcauugcaaccaca

SEQ ID NO: 2021182 - RNA, 15 nt, Shigella flexneri 2a str. 301
cguucgaacuggaua

SEQ ID NO: 2021183 - RNA, 21 nt, Shigella flexneri 2a str. 301
cguuccuuuacggugaacuca

SEQ ID NO: 2021184 - RNA, 12 nt, Shigella flexneri 2a str. 301
cguuccuuucuu

SEQ ID NO: 2021185 - RNA, 21 nt, Shigella flexneri 2a str. 301
cguuccuuucuugcgcaaacc

SEQ ID NO: 2021186 - RNA, 13 nt, Shigella flexneri 2a str. 301
cguuccugcaacg

SEQ ID NO: 2021187 - RNA, 19 nt, Shigella flexneri 2a str. 301
cguuccuacaacugggaca

SEQ ID NO: 2021188 - RNA, 15 nt, Shigella flexneri 2a str. 301
cguuccuaacaugcc

SEQ ID NO: 2021189 - RNA, 17 nt, Shigella flexneri 2a str. 301
cguucgauggcgcgcca

SEQ ID NO: 2021190 - RNA, 19 nt, Shigella flexneri 2a str. 301
cguccacagccaacacauu

SEQ ID NO: 2021191 - RNA, 20 nt, Shigella flexneri 2a str. 301
cgucauuucgaagaaaccga

SEQ ID NO: 2021192 - RNA, 21 nt, Shigella flexneri 2a str. 301
cgucauuuucaucgcuuucuu

SEQ ID NO: 2021193 - RNA, 23 nt, Shigella flexneri 2a str. 301
cgucauuguuaacgccgcgccgu

SEQ ID NO: 2021194 - RNA, 13 nt, Shigella flexneri 2a str. 301
cgucauggcuguc

SEQ ID NO: 2021195 - RNA, 20 nt, Shigella flexneri 2a str. 301
cgucauuagcgauaaauguc

SEQ ID NO: 2021196 - RNA, 20 nt, Shigella flexneri 2a str. 301
cguuaguucgcguaacugcu

SEQ ID NO: 2021197 - RNA, 22 nt, Shigella flexneri 2a str. 301
cguuauacaucgcuuuccaggu

SEQ ID NO: 2021198 - RNA, 20 nt, Shigella flexneri 2a str. 301
cguuagugucuuaucuggca

SEQ ID NO: 2021199 - RNA, 23 nt, Shigella flexneri 2a str. 301
cguuagugucuuaucuggcauuu

SEQ ID NO: 2021200 - RNA, 12 nt, Shigella flexneri 2a str. 301
aaaaaaagaaga

SEQ ID NO: 2021201 - RNA, 12 nt, Shigella flexneri 2a str. 301
aaaaaaauaagc

SEQ ID NO: 2021202 - RNA, 11 nt, Shigella flexneri 2a str. 301
aaaaaaaagau

SEQ ID NO: 2021203 - RNA, 13 nt, Shigella flexneri 2a str. 301
aaaaaaaagaaga

SEQ ID NO: 2021204 - RNA, 13 nt, Shigella flexneri 2a str. 301
aaaaaacaauaug

SEQ ID NO: 2021205 - RNA, 18 nt, Shigella flexneri 2a str. 301
aaaaaaauucugaacaau

SEQ ID NO: 2021206 - RNA, 13 nt, Shigella flexneri 2a str. 301
aaaaaaccgccau

SEQ ID NO: 2021207 - RNA, 14 nt, Shigella flexneri 2a str. 301
aaaaacaucaugau

SEQ ID NO: 2021208 - RNA, 13 nt, Shigella flexneri 2a str. 301
aaaaacaucauga

SEQ ID NO: 2021209 - RNA, 13 nt, Shigella flexneri 2a str. 301
aaaaacagcauca

SEQ ID NO: 2021210 - RNA, 19 nt, Shigella flexneri 2a str. 301
aaaaacagcaucaauaauc

SEQ ID NO: 2021211 - RNA, 16 nt, Shigella flexneri 2a str. 301
aaaaacagccagcagc

SEQ ID NO: 2021212 - RNA, 11 nt, Shigella flexneri 2a str. 301
aaaaaauccca

SEQ ID NO: 2021213 - RNA, 23 nt, Shigella flexneri 2a str. 301
aaaaaaucaaugcccaucacuau

SEQ ID NO: 2021214 - RNA, 13 nt, Shigella flexneri 2a str. 301
aaaaaauagcaaa

SEQ ID NO: 2021215 - RNA, 16 nt, Shigella flexneri 2a str. 301
aaaaaaugagaaagcc

SEQ ID NO: 2021216 - RNA, 20 nt, Shigella flexneri 2a str. 301
aaaaaauggccagacauuau

SEQ ID NO: 2021217 - RNA, 13 nt, Shigella flexneri 2a str. 301
aaaaaauuaacaa

SEQ ID NO: 2021218 - RNA, 19 nt, Shigella flexneri 2a str. 301
aaaaaauuaacaaaacaau

SEQ ID NO: 2021219 - RNA, 20 nt, Shigella flexneri 2a str. 301
aaaaaauuacaaaaagugcu

SEQ ID NO: 2021220 - RNA, 12 nt, Shigella flexneri 2a str. 301
aaaaaauucuga

SEQ ID NO: 2021221 - RNA, 21 nt, Shigella flexneri 2a str. 301
aaaaacagcaucaauaaucaa

SEQ ID NO: 2021222 - RNA, 12 nt, Shigella flexneri 2a str. 301
aaaaacagccag

SEQ ID NO: 2021223 - RNA, 12 nt, Shigella flexneri 2a str. 301
aaaaacacaaag

SEQ ID NO: 2021224 - RNA, 20 nt, Shigella flexneri 2a str. 301
aaaaacacugggaugaaagu

SEQ ID NO: 2021225 - RNA, 20 nt, Shigella flexneri 2a str. 301
aaaaugcaucggcauaauca

SEQ ID NO: 2021226 - RNA, 15 nt, Shigella flexneri 2a str. 301
aaaaugccccagcgc

SEQ ID NO: 2021227 - RNA, 16 nt, Shigella flexneri 2a str. 301
aaaaugccgcacauca

SEQ ID NO: 2021228 - RNA, 14 nt, Shigella flexneri 2a str. 301
aaaaugcgcaugau

SEQ ID NO: 2021229 - RNA, 20 nt, Shigella flexneri 2a str. 301
aaaaugccuuuaccgacaua

SEQ ID NO: 2021230 - RNA, 19 nt, Shigella flexneri 2a str. 301
aaaauuauaucuuauugcu

SEQ ID NO: 2021231 - RNA, 16 nt, Shigella flexneri 2a str. 301
aaaauuagcaauacca

SEQ ID NO: 2021232 - RNA, 15 nt, Shigella flexneri 2a str. 301
aaaauuauuuuaaau

SEQ ID NO: 2021233 - RNA, 13 nt, Shigella flexneri 2a str. 301
aaaaucgcuucag

SEQ ID NO: 2021234 - RNA, 17 nt, Shigella flexneri 2a str. 301
aaaaucgacaucugcaa

SEQ ID NO: 2021235 - RNA, 21 nt, Shigella flexneri 2a str. 301
aaaaucccggcaacaaauuca

SEQ ID NO: 2021236 - RNA, 22 nt, Shigella flexneri 2a str. 301
aaaaugauguagaccugauaca

SEQ ID NO: 2021237 - RNA, 21 nt, Shigella flexneri 2a str. 301
aaaaugauguagaccugauac

SEQ ID NO: 2021238 - RNA, 19 nt, Shigella flexneri 2a str. 301
aaaaucuccugccaauaca

SEQ ID NO: 2021239 - RNA, 14 nt, Shigella flexneri 2a str. 301
aaaaucucaaugua

SEQ ID NO: 2021240 - RNA, 23 nt, Shigella flexneri 2a str. 301
aaaaucgugaaaaaucaauauau

SEQ ID NO: 2021241 - RNA, 19 nt, Shigella flexneri 2a str. 301
aaaaucguaagcaggagau

SEQ ID NO: 2021242 - RNA, 20 nt, Shigella flexneri 2a str. 301
aaaauuucccccacagcucu

SEQ ID NO: 2021243 - RNA, 12 nt, Shigella flexneri 2a str. 301
aaaauuuacagu

SEQ ID NO: 2021244 - RNA, 14 nt, Shigella flexneri 2a str. 301
aaaauuuucauugc

SEQ ID NO: 2021245 - RNA, 13 nt, Shigella flexneri 2a str. 301
aaaauucaagaca

SEQ ID NO: 2021246 - RNA, 21 nt, Shigella flexneri 2a str. 301
aaaauucacaucguugacauu

SEQ ID NO: 2021247 - RNA, 23 nt, Shigella flexneri 2a str. 301
aaaauucauucaauuaauaacac

SEQ ID NO: 2021248 - RNA, 22 nt, Shigella flexneri 2a str. 301
aaacaacgagccaauaaaaaua

SEQ ID NO: 2021249 - RNA, 21 nt, Shigella flexneri 2a str. 301
aaacaacggaacgaaaaaaau

SEQ ID NO: 2021250 - RNA, 13 nt, Shigella flexneri 2a str. 301
aaacaaccccauc

SEQ ID NO: 2021251 - RNA, 14 nt, Shigella flexneri 2a str. 301
aaacaaaucacuau

SEQ ID NO: 2021252 - RNA, 13 nt, Shigella flexneri 2a str. 301
aaaaucaccauca

SEQ ID NO: 2021253 - RNA, 14 nt, Shigella flexneri 2a str. 301
aaaaucaccaucac

SEQ ID NO: 2021254 - RNA, 20 nt, Shigella flexneri 2a str. 301
aaaaucaaccauacggucug

SEQ ID NO: 2021255 - RNA, 15 nt, Shigella flexneri 2a str. 301
aaaaucaacgacaaa

SEQ ID NO: 2021256 - RNA, 14 nt, Shigella flexneri 2a str. 301
aaaauccaccagug

SEQ ID NO: 2021257 - RNA, 19 nt, Shigella flexneri 2a str. 301
aaaauccagauuuauaaaa

SEQ ID NO: 2021258 - RNA, 22 nt, Shigella flexneri 2a str. 301
aaaauccauuuucuauuuugca

SEQ ID NO: 2021259 - RNA, 15 nt, Shigella flexneri 2a str. 301
aaaaucccacugcca

SEQ ID NO: 2021260 - RNA, 16 nt, Shigella flexneri 2a str. 301
aaaaucccacugccaa

SEQ ID NO: 2021261 - RNA, 15 nt, Shigella flexneri 2a str. 301
aaaauccgaacuauu

SEQ ID NO: 2021262 - RNA, 19 nt, Shigella flexneri 2a str. 301
aaaauaaugcgacaacaga

SEQ ID NO: 2021263 - RNA, 16 nt, Shigella flexneri 2a str. 301
aaaauaccgagcagcc

SEQ ID NO: 2021264 - RNA, 15 nt, Shigella flexneri 2a str. 301
aaaauacguucucac

SEQ ID NO: 2021265 - RNA, 18 nt, Shigella flexneri 2a str. 301
aaaauaauuuuaaauauc

SEQ ID NO: 2021266 - RNA, 21 nt, Shigella flexneri 2a str. 301
aaaauagcuguuuauuuauac

SEQ ID NO: 2021267 - RNA, 20 nt, Shigella flexneri 2a str. 301
aaaauagauaaucgcuuucg

SEQ ID NO: 2021268 - RNA, 16 nt, Shigella flexneri 2a str. 301
aaaauaaugcgacaac

SEQ ID NO: 2021269 - RNA, 22 nt, Shigella flexneri 2a str. 301
aaaagugguguugaagaaacau

SEQ ID NO: 2021270 - RNA, 22 nt, Shigella flexneri 2a str. 301
aaaaguaaaccagagagaagcu

SEQ ID NO: 2021271 - RNA, 21 nt, Shigella flexneri 2a str. 301
aaaaguaagauugccugaugc

SEQ ID NO: 2021272 - RNA, 20 nt, Shigella flexneri 2a str. 301
aaaaguaguuccagcaugau

SEQ ID NO: 2021273 - RNA, 17 nt, Shigella flexneri 2a str. 301
aaaagccuaagaaguca

SEQ ID NO: 2021274 - RNA, 22 nt, Shigella flexneri 2a str. 301
aaaagccgacucacuugcaguc

SEQ ID NO: 2021275 - RNA, 15 nt, Shigella flexneri 2a str. 301
aaaagccugccaucu

SEQ ID NO: 2021276 - RNA, 21 nt, Shigella flexneri 2a str. 301
aaaagcauagccccagcgcag

SEQ ID NO: 2021277 - RNA, 19 nt, Shigella flexneri 2a str. 301
aaaacucgagccuuuacga

SEQ ID NO: 2021278 - RNA, 16 nt, Shigella flexneri 2a str. 301
aaaacugccugauacu

SEQ ID NO: 2021279 - RNA, 20 nt, Shigella flexneri 2a str. 301
aaaacuggauuacaaauaaa

SEQ ID NO: 2021280 - RNA, 19 nt, Shigella flexneri 2a str. 301
aaaacuuuuagcaucuuau

SEQ ID NO: 2021281 - RNA, 11 nt, Shigella flexneri 2a str. 301
aaaacuuucca

SEQ ID NO: 2021282 - RNA, 19 nt, Shigella flexneri 2a str. 301
aaaacuguaguguugcagu

SEQ ID NO: 2021283 - RNA, 19 nt, Shigella flexneri 2a str. 301
aaaacguggccuccaaaaa

SEQ ID NO: 2021284 - RNA, 13 nt, Shigella flexneri 2a str. 301
aaaacgugcagcu

SEQ ID NO: 2021285 - RNA, 16 nt, Shigella flexneri 2a str. 301
aaaacgugcagcugcc

SEQ ID NO: 2021286 - RNA, 20 nt, Shigella flexneri 2a str. 301
aaaacguggccuccaaaaaa

SEQ ID NO: 2021287 - RNA, 13 nt, Shigella flexneri 2a str. 301
aaaacuaaaaaca

SEQ ID NO: 2021288 - RNA, 15 nt, Shigella flexneri 2a str. 301
aaaacuaaaaacagc

SEQ ID NO: 2021289 - RNA, 22 nt, Shigella flexneri 2a str. 301
aaaacguugucaguucuuuuau

SEQ ID NO: 2021290 - RNA, 17 nt, Shigella flexneri 2a str. 301
aaaacggugaucaaaac

SEQ ID NO: 2021291 - RNA, 16 nt, Shigella flexneri 2a str. 301
aaaacgguaaggacaa

SEQ ID NO: 2021292 - RNA, 23 nt, Shigella flexneri 2a str. 301
aaaacgugacagcauaccuucac

SEQ ID NO: 2021293 - RNA, 18 nt, Shigella flexneri 2a str. 301
aaaacgggucaccuucug

SEQ ID NO: 2021294 - RNA, 15 nt, Shigella flexneri 2a str. 301
aaaacggauguuucu

SEQ ID NO: 2021295 - RNA, 22 nt, Shigella flexneri 2a str. 301
aaaacggauugcuuguucgaug

SEQ ID NO: 2021296 - RNA, 15 nt, Shigella flexneri 2a str. 301
aaaagcaaaaauaag

SEQ ID NO: 2021297 - RNA, 13 nt, Shigella flexneri 2a str. 301
aaaagcacagaau

SEQ ID NO: 2021298 - RNA, 15 nt, Shigella flexneri 2a str. 301
aaaagcacagaaucu

SEQ ID NO: 2021299 - RNA, 15 nt, Shigella flexneri 2a str. 301
aaaagaguaaaguua

SEQ ID NO: 2021300 - RNA, 10 nt, Shigella flexneri 2a str. 301
aaaagagcgu

SEQ ID NO: 2021301 - RNA, 16 nt, Shigella flexneri 2a str. 301
aaaagauggucaucgg

SEQ ID NO: 2021302 - RNA, 14 nt, Shigella flexneri 2a str. 301
aaaagaaaaaauga

SEQ ID NO: 2021303 - RNA, 21 nt, Shigella flexneri 2a str. 301
aaaagaaaguuugcagaaauu

SEQ ID NO: 2021304 - RNA, 23 nt, Shigella flexneri 2a str. 301
aaaagaagaccugccagaacaac

SEQ ID NO: 2021305 - RNA, 11 nt, Shigella flexneri 2a str. 301
aaaagaaaguu

SEQ ID NO: 2021306 - RNA, 23 nt, Shigella flexneri 2a str. 301
aaaagaaaucagaccauguuuga

SEQ ID NO: 2021307 - RNA, 15 nt, Shigella flexneri 2a str. 301
aaaagagcaucagca

SEQ ID NO: 2021308 - RNA, 13 nt, Shigella flexneri 2a str. 301
aaaacaucaugau

SEQ ID NO: 2021309 - RNA, 22 nt, Shigella flexneri 2a str. 301
aaaacaucaugauucacaguua

SEQ ID NO: 2021310 - RNA, 14 nt, Shigella flexneri 2a str. 301
aaaacacucuuuuu

SEQ ID NO: 2021311 - RNA, 18 nt, Shigella flexneri 2a str. 301
aaaacauugccguaagca

SEQ ID NO: 2021312 - RNA, 13 nt, Shigella flexneri 2a str. 301
aaaacacagcauc

SEQ ID NO: 2021313 - RNA, 19 nt, Shigella flexneri 2a str. 301
aaaacaaugggaaaacagg

SEQ ID NO: 2021314 - RNA, 15 nt, Shigella flexneri 2a str. 301
aaaacacucuucaac

SEQ ID NO: 2021315 - RNA, 15 nt, Shigella flexneri 2a str. 301
aaaaauuacaaaaag

SEQ ID NO: 2021316 - RNA, 16 nt, Shigella flexneri 2a str. 301
aaaaauuacaaaaagu

SEQ ID NO: 2021317 - RNA, 18 nt, Shigella flexneri 2a str. 301
aaaaauuaacaaaacaau

SEQ ID NO: 2021318 - RNA, 23 nt, Shigella flexneri 2a str. 301
aaaaauuagcaauaccauuuaca

SEQ ID NO: 2021319 - RNA, 18 nt, Shigella flexneri 2a str. 301
aaaaaucgacaaaaucgg

SEQ ID NO: 2021320 - RNA, 20 nt, Shigella flexneri 2a str. 301
aaaaaucaugcaauaaauau

SEQ ID NO: 2021321 - RNA, 22 nt, Shigella flexneri 2a str. 301
aaaaauccagauuuauaaaaga

SEQ ID NO: 2021322 - RNA, 21 nt, Shigella flexneri 2a str. 301
aaaaauaguuacuaucuucaa

SEQ ID NO: 2021323 - RNA, 14 nt, Shigella flexneri 2a str. 301
aaaaauaccgagca

SEQ ID NO: 2021324 - RNA, 16 nt, Shigella flexneri 2a str. 301
aaaaauaccgagcagc

SEQ ID NO: 2021325 - RNA, 13 nt, Shigella flexneri 2a str. 301
aaaaauaccucau

SEQ ID NO: 2021326 - RNA, 15 nt, Shigella flexneri 2a str. 301
aaaaauaauuuuaaa

SEQ ID NO: 2021327 - RNA, 15 nt, Shigella flexneri 2a str. 301
aaaaauaaucugauu

SEQ ID NO: 2021328 - RNA, 12 nt, Shigella flexneri 2a str. 301
aaaaaccagaga

SEQ ID NO: 2021329 - RNA, 15 nt, Shigella flexneri 2a str. 301
aaaaaccagacgaua

SEQ ID NO: 2021330 - RNA, 22 nt, Shigella flexneri 2a str. 301
aaaaaccagaaagggaagaaca

SEQ ID NO: 2021331 - RNA, 11 nt, Shigella flexneri 2a str. 301
aaaaauaaaag

SEQ ID NO: 2021332 - RNA, 14 nt, Shigella flexneri 2a str. 301
aaaaauaaucaucu

SEQ ID NO: 2021333 - RNA, 17 nt, Shigella flexneri 2a str. 301
aaacgcccaaugcccag

SEQ ID NO: 2021334 - RNA, 17 nt, Shigella flexneri 2a str. 301
aaacgccguucuucagc

SEQ ID NO: 2021335 - RNA, 15 nt, Shigella flexneri 2a str. 301
aaacgcaacauugcc

SEQ ID NO: 2021336 - RNA, 16 nt, Shigella flexneri 2a str. 301
aaacgcagucuuccca

SEQ ID NO: 2021337 - RNA, 13 nt, Shigella flexneri 2a str. 301
aaacgccagcagc

SEQ ID NO: 2021338 - RNA, 18 nt, Shigella flexneri 2a str. 301
aaacgccaccuguuucuu

SEQ ID NO: 2021339 - RNA, 18 nt, Shigella flexneri 2a str. 301
aaacgacacugcucgcag

SEQ ID NO: 2021340 - RNA, 18 nt, Shigella flexneri 2a str. 301
aaaccuguugaaauuauu

SEQ ID NO: 2021341 - RNA, 16 nt, Shigella flexneri 2a str. 301
aaaccuguugaaauua

SEQ ID NO: 2021342 - RNA, 21 nt, Shigella flexneri 2a str. 301
aaaccuucuugacgcugauuu

SEQ ID NO: 2021343 - RNA, 22 nt, Shigella flexneri 2a str. 301
aaacgaauggcaaaacggcucu

SEQ ID NO: 2021344 - RNA, 18 nt, Shigella flexneri 2a str. 301
aaacgaaccauaaaauca

SEQ ID NO: 2021345 - RNA, 16 nt, Shigella flexneri 2a str. 301
aaacaagcccaugagc

SEQ ID NO: 2021346 - RNA, 20 nt, Shigella flexneri 2a str. 301
aaaccuguauacgcauauca

SEQ ID NO: 2021347 - RNA, 17 nt, Shigella flexneri 2a str. 301
aaaccugauuacgcacc

SEQ ID NO: 2021348 - RNA, 14 nt, Shigella flexneri 2a str. 301
aaacuaaaaacagc

SEQ ID NO: 2021349 - RNA, 16 nt, Shigella flexneri 2a str. 301
aaacuaacaguguuuc

SEQ ID NO: 2021350 - RNA, 20 nt, Shigella flexneri 2a str. 301
aaacguuagcacgaaccguc

SEQ ID NO: 2021351 - RNA, 22 nt, Shigella flexneri 2a str. 301
aaacguugucaguucuuuuauu

SEQ ID NO: 2021352 - RNA, 13 nt, Shigella flexneri 2a str. 301
aaacguuuaaaaa

SEQ ID NO: 2021353 - RNA, 15 nt, Shigella flexneri 2a str. 301
aaacguuuaaaaacu

SEQ ID NO: 2021354 - RNA, 15 nt, Shigella flexneri 2a str. 301
aaacgucucacuaac

SEQ ID NO: 2021355 - RNA, 20 nt, Shigella flexneri 2a str. 301
aaacgguuucagcagcggca

SEQ ID NO: 2021356 - RNA, 15 nt, Shigella flexneri 2a str. 301
aaacggugaucaaaa

SEQ ID NO: 2021357 - RNA, 17 nt, Shigella flexneri 2a str. 301
aaacggucccucaacaa

SEQ ID NO: 2021358 - RNA, 22 nt, Shigella flexneri 2a str. 301
aaacgggggcgauuuuccucca

SEQ ID NO: 2021359 - RNA, 22 nt, Shigella flexneri 2a str. 301
aaacggaaagcagauaacccag

SEQ ID NO: 2021360 - RNA, 21 nt, Shigella flexneri 2a str. 301
aaacgcuuauaguaacguuug

SEQ ID NO: 2021361 - RNA, 15 nt, Shigella flexneri 2a str. 301
aaacggcacgaugag

SEQ ID NO: 2021362 - RNA, 12 nt, Shigella flexneri 2a str. 301
aaacgcucggca

SEQ ID NO: 2021363 - RNA, 15 nt, Shigella flexneri 2a str. 301
aaacgcucucucagu

SEQ ID NO: 2021364 - RNA, 22 nt, Shigella flexneri 2a str. 301
aaacgcuggcagcauuucucua

SEQ ID NO: 2021365 - RNA, 16 nt, Shigella flexneri 2a str. 301
aaacgcucccugccag

SEQ ID NO: 2021366 - RNA, 14 nt, Shigella flexneri 2a str. 301
aaacgcgaccgccg

SEQ ID NO: 2021367 - RNA, 22 nt, Shigella flexneri 2a str. 301
aaacgccuuauccagccuacaa

SEQ ID NO: 2021368 - RNA, 22 nt, Shigella flexneri 2a str. 301
aaacuaaucgacaguugcugcg

SEQ ID NO: 2021369 - RNA, 16 nt, Shigella flexneri 2a str. 301
aaacucucaaaacaac

SEQ ID NO: 2021370 - RNA, 17 nt, Shigella flexneri 2a str. 301
aaacucucaaaacaaca

SEQ ID NO: 2021371 - RNA, 17 nt, Shigella flexneri 2a str. 301
aaacucucaucuuugaa

SEQ ID NO: 2021372 - RNA, 20 nt, Shigella flexneri 2a str. 301
aaacucgcgcaggcugacau

SEQ ID NO: 2021373 - RNA, 14 nt, Shigella flexneri 2a str. 301
aaacuccagcccuu

SEQ ID NO: 2021374 - RNA, 18 nt, Shigella flexneri 2a str. 301
aaacucauaaauucaaag

SEQ ID NO: 2021375 - RNA, 14 nt, Shigella flexneri 2a str. 301
aaacucaugggucu

SEQ ID NO: 2021376 - RNA, 23 nt, Shigella flexneri 2a str. 301
aaacucaggcuggcaagcugcug

SEQ ID NO: 2021377 - RNA, 18 nt, Shigella flexneri 2a str. 301
aaacuggugguaagaaua

SEQ ID NO: 2021378 - RNA, 15 nt, Shigella flexneri 2a str. 301
aaacuggauuacaaa

SEQ ID NO: 2021379 - RNA, 15 nt, Shigella flexneri 2a str. 301
aaacuguuuacaggc

SEQ ID NO: 2021380 - RNA, 22 nt, Shigella flexneri 2a str. 301
aaacugcgucgacauagccauc

SEQ ID NO: 2021381 - RNA, 15 nt, Shigella flexneri 2a str. 301
aaacugccugauacu

SEQ ID NO: 2021382 - RNA, 14 nt, Shigella flexneri 2a str. 301
aaacuggaaaaaua

SEQ ID NO: 2021383 - RNA, 14 nt, Shigella flexneri 2a str. 301
aaacugaugcccua

SEQ ID NO: 2021384 - RNA, 17 nt, Shigella flexneri 2a str. 301
aaacuucguuagguucu

SEQ ID NO: 2021385 - RNA, 14 nt, Shigella flexneri 2a str. 301
aaacuucugccgga

SEQ ID NO: 2021386 - RNA, 14 nt, Shigella flexneri 2a str. 301
aaacuucacuuccc

SEQ ID NO: 2021387 - RNA, 21 nt, Shigella flexneri 2a str. 301
aaacuuuaauuuuucaauauc

SEQ ID NO: 2021388 - RNA, 22 nt, Shigella flexneri 2a str. 301
aaacuugaacgcgagaaaagca

SEQ ID NO: 2021389 - RNA, 17 nt, Shigella flexneri 2a str. 301
aaacuugcguaucgacc

SEQ ID NO: 2021390 - RNA, 19 nt, Shigella flexneri 2a str. 301
aaagagcauuacacgcggc

SEQ ID NO: 2021391 - RNA, 15 nt, Shigella flexneri 2a str. 301
aaagagcaucagcag

SEQ ID NO: 2021392 - RNA, 16 nt, Shigella flexneri 2a str. 301
aaagagaacucuuuuu

SEQ ID NO: 2021393 - RNA, 17 nt, Shigella flexneri 2a str. 301
aaagagaacucuuuuuu

SEQ ID NO: 2021394 - RNA, 16 nt, Shigella flexneri 2a str. 301
aaagagacgcugaaaa

SEQ ID NO: 2021395 - RNA, 16 nt, Shigella flexneri 2a str. 301
aaagagaguuacuggc

SEQ ID NO: 2021396 - RNA, 13 nt, Shigella flexneri 2a str. 301
aaagagaacucuu

SEQ ID NO: 2021397 - RNA, 20 nt, Shigella flexneri 2a str. 301
aaacuuuucccuacugcuga

SEQ ID NO: 2021398 - RNA, 13 nt, Shigella flexneri 2a str. 301
aaagacguuaaaa

SEQ ID NO: 2021399 - RNA, 14 nt, Shigella flexneri 2a str. 301
aaagccaacagcag

SEQ ID NO: 2021400 - RNA, 18 nt, Shigella flexneri 2a str. 301
aaagcauuuuuucacaug

SEQ ID NO: 2021401 - RNA, 16 nt, Shigella flexneri 2a str. 301
aaagcauuuuuucaca

SEQ ID NO: 2021402 - RNA, 14 nt, Shigella flexneri 2a str. 301
aaagccaaccugcg

SEQ ID NO: 2021403 - RNA, 20 nt, Shigella flexneri 2a str. 301
aaagccaaccugcggguugg

SEQ ID NO: 2021404 - RNA, 15 nt, Shigella flexneri 2a str. 301
aaagccaacagcagc

SEQ ID NO: 2021405 - RNA, 22 nt, Shigella flexneri 2a str. 301
aaagccaauuaacgaaaucuca

SEQ ID NO: 2021406 - RNA, 17 nt, Shigella flexneri 2a str. 301
aaagcagagcagggaag

SEQ ID NO: 2021407 - RNA, 21 nt, Shigella flexneri 2a str. 301
aaagcagacggcugucaucca

SEQ ID NO: 2021408 - RNA, 19 nt, Shigella flexneri 2a str. 301
aaagcagacaacccacaca

SEQ ID NO: 2021409 - RNA, 13 nt, Shigella flexneri 2a str. 301
aaagauuuuacca

SEQ ID NO: 2021410 - RNA, 21 nt, Shigella flexneri 2a str. 301
aaagauaccagacauguggau

SEQ ID NO: 2021411 - RNA, 21 nt, Shigella flexneri 2a str. 301
aaagcugcugaccaccagcac

SEQ ID NO: 2021412 - RNA, 19 nt, Shigella flexneri 2a str. 301
aaagcugcugaccaccagc

SEQ ID NO: 2021413 - RNA, 21 nt, Shigella flexneri 2a str. 301
aaagcugggauggcaaaaccu

SEQ ID NO: 2021414 - RNA, 23 nt, Shigella flexneri 2a str. 301
aaaggaacaaggguaagggagga

SEQ ID NO: 2021415 - RNA, 23 nt, Shigella flexneri 2a str. 301
aaaggacagugggauuaaaaagu

SEQ ID NO: 2021416 - RNA, 16 nt, Shigella flexneri 2a str. 301
aaaggcaaaaugccag

SEQ ID NO: 2021417 - RNA, 16 nt, Shigella flexneri 2a str. 301
aaaggcacaaggguga

SEQ ID NO: 2021418 - RNA, 16 nt, Shigella flexneri 2a str. 301
aaaggcaacaugaaac

SEQ ID NO: 2021419 - RNA, 18 nt, Shigella flexneri 2a str. 301
aaaggcaacaugaaacag

SEQ ID NO: 2021420 - RNA, 18 nt, Shigella flexneri 2a str. 301
aaagccgguuuugguuaa

SEQ ID NO: 2021421 - RNA, 15 nt, Shigella flexneri 2a str. 301
aaagcuaacagagcc

SEQ ID NO: 2021422 - RNA, 21 nt, Shigella flexneri 2a str. 301
aaagcccuugccgaugcggga

SEQ ID NO: 2021423 - RNA, 15 nt, Shigella flexneri 2a str. 301
aaagcccucaccgaa

SEQ ID NO: 2021424 - RNA, 14 nt, Shigella flexneri 2a str. 301
aaagccccaccagc

SEQ ID NO: 2021425 - RNA, 23 nt, Shigella flexneri 2a str. 301
aaagcccccgcaacauugcgccu

SEQ ID NO: 2021426 - RNA, 14 nt, Shigella flexneri 2a str. 301
aaaguaaaaaagaa

SEQ ID NO: 2021427 - RNA, 20 nt, Shigella flexneri 2a str. 301
aaagguuuccucaugcauaa

SEQ ID NO: 2021428 - RNA, 16 nt, Shigella flexneri 2a str. 301
aaagggggcgacauuu

SEQ ID NO: 2021429 - RNA, 15 nt, Shigella flexneri 2a str. 301
aaagggaugccccca

SEQ ID NO: 2021430 - RNA, 20 nt, Shigella flexneri 2a str. 301
aaagggcuaacgugcagguu

SEQ ID NO: 2021431 - RNA, 23 nt, Shigella flexneri 2a str. 301
aaaggccgcaggcuguuaccccu

SEQ ID NO: 2021432 - RNA, 22 nt, Shigella flexneri 2a str. 301
aaagucacgccaauaaucgauu

SEQ ID NO: 2021433 - RNA, 20 nt, Shigella flexneri 2a str. 301
aaaguacagaugccaaucag

SEQ ID NO: 2021434 - RNA, 16 nt, Shigella flexneri 2a str. 301
aaaguacuucacaauc

SEQ ID NO: 2021435 - RNA, 14 nt, Shigella flexneri 2a str. 301
aaaucagaaaucac

SEQ ID NO: 2021436 - RNA, 21 nt, Shigella flexneri 2a str. 301
aaaucacgcugcugauuaaaa

SEQ ID NO: 2021437 - RNA, 13 nt, Shigella flexneri 2a str. 301
aaaucacgcaucg

SEQ ID NO: 2021438 - RNA, 22 nt, Shigella flexneri 2a str. 301
aaaucacuauuaaagaaaguaa

SEQ ID NO: 2021439 - RNA, 16 nt, Shigella flexneri 2a str. 301
aaaucacuaaacccga

SEQ ID NO: 2021440 - RNA, 22 nt, Shigella flexneri 2a str. 301
aaaucacuaaacccgaccacuu

SEQ ID NO: 2021441 - RNA, 20 nt, Shigella flexneri 2a str. 301
aaaucacuauuaaagaaagu

SEQ ID NO: 2021442 - RNA, 15 nt, Shigella flexneri 2a str. 301
aaaucauaaaaauca

SEQ ID NO: 2021443 - RNA, 19 nt, Shigella flexneri 2a str. 301
aaaucagguggcuauaaau

SEQ ID NO: 2021444 - RNA, 14 nt, Shigella flexneri 2a str. 301
aaaucaagcgccgc

SEQ ID NO: 2021445 - RNA, 22 nt, Shigella flexneri 2a str. 301
aaaucaacgacaaaaauaccac

SEQ ID NO: 2021446 - RNA, 12 nt, Shigella flexneri 2a str. 301
aaaucaaugguc

SEQ ID NO: 2021447 - RNA, 11 nt, Shigella flexneri 2a str. 301
aaaucaccaca

SEQ ID NO: 2021448 - RNA, 17 nt, Shigella flexneri 2a str. 301
aaaucaccgccaccagc

SEQ ID NO: 2021449 - RNA, 17 nt, Shigella flexneri 2a str. 301
aaauaugaaaucucuug

SEQ ID NO: 2021450 - RNA, 17 nt, Shigella flexneri 2a str. 301
aaauauuauuggcaucg

SEQ ID NO: 2021451 - RNA, 23 nt, Shigella flexneri 2a str. 301
aaauagugccuggcugcgugagg

SEQ ID NO: 2021452 - RNA, 15 nt, Shigella flexneri 2a str. 301
aaaucaaacagaaua

SEQ ID NO: 2021453 - RNA, 19 nt, Shigella flexneri 2a str. 301
aaaucaaaaaacuggaaaa

SEQ ID NO: 2021454 - RNA, 15 nt, Shigella flexneri 2a str. 301
aaauauugagcagaa

SEQ ID NO: 2021455 - RNA, 17 nt, Shigella flexneri 2a str. 301
aaauauugaugggaagc

SEQ ID NO: 2021456 - RNA, 23 nt, Shigella flexneri 2a str. 301
aaauaaucccgcgcaacaaauaa

SEQ ID NO: 2021457 - RNA, 14 nt, Shigella flexneri 2a str. 301
aaauaauccgcugu

SEQ ID NO: 2021458 - RNA, 19 nt, Shigella flexneri 2a str. 301
aaauaaucuauugauuuaa

SEQ ID NO: 2021459 - RNA, 21 nt, Shigella flexneri 2a str. 301
aaauaaucgcaauuacccagu

SEQ ID NO: 2021460 - RNA, 19 nt, Shigella flexneri 2a str. 301
aaauaaucgggaauacaga

SEQ ID NO: 2021461 - RNA, 19 nt, Shigella flexneri 2a str. 301
aaauacguaggccugauaa

SEQ ID NO: 2021462 - RNA, 23 nt, Shigella flexneri 2a str. 301
aaauacgcuuuuucccugguaaa

SEQ ID NO: 2021463 - RNA, 15 nt, Shigella flexneri 2a str. 301
aaauagcucaaugaa

SEQ ID NO: 2021464 - RNA, 17 nt, Shigella flexneri 2a str. 301
aaauagcuguuuauuua

SEQ ID NO: 2021465 - RNA, 23 nt, Shigella flexneri 2a str. 301
aaauagccagcagagcaaaaauc

SEQ ID NO: 2021466 - RNA, 17 nt, Shigella flexneri 2a str. 301
aaauagccaauucccag

SEQ ID NO: 2021467 - RNA, 17 nt, Shigella flexneri 2a str. 301
aaauagcauaauauaac

SEQ ID NO: 2021468 - RNA, 18 nt, Shigella flexneri 2a str. 301
aaauacuggcuaagaagc

SEQ ID NO: 2021469 - RNA, 19 nt, Shigella flexneri 2a str. 301
aaauacuggcuaagaagcc

SEQ ID NO: 2021470 - RNA, 17 nt, Shigella flexneri 2a str. 301
aaauacuggcuaagaag

SEQ ID NO: 2021471 - RNA, 14 nt, Shigella flexneri 2a str. 301
aaauacuuaaacag

SEQ ID NO: 2021472 - RNA, 23 nt, Shigella flexneri 2a str. 301
aaauacuguuuaccggugccagc

SEQ ID NO: 2021473 - RNA, 14 nt, Shigella flexneri 2a str. 301
aaauaacaucgcca

SEQ ID NO: 2021474 - RNA, 12 nt, Shigella flexneri 2a str. 301
aaauaaccacaa

SEQ ID NO: 2021475 - RNA, 23 nt, Shigella flexneri 2a str. 301
aaauaaaugcuugacucuguagc

SEQ ID NO: 2021476 - RNA, 14 nt, Shigella flexneri 2a str. 301
aaauaaauguguuu

SEQ ID NO: 2021477 - RNA, 23 nt, Shigella flexneri 2a str. 301
aaauaacgccggagagaaaaacc

SEQ ID NO: 2021478 - RNA, 23 nt, Shigella flexneri 2a str. 301
aaauaacgccccggcaaaaccau

SEQ ID NO: 2021479 - RNA, 22 nt, Shigella flexneri 2a str. 301
aaauaacuggugcuaacagcaa

SEQ ID NO: 2021480 - RNA, 13 nt, Shigella flexneri 2a str. 301
aaauaagaaaagc

SEQ ID NO: 2021481 - RNA, 20 nt, Shigella flexneri 2a str. 301
aaauaagaugcgaguaaaca

SEQ ID NO: 2021482 - RNA, 19 nt, Shigella flexneri 2a str. 301
aaauaagcacgguuaacac

SEQ ID NO: 2021483 - RNA, 13 nt, Shigella flexneri 2a str. 301
aaauaauacacac

SEQ ID NO: 2021484 - RNA, 19 nt, Shigella flexneri 2a str. 301
aaauaauacacacaucaau

SEQ ID NO: 2021485 - RNA, 21 nt, Shigella flexneri 2a str. 301
aaauaauaagagcguccagau

SEQ ID NO: 2021486 - RNA, 18 nt, Shigella flexneri 2a str. 301
aaauucgaaauagagaaa

SEQ ID NO: 2021487 - RNA, 15 nt, Shigella flexneri 2a str. 301
aaauucagcauuacc

SEQ ID NO: 2021488 - RNA, 18 nt, Shigella flexneri 2a str. 301
aaauucagcaguuuuugc

SEQ ID NO: 2021489 - RNA, 19 nt, Shigella flexneri 2a str. 301
aaauucagcaguuuuugca

SEQ ID NO: 2021490 - RNA, 14 nt, Shigella flexneri 2a str. 301
aaauuauuaccauc

SEQ ID NO: 2021491 - RNA, 20 nt, Shigella flexneri 2a str. 301
aaauuauccagcuuuuccca

SEQ ID NO: 2021492 - RNA, 14 nt, Shigella flexneri 2a str. 301
aaauuauccagcuu

SEQ ID NO: 2021493 - RNA, 22 nt, Shigella flexneri 2a str. 301
aaauguuaagacuggcaaagca

SEQ ID NO: 2021494 - RNA, 18 nt, Shigella flexneri 2a str. 301
aaaugugguuucacuuuc

SEQ ID NO: 2021495 - RNA, 14 nt, Shigella flexneri 2a str. 301
aaauguguaaucag

SEQ ID NO: 2021496 - RNA, 20 nt, Shigella flexneri 2a str. 301
aaauuaaaucgguauuucca

SEQ ID NO: 2021497 - RNA, 23 nt, Shigella flexneri 2a str. 301
aaauuaaacugucgucgcuuuca

SEQ ID NO: 2021498 - RNA, 19 nt, Shigella flexneri 2a str. 301
aaauuaaaugguuaacaug

SEQ ID NO: 2021499 - RNA, 16 nt, Shigella flexneri 2a str. 301
aaauguugucucagau

SEQ ID NO: 2021500 - RNA, 16 nt, Shigella flexneri 2a str. 301
aaauuaacaaaacaau

SEQ ID NO: 2021501 - RNA, 13 nt, Shigella flexneri 2a str. 301
aaaaaggcaugca

SEQ ID NO: 2021502 - RNA, 19 nt, Shigella flexneri 2a str. 301
aaaaaggcgaaaggcuggc

SEQ ID NO: 2021503 - RNA, 14 nt, Shigella flexneri 2a str. 301
aaauuacaaaaagu

SEQ ID NO: 2021504 - RNA, 16 nt, Shigella flexneri 2a str. 301
aaauuacccuuuauuu

SEQ ID NO: 2021505 - RNA, 22 nt, Shigella flexneri 2a str. 301
aaauuaccgcaccaccagcagc

SEQ ID NO: 2021506 - RNA, 14 nt, Shigella flexneri 2a str. 301
aaaaagccggauga

SEQ ID NO: 2021507 - RNA, 16 nt, Shigella flexneri 2a str. 301
aaaaagccuaagaagu

SEQ ID NO: 2021508 - RNA, 16 nt, Shigella flexneri 2a str. 301
aaaaagcauuuaauac

SEQ ID NO: 2021509 - RNA, 18 nt, Shigella flexneri 2a str. 301
aaaaagcguauccugacg

SEQ ID NO: 2021510 - RNA, 19 nt, Shigella flexneri 2a str. 301
aaaaagcguauccugacgg

SEQ ID NO: 2021511 - RNA, 14 nt, Shigella flexneri 2a str. 301
aaaucaugcaauaa

SEQ ID NO: 2021512 - RNA, 15 nt, Shigella flexneri 2a str. 301
aaaucaugaaugcaa

SEQ ID NO: 2021513 - RNA, 22 nt, Shigella flexneri 2a str. 301
aaaucauauaucgcaagucauu

SEQ ID NO: 2021514 - RNA, 19 nt, Shigella flexneri 2a str. 301
aaaucaucauugcuguuuu

SEQ ID NO: 2021515 - RNA, 21 nt, Shigella flexneri 2a str. 301
aaaucauccagacugcucagc

SEQ ID NO: 2021516 - RNA, 16 nt, Shigella flexneri 2a str. 301
aaaucauccagacugc

SEQ ID NO: 2021517 - RNA, 18 nt, Shigella flexneri 2a str. 301
aaaucgcaagaucucauu

SEQ ID NO: 2021518 - RNA, 20 nt, Shigella flexneri 2a str. 301
aaaucgccaacaaucucuuc

SEQ ID NO: 2021519 - RNA, 17 nt, Shigella flexneri 2a str. 301
aaaucuauuauuauuuu

SEQ ID NO: 2021520 - RNA, 15 nt, Shigella flexneri 2a str. 301
aaaucuauugcaaca

SEQ ID NO: 2021521 - RNA, 21 nt, Shigella flexneri 2a str. 301
aaaucucagcccgaugauaaa

SEQ ID NO: 2021522 - RNA, 11 nt, Shigella flexneri 2a str. 301
aaaucuccauu

SEQ ID NO: 2021523 - RNA, 14 nt, Shigella flexneri 2a str. 301
aaaucuccauuuca

SEQ ID NO: 2021524 - RNA, 13 nt, Shigella flexneri 2a str. 301
aaaucuccauuuc

SEQ ID NO: 2021525 - RNA, 13 nt, Shigella flexneri 2a str. 301
aaaugauuuccug

SEQ ID NO: 2021526 - RNA, 18 nt, Shigella flexneri 2a str. 301
aaaugauggucuggugua

SEQ ID NO: 2021527 - RNA, 12 nt, Shigella flexneri 2a str. 301
aaaugaaaaaau

SEQ ID NO: 2021528 - RNA, 15 nt, Shigella flexneri 2a str. 301
aaaugcgcucagggu

SEQ ID NO: 2021529 - RNA, 11 nt, Shigella flexneri 2a str. 301
aaaugcgcaug

SEQ ID NO: 2021530 - RNA, 18 nt, Shigella flexneri 2a str. 301
aaaugcgcuuuauucaga

SEQ ID NO: 2021531 - RNA, 14 nt, Shigella flexneri 2a str. 301
aaaugccuuucuca

SEQ ID NO: 2021532 - RNA, 19 nt, Shigella flexneri 2a str. 301
aaaugccuuucucagaagu

SEQ ID NO: 2021533 - RNA, 16 nt, Shigella flexneri 2a str. 301
aaaugcgacaacuggc

SEQ ID NO: 2021534 - RNA, 18 nt, Shigella flexneri 2a str. 301
aaaugcccgauaagcaaa

SEQ ID NO: 2021535 - RNA, 12 nt, Shigella flexneri 2a str. 301
aaaugauuuccu

SEQ ID NO: 2021536 - RNA, 22 nt, Shigella flexneri 2a str. 301
aaaugcguggcgcguaccgccg

SEQ ID NO: 2021537 - RNA, 19 nt, Shigella flexneri 2a str. 301
aaaugcugcuuuauauucu

SEQ ID NO: 2021538 - RNA, 16 nt, Shigella flexneri 2a str. 301
aaguuuuuaugaguuu

SEQ ID NO: 2021539 - RNA, 14 nt, Shigella flexneri 2a str. 301
aaguuuuuucuucc

SEQ ID NO: 2021540 - RNA, 12 nt, Shigella flexneri 2a str. 301
aaguuuuuauga

SEQ ID NO: 2021541 - RNA, 21 nt, Shigella flexneri 2a str. 301
aaguuuuagcaugcaggcugg

SEQ ID NO: 2021542 - RNA, 13 nt, Shigella flexneri 2a str. 301
aaguuuuccucag

SEQ ID NO: 2021543 - RNA, 12 nt, Shigella flexneri 2a str. 301
aaguuuuccuca

SEQ ID NO: 2021544 - RNA, 21 nt, Shigella flexneri 2a str. 301
aauaaacaaugagauauuuaa

SEQ ID NO: 2021545 - RNA, 18 nt, Shigella flexneri 2a str. 301
aauaaaauucuccagcgc

SEQ ID NO: 2021546 - RNA, 11 nt, Shigella flexneri 2a str. 301
aauaaaacagg

SEQ ID NO: 2021547 - RNA, 14 nt, Shigella flexneri 2a str. 301
aauaaaacagggcg

SEQ ID NO: 2021548 - RNA, 14 nt, Shigella flexneri 2a str. 301
aauaaaaauugaau

SEQ ID NO: 2021549 - RNA, 14 nt, Shigella flexneri 2a str. 301
aauaaaacaucacc

SEQ ID NO: 2021550 - RNA, 13 nt, Shigella flexneri 2a str. 301
aauaaaauaucuu

SEQ ID NO: 2021551 - RNA, 14 nt, Shigella flexneri 2a str. 301
aauaaaauaucuuc

SEQ ID NO: 2021552 - RNA, 19 nt, Shigella flexneri 2a str. 301
aauaaacaugaugaucuua

SEQ ID NO: 2021553 - RNA, 22 nt, Shigella flexneri 2a str. 301
aauaaacaugaugaucuuauga

SEQ ID NO: 2021554 - RNA, 22 nt, Shigella flexneri 2a str. 301
aauaaaccugccuuacauauca

SEQ ID NO: 2021555 - RNA, 12 nt, Shigella flexneri 2a str. 301
aauaaauagauc

SEQ ID NO: 2021556 - RNA, 18 nt, Shigella flexneri 2a str. 301
aauaaauacacuauaaaa

SEQ ID NO: 2021557 - RNA, 20 nt, Shigella flexneri 2a str. 301
aauaaauacacuauaaaaua

SEQ ID NO: 2021558 - RNA, 21 nt, Shigella flexneri 2a str. 301
aauaaagccuauccagaagcc

SEQ ID NO: 2021559 - RNA, 16 nt, Shigella flexneri 2a str. 301
aauaacacauauauua

SEQ ID NO: 2021560 - RNA, 17 nt, Shigella flexneri 2a str. 301
aauaacacauauauuaa

SEQ ID NO: 2021561 - RNA, 18 nt, Shigella flexneri 2a str. 301
aauaacaauacuuauaaa

SEQ ID NO: 2021562 - RNA, 20 nt, Shigella flexneri 2a str. 301
aauaacaauacuuauaaacc

SEQ ID NO: 2021563 - RNA, 23 nt, Shigella flexneri 2a str. 301
aaguggcggggucgugcagaacg

SEQ ID NO: 2021564 - RNA, 23 nt, Shigella flexneri 2a str. 301
aaguggcgcagagccugaauaaa

SEQ ID NO: 2021565 - RNA, 17 nt, Shigella flexneri 2a str. 301
aaguggcgauacagugc

SEQ ID NO: 2021566 - RNA, 19 nt, Shigella flexneri 2a str. 301
aaguggacgaacaguucaa

SEQ ID NO: 2021567 - RNA, 18 nt, Shigella flexneri 2a str. 301
aagugaguugguuauuca

SEQ ID NO: 2021568 - RNA, 15 nt, Shigella flexneri 2a str. 301
aagugauuuuuaaua

SEQ ID NO: 2021569 - RNA, 19 nt, Shigella flexneri 2a str. 301
aaguaagaauugauaaaaa

SEQ ID NO: 2021570 - RNA, 18 nt, Shigella flexneri 2a str. 301
aaguaaggcgggaauaau

SEQ ID NO: 2021571 - RNA, 19 nt, Shigella flexneri 2a str. 301
aaguaacaauagcgaacag

SEQ ID NO: 2021572 - RNA, 23 nt, Shigella flexneri 2a str. 301
aagucuuccggugcaucaacaua

SEQ ID NO: 2021573 - RNA, 13 nt, Shigella flexneri 2a str. 301
aaguaaucuauau

SEQ ID NO: 2021574 - RNA, 15 nt, Shigella flexneri 2a str. 301
aaguaauaaugauca

SEQ ID NO: 2021575 - RNA, 23 nt, Shigella flexneri 2a str. 301
aaguugcucaagcugaacauuuu

SEQ ID NO: 2021576 - RNA, 18 nt, Shigella flexneri 2a str. 301
aaguugcgaaagcgagca

SEQ ID NO: 2021577 - RNA, 17 nt, Shigella flexneri 2a str. 301
aaguuccuguaaagagu

SEQ ID NO: 2021578 - RNA, 22 nt, Shigella flexneri 2a str. 301
aaguucguugguguccacgccg

SEQ ID NO: 2021579 - RNA, 23 nt, Shigella flexneri 2a str. 301
aaguuccgauaaucggugcggca

SEQ ID NO: 2021580 - RNA, 21 nt, Shigella flexneri 2a str. 301
aaguuauccugguacucgacu

SEQ ID NO: 2021581 - RNA, 14 nt, Shigella flexneri 2a str. 301
aaguuauaaggcgu

SEQ ID NO: 2021582 - RNA, 22 nt, Shigella flexneri 2a str. 301
aaguuagaguagccaauaccaa

SEQ ID NO: 2021583 - RNA, 16 nt, Shigella flexneri 2a str. 301
aaguuagaggcacaua

SEQ ID NO: 2021584 - RNA, 18 nt, Shigella flexneri 2a str. 301
aaguuagaggcacauagc

SEQ ID NO: 2021585 - RNA, 20 nt, Shigella flexneri 2a str. 301
aagugguguucuuuguguug

SEQ ID NO: 2021586 - RNA, 11 nt, Shigella flexneri 2a str. 301
aauaaucagau

SEQ ID NO: 2021587 - RNA, 22 nt, Shigella flexneri 2a str. 301
aauaaucaccacacaaccgagg

SEQ ID NO: 2021588 - RNA, 21 nt, Shigella flexneri 2a str. 301
aaaaaucaugcaauaaauaug

SEQ ID NO: 2021589 - RNA, 20 nt, Shigella flexneri 2a str. 301
aauaaucaacgcggcaauaa

SEQ ID NO: 2021590 - RNA, 18 nt, Shigella flexneri 2a str. 301
aauaaucgggaauacaga

SEQ ID NO: 2021591 - RNA, 18 nt, Shigella flexneri 2a str. 301
aauacagcaauggaaaaa

SEQ ID NO: 2021592 - RNA, 17 nt, Shigella flexneri 2a str. 301
aauacagcaauggaaaa

SEQ ID NO: 2021593 - RNA, 19 nt, Shigella flexneri 2a str. 301
aauacagcaauggaaaaag

SEQ ID NO: 2021594 - RNA, 20 nt, Shigella flexneri 2a str. 301
aauacagcaauggaaaaagu

SEQ ID NO: 2021595 - RNA, 16 nt, Shigella flexneri 2a str. 301
aauacagcaauggaaa

SEQ ID NO: 2021596 - RNA, 21 nt, Shigella flexneri 2a str. 301
aauacaggcgacgaguugcuu

SEQ ID NO: 2021597 - RNA, 19 nt, Shigella flexneri 2a str. 301
aauacagcuuaaucaccag

SEQ ID NO: 2021598 - RNA, 18 nt, Shigella flexneri 2a str. 301
aauacaggcuacucccag

SEQ ID NO: 2021599 - RNA, 23 nt, Shigella flexneri 2a str. 301
aauacagccagccagcaccaggc

SEQ ID NO: 2021600 - RNA, 21 nt, Shigella flexneri 2a str. 301
aauaauuuacagccugccagc

SEQ ID NO: 2021601 - RNA, 17 nt, Shigella flexneri 2a str. 301
aauacaacaacacccau

SEQ ID NO: 2021602 - RNA, 21 nt, Shigella flexneri 2a str. 301
aauaacgccccggcaaaacca

SEQ ID NO: 2021603 - RNA, 19 nt, Shigella flexneri 2a str. 301
aauaacggcucaaacugcu

SEQ ID NO: 2021604 - RNA, 18 nt, Shigella flexneri 2a str. 301
aauaaccugcaaaauagu

SEQ ID NO: 2021605 - RNA, 21 nt, Shigella flexneri 2a str. 301
aauaacgccggagagaaaaac

SEQ ID NO: 2021606 - RNA, 20 nt, Shigella flexneri 2a str. 301
aaaaauacccuguauaauag

SEQ ID NO: 2021607 - RNA, 22 nt, Shigella flexneri 2a str. 301
aauaauaccguucucuuuaaaa

SEQ ID NO: 2021608 - RNA, 22 nt, Shigella flexneri 2a str. 301
aauaacucacccaugaagaaua

SEQ ID NO: 2021609 - RNA, 13 nt, Shigella flexneri 2a str. 301
aaaaaucaauaaa

SEQ ID NO: 2021610 - RNA, 14 nt, Shigella flexneri 2a str. 301
aaaaaucaaaaaac

SEQ ID NO: 2021611 - RNA, 23 nt, Shigella flexneri 2a str. 301
aauaaucaacgcgauauaauaaa

SEQ ID NO: 2021612 - RNA, 15 nt, Shigella flexneri 2a str. 301
aauaauaucuccagc

SEQ ID NO: 2021613 - RNA, 12 nt, Shigella flexneri 2a str. 301
aauaauaucuuu

SEQ ID NO: 2021614 - RNA, 15 nt, Shigella flexneri 2a str. 301
aauaauauccuuucc

SEQ ID NO: 2021615 - RNA, 21 nt, Shigella flexneri 2a str. 301
aauacggcaaguaauaauauc

SEQ ID NO: 2021616 - RNA, 15 nt, Shigella flexneri 2a str. 301
aauacgucuuuagga

SEQ ID NO: 2021617 - RNA, 19 nt, Shigella flexneri 2a str. 301
aauacguugcuucaugccg

SEQ ID NO: 2021618 - RNA, 17 nt, Shigella flexneri 2a str. 301
aauacguuucauauccg

SEQ ID NO: 2021619 - RNA, 23 nt, Shigella flexneri 2a str. 301
aauacgcuggcugaacauuaaau

SEQ ID NO: 2021620 - RNA, 20 nt, Shigella flexneri 2a str. 301
aauacgcucgaacagcuggu

SEQ ID NO: 2021621 - RNA, 21 nt, Shigella flexneri 2a str. 301
aauacggauauucaucuccag

SEQ ID NO: 2021622 - RNA, 18 nt, Shigella flexneri 2a str. 301
aauacgcucgaacagcug

SEQ ID NO: 2021623 - RNA, 17 nt, Shigella flexneri 2a str. 301
aauacgcccaucauuca

SEQ ID NO: 2021624 - RNA, 19 nt, Shigella flexneri 2a str. 301
aauacgauccugagcagcc

SEQ ID NO: 2021625 - RNA, 23 nt, Shigella flexneri 2a str. 301
aauacaucaauuuucccuucuga

SEQ ID NO: 2021626 - RNA, 11 nt, Shigella flexneri 2a str. 301
aauacauauau

SEQ ID NO: 2021627 - RNA, 19 nt, Shigella flexneri 2a str. 301
aauaccgccugcaaauaaa

SEQ ID NO: 2021628 - RNA, 14 nt, Shigella flexneri 2a str. 301
aauaccgcccagac

SEQ ID NO: 2021629 - RNA, 14 nt, Shigella flexneri 2a str. 301
aauaccgcccacca

SEQ ID NO: 2021630 - RNA, 15 nt, Shigella flexneri 2a str. 301
aauaccgaagaguaa

SEQ ID NO: 2021631 - RNA, 21 nt, Shigella flexneri 2a str. 301
aauacccuugcagauauugca

SEQ ID NO: 2021632 - RNA, 19 nt, Shigella flexneri 2a str. 301
aauacuuucacaaaaauaa

SEQ ID NO: 2021633 - RNA, 18 nt, Shigella flexneri 2a str. 301
aauacuuucacaaaaaua

SEQ ID NO: 2021634 - RNA, 20 nt, Shigella flexneri 2a str. 301
aauacuuuuacucucuggac

SEQ ID NO: 2021635 - RNA, 20 nt, Shigella flexneri 2a str. 301
aauagaacuauaauugcuuu

SEQ ID NO: 2021636 - RNA, 13 nt, Shigella flexneri 2a str. 301
aauagaaacuggc

SEQ ID NO: 2021637 - RNA, 17 nt, Shigella flexneri 2a str. 301
aauagagaucucucuug

SEQ ID NO: 2021638 - RNA, 18 nt, Shigella flexneri 2a str. 301
aauagagaucucucuugc

SEQ ID NO: 2021639 - RNA, 12 nt, Shigella flexneri 2a str. 301
aauacuccccuu

SEQ ID NO: 2021640 - RNA, 21 nt, Shigella flexneri 2a str. 301
aauacucgucccguccuucau

SEQ ID NO: 2021641 - RNA, 15 nt, Shigella flexneri 2a str. 301
aauacugaucaucau

SEQ ID NO: 2021642 - RNA, 22 nt, Shigella flexneri 2a str. 301
aauacugaagucgaacuucucu

SEQ ID NO: 2021643 - RNA, 17 nt, Shigella flexneri 2a str. 301
aauacugacaucagcau

SEQ ID NO: 2021644 - RNA, 16 nt, Shigella flexneri 2a str. 301
aauacuuauaaaccac

SEQ ID NO: 2021645 - RNA, 19 nt, Shigella flexneri 2a str. 301
aagaugaaauaguugcauu

SEQ ID NO: 2021646 - RNA, 16 nt, Shigella flexneri 2a str. 301
aagaugaugucacagc

SEQ ID NO: 2021647 - RNA, 18 nt, Shigella flexneri 2a str. 301
aagaugacauugacaguu

SEQ ID NO: 2021648 - RNA, 14 nt, Shigella flexneri 2a str. 301
aagaauuaaaauau

SEQ ID NO: 2021649 - RNA, 22 nt, Shigella flexneri 2a str. 301
aagaugugagcgauacccauuu

SEQ ID NO: 2021650 - RNA, 22 nt, Shigella flexneri 2a str. 301
aagauguugacgccgucaaaac

SEQ ID NO: 2021651 - RNA, 14 nt, Shigella flexneri 2a str. 301
aagauguugccaca

SEQ ID NO: 2021652 - RNA, 19 nt, Shigella flexneri 2a str. 301
aagauguuguacagcgaaa

SEQ ID NO: 2021653 - RNA, 17 nt, Shigella flexneri 2a str. 301
aagaugguuauccagcu

SEQ ID NO: 2021654 - RNA, 19 nt, Shigella flexneri 2a str. 301
aagaugcaucauuaaugug

SEQ ID NO: 2021655 - RNA, 13 nt, Shigella flexneri 2a str. 301
aagauuacugaca

SEQ ID NO: 2021656 - RNA, 14 nt, Shigella flexneri 2a str. 301
aagauguuucuggu

SEQ ID NO: 2021657 - RNA, 22 nt, Shigella flexneri 2a str. 301
aagauuaagagaaccagcugcc

SEQ ID NO: 2021658 - RNA, 16 nt, Shigella flexneri 2a str. 301
aagauucguauuuaaa

SEQ ID NO: 2021659 - RNA, 21 nt, Shigella flexneri 2a str. 301
aagauugccggggauaucccc

SEQ ID NO: 2021660 - RNA, 15 nt, Shigella flexneri 2a str. 301
aagauuccagugccg

SEQ ID NO: 2021661 - RNA, 14 nt, Shigella flexneri 2a str. 301
aagcaagaacagcc

SEQ ID NO: 2021662 - RNA, 21 nt, Shigella flexneri 2a str. 301
aagcaauccauaccagcacau

SEQ ID NO: 2021663 - RNA, 15 nt, Shigella flexneri 2a str. 301
aagcaccacuccuca

SEQ ID NO: 2021664 - RNA, 21 nt, Shigella flexneri 2a str. 301
aagcaccauccuguuccacug

SEQ ID NO: 2021665 - RNA, 16 nt, Shigella flexneri 2a str. 301
aagcacccagcaaucc

SEQ ID NO: 2021666 - RNA, 21 nt, Shigella flexneri 2a str. 301
aagauuuuugcuugguucucc

SEQ ID NO: 2021667 - RNA, 21 nt, Shigella flexneri 2a str. 301
aagcaaccgccauccgcgaau

SEQ ID NO: 2021668 - RNA, 14 nt, Shigella flexneri 2a str. 301
aagcaaauguuaau

SEQ ID NO: 2021669 - RNA, 12 nt, Shigella flexneri 2a str. 301
aagcaacuccau

SEQ ID NO: 2021670 - RNA, 18 nt, Shigella flexneri 2a str. 301
aagcaacugacuggcucu

SEQ ID NO: 2021671 - RNA, 22 nt, Shigella flexneri 2a str. 301
aagcaaaaauaaaugcuugacu

SEQ ID NO: 2021672 - RNA, 13 nt, Shigella flexneri 2a str. 301
aagcaaaauguua

SEQ ID NO: 2021673 - RNA, 16 nt, Shigella flexneri 2a str. 301
aagcagagcagggaag

SEQ ID NO: 2021674 - RNA, 15 nt, Shigella flexneri 2a str. 301
aagcagauaacccag

SEQ ID NO: 2021675 - RNA, 18 nt, Shigella flexneri 2a str. 301
aagcagaucggcauucac

SEQ ID NO: 2021676 - RNA, 15 nt, Shigella flexneri 2a str. 301
aagcagaucuggaag

SEQ ID NO: 2021677 - RNA, 16 nt, Shigella flexneri 2a str. 301
aagcagauucuucgau

SEQ ID NO: 2021678 - RNA, 19 nt, Shigella flexneri 2a str. 301
aagcagcauguagaugccg

SEQ ID NO: 2021679 - RNA, 15 nt, Shigella flexneri 2a str. 301
aagcagcgaugcuuu

SEQ ID NO: 2021680 - RNA, 20 nt, Shigella flexneri 2a str. 301
aagcagcgcgcagaacauau

SEQ ID NO: 2021681 - RNA, 15 nt, Shigella flexneri 2a str. 301
aagcagaaaaagaag

SEQ ID NO: 2021682 - RNA, 20 nt, Shigella flexneri 2a str. 301
aagcacucugacggauagua

SEQ ID NO: 2021683 - RNA, 16 nt, Shigella flexneri 2a str. 301
aagcacugcaucaaug

SEQ ID NO: 2021684 - RNA, 19 nt, Shigella flexneri 2a str. 301
aagcacucguaagaggcgu

SEQ ID NO: 2021685 - RNA, 21 nt, Shigella flexneri 2a str. 301
aagcacuacucuauacaggau

SEQ ID NO: 2021686 - RNA, 18 nt, Shigella flexneri 2a str. 301
aagcaguuucaccagcag

SEQ ID NO: 2021687 - RNA, 17 nt, Shigella flexneri 2a str. 301
aagcaguuucaccagca

SEQ ID NO: 2021688 - RNA, 17 nt, Shigella flexneri 2a str. 301
aagcaggucggcucagc

SEQ ID NO: 2021689 - RNA, 12 nt, Shigella flexneri 2a str. 301
aagcaguccagc

SEQ ID NO: 2021690 - RNA, 21 nt, Shigella flexneri 2a str. 301
aagcaguccagcgccugacgc

SEQ ID NO: 2021691 - RNA, 13 nt, Shigella flexneri 2a str. 301
aagcauagcccca

SEQ ID NO: 2021692 - RNA, 23 nt, Shigella flexneri 2a str. 301
aagcaucgcaacgccuaaauccg

SEQ ID NO: 2021693 - RNA, 15 nt, Shigella flexneri 2a str. 301
aagccccguagccau

SEQ ID NO: 2021694 - RNA, 13 nt, Shigella flexneri 2a str. 301
aagccccagcagg

SEQ ID NO: 2021695 - RNA, 18 nt, Shigella flexneri 2a str. 301
aagcccauaccacagcaa

SEQ ID NO: 2021696 - RNA, 15 nt, Shigella flexneri 2a str. 301
aagcccauaccacag

SEQ ID NO: 2021697 - RNA, 21 nt, Shigella flexneri 2a str. 301
aagcccaaaucauaaaaauca

SEQ ID NO: 2021698 - RNA, 11 nt, Shigella flexneri 2a str. 301
aagcccagaac

SEQ ID NO: 2021699 - RNA, 22 nt, Shigella flexneri 2a str. 301
aagccauaucguucugccagau

SEQ ID NO: 2021700 - RNA, 20 nt, Shigella flexneri 2a str. 301
aagccaugcuuugcauccca

SEQ ID NO: 2021701 - RNA, 20 nt, Shigella flexneri 2a str. 301
aagccauguuuaacuccuuc

SEQ ID NO: 2021702 - RNA, 16 nt, Shigella flexneri 2a str. 301
aagccaccgaacaaaa

SEQ ID NO: 2021703 - RNA, 19 nt, Shigella flexneri 2a str. 301
aagccacugugcgcgccag

SEQ ID NO: 2021704 - RNA, 20 nt, Shigella flexneri 2a str. 301
aagcauuuuuucacauguuc

SEQ ID NO: 2021705 - RNA, 18 nt, Shigella flexneri 2a str. 301
aagcauuuucauccauua

SEQ ID NO: 2021706 - RNA, 18 nt, Shigella flexneri 2a str. 301
aagccaacagcagccaca

SEQ ID NO: 2021707 - RNA, 17 nt, Shigella flexneri 2a str. 301
aagcauucguaaugaau

SEQ ID NO: 2021708 - RNA, 18 nt, Shigella flexneri 2a str. 301
aagcauuauauaaugcca

SEQ ID NO: 2021709 - RNA, 19 nt, Shigella flexneri 2a str. 301
aagguucacuuaaucucug

SEQ ID NO: 2021710 - RNA, 19 nt, Shigella flexneri 2a str. 301
aagguugccauaucuuccc

SEQ ID NO: 2021711 - RNA, 14 nt, Shigella flexneri 2a str. 301
aagguugccugucu

SEQ ID NO: 2021712 - RNA, 16 nt, Shigella flexneri 2a str. 301
aagguuacccgcacgg

SEQ ID NO: 2021713 - RNA, 14 nt, Shigella flexneri 2a str. 301
aagguuguugaaag

SEQ ID NO: 2021714 - RNA, 12 nt, Shigella flexneri 2a str. 301
aagguuucugca

SEQ ID NO: 2021715 - RNA, 14 nt, Shigella flexneri 2a str. 301
aaggugggaggcgg

SEQ ID NO: 2021716 - RNA, 18 nt, Shigella flexneri 2a str. 301
aagguggcgaagugccag

SEQ ID NO: 2021717 - RNA, 22 nt, Shigella flexneri 2a str. 301
aagguggucagacggaacaucu

SEQ ID NO: 2021718 - RNA, 17 nt, Shigella flexneri 2a str. 301
aagguaucgcgaaaaaa

SEQ ID NO: 2021719 - RNA, 22 nt, Shigella flexneri 2a str. 301
aagguaucgcgaaaaaaaagau

SEQ ID NO: 2021720 - RNA, 22 nt, Shigella flexneri 2a str. 301
aagguaucgcacugaugugaca

SEQ ID NO: 2021721 - RNA, 16 nt, Shigella flexneri 2a str. 301
aaggucaccaguucac

SEQ ID NO: 2021722 - RNA, 13 nt, Shigella flexneri 2a str. 301
aaggucagacgaa

SEQ ID NO: 2021723 - RNA, 20 nt, Shigella flexneri 2a str. 301
aagguagaauaaggcuuucg

SEQ ID NO: 2021724 - RNA, 20 nt, Shigella flexneri 2a str. 301
aagguaaugcgcgagccaua

SEQ ID NO: 2021725 - RNA, 13 nt, Shigella flexneri 2a str. 301
aagguacgaaaaa

SEQ ID NO: 2021726 - RNA, 13 nt, Shigella flexneri 2a str. 301
aagguagaauaag

SEQ ID NO: 2021727 - RNA, 22 nt, Shigella flexneri 2a str. 301
aaggucaucaaucauuuuuuga

SEQ ID NO: 2021728 - RNA, 18 nt, Shigella flexneri 2a str. 301
aaggucauccaaaucgcc

SEQ ID NO: 2021729 - RNA, 17 nt, Shigella flexneri 2a str. 301
aaggucggcuuugaaua

SEQ ID NO: 2021730 - RNA, 18 nt, Shigella flexneri 2a str. 301
aaggucggcuuugaauau

SEQ ID NO: 2021731 - RNA, 23 nt, Shigella flexneri 2a str. 301
aaggucggcuuugaauaucuccu

SEQ ID NO: 2021732 - RNA, 16 nt, Shigella flexneri 2a str. 301
aaggugauauagaaaa

SEQ ID NO: 2021733 - RNA, 18 nt, Shigella flexneri 2a str. 301
aaggcgcgagguuuuccu

SEQ ID NO: 2021734 - RNA, 21 nt, Shigella flexneri 2a str. 301
aaggcgcugaaggcacagaaa

SEQ ID NO: 2021735 - RNA, 18 nt, Shigella flexneri 2a str. 301
aaggcgcucauuuucucu

SEQ ID NO: 2021736 - RNA, 18 nt, Shigella flexneri 2a str. 301
aaggcgcuuugcaccaga

SEQ ID NO: 2021737 - RNA, 16 nt, Shigella flexneri 2a str. 301
aaggcgggaauaauuu

SEQ ID NO: 2021738 - RNA, 15 nt, Shigella flexneri 2a str. 301
aaggcggcagaacag

SEQ ID NO: 2021739 - RNA, 12 nt, Shigella flexneri 2a str. 301
aaggcaaacugu

SEQ ID NO: 2021740 - RNA, 14 nt, Shigella flexneri 2a str. 301
aaggcguucacgcc

SEQ ID NO: 2021741 - RNA, 19 nt, Shigella flexneri 2a str. 301
aagggaggauuucuccccc

SEQ ID NO: 2021742 - RNA, 16 nt, Shigella flexneri 2a str. 301
aaggguuuuuuuaugc

SEQ ID NO: 2021743 - RNA, 22 nt, Shigella flexneri 2a str. 301
aagggugucuguuaaucgcauu

SEQ ID NO: 2021744 - RNA, 14 nt, Shigella flexneri 2a str. 301
aagggugagggagg

SEQ ID NO: 2021745 - RNA, 22 nt, Shigella flexneri 2a str. 301
aagggugagggaggauuucucc

SEQ ID NO: 2021746 - RNA, 15 nt, Shigella flexneri 2a str. 301
aagggucagggagaa

SEQ ID NO: 2021747 - RNA, 21 nt, Shigella flexneri 2a str. 301
aagcggcacugcucuuuaaca

SEQ ID NO: 2021748 - RNA, 15 nt, Shigella flexneri 2a str. 301
aagcgucagaaaaau

SEQ ID NO: 2021749 - RNA, 13 nt, Shigella flexneri 2a str. 301
aagcgucagcuuu

SEQ ID NO: 2021750 - RNA, 22 nt, Shigella flexneri 2a str. 301
aagcgucaaguugacucucauc

SEQ ID NO: 2021751 - RNA, 15 nt, Shigella flexneri 2a str. 301
aagccgcauccgguu

SEQ ID NO: 2021752 - RNA, 20 nt, Shigella flexneri 2a str. 301
aagccgccgguagucaccgc

SEQ ID NO: 2021753 - RNA, 15 nt, Shigella flexneri 2a str. 301
aagccgaucgugcua

SEQ ID NO: 2021754 - RNA, 18 nt, Shigella flexneri 2a str. 301
aagccgcuaacagcagca

SEQ ID NO: 2021755 - RNA, 16 nt, Shigella flexneri 2a str. 301
aagccgcuaacagcag

SEQ ID NO: 2021756 - RNA, 15 nt, Shigella flexneri 2a str. 301
aagcgcgucaccacc

SEQ ID NO: 2021757 - RNA, 17 nt, Shigella flexneri 2a str. 301
aagcgcguguuacugga

SEQ ID NO: 2021758 - RNA, 16 nt, Shigella flexneri 2a str. 301
aagccggaauuuuccu

SEQ ID NO: 2021759 - RNA, 15 nt, Shigella flexneri 2a str. 301
aagcgugcaaauaua

SEQ ID NO: 2021760 - RNA, 16 nt, Shigella flexneri 2a str. 301
aagcgugcaaauauac

SEQ ID NO: 2021761 - RNA, 13 nt, Shigella flexneri 2a str. 301
aagcugacaggcg

SEQ ID NO: 2021762 - RNA, 19 nt, Shigella flexneri 2a str. 301
aagcucuguauauaaaugu

SEQ ID NO: 2021763 - RNA, 14 nt, Shigella flexneri 2a str. 301
aagcucguuguuua

SEQ ID NO: 2021764 - RNA, 14 nt, Shigella flexneri 2a str. 301
aagcuguagaggcg

SEQ ID NO: 2021765 - RNA, 22 nt, Shigella flexneri 2a str. 301
aagcugcugacggugauaauca

SEQ ID NO: 2021766 - RNA, 21 nt, Shigella flexneri 2a str. 301
aagcugcggauccugagcaaa

SEQ ID NO: 2021767 - RNA, 16 nt, Shigella flexneri 2a str. 301
aagcugugccugaaua

SEQ ID NO: 2021768 - RNA, 24 nt, Shigella flexneri 2a str. 301
aagcuguaucccagcccagcggaa

SEQ ID NO: 2021769 - RNA, 20 nt, Shigella flexneri 2a str. 301
aagcugacaggcgcugauga

SEQ ID NO: 2021770 - RNA, 14 nt, Shigella flexneri 2a str. 301
aagcugcaggacca

SEQ ID NO: 2021771 - RNA, 20 nt, Shigella flexneri 2a str. 301
aagcugcaaguauucacucu

SEQ ID NO: 2021772 - RNA, 13 nt, Shigella flexneri 2a str. 301
aaggauaaaaaag

SEQ ID NO: 2021773 - RNA, 18 nt, Shigella flexneri 2a str. 301
aaggauugaucaauucua

SEQ ID NO: 2021774 - RNA, 15 nt, Shigella flexneri 2a str. 301
aaggauucgaaccuu

SEQ ID NO: 2021775 - RNA, 13 nt, Shigella flexneri 2a str. 301
aaggagagccaua

SEQ ID NO: 2021776 - RNA, 14 nt, Shigella flexneri 2a str. 301
aagcuuuccacgca

SEQ ID NO: 2021777 - RNA, 15 nt, Shigella flexneri 2a str. 301
aacgccagcagcagc

SEQ ID NO: 2021778 - RNA, 15 nt, Shigella flexneri 2a str. 301
aacgccacgcucacu

SEQ ID NO: 2021779 - RNA, 13 nt, Shigella flexneri 2a str. 301
aacgcaccaauag

SEQ ID NO: 2021780 - RNA, 13 nt, Shigella flexneri 2a str. 301
aacgcaccaggcg

SEQ ID NO: 2021781 - RNA, 13 nt, Shigella flexneri 2a str. 301
aacgcaccugaaa

SEQ ID NO: 2021782 - RNA, 21 nt, Shigella flexneri 2a str. 301
aacgcaaucaaauaccaccag

SEQ ID NO: 2021783 - RNA, 21 nt, Shigella flexneri 2a str. 301
aacgcaaagagagaagccaga

SEQ ID NO: 2021784 - RNA, 16 nt, Shigella flexneri 2a str. 301
aacgccgccagaccac

SEQ ID NO: 2021785 - RNA, 15 nt, Shigella flexneri 2a str. 301
aacgccccaauccac

SEQ ID NO: 2021786 - RNA, 16 nt, Shigella flexneri 2a str. 301
aacgcccaucaacaug

SEQ ID NO: 2021787 - RNA, 18 nt, Shigella flexneri 2a str. 301
aaccggcacaauaucuuu

SEQ ID NO: 2021788 - RNA, 13 nt, Shigella flexneri 2a str. 301
aaccgcuuuucca

SEQ ID NO: 2021789 - RNA, 17 nt, Shigella flexneri 2a str. 301
aaccggacugaaaguac

SEQ ID NO: 2021790 - RNA, 13 nt, Shigella flexneri 2a str. 301
aaccggagucaga

SEQ ID NO: 2021791 - RNA, 21 nt, Shigella flexneri 2a str. 301
aacgauucaaaagaugagaaa

SEQ ID NO: 2021792 - RNA, 12 nt, Shigella flexneri 2a str. 301
aacgcaaaauuc

SEQ ID NO: 2021793 - RNA, 17 nt, Shigella flexneri 2a str. 301
aacgcaaacuguuucag

SEQ ID NO: 2021794 - RNA, 16 nt, Shigella flexneri 2a str. 301
aacgauuuuuuccgca

SEQ ID NO: 2021795 - RNA, 18 nt, Shigella flexneri 2a str. 301
aacgaucgcccagaccac

SEQ ID NO: 2021796 - RNA, 22 nt, Shigella flexneri 2a str. 301
aacgaucgccugguaccagcac

SEQ ID NO: 2021797 - RNA, 12 nt, Shigella flexneri 2a str. 301
aacgaugacauc

SEQ ID NO: 2021798 - RNA, 14 nt, Shigella flexneri 2a str. 301
aacgcugccagccg

SEQ ID NO: 2021799 - RNA, 15 nt, Shigella flexneri 2a str. 301
aacgcugccagccgc

SEQ ID NO: 2021800 - RNA, 22 nt, Shigella flexneri 2a str. 301
aacgccguuauuaaaaagccug

SEQ ID NO: 2021801 - RNA, 19 nt, Shigella flexneri 2a str. 301
aacgccggaugacacauca

SEQ ID NO: 2021802 - RNA, 15 nt, Shigella flexneri 2a str. 301
aacgccggagagaaa

SEQ ID NO: 2021803 - RNA, 16 nt, Shigella flexneri 2a str. 301
aacgccgcgccauagu

SEQ ID NO: 2021804 - RNA, 22 nt, Shigella flexneri 2a str. 301
aacgccgcuauacgccucacag

SEQ ID NO: 2021805 - RNA, 22 nt, Shigella flexneri 2a str. 301
aacgcuuucucaccaugaccga

SEQ ID NO: 2021806 - RNA, 19 nt, Shigella flexneri 2a str. 301
aacgcuuucucaccaugac

SEQ ID NO: 2021807 - RNA, 14 nt, Shigella flexneri 2a str. 301
aacgcuuucuuugg

SEQ ID NO: 2021808 - RNA, 23 nt, Shigella flexneri 2a str. 301
aacgcuuucuuuggcaucaauca

SEQ ID NO: 2021809 - RNA, 16 nt, Shigella flexneri 2a str. 301
aacggaaagcagauaa

SEQ ID NO: 2021810 - RNA, 22 nt, Shigella flexneri 2a str. 301
aacgcuucucccagccgcccug

SEQ ID NO: 2021811 - RNA, 13 nt, Shigella flexneri 2a str. 301
aacgcuugcugau

SEQ ID NO: 2021812 - RNA, 13 nt, Shigella flexneri 2a str. 301
aacgcuuucccug

SEQ ID NO: 2021813 - RNA, 21 nt, Shigella flexneri 2a str. 301
aacgcugugcguaaucgccga

SEQ ID NO: 2021814 - RNA, 18 nt, Shigella flexneri 2a str. 301
aacgcuucucccagccgc

SEQ ID NO: 2021815 - RNA, 18 nt, Shigella flexneri 2a str. 301
aacggucgccgcgcaaau

SEQ ID NO: 2021816 - RNA, 16 nt, Shigella flexneri 2a str. 301
aacggucccucaacaa

SEQ ID NO: 2021817 - RNA, 22 nt, Shigella flexneri 2a str. 301
aacgguccuuaccaugcugcag

SEQ ID NO: 2021818 - RNA, 22 nt, Shigella flexneri 2a str. 301
aacggucgccgcgcaaauccac

SEQ ID NO: 2021819 - RNA, 13 nt, Shigella flexneri 2a str. 301
aacggucacggcu

SEQ ID NO: 2021820 - RNA, 12 nt, Shigella flexneri 2a str. 301
aacgguuuucac

SEQ ID NO: 2021821 - RNA, 18 nt, Shigella flexneri 2a str. 301
aacggugcgaccaaacug

SEQ ID NO: 2021822 - RNA, 16 nt, Shigella flexneri 2a str. 301
aacggguuaaauccug

SEQ ID NO: 2021823 - RNA, 14 nt, Shigella flexneri 2a str. 301
aacgguaaggacaa

SEQ ID NO: 2021824 - RNA, 13 nt, Shigella flexneri 2a str. 301
aacgguaagaaca

SEQ ID NO: 2021825 - RNA, 15 nt, Shigella flexneri 2a str. 301
aacggaacgaaaaaa

SEQ ID NO: 2021826 - RNA, 17 nt, Shigella flexneri 2a str. 301
aacggaacgaaaaaaau

SEQ ID NO: 2021827 - RNA, 23 nt, Shigella flexneri 2a str. 301
aacggggguuuuacuuuuuaacu

SEQ ID NO: 2021828 - RNA, 20 nt, Shigella flexneri 2a str. 301
aacggaccaauaaacgccag

SEQ ID NO: 2021829 - RNA, 14 nt, Shigella flexneri 2a str. 301
aacggacccgcgau

SEQ ID NO: 2021830 - RNA, 13 nt, Shigella flexneri 2a str. 301
aacggaccaauaa

SEQ ID NO: 2021831 - RNA, 20 nt, Shigella flexneri 2a str. 301
aacuaccagcaguuugguaa

SEQ ID NO: 2021832 - RNA, 22 nt, Shigella flexneri 2a str. 301
aacuacauagcguguugauuau

SEQ ID NO: 2021833 - RNA, 23 nt, Shigella flexneri 2a str. 301
aacuacauagcguguugauuaua

SEQ ID NO: 2021834 - RNA, 17 nt, Shigella flexneri 2a str. 301
aacuacggcaaaagaau

SEQ ID NO: 2021835 - RNA, 21 nt, Shigella flexneri 2a str. 301
aacuauugacgaaaagcugaa

SEQ ID NO: 2021836 - RNA, 14 nt, Shigella flexneri 2a str. 301
aacuagcuguugua

SEQ ID NO: 2021837 - RNA, 23 nt, Shigella flexneri 2a str. 301
aacuagcuguuguaaugauuuaa

SEQ ID NO: 2021838 - RNA, 13 nt, Shigella flexneri 2a str. 301
aacuaaaaacagc

SEQ ID NO: 2021839 - RNA, 19 nt, Shigella flexneri 2a str. 301
aacgugcaaaaucaaacag

SEQ ID NO: 2021840 - RNA, 15 nt, Shigella flexneri 2a str. 301
aacgugggccuggcg

SEQ ID NO: 2021841 - RNA, 13 nt, Shigella flexneri 2a str. 301
aacguggccauga

SEQ ID NO: 2021842 - RNA, 21 nt, Shigella flexneri 2a str. 301
aacgugugcuuuguucaugcc

SEQ ID NO: 2021843 - RNA, 22 nt, Shigella flexneri 2a str. 301
aacguugcugcgccgagcaaua

SEQ ID NO: 2021844 - RNA, 17 nt, Shigella flexneri 2a str. 301
aacguuuacagggaugg

SEQ ID NO: 2021845 - RNA, 18 nt, Shigella flexneri 2a str. 301
aacguugaauuucagguu

SEQ ID NO: 2021846 - RNA, 21 nt, Shigella flexneri 2a str. 301
aacguuccccaggguuucucc

SEQ ID NO: 2021847 - RNA, 22 nt, Shigella flexneri 2a str. 301
aacgucgcaagacgaaaaauga

SEQ ID NO: 2021848 - RNA, 13 nt, Shigella flexneri 2a str. 301
aacgucgccagcg

SEQ ID NO: 2021849 - RNA, 18 nt, Shigella flexneri 2a str. 301
aacgucucuauuucaccc

SEQ ID NO: 2021850 - RNA, 20 nt, Shigella flexneri 2a str. 301
aacgucaggugagcgucauu

SEQ ID NO: 2021851 - RNA, 14 nt, Shigella flexneri 2a str. 301
aacguaacaaaacu

SEQ ID NO: 2021852 - RNA, 16 nt, Shigella flexneri 2a str. 301
aacguaacaguacaau

SEQ ID NO: 2021853 - RNA, 16 nt, Shigella flexneri 2a str. 301
aacguaggcacauucg

SEQ ID NO: 2021854 - RNA, 20 nt, Shigella flexneri 2a str. 301
aacugcuauucaccagcaaa

SEQ ID NO: 2021855 - RNA, 16 nt, Shigella flexneri 2a str. 301
aacugcucaaaggcga

SEQ ID NO: 2021856 - RNA, 21 nt, Shigella flexneri 2a str. 301
aacugcggucuaaaucuuccg

SEQ ID NO: 2021857 - RNA, 15 nt, Shigella flexneri 2a str. 301
aacugcguucugucg

SEQ ID NO: 2021858 - RNA, 15 nt, Shigella flexneri 2a str. 301
aacuggcaggaaaca

SEQ ID NO: 2021859 - RNA, 15 nt, Shigella flexneri 2a str. 301
aacuggaugaaaaaa

SEQ ID NO: 2021860 - RNA, 17 nt, Shigella flexneri 2a str. 301
aacuggcaaccagaaga

SEQ ID NO: 2021861 - RNA, 17 nt, Shigella flexneri 2a str. 301
aacuggaaaaauaauuu

SEQ ID NO: 2021862 - RNA, 17 nt, Shigella flexneri 2a str. 301
aacuggaagcugccucg

SEQ ID NO: 2021863 - RNA, 13 nt, Shigella flexneri 2a str. 301
aacuggaaaaaua

SEQ ID NO: 2021864 - RNA, 14 nt, Shigella flexneri 2a str. 301
aacugauugccacc

SEQ ID NO: 2021865 - RNA, 16 nt, Shigella flexneri 2a str. 301
aacugauuuucaucuu

SEQ ID NO: 2021866 - RNA, 19 nt, Shigella flexneri 2a str. 301
aacucaaaaauaaucaucu

SEQ ID NO: 2021867 - RNA, 17 nt, Shigella flexneri 2a str. 301
aacucuuccuuaacauc

SEQ ID NO: 2021868 - RNA, 16 nt, Shigella flexneri 2a str. 301
aacucaaaaauaauca

SEQ ID NO: 2021869 - RNA, 15 nt, Shigella flexneri 2a str. 301
aacuuaagucuccau

SEQ ID NO: 2021870 - RNA, 20 nt, Shigella flexneri 2a str. 301
aacuuacugacaucaaaccc

SEQ ID NO: 2021871 - RNA, 22 nt, Shigella flexneri 2a str. 301
aacuuaccgccgcuccagaauc

SEQ ID NO: 2021872 - RNA, 21 nt, Shigella flexneri 2a str. 301
aacuuacugauaguguuuuau

SEQ ID NO: 2021873 - RNA, 22 nt, Shigella flexneri 2a str. 301
aacugguccagccccugaagcg

SEQ ID NO: 2021874 - RNA, 19 nt, Shigella flexneri 2a str. 301
aacuggcuugguaacaugc

SEQ ID NO: 2021875 - RNA, 17 nt, Shigella flexneri 2a str. 301
aacuucuucaguuuuuc

SEQ ID NO: 2021876 - RNA, 14 nt, Shigella flexneri 2a str. 301
aacuucuucaguuu

SEQ ID NO: 2021877 - RNA, 14 nt, Shigella flexneri 2a str. 301
aacuucaccagcac

SEQ ID NO: 2021878 - RNA, 20 nt, Shigella flexneri 2a str. 301
aacuucaccagcacuucacu

SEQ ID NO: 2021879 - RNA, 18 nt, Shigella flexneri 2a str. 301
aacuucuuuuucgacaaa

SEQ ID NO: 2021880 - RNA, 18 nt, Shigella flexneri 2a str. 301
aacuuaucuguaauuaaa

SEQ ID NO: 2021881 - RNA, 23 nt, Shigella flexneri 2a str. 301
aacuuaucaucgcaaaugaugca

SEQ ID NO: 2021882 - RNA, 20 nt, Shigella flexneri 2a str. 301
aacuuaucaucaggcgaagg

SEQ ID NO: 2021883 - RNA, 17 nt, Shigella flexneri 2a str. 301
aagaaagcaaugaaauu

SEQ ID NO: 2021884 - RNA, 14 nt, Shigella flexneri 2a str. 301
aagaaagguugagg

SEQ ID NO: 2021885 - RNA, 23 nt, Shigella flexneri 2a str. 301
aagaacaccagagccugccaaug

SEQ ID NO: 2021886 - RNA, 16 nt, Shigella flexneri 2a str. 301
aagaacaguuaacagc

SEQ ID NO: 2021887 - RNA, 19 nt, Shigella flexneri 2a str. 301
aagaacagccuuaaacuca

SEQ ID NO: 2021888 - RNA, 17 nt, Shigella flexneri 2a str. 301
aagaaccaacgcugcca

SEQ ID NO: 2021889 - RNA, 11 nt, Shigella flexneri 2a str. 301
aagaaccaugc

SEQ ID NO: 2021890 - RNA, 16 nt, Shigella flexneri 2a str. 301
aagaacgccauaaaag

SEQ ID NO: 2021891 - RNA, 19 nt, Shigella flexneri 2a str. 301
aacuuguagcuuucaacgc

SEQ ID NO: 2021892 - RNA, 21 nt, Shigella flexneri 2a str. 301
aagaaaaaaugaccggccagc

SEQ ID NO: 2021893 - RNA, 16 nt, Shigella flexneri 2a str. 301
aagaaacgcuuaaaac

SEQ ID NO: 2021894 - RNA, 16 nt, Shigella flexneri 2a str. 301
aagaaaacguuucaac

SEQ ID NO: 2021895 - RNA, 19 nt, Shigella flexneri 2a str. 301
aagaagcggugaaaaaauu

SEQ ID NO: 2021896 - RNA, 18 nt, Shigella flexneri 2a str. 301
aagaagcggugaaaaaau

SEQ ID NO: 2021897 - RNA, 23 nt, Shigella flexneri 2a str. 301
aagaagaucguggagaacaauau

SEQ ID NO: 2021898 - RNA, 22 nt, Shigella flexneri 2a str. 301
aagaagaucguggagaacaaua

SEQ ID NO: 2021899 - RNA, 22 nt, Shigella flexneri 2a str. 301
aagaagaccugccagaacaacc

SEQ ID NO: 2021900 - RNA, 23 nt, Shigella flexneri 2a str. 301
aagaagaccugccagaacaacca

SEQ ID NO: 2021901 - RNA, 24 nt, Shigella flexneri 2a str. 301
aagaagaccugccagaacaaccag

SEQ ID NO: 2021902 - RNA, 19 nt, Shigella flexneri 2a str. 301
aagaacucgaggauaaauu

SEQ ID NO: 2021903 - RNA, 14 nt, Shigella flexneri 2a str. 301
aagaacuccugaaa

SEQ ID NO: 2021904 - RNA, 20 nt, Shigella flexneri 2a str. 301
aagaagggcuggccaauugg

SEQ ID NO: 2021905 - RNA, 13 nt, Shigella flexneri 2a str. 301
aagaaggaaaaua

SEQ ID NO: 2021906 - RNA, 14 nt, Shigella flexneri 2a str. 301
aagaaggaaaauac

SEQ ID NO: 2021907 - RNA, 15 nt, Shigella flexneri 2a str. 301
aagaaggcauaacuc

SEQ ID NO: 2021908 - RNA, 17 nt, Shigella flexneri 2a str. 301
aagaauaaaacgccuga

SEQ ID NO: 2021909 - RNA, 21 nt, Shigella flexneri 2a str. 301
aagaauaugcuuugccuuauu

SEQ ID NO: 2021910 - RNA, 13 nt, Shigella flexneri 2a str. 301
aaccaaucuccca

SEQ ID NO: 2021911 - RNA, 13 nt, Shigella flexneri 2a str. 301
aaccaaugccacc

SEQ ID NO: 2021912 - RNA, 17 nt, Shigella flexneri 2a str. 301
aaccacaaaacacucuu

SEQ ID NO: 2021913 - RNA, 15 nt, Shigella flexneri 2a str. 301
aaccacaaccacuuu

SEQ ID NO: 2021914 - RNA, 12 nt, Shigella flexneri 2a str. 301
aacauugcugcu

SEQ ID NO: 2021915 - RNA, 14 nt, Shigella flexneri 2a str. 301
aacauugcugccag

SEQ ID NO: 2021916 - RNA, 12 nt, Shigella flexneri 2a str. 301
aacauugcaaga

SEQ ID NO: 2021917 - RNA, 18 nt, Shigella flexneri 2a str. 301
aacauugcaagauuuuug

SEQ ID NO: 2021918 - RNA, 21 nt, Shigella flexneri 2a str. 301
aacauugcccggucaggaugg

SEQ ID NO: 2021919 - RNA, 18 nt, Shigella flexneri 2a str. 301
aacauuguuauucuccuu

SEQ ID NO: 2021920 - RNA, 20 nt, Shigella flexneri 2a str. 301
aaccaacggcgagccagcgc

SEQ ID NO: 2021921 - RNA, 19 nt, Shigella flexneri 2a str. 301
aaccaacgcugccagccgc

SEQ ID NO: 2021922 - RNA, 16 nt, Shigella flexneri 2a str. 301
aaccaacaguaucuga

SEQ ID NO: 2021923 - RNA, 19 nt, Shigella flexneri 2a str. 301
aaccaacaauugcccccca

SEQ ID NO: 2021924 - RNA, 19 nt, Shigella flexneri 2a str. 301
aacauucgccgcugugauu

SEQ ID NO: 2021925 - RNA, 21 nt, Shigella flexneri 2a str. 301
aacauucgccgcugugauuuc

SEQ ID NO: 2021926 - RNA, 18 nt, Shigella flexneri 2a str. 301
aacauguuccugccaguc

SEQ ID NO: 2021927 - RNA, 13 nt, Shigella flexneri 2a str. 301
aacaugaaaauaa

SEQ ID NO: 2021928 - RNA, 14 nt, Shigella flexneri 2a str. 301
aacauuacgugggc

SEQ ID NO: 2021929 - RNA, 17 nt, Shigella flexneri 2a str. 301
aacauacccaguuucau

SEQ ID NO: 2021930 - RNA, 16 nt, Shigella flexneri 2a str. 301
aacauacgcugcacaa

SEQ ID NO: 2021931 - RNA, 13 nt, Shigella flexneri 2a str. 301
aacauacaaauag

SEQ ID NO: 2021932 - RNA, 16 nt, Shigella flexneri 2a str. 301
aacagccccugagcgu

SEQ ID NO: 2021933 - RNA, 16 nt, Shigella flexneri 2a str. 301
aacagcccaaucaucg

SEQ ID NO: 2021934 - RNA, 22 nt, Shigella flexneri 2a str. 301
aacagcgcaccagaaacaauaa

SEQ ID NO: 2021935 - RNA, 20 nt, Shigella flexneri 2a str. 301
aacagcgacaccagccaucu

SEQ ID NO: 2021936 - RNA, 13 nt, Shigella flexneri 2a str. 301
aacagcgcaccag

SEQ ID NO: 2021937 - RNA, 17 nt, Shigella flexneri 2a str. 301
aacaucccgguaauaau

SEQ ID NO: 2021938 - RNA, 13 nt, Shigella flexneri 2a str. 301
aacaucccuguaa

SEQ ID NO: 2021939 - RNA, 21 nt, Shigella flexneri 2a str. 301
aacauccgcuuucgguuuuuc

SEQ ID NO: 2021940 - RNA, 21 nt, Shigella flexneri 2a str. 301
aacauccguuuugugguguuu

SEQ ID NO: 2021941 - RNA, 15 nt, Shigella flexneri 2a str. 301
aacaucuuaccucug

SEQ ID NO: 2021942 - RNA, 19 nt, Shigella flexneri 2a str. 301
aacaugacuaaucugacaa

SEQ ID NO: 2021943 - RNA, 16 nt, Shigella flexneri 2a str. 301
aacauccaucgccagc

SEQ ID NO: 2021944 - RNA, 20 nt, Shigella flexneri 2a str. 301
aacaucaugccggccagcgc

SEQ ID NO: 2021945 - RNA, 13 nt, Shigella flexneri 2a str. 301
aacaucaaaccac

SEQ ID NO: 2021946 - RNA, 11 nt, Shigella flexneri 2a str. 301
aacccuuucca

SEQ ID NO: 2021947 - RNA, 16 nt, Shigella flexneri 2a str. 301
aacccuuuccagcgcc

SEQ ID NO: 2021948 - RNA, 22 nt, Shigella flexneri 2a str. 301
aaccgacgguaacucugaugac

SEQ ID NO: 2021949 - RNA, 18 nt, Shigella flexneri 2a str. 301
aaccgagguuaaugaucg

SEQ ID NO: 2021950 - RNA, 14 nt, Shigella flexneri 2a str. 301
aaccgagcagauac

SEQ ID NO: 2021951 - RNA, 18 nt, Shigella flexneri 2a str. 301
aacccuugcguuucugac

SEQ ID NO: 2021952 - RNA, 14 nt, Shigella flexneri 2a str. 301
aacccuucuuccau

SEQ ID NO: 2021953 - RNA, 22 nt, Shigella flexneri 2a str. 301
aacccugagugaauuguuuuau

SEQ ID NO: 2021954 - RNA, 22 nt, Shigella flexneri 2a str. 301
aacccugauuucgugauuguug

SEQ ID NO: 2021955 - RNA, 11 nt, Shigella flexneri 2a str. 301
aacccugcaga

SEQ ID NO: 2021956 - RNA, 14 nt, Shigella flexneri 2a str. 301
aacccugcgucagg

SEQ ID NO: 2021957 - RNA, 22 nt, Shigella flexneri 2a str. 301
aaccgcccagugccagcaccac

SEQ ID NO: 2021958 - RNA, 20 nt, Shigella flexneri 2a str. 301
aaccgcccagaccugcguuc

SEQ ID NO: 2021959 - RNA, 15 nt, Shigella flexneri 2a str. 301
aaccgcccugcggcu

SEQ ID NO: 2021960 - RNA, 14 nt, Shigella flexneri 2a str. 301
aaccgcgacuggga

SEQ ID NO: 2021961 - RNA, 19 nt, Shigella flexneri 2a str. 301
aaccgcuacauacuuaaau

SEQ ID NO: 2021962 - RNA, 22 nt, Shigella flexneri 2a str. 301
aaccgcaguguaguucuggccu

SEQ ID NO: 2021963 - RNA, 16 nt, Shigella flexneri 2a str. 301
aaccgccagcuaggcg

SEQ ID NO: 2021964 - RNA, 16 nt, Shigella flexneri 2a str. 301
aaccgccaucauggau

SEQ ID NO: 2021965 - RNA, 17 nt, Shigella flexneri 2a str. 301
aaccgcauccagauucu

SEQ ID NO: 2021966 - RNA, 15 nt, Shigella flexneri 2a str. 301
aaccgcaaaugauua

SEQ ID NO: 2021967 - RNA, 22 nt, Shigella flexneri 2a str. 301
aacccaacguucguacugcccu

SEQ ID NO: 2021968 - RNA, 18 nt, Shigella flexneri 2a str. 301
aacccaucaagcgaaaau

SEQ ID NO: 2021969 - RNA, 13 nt, Shigella flexneri 2a str. 301
aacccauccagca

SEQ ID NO: 2021970 - RNA, 14 nt, Shigella flexneri 2a str. 301
aacccgcugccauc

SEQ ID NO: 2021971 - RNA, 23 nt, Shigella flexneri 2a str. 301
aacccgucugguuugggcaugau

SEQ ID NO: 2021972 - RNA, 23 nt, Shigella flexneri 2a str. 301
aacccggccugcucccgaaccuu

SEQ ID NO: 2021973 - RNA, 15 nt, Shigella flexneri 2a str. 301
aacccggucccuuca

SEQ ID NO: 2021974 - RNA, 19 nt, Shigella flexneri 2a str. 301
aaccaugucgcauccgaca

SEQ ID NO: 2021975 - RNA, 15 nt, Shigella flexneri 2a str. 301
aaccaugucaucaau

SEQ ID NO: 2021976 - RNA, 23 nt, Shigella flexneri 2a str. 301
aaccaugacgcacuuucgcuuua

SEQ ID NO: 2021977 - RNA, 21 nt, Shigella flexneri 2a str. 301
aaccaucaggaugacaaacuu

SEQ ID NO: 2021978 - RNA, 18 nt, Shigella flexneri 2a str. 301
aaccacgacuuuuugucu

SEQ ID NO: 2021979 - RNA, 16 nt, Shigella flexneri 2a str. 301
aaccacgcaaaauccc

SEQ ID NO: 2021980 - RNA, 14 nt, Shigella flexneri 2a str. 301
aaccacgcaauaaa

SEQ ID NO: 2021981 - RNA, 14 nt, Shigella flexneri 2a str. 301
aaccacaaugaaga

SEQ ID NO: 2021982 - RNA, 23 nt, Shigella flexneri 2a str. 301
aaccacgccuaaaauccacaucg

SEQ ID NO: 2021983 - RNA, 18 nt, Shigella flexneri 2a str. 301
aaccacguucauuucaua

SEQ ID NO: 2021984 - RNA, 12 nt, Shigella flexneri 2a str. 301
aaccacucacga

SEQ ID NO: 2021985 - RNA, 19 nt, Shigella flexneri 2a str. 301
aaauucuuacguaauuuau

SEQ ID NO: 2021986 - RNA, 20 nt, Shigella flexneri 2a str. 301
aaauucuucugaaugugccu

SEQ ID NO: 2021987 - RNA, 18 nt, Shigella flexneri 2a str. 301
aaauucuggcggcaauaa

SEQ ID NO: 2021988 - RNA, 23 nt, Shigella flexneri 2a str. 301
aacaauugcgggccaaagaccag

SEQ ID NO: 2021989 - RNA, 19 nt, Shigella flexneri 2a str. 301
aacaauucguuguuuuugu

SEQ ID NO: 2021990 - RNA, 19 nt, Shigella flexneri 2a str. 301
aacaauuaacguaucaauu

SEQ ID NO: 2021991 - RNA, 12 nt, Shigella flexneri 2a str. 301
aacaaugcguuu

SEQ ID NO: 2021992 - RNA, 18 nt, Shigella flexneri 2a str. 301
aacaaucacaauagaaau

SEQ ID NO: 2021993 - RNA, 14 nt, Shigella flexneri 2a str. 301
aacaaucacaauag

SEQ ID NO: 2021994 - RNA, 17 nt, Shigella flexneri 2a str. 301
aacaaucgggaaaaucu

SEQ ID NO: 2021995 - RNA, 21 nt, Shigella flexneri 2a str. 301
aaaaaggugagucgcaaaacu

SEQ ID NO: 2021996 - RNA, 19 nt, Shigella flexneri 2a str. 301
aaaaaggcugacaaaucag

SEQ ID NO: 2021997 - RNA, 22 nt, Shigella flexneri 2a str. 301
aaaaaggcgugaucuccuugga

SEQ ID NO: 2021998 - RNA, 15 nt, Shigella flexneri 2a str. 301
aacacauccaguggc

SEQ ID NO: 2021999 - RNA, 17 nt, Shigella flexneri 2a str. 301
aacacaggauacgcaua

SEQ ID NO: 2022000 - RNA, 17 nt, Shigella flexneri 2a str. 301
aacacagguaacuuaaa

SEQ ID NO: 2022001 - RNA, 17 nt, Shigella flexneri 2a str. 301
aacacagcgauccggua

SEQ ID NO: 2022002 - RNA, 18 nt, Shigella flexneri 2a str. 301
aacacagcaucuggauga

SEQ ID NO: 2022003 - RNA, 24 nt, Shigella flexneri 2a str. 301
aacacauauauuaauugccguuaa

SEQ ID NO: 2022004 - RNA, 13 nt, Shigella flexneri 2a str. 301
aacacacuuucca

SEQ ID NO: 2022005 - RNA, 22 nt, Shigella flexneri 2a str. 301
aacacacuuuccaguuccggca

SEQ ID NO: 2022006 - RNA, 20 nt, Shigella flexneri 2a str. 301
aacacacguaggccggauaa

SEQ ID NO: 2022007 - RNA, 14 nt, Shigella flexneri 2a str. 301
aacacacauuuauc

SEQ ID NO: 2022008 - RNA, 15 nt, Shigella flexneri 2a str. 301
aacacaauauucaua

SEQ ID NO: 2022009 - RNA, 13 nt, Shigella flexneri 2a str. 301
aacacaacguggu

SEQ ID NO: 2022010 - RNA, 21 nt, Shigella flexneri 2a str. 301
aacacacaauuaccuuccaca

SEQ ID NO: 2022011 - RNA, 16 nt, Shigella flexneri 2a str. 301
aacacauuauuaagaa

SEQ ID NO: 2022012 - RNA, 23 nt, Shigella flexneri 2a str. 301
aaaaaguaagaauugauaaaaaa

SEQ ID NO: 2022013 - RNA, 16 nt, Shigella flexneri 2a str. 301
aaaaagucagaucguu

SEQ ID NO: 2022014 - RNA, 18 nt, Shigella flexneri 2a str. 301
aaaaaguccaaaaggucc

SEQ ID NO: 2022015 - RNA, 12 nt, Shigella flexneri 2a str. 301
aacaccagcagu

SEQ ID NO: 2022016 - RNA, 15 nt, Shigella flexneri 2a str. 301
aacaccagcaauaau

SEQ ID NO: 2022017 - RNA, 12 nt, Shigella flexneri 2a str. 301
aacaccauaaug

SEQ ID NO: 2022018 - RNA, 18 nt, Shigella flexneri 2a str. 301
aacaccaucauauuuucc

SEQ ID NO: 2022019 - RNA, 20 nt, Shigella flexneri 2a str. 301
aacaccaucauauuuuccau

SEQ ID NO: 2022020 - RNA, 12 nt, Shigella flexneri 2a str. 301
aacaccaaaccc

SEQ ID NO: 2022021 - RNA, 15 nt, Shigella flexneri 2a str. 301
aacaccgucgccuuc

SEQ ID NO: 2022022 - RNA, 12 nt, Shigella flexneri 2a str. 301
aacaccgggugc

SEQ ID NO: 2022023 - RNA, 18 nt, Shigella flexneri 2a str. 301
aacaccgcuucaacagcg

SEQ ID NO: 2022024 - RNA, 23 nt, Shigella flexneri 2a str. 301
aacaccgauuuuguaaaagaagg

SEQ ID NO: 2022025 - RNA, 17 nt, Shigella flexneri 2a str. 301
aacaccgaaccagagau

SEQ ID NO: 2022026 - RNA, 22 nt, Shigella flexneri 2a str. 301
aacacccauggggaugcugcag

SEQ ID NO: 2022027 - RNA, 19 nt, Shigella flexneri 2a str. 301
aacacgggguuaaauugau

SEQ ID NO: 2022028 - RNA, 18 nt, Shigella flexneri 2a str. 301
aacacguugcacuagguu

SEQ ID NO: 2022029 - RNA, 14 nt, Shigella flexneri 2a str. 301
aacacgaucagcca

SEQ ID NO: 2022030 - RNA, 15 nt, Shigella flexneri 2a str. 301
aacacgcucaggcga

SEQ ID NO: 2022031 - RNA, 21 nt, Shigella flexneri 2a str. 301
aacacggaucaggcggcucac

SEQ ID NO: 2022032 - RNA, 16 nt, Shigella flexneri 2a str. 301
aacacucucugaagua

SEQ ID NO: 2022033 - RNA, 15 nt, Shigella flexneri 2a str. 301
aacacucuuccaguc

SEQ ID NO: 2022034 - RNA, 15 nt, Shigella flexneri 2a str. 301
aacagaccaguaaag

SEQ ID NO: 2022035 - RNA, 12 nt, Shigella flexneri 2a str. 301
aacagaccaaug

SEQ ID NO: 2022036 - RNA, 12 nt, Shigella flexneri 2a str. 301
aacagagauuac

SEQ ID NO: 2022037 - RNA, 21 nt, Shigella flexneri 2a str. 301
aacagagguuucucauaauua

SEQ ID NO: 2022038 - RNA, 21 nt, Shigella flexneri 2a str. 301
aacagauaggcaucagcaauu

SEQ ID NO: 2022039 - RNA, 17 nt, Shigella flexneri 2a str. 301
aacagaaacgccaucca

SEQ ID NO: 2022040 - RNA, 20 nt, Shigella flexneri 2a str. 301
aacacuuugccgucagccac

SEQ ID NO: 2022041 - RNA, 14 nt, Shigella flexneri 2a str. 301
aacagaacaauaau

SEQ ID NO: 2022042 - RNA, 23 nt, Shigella flexneri 2a str. 301
aacagaacgcgccuuaaaaacca

SEQ ID NO: 2022043 - RNA, 13 nt, Shigella flexneri 2a str. 301
aacagaacgcaua

SEQ ID NO: 2022044 - RNA, 13 nt, Shigella flexneri 2a str. 301
aacagacaaaaag

SEQ ID NO: 2022045 - RNA, 15 nt, Shigella flexneri 2a str. 301
aacagacaaaaagaa

SEQ ID NO: 2022046 - RNA, 14 nt, Shigella flexneri 2a str. 301
aacagaaugcacgu

SEQ ID NO: 2022047 - RNA, 19 nt, Shigella flexneri 2a str. 301
aacagaagugcguuucugg

SEQ ID NO: 2022048 - RNA, 21 nt, Shigella flexneri 2a str. 301
aacagccagcgcugacgugau

SEQ ID NO: 2022049 - RNA, 19 nt, Shigella flexneri 2a str. 301
aacagccauaaccccacca

SEQ ID NO: 2022050 - RNA, 22 nt, Shigella flexneri 2a str. 301
aacagccauaaccccaccagca

SEQ ID NO: 2022051 - RNA, 15 nt, Shigella flexneri 2a str. 301
aacagccagaagccc

SEQ ID NO: 2022052 - RNA, 14 nt, Shigella flexneri 2a str. 301
aacagcagcagguc

SEQ ID NO: 2022053 - RNA, 15 nt, Shigella flexneri 2a str. 301
aacagcaccagcagg

SEQ ID NO: 2022054 - RNA, 23 nt, Shigella flexneri 2a str. 301
aacagcaccagcaggugauacau

SEQ ID NO: 2022055 - RNA, 20 nt, Shigella flexneri 2a str. 301
aacagcagaacgaccagcgc

SEQ ID NO: 2022056 - RNA, 16 nt, Shigella flexneri 2a str. 301
aacagcaaccuccguc

SEQ ID NO: 2022057 - RNA, 19 nt, Shigella flexneri 2a str. 301
aacagcaauacguuucaua

SEQ ID NO: 2022058 - RNA, 22 nt, Shigella flexneri 2a str. 301
aacagaugaugcgucucaucag

SEQ ID NO: 2022059 - RNA, 17 nt, Shigella flexneri 2a str. 301
aauggcgcgaaaacaac

SEQ ID NO: 2022060 - RNA, 15 nt, Shigella flexneri 2a str. 301
aauggcgauuuuuga

SEQ ID NO: 2022061 - RNA, 17 nt, Shigella flexneri 2a str. 301
aauggcccaaaaggcag

SEQ ID NO: 2022062 - RNA, 19 nt, Shigella flexneri 2a str. 301
aauggccgucgccacaacc

SEQ ID NO: 2022063 - RNA, 20 nt, Shigella flexneri 2a str. 301
aauggagauuguuaauacga

SEQ ID NO: 2022064 - RNA, 14 nt, Shigella flexneri 2a str. 301
aauggacuccaccg

SEQ ID NO: 2022065 - RNA, 17 nt, Shigella flexneri 2a str. 301
aauggaaagcccgcccc

SEQ ID NO: 2022066 - RNA, 14 nt, Shigella flexneri 2a str. 301
aauggcaucugaua

SEQ ID NO: 2022067 - RNA, 18 nt, Shigella flexneri 2a str. 301
aaugcgcaucaaagccag

SEQ ID NO: 2022068 - RNA, 17 nt, Shigella flexneri 2a str. 301
aaugcgcaucaaagcca

SEQ ID NO: 2022069 - RNA, 14 nt, Shigella flexneri 2a str. 301
aaugcgcucagggu

SEQ ID NO: 2022070 - RNA, 21 nt, Shigella flexneri 2a str. 301
aaugcgcuguuuagcgcggca

SEQ ID NO: 2022071 - RNA, 19 nt, Shigella flexneri 2a str. 301
aaugcuguaaccagcgcag

SEQ ID NO: 2022072 - RNA, 20 nt, Shigella flexneri 2a str. 301
aaugcggauaagccugugcg

SEQ ID NO: 2022073 - RNA, 13 nt, Shigella flexneri 2a str. 301
aaugcuucuaccg

SEQ ID NO: 2022074 - RNA, 14 nt, Shigella flexneri 2a str. 301
aauggaaacagcac

SEQ ID NO: 2022075 - RNA, 19 nt, Shigella flexneri 2a str. 301
aaugcuuuuuccugcguca

SEQ ID NO: 2022076 - RNA, 23 nt, Shigella flexneri 2a str. 301
aaugccacaaacgccgugcacac

SEQ ID NO: 2022077 - RNA, 17 nt, Shigella flexneri 2a str. 301
aaugccaccagggauaa

SEQ ID NO: 2022078 - RNA, 19 nt, Shigella flexneri 2a str. 301
aaugccaaauauuucuuua

SEQ ID NO: 2022079 - RNA, 16 nt, Shigella flexneri 2a str. 301
aaugcagcauugccug

SEQ ID NO: 2022080 - RNA, 17 nt, Shigella flexneri 2a str. 301
aaugccagauaagacac

SEQ ID NO: 2022081 - RNA, 13 nt, Shigella flexneri 2a str. 301
aaugccagauaag

SEQ ID NO: 2022082 - RNA, 16 nt, Shigella flexneri 2a str. 301
aaugccagauaagaca

SEQ ID NO: 2022083 - RNA, 20 nt, Shigella flexneri 2a str. 301
aaugcgauccugagccaguu

SEQ ID NO: 2022084 - RNA, 14 nt, Shigella flexneri 2a str. 301
aaugcgcaaaauuc

SEQ ID NO: 2022085 - RNA, 16 nt, Shigella flexneri 2a str. 301
aaugcgacaacagaaa

SEQ ID NO: 2022086 - RNA, 14 nt, Shigella flexneri 2a str. 301
aaugcgaaaauccu

SEQ ID NO: 2022087 - RNA, 11 nt, Shigella flexneri 2a str. 301
aaugcgaaaac

SEQ ID NO: 2022088 - RNA, 17 nt, Shigella flexneri 2a str. 301
aaugccuuauccgaugg

SEQ ID NO: 2022089 - RNA, 15 nt, Shigella flexneri 2a str. 301
aaugccuuugaaauc

SEQ ID NO: 2022090 - RNA, 21 nt, Shigella flexneri 2a str. 301
aaugccuuugaaaucgaacag

SEQ ID NO: 2022091 - RNA, 13 nt, Shigella flexneri 2a str. 301
aaucuugaaacca

SEQ ID NO: 2022092 - RNA, 20 nt, Shigella flexneri 2a str. 301
aaugauuuugauggaagaaa

SEQ ID NO: 2022093 - RNA, 23 nt, Shigella flexneri 2a str. 301
aaugauuuugauggaagaaacca

SEQ ID NO: 2022094 - RNA, 21 nt, Shigella flexneri 2a str. 301
aaugauugcguuaacugcuga

SEQ ID NO: 2022095 - RNA, 22 nt, Shigella flexneri 2a str. 301
aaugauuuccugcgugacuaaa

SEQ ID NO: 2022096 - RNA, 17 nt, Shigella flexneri 2a str. 301
aaugauuuaaaaccacu

SEQ ID NO: 2022097 - RNA, 16 nt, Shigella flexneri 2a str. 301
aaugauuuacggaaau

SEQ ID NO: 2022098 - RNA, 19 nt, Shigella flexneri 2a str. 301
aauguucguccauuucagc

SEQ ID NO: 2022099 - RNA, 23 nt, Shigella flexneri 2a str. 301
aauguuauuuaauuacugagaac

SEQ ID NO: 2022100 - RNA, 19 nt, Shigella flexneri 2a str. 301
aauguuagcaauccuugag

SEQ ID NO: 2022101 - RNA, 13 nt, Shigella flexneri 2a str. 301
aauguuaaagaga

SEQ ID NO: 2022102 - RNA, 13 nt, Shigella flexneri 2a str. 301
aauguuaacgcca

SEQ ID NO: 2022103 - RNA, 13 nt, Shigella flexneri 2a str. 301
aauguuacgaccu

SEQ ID NO: 2022104 - RNA, 16 nt, Shigella flexneri 2a str. 301
aaugugccguaaccaa

SEQ ID NO: 2022105 - RNA, 21 nt, Shigella flexneri 2a str. 301
aauguggccccugaaguucau

SEQ ID NO: 2022106 - RNA, 15 nt, Shigella flexneri 2a str. 301
aaugugaaaacccug

SEQ ID NO: 2022107 - RNA, 21 nt, Shigella flexneri 2a str. 301
aaugucgggauuuucgaugaa

SEQ ID NO: 2022108 - RNA, 18 nt, Shigella flexneri 2a str. 301
aaugucggcccgcauuau

SEQ ID NO: 2022109 - RNA, 21 nt, Shigella flexneri 2a str. 301
aauuaacaccuagugcagaua

SEQ ID NO: 2022110 - RNA, 15 nt, Shigella flexneri 2a str. 301
aauuaacaaaacaau

SEQ ID NO: 2022111 - RNA, 15 nt, Shigella flexneri 2a str. 301
aauuaaauuaucaac

SEQ ID NO: 2022112 - RNA, 12 nt, Shigella flexneri 2a str. 301
aauguuucugca

SEQ ID NO: 2022113 - RNA, 15 nt, Shigella flexneri 2a str. 301
aauguuugcaauaaa

SEQ ID NO: 2022114 - RNA, 11 nt, Shigella flexneri 2a str. 301
aauguuugcca

SEQ ID NO: 2022115 - RNA, 15 nt, Shigella flexneri 2a str. 301
aauguuuaugccugg

SEQ ID NO: 2022116 - RNA, 20 nt, Shigella flexneri 2a str. 301
aauguugucucagauucaga

SEQ ID NO: 2022117 - RNA, 23 nt, Shigella flexneri 2a str. 301
aauucugagagcaugaaaugaaa

SEQ ID NO: 2022118 - RNA, 14 nt, Shigella flexneri 2a str. 301
aauucugaguaaua

SEQ ID NO: 2022119 - RNA, 20 nt, Shigella flexneri 2a str. 301
aauucugagagcaugaaaug

SEQ ID NO: 2022120 - RNA, 18 nt, Shigella flexneri 2a str. 301
aauucgacuuucucuggc

SEQ ID NO: 2022121 - RNA, 22 nt, Shigella flexneri 2a str. 301
aauucuacagaaaugaaaaaau

SEQ ID NO: 2022122 - RNA, 15 nt, Shigella flexneri 2a str. 301
aauucuaucaugcaa

SEQ ID NO: 2022123 - RNA, 19 nt, Shigella flexneri 2a str. 301
aauucgaaauagagaaagu

SEQ ID NO: 2022124 - RNA, 21 nt, Shigella flexneri 2a str. 301
aauucgaaauagagaaaguaa

SEQ ID NO: 2022125 - RNA, 21 nt, Shigella flexneri 2a str. 301
aauuccuuucccuauuuuuuc

SEQ ID NO: 2022126 - RNA, 22 nt, Shigella flexneri 2a str. 301
aauucaucuucacuucaucccu

SEQ ID NO: 2022127 - RNA, 20 nt, Shigella flexneri 2a str. 301
aauucauuacgaaguuuaau

SEQ ID NO: 2022128 - RNA, 22 nt, Shigella flexneri 2a str. 301
aauucauucaauuaauaacaca

SEQ ID NO: 2022129 - RNA, 15 nt, Shigella flexneri 2a str. 301
aauuccagaaaagag

SEQ ID NO: 2022130 - RNA, 19 nt, Shigella flexneri 2a str. 301
aauuccacgcgccacgcac

SEQ ID NO: 2022131 - RNA, 12 nt, Shigella flexneri 2a str. 301
aauucccagaau

SEQ ID NO: 2022132 - RNA, 18 nt, Shigella flexneri 2a str. 301
aauucccaguuacugcca

SEQ ID NO: 2022133 - RNA, 23 nt, Shigella flexneri 2a str. 301
aauuauccccucaaccucuugua

SEQ ID NO: 2022134 - RNA, 21 nt, Shigella flexneri 2a str. 301
aauuaucccugcggaaaaaag

SEQ ID NO: 2022135 - RNA, 22 nt, Shigella flexneri 2a str. 301
aauuaucccugcggaaaaaaga

SEQ ID NO: 2022136 - RNA, 23 nt, Shigella flexneri 2a str. 301
aauuaucccugcggaaaaaagaa

SEQ ID NO: 2022137 - RNA, 20 nt, Shigella flexneri 2a str. 301
aauuauaguaucguuaaauu

SEQ ID NO: 2022138 - RNA, 22 nt, Shigella flexneri 2a str. 301
aauuaacguaucaauuagauuu

SEQ ID NO: 2022139 - RNA, 22 nt, Shigella flexneri 2a str. 301
aauucaccguaauaguuucuga

SEQ ID NO: 2022140 - RNA, 16 nt, Shigella flexneri 2a str. 301
aauucagaaaaauaca

SEQ ID NO: 2022141 - RNA, 18 nt, Shigella flexneri 2a str. 301
aauucagaccauuccucu

SEQ ID NO: 2022142 - RNA, 13 nt, Shigella flexneri 2a str. 301
aauuauuauaaua

SEQ ID NO: 2022143 - RNA, 19 nt, Shigella flexneri 2a str. 301
aauuaucucuguuuugcau

SEQ ID NO: 2022144 - RNA, 22 nt, Shigella flexneri 2a str. 301
aauuauuguaagcugucgaaaa

SEQ ID NO: 2022145 - RNA, 20 nt, Shigella flexneri 2a str. 301
aauugguugccggauauucc

SEQ ID NO: 2022146 - RNA, 12 nt, Shigella flexneri 2a str. 301
aauuguaaaucu

SEQ ID NO: 2022147 - RNA, 22 nt, Shigella flexneri 2a str. 301
aauugugaacgagaaaaugacg

SEQ ID NO: 2022148 - RNA, 19 nt, Shigella flexneri 2a str. 301
aauuguuuuauaaagaacu

SEQ ID NO: 2022149 - RNA, 23 nt, Shigella flexneri 2a str. 301
aauuuacagccugccagcaugca

SEQ ID NO: 2022150 - RNA, 14 nt, Shigella flexneri 2a str. 301
aauugccagcuugc

SEQ ID NO: 2022151 - RNA, 18 nt, Shigella flexneri 2a str. 301
aauugcccgaagccaauu

SEQ ID NO: 2022152 - RNA, 12 nt, Shigella flexneri 2a str. 301
aauugccagaca

SEQ ID NO: 2022153 - RNA, 13 nt, Shigella flexneri 2a str. 301
aauugccagcccu

SEQ ID NO: 2022154 - RNA, 21 nt, Shigella flexneri 2a str. 301
aauugccguuaaaacuaaaaa

SEQ ID NO: 2022155 - RNA, 17 nt, Shigella flexneri 2a str. 301
aauugcugguuuuguag

SEQ ID NO: 2022156 - RNA, 16 nt, Shigella flexneri 2a str. 301
aauuggaauacauaua

SEQ ID NO: 2022157 - RNA, 16 nt, Shigella flexneri 2a str. 301
aauuggauagugagua

SEQ ID NO: 2022158 - RNA, 18 nt, Shigella flexneri 2a str. 301
aauugcuuuuaccauacu

SEQ ID NO: 2022159 - RNA, 13 nt, Shigella flexneri 2a str. 301
aauugguagacgc

SEQ ID NO: 2022160 - RNA, 23 nt, Shigella flexneri 2a str. 301
aauugguauucugggaacuauau

SEQ ID NO: 2022161 - RNA, 23 nt, Shigella flexneri 2a str. 301
aauugcaggguuuuguuuaaaua

SEQ ID NO: 2022162 - RNA, 16 nt, Shigella flexneri 2a str. 301
aauugauggaaaauug

SEQ ID NO: 2022163 - RNA, 19 nt, Shigella flexneri 2a str. 301
aauugcauauuucaacgac

SEQ ID NO: 2022164 - RNA, 23 nt, Shigella flexneri 2a str. 301
aaaacaacgagccaauaaaaaua

SEQ ID NO: 2022165 - RNA, 15 nt, Shigella flexneri 2a str. 301
aauucuggcugaacg

SEQ ID NO: 2022166 - RNA, 22 nt, Shigella flexneri 2a str. 301
aauucuggcugaacgacaaauu

SEQ ID NO: 2022167 - RNA, 23 nt, Shigella flexneri 2a str. 301
aauucuuuuuaagaauugauggu

SEQ ID NO: 2022168 - RNA, 15 nt, Shigella flexneri 2a str. 301
aaucaaauaaaaaua

SEQ ID NO: 2022169 - RNA, 14 nt, Shigella flexneri 2a str. 301
aaucaaagucagau

SEQ ID NO: 2022170 - RNA, 22 nt, Shigella flexneri 2a str. 301
aaucaaagaugaugucacagcc

SEQ ID NO: 2022171 - RNA, 17 nt, Shigella flexneri 2a str. 301
aaucaaaccaagcagca

SEQ ID NO: 2022172 - RNA, 17 nt, Shigella flexneri 2a str. 301
aaucaacgcgauauaau

SEQ ID NO: 2022173 - RNA, 21 nt, Shigella flexneri 2a str. 301
aaucaacgcgaaaaugcccca

SEQ ID NO: 2022174 - RNA, 16 nt, Shigella flexneri 2a str. 301
aaucaacauauucccc

SEQ ID NO: 2022175 - RNA, 16 nt, Shigella flexneri 2a str. 301
aaucaacaugaaaaua

SEQ ID NO: 2022176 - RNA, 22 nt, Shigella flexneri 2a str. 301
aaucaacuuauugguaaacuca

SEQ ID NO: 2022177 - RNA, 13 nt, Shigella flexneri 2a str. 301
aaucaacugccca

SEQ ID NO: 2022178 - RNA, 23 nt, Shigella flexneri 2a str. 301
aaucacaaaaaguaguuccagca

SEQ ID NO: 2022179 - RNA, 12 nt, Shigella flexneri 2a str. 301
aaucaauuuuuc

SEQ ID NO: 2022180 - RNA, 15 nt, Shigella flexneri 2a str. 301
aaucaauuuuucauc

SEQ ID NO: 2022181 - RNA, 17 nt, Shigella flexneri 2a str. 301
aaucaauucaucgcucu

SEQ ID NO: 2022182 - RNA, 20 nt, Shigella flexneri 2a str. 301
aaucaauaaguuacacauca

SEQ ID NO: 2022183 - RNA, 16 nt, Shigella flexneri 2a str. 301
aaucaauaugcauaaa

SEQ ID NO: 2022184 - RNA, 20 nt, Shigella flexneri 2a str. 301
aaucaauccaguguaaaaca

SEQ ID NO: 2022185 - RNA, 21 nt, Shigella flexneri 2a str. 301
aaucaauggucccgacaaccu

SEQ ID NO: 2022186 - RNA, 15 nt, Shigella flexneri 2a str. 301
aaucaccuuuaaccu

SEQ ID NO: 2022187 - RNA, 17 nt, Shigella flexneri 2a str. 301
aaucaccucaucaccac

SEQ ID NO: 2022188 - RNA, 20 nt, Shigella flexneri 2a str. 301
aaucacccgugagaacugcu

SEQ ID NO: 2022189 - RNA, 19 nt, Shigella flexneri 2a str. 301
aaucaccgccaccagcguc

SEQ ID NO: 2022190 - RNA, 14 nt, Shigella flexneri 2a str. 301
aaucaccgccacca

SEQ ID NO: 2022191 - RNA, 22 nt, Shigella flexneri 2a str. 301
aaucaccgcuucacucccugcc

SEQ ID NO: 2022192 - RNA, 14 nt, Shigella flexneri 2a str. 301
aaucacaucaccau

SEQ ID NO: 2022193 - RNA, 17 nt, Shigella flexneri 2a str. 301
aaucacaucaccauaaa

SEQ ID NO: 2022194 - RNA, 21 nt, Shigella flexneri 2a str. 301
aaucacaauagaaauauugau

SEQ ID NO: 2022195 - RNA, 21 nt, Shigella flexneri 2a str. 301
aaucacacuaaccguuucuaa

SEQ ID NO: 2022196 - RNA, 13 nt, Shigella flexneri 2a str. 301
aaucagaaaggcg

SEQ ID NO: 2022197 - RNA, 18 nt, Shigella flexneri 2a str. 301
aaucagaacggaauguca

SEQ ID NO: 2022198 - RNA, 14 nt, Shigella flexneri 2a str. 301
aaucacugccagaa

SEQ ID NO: 2022199 - RNA, 13 nt, Shigella flexneri 2a str. 301
aaucacucaucau

SEQ ID NO: 2022200 - RNA, 22 nt, Shigella flexneri 2a str. 301
aaucacuauuaaagaaaguaau

SEQ ID NO: 2022201 - RNA, 23 nt, Shigella flexneri 2a str. 301
aaucacucuuccccgcuucagcc

SEQ ID NO: 2022202 - RNA, 14 nt, Shigella flexneri 2a str. 301
aaucacgcaucacu

SEQ ID NO: 2022203 - RNA, 23 nt, Shigella flexneri 2a str. 301
aaucacgcuucacccuugaugca

SEQ ID NO: 2022204 - RNA, 13 nt, Shigella flexneri 2a str. 301
aaucacgcccauu

SEQ ID NO: 2022205 - RNA, 20 nt, Shigella flexneri 2a str. 301
aauagccagcagagcaaaaa

SEQ ID NO: 2022206 - RNA, 16 nt, Shigella flexneri 2a str. 301
aauagccaucacaaaa

SEQ ID NO: 2022207 - RNA, 21 nt, Shigella flexneri 2a str. 301
aauagccaauacgauaaugcc

SEQ ID NO: 2022208 - RNA, 15 nt, Shigella flexneri 2a str. 301
aauagaguguuccuc

SEQ ID NO: 2022209 - RNA, 21 nt, Shigella flexneri 2a str. 301
aauagagugguuagagcacag

SEQ ID NO: 2022210 - RNA, 23 nt, Shigella flexneri 2a str. 301
aauaugcggugccauuaaaccaa

SEQ ID NO: 2022211 - RNA, 20 nt, Shigella flexneri 2a str. 301
aauaugcugguuccugacuc

SEQ ID NO: 2022212 - RNA, 21 nt, Shigella flexneri 2a str. 301
aauaugcugaaucgccaaaaa

SEQ ID NO: 2022213 - RNA, 17 nt, Shigella flexneri 2a str. 301
aauaugccguaaaagua

SEQ ID NO: 2022214 - RNA, 17 nt, Shigella flexneri 2a str. 301
aauauuaacuuaauaaa

SEQ ID NO: 2022215 - RNA, 20 nt, Shigella flexneri 2a str. 301
aauauuaacuuaauaaacau

SEQ ID NO: 2022216 - RNA, 22 nt, Shigella flexneri 2a str. 301
aauauguaagaucgaaggcugu

SEQ ID NO: 2022217 - RNA, 23 nt, Shigella flexneri 2a str. 301
aauauggugaaaguaaaaaagaa

SEQ ID NO: 2022218 - RNA, 20 nt, Shigella flexneri 2a str. 301
aauauggugaaaguaaaaaa

SEQ ID NO: 2022219 - RNA, 22 nt, Shigella flexneri 2a str. 301
aauauggugaaaguaaaaaaga

SEQ ID NO: 2022220 - RNA, 23 nt, Shigella flexneri 2a str. 301
aauauggaacggaugcagcauca

SEQ ID NO: 2022221 - RNA, 16 nt, Shigella flexneri 2a str. 301
aauaugucguuauaua

SEQ ID NO: 2022222 - RNA, 23 nt, Shigella flexneri 2a str. 301
aauauucuggguaguccaugacc

SEQ ID NO: 2022223 - RNA, 18 nt, Shigella flexneri 2a str. 301
aauauucauuaaaacuga

SEQ ID NO: 2022224 - RNA, 18 nt, Shigella flexneri 2a str. 301
aauauuccuuaugguuca

SEQ ID NO: 2022225 - RNA, 22 nt, Shigella flexneri 2a str. 301
aauauucacccgaauaccuuuc

SEQ ID NO: 2022226 - RNA, 22 nt, Shigella flexneri 2a str. 301
aauauugccggaugugaugcau

SEQ ID NO: 2022227 - RNA, 18 nt, Shigella flexneri 2a str. 301
aauauuguuauucgccag

SEQ ID NO: 2022228 - RNA, 16 nt, Shigella flexneri 2a str. 301
aauauugaugggaagc

SEQ ID NO: 2022229 - RNA, 21 nt, Shigella flexneri 2a str. 301
aauauugaauugcucaguaca

SEQ ID NO: 2022230 - RNA, 21 nt, Shigella flexneri 2a str. 301
aauauuucucggcaaauucau

SEQ ID NO: 2022231 - RNA, 14 nt, Shigella flexneri 2a str. 301
aauauuuccaguuc

SEQ ID NO: 2022232 - RNA, 19 nt, Shigella flexneri 2a str. 301
aaucaaaaaaggcugacaa

SEQ ID NO: 2022233 - RNA, 14 nt, Shigella flexneri 2a str. 301
aauauuuuuaugcc

SEQ ID NO: 2022234 - RNA, 13 nt, Shigella flexneri 2a str. 301
aauauuuuuaugc

SEQ ID NO: 2022235 - RNA, 20 nt, Shigella flexneri 2a str. 301
aauauuuuguugcauaauuu

SEQ ID NO: 2022236 - RNA, 17 nt, Shigella flexneri 2a str. 301
aaucuguuucaucucuu

SEQ ID NO: 2022237 - RNA, 13 nt, Shigella flexneri 2a str. 301
aaucuguugaaau

SEQ ID NO: 2022238 - RNA, 17 nt, Shigella flexneri 2a str. 301
aaucuucacuaaaauca

SEQ ID NO: 2022239 - RNA, 18 nt, Shigella flexneri 2a str. 301
aaucuucacuaaaaucau

SEQ ID NO: 2022240 - RNA, 15 nt, Shigella flexneri 2a str. 301
aaucuuauaugauga

SEQ ID NO: 2022241 - RNA, 21 nt, Shigella flexneri 2a str. 301
aaucucuuuuuccaccgcaaa

SEQ ID NO: 2022242 - RNA, 12 nt, Shigella flexneri 2a str. 301
aaucugaguauu

SEQ ID NO: 2022243 - RNA, 20 nt, Shigella flexneri 2a str. 301
aaucugcaaauuauguucuc

SEQ ID NO: 2022244 - RNA, 14 nt, Shigella flexneri 2a str. 301
aaucugauauuuag

SEQ ID NO: 2022245 - RNA, 14 nt, Shigella flexneri 2a str. 301
aaucugauaaucca

SEQ ID NO: 2022246 - RNA, 18 nt, Shigella flexneri 2a str. 301
aaucugccagaaggauug

SEQ ID NO: 2022247 - RNA, 12 nt, Shigella flexneri 2a str. 301
aaucugccagaa

SEQ ID NO: 2022248 - RNA, 19 nt, Shigella flexneri 2a str. 301
aaucugcccguuaaccaua

SEQ ID NO: 2022249 - RNA, 20 nt, Shigella flexneri 2a str. 301
aaucuggcagccuaauuccu

SEQ ID NO: 2022250 - RNA, 15 nt, Shigella flexneri 2a str. 301
aaucuggcgcaggug

SEQ ID NO: 2022251 - RNA, 17 nt, Shigella flexneri 2a str. 301
aaucgucgauuguuaua

SEQ ID NO: 2022252 - RNA, 22 nt, Shigella flexneri 2a str. 301
aaucgucaaugccgucaccagc

SEQ ID NO: 2022253 - RNA, 14 nt, Shigella flexneri 2a str. 301
aaucgucaguucac

SEQ ID NO: 2022254 - RNA, 19 nt, Shigella flexneri 2a str. 301
aaucgucaguuuuucacga

SEQ ID NO: 2022255 - RNA, 20 nt, Shigella flexneri 2a str. 301
aaucgcagcacuggugcugu

SEQ ID NO: 2022256 - RNA, 21 nt, Shigella flexneri 2a str. 301
aaucgcauugacgccaaaaua

SEQ ID NO: 2022257 - RNA, 22 nt, Shigella flexneri 2a str. 301
aaucgcauugacgccaaaauaa

SEQ ID NO: 2022258 - RNA, 12 nt, Shigella flexneri 2a str. 301
aaucgcauugcg

SEQ ID NO: 2022259 - RNA, 14 nt, Shigella flexneri 2a str. 301
aaucgccaaaaaca

SEQ ID NO: 2022260 - RNA, 15 nt, Shigella flexneri 2a str. 301
aaucgccaaaaacau

SEQ ID NO: 2022261 - RNA, 19 nt, Shigella flexneri 2a str. 301
aaucgccacaacuucaacg

SEQ ID NO: 2022262 - RNA, 24 nt, Shigella flexneri 2a str. 301
aaucucacccgguacaucaauacc

SEQ ID NO: 2022263 - RNA, 20 nt, Shigella flexneri 2a str. 301
aaucucacuccggccagagc

SEQ ID NO: 2022264 - RNA, 20 nt, Shigella flexneri 2a str. 301
aaucucagcccgaugauaaa

SEQ ID NO: 2022265 - RNA, 22 nt, Shigella flexneri 2a str. 301
aaucuacaaaagauuauugcuu

SEQ ID NO: 2022266 - RNA, 20 nt, Shigella flexneri 2a str. 301
aaucuaccgucaugcugacc

SEQ ID NO: 2022267 - RNA, 22 nt, Shigella flexneri 2a str. 301
aaucuacgguggaacauuuacc

SEQ ID NO: 2022268 - RNA, 19 nt, Shigella flexneri 2a str. 301
aaucccugcgaacugcgca

SEQ ID NO: 2022269 - RNA, 16 nt, Shigella flexneri 2a str. 301
aaucccuggauuugcc

SEQ ID NO: 2022270 - RNA, 20 nt, Shigella flexneri 2a str. 301
aaucccuuagcuaauuuuug

SEQ ID NO: 2022271 - RNA, 12 nt, Shigella flexneri 2a str. 301
aaucccuucgac

SEQ ID NO: 2022272 - RNA, 19 nt, Shigella flexneri 2a str. 301
aauccgccagaaaucagcu

SEQ ID NO: 2022273 - RNA, 22 nt, Shigella flexneri 2a str. 301
aauccgagaaucguacucacca

SEQ ID NO: 2022274 - RNA, 13 nt, Shigella flexneri 2a str. 301
aauccggaagaau

SEQ ID NO: 2022275 - RNA, 19 nt, Shigella flexneri 2a str. 301
aauccguaauauucgccuc

SEQ ID NO: 2022276 - RNA, 18 nt, Shigella flexneri 2a str. 301
aauccgguagguucaaca

SEQ ID NO: 2022277 - RNA, 18 nt, Shigella flexneri 2a str. 301
aauccgggugaacugcca

SEQ ID NO: 2022278 - RNA, 21 nt, Shigella flexneri 2a str. 301
aauccggugccauagacugga

SEQ ID NO: 2022279 - RNA, 21 nt, Shigella flexneri 2a str. 301
aauccuucacuuuugccagac

SEQ ID NO: 2022280 - RNA, 22 nt, Shigella flexneri 2a str. 301
aauccuucacuuuugccagacg

SEQ ID NO: 2022281 - RNA, 17 nt, Shigella flexneri 2a str. 301
aauccuucacuuuugcc

SEQ ID NO: 2022282 - RNA, 14 nt, Shigella flexneri 2a str. 301
aauccuucuuguuc

SEQ ID NO: 2022283 - RNA, 24 nt, Shigella flexneri 2a str. 301
aaucgaucaucaccugagcuggca

SEQ ID NO: 2022284 - RNA, 19 nt, Shigella flexneri 2a str. 301
aaucgagccgauuaaaauc

SEQ ID NO: 2022285 - RNA, 11 nt, Shigella flexneri 2a str. 301
aaucagcacac

SEQ ID NO: 2022286 - RNA, 20 nt, Shigella flexneri 2a str. 301
aaucagcagauaucccgcca

SEQ ID NO: 2022287 - RNA, 22 nt, Shigella flexneri 2a str. 301
aaucagcaaggaaagccacugu

SEQ ID NO: 2022288 - RNA, 14 nt, Shigella flexneri 2a str. 301
aaucagcacaauaa

SEQ ID NO: 2022289 - RNA, 17 nt, Shigella flexneri 2a str. 301
aaucagauugccacagg

SEQ ID NO: 2022290 - RNA, 23 nt, Shigella flexneri 2a str. 301
aaucagauaaaauacacuuuaau

SEQ ID NO: 2022291 - RNA, 16 nt, Shigella flexneri 2a str. 301
aaucagauaaaauaca

SEQ ID NO: 2022292 - RNA, 14 nt, Shigella flexneri 2a str. 301
aaucagauaaaaua

SEQ ID NO: 2022293 - RNA, 12 nt, Shigella flexneri 2a str. 301
aaucagauaaaa

SEQ ID NO: 2022294 - RNA, 17 nt, Shigella flexneri 2a str. 301
aaucaugcaauaaauau

SEQ ID NO: 2022295 - RNA, 12 nt, Shigella flexneri 2a str. 301
aaucaugcaaua

SEQ ID NO: 2022296 - RNA, 17 nt, Shigella flexneri 2a str. 301
aaucaugccaaaaauaa

SEQ ID NO: 2022297 - RNA, 15 nt, Shigella flexneri 2a str. 301
aauccaaacauggca

SEQ ID NO: 2022298 - RNA, 16 nt, Shigella flexneri 2a str. 301
aauccacguuccagau

SEQ ID NO: 2022299 - RNA, 19 nt, Shigella flexneri 2a str. 301
aauccacgguuuaucggcg

SEQ ID NO: 2022300 - RNA, 16 nt, Shigella flexneri 2a str. 301
aaucauuuuuugaagu

SEQ ID NO: 2022301 - RNA, 16 nt, Shigella flexneri 2a str. 301
aauccacuucgccaga

SEQ ID NO: 2022302 - RNA, 15 nt, Shigella flexneri 2a str. 301
aauccagaacaccau

SEQ ID NO: 2022303 - RNA, 21 nt, Shigella flexneri 2a str. 301
aauccagauccugauccugca

SEQ ID NO: 2022304 - RNA, 11 nt, Shigella flexneri 2a str. 301
aauccagcaau

SEQ ID NO: 2022305 - RNA, 15 nt, Shigella flexneri 2a str. 301
aauccagcaccguca

SEQ ID NO: 2022306 - RNA, 22 nt, Shigella flexneri 2a str. 301
aauccagauuuauaaaagaaaa

SEQ ID NO: 2022307 - RNA, 15 nt, Shigella flexneri 2a str. 301
aaucccaaaauaaua

SEQ ID NO: 2022308 - RNA, 13 nt, Shigella flexneri 2a str. 301
aaucccagacuua

SEQ ID NO: 2022309 - RNA, 24 nt, Shigella flexneri 2a str. 301
acaaucgucagcucgcugccauca

SEQ ID NO: 2022310 - RNA, 14 nt, Shigella flexneri 2a str. 301
acaaucgcuuaauc

SEQ ID NO: 2022311 - RNA, 23 nt, Shigella flexneri 2a str. 301
acaaucgcuucaucgcccacauc

SEQ ID NO: 2022312 - RNA, 13 nt, Shigella flexneri 2a str. 301
acaaucaaauccu

SEQ ID NO: 2022313 - RNA, 18 nt, Shigella flexneri 2a str. 301
acaaucacgauagccaga

SEQ ID NO: 2022314 - RNA, 23 nt, Shigella flexneri 2a str. 301
acaaucagccagaacagcggugc

SEQ ID NO: 2022315 - RNA, 20 nt, Shigella flexneri 2a str. 301
acaaucaccaggucaccaga

SEQ ID NO: 2022316 - RNA, 22 nt, Shigella flexneri 2a str. 301
acaaugagauauuuaaaugauu

SEQ ID NO: 2022317 - RNA, 14 nt, Shigella flexneri 2a str. 301
acaaugagauauuu

SEQ ID NO: 2022318 - RNA, 18 nt, Shigella flexneri 2a str. 301
acaaugccgauaaauaca

SEQ ID NO: 2022319 - RNA, 13 nt, Shigella flexneri 2a str. 301
acaaugcaauaau

SEQ ID NO: 2022320 - RNA, 18 nt, Shigella flexneri 2a str. 301
acaauugcgggccaaaga

SEQ ID NO: 2022321 - RNA, 20 nt, Shigella flexneri 2a str. 301
acaauugcgggccaaagacc

SEQ ID NO: 2022322 - RNA, 19 nt, Shigella flexneri 2a str. 301
acaauugaagaauaucuuc

SEQ ID NO: 2022323 - RNA, 15 nt, Shigella flexneri 2a str. 301
acaauugaccaguaa

SEQ ID NO: 2022324 - RNA, 15 nt, Shigella flexneri 2a str. 301
acaauugagauucaa

SEQ ID NO: 2022325 - RNA, 18 nt, Shigella flexneri 2a str. 301
acaauucccaguuacugc

SEQ ID NO: 2022326 - RNA, 15 nt, Shigella flexneri 2a str. 301
acaauucgccagggc

SEQ ID NO: 2022327 - RNA, 22 nt, Shigella flexneri 2a str. 301
acaauucgcguaguaaagccuu

SEQ ID NO: 2022328 - RNA, 14 nt, Shigella flexneri 2a str. 301
acaauagaaauauu

SEQ ID NO: 2022329 - RNA, 20 nt, Shigella flexneri 2a str. 301
acaauauugaugcucacugc

SEQ ID NO: 2022330 - RNA, 17 nt, Shigella flexneri 2a str. 301
acaagugggugcuucac

SEQ ID NO: 2022331 - RNA, 14 nt, Shigella flexneri 2a str. 301
acaaggcaucguga

SEQ ID NO: 2022332 - RNA, 21 nt, Shigella flexneri 2a str. 301
acaaggaauguggcaaugagu

SEQ ID NO: 2022333 - RNA, 19 nt, Shigella flexneri 2a str. 301
acaaggaauguggcaauga

SEQ ID NO: 2022334 - RNA, 20 nt, Shigella flexneri 2a str. 301
acaagguuugaaaaaaccug

SEQ ID NO: 2022335 - RNA, 14 nt, Shigella flexneri 2a str. 301
acaagguacgaaaa

SEQ ID NO: 2022336 - RNA, 22 nt, Shigella flexneri 2a str. 301
acaagggcauauuucgucagca

SEQ ID NO: 2022337 - RNA, 22 nt, Shigella flexneri 2a str. 301
acaagggaaauaagaaaagcga

SEQ ID NO: 2022338 - RNA, 15 nt, Shigella flexneri 2a str. 301
acaagcguaagagaa

SEQ ID NO: 2022339 - RNA, 14 nt, Shigella flexneri 2a str. 301
acaagcuccggcuu

SEQ ID NO: 2022340 - RNA, 18 nt, Shigella flexneri 2a str. 301
acaacgaccggccauucc

SEQ ID NO: 2022341 - RNA, 13 nt, Shigella flexneri 2a str. 301
acaacgagcgcaa

SEQ ID NO: 2022342 - RNA, 23 nt, Shigella flexneri 2a str. 301
acaccguccggcgggcaaauucu

SEQ ID NO: 2022343 - RNA, 13 nt, Shigella flexneri 2a str. 301
acaccggaccaga

SEQ ID NO: 2022344 - RNA, 22 nt, Shigella flexneri 2a str. 301
acaccgcugacuuucaaacgcc

SEQ ID NO: 2022345 - RNA, 20 nt, Shigella flexneri 2a str. 301
acaccuucagcgaagcccac

SEQ ID NO: 2022346 - RNA, 19 nt, Shigella flexneri 2a str. 301
acaccuucagcgaagccca

SEQ ID NO: 2022347 - RNA, 22 nt, Shigella flexneri 2a str. 301
acaccugggcaauggugaacug

SEQ ID NO: 2022348 - RNA, 13 nt, Shigella flexneri 2a str. 301
acaccuuaaggcu

SEQ ID NO: 2022349 - RNA, 21 nt, Shigella flexneri 2a str. 301
acacgcugcgguuuacgccag

SEQ ID NO: 2022350 - RNA, 20 nt, Shigella flexneri 2a str. 301
acacgcucuggcaggcuuca

SEQ ID NO: 2022351 - RNA, 20 nt, Shigella flexneri 2a str. 301
acacgcuaccacaagccacc

SEQ ID NO: 2022352 - RNA, 19 nt, Shigella flexneri 2a str. 301
acacggcagcaaccgcuuc

SEQ ID NO: 2022353 - RNA, 20 nt, Shigella flexneri 2a str. 301
acacgccgccagaccaauag

SEQ ID NO: 2022354 - RNA, 18 nt, Shigella flexneri 2a str. 301
acacgccgcgaggcaaau

SEQ ID NO: 2022355 - RNA, 19 nt, Shigella flexneri 2a str. 301
acacgccaggccacgcuuu

SEQ ID NO: 2022356 - RNA, 16 nt, Shigella flexneri 2a str. 301
acacaaauccagcacc

SEQ ID NO: 2022357 - RNA, 17 nt, Shigella flexneri 2a str. 301
acacaacagacauuacc

SEQ ID NO: 2022358 - RNA, 13 nt, Shigella flexneri 2a str. 301
acaccaacaucac

SEQ ID NO: 2022359 - RNA, 14 nt, Shigella flexneri 2a str. 301
acaccaacaucacg

SEQ ID NO: 2022360 - RNA, 18 nt, Shigella flexneri 2a str. 301
acaccaacaggugccgga

SEQ ID NO: 2022361 - RNA, 13 nt, Shigella flexneri 2a str. 301
acaccaaacagac

SEQ ID NO: 2022362 - RNA, 17 nt, Shigella flexneri 2a str. 301
acacauuacugcuugcu

SEQ ID NO: 2022363 - RNA, 14 nt, Shigella flexneri 2a str. 301
acacauugcuguau

SEQ ID NO: 2022364 - RNA, 20 nt, Shigella flexneri 2a str. 301
acacauugcuguaucacuau

SEQ ID NO: 2022365 - RNA, 19 nt, Shigella flexneri 2a str. 301
acacauuaucucaacacac

SEQ ID NO: 2022366 - RNA, 21 nt, Shigella flexneri 2a str. 301
acaccgcgaucuuccacgccu

SEQ ID NO: 2022367 - RNA, 22 nt, Shigella flexneri 2a str. 301
acaccgcagccgccacaauaaa

SEQ ID NO: 2022368 - RNA, 22 nt, Shigella flexneri 2a str. 301
acaccgauuuuguaaaagaagg

SEQ ID NO: 2022369 - RNA, 15 nt, Shigella flexneri 2a str. 301
acaccgauugccccu

SEQ ID NO: 2022370 - RNA, 14 nt, Shigella flexneri 2a str. 301
acaccgauuuugua

SEQ ID NO: 2022371 - RNA, 14 nt, Shigella flexneri 2a str. 301
acacccaguucaac

SEQ ID NO: 2022372 - RNA, 12 nt, Shigella flexneri 2a str. 301
acacccacauca

SEQ ID NO: 2022373 - RNA, 16 nt, Shigella flexneri 2a str. 301
acacccaaaacaaagc

SEQ ID NO: 2022374 - RNA, 18 nt, Shigella flexneri 2a str. 301
acacccauggggaugcug

SEQ ID NO: 2022375 - RNA, 12 nt, Shigella flexneri 2a str. 301
acacccagcccc

SEQ ID NO: 2022376 - RNA, 14 nt, Shigella flexneri 2a str. 301
acaccaacgccccg

SEQ ID NO: 2022377 - RNA, 18 nt, Shigella flexneri 2a str. 301
acaaaaaugcccgauccu

SEQ ID NO: 2022378 - RNA, 14 nt, Shigella flexneri 2a str. 301
acaaaacaauggga

SEQ ID NO: 2022379 - RNA, 21 nt, Shigella flexneri 2a str. 301
acaaaaaguaguuccagcaug

SEQ ID NO: 2022380 - RNA, 15 nt, Shigella flexneri 2a str. 301
acaaaaacucauaaa

SEQ ID NO: 2022381 - RNA, 16 nt, Shigella flexneri 2a str. 301
acaaaaaagccaauca

SEQ ID NO: 2022382 - RNA, 15 nt, Shigella flexneri 2a str. 301
acaaaaaaugugaag

SEQ ID NO: 2022383 - RNA, 16 nt, Shigella flexneri 2a str. 301
aauuuuuuuucaguug

SEQ ID NO: 2022384 - RNA, 16 nt, Shigella flexneri 2a str. 301
acaaaagcgaagcgaa

SEQ ID NO: 2022385 - RNA, 17 nt, Shigella flexneri 2a str. 301
acaaaagcggugauaaa

SEQ ID NO: 2022386 - RNA, 15 nt, Shigella flexneri 2a str. 301
acaaaaucuuaaaga

SEQ ID NO: 2022387 - RNA, 18 nt, Shigella flexneri 2a str. 301
acaaaaucggaaacaaau

SEQ ID NO: 2022388 - RNA, 14 nt, Shigella flexneri 2a str. 301
acaaaauccugcca

SEQ ID NO: 2022389 - RNA, 13 nt, Shigella flexneri 2a str. 301
acaaacucuuuuc

SEQ ID NO: 2022390 - RNA, 14 nt, Shigella flexneri 2a str. 301
acaaacggaaaaca

SEQ ID NO: 2022391 - RNA, 19 nt, Shigella flexneri 2a str. 301
acaaacgcuguaauuacca

SEQ ID NO: 2022392 - RNA, 21 nt, Shigella flexneri 2a str. 301
acaaacgcuuuacucaacucc

SEQ ID NO: 2022393 - RNA, 14 nt, Shigella flexneri 2a str. 301
acaaacgacgggcc

SEQ ID NO: 2022394 - RNA, 17 nt, Shigella flexneri 2a str. 301
acaaaccguugcugcaa

SEQ ID NO: 2022395 - RNA, 16 nt, Shigella flexneri 2a str. 301
acaaacgcaaacacca

SEQ ID NO: 2022396 - RNA, 16 nt, Shigella flexneri 2a str. 301
acaaacgccagauaca

SEQ ID NO: 2022397 - RNA, 19 nt, Shigella flexneri 2a str. 301
acaaacgccagauacauca

SEQ ID NO: 2022398 - RNA, 18 nt, Shigella flexneri 2a str. 301
acaaacauugcugccaga

SEQ ID NO: 2022399 - RNA, 18 nt, Shigella flexneri 2a str. 301
acaaaccauaagguggga

SEQ ID NO: 2022400 - RNA, 22 nt, Shigella flexneri 2a str. 301
acaaaccgaguuaguccacacg

SEQ ID NO: 2022401 - RNA, 14 nt, Shigella flexneri 2a str. 301
acaaacacaaaacu

SEQ ID NO: 2022402 - RNA, 13 nt, Shigella flexneri 2a str. 301
acaaacacaauau

SEQ ID NO: 2022403 - RNA, 18 nt, Shigella flexneri 2a str. 301
acaaacaccgaaccagag

SEQ ID NO: 2022404 - RNA, 15 nt, Shigella flexneri 2a str. 301
acaaacaaugagaau

SEQ ID NO: 2022405 - RNA, 16 nt, Shigella flexneri 2a str. 301
acaaaauuuucagcgu

SEQ ID NO: 2022406 - RNA, 18 nt, Shigella flexneri 2a str. 301
acaaagacaucaaacccu

SEQ ID NO: 2022407 - RNA, 15 nt, Shigella flexneri 2a str. 301
acaaagaagggaaug

SEQ ID NO: 2022408 - RNA, 13 nt, Shigella flexneri 2a str. 301
acaaagagcuuuc

SEQ ID NO: 2022409 - RNA, 18 nt, Shigella flexneri 2a str. 301
acaaacugguguugaaac

SEQ ID NO: 2022410 - RNA, 15 nt, Shigella flexneri 2a str. 301
acaaagccaacagca

SEQ ID NO: 2022411 - RNA, 16 nt, Shigella flexneri 2a str. 301
acaaaggcuugcugca

SEQ ID NO: 2022412 - RNA, 23 nt, Shigella flexneri 2a str. 301
acaaaugucacugcuuuggcucu

SEQ ID NO: 2022413 - RNA, 17 nt, Shigella flexneri 2a str. 301
acaaauggcaaugacua

SEQ ID NO: 2022414 - RNA, 18 nt, Shigella flexneri 2a str. 301
acaaauggcaaugacuag

SEQ ID NO: 2022415 - RNA, 18 nt, Shigella flexneri 2a str. 301
acaaaugcaguuuuuaau

SEQ ID NO: 2022416 - RNA, 21 nt, Shigella flexneri 2a str. 301
acaaauucuggcggcaauaac

SEQ ID NO: 2022417 - RNA, 18 nt, Shigella flexneri 2a str. 301
acaaauuccgaacaaaac

SEQ ID NO: 2022418 - RNA, 21 nt, Shigella flexneri 2a str. 301
acaaauucacgccuucuucca

SEQ ID NO: 2022419 - RNA, 13 nt, Shigella flexneri 2a str. 301
acaaauccagcac

SEQ ID NO: 2022420 - RNA, 15 nt, Shigella flexneri 2a str. 301
acaaauccagcaccg

SEQ ID NO: 2022421 - RNA, 21 nt, Shigella flexneri 2a str. 301
acaaaugaccgacguuaugcu

SEQ ID NO: 2022422 - RNA, 16 nt, Shigella flexneri 2a str. 301
acaaaugaacaccaaa

SEQ ID NO: 2022423 - RNA, 23 nt, Shigella flexneri 2a str. 301
acaaauagagauagaaugccaag

SEQ ID NO: 2022424 - RNA, 20 nt, Shigella flexneri 2a str. 301
acaaauacgcuuuuucccug

SEQ ID NO: 2022425 - RNA, 19 nt, Shigella flexneri 2a str. 301
acaaauacgcuuuuucccu

SEQ ID NO: 2022426 - RNA, 13 nt, Shigella flexneri 2a str. 301
acaaauagacaca

SEQ ID NO: 2022427 - RNA, 15 nt, Shigella flexneri 2a str. 301
acaaauagccaauuc

SEQ ID NO: 2022428 - RNA, 18 nt, Shigella flexneri 2a str. 301
acaaauaaaagcaaaaau

SEQ ID NO: 2022429 - RNA, 20 nt, Shigella flexneri 2a str. 301
acaaagggcgucgcuuaauu

SEQ ID NO: 2022430 - RNA, 16 nt, Shigella flexneri 2a str. 301
acaacacucucugaag

SEQ ID NO: 2022431 - RNA, 17 nt, Shigella flexneri 2a str. 301
acaacacucucugaagu

SEQ ID NO: 2022432 - RNA, 13 nt, Shigella flexneri 2a str. 301
acaacacuucaua

SEQ ID NO: 2022433 - RNA, 19 nt, Shigella flexneri 2a str. 301
acaacagaaauaaucgcaa

SEQ ID NO: 2022434 - RNA, 19 nt, Shigella flexneri 2a str. 301
acaacagucccaggcagaa

SEQ ID NO: 2022435 - RNA, 22 nt, Shigella flexneri 2a str. 301
acaacagucccaggcagaagcg

SEQ ID NO: 2022436 - RNA, 14 nt, Shigella flexneri 2a str. 301
acaacaacacccau

SEQ ID NO: 2022437 - RNA, 22 nt, Shigella flexneri 2a str. 301
acaacacccggucagccauugc

SEQ ID NO: 2022438 - RNA, 15 nt, Shigella flexneri 2a str. 301
acaacaaacgcaaac

SEQ ID NO: 2022439 - RNA, 16 nt, Shigella flexneri 2a str. 301
acaaauuugugcucug

SEQ ID NO: 2022440 - RNA, 20 nt, Shigella flexneri 2a str. 301
acaacaucacaccugcucag

SEQ ID NO: 2022441 - RNA, 14 nt, Shigella flexneri 2a str. 301
acaacaucaucugc

SEQ ID NO: 2022442 - RNA, 15 nt, Shigella flexneri 2a str. 301
acaacaucaucugcc

SEQ ID NO: 2022443 - RNA, 13 nt, Shigella flexneri 2a str. 301
acaacaugcagcc

SEQ ID NO: 2022444 - RNA, 21 nt, Shigella flexneri 2a str. 301
acaacaugcagcccagcauca

SEQ ID NO: 2022445 - RNA, 18 nt, Shigella flexneri 2a str. 301
acaacaugagaacaguuc

SEQ ID NO: 2022446 - RNA, 12 nt, Shigella flexneri 2a str. 301
acaaccaucccu

SEQ ID NO: 2022447 - RNA, 15 nt, Shigella flexneri 2a str. 301
acaaccgaggcucaa

SEQ ID NO: 2022448 - RNA, 18 nt, Shigella flexneri 2a str. 301
acaaccugaccuuuuuuc

SEQ ID NO: 2022449 - RNA, 14 nt, Shigella flexneri 2a str. 301
accaacaaagccac

SEQ ID NO: 2022450 - RNA, 22 nt, Shigella flexneri 2a str. 301
accaacaaauagagauagaaug

SEQ ID NO: 2022451 - RNA, 12 nt, Shigella flexneri 2a str. 301
accaaaugacuc

SEQ ID NO: 2022452 - RNA, 13 nt, Shigella flexneri 2a str. 301
accaacaucacgc

SEQ ID NO: 2022453 - RNA, 14 nt, Shigella flexneri 2a str. 301
accaaauaaacgaa

SEQ ID NO: 2022454 - RNA, 16 nt, Shigella flexneri 2a str. 301
accaaagccuuucacu

SEQ ID NO: 2022455 - RNA, 17 nt, Shigella flexneri 2a str. 301
accaaagccuuucacuu

SEQ ID NO: 2022456 - RNA, 13 nt, Shigella flexneri 2a str. 301
accaaauacacgc

SEQ ID NO: 2022457 - RNA, 23 nt, Shigella flexneri 2a str. 301
accaaaaucaggccgaggcacag

SEQ ID NO: 2022458 - RNA, 12 nt, Shigella flexneri 2a str. 301
accaaaaucauc

SEQ ID NO: 2022459 - RNA, 16 nt, Shigella flexneri 2a str. 301
accaaaaucaucaauu

SEQ ID NO: 2022460 - RNA, 22 nt, Shigella flexneri 2a str. 301
accaaacccugagugaauuguu

SEQ ID NO: 2022461 - RNA, 14 nt, Shigella flexneri 2a str. 301
accaaagaaaucag

SEQ ID NO: 2022462 - RNA, 16 nt, Shigella flexneri 2a str. 301
accaaacuucagcccu

SEQ ID NO: 2022463 - RNA, 12 nt, Shigella flexneri 2a str. 301
accaaaccugca

SEQ ID NO: 2022464 - RNA, 20 nt, Shigella flexneri 2a str. 301
accaaaacgugcagcugccu

SEQ ID NO: 2022465 - RNA, 17 nt, Shigella flexneri 2a str. 301
accaaaacagcgacacc

SEQ ID NO: 2022466 - RNA, 15 nt, Shigella flexneri 2a str. 301
accaaaacaccagcc

SEQ ID NO: 2022467 - RNA, 16 nt, Shigella flexneri 2a str. 301
accaaaaaaucaaugc

SEQ ID NO: 2022468 - RNA, 19 nt, Shigella flexneri 2a str. 301
acauuacguccaucacaau

SEQ ID NO: 2022469 - RNA, 19 nt, Shigella flexneri 2a str. 301
acauuaccacgauuuugac

SEQ ID NO: 2022470 - RNA, 18 nt, Shigella flexneri 2a str. 301
acauugcaguggcgugcc

SEQ ID NO: 2022471 - RNA, 19 nt, Shigella flexneri 2a str. 301
acauuguuaaagccuugcu

SEQ ID NO: 2022472 - RNA, 21 nt, Shigella flexneri 2a str. 301
acauugacgauagcgccgcca

SEQ ID NO: 2022473 - RNA, 15 nt, Shigella flexneri 2a str. 301
acauugagcuugcgu

SEQ ID NO: 2022474 - RNA, 15 nt, Shigella flexneri 2a str. 301
acauugaccagccaa

SEQ ID NO: 2022475 - RNA, 13 nt, Shigella flexneri 2a str. 301
acauugauauaca

SEQ ID NO: 2022476 - RNA, 12 nt, Shigella flexneri 2a str. 301
acauugaagaau

SEQ ID NO: 2022477 - RNA, 13 nt, Shigella flexneri 2a str. 301
acauuuuccauca

SEQ ID NO: 2022478 - RNA, 11 nt, Shigella flexneri 2a str. 301
acauuuuccau

SEQ ID NO: 2022479 - RNA, 12 nt, Shigella flexneri 2a str. 301
acauuucugcug

SEQ ID NO: 2022480 - RNA, 12 nt, Shigella flexneri 2a str. 301
acauuucuuuug

SEQ ID NO: 2022481 - RNA, 18 nt, Shigella flexneri 2a str. 301
acauuugcuuuuguuaau

SEQ ID NO: 2022482 - RNA, 20 nt, Shigella flexneri 2a str. 301
acauuugcggcgaacugccg

SEQ ID NO: 2022483 - RNA, 19 nt, Shigella flexneri 2a str. 301
acaucuggcgagucaccau

SEQ ID NO: 2022484 - RNA, 16 nt, Shigella flexneri 2a str. 301
acaugaagcacugcau

SEQ ID NO: 2022485 - RNA, 19 nt, Shigella flexneri 2a str. 301
acaucugucugauaaaaaa

SEQ ID NO: 2022486 - RNA, 18 nt, Shigella flexneri 2a str. 301
acaucuaccgccagccag

SEQ ID NO: 2022487 - RNA, 16 nt, Shigella flexneri 2a str. 301
acaucguaucuggcaa

SEQ ID NO: 2022488 - RNA, 14 nt, Shigella flexneri 2a str. 301
acaucgucaggggc

SEQ ID NO: 2022489 - RNA, 21 nt, Shigella flexneri 2a str. 301
acaucgucaggggcauuuuca

SEQ ID NO: 2022490 - RNA, 20 nt, Shigella flexneri 2a str. 301
acaucgucuuuuucucccuu

SEQ ID NO: 2022491 - RNA, 20 nt, Shigella flexneri 2a str. 301
acaucguugacauuugcuuu

SEQ ID NO: 2022492 - RNA, 21 nt, Shigella flexneri 2a str. 301
acaucguugacauuugcuuuu

SEQ ID NO: 2022493 - RNA, 19 nt, Shigella flexneri 2a str. 301
acauguacauggugcacau

SEQ ID NO: 2022494 - RNA, 19 nt, Shigella flexneri 2a str. 301
acaugcggugauuuugccu

SEQ ID NO: 2022495 - RNA, 23 nt, Shigella flexneri 2a str. 301
acaugcgguucacgcgccagaga

SEQ ID NO: 2022496 - RNA, 15 nt, Shigella flexneri 2a str. 301
acaugagagaaaauc

SEQ ID NO: 2022497 - RNA, 12 nt, Shigella flexneri 2a str. 301
acaugagagaaa

SEQ ID NO: 2022498 - RNA, 19 nt, Shigella flexneri 2a str. 301
acaugagaacaguucagca

SEQ ID NO: 2022499 - RNA, 17 nt, Shigella flexneri 2a str. 301
acaugcgauaaagcaua

SEQ ID NO: 2022500 - RNA, 17 nt, Shigella flexneri 2a str. 301
acaugcgcgacaaaaau

SEQ ID NO: 2022501 - RNA, 21 nt, Shigella flexneri 2a str. 301
acaugcgcgacaaaaauuacu

SEQ ID NO: 2022502 - RNA, 15 nt, Shigella flexneri 2a str. 301
acaugccugcauaaa

SEQ ID NO: 2022503 - RNA, 13 nt, Shigella flexneri 2a str. 301
acauaaucgaaaa

SEQ ID NO: 2022504 - RNA, 12 nt, Shigella flexneri 2a str. 301
acauaauggccg

SEQ ID NO: 2022505 - RNA, 15 nt, Shigella flexneri 2a str. 301
acaucaagauaacua

SEQ ID NO: 2022506 - RNA, 14 nt, Shigella flexneri 2a str. 301
acauaacugccucg

SEQ ID NO: 2022507 - RNA, 21 nt, Shigella flexneri 2a str. 301
acaucaccaaugaaagcccca

SEQ ID NO: 2022508 - RNA, 13 nt, Shigella flexneri 2a str. 301
acaucaccaacac

SEQ ID NO: 2022509 - RNA, 13 nt, Shigella flexneri 2a str. 301
acaucacaugcug

SEQ ID NO: 2022510 - RNA, 22 nt, Shigella flexneri 2a str. 301
acaucacaccugcucagcccgu

SEQ ID NO: 2022511 - RNA, 19 nt, Shigella flexneri 2a str. 301
acaucaccccgccgggcuu

SEQ ID NO: 2022512 - RNA, 16 nt, Shigella flexneri 2a str. 301
acaucauccagugccg

SEQ ID NO: 2022513 - RNA, 13 nt, Shigella flexneri 2a str. 301
acaucaucugcca

SEQ ID NO: 2022514 - RNA, 19 nt, Shigella flexneri 2a str. 301
acaucgcugauuucaccau

SEQ ID NO: 2022515 - RNA, 23 nt, Shigella flexneri 2a str. 301
acaucgcugauuucaccaucuuc

SEQ ID NO: 2022516 - RNA, 13 nt, Shigella flexneri 2a str. 301
acaucgcugugcu

SEQ ID NO: 2022517 - RNA, 21 nt, Shigella flexneri 2a str. 301
acaucgcguugacguucaugc

SEQ ID NO: 2022518 - RNA, 22 nt, Shigella flexneri 2a str. 301
acauccugcguuaaucgccgua

SEQ ID NO: 2022519 - RNA, 20 nt, Shigella flexneri 2a str. 301
acaucaugcgucaccaacag

SEQ ID NO: 2022520 - RNA, 15 nt, Shigella flexneri 2a str. 301
acaucaugcugccgg

SEQ ID NO: 2022521 - RNA, 17 nt, Shigella flexneri 2a str. 301
acauccucuucaagaau

SEQ ID NO: 2022522 - RNA, 17 nt, Shigella flexneri 2a str. 301
acauccggcaaaaacaa

SEQ ID NO: 2022523 - RNA, 16 nt, Shigella flexneri 2a str. 301
acaggugcuccagggu

SEQ ID NO: 2022524 - RNA, 14 nt, Shigella flexneri 2a str. 301
acaggucuguauga

SEQ ID NO: 2022525 - RNA, 21 nt, Shigella flexneri 2a str. 301
acaggucaaaguaaccuuuga

SEQ ID NO: 2022526 - RNA, 17 nt, Shigella flexneri 2a str. 301
acagggcucuuaagcac

SEQ ID NO: 2022527 - RNA, 15 nt, Shigella flexneri 2a str. 301
acagguaaggcgcga

SEQ ID NO: 2022528 - RNA, 15 nt, Shigella flexneri 2a str. 301
acaggggcuggaaga

SEQ ID NO: 2022529 - RNA, 15 nt, Shigella flexneri 2a str. 301
acagguuuaaacaga

SEQ ID NO: 2022530 - RNA, 16 nt, Shigella flexneri 2a str. 301
acagguuuaaacagag

SEQ ID NO: 2022531 - RNA, 20 nt, Shigella flexneri 2a str. 301
acagguuuaaacagagauua

SEQ ID NO: 2022532 - RNA, 15 nt, Shigella flexneri 2a str. 301
acaguaaagcgcaaa

SEQ ID NO: 2022533 - RNA, 15 nt, Shigella flexneri 2a str. 301
acaguaacccggcac

SEQ ID NO: 2022534 - RNA, 17 nt, Shigella flexneri 2a str. 301
acaguaaugauuuaaaa

SEQ ID NO: 2022535 - RNA, 16 nt, Shigella flexneri 2a str. 301
acaguacaauaugaau

SEQ ID NO: 2022536 - RNA, 20 nt, Shigella flexneri 2a str. 301
acagucaguuaucgcauuau

SEQ ID NO: 2022537 - RNA, 13 nt, Shigella flexneri 2a str. 301
acagucaggcugu

SEQ ID NO: 2022538 - RNA, 16 nt, Shigella flexneri 2a str. 301
acauaaagucuuucuu

SEQ ID NO: 2022539 - RNA, 13 nt, Shigella flexneri 2a str. 301
acauaaccacuca

SEQ ID NO: 2022540 - RNA, 13 nt, Shigella flexneri 2a str. 301
acauaacacuagc

SEQ ID NO: 2022541 - RNA, 21 nt, Shigella flexneri 2a str. 301
acauaaaacgcuuacgcuuca

SEQ ID NO: 2022542 - RNA, 17 nt, Shigella flexneri 2a str. 301
acauaaacagguaaaga

SEQ ID NO: 2022543 - RNA, 23 nt, Shigella flexneri 2a str. 301
acaguuuucagugcuucaccgau

SEQ ID NO: 2022544 - RNA, 19 nt, Shigella flexneri 2a str. 301
acaguuucggaccagccgc

SEQ ID NO: 2022545 - RNA, 16 nt, Shigella flexneri 2a str. 301
acaguuauaaaaugau

SEQ ID NO: 2022546 - RNA, 19 nt, Shigella flexneri 2a str. 301
acaguucuucaaaaauaau

SEQ ID NO: 2022547 - RNA, 12 nt, Shigella flexneri 2a str. 301
acaguucuuccu

SEQ ID NO: 2022548 - RNA, 16 nt, Shigella flexneri 2a str. 301
acaguucuucaaaaau

SEQ ID NO: 2022549 - RNA, 23 nt, Shigella flexneri 2a str. 301
acaguugucagcccuuuuucacg

SEQ ID NO: 2022550 - RNA, 21 nt, Shigella flexneri 2a str. 301
acagugauuacuaaaugugca

SEQ ID NO: 2022551 - RNA, 22 nt, Shigella flexneri 2a str. 301
acagugaccaucuuccagcauc

SEQ ID NO: 2022552 - RNA, 15 nt, Shigella flexneri 2a str. 301
acagugacccgcagc

SEQ ID NO: 2022553 - RNA, 14 nt, Shigella flexneri 2a str. 301
acagucugcucccu

SEQ ID NO: 2022554 - RNA, 20 nt, Shigella flexneri 2a str. 301
acagugggauuaaaaaguaa

SEQ ID NO: 2022555 - RNA, 16 nt, Shigella flexneri 2a str. 301
acaguggcgacaucuu

SEQ ID NO: 2022556 - RNA, 20 nt, Shigella flexneri 2a str. 301
acagcuaaucaucaucagug

SEQ ID NO: 2022557 - RNA, 15 nt, Shigella flexneri 2a str. 301
acagcguuucuucga

SEQ ID NO: 2022558 - RNA, 22 nt, Shigella flexneri 2a str. 301
acagcucacggcccugugccug

SEQ ID NO: 2022559 - RNA, 14 nt, Shigella flexneri 2a str. 301
acagcguuucgcca

SEQ ID NO: 2022560 - RNA, 14 nt, Shigella flexneri 2a str. 301
acagcgcccgccag

SEQ ID NO: 2022561 - RNA, 21 nt, Shigella flexneri 2a str. 301
acagcgccaucugcagggcau

SEQ ID NO: 2022562 - RNA, 23 nt, Shigella flexneri 2a str. 301
acagcgccaucugcagggcaucg

SEQ ID NO: 2022563 - RNA, 14 nt, Shigella flexneri 2a str. 301
acagcgccagaagg

SEQ ID NO: 2022564 - RNA, 15 nt, Shigella flexneri 2a str. 301
acagcgccagaaggg

SEQ ID NO: 2022565 - RNA, 22 nt, Shigella flexneri 2a str. 301
acagcgacucucugagccagcu

SEQ ID NO: 2022566 - RNA, 22 nt, Shigella flexneri 2a str. 301
acagcgauugcuucgaucucaa

SEQ ID NO: 2022567 - RNA, 22 nt, Shigella flexneri 2a str. 301
acagcgcaccagaaacaauaag

SEQ ID NO: 2022568 - RNA, 21 nt, Shigella flexneri 2a str. 301
acaggcuuuccugauaaucca

SEQ ID NO: 2022569 - RNA, 15 nt, Shigella flexneri 2a str. 301
acaggcgggaagaac

SEQ ID NO: 2022570 - RNA, 16 nt, Shigella flexneri 2a str. 301
acagcuuuuuccugcg

SEQ ID NO: 2022571 - RNA, 14 nt, Shigella flexneri 2a str. 301
acagcuuuuuccug

SEQ ID NO: 2022572 - RNA, 17 nt, Shigella flexneri 2a str. 301
acaggaagcagcuugcu

SEQ ID NO: 2022573 - RNA, 20 nt, Shigella flexneri 2a str. 301
acaggaacagccacugguga

SEQ ID NO: 2022574 - RNA, 15 nt, Shigella flexneri 2a str. 301
acaggaacagccacu

SEQ ID NO: 2022575 - RNA, 21 nt, Shigella flexneri 2a str. 301
acaggcgcuggguaaagagcg

SEQ ID NO: 2022576 - RNA, 18 nt, Shigella flexneri 2a str. 301
acagccuaccagaccgca

SEQ ID NO: 2022577 - RNA, 13 nt, Shigella flexneri 2a str. 301
acagccuaccaga

SEQ ID NO: 2022578 - RNA, 14 nt, Shigella flexneri 2a str. 301
acagccuuaacaag

SEQ ID NO: 2022579 - RNA, 14 nt, Shigella flexneri 2a str. 301
acagcgaaaucccu

SEQ ID NO: 2022580 - RNA, 23 nt, Shigella flexneri 2a str. 301
acagccuucggacguuugccaug

SEQ ID NO: 2022581 - RNA, 12 nt, Shigella flexneri 2a str. 301
acagccagcgcu

SEQ ID NO: 2022582 - RNA, 21 nt, Shigella flexneri 2a str. 301
acagccgccagacaauugccg

SEQ ID NO: 2022583 - RNA, 16 nt, Shigella flexneri 2a str. 301
acagccauccgucauc

SEQ ID NO: 2022584 - RNA, 18 nt, Shigella flexneri 2a str. 301
acagccagccagcaccag

SEQ ID NO: 2022585 - RNA, 22 nt, Shigella flexneri 2a str. 301
acagccagccagcaccaggcuu

SEQ ID NO: 2022586 - RNA, 12 nt, Shigella flexneri 2a str. 301
acagccagccag

SEQ ID NO: 2022587 - RNA, 12 nt, Shigella flexneri 2a str. 301
acagccagccaa

SEQ ID NO: 2022588 - RNA, 18 nt, Shigella flexneri 2a str. 301
acagccagauuaaaagug

SEQ ID NO: 2022589 - RNA, 18 nt, Shigella flexneri 2a str. 301
acagccaaaucaucagua

SEQ ID NO: 2022590 - RNA, 13 nt, Shigella flexneri 2a str. 301
acagccaacugga

SEQ ID NO: 2022591 - RNA, 15 nt, Shigella flexneri 2a str. 301
acagccaaaucauca

SEQ ID NO: 2022592 - RNA, 22 nt, Shigella flexneri 2a str. 301
acagccacagggugaucaccag

SEQ ID NO: 2022593 - RNA, 23 nt, Shigella flexneri 2a str. 301
acagccacagggugaucaccagu

SEQ ID NO: 2022594 - RNA, 19 nt, Shigella flexneri 2a str. 301
acagcaggcagauccaguu

SEQ ID NO: 2022595 - RNA, 21 nt, Shigella flexneri 2a str. 301
acagcaguacgccgagaauaa

SEQ ID NO: 2022596 - RNA, 20 nt, Shigella flexneri 2a str. 301
acagcaaagcgugcaaauau

SEQ ID NO: 2022597 - RNA, 16 nt, Shigella flexneri 2a str. 301
acagcagccacaccaa

SEQ ID NO: 2022598 - RNA, 18 nt, Shigella flexneri 2a str. 301
acagcacauuucagaaag

SEQ ID NO: 2022599 - RNA, 19 nt, Shigella flexneri 2a str. 301
acagcagccacaccaauca

SEQ ID NO: 2022600 - RNA, 22 nt, Shigella flexneri 2a str. 301
agacgauaguaauuucaucugc

SEQ ID NO: 2022601 - RNA, 16 nt, Shigella flexneri 2a str. 301
agacgagggaaaauaa

SEQ ID NO: 2022602 - RNA, 15 nt, Shigella flexneri 2a str. 301
agacgagagugacga

SEQ ID NO: 2022603 - RNA, 20 nt, Shigella flexneri 2a str. 301
agacgaacguuuaauaaaac

SEQ ID NO: 2022604 - RNA, 20 nt, Shigella flexneri 2a str. 301
agaccuaacuuggcaaagcu

SEQ ID NO: 2022605 - RNA, 20 nt, Shigella flexneri 2a str. 301
agacgcucuucaauggucag

SEQ ID NO: 2022606 - RNA, 21 nt, Shigella flexneri 2a str. 301
agacgcucguuaaaacgcgcg

SEQ ID NO: 2022607 - RNA, 16 nt, Shigella flexneri 2a str. 301
agacgcgucagugucu

SEQ ID NO: 2022608 - RNA, 19 nt, Shigella flexneri 2a str. 301
agacgcucgccauuuuuca

SEQ ID NO: 2022609 - RNA, 18 nt, Shigella flexneri 2a str. 301
agacgcguuuacagagcc

SEQ ID NO: 2022610 - RNA, 21 nt, Shigella flexneri 2a str. 301
agacgcuacuuuuuucaccca

SEQ ID NO: 2022611 - RNA, 20 nt, Shigella flexneri 2a str. 301
agacgcgcagcuucacuucu

SEQ ID NO: 2022612 - RNA, 18 nt, Shigella flexneri 2a str. 301
agacgcgcuagcuucagg

SEQ ID NO: 2022613 - RNA, 18 nt, Shigella flexneri 2a str. 301
agacgcgcuugcauuacu

SEQ ID NO: 2022614 - RNA, 13 nt, Shigella flexneri 2a str. 301
agacgagagugac

SEQ ID NO: 2022615 - RNA, 19 nt, Shigella flexneri 2a str. 301
agacccugcucuuucagca

SEQ ID NO: 2022616 - RNA, 17 nt, Shigella flexneri 2a str. 301
agaccguugcucagaau

SEQ ID NO: 2022617 - RNA, 20 nt, Shigella flexneri 2a str. 301
agaauuucuuuacugacagg

SEQ ID NO: 2022618 - RNA, 23 nt, Shigella flexneri 2a str. 301
agaauuuccuucgcuuccuguau

SEQ ID NO: 2022619 - RNA, 12 nt, Shigella flexneri 2a str. 301
agacccaguuuu

SEQ ID NO: 2022620 - RNA, 17 nt, Shigella flexneri 2a str. 301
agacggcggaaagggcc

SEQ ID NO: 2022621 - RNA, 12 nt, Shigella flexneri 2a str. 301
agacucaagcag

SEQ ID NO: 2022622 - RNA, 14 nt, Shigella flexneri 2a str. 301
agacucaaaccaau

SEQ ID NO: 2022623 - RNA, 13 nt, Shigella flexneri 2a str. 301
agacucccagccu

SEQ ID NO: 2022624 - RNA, 14 nt, Shigella flexneri 2a str. 301
agacucccagccuc

SEQ ID NO: 2022625 - RNA, 15 nt, Shigella flexneri 2a str. 301
agacuuaagccuguu

SEQ ID NO: 2022626 - RNA, 14 nt, Shigella flexneri 2a str. 301
agacugugaaucau

SEQ ID NO: 2022627 - RNA, 20 nt, Shigella flexneri 2a str. 301
agacuguagaugaucgccgc

SEQ ID NO: 2022628 - RNA, 22 nt, Shigella flexneri 2a str. 301
agacuggaaacucacgccagca

SEQ ID NO: 2022629 - RNA, 15 nt, Shigella flexneri 2a str. 301
agacugcaagaauag

SEQ ID NO: 2022630 - RNA, 22 nt, Shigella flexneri 2a str. 301
agacugaugacaaacacaaaac

SEQ ID NO: 2022631 - RNA, 19 nt, Shigella flexneri 2a str. 301
agacugaugacaaacggaa

SEQ ID NO: 2022632 - RNA, 17 nt, Shigella flexneri 2a str. 301
agacugaugugauccau

SEQ ID NO: 2022633 - RNA, 19 nt, Shigella flexneri 2a str. 301
agacugauaucccgcgcgu

SEQ ID NO: 2022634 - RNA, 18 nt, Shigella flexneri 2a str. 301
agacugaugacaaacaca

SEQ ID NO: 2022635 - RNA, 20 nt, Shigella flexneri 2a str. 301
agagcaucgguaucuuccca

SEQ ID NO: 2022636 - RNA, 18 nt, Shigella flexneri 2a str. 301
agagcaugaaaugaaaau

SEQ ID NO: 2022637 - RNA, 13 nt, Shigella flexneri 2a str. 301
agagcaaauaaaa

SEQ ID NO: 2022638 - RNA, 15 nt, Shigella flexneri 2a str. 301
agagcaaauaaaaca

SEQ ID NO: 2022639 - RNA, 20 nt, Shigella flexneri 2a str. 301
agagcaaauaaaacaucacc

SEQ ID NO: 2022640 - RNA, 14 nt, Shigella flexneri 2a str. 301
agagcaacccccuc

SEQ ID NO: 2022641 - RNA, 18 nt, Shigella flexneri 2a str. 301
agagccagccccacagca

SEQ ID NO: 2022642 - RNA, 13 nt, Shigella flexneri 2a str. 301
agagccagcccca

SEQ ID NO: 2022643 - RNA, 13 nt, Shigella flexneri 2a str. 301
agagccaccaacu

SEQ ID NO: 2022644 - RNA, 23 nt, Shigella flexneri 2a str. 301
agagccaccaacucugggcugaa

SEQ ID NO: 2022645 - RNA, 19 nt, Shigella flexneri 2a str. 301
agagcuacaaaguguuguu

SEQ ID NO: 2022646 - RNA, 20 nt, Shigella flexneri 2a str. 301
aaaaccaacaguaucugaau

SEQ ID NO: 2022647 - RNA, 12 nt, Shigella flexneri 2a str. 301
agagcgucugga

SEQ ID NO: 2022648 - RNA, 15 nt, Shigella flexneri 2a str. 301
agagcgucuggaaga

SEQ ID NO: 2022649 - RNA, 13 nt, Shigella flexneri 2a str. 301
agagcuaacugga

SEQ ID NO: 2022650 - RNA, 16 nt, Shigella flexneri 2a str. 301
agagauucuuuuccuu

SEQ ID NO: 2022651 - RNA, 19 nt, Shigella flexneri 2a str. 301
agagauuuuuccccaccuc

SEQ ID NO: 2022652 - RNA, 12 nt, Shigella flexneri 2a str. 301
agagcaaauaaa

SEQ ID NO: 2022653 - RNA, 21 nt, Shigella flexneri 2a str. 301
agagauaguguugguaaauaa

SEQ ID NO: 2022654 - RNA, 13 nt, Shigella flexneri 2a str. 301
agagaucagauaa

SEQ ID NO: 2022655 - RNA, 14 nt, Shigella flexneri 2a str. 301
agagauaauaaaac

SEQ ID NO: 2022656 - RNA, 22 nt, Shigella flexneri 2a str. 301
agagacuuuuccagccgaccau

SEQ ID NO: 2022657 - RNA, 16 nt, Shigella flexneri 2a str. 301
agagagcgccagaagu

SEQ ID NO: 2022658 - RNA, 14 nt, Shigella flexneri 2a str. 301
agacuuuagcgcaa

SEQ ID NO: 2022659 - RNA, 17 nt, Shigella flexneri 2a str. 301
agacuuggcuuucucuu

SEQ ID NO: 2022660 - RNA, 18 nt, Shigella flexneri 2a str. 301
agacuuuagucaucaguc

SEQ ID NO: 2022661 - RNA, 16 nt, Shigella flexneri 2a str. 301
agacuuugcugccuuu

SEQ ID NO: 2022662 - RNA, 16 nt, Shigella flexneri 2a str. 301
agagaaaagcaaaaga

SEQ ID NO: 2022663 - RNA, 15 nt, Shigella flexneri 2a str. 301
agagaaaaaaaagca

SEQ ID NO: 2022664 - RNA, 23 nt, Shigella flexneri 2a str. 301
agacuuuuuucaugggugccaga

SEQ ID NO: 2022665 - RNA, 15 nt, Shigella flexneri 2a str. 301
agagaaagcaaaaau

SEQ ID NO: 2022666 - RNA, 22 nt, Shigella flexneri 2a str. 301
agagaaaaugccgcacaucacc

SEQ ID NO: 2022667 - RNA, 13 nt, Shigella flexneri 2a str. 301
agagaaaaucaca

SEQ ID NO: 2022668 - RNA, 13 nt, Shigella flexneri 2a str. 301
agagaagguaaag

SEQ ID NO: 2022669 - RNA, 13 nt, Shigella flexneri 2a str. 301
agagacagaauca

SEQ ID NO: 2022670 - RNA, 14 nt, Shigella flexneri 2a str. 301
agagacacaacaau

SEQ ID NO: 2022671 - RNA, 16 nt, Shigella flexneri 2a str. 301
agagacgcugaaaagc

SEQ ID NO: 2022672 - RNA, 23 nt, Shigella flexneri 2a str. 301
agaugcucuuuucugaaguacac

SEQ ID NO: 2022673 - RNA, 17 nt, Shigella flexneri 2a str. 301
agaugcugcaaggugau

SEQ ID NO: 2022674 - RNA, 20 nt, Shigella flexneri 2a str. 301
agauguugucucagcuucag

SEQ ID NO: 2022675 - RNA, 23 nt, Shigella flexneri 2a str. 301
agauguugucucagcuucagauu

SEQ ID NO: 2022676 - RNA, 16 nt, Shigella flexneri 2a str. 301
agauguugucucagau

SEQ ID NO: 2022677 - RNA, 13 nt, Shigella flexneri 2a str. 301
agaugguggucau

SEQ ID NO: 2022678 - RNA, 23 nt, Shigella flexneri 2a str. 301
agaugguuacuuuuuaugucauu

SEQ ID NO: 2022679 - RNA, 17 nt, Shigella flexneri 2a str. 301
agauuaacgugaccgcc

SEQ ID NO: 2022680 - RNA, 13 nt, Shigella flexneri 2a str. 301
agauuaaaaguga

SEQ ID NO: 2022681 - RNA, 23 nt, Shigella flexneri 2a str. 301
agaugaaauaguugcauuccagu

SEQ ID NO: 2022682 - RNA, 17 nt, Shigella flexneri 2a str. 301
agaucuuuaaugcacgg

SEQ ID NO: 2022683 - RNA, 15 nt, Shigella flexneri 2a str. 301
agaugaaaacgcuga

SEQ ID NO: 2022684 - RNA, 16 nt, Shigella flexneri 2a str. 301
agaugcggcuucgcuu

SEQ ID NO: 2022685 - RNA, 16 nt, Shigella flexneri 2a str. 301
agaugcuacaacaucg

SEQ ID NO: 2022686 - RNA, 19 nt, Shigella flexneri 2a str. 301
agaugaugucacagccgca

SEQ ID NO: 2022687 - RNA, 19 nt, Shigella flexneri 2a str. 301
agaugauggcauucucacu

SEQ ID NO: 2022688 - RNA, 20 nt, Shigella flexneri 2a str. 301
agauccagugcucauccuuc

SEQ ID NO: 2022689 - RNA, 21 nt, Shigella flexneri 2a str. 301
agauccagugcucauccuuca

SEQ ID NO: 2022690 - RNA, 17 nt, Shigella flexneri 2a str. 301
agauccgggcauauuuc

SEQ ID NO: 2022691 - RNA, 19 nt, Shigella flexneri 2a str. 301
agauccgccauuucuccuc

SEQ ID NO: 2022692 - RNA, 16 nt, Shigella flexneri 2a str. 301
agauccgccaguuugu

SEQ ID NO: 2022693 - RNA, 16 nt, Shigella flexneri 2a str. 301
agaucgccgcuguaau

SEQ ID NO: 2022694 - RNA, 15 nt, Shigella flexneri 2a str. 301
agaucgguugccaua

SEQ ID NO: 2022695 - RNA, 14 nt, Shigella flexneri 2a str. 301
agaucggaugacgc

SEQ ID NO: 2022696 - RNA, 15 nt, Shigella flexneri 2a str. 301
agaucggccagcacc

SEQ ID NO: 2022697 - RNA, 18 nt, Shigella flexneri 2a str. 301
agaucguucgcaccaaau

SEQ ID NO: 2022698 - RNA, 18 nt, Shigella flexneri 2a str. 301
agaucgugaaacucagcc

SEQ ID NO: 2022699 - RNA, 16 nt, Shigella flexneri 2a str. 301
agaucucucuugcuau

SEQ ID NO: 2022700 - RNA, 20 nt, Shigella flexneri 2a str. 301
agaucucucuugcuaucacc

SEQ ID NO: 2022701 - RNA, 22 nt, Shigella flexneri 2a str. 301
agaucugcuucaggaauauguu

SEQ ID NO: 2022702 - RNA, 18 nt, Shigella flexneri 2a str. 301
agauaaaauacacuuuaa

SEQ ID NO: 2022703 - RNA, 15 nt, Shigella flexneri 2a str. 301
agauaaauuacugcc

SEQ ID NO: 2022704 - RNA, 21 nt, Shigella flexneri 2a str. 301
agauaacgccuggcaguggug

SEQ ID NO: 2022705 - RNA, 19 nt, Shigella flexneri 2a str. 301
agauaaccacguucauuuc

SEQ ID NO: 2022706 - RNA, 23 nt, Shigella flexneri 2a str. 301
agauaaccccgcuugcuguuccu

SEQ ID NO: 2022707 - RNA, 12 nt, Shigella flexneri 2a str. 301
agauaauaggua

SEQ ID NO: 2022708 - RNA, 21 nt, Shigella flexneri 2a str. 301
agauaacuacccaaccgauaa

SEQ ID NO: 2022709 - RNA, 16 nt, Shigella flexneri 2a str. 301
agaguuuccaggcugg

SEQ ID NO: 2022710 - RNA, 16 nt, Shigella flexneri 2a str. 301
agaguggaacaauaca

SEQ ID NO: 2022711 - RNA, 16 nt, Shigella flexneri 2a str. 301
agagugguaaaggaga

SEQ ID NO: 2022712 - RNA, 22 nt, Shigella flexneri 2a str. 301
agagugguuagccggauaaaca

SEQ ID NO: 2022713 - RNA, 13 nt, Shigella flexneri 2a str. 301
agauaaaaaugaa

SEQ ID NO: 2022714 - RNA, 17 nt, Shigella flexneri 2a str. 301
agauaaaacgacaccac

SEQ ID NO: 2022715 - RNA, 13 nt, Shigella flexneri 2a str. 301
aaaaccagagaau

SEQ ID NO: 2022716 - RNA, 22 nt, Shigella flexneri 2a str. 301
aaaaccagaaagggaagaacau

SEQ ID NO: 2022717 - RNA, 20 nt, Shigella flexneri 2a str. 301
agaguaugcgcgucagagau

SEQ ID NO: 2022718 - RNA, 17 nt, Shigella flexneri 2a str. 301
agaguauccaugcgcau

SEQ ID NO: 2022719 - RNA, 21 nt, Shigella flexneri 2a str. 301
agagugacgucauagcaguac

SEQ ID NO: 2022720 - RNA, 15 nt, Shigella flexneri 2a str. 301
agagugauucuuugu

SEQ ID NO: 2022721 - RNA, 21 nt, Shigella flexneri 2a str. 301
agauauuuuuaugcaugaccu

SEQ ID NO: 2022722 - RNA, 23 nt, Shigella flexneri 2a str. 301
agauauuuuuaugcaugaccuac

SEQ ID NO: 2022723 - RNA, 16 nt, Shigella flexneri 2a str. 301
agauaguuuacugacu

SEQ ID NO: 2022724 - RNA, 15 nt, Shigella flexneri 2a str. 301
agauaggcaucagca

SEQ ID NO: 2022725 - RNA, 21 nt, Shigella flexneri 2a str. 301
agauacaucgcauaaaacaac

SEQ ID NO: 2022726 - RNA, 14 nt, Shigella flexneri 2a str. 301
agauacaggccacc

SEQ ID NO: 2022727 - RNA, 15 nt, Shigella flexneri 2a str. 301
agauagcugucccag

SEQ ID NO: 2022728 - RNA, 20 nt, Shigella flexneri 2a str. 301
agauaaugcccgaugaccuu

SEQ ID NO: 2022729 - RNA, 20 nt, Shigella flexneri 2a str. 301
agauaauccccaaugaccuu

SEQ ID NO: 2022730 - RNA, 15 nt, Shigella flexneri 2a str. 301
agauaauuuuuucuu

SEQ ID NO: 2022731 - RNA, 22 nt, Shigella flexneri 2a str. 301
agauaauuaugccgaucaucau

SEQ ID NO: 2022732 - RNA, 14 nt, Shigella flexneri 2a str. 301
agaaauuuuuauua

SEQ ID NO: 2022733 - RNA, 22 nt, Shigella flexneri 2a str. 301
agaacaacccggcgaaagagcu

SEQ ID NO: 2022734 - RNA, 21 nt, Shigella flexneri 2a str. 301
agaaccagggaaaaaagcccc

SEQ ID NO: 2022735 - RNA, 23 nt, Shigella flexneri 2a str. 301
agaaccacggaauaaccagcgaa

SEQ ID NO: 2022736 - RNA, 13 nt, Shigella flexneri 2a str. 301
agaaccagcugcc

SEQ ID NO: 2022737 - RNA, 21 nt, Shigella flexneri 2a str. 301
agaaccacaaugaagaaagua

SEQ ID NO: 2022738 - RNA, 20 nt, Shigella flexneri 2a str. 301
agaacgcgccuuaaaaacca

SEQ ID NO: 2022739 - RNA, 16 nt, Shigella flexneri 2a str. 301
agaacgcauaacagcc

SEQ ID NO: 2022740 - RNA, 19 nt, Shigella flexneri 2a str. 301
agaacgaccaucagcugcc

SEQ ID NO: 2022741 - RNA, 15 nt, Shigella flexneri 2a str. 301
agaacgacagugacu

SEQ ID NO: 2022742 - RNA, 18 nt, Shigella flexneri 2a str. 301
agaacgaccaucagcugc

SEQ ID NO: 2022743 - RNA, 21 nt, Shigella flexneri 2a str. 301
agaaccaugcaauuaccgcca

SEQ ID NO: 2022744 - RNA, 17 nt, Shigella flexneri 2a str. 301
agaacggauucagugag

SEQ ID NO: 2022745 - RNA, 14 nt, Shigella flexneri 2a str. 301
agaacuucugcaac

SEQ ID NO: 2022746 - RNA, 24 nt, Shigella flexneri 2a str. 301
agaacgugcuacgguugacugaaa

SEQ ID NO: 2022747 - RNA, 10 nt, Shigella flexneri 2a str. 301
agaagaccug

SEQ ID NO: 2022748 - RNA, 20 nt, Shigella flexneri 2a str. 301
agaagagaggcgugccaggu

SEQ ID NO: 2022749 - RNA, 16 nt, Shigella flexneri 2a str. 301
agaaaucauucaauac

SEQ ID NO: 2022750 - RNA, 17 nt, Shigella flexneri 2a str. 301
agaaaucauucaauacu

SEQ ID NO: 2022751 - RNA, 18 nt, Shigella flexneri 2a str. 301
agaaaucaguaaauugca

SEQ ID NO: 2022752 - RNA, 16 nt, Shigella flexneri 2a str. 301
agaaaucccauuagac

SEQ ID NO: 2022753 - RNA, 17 nt, Shigella flexneri 2a str. 301
agaaaucccauuagacu

SEQ ID NO: 2022754 - RNA, 20 nt, Shigella flexneri 2a str. 301
agaaaucagcuuuggugaaa

SEQ ID NO: 2022755 - RNA, 16 nt, Shigella flexneri 2a str. 301
agaaaugaaaaaauag

SEQ ID NO: 2022756 - RNA, 16 nt, Shigella flexneri 2a str. 301
agaaaugccaguaacu

SEQ ID NO: 2022757 - RNA, 14 nt, Shigella flexneri 2a str. 301
agaaaugccaguaa

SEQ ID NO: 2022758 - RNA, 19 nt, Shigella flexneri 2a str. 301
agaaauuuggcuccucuga

SEQ ID NO: 2022759 - RNA, 17 nt, Shigella flexneri 2a str. 301
agaaauuuggcuccucu

SEQ ID NO: 2022760 - RNA, 21 nt, Shigella flexneri 2a str. 301
agaaauugucuccaccaauga

SEQ ID NO: 2022761 - RNA, 15 nt, Shigella flexneri 2a str. 301
agaaaugguaaagaa

SEQ ID NO: 2022762 - RNA, 15 nt, Shigella flexneri 2a str. 301
agaaauggcccaaaa

SEQ ID NO: 2022763 - RNA, 14 nt, Shigella flexneri 2a str. 301
aaaacacucuucaa

SEQ ID NO: 2022764 - RNA, 20 nt, Shigella flexneri 2a str. 301
aaaacagacgagggaaaaua

SEQ ID NO: 2022765 - RNA, 22 nt, Shigella flexneri 2a str. 301
aaaacagcaaagcgugcaaaua

SEQ ID NO: 2022766 - RNA, 15 nt, Shigella flexneri 2a str. 301
agaaacgccagcagc

SEQ ID NO: 2022767 - RNA, 17 nt, Shigella flexneri 2a str. 301
agaaacgccagcagcag

SEQ ID NO: 2022768 - RNA, 17 nt, Shigella flexneri 2a str. 301
agaaacgcucauaaauu

SEQ ID NO: 2022769 - RNA, 22 nt, Shigella flexneri 2a str. 301
agaauaccuugcugcuccagcg

SEQ ID NO: 2022770 - RNA, 14 nt, Shigella flexneri 2a str. 301
agaauagacaaaaa

SEQ ID NO: 2022771 - RNA, 17 nt, Shigella flexneri 2a str. 301
agaauagacaaaaauuu

SEQ ID NO: 2022772 - RNA, 13 nt, Shigella flexneri 2a str. 301
agaagcauuuuac

SEQ ID NO: 2022773 - RNA, 22 nt, Shigella flexneri 2a str. 301
agaagaucagaaauuuccugag

SEQ ID NO: 2022774 - RNA, 19 nt, Shigella flexneri 2a str. 301
agaagccauuaaacaccag

SEQ ID NO: 2022775 - RNA, 13 nt, Shigella flexneri 2a str. 301
agaagccugcugg

SEQ ID NO: 2022776 - RNA, 18 nt, Shigella flexneri 2a str. 301
agaagccugcuggcccca

SEQ ID NO: 2022777 - RNA, 18 nt, Shigella flexneri 2a str. 301
agaagccgaucgugcuaa

SEQ ID NO: 2022778 - RNA, 20 nt, Shigella flexneri 2a str. 301
agaaguuccagggcagcagu

SEQ ID NO: 2022779 - RNA, 13 nt, Shigella flexneri 2a str. 301
agaaguucugcag

SEQ ID NO: 2022780 - RNA, 23 nt, Shigella flexneri 2a str. 301
agaagucgcaaugaguauuacuu

SEQ ID NO: 2022781 - RNA, 15 nt, Shigella flexneri 2a str. 301
agaagucgaucauau

SEQ ID NO: 2022782 - RNA, 17 nt, Shigella flexneri 2a str. 301
agaaugguuucauucca

SEQ ID NO: 2022783 - RNA, 19 nt, Shigella flexneri 2a str. 301
agaaugguaacaccagagu

SEQ ID NO: 2022784 - RNA, 19 nt, Shigella flexneri 2a str. 301
agaauucccccauugaaac

SEQ ID NO: 2022785 - RNA, 21 nt, Shigella flexneri 2a str. 301
agaauucaauauauugcagga

SEQ ID NO: 2022786 - RNA, 20 nt, Shigella flexneri 2a str. 301
agaaucugcguaaauauggc

SEQ ID NO: 2022787 - RNA, 14 nt, Shigella flexneri 2a str. 301
agaaucucugacag

SEQ ID NO: 2022788 - RNA, 19 nt, Shigella flexneri 2a str. 301
agaaugcucgcuggcaggc

SEQ ID NO: 2022789 - RNA, 17 nt, Shigella flexneri 2a str. 301
agaaugcucgcuggcag

SEQ ID NO: 2022790 - RNA, 21 nt, Shigella flexneri 2a str. 301
agaaugcgggcgaaaacaucg

SEQ ID NO: 2022791 - RNA, 19 nt, Shigella flexneri 2a str. 301
agaauauugccgaagacca

SEQ ID NO: 2022792 - RNA, 14 nt, Shigella flexneri 2a str. 301
agaauaugcuuugc

SEQ ID NO: 2022793 - RNA, 18 nt, Shigella flexneri 2a str. 301
agaauaucgguaucagcc

SEQ ID NO: 2022794 - RNA, 23 nt, Shigella flexneri 2a str. 301
agaauauacggaaugauauuggu

SEQ ID NO: 2022795 - RNA, 16 nt, Shigella flexneri 2a str. 301
agaaucaugccaaaaa

SEQ ID NO: 2022796 - RNA, 16 nt, Shigella flexneri 2a str. 301
agaaucauaaauacaa

SEQ ID NO: 2022797 - RNA, 17 nt, Shigella flexneri 2a str. 301
agaaucacuucaucgcc

SEQ ID NO: 2022798 - RNA, 17 nt, Shigella flexneri 2a str. 301
agaaucguaaagaucug

SEQ ID NO: 2022799 - RNA, 18 nt, Shigella flexneri 2a str. 301
agaaucuaagaucccugc

SEQ ID NO: 2022800 - RNA, 16 nt, Shigella flexneri 2a str. 301
agaaucaagucuauuu

SEQ ID NO: 2022801 - RNA, 18 nt, Shigella flexneri 2a str. 301
agaaucagcgagacaaca

SEQ ID NO: 2022802 - RNA, 13 nt, Shigella flexneri 2a str. 301
agaaucaccucuu

SEQ ID NO: 2022803 - RNA, 17 nt, Shigella flexneri 2a str. 301
agaaucacgccaacaaa

SEQ ID NO: 2022804 - RNA, 20 nt, Shigella flexneri 2a str. 301
acuuugugcaauugcucccu

SEQ ID NO: 2022805 - RNA, 13 nt, Shigella flexneri 2a str. 301
acuuugucaaaaa

SEQ ID NO: 2022806 - RNA, 17 nt, Shigella flexneri 2a str. 301
acuuuuaaaucgccaag

SEQ ID NO: 2022807 - RNA, 15 nt, Shigella flexneri 2a str. 301
acuuuguucugaauc

SEQ ID NO: 2022808 - RNA, 13 nt, Shigella flexneri 2a str. 301
acuuuuaccugcu

SEQ ID NO: 2022809 - RNA, 23 nt, Shigella flexneri 2a str. 301
acuuuuacaugcgcgacaaaaau

SEQ ID NO: 2022810 - RNA, 17 nt, Shigella flexneri 2a str. 301
acuuuuaaauugaagag

SEQ ID NO: 2022811 - RNA, 20 nt, Shigella flexneri 2a str. 301
acuuugaucgcguuuuuugu

SEQ ID NO: 2022812 - RNA, 19 nt, Shigella flexneri 2a str. 301
acuuucggcaaccucgccc

SEQ ID NO: 2022813 - RNA, 17 nt, Shigella flexneri 2a str. 301
acuuucggugacuucaa

SEQ ID NO: 2022814 - RNA, 16 nt, Shigella flexneri 2a str. 301
acuuuccaucuuuccu

SEQ ID NO: 2022815 - RNA, 15 nt, Shigella flexneri 2a str. 301
acuuuccagccacag

SEQ ID NO: 2022816 - RNA, 20 nt, Shigella flexneri 2a str. 301
acuuuccagccacaguucga

SEQ ID NO: 2022817 - RNA, 13 nt, Shigella flexneri 2a str. 301
acuuucugagauu

SEQ ID NO: 2022818 - RNA, 24 nt, Shigella flexneri 2a str. 301
acuuucugagauucaauuauagua

SEQ ID NO: 2022819 - RNA, 22 nt, Shigella flexneri 2a str. 301
acuuuuuccuuaaacaccuggc

SEQ ID NO: 2022820 - RNA, 20 nt, Shigella flexneri 2a str. 301
acuuuugagccaaaaugccu

SEQ ID NO: 2022821 - RNA, 16 nt, Shigella flexneri 2a str. 301
acuuuuacagcuuagc

SEQ ID NO: 2022822 - RNA, 21 nt, Shigella flexneri 2a str. 301
acuuuucaagucucggaaggu

SEQ ID NO: 2022823 - RNA, 22 nt, Shigella flexneri 2a str. 301
acuuuucaccgcuuugccaaac

SEQ ID NO: 2022824 - RNA, 14 nt, Shigella flexneri 2a str. 301
acuuuuauuucacc

SEQ ID NO: 2022825 - RNA, 17 nt, Shigella flexneri 2a str. 301
agaaaaucucaauguau

SEQ ID NO: 2022826 - RNA, 18 nt, Shigella flexneri 2a str. 301
agaaaauuagccaguuca

SEQ ID NO: 2022827 - RNA, 12 nt, Shigella flexneri 2a str. 301
agaaacaaaaaa

SEQ ID NO: 2022828 - RNA, 22 nt, Shigella flexneri 2a str. 301
agaaacaaaaaaaacagcgccc

SEQ ID NO: 2022829 - RNA, 19 nt, Shigella flexneri 2a str. 301
agaaaauuuuagggaagua

SEQ ID NO: 2022830 - RNA, 22 nt, Shigella flexneri 2a str. 301
agaaaaaaugaccggccagcau

SEQ ID NO: 2022831 - RNA, 13 nt, Shigella flexneri 2a str. 301
agaaaaaaaagca

SEQ ID NO: 2022832 - RNA, 15 nt, Shigella flexneri 2a str. 301
acuuuaagcugaaaa

SEQ ID NO: 2022833 - RNA, 17 nt, Shigella flexneri 2a str. 301
acuuuaaauucagcauu

SEQ ID NO: 2022834 - RNA, 15 nt, Shigella flexneri 2a str. 301
acuuuaauuuuucaa

SEQ ID NO: 2022835 - RNA, 20 nt, Shigella flexneri 2a str. 301
acuuuaauuuugugcagcau

SEQ ID NO: 2022836 - RNA, 23 nt, Shigella flexneri 2a str. 301
acuuuaauuuugugcagcaugca

SEQ ID NO: 2022837 - RNA, 16 nt, Shigella flexneri 2a str. 301
acuuuaccgguuucaa

SEQ ID NO: 2022838 - RNA, 16 nt, Shigella flexneri 2a str. 301
acuuuacgaccagccg

SEQ ID NO: 2022839 - RNA, 16 nt, Shigella flexneri 2a str. 301
acuuuaauuuugugca

SEQ ID NO: 2022840 - RNA, 19 nt, Shigella flexneri 2a str. 301
acuuuaauaaucucgccuu

SEQ ID NO: 2022841 - RNA, 18 nt, Shigella flexneri 2a str. 301
acuuuagccgguuuuuca

SEQ ID NO: 2022842 - RNA, 18 nt, Shigella flexneri 2a str. 301
acuuuagcgaaaucuucc

SEQ ID NO: 2022843 - RNA, 15 nt, Shigella flexneri 2a str. 301
acuuuaugaaccuga

SEQ ID NO: 2022844 - RNA, 15 nt, Shigella flexneri 2a str. 301
acuuucacgcccaua

SEQ ID NO: 2022845 - RNA, 17 nt, Shigella flexneri 2a str. 301
acuuucacgccgccaaa

SEQ ID NO: 2022846 - RNA, 22 nt, Shigella flexneri 2a str. 301
acuuucaguggcuuaucuuccu

SEQ ID NO: 2022847 - RNA, 21 nt, Shigella flexneri 2a str. 301
acuuucaucgcggucagcugc

SEQ ID NO: 2022848 - RNA, 13 nt, Shigella flexneri 2a str. 301
acuuuccagccac

SEQ ID NO: 2022849 - RNA, 17 nt, Shigella flexneri 2a str. 301
acuuucacaaaaauaau

SEQ ID NO: 2022850 - RNA, 14 nt, Shigella flexneri 2a str. 301
acuugcggcaccca

SEQ ID NO: 2022851 - RNA, 16 nt, Shigella flexneri 2a str. 301
acuugcggacccggcg

SEQ ID NO: 2022852 - RNA, 20 nt, Shigella flexneri 2a str. 301
acuugccgcaaaacccaggc

SEQ ID NO: 2022853 - RNA, 14 nt, Shigella flexneri 2a str. 301
acuugccuccagcg

SEQ ID NO: 2022854 - RNA, 21 nt, Shigella flexneri 2a str. 301
acuugcucaaucgcauggcug

SEQ ID NO: 2022855 - RNA, 17 nt, Shigella flexneri 2a str. 301
acuugcaaucuuuagca

SEQ ID NO: 2022856 - RNA, 11 nt, Shigella flexneri 2a str. 301
acuuaucauca

SEQ ID NO: 2022857 - RNA, 18 nt, Shigella flexneri 2a str. 301
acuugccagauaaacaua

SEQ ID NO: 2022858 - RNA, 22 nt, Shigella flexneri 2a str. 301
acuugucauacaccguuuuaca

SEQ ID NO: 2022859 - RNA, 14 nt, Shigella flexneri 2a str. 301
acuuggguaacagc

SEQ ID NO: 2022860 - RNA, 14 nt, Shigella flexneri 2a str. 301
agccgccagcucuu

SEQ ID NO: 2022861 - RNA, 17 nt, Shigella flexneri 2a str. 301
agccgauuaaucuucca

SEQ ID NO: 2022862 - RNA, 20 nt, Shigella flexneri 2a str. 301
agccgauuaaaaucagaauc

SEQ ID NO: 2022863 - RNA, 18 nt, Shigella flexneri 2a str. 301
agccgaugaguuaagaag

SEQ ID NO: 2022864 - RNA, 20 nt, Shigella flexneri 2a str. 301
agccgaccauugccaguaac

SEQ ID NO: 2022865 - RNA, 19 nt, Shigella flexneri 2a str. 301
agccgaacuuugcacccca

SEQ ID NO: 2022866 - RNA, 17 nt, Shigella flexneri 2a str. 301
agccgaaauauggcucu

SEQ ID NO: 2022867 - RNA, 14 nt, Shigella flexneri 2a str. 301
agccagucaguaac

SEQ ID NO: 2022868 - RNA, 15 nt, Shigella flexneri 2a str. 301
agccagucaguaacg

SEQ ID NO: 2022869 - RNA, 22 nt, Shigella flexneri 2a str. 301
agcccgcugccgcagauauucc

SEQ ID NO: 2022870 - RNA, 18 nt, Shigella flexneri 2a str. 301
agccagguuuaccagcag

SEQ ID NO: 2022871 - RNA, 16 nt, Shigella flexneri 2a str. 301
agcccguguuucugau

SEQ ID NO: 2022872 - RNA, 14 nt, Shigella flexneri 2a str. 301
agcccucaaacaac

SEQ ID NO: 2022873 - RNA, 19 nt, Shigella flexneri 2a str. 301
agcccucaccgaagcgagg

SEQ ID NO: 2022874 - RNA, 21 nt, Shigella flexneri 2a str. 301
agccggagaaauaccacccgu

SEQ ID NO: 2022875 - RNA, 20 nt, Shigella flexneri 2a str. 301
agccggagaaauaccacccg

SEQ ID NO: 2022876 - RNA, 15 nt, Shigella flexneri 2a str. 301
agccggaggugaaaa

SEQ ID NO: 2022877 - RNA, 15 nt, Shigella flexneri 2a str. 301
agccggaguggggga

SEQ ID NO: 2022878 - RNA, 17 nt, Shigella flexneri 2a str. 301
agccggauaaacaaugu

SEQ ID NO: 2022879 - RNA, 17 nt, Shigella flexneri 2a str. 301
agccgcuucugcagcuu

SEQ ID NO: 2022880 - RNA, 21 nt, Shigella flexneri 2a str. 301
agccgcuuggcaagcccagca

SEQ ID NO: 2022881 - RNA, 23 nt, Shigella flexneri 2a str. 301
agccgcuuggcaagcccagcacc

SEQ ID NO: 2022882 - RNA, 14 nt, Shigella flexneri 2a str. 301
agccggaauuuucc

SEQ ID NO: 2022883 - RNA, 14 nt, Shigella flexneri 2a str. 301
agccggacccacac

SEQ ID NO: 2022884 - RNA, 16 nt, Shigella flexneri 2a str. 301
agccggaccucuuucu

SEQ ID NO: 2022885 - RNA, 15 nt, Shigella flexneri 2a str. 301
agccgcgugcgcugg

SEQ ID NO: 2022886 - RNA, 17 nt, Shigella flexneri 2a str. 301
agccgcuaacagcagca

SEQ ID NO: 2022887 - RNA, 13 nt, Shigella flexneri 2a str. 301
agccgcccuguuu

SEQ ID NO: 2022888 - RNA, 15 nt, Shigella flexneri 2a str. 301
agccgccaucucuuc

SEQ ID NO: 2022889 - RNA, 21 nt, Shigella flexneri 2a str. 301
agccgccgcuaucggcaagga

SEQ ID NO: 2022890 - RNA, 17 nt, Shigella flexneri 2a str. 301
agccgcgccgagcggga

SEQ ID NO: 2022891 - RNA, 19 nt, Shigella flexneri 2a str. 301
agccgcgagaauaugcuga

SEQ ID NO: 2022892 - RNA, 19 nt, Shigella flexneri 2a str. 301
agccucccugccuccauga

SEQ ID NO: 2022893 - RNA, 22 nt, Shigella flexneri 2a str. 301
agccucuuuuuucagugcaccg

SEQ ID NO: 2022894 - RNA, 21 nt, Shigella flexneri 2a str. 301
agccuucgccuuucaguucaa

SEQ ID NO: 2022895 - RNA, 14 nt, Shigella flexneri 2a str. 301
agccuugcgugccu

SEQ ID NO: 2022896 - RNA, 19 nt, Shigella flexneri 2a str. 301
agccuugccaaauguuguc

SEQ ID NO: 2022897 - RNA, 13 nt, Shigella flexneri 2a str. 301
agccuugccagau

SEQ ID NO: 2022898 - RNA, 14 nt, Shigella flexneri 2a str. 301
agcgaaaucgccuu

SEQ ID NO: 2022899 - RNA, 12 nt, Shigella flexneri 2a str. 301
agccuuucacuu

SEQ ID NO: 2022900 - RNA, 13 nt, Shigella flexneri 2a str. 301
agcgaacaccagc

SEQ ID NO: 2022901 - RNA, 16 nt, Shigella flexneri 2a str. 301
agcgaagcgaacaucg

SEQ ID NO: 2022902 - RNA, 15 nt, Shigella flexneri 2a str. 301
agcgaaggaucaccc

SEQ ID NO: 2022903 - RNA, 22 nt, Shigella flexneri 2a str. 301
agccgugaaaacagcaaccucc

SEQ ID NO: 2022904 - RNA, 19 nt, Shigella flexneri 2a str. 301
agccguuaccgauuucacg

SEQ ID NO: 2022905 - RNA, 23 nt, Shigella flexneri 2a str. 301
agccguuucgaauuacacagcca

SEQ ID NO: 2022906 - RNA, 18 nt, Shigella flexneri 2a str. 301
agccuaagccauuuaacu

SEQ ID NO: 2022907 - RNA, 22 nt, Shigella flexneri 2a str. 301
agccuaagaagucauuggcuga

SEQ ID NO: 2022908 - RNA, 14 nt, Shigella flexneri 2a str. 301
agccuacaaaaacu

SEQ ID NO: 2022909 - RNA, 12 nt, Shigella flexneri 2a str. 301
agccguacugca

SEQ ID NO: 2022910 - RNA, 13 nt, Shigella flexneri 2a str. 301
agccguauucuga

SEQ ID NO: 2022911 - RNA, 16 nt, Shigella flexneri 2a str. 301
agccgucaccgccugc

SEQ ID NO: 2022912 - RNA, 21 nt, Shigella flexneri 2a str. 301
agccgguuuugguuuucuguc

SEQ ID NO: 2022913 - RNA, 17 nt, Shigella flexneri 2a str. 301
agccgggaugaaaggca

SEQ ID NO: 2022914 - RNA, 13 nt, Shigella flexneri 2a str. 301
agcggcaggccgu

SEQ ID NO: 2022915 - RNA, 23 nt, Shigella flexneri 2a str. 301
agcggcaggccguggaucacauc

SEQ ID NO: 2022916 - RNA, 20 nt, Shigella flexneri 2a str. 301
agcggcaaugcguuccagca

SEQ ID NO: 2022917 - RNA, 12 nt, Shigella flexneri 2a str. 301
agcggaaaucac

SEQ ID NO: 2022918 - RNA, 14 nt, Shigella flexneri 2a str. 301
agcggacaaugccu

SEQ ID NO: 2022919 - RNA, 15 nt, Shigella flexneri 2a str. 301
agcggacacuaccau

SEQ ID NO: 2022920 - RNA, 14 nt, Shigella flexneri 2a str. 301
agcgcuuuuuuccu

SEQ ID NO: 2022921 - RNA, 15 nt, Shigella flexneri 2a str. 301
agcgcuuuuuuccug

SEQ ID NO: 2022922 - RNA, 20 nt, Shigella flexneri 2a str. 301
agcgcugaagaaaauggcca

SEQ ID NO: 2022923 - RNA, 14 nt, Shigella flexneri 2a str. 301
agcgcugcaaacca

SEQ ID NO: 2022924 - RNA, 18 nt, Shigella flexneri 2a str. 301
agcgcugaagaaaauggc

SEQ ID NO: 2022925 - RNA, 14 nt, Shigella flexneri 2a str. 301
agcguaugcagcca

SEQ ID NO: 2022926 - RNA, 18 nt, Shigella flexneri 2a str. 301
agcguaugcagccaggcc

SEQ ID NO: 2022927 - RNA, 22 nt, Shigella flexneri 2a str. 301
agcguaucuguggcgcuaugcu

SEQ ID NO: 2022928 - RNA, 18 nt, Shigella flexneri 2a str. 301
agcguacggcaugcguuc

SEQ ID NO: 2022929 - RNA, 23 nt, Shigella flexneri 2a str. 301
agcguaccaugauccugcaauac

SEQ ID NO: 2022930 - RNA, 16 nt, Shigella flexneri 2a str. 301
agcguagcgcaucagg

SEQ ID NO: 2022931 - RNA, 20 nt, Shigella flexneri 2a str. 301
agcggucggagguucgaauc

SEQ ID NO: 2022932 - RNA, 18 nt, Shigella flexneri 2a str. 301
agcggccuuuuccuuuca

SEQ ID NO: 2022933 - RNA, 18 nt, Shigella flexneri 2a str. 301
agcggcauaaaacgaaug

SEQ ID NO: 2022934 - RNA, 20 nt, Shigella flexneri 2a str. 301
agcgggguucuccugagaau

SEQ ID NO: 2022935 - RNA, 21 nt, Shigella flexneri 2a str. 301
agcggguuuuuacguuauuug

SEQ ID NO: 2022936 - RNA, 16 nt, Shigella flexneri 2a str. 301
agcggguuaagcgcgc

SEQ ID NO: 2022937 - RNA, 21 nt, Shigella flexneri 2a str. 301
agcgaccauacagcagcaacg

SEQ ID NO: 2022938 - RNA, 20 nt, Shigella flexneri 2a str. 301
agcgcaccugaucagcaauc

SEQ ID NO: 2022939 - RNA, 24 nt, Shigella flexneri 2a str. 301
agcgcaggaaagauaagcgaacau

SEQ ID NO: 2022940 - RNA, 21 nt, Shigella flexneri 2a str. 301
agcgcaggaaagauaagcgaa

SEQ ID NO: 2022941 - RNA, 13 nt, Shigella flexneri 2a str. 301
agcgcagcaccca

SEQ ID NO: 2022942 - RNA, 17 nt, Shigella flexneri 2a str. 301
agcgcauucggcaagau

SEQ ID NO: 2022943 - RNA, 12 nt, Shigella flexneri 2a str. 301
agcgcagugaca

SEQ ID NO: 2022944 - RNA, 15 nt, Shigella flexneri 2a str. 301
agcgcauaagccacc

SEQ ID NO: 2022945 - RNA, 16 nt, Shigella flexneri 2a str. 301
agcgcauaagccaccu

SEQ ID NO: 2022946 - RNA, 17 nt, Shigella flexneri 2a str. 301
agcgcauaagccaccuc

SEQ ID NO: 2022947 - RNA, 18 nt, Shigella flexneri 2a str. 301
agcgcagucaccagcauc

SEQ ID NO: 2022948 - RNA, 20 nt, Shigella flexneri 2a str. 301
agcgccaccaccagcacacu

SEQ ID NO: 2022949 - RNA, 21 nt, Shigella flexneri 2a str. 301
agcgccaccgguuuauuauug

SEQ ID NO: 2022950 - RNA, 23 nt, Shigella flexneri 2a str. 301
agcgccaccagcgccgcgccacu

SEQ ID NO: 2022951 - RNA, 19 nt, Shigella flexneri 2a str. 301
agcgccaccgucagugcga

SEQ ID NO: 2022952 - RNA, 16 nt, Shigella flexneri 2a str. 301
agcgccacgcaacaga

SEQ ID NO: 2022953 - RNA, 14 nt, Shigella flexneri 2a str. 301
agcgcccgccagca

SEQ ID NO: 2022954 - RNA, 16 nt, Shigella flexneri 2a str. 301
agcgccaucugcaggg

SEQ ID NO: 2022955 - RNA, 16 nt, Shigella flexneri 2a str. 301
agcgcgaggguaaaca

SEQ ID NO: 2022956 - RNA, 19 nt, Shigella flexneri 2a str. 301
agcgccguugcgcccauca

SEQ ID NO: 2022957 - RNA, 12 nt, Shigella flexneri 2a str. 301
agcgccuaaauc

SEQ ID NO: 2022958 - RNA, 17 nt, Shigella flexneri 2a str. 301
agcgccuaaauccaccg

SEQ ID NO: 2022959 - RNA, 22 nt, Shigella flexneri 2a str. 301
agcgccgggaaugccacgcaaa

SEQ ID NO: 2022960 - RNA, 17 nt, Shigella flexneri 2a str. 301
agcgccgcuuuccaggc

SEQ ID NO: 2022961 - RNA, 15 nt, Shigella flexneri 2a str. 301
agcgccgccucagcc

SEQ ID NO: 2022962 - RNA, 19 nt, Shigella flexneri 2a str. 301
agcgcggauuuuauucagc

SEQ ID NO: 2022963 - RNA, 16 nt, Shigella flexneri 2a str. 301
agcgcggugacgcaca

SEQ ID NO: 2022964 - RNA, 16 nt, Shigella flexneri 2a str. 301
agcgcggggaucacug

SEQ ID NO: 2022965 - RNA, 22 nt, Shigella flexneri 2a str. 301
aaaaccuccgccucuuucacuc

SEQ ID NO: 2022966 - RNA, 18 nt, Shigella flexneri 2a str. 301
aaaaccuguauacgcaua

SEQ ID NO: 2022967 - RNA, 12 nt, Shigella flexneri 2a str. 301
agcagcccugcc

SEQ ID NO: 2022968 - RNA, 18 nt, Shigella flexneri 2a str. 301
agcagacgcuccauugcc

SEQ ID NO: 2022969 - RNA, 23 nt, Shigella flexneri 2a str. 301
agcagacgcuccauugcccgccc

SEQ ID NO: 2022970 - RNA, 19 nt, Shigella flexneri 2a str. 301
agcagcgaaucagcccagc

SEQ ID NO: 2022971 - RNA, 15 nt, Shigella flexneri 2a str. 301
agcagcgcaauuaac

SEQ ID NO: 2022972 - RNA, 22 nt, Shigella flexneri 2a str. 301
agcagcgaauuucucauccgca

SEQ ID NO: 2022973 - RNA, 15 nt, Shigella flexneri 2a str. 301
agcagcugacuucca

SEQ ID NO: 2022974 - RNA, 14 nt, Shigella flexneri 2a str. 301
agcagcuguagggu

SEQ ID NO: 2022975 - RNA, 17 nt, Shigella flexneri 2a str. 301
agcagcuuucagcagcg

SEQ ID NO: 2022976 - RNA, 12 nt, Shigella flexneri 2a str. 301
agcagcuuucag

SEQ ID NO: 2022977 - RNA, 16 nt, Shigella flexneri 2a str. 301
agcagcuuucagcagc

SEQ ID NO: 2022978 - RNA, 14 nt, Shigella flexneri 2a str. 301
agcagggcaaacag

SEQ ID NO: 2022979 - RNA, 17 nt, Shigella flexneri 2a str. 301
agcagggcaaacagcac

SEQ ID NO: 2022980 - RNA, 15 nt, Shigella flexneri 2a str. 301
agcagguacuggaaa

SEQ ID NO: 2022981 - RNA, 15 nt, Shigella flexneri 2a str. 301
agcagguaaucugcc

SEQ ID NO: 2022982 - RNA, 16 nt, Shigella flexneri 2a str. 301
agcagguaaucugcca

SEQ ID NO: 2022983 - RNA, 22 nt, Shigella flexneri 2a str. 301
agcaggguuucaucgguggugu

SEQ ID NO: 2022984 - RNA, 18 nt, Shigella flexneri 2a str. 301
agcauaaucaccaucagc

SEQ ID NO: 2022985 - RNA, 21 nt, Shigella flexneri 2a str. 301
agcauaaucaccaucagcagc

SEQ ID NO: 2022986 - RNA, 21 nt, Shigella flexneri 2a str. 301
agcauaucgacgaaccauuuc

SEQ ID NO: 2022987 - RNA, 16 nt, Shigella flexneri 2a str. 301
agcauaauaagcuuuu

SEQ ID NO: 2022988 - RNA, 14 nt, Shigella flexneri 2a str. 301
agcauauugcaggc

SEQ ID NO: 2022989 - RNA, 17 nt, Shigella flexneri 2a str. 301
agcaucaaacuuuuaaa

SEQ ID NO: 2022990 - RNA, 13 nt, Shigella flexneri 2a str. 301
agcaucaauaacc

SEQ ID NO: 2022991 - RNA, 16 nt, Shigella flexneri 2a str. 301
agcaucccaccugaaa

SEQ ID NO: 2022992 - RNA, 16 nt, Shigella flexneri 2a str. 301
agcaucaugaauauau

SEQ ID NO: 2022993 - RNA, 14 nt, Shigella flexneri 2a str. 301
agcauccaacugau

SEQ ID NO: 2022994 - RNA, 21 nt, Shigella flexneri 2a str. 301
agcauccccggcaaccacacc

SEQ ID NO: 2022995 - RNA, 20 nt, Shigella flexneri 2a str. 301
agcaucgaccaggauuugau

SEQ ID NO: 2022996 - RNA, 22 nt, Shigella flexneri 2a str. 301
agcaguucguaauuaagcccgg

SEQ ID NO: 2022997 - RNA, 18 nt, Shigella flexneri 2a str. 301
agcaguuuauaaaauucu

SEQ ID NO: 2022998 - RNA, 15 nt, Shigella flexneri 2a str. 301
agcaguuucaccagc

SEQ ID NO: 2022999 - RNA, 18 nt, Shigella flexneri 2a str. 301
agcaguuucaccagcagu

SEQ ID NO: 2023000 - RNA, 19 nt, Shigella flexneri 2a str. 301
agcaguuucaccagcagua

SEQ ID NO: 2023001 - RNA, 13 nt, Shigella flexneri 2a str. 301
agcauaaaaauau

SEQ ID NO: 2023002 - RNA, 22 nt, Shigella flexneri 2a str. 301
agcaguuuuuccccugccagau

SEQ ID NO: 2023003 - RNA, 20 nt, Shigella flexneri 2a str. 301
agcaguuuuuccccugccag

SEQ ID NO: 2023004 - RNA, 13 nt, Shigella flexneri 2a str. 301
agcauaaaaguua

SEQ ID NO: 2023005 - RNA, 14 nt, Shigella flexneri 2a str. 301
agcaguuccagcau

SEQ ID NO: 2023006 - RNA, 15 nt, Shigella flexneri 2a str. 301
agcaguuccagcauc

SEQ ID NO: 2023007 - RNA, 16 nt, Shigella flexneri 2a str. 301
agcaguucaugcacuu

SEQ ID NO: 2023008 - RNA, 21 nt, Shigella flexneri 2a str. 301
agcaguucaugcacuugguuc

SEQ ID NO: 2023009 - RNA, 17 nt, Shigella flexneri 2a str. 301
agcaguucacgcagcuu

SEQ ID NO: 2023010 - RNA, 22 nt, Shigella flexneri 2a str. 301
agccaauggggacaaucaccau

SEQ ID NO: 2023011 - RNA, 19 nt, Shigella flexneri 2a str. 301
agccaauuaacgaaaucuc

SEQ ID NO: 2023012 - RNA, 16 nt, Shigella flexneri 2a str. 301
agccaaucccggaagc

SEQ ID NO: 2023013 - RNA, 20 nt, Shigella flexneri 2a str. 301
agccaaucccggaagccacc

SEQ ID NO: 2023014 - RNA, 18 nt, Shigella flexneri 2a str. 301
agccacaaucgcagcgca

SEQ ID NO: 2023015 - RNA, 15 nt, Shigella flexneri 2a str. 301
agccacaccuggugc

SEQ ID NO: 2023016 - RNA, 14 nt, Shigella flexneri 2a str. 301
agccacaccacuuu

SEQ ID NO: 2023017 - RNA, 20 nt, Shigella flexneri 2a str. 301
agccacagggugaucaccag

SEQ ID NO: 2023018 - RNA, 16 nt, Shigella flexneri 2a str. 301
agccaaauccagcgca

SEQ ID NO: 2023019 - RNA, 13 nt, Shigella flexneri 2a str. 301
agccaaauccagc

SEQ ID NO: 2023020 - RNA, 12 nt, Shigella flexneri 2a str. 301
agccaacagcag

SEQ ID NO: 2023021 - RNA, 22 nt, Shigella flexneri 2a str. 301
agccaauaaaugccaccacacc

SEQ ID NO: 2023022 - RNA, 13 nt, Shigella flexneri 2a str. 301
agccaaaucaucc

SEQ ID NO: 2023023 - RNA, 16 nt, Shigella flexneri 2a str. 301
agccaaaucauccaga

SEQ ID NO: 2023024 - RNA, 14 nt, Shigella flexneri 2a str. 301
agccaaauaaaauc

SEQ ID NO: 2023025 - RNA, 19 nt, Shigella flexneri 2a str. 301
agccagcagcgaaucagcc

SEQ ID NO: 2023026 - RNA, 15 nt, Shigella flexneri 2a str. 301
agccagcagcgaauc

SEQ ID NO: 2023027 - RNA, 17 nt, Shigella flexneri 2a str. 301
agccagccccacagcag

SEQ ID NO: 2023028 - RNA, 20 nt, Shigella flexneri 2a str. 301
agccaccacgccaagaaaca

SEQ ID NO: 2023029 - RNA, 22 nt, Shigella flexneri 2a str. 301
agccacauuugcggcgaacugc

SEQ ID NO: 2023030 - RNA, 16 nt, Shigella flexneri 2a str. 301
agccaccacuugcagc

SEQ ID NO: 2023031 - RNA, 13 nt, Shigella flexneri 2a str. 301
agccaccagcacc

SEQ ID NO: 2023032 - RNA, 20 nt, Shigella flexneri 2a str. 301
agccacggcuccagcaaugu

SEQ ID NO: 2023033 - RNA, 19 nt, Shigella flexneri 2a str. 301
agcauuauauaaugccagg

SEQ ID NO: 2023034 - RNA, 14 nt, Shigella flexneri 2a str. 301
agcauuacacgcgg

SEQ ID NO: 2023035 - RNA, 18 nt, Shigella flexneri 2a str. 301
agcauguguaaccgcuuu

SEQ ID NO: 2023036 - RNA, 22 nt, Shigella flexneri 2a str. 301
agcaucuacucguuuauuaugc

SEQ ID NO: 2023037 - RNA, 16 nt, Shigella flexneri 2a str. 301
agcaucgcaacaugcu

SEQ ID NO: 2023038 - RNA, 16 nt, Shigella flexneri 2a str. 301
agcaucucauccauca

SEQ ID NO: 2023039 - RNA, 19 nt, Shigella flexneri 2a str. 301
agcaucucauccaucaaau

SEQ ID NO: 2023040 - RNA, 23 nt, Shigella flexneri 2a str. 301
agcauggcuucuuccccggauga

SEQ ID NO: 2023041 - RNA, 14 nt, Shigella flexneri 2a str. 301
agcauggcuucuuc

SEQ ID NO: 2023042 - RNA, 18 nt, Shigella flexneri 2a str. 301
agcauggcuucuuccccg

SEQ ID NO: 2023043 - RNA, 16 nt, Shigella flexneri 2a str. 301
agcaucuuaucacgau

SEQ ID NO: 2023044 - RNA, 14 nt, Shigella flexneri 2a str. 301
agcaucuuccagcg

SEQ ID NO: 2023045 - RNA, 17 nt, Shigella flexneri 2a str. 301
agcauuggcaugcacgu

SEQ ID NO: 2023046 - RNA, 13 nt, Shigella flexneri 2a str. 301
agcauucaguuac

SEQ ID NO: 2023047 - RNA, 14 nt, Shigella flexneri 2a str. 301
agcauuccagauac

SEQ ID NO: 2023048 - RNA, 14 nt, Shigella flexneri 2a str. 301
agcauucgcgcaca

SEQ ID NO: 2023049 - RNA, 20 nt, Shigella flexneri 2a str. 301
agcauucgcgcacaggcugc

SEQ ID NO: 2023050 - RNA, 21 nt, Shigella flexneri 2a str. 301
agcauugaugcguuagaugau

SEQ ID NO: 2023051 - RNA, 16 nt, Shigella flexneri 2a str. 301
agcauuuucauccauu

SEQ ID NO: 2023052 - RNA, 19 nt, Shigella flexneri 2a str. 301
agcauuucgcgauauugcu

SEQ ID NO: 2023053 - RNA, 19 nt, Shigella flexneri 2a str. 301
agccaaacaugcaaaccau

SEQ ID NO: 2023054 - RNA, 12 nt, Shigella flexneri 2a str. 301
agccaaaaauga

SEQ ID NO: 2023055 - RNA, 14 nt, Shigella flexneri 2a str. 301
agcauuuuuucaca

SEQ ID NO: 2023056 - RNA, 21 nt, Shigella flexneri 2a str. 301
agcaccauccgcccacaccag

SEQ ID NO: 2023057 - RNA, 21 nt, Shigella flexneri 2a str. 301
agcaccauccuguuccacugg

SEQ ID NO: 2023058 - RNA, 13 nt, Shigella flexneri 2a str. 301
agcaccagcaacg

SEQ ID NO: 2023059 - RNA, 13 nt, Shigella flexneri 2a str. 301
agcaccagauaau

SEQ ID NO: 2023060 - RNA, 16 nt, Shigella flexneri 2a str. 301
agcacccugaguuuuc

SEQ ID NO: 2023061 - RNA, 16 nt, Shigella flexneri 2a str. 301
agcacaucaucaaagc

SEQ ID NO: 2023062 - RNA, 18 nt, Shigella flexneri 2a str. 301
agcacaucaucaaagcca

SEQ ID NO: 2023063 - RNA, 21 nt, Shigella flexneri 2a str. 301
agcacaucagccagaugcacc

SEQ ID NO: 2023064 - RNA, 13 nt, Shigella flexneri 2a str. 301
agcacaucagcca

SEQ ID NO: 2023065 - RNA, 18 nt, Shigella flexneri 2a str. 301
agcacauagcaacuuuua

SEQ ID NO: 2023066 - RNA, 13 nt, Shigella flexneri 2a str. 301
agcacaucacuca

SEQ ID NO: 2023067 - RNA, 23 nt, Shigella flexneri 2a str. 301
agcacacugguucccaacaacag

SEQ ID NO: 2023068 - RNA, 22 nt, Shigella flexneri 2a str. 301
agcacacugguucccaacaaca

SEQ ID NO: 2023069 - RNA, 13 nt, Shigella flexneri 2a str. 301
agcaccaaaagca

SEQ ID NO: 2023070 - RNA, 15 nt, Shigella flexneri 2a str. 301
agcacaugcugacau

SEQ ID NO: 2023071 - RNA, 16 nt, Shigella flexneri 2a str. 301
agcacaugcugacauu

SEQ ID NO: 2023072 - RNA, 20 nt, Shigella flexneri 2a str. 301
agcacaucuggcgagucacc

SEQ ID NO: 2023073 - RNA, 17 nt, Shigella flexneri 2a str. 301
agcaccgcgcuauuuuc

SEQ ID NO: 2023074 - RNA, 14 nt, Shigella flexneri 2a str. 301
agcacgacuauuau

SEQ ID NO: 2023075 - RNA, 17 nt, Shigella flexneri 2a str. 301
agcacgacuuucucuuc

SEQ ID NO: 2023076 - RNA, 14 nt, Shigella flexneri 2a str. 301
agcacgaucagugc

SEQ ID NO: 2023077 - RNA, 14 nt, Shigella flexneri 2a str. 301
agcaccgaacagcu

SEQ ID NO: 2023078 - RNA, 18 nt, Shigella flexneri 2a str. 301
agcacggauaccgcacgc

SEQ ID NO: 2023079 - RNA, 17 nt, Shigella flexneri 2a str. 301
agcacgcuuuucagugc

SEQ ID NO: 2023080 - RNA, 18 nt, Shigella flexneri 2a str. 301
agcacgauuuuguaggcc

SEQ ID NO: 2023081 - RNA, 21 nt, Shigella flexneri 2a str. 301
agcacgcagugagaagccacc

SEQ ID NO: 2023082 - RNA, 17 nt, Shigella flexneri 2a str. 301
agcacgccccggcggcc

SEQ ID NO: 2023083 - RNA, 13 nt, Shigella flexneri 2a str. 301
agcacgccagaca

SEQ ID NO: 2023084 - RNA, 16 nt, Shigella flexneri 2a str. 301
agcacgccuggaaagu

SEQ ID NO: 2023085 - RNA, 17 nt, Shigella flexneri 2a str. 301
agcacuucacugacauu

SEQ ID NO: 2023086 - RNA, 18 nt, Shigella flexneri 2a str. 301
agcacuggcggcagcagg

SEQ ID NO: 2023087 - RNA, 19 nt, Shigella flexneri 2a str. 301
agcacuggcggcagcaggu

SEQ ID NO: 2023088 - RNA, 12 nt, Shigella flexneri 2a str. 301
agcacuggggcu

SEQ ID NO: 2023089 - RNA, 21 nt, Shigella flexneri 2a str. 301
agcacugucuaacaacaugac

SEQ ID NO: 2023090 - RNA, 19 nt, Shigella flexneri 2a str. 301
agcacuguaaaccucuuuc

SEQ ID NO: 2023091 - RNA, 22 nt, Shigella flexneri 2a str. 301
agcacugccagaaucaagguga

SEQ ID NO: 2023092 - RNA, 15 nt, Shigella flexneri 2a str. 301
agcacugcaucaaug

SEQ ID NO: 2023093 - RNA, 22 nt, Shigella flexneri 2a str. 301
agcagaccccagguuuucaacg

SEQ ID NO: 2023094 - RNA, 21 nt, Shigella flexneri 2a str. 301
aaaaccguucuuuucgagcag

SEQ ID NO: 2023095 - RNA, 13 nt, Shigella flexneri 2a str. 301
agcagaccagcaa

SEQ ID NO: 2023096 - RNA, 15 nt, Shigella flexneri 2a str. 301
agcagaccagcaaua

SEQ ID NO: 2023097 - RNA, 13 nt, Shigella flexneri 2a str. 301
agcagacaaccca

SEQ ID NO: 2023098 - RNA, 21 nt, Shigella flexneri 2a str. 301
agcacaaaguggcggcuaccc

SEQ ID NO: 2023099 - RNA, 18 nt, Shigella flexneri 2a str. 301
agcacaacaggcuauuuu

SEQ ID NO: 2023100 - RNA, 20 nt, Shigella flexneri 2a str. 301
agcacaaacauccaucugcu

SEQ ID NO: 2023101 - RNA, 17 nt, Shigella flexneri 2a str. 301
agcaauuuuuccugguu

SEQ ID NO: 2023102 - RNA, 17 nt, Shigella flexneri 2a str. 301
agcaauuuuaguaucca

SEQ ID NO: 2023103 - RNA, 23 nt, Shigella flexneri 2a str. 301
agcacaaucaaaucgacagccag

SEQ ID NO: 2023104 - RNA, 20 nt, Shigella flexneri 2a str. 301
agcacaauaaucagcccaac

SEQ ID NO: 2023105 - RNA, 16 nt, Shigella flexneri 2a str. 301
agcacaauaaucagcc

SEQ ID NO: 2023106 - RNA, 14 nt, Shigella flexneri 2a str. 301
agcaauuaacagug

SEQ ID NO: 2023107 - RNA, 17 nt, Shigella flexneri 2a str. 301
agcaauuaacagugaca

SEQ ID NO: 2023108 - RNA, 15 nt, Shigella flexneri 2a str. 301
agcaauuucuccgcc

SEQ ID NO: 2023109 - RNA, 20 nt, Shigella flexneri 2a str. 301
agcaauuccagcgccaguaa

SEQ ID NO: 2023110 - RNA, 19 nt, Shigella flexneri 2a str. 301
agcaaugaucucaauaguu

SEQ ID NO: 2023111 - RNA, 14 nt, Shigella flexneri 2a str. 301
agcaaugagcuaug

SEQ ID NO: 2023112 - RNA, 16 nt, Shigella flexneri 2a str. 301
agcaauccugcaugua

SEQ ID NO: 2023113 - RNA, 22 nt, Shigella flexneri 2a str. 301
agcaaucugauugacaucauuu

SEQ ID NO: 2023114 - RNA, 20 nt, Shigella flexneri 2a str. 301
agcaaucucuucaagcugcu

SEQ ID NO: 2023115 - RNA, 17 nt, Shigella flexneri 2a str. 301
agcaaucucuucaagcu

SEQ ID NO: 2023116 - RNA, 20 nt, Shigella flexneri 2a str. 301
agcaaucaucccaguggaua

SEQ ID NO: 2023117 - RNA, 21 nt, Shigella flexneri 2a str. 301
agcaauaaucucuuuacccag

SEQ ID NO: 2023118 - RNA, 22 nt, Shigella flexneri 2a str. 301
agcaauaaacgguagauaauug

SEQ ID NO: 2023119 - RNA, 20 nt, Shigella flexneri 2a str. 301
agcaauagacaguucuuccu

SEQ ID NO: 2023120 - RNA, 16 nt, Shigella flexneri 2a str. 301
agcaauaauuucaaca

SEQ ID NO: 2023121 - RNA, 14 nt, Shigella flexneri 2a str. 301
agcaauaaugccag

SEQ ID NO: 2023122 - RNA, 13 nt, Shigella flexneri 2a str. 301
agcaacugacugg

SEQ ID NO: 2023123 - RNA, 20 nt, Shigella flexneri 2a str. 301
agcaacugcgacguggauca

SEQ ID NO: 2023124 - RNA, 17 nt, Shigella flexneri 2a str. 301
agcaacugacugacuuc

SEQ ID NO: 2023125 - RNA, 21 nt, Shigella flexneri 2a str. 301
agcaacugacugacuucaaca

SEQ ID NO: 2023126 - RNA, 13 nt, Shigella flexneri 2a str. 301
agcaacgccaaau

SEQ ID NO: 2023127 - RNA, 18 nt, Shigella flexneri 2a str. 301
agcaacggcacauccaga

SEQ ID NO: 2023128 - RNA, 13 nt, Shigella flexneri 2a str. 301
agauuauugacaa

SEQ ID NO: 2023129 - RNA, 14 nt, Shigella flexneri 2a str. 301
agcaaggccagguu

SEQ ID NO: 2023130 - RNA, 16 nt, Shigella flexneri 2a str. 301
agcaagucuucacugc

SEQ ID NO: 2023131 - RNA, 14 nt, Shigella flexneri 2a str. 301
agcaagcauuauau

SEQ ID NO: 2023132 - RNA, 22 nt, Shigella flexneri 2a str. 301
acucaccagacaucccagugca

SEQ ID NO: 2023133 - RNA, 21 nt, Shigella flexneri 2a str. 301
acucaccagugguaagaggaa

SEQ ID NO: 2023134 - RNA, 21 nt, Shigella flexneri 2a str. 301
acucaccuuuuuuguuguuau

SEQ ID NO: 2023135 - RNA, 16 nt, Shigella flexneri 2a str. 301
acucacgauuguuaau

SEQ ID NO: 2023136 - RNA, 19 nt, Shigella flexneri 2a str. 301
acucacgccguuaacuuca

SEQ ID NO: 2023137 - RNA, 19 nt, Shigella flexneri 2a str. 301
acucaccgaugaucgccau

SEQ ID NO: 2023138 - RNA, 23 nt, Shigella flexneri 2a str. 301
acucaccgaugaucgccaucagu

SEQ ID NO: 2023139 - RNA, 12 nt, Shigella flexneri 2a str. 301
acucaccggcgu

SEQ ID NO: 2023140 - RNA, 16 nt, Shigella flexneri 2a str. 301
acucaccggcguuuca

SEQ ID NO: 2023141 - RNA, 13 nt, Shigella flexneri 2a str. 301
acucaccuuuaaa

SEQ ID NO: 2023142 - RNA, 16 nt, Shigella flexneri 2a str. 301
acucaaccccagccau

SEQ ID NO: 2023143 - RNA, 22 nt, Shigella flexneri 2a str. 301
acucaacgguucgccaucaaga

SEQ ID NO: 2023144 - RNA, 13 nt, Shigella flexneri 2a str. 301
acucaaaucacgc

SEQ ID NO: 2023145 - RNA, 15 nt, Shigella flexneri 2a str. 301
acuaugcggaugcca

SEQ ID NO: 2023146 - RNA, 16 nt, Shigella flexneri 2a str. 301
acuauuaaagaaagua

SEQ ID NO: 2023147 - RNA, 21 nt, Shigella flexneri 2a str. 301
acucaaacagggcaauuaaaa

SEQ ID NO: 2023148 - RNA, 17 nt, Shigella flexneri 2a str. 301
acucaaaccccgcagca

SEQ ID NO: 2023149 - RNA, 15 nt, Shigella flexneri 2a str. 301
acguuccuuucuugc

SEQ ID NO: 2023150 - RNA, 13 nt, Shigella flexneri 2a str. 301
acguucgcccacu

SEQ ID NO: 2023151 - RNA, 13 nt, Shigella flexneri 2a str. 301
acguucaguucac

SEQ ID NO: 2023152 - RNA, 19 nt, Shigella flexneri 2a str. 301
acguucaucgggcauugca

SEQ ID NO: 2023153 - RNA, 17 nt, Shigella flexneri 2a str. 301
acguuccccaggguuuc

SEQ ID NO: 2023154 - RNA, 21 nt, Shigella flexneri 2a str. 301
acuacgugaucgucuucaacc

SEQ ID NO: 2023155 - RNA, 14 nt, Shigella flexneri 2a str. 301
acuacguagaucau

SEQ ID NO: 2023156 - RNA, 20 nt, Shigella flexneri 2a str. 301
acuacggaguaaccugccug

SEQ ID NO: 2023157 - RNA, 16 nt, Shigella flexneri 2a str. 301
acuacggcaaaagaau

SEQ ID NO: 2023158 - RNA, 22 nt, Shigella flexneri 2a str. 301
acuacggcuucugacauaacca

SEQ ID NO: 2023159 - RNA, 18 nt, Shigella flexneri 2a str. 301
acuaucauugcgugguuu

SEQ ID NO: 2023160 - RNA, 21 nt, Shigella flexneri 2a str. 301
acuaucauugcgugguuuuug

SEQ ID NO: 2023161 - RNA, 17 nt, Shigella flexneri 2a str. 301
acuauccuggacuuuaa

SEQ ID NO: 2023162 - RNA, 18 nt, Shigella flexneri 2a str. 301
acuaucgcugagauacuc

SEQ ID NO: 2023163 - RNA, 19 nt, Shigella flexneri 2a str. 301
acuaucgaaaguuuaccag

SEQ ID NO: 2023164 - RNA, 23 nt, Shigella flexneri 2a str. 301
acuaucuugcuucugacuauaua

SEQ ID NO: 2023165 - RNA, 17 nt, Shigella flexneri 2a str. 301
acucagcgccugcugca

SEQ ID NO: 2023166 - RNA, 12 nt, Shigella flexneri 2a str. 301
acucagcaucug

SEQ ID NO: 2023167 - RNA, 17 nt, Shigella flexneri 2a str. 301
acucagaccaguuuuuu

SEQ ID NO: 2023168 - RNA, 19 nt, Shigella flexneri 2a str. 301
acucaggcuggcaagcugc

SEQ ID NO: 2023169 - RNA, 20 nt, Shigella flexneri 2a str. 301
acucaggcuggcaagcugcu

SEQ ID NO: 2023170 - RNA, 22 nt, Shigella flexneri 2a str. 301
acucaggcuggcaagcugcugu

SEQ ID NO: 2023171 - RNA, 19 nt, Shigella flexneri 2a str. 301
acucauaaauucaaagugu

SEQ ID NO: 2023172 - RNA, 22 nt, Shigella flexneri 2a str. 301
acucaguguuggauggcggcuu

SEQ ID NO: 2023173 - RNA, 23 nt, Shigella flexneri 2a str. 301
acucaucaacguuuuuuugcuuu

SEQ ID NO: 2023174 - RNA, 16 nt, Shigella flexneri 2a str. 301
acucauacugagcaag

SEQ ID NO: 2023175 - RNA, 18 nt, Shigella flexneri 2a str. 301
acucauacugagcaaggc

SEQ ID NO: 2023176 - RNA, 12 nt, Shigella flexneri 2a str. 301
acucauugccag

SEQ ID NO: 2023177 - RNA, 13 nt, Shigella flexneri 2a str. 301
acucauugccagu

SEQ ID NO: 2023178 - RNA, 15 nt, Shigella flexneri 2a str. 301
acucauugccagucc

SEQ ID NO: 2023179 - RNA, 17 nt, Shigella flexneri 2a str. 301
acucaucuuauugauca

SEQ ID NO: 2023180 - RNA, 14 nt, Shigella flexneri 2a str. 301
acuccaacccggca

SEQ ID NO: 2023181 - RNA, 13 nt, Shigella flexneri 2a str. 301
acucauuuacaga

SEQ ID NO: 2023182 - RNA, 22 nt, Shigella flexneri 2a str. 301
acuccagaauaccgccaauauc

SEQ ID NO: 2023183 - RNA, 15 nt, Shigella flexneri 2a str. 301
acuccugaaagcgaa

SEQ ID NO: 2023184 - RNA, 18 nt, Shigella flexneri 2a str. 301
acuccugaagaagcguuc

SEQ ID NO: 2023185 - RNA, 19 nt, Shigella flexneri 2a str. 301
acuccuguaucgucacugg

SEQ ID NO: 2023186 - RNA, 14 nt, Shigella flexneri 2a str. 301
acuccugccaccac

SEQ ID NO: 2023187 - RNA, 20 nt, Shigella flexneri 2a str. 301
acuccuucuaaagccugagc

SEQ ID NO: 2023188 - RNA, 18 nt, Shigella flexneri 2a str. 301
acuccuuccugaaauaga

SEQ ID NO: 2023189 - RNA, 19 nt, Shigella flexneri 2a str. 301
acucgcccccgaagagggg

SEQ ID NO: 2023190 - RNA, 13 nt, Shigella flexneri 2a str. 301
acucgcagaagca

SEQ ID NO: 2023191 - RNA, 16 nt, Shigella flexneri 2a str. 301
acucgauuaauucaua

SEQ ID NO: 2023192 - RNA, 16 nt, Shigella flexneri 2a str. 301
acucgccgcuguggau

SEQ ID NO: 2023193 - RNA, 18 nt, Shigella flexneri 2a str. 301
acucgcguucuguugccg

SEQ ID NO: 2023194 - RNA, 12 nt, Shigella flexneri 2a str. 301
acucccagccuc

SEQ ID NO: 2023195 - RNA, 20 nt, Shigella flexneri 2a str. 301
acuccauugaagagcauccg

SEQ ID NO: 2023196 - RNA, 17 nt, Shigella flexneri 2a str. 301
acucccagaacaacccg

SEQ ID NO: 2023197 - RNA, 19 nt, Shigella flexneri 2a str. 301
acuccgccccggcaauaaa

SEQ ID NO: 2023198 - RNA, 18 nt, Shigella flexneri 2a str. 301
acuccgccgcaucuuccc

SEQ ID NO: 2023199 - RNA, 17 nt, Shigella flexneri 2a str. 301
acuccauccagcaacaa

SEQ ID NO: 2023200 - RNA, 16 nt, Shigella flexneri 2a str. 301
acuccauccagcaaca

SEQ ID NO: 2023201 - RNA, 15 nt, Shigella flexneri 2a str. 301
acuccauccagcaac

SEQ ID NO: 2023202 - RNA, 14 nt, Shigella flexneri 2a str. 301
acuccaguuucaca

SEQ ID NO: 2023203 - RNA, 21 nt, Shigella flexneri 2a str. 301
acuccaguuuguucagcugcg

SEQ ID NO: 2023204 - RNA, 14 nt, Shigella flexneri 2a str. 301
acuccauccagcaa

SEQ ID NO: 2023205 - RNA, 16 nt, Shigella flexneri 2a str. 301
acuccagucccaguuc

SEQ ID NO: 2023206 - RNA, 15 nt, Shigella flexneri 2a str. 301
acuccagcgcuucgc

SEQ ID NO: 2023207 - RNA, 15 nt, Shigella flexneri 2a str. 301
acuccagccagagcc

SEQ ID NO: 2023208 - RNA, 11 nt, Shigella flexneri 2a str. 301
acuccagcaga

SEQ ID NO: 2023209 - RNA, 12 nt, Shigella flexneri 2a str. 301
acuccagcagac

SEQ ID NO: 2023210 - RNA, 15 nt, Shigella flexneri 2a str. 301
acuccagcagaccag

SEQ ID NO: 2023211 - RNA, 21 nt, Shigella flexneri 2a str. 301
acuccagcagaccagcaaaaa

SEQ ID NO: 2023212 - RNA, 14 nt, Shigella flexneri 2a str. 301
acugcuuaucauca

SEQ ID NO: 2023213 - RNA, 14 nt, Shigella flexneri 2a str. 301
acugcuuacaggcu

SEQ ID NO: 2023214 - RNA, 15 nt, Shigella flexneri 2a str. 301
acugcuuaacugcgc

SEQ ID NO: 2023215 - RNA, 21 nt, Shigella flexneri 2a str. 301
acugcuuaauauuaacuuaau

SEQ ID NO: 2023216 - RNA, 19 nt, Shigella flexneri 2a str. 301
acugcucagcuccucuuuc

SEQ ID NO: 2023217 - RNA, 14 nt, Shigella flexneri 2a str. 301
acugcucagcuccu

SEQ ID NO: 2023218 - RNA, 17 nt, Shigella flexneri 2a str. 301
acugcuccauaauugcc

SEQ ID NO: 2023219 - RNA, 17 nt, Shigella flexneri 2a str. 301
acugcuccuguaugacc

SEQ ID NO: 2023220 - RNA, 19 nt, Shigella flexneri 2a str. 301
acugcgugucguaagccac

SEQ ID NO: 2023221 - RNA, 12 nt, Shigella flexneri 2a str. 301
acugcgugguga

SEQ ID NO: 2023222 - RNA, 15 nt, Shigella flexneri 2a str. 301
acugccguacaggca

SEQ ID NO: 2023223 - RNA, 12 nt, Shigella flexneri 2a str. 301
acugcgugcuga

SEQ ID NO: 2023224 - RNA, 15 nt, Shigella flexneri 2a str. 301
acugccguacagaca

SEQ ID NO: 2023225 - RNA, 16 nt, Shigella flexneri 2a str. 301
acugccggacguucgc

SEQ ID NO: 2023226 - RNA, 14 nt, Shigella flexneri 2a str. 301
acugcccgagaaca

SEQ ID NO: 2023227 - RNA, 13 nt, Shigella flexneri 2a str. 301
acugccagaauag

SEQ ID NO: 2023228 - RNA, 12 nt, Shigella flexneri 2a str. 301
acugccaggagc

SEQ ID NO: 2023229 - RNA, 13 nt, Shigella flexneri 2a str. 301
acugauugaacug

SEQ ID NO: 2023230 - RNA, 15 nt, Shigella flexneri 2a str. 301
acugauuaucgauca

SEQ ID NO: 2023231 - RNA, 14 nt, Shigella flexneri 2a str. 301
acugcaaugaccau

SEQ ID NO: 2023232 - RNA, 15 nt, Shigella flexneri 2a str. 301
acugaugaauaaaua

SEQ ID NO: 2023233 - RNA, 17 nt, Shigella flexneri 2a str. 301
acugaugaauaaauaca

SEQ ID NO: 2023234 - RNA, 16 nt, Shigella flexneri 2a str. 301
acugagagaaaaaaaa

SEQ ID NO: 2023235 - RNA, 21 nt, Shigella flexneri 2a str. 301
acugacggaucccgccaacag

SEQ ID NO: 2023236 - RNA, 16 nt, Shigella flexneri 2a str. 301
acugacgcgucuuauc

SEQ ID NO: 2023237 - RNA, 13 nt, Shigella flexneri 2a str. 301
acugacuauccug

SEQ ID NO: 2023238 - RNA, 19 nt, Shigella flexneri 2a str. 301
acugacaauucaggggcau

SEQ ID NO: 2023239 - RNA, 16 nt, Shigella flexneri 2a str. 301
acugacauacagaucg

SEQ ID NO: 2023240 - RNA, 14 nt, Shigella flexneri 2a str. 301
acugacaucaaacc

SEQ ID NO: 2023241 - RNA, 14 nt, Shigella flexneri 2a str. 301
acugacaauuugcc

SEQ ID NO: 2023242 - RNA, 15 nt, Shigella flexneri 2a str. 301
acugaaugaucacuu

SEQ ID NO: 2023243 - RNA, 19 nt, Shigella flexneri 2a str. 301
acugaaugaucacuuguuc

SEQ ID NO: 2023244 - RNA, 15 nt, Shigella flexneri 2a str. 301
acugaccaccaccac

SEQ ID NO: 2023245 - RNA, 14 nt, Shigella flexneri 2a str. 301
acugaccaccacca

SEQ ID NO: 2023246 - RNA, 15 nt, Shigella flexneri 2a str. 301
acugacauugccuuc

SEQ ID NO: 2023247 - RNA, 19 nt, Shigella flexneri 2a str. 301
acugacaucagcauccgca

SEQ ID NO: 2023248 - RNA, 17 nt, Shigella flexneri 2a str. 301
acugaccccaaaaaguu

SEQ ID NO: 2023249 - RNA, 13 nt, Shigella flexneri 2a str. 301
acugaacaaaaaa

SEQ ID NO: 2023250 - RNA, 20 nt, Shigella flexneri 2a str. 301
acugaaccgcgcaauugcac

SEQ ID NO: 2023251 - RNA, 17 nt, Shigella flexneri 2a str. 301
acucucaccacgcucca

SEQ ID NO: 2023252 - RNA, 18 nt, Shigella flexneri 2a str. 301
acugaaauuuuaugauaa

SEQ ID NO: 2023253 - RNA, 23 nt, Shigella flexneri 2a str. 301
acugaagauugaacagcagaaca

SEQ ID NO: 2023254 - RNA, 16 nt, Shigella flexneri 2a str. 301
acugaagcauugccga

SEQ ID NO: 2023255 - RNA, 21 nt, Shigella flexneri 2a str. 301
acucgguugauucgcucugcg

SEQ ID NO: 2023256 - RNA, 11 nt, Shigella flexneri 2a str. 301
acucuauggcu

SEQ ID NO: 2023257 - RNA, 14 nt, Shigella flexneri 2a str. 301
acucucaaaacaac

SEQ ID NO: 2023258 - RNA, 16 nt, Shigella flexneri 2a str. 301
acucucaaaacaacac

SEQ ID NO: 2023259 - RNA, 17 nt, Shigella flexneri 2a str. 301
acucucaaaacaacaca

SEQ ID NO: 2023260 - RNA, 13 nt, Shigella flexneri 2a str. 301
acucuacuucuuc

SEQ ID NO: 2023261 - RNA, 13 nt, Shigella flexneri 2a str. 301
acugguagugcag

SEQ ID NO: 2023262 - RNA, 15 nt, Shigella flexneri 2a str. 301
acugggaugaaagug

SEQ ID NO: 2023263 - RNA, 22 nt, Shigella flexneri 2a str. 301
acugggaugugaaaaugaguau

SEQ ID NO: 2023264 - RNA, 13 nt, Shigella flexneri 2a str. 301
acugggcgauuaa

SEQ ID NO: 2023265 - RNA, 17 nt, Shigella flexneri 2a str. 301
acugggcgauuaauaaa

SEQ ID NO: 2023266 - RNA, 13 nt, Shigella flexneri 2a str. 301
acuggugccauga

SEQ ID NO: 2023267 - RNA, 21 nt, Shigella flexneri 2a str. 301
acuggugacuuuugcccggca

SEQ ID NO: 2023268 - RNA, 17 nt, Shigella flexneri 2a str. 301
acugguggcaggaaaac

SEQ ID NO: 2023269 - RNA, 21 nt, Shigella flexneri 2a str. 301
acuggucaucaaauuacgaua

SEQ ID NO: 2023270 - RNA, 15 nt, Shigella flexneri 2a str. 301
acugguccagccccu

SEQ ID NO: 2023271 - RNA, 16 nt, Shigella flexneri 2a str. 301
acuggcccucgucuuu

SEQ ID NO: 2023272 - RNA, 18 nt, Shigella flexneri 2a str. 301
acuggcgagauccggauc

SEQ ID NO: 2023273 - RNA, 20 nt, Shigella flexneri 2a str. 301
acuggcaugcuguccagcag

SEQ ID NO: 2023274 - RNA, 13 nt, Shigella flexneri 2a str. 301
acugcuugaagcg

SEQ ID NO: 2023275 - RNA, 22 nt, Shigella flexneri 2a str. 301
acugcuuaucaucacgcaucac

SEQ ID NO: 2023276 - RNA, 16 nt, Shigella flexneri 2a str. 301
acugcuuacaggcugg

SEQ ID NO: 2023277 - RNA, 18 nt, Shigella flexneri 2a str. 301
acuggcuacugucuaaaa

SEQ ID NO: 2023278 - RNA, 16 nt, Shigella flexneri 2a str. 301
acuggcuacugucuaa

SEQ ID NO: 2023279 - RNA, 14 nt, Shigella flexneri 2a str. 301
acuggcuuuccagc

SEQ ID NO: 2023280 - RNA, 16 nt, Shigella flexneri 2a str. 301
acuggcugcgugguuu

SEQ ID NO: 2023281 - RNA, 19 nt, Shigella flexneri 2a str. 301
acuggcuguagaagcugac

SEQ ID NO: 2023282 - RNA, 14 nt, Shigella flexneri 2a str. 301
acuggcucuuuuuc

SEQ ID NO: 2023283 - RNA, 14 nt, Shigella flexneri 2a str. 301
acuuaaugaaucau

SEQ ID NO: 2023284 - RNA, 20 nt, Shigella flexneri 2a str. 301
acuuaauaacgacauauaca

SEQ ID NO: 2023285 - RNA, 21 nt, Shigella flexneri 2a str. 301
acuuaauauugccguccggca

SEQ ID NO: 2023286 - RNA, 16 nt, Shigella flexneri 2a str. 301
acuuaaggucacagaa

SEQ ID NO: 2023287 - RNA, 12 nt, Shigella flexneri 2a str. 301
acuuaagucucc

SEQ ID NO: 2023288 - RNA, 16 nt, Shigella flexneri 2a str. 301
acuguuuucuaacuca

SEQ ID NO: 2023289 - RNA, 22 nt, Shigella flexneri 2a str. 301
acuguuaccucgauauucaggc

SEQ ID NO: 2023290 - RNA, 17 nt, Shigella flexneri 2a str. 301
acugugggauugcuuca

SEQ ID NO: 2023291 - RNA, 18 nt, Shigella flexneri 2a str. 301
acugugggauugcuucag

SEQ ID NO: 2023292 - RNA, 22 nt, Shigella flexneri 2a str. 301
acuguguuagccuggaagugcu

SEQ ID NO: 2023293 - RNA, 14 nt, Shigella flexneri 2a str. 301
acugucccauccac

SEQ ID NO: 2023294 - RNA, 16 nt, Shigella flexneri 2a str. 301
acuguagacaaaaugu

SEQ ID NO: 2023295 - RNA, 13 nt, Shigella flexneri 2a str. 301
acuguaccagcaa

SEQ ID NO: 2023296 - RNA, 23 nt, Shigella flexneri 2a str. 301
acuguaaauaaaccaccuggguc

SEQ ID NO: 2023297 - RNA, 21 nt, Shigella flexneri 2a str. 301
acuguauacgggcuuuuuaau

SEQ ID NO: 2023298 - RNA, 12 nt, Shigella flexneri 2a str. 301
acugucagaugc

SEQ ID NO: 2023299 - RNA, 24 nt, Shigella flexneri 2a str. 301
acgccgggaaauuuuuccguuuuc

SEQ ID NO: 2023300 - RNA, 17 nt, Shigella flexneri 2a str. 301
acgccgucaucacaccg

SEQ ID NO: 2023301 - RNA, 15 nt, Shigella flexneri 2a str. 301
acgccguaaguaagg

SEQ ID NO: 2023302 - RNA, 15 nt, Shigella flexneri 2a str. 301
acgccgcguuugcgc

SEQ ID NO: 2023303 - RNA, 15 nt, Shigella flexneri 2a str. 301
acgccgcgcgccacc

SEQ ID NO: 2023304 - RNA, 20 nt, Shigella flexneri 2a str. 301
acgccgcugucuaccagcac

SEQ ID NO: 2023305 - RNA, 22 nt, Shigella flexneri 2a str. 301
acgccgcugucuaccagcaccu

SEQ ID NO: 2023306 - RNA, 15 nt, Shigella flexneri 2a str. 301
acgccgcccagagaa

SEQ ID NO: 2023307 - RNA, 22 nt, Shigella flexneri 2a str. 301
acgccgccggaaguauuucaau

SEQ ID NO: 2023308 - RNA, 21 nt, Shigella flexneri 2a str. 301
acgccgccgcuucgcccaaau

SEQ ID NO: 2023309 - RNA, 19 nt, Shigella flexneri 2a str. 301
acgccgccguuagcuucag

SEQ ID NO: 2023310 - RNA, 15 nt, Shigella flexneri 2a str. 301
acgccgcgaggcaaa

SEQ ID NO: 2023311 - RNA, 15 nt, Shigella flexneri 2a str. 301
acgccucguaaugcu

SEQ ID NO: 2023312 - RNA, 23 nt, Shigella flexneri 2a str. 301
acgccucgggaaggucagguuug

SEQ ID NO: 2023313 - RNA, 14 nt, Shigella flexneri 2a str. 301
acgccugccgcauc

SEQ ID NO: 2023314 - RNA, 12 nt, Shigella flexneri 2a str. 301
acgccugcggcu

SEQ ID NO: 2023315 - RNA, 19 nt, Shigella flexneri 2a str. 301
acgccuggcucaagcacca

SEQ ID NO: 2023316 - RNA, 22 nt, Shigella flexneri 2a str. 301
acgccuggcucaagcaccaucc

SEQ ID NO: 2023317 - RNA, 23 nt, Shigella flexneri 2a str. 301
acgccguuuuuacccagcagcag

SEQ ID NO: 2023318 - RNA, 14 nt, Shigella flexneri 2a str. 301
acgccuaucaccag

SEQ ID NO: 2023319 - RNA, 23 nt, Shigella flexneri 2a str. 301
acgccguuggcguaaaucaaacc

SEQ ID NO: 2023320 - RNA, 22 nt, Shigella flexneri 2a str. 301
acgccuuugucgggcaggcuuc

SEQ ID NO: 2023321 - RNA, 14 nt, Shigella flexneri 2a str. 301
acgccuucccuuuc

SEQ ID NO: 2023322 - RNA, 17 nt, Shigella flexneri 2a str. 301
acgccugcucuuauuac

SEQ ID NO: 2023323 - RNA, 15 nt, Shigella flexneri 2a str. 301
acgcccaaugcccag

SEQ ID NO: 2023324 - RNA, 19 nt, Shigella flexneri 2a str. 301
acgcccaacuaaaugcugc

SEQ ID NO: 2023325 - RNA, 17 nt, Shigella flexneri 2a str. 301
acgccauuaaccgugcg

SEQ ID NO: 2023326 - RNA, 14 nt, Shigella flexneri 2a str. 301
acgccaucucuuua

SEQ ID NO: 2023327 - RNA, 16 nt, Shigella flexneri 2a str. 301
acgccaugaagauggu

SEQ ID NO: 2023328 - RNA, 17 nt, Shigella flexneri 2a str. 301
acgccccgguuucucuu

SEQ ID NO: 2023329 - RNA, 19 nt, Shigella flexneri 2a str. 301
acgccccacagacccaggu

SEQ ID NO: 2023330 - RNA, 13 nt, Shigella flexneri 2a str. 301
acgccccacaaac

SEQ ID NO: 2023331 - RNA, 19 nt, Shigella flexneri 2a str. 301
acgcccgcauaugcgggcg

SEQ ID NO: 2023332 - RNA, 14 nt, Shigella flexneri 2a str. 301
acgcccgccgacca

SEQ ID NO: 2023333 - RNA, 20 nt, Shigella flexneri 2a str. 301
acgcccgucaacggugccau

SEQ ID NO: 2023334 - RNA, 19 nt, Shigella flexneri 2a str. 301
acgcccugcgcuggugaaa

SEQ ID NO: 2023335 - RNA, 20 nt, Shigella flexneri 2a str. 301
acgccgaaaccgcgcagcgg

SEQ ID NO: 2023336 - RNA, 15 nt, Shigella flexneri 2a str. 301
acgccgaccagaccg

SEQ ID NO: 2023337 - RNA, 16 nt, Shigella flexneri 2a str. 301
acgccgaaugccgggu

SEQ ID NO: 2023338 - RNA, 20 nt, Shigella flexneri 2a str. 301
acgccgacgggucagcgggg

SEQ ID NO: 2023339 - RNA, 23 nt, Shigella flexneri 2a str. 301
acgccgagaauaaaacaggcagc

SEQ ID NO: 2023340 - RNA, 19 nt, Shigella flexneri 2a str. 301
acgccgagaauaaaacagg

SEQ ID NO: 2023341 - RNA, 20 nt, Shigella flexneri 2a str. 301
acgccgcauccggcauuuug

SEQ ID NO: 2023342 - RNA, 16 nt, Shigella flexneri 2a str. 301
acgccgccagaccaau

SEQ ID NO: 2023343 - RNA, 21 nt, Shigella flexneri 2a str. 301
acgccgccagaccaauagaaa

SEQ ID NO: 2023344 - RNA, 19 nt, Shigella flexneri 2a str. 301
acgccgcauccggcaugaa

SEQ ID NO: 2023345 - RNA, 22 nt, Shigella flexneri 2a str. 301
acgccgcaauggcuucauccac

SEQ ID NO: 2023346 - RNA, 19 nt, Shigella flexneri 2a str. 301
acgccgauugacuggaugc

SEQ ID NO: 2023347 - RNA, 20 nt, Shigella flexneri 2a str. 301
acgccgaggugcucuccacg

SEQ ID NO: 2023348 - RNA, 21 nt, Shigella flexneri 2a str. 301
acgcuccaguguggccagagu

SEQ ID NO: 2023349 - RNA, 13 nt, Shigella flexneri 2a str. 301
acgcuccagcagg

SEQ ID NO: 2023350 - RNA, 14 nt, Shigella flexneri 2a str. 301
acgcuaccaaaaaa

SEQ ID NO: 2023351 - RNA, 20 nt, Shigella flexneri 2a str. 301
acgcguuauccggcuaacaa

SEQ ID NO: 2023352 - RNA, 17 nt, Shigella flexneri 2a str. 301
acgcguggacuggcugc

SEQ ID NO: 2023353 - RNA, 18 nt, Shigella flexneri 2a str. 301
acgcguucauacuuuuca

SEQ ID NO: 2023354 - RNA, 23 nt, Shigella flexneri 2a str. 301
acgcguuuuuucgauaucaagcc

SEQ ID NO: 2023355 - RNA, 12 nt, Shigella flexneri 2a str. 301
acgcgucuuauc

SEQ ID NO: 2023356 - RNA, 17 nt, Shigella flexneri 2a str. 301
acgcguaaaacagccag

SEQ ID NO: 2023357 - RNA, 13 nt, Shigella flexneri 2a str. 301
acgcgguuacgca

SEQ ID NO: 2023358 - RNA, 17 nt, Shigella flexneri 2a str. 301
acgcgguauuggugaaa

SEQ ID NO: 2023359 - RNA, 21 nt, Shigella flexneri 2a str. 301
acgcuggcuuugcccuggcgc

SEQ ID NO: 2023360 - RNA, 23 nt, Shigella flexneri 2a str. 301
acgcugguaguuguacaacugcu

SEQ ID NO: 2023361 - RNA, 19 nt, Shigella flexneri 2a str. 301
acgcugcugcguacugaga

SEQ ID NO: 2023362 - RNA, 20 nt, Shigella flexneri 2a str. 301
acgcuggccgcgucuuaucc

SEQ ID NO: 2023363 - RNA, 18 nt, Shigella flexneri 2a str. 301
acgcuggcgcgccgccuc

SEQ ID NO: 2023364 - RNA, 18 nt, Shigella flexneri 2a str. 301
acgcuccccggcacuuaa

SEQ ID NO: 2023365 - RNA, 17 nt, Shigella flexneri 2a str. 301
acgcucgccauuuuuca

SEQ ID NO: 2023366 - RNA, 23 nt, Shigella flexneri 2a str. 301
acgcugccccugguuaucuucca

SEQ ID NO: 2023367 - RNA, 22 nt, Shigella flexneri 2a str. 301
acgcucggcuguuucuggauga

SEQ ID NO: 2023368 - RNA, 22 nt, Shigella flexneri 2a str. 301
acgcugcgcacauugguaauca

SEQ ID NO: 2023369 - RNA, 16 nt, Shigella flexneri 2a str. 301
acgcgcuaaucagcuu

SEQ ID NO: 2023370 - RNA, 16 nt, Shigella flexneri 2a str. 301
acgcggcccaggcggc

SEQ ID NO: 2023371 - RNA, 21 nt, Shigella flexneri 2a str. 301
acgcggcagcgucgcauccga

SEQ ID NO: 2023372 - RNA, 23 nt, Shigella flexneri 2a str. 301
acgcggcaauaauagccccaacc

SEQ ID NO: 2023373 - RNA, 22 nt, Shigella flexneri 2a str. 301
acgcgccaggaucagaaugcgc

SEQ ID NO: 2023374 - RNA, 15 nt, Shigella flexneri 2a str. 301
acgcgccaccgacca

SEQ ID NO: 2023375 - RNA, 18 nt, Shigella flexneri 2a str. 301
acgcgcagcguucauaaa

SEQ ID NO: 2023376 - RNA, 16 nt, Shigella flexneri 2a str. 301
acgcgcacaggcgcug

SEQ ID NO: 2023377 - RNA, 22 nt, Shigella flexneri 2a str. 301
acgcgcagggugcagaaucaau

SEQ ID NO: 2023378 - RNA, 17 nt, Shigella flexneri 2a str. 301
acgcgcauccggcagga

SEQ ID NO: 2023379 - RNA, 21 nt, Shigella flexneri 2a str. 301
acgcgaccgugggcaauuucu

SEQ ID NO: 2023380 - RNA, 17 nt, Shigella flexneri 2a str. 301
acgcgaccaaaggcgag

SEQ ID NO: 2023381 - RNA, 19 nt, Shigella flexneri 2a str. 301
acgcgauucccagucgcgc

SEQ ID NO: 2023382 - RNA, 19 nt, Shigella flexneri 2a str. 301
acgcgauuucucaucaaau

SEQ ID NO: 2023383 - RNA, 15 nt, Shigella flexneri 2a str. 301
acgugcacaggcaac

SEQ ID NO: 2023384 - RNA, 20 nt, Shigella flexneri 2a str. 301
acgugcaaaaucaaacagaa

SEQ ID NO: 2023385 - RNA, 15 nt, Shigella flexneri 2a str. 301
acgugcaaaaucaaa

SEQ ID NO: 2023386 - RNA, 16 nt, Shigella flexneri 2a str. 301
acguggcacauucuga

SEQ ID NO: 2023387 - RNA, 19 nt, Shigella flexneri 2a str. 301
acguggguaggaucagaau

SEQ ID NO: 2023388 - RNA, 13 nt, Shigella flexneri 2a str. 301
acguuaagaaaac

SEQ ID NO: 2023389 - RNA, 18 nt, Shigella flexneri 2a str. 301
acguguggucuuuucaac

SEQ ID NO: 2023390 - RNA, 22 nt, Shigella flexneri 2a str. 301
acguguggucuuuucaacaguu

SEQ ID NO: 2023391 - RNA, 23 nt, Shigella flexneri 2a str. 301
acguguggucuuuucaacaguuu

SEQ ID NO: 2023392 - RNA, 18 nt, Shigella flexneri 2a str. 301
acguguguugagauaaug

SEQ ID NO: 2023393 - RNA, 17 nt, Shigella flexneri 2a str. 301
acgucuccggugcuuua

SEQ ID NO: 2023394 - RNA, 14 nt, Shigella flexneri 2a str. 301
acgucuacaguacg

SEQ ID NO: 2023395 - RNA, 17 nt, Shigella flexneri 2a str. 301
acgucucaaucaccacc

SEQ ID NO: 2023396 - RNA, 18 nt, Shigella flexneri 2a str. 301
acgucgauuuuuaaugaa

SEQ ID NO: 2023397 - RNA, 20 nt, Shigella flexneri 2a str. 301
acgucgauuuuuaaugaacg

SEQ ID NO: 2023398 - RNA, 20 nt, Shigella flexneri 2a str. 301
acgucgcaacuccaccagca

SEQ ID NO: 2023399 - RNA, 14 nt, Shigella flexneri 2a str. 301
acguccccugggga

SEQ ID NO: 2023400 - RNA, 23 nt, Shigella flexneri 2a str. 301
acgucccgccgcuaucccaugcc

SEQ ID NO: 2023401 - RNA, 12 nt, Shigella flexneri 2a str. 301
acguccagccag

SEQ ID NO: 2023402 - RNA, 23 nt, Shigella flexneri 2a str. 301
acguccagcgauuugcggaagua

SEQ ID NO: 2023403 - RNA, 17 nt, Shigella flexneri 2a str. 301
acgucauuaccgcgaag

SEQ ID NO: 2023404 - RNA, 21 nt, Shigella flexneri 2a str. 301
acgucauugcuaucuccuguu

SEQ ID NO: 2023405 - RNA, 19 nt, Shigella flexneri 2a str. 301
acgucaucugucauaacac

SEQ ID NO: 2023406 - RNA, 15 nt, Shigella flexneri 2a str. 301
acgucaccucaggaa

SEQ ID NO: 2023407 - RNA, 16 nt, Shigella flexneri 2a str. 301
acgucagcacaaacau

SEQ ID NO: 2023408 - RNA, 23 nt, Shigella flexneri 2a str. 301
acgucaguaaccgcuuuuucaau

SEQ ID NO: 2023409 - RNA, 17 nt, Shigella flexneri 2a str. 301
acgguuaaaaacagcca

SEQ ID NO: 2023410 - RNA, 18 nt, Shigella flexneri 2a str. 301
acgguuaaaaacagccag

SEQ ID NO: 2023411 - RNA, 17 nt, Shigella flexneri 2a str. 301
acgguugaugccguucc

SEQ ID NO: 2023412 - RNA, 22 nt, Shigella flexneri 2a str. 301
acggugaagaagcggaaaucac

SEQ ID NO: 2023413 - RNA, 23 nt, Shigella flexneri 2a str. 301
acgguguaccggauaaauuuaaa

SEQ ID NO: 2023414 - RNA, 15 nt, Shigella flexneri 2a str. 301
acgucaauggugaga

SEQ ID NO: 2023415 - RNA, 14 nt, Shigella flexneri 2a str. 301
acgucaacuuuguu

SEQ ID NO: 2023416 - RNA, 14 nt, Shigella flexneri 2a str. 301
acgggcaaucucau

SEQ ID NO: 2023417 - RNA, 13 nt, Shigella flexneri 2a str. 301
acgggcaagaaua

SEQ ID NO: 2023418 - RNA, 23 nt, Shigella flexneri 2a str. 301
acgggguugugauuacaggaugc

SEQ ID NO: 2023419 - RNA, 19 nt, Shigella flexneri 2a str. 301
acggguaaaacgugccauu

SEQ ID NO: 2023420 - RNA, 16 nt, Shigella flexneri 2a str. 301
acgguacucaucacgu

SEQ ID NO: 2023421 - RNA, 18 nt, Shigella flexneri 2a str. 301
acggggacuccacaccgg

SEQ ID NO: 2023422 - RNA, 21 nt, Shigella flexneri 2a str. 301
acgguaguggcaaccagcaga

SEQ ID NO: 2023423 - RNA, 19 nt, Shigella flexneri 2a str. 301
acgggguugugauuacagg

SEQ ID NO: 2023424 - RNA, 15 nt, Shigella flexneri 2a str. 301
acggugaccagaacu

SEQ ID NO: 2023425 - RNA, 15 nt, Shigella flexneri 2a str. 301
acgguccuuaccaug

SEQ ID NO: 2023426 - RNA, 22 nt, Shigella flexneri 2a str. 301
acggucccucaacaacagucuc

SEQ ID NO: 2023427 - RNA, 17 nt, Shigella flexneri 2a str. 301
acggucaggcuaaagaa

SEQ ID NO: 2023428 - RNA, 20 nt, Shigella flexneri 2a str. 301
acggucaggcuaaagaaaac

SEQ ID NO: 2023429 - RNA, 18 nt, Shigella flexneri 2a str. 301
acggcacuccucuucacg

SEQ ID NO: 2023430 - RNA, 19 nt, Shigella flexneri 2a str. 301
acggcagcaacggcaguuu

SEQ ID NO: 2023431 - RNA, 12 nt, Shigella flexneri 2a str. 301
acggcaccaccc

SEQ ID NO: 2023432 - RNA, 16 nt, Shigella flexneri 2a str. 301
acggcauuuugcugau

SEQ ID NO: 2023433 - RNA, 22 nt, Shigella flexneri 2a str. 301
acggcaggaucaggcaaacgaa

SEQ ID NO: 2023434 - RNA, 15 nt, Shigella flexneri 2a str. 301
acggcaucaacauca

SEQ ID NO: 2023435 - RNA, 16 nt, Shigella flexneri 2a str. 301
acggcauaagccgucc

SEQ ID NO: 2023436 - RNA, 18 nt, Shigella flexneri 2a str. 301
acggcgaaucaaccgcgc

SEQ ID NO: 2023437 - RNA, 13 nt, Shigella flexneri 2a str. 301
acggcccagaccc

SEQ ID NO: 2023438 - RNA, 22 nt, Shigella flexneri 2a str. 301
accugcuggacgcgccaacaaa

SEQ ID NO: 2023439 - RNA, 18 nt, Shigella flexneri 2a str. 301
accugcuggaaaggccgc

SEQ ID NO: 2023440 - RNA, 17 nt, Shigella flexneri 2a str. 301
accugcucgucauccgc

SEQ ID NO: 2023441 - RNA, 19 nt, Shigella flexneri 2a str. 301
accugcuuuguucagcccu

SEQ ID NO: 2023442 - RNA, 21 nt, Shigella flexneri 2a str. 301
accugcuuuaaaagcucgcuc

SEQ ID NO: 2023443 - RNA, 16 nt, Shigella flexneri 2a str. 301
accugcuuuguucagc

SEQ ID NO: 2023444 - RNA, 16 nt, Shigella flexneri 2a str. 301
accuggauauugcgga

SEQ ID NO: 2023445 - RNA, 14 nt, Shigella flexneri 2a str. 301
accuggauugccug

SEQ ID NO: 2023446 - RNA, 20 nt, Shigella flexneri 2a str. 301
accugcgccugcaccauugc

SEQ ID NO: 2023447 - RNA, 12 nt, Shigella flexneri 2a str. 301
accugccggagc

SEQ ID NO: 2023448 - RNA, 14 nt, Shigella flexneri 2a str. 301
accugccuuacaua

SEQ ID NO: 2023449 - RNA, 23 nt, Shigella flexneri 2a str. 301
accugcguucagcaguucugcca

SEQ ID NO: 2023450 - RNA, 22 nt, Shigella flexneri 2a str. 301
accuccagcgaaggaucacccc

SEQ ID NO: 2023451 - RNA, 18 nt, Shigella flexneri 2a str. 301
accuccacgcccagcgca

SEQ ID NO: 2023452 - RNA, 18 nt, Shigella flexneri 2a str. 301
accugcaaauucaauaaa

SEQ ID NO: 2023453 - RNA, 15 nt, Shigella flexneri 2a str. 301
accugcccuccggua

SEQ ID NO: 2023454 - RNA, 14 nt, Shigella flexneri 2a str. 301
accugcccuccggu

SEQ ID NO: 2023455 - RNA, 23 nt, Shigella flexneri 2a str. 301
accugccaggugagauccgggaa

SEQ ID NO: 2023456 - RNA, 22 nt, Shigella flexneri 2a str. 301
accugccagggagcgaaaaagc

SEQ ID NO: 2023457 - RNA, 19 nt, Shigella flexneri 2a str. 301
accugccagaacaaccaga

SEQ ID NO: 2023458 - RNA, 21 nt, Shigella flexneri 2a str. 301
accugccagcgccgacagcag

SEQ ID NO: 2023459 - RNA, 16 nt, Shigella flexneri 2a str. 301
accugcauacaaauaa

SEQ ID NO: 2023460 - RNA, 22 nt, Shigella flexneri 2a str. 301
accugcacaaauagccagcaga

SEQ ID NO: 2023461 - RNA, 21 nt, Shigella flexneri 2a str. 301
accuguaacguugcugcgccg

SEQ ID NO: 2023462 - RNA, 15 nt, Shigella flexneri 2a str. 301
accuguaccagcccg

SEQ ID NO: 2023463 - RNA, 14 nt, Shigella flexneri 2a str. 301
accuggcuugccgg

SEQ ID NO: 2023464 - RNA, 17 nt, Shigella flexneri 2a str. 301
accuggcgcaguggaua

SEQ ID NO: 2023465 - RNA, 14 nt, Shigella flexneri 2a str. 301
accuggccugggau

SEQ ID NO: 2023466 - RNA, 20 nt, Shigella flexneri 2a str. 301
accuggccugggaucaucag

SEQ ID NO: 2023467 - RNA, 22 nt, Shigella flexneri 2a str. 301
accuggccugggaucaucagca

SEQ ID NO: 2023468 - RNA, 19 nt, Shigella flexneri 2a str. 301
accuguccuguaggccuga

SEQ ID NO: 2023469 - RNA, 16 nt, Shigella flexneri 2a str. 301
accugugacagcagcg

SEQ ID NO: 2023470 - RNA, 19 nt, Shigella flexneri 2a str. 301
accuucacagaaggccagg

SEQ ID NO: 2023471 - RNA, 14 nt, Shigella flexneri 2a str. 301
accuucaggcacaa

SEQ ID NO: 2023472 - RNA, 12 nt, Shigella flexneri 2a str. 301
accuucacgcgc

SEQ ID NO: 2023473 - RNA, 20 nt, Shigella flexneri 2a str. 301
accuucacgcgcuccaggag

SEQ ID NO: 2023474 - RNA, 23 nt, Shigella flexneri 2a str. 301
accuucagcgaagcccacgccgc

SEQ ID NO: 2023475 - RNA, 22 nt, Shigella flexneri 2a str. 301
accuucagcgaagcccacgccg

SEQ ID NO: 2023476 - RNA, 13 nt, Shigella flexneri 2a str. 301
accuugucaugca

SEQ ID NO: 2023477 - RNA, 14 nt, Shigella flexneri 2a str. 301
accuuguuucugag

SEQ ID NO: 2023478 - RNA, 13 nt, Shigella flexneri 2a str. 301
accuuggcacuga

SEQ ID NO: 2023479 - RNA, 12 nt, Shigella flexneri 2a str. 301
accuucuuccca

SEQ ID NO: 2023480 - RNA, 13 nt, Shigella flexneri 2a str. 301
accuucuuccugc

SEQ ID NO: 2023481 - RNA, 15 nt, Shigella flexneri 2a str. 301
accuucauccagcau

SEQ ID NO: 2023482 - RNA, 19 nt, Shigella flexneri 2a str. 301
accuucugcgcccgcccgc

SEQ ID NO: 2023483 - RNA, 16 nt, Shigella flexneri 2a str. 301
acgagcgcaaugaaaa

SEQ ID NO: 2023484 - RNA, 23 nt, Shigella flexneri 2a str. 301
acgagugcaucugguaagugcca

SEQ ID NO: 2023485 - RNA, 19 nt, Shigella flexneri 2a str. 301
acgaccgauugauucccaa

SEQ ID NO: 2023486 - RNA, 18 nt, Shigella flexneri 2a str. 301
acgaccgcaugcgguuua

SEQ ID NO: 2023487 - RNA, 18 nt, Shigella flexneri 2a str. 301
acgaccaucagcugccag

SEQ ID NO: 2023488 - RNA, 22 nt, Shigella flexneri 2a str. 301
acgaccagaucggucagugcca

SEQ ID NO: 2023489 - RNA, 19 nt, Shigella flexneri 2a str. 301
acgaccguuccauucaaac

SEQ ID NO: 2023490 - RNA, 19 nt, Shigella flexneri 2a str. 301
acgacgggauucgaaccug

SEQ ID NO: 2023491 - RNA, 14 nt, Shigella flexneri 2a str. 301
acgacgaagaaacc

SEQ ID NO: 2023492 - RNA, 15 nt, Shigella flexneri 2a str. 301
acgacgacaggcaag

SEQ ID NO: 2023493 - RNA, 15 nt, Shigella flexneri 2a str. 301
acgacgcagaacuga

SEQ ID NO: 2023494 - RNA, 15 nt, Shigella flexneri 2a str. 301
acgacgccaagaaag

SEQ ID NO: 2023495 - RNA, 15 nt, Shigella flexneri 2a str. 301
acgacgguuuccacc

SEQ ID NO: 2023496 - RNA, 21 nt, Shigella flexneri 2a str. 301
acgaaacgccggugaccauca

SEQ ID NO: 2023497 - RNA, 18 nt, Shigella flexneri 2a str. 301
accuuuguaugccuggca

SEQ ID NO: 2023498 - RNA, 17 nt, Shigella flexneri 2a str. 301
acgaaagcgcaguaagc

SEQ ID NO: 2023499 - RNA, 15 nt, Shigella flexneri 2a str. 301
acgaaucuauucauu

SEQ ID NO: 2023500 - RNA, 21 nt, Shigella flexneri 2a str. 301
acgaaugacauaaugcaaaau

SEQ ID NO: 2023501 - RNA, 17 nt, Shigella flexneri 2a str. 301
acgaaucaaucgccccu

SEQ ID NO: 2023502 - RNA, 14 nt, Shigella flexneri 2a str. 301
acgaccacccaccg

SEQ ID NO: 2023503 - RNA, 16 nt, Shigella flexneri 2a str. 301
acgacauggcccagcc

SEQ ID NO: 2023504 - RNA, 11 nt, Shigella flexneri 2a str. 301
acgacaaucuc

SEQ ID NO: 2023505 - RNA, 18 nt, Shigella flexneri 2a str. 301
acgacacucucuucaaca

SEQ ID NO: 2023506 - RNA, 13 nt, Shigella flexneri 2a str. 301
acgaauuaucacu

SEQ ID NO: 2023507 - RNA, 22 nt, Shigella flexneri 2a str. 301
acgaauugauuuucgaaaaaaa

SEQ ID NO: 2023508 - RNA, 21 nt, Shigella flexneri 2a str. 301
acgacaaggcaggcaucaaug

SEQ ID NO: 2023509 - RNA, 22 nt, Shigella flexneri 2a str. 301
acgacaaggcaggcaucaauga

SEQ ID NO: 2023510 - RNA, 21 nt, Shigella flexneri 2a str. 301
acgacaaaaauaccaccaaug

SEQ ID NO: 2023511 - RNA, 23 nt, Shigella flexneri 2a str. 301
accgugcugacucagcggcugcc

SEQ ID NO: 2023512 - RNA, 22 nt, Shigella flexneri 2a str. 301
accgugcuucgccuuacucacc

SEQ ID NO: 2023513 - RNA, 20 nt, Shigella flexneri 2a str. 301
accgugcgggcaucaucuuc

SEQ ID NO: 2023514 - RNA, 20 nt, Shigella flexneri 2a str. 301
accgugggaaacaguaagca

SEQ ID NO: 2023515 - RNA, 13 nt, Shigella flexneri 2a str. 301
accguuaaaacca

SEQ ID NO: 2023516 - RNA, 20 nt, Shigella flexneri 2a str. 301
accguucauuaacgccccaa

SEQ ID NO: 2023517 - RNA, 14 nt, Shigella flexneri 2a str. 301
accguucaggcaca

SEQ ID NO: 2023518 - RNA, 22 nt, Shigella flexneri 2a str. 301
accguuggccugauaaacauag

SEQ ID NO: 2023519 - RNA, 14 nt, Shigella flexneri 2a str. 301
accgucgaugaaag

SEQ ID NO: 2023520 - RNA, 20 nt, Shigella flexneri 2a str. 301
accguccucuucccagaccc

SEQ ID NO: 2023521 - RNA, 13 nt, Shigella flexneri 2a str. 301
accguccucacug

SEQ ID NO: 2023522 - RNA, 14 nt, Shigella flexneri 2a str. 301
accguccucacugu

SEQ ID NO: 2023523 - RNA, 18 nt, Shigella flexneri 2a str. 301
accgugaucguggccaug

SEQ ID NO: 2023524 - RNA, 14 nt, Shigella flexneri 2a str. 301
accgugaaaauggc

SEQ ID NO: 2023525 - RNA, 16 nt, Shigella flexneri 2a str. 301
accgucucugcgcccu

SEQ ID NO: 2023526 - RNA, 19 nt, Shigella flexneri 2a str. 301
accgucuucccgcagccac

SEQ ID NO: 2023527 - RNA, 16 nt, Shigella flexneri 2a str. 301
accgucuucccgcagc

SEQ ID NO: 2023528 - RNA, 12 nt, Shigella flexneri 2a str. 301
accgucuguaac

SEQ ID NO: 2023529 - RNA, 23 nt, Shigella flexneri 2a str. 301
accgucugugugccugucgggac

SEQ ID NO: 2023530 - RNA, 16 nt, Shigella flexneri 2a str. 301
accgucugcgccgagg

SEQ ID NO: 2023531 - RNA, 17 nt, Shigella flexneri 2a str. 301
accucaucagacaccag

SEQ ID NO: 2023532 - RNA, 21 nt, Shigella flexneri 2a str. 301
accucaucaccacagacaaac

SEQ ID NO: 2023533 - RNA, 20 nt, Shigella flexneri 2a str. 301
accucauuaagaugcauuua

SEQ ID NO: 2023534 - RNA, 19 nt, Shigella flexneri 2a str. 301
accuaccugcaguucauca

SEQ ID NO: 2023535 - RNA, 19 nt, Shigella flexneri 2a str. 301
accuacgugcgcaauaacc

SEQ ID NO: 2023536 - RNA, 23 nt, Shigella flexneri 2a str. 301
accguuuugugcgcgugagcugg

SEQ ID NO: 2023537 - RNA, 16 nt, Shigella flexneri 2a str. 301
accuaaaaaaucccac

SEQ ID NO: 2023538 - RNA, 18 nt, Shigella flexneri 2a str. 301
accguuugauugaaaaau

SEQ ID NO: 2023539 - RNA, 19 nt, Shigella flexneri 2a str. 301
accguuucuuugccgagga

SEQ ID NO: 2023540 - RNA, 13 nt, Shigella flexneri 2a str. 301
accuaacagcauc

SEQ ID NO: 2023541 - RNA, 18 nt, Shigella flexneri 2a str. 301
accuaaaguaaaggaaca

SEQ ID NO: 2023542 - RNA, 19 nt, Shigella flexneri 2a str. 301
accuaaacguuuaaaaacu

SEQ ID NO: 2023543 - RNA, 17 nt, Shigella flexneri 2a str. 301
accuacaaaaccugcac

SEQ ID NO: 2023544 - RNA, 21 nt, Shigella flexneri 2a str. 301
accuacaaaaucuugcaaaau

SEQ ID NO: 2023545 - RNA, 14 nt, Shigella flexneri 2a str. 301
accuaaccugauau

SEQ ID NO: 2023546 - RNA, 19 nt, Shigella flexneri 2a str. 301
accgguaaagaagagcggc

SEQ ID NO: 2023547 - RNA, 17 nt, Shigella flexneri 2a str. 301
accggguuuucaaugau

SEQ ID NO: 2023548 - RNA, 19 nt, Shigella flexneri 2a str. 301
accgggugguaauaccacc

SEQ ID NO: 2023549 - RNA, 23 nt, Shigella flexneri 2a str. 301
accgggugguaauaccacccggu

SEQ ID NO: 2023550 - RNA, 17 nt, Shigella flexneri 2a str. 301
accgguaacgauuucau

SEQ ID NO: 2023551 - RNA, 17 nt, Shigella flexneri 2a str. 301
accgguacaaacaucau

SEQ ID NO: 2023552 - RNA, 19 nt, Shigella flexneri 2a str. 301
accggcuuucgcuucaacc

SEQ ID NO: 2023553 - RNA, 16 nt, Shigella flexneri 2a str. 301
accgggaagauccagg

SEQ ID NO: 2023554 - RNA, 18 nt, Shigella flexneri 2a str. 301
accguacauugccgggcg

SEQ ID NO: 2023555 - RNA, 14 nt, Shigella flexneri 2a str. 301
accguaccggcacc

SEQ ID NO: 2023556 - RNA, 19 nt, Shigella flexneri 2a str. 301
accguacgcaucaccagac

SEQ ID NO: 2023557 - RNA, 20 nt, Shigella flexneri 2a str. 301
accggucccuucaaucucaa

SEQ ID NO: 2023558 - RNA, 19 nt, Shigella flexneri 2a str. 301
accgguuucaauccaggua

SEQ ID NO: 2023559 - RNA, 14 nt, Shigella flexneri 2a str. 301
accgguucgugcca

SEQ ID NO: 2023560 - RNA, 17 nt, Shigella flexneri 2a str. 301
accgucaaaaaaacggc

SEQ ID NO: 2023561 - RNA, 11 nt, Shigella flexneri 2a str. 301
accguauuuug

SEQ ID NO: 2023562 - RNA, 18 nt, Shigella flexneri 2a str. 301
accguauuuugguaauga

SEQ ID NO: 2023563 - RNA, 21 nt, Shigella flexneri 2a str. 301
accguaguccauacccagcau

SEQ ID NO: 2023564 - RNA, 20 nt, Shigella flexneri 2a str. 301
accguaucuucauugugcgg

SEQ ID NO: 2023565 - RNA, 22 nt, Shigella flexneri 2a str. 301
accguaucccccagagcaaagu

SEQ ID NO: 2023566 - RNA, 19 nt, Shigella flexneri 2a str. 301
accgcucugcgaucugcgc

SEQ ID NO: 2023567 - RNA, 19 nt, Shigella flexneri 2a str. 301
accgcuuuacgccaccgca

SEQ ID NO: 2023568 - RNA, 21 nt, Shigella flexneri 2a str. 301
accgcuuggcgauaccccaac

SEQ ID NO: 2023569 - RNA, 21 nt, Shigella flexneri 2a str. 301
accgcuucgcucacaucaugc

SEQ ID NO: 2023570 - RNA, 19 nt, Shigella flexneri 2a str. 301
accggcacuucaacuucgc

SEQ ID NO: 2023571 - RNA, 19 nt, Shigella flexneri 2a str. 301
accggacaguuugaucagu

SEQ ID NO: 2023572 - RNA, 13 nt, Shigella flexneri 2a str. 301
accggacaauaaa

SEQ ID NO: 2023573 - RNA, 16 nt, Shigella flexneri 2a str. 301
accggaaaaggcguuc

SEQ ID NO: 2023574 - RNA, 21 nt, Shigella flexneri 2a str. 301
accgcuuuuccagcauaaugu

SEQ ID NO: 2023575 - RNA, 14 nt, Shigella flexneri 2a str. 301
accggaacccaccg

SEQ ID NO: 2023576 - RNA, 12 nt, Shigella flexneri 2a str. 301
accggaacccac

SEQ ID NO: 2023577 - RNA, 12 nt, Shigella flexneri 2a str. 301
accggaaccagc

SEQ ID NO: 2023578 - RNA, 13 nt, Shigella flexneri 2a str. 301
accggaacaucac

SEQ ID NO: 2023579 - RNA, 15 nt, Shigella flexneri 2a str. 301
accggaacaucacca

SEQ ID NO: 2023580 - RNA, 22 nt, Shigella flexneri 2a str. 301
accgcuccgccaucuucuugca

SEQ ID NO: 2023581 - RNA, 13 nt, Shigella flexneri 2a str. 301
accgcucgcgcuu

SEQ ID NO: 2023582 - RNA, 17 nt, Shigella flexneri 2a str. 301
accgcuauuugcgccug

SEQ ID NO: 2023583 - RNA, 14 nt, Shigella flexneri 2a str. 301
accgcucagcuccu

SEQ ID NO: 2023584 - RNA, 17 nt, Shigella flexneri 2a str. 301
accgcgugcgcggcagc

SEQ ID NO: 2023585 - RNA, 23 nt, Shigella flexneri 2a str. 301
accgcaaagguugcugcgcccca

SEQ ID NO: 2023586 - RNA, 23 nt, Shigella flexneri 2a str. 301
accgcguaauacaucagcuaaau

SEQ ID NO: 2023587 - RNA, 18 nt, Shigella flexneri 2a str. 301
accgcaaaaccaacgccu

SEQ ID NO: 2023588 - RNA, 12 nt, Shigella flexneri 2a str. 301
accgauucccag

SEQ ID NO: 2023589 - RNA, 16 nt, Shigella flexneri 2a str. 301
accagcgucagaaaca

SEQ ID NO: 2023590 - RNA, 16 nt, Shigella flexneri 2a str. 301
accagcgucaucggau

SEQ ID NO: 2023591 - RNA, 20 nt, Shigella flexneri 2a str. 301
accagcgcagauagcccgga

SEQ ID NO: 2023592 - RNA, 14 nt, Shigella flexneri 2a str. 301
accagcgauaaaaa

SEQ ID NO: 2023593 - RNA, 17 nt, Shigella flexneri 2a str. 301
accagcgcaauauguuu

SEQ ID NO: 2023594 - RNA, 20 nt, Shigella flexneri 2a str. 301
accagccuggcggaaagcca

SEQ ID NO: 2023595 - RNA, 20 nt, Shigella flexneri 2a str. 301
accagccguugucagucauc

SEQ ID NO: 2023596 - RNA, 21 nt, Shigella flexneri 2a str. 301
accagcgaauggguaaaaccg

SEQ ID NO: 2023597 - RNA, 19 nt, Shigella flexneri 2a str. 301
accagcgacggaugacacg

SEQ ID NO: 2023598 - RNA, 22 nt, Shigella flexneri 2a str. 301
accagcgaaaucaccgccacca

SEQ ID NO: 2023599 - RNA, 12 nt, Shigella flexneri 2a str. 301
accagccuugcc

SEQ ID NO: 2023600 - RNA, 15 nt, Shigella flexneri 2a str. 301
accagcaucaacaac

SEQ ID NO: 2023601 - RNA, 17 nt, Shigella flexneri 2a str. 301
accagcaucccggcagc

SEQ ID NO: 2023602 - RNA, 13 nt, Shigella flexneri 2a str. 301
accagcagcugcu

SEQ ID NO: 2023603 - RNA, 13 nt, Shigella flexneri 2a str. 301
accagcaguaaac

SEQ ID NO: 2023604 - RNA, 18 nt, Shigella flexneri 2a str. 301
accagcaugaucagcgca

SEQ ID NO: 2023605 - RNA, 22 nt, Shigella flexneri 2a str. 301
accagccgcuaccagcgcggca

SEQ ID NO: 2023606 - RNA, 23 nt, Shigella flexneri 2a str. 301
accagccgcuaccagcgcggcac

SEQ ID NO: 2023607 - RNA, 17 nt, Shigella flexneri 2a str. 301
accagccccagaauuca

SEQ ID NO: 2023608 - RNA, 21 nt, Shigella flexneri 2a str. 301
accagccauuaaccagccacu

SEQ ID NO: 2023609 - RNA, 17 nt, Shigella flexneri 2a str. 301
accagccaggccgccag

SEQ ID NO: 2023610 - RNA, 15 nt, Shigella flexneri 2a str. 301
accagccagcgcuga

SEQ ID NO: 2023611 - RNA, 14 nt, Shigella flexneri 2a str. 301
accaagaccaaucc

SEQ ID NO: 2023612 - RNA, 14 nt, Shigella flexneri 2a str. 301
accaagaaagagaa

SEQ ID NO: 2023613 - RNA, 17 nt, Shigella flexneri 2a str. 301
accaacuucagcaacaa

SEQ ID NO: 2023614 - RNA, 21 nt, Shigella flexneri 2a str. 301
accaacuucagcaacaaaaug

SEQ ID NO: 2023615 - RNA, 21 nt, Shigella flexneri 2a str. 301
accagacgcgcguccccugcc

SEQ ID NO: 2023616 - RNA, 16 nt, Shigella flexneri 2a str. 301
accagacggcguaauc

SEQ ID NO: 2023617 - RNA, 20 nt, Shigella flexneri 2a str. 301
accagacgugauaaacaucc

SEQ ID NO: 2023618 - RNA, 17 nt, Shigella flexneri 2a str. 301
accagaccaauggcuuu

SEQ ID NO: 2023619 - RNA, 18 nt, Shigella flexneri 2a str. 301
accagacaucccagugca

SEQ ID NO: 2023620 - RNA, 21 nt, Shigella flexneri 2a str. 301
accagaccggcaaucgcgcca

SEQ ID NO: 2023621 - RNA, 23 nt, Shigella flexneri 2a str. 301
accagaccggcaaucgcgccaga

SEQ ID NO: 2023622 - RNA, 12 nt, Shigella flexneri 2a str. 301
accagaauuuac

SEQ ID NO: 2023623 - RNA, 18 nt, Shigella flexneri 2a str. 301
accagcaccguguucuca

SEQ ID NO: 2023624 - RNA, 13 nt, Shigella flexneri 2a str. 301
accagcaauaaca

SEQ ID NO: 2023625 - RNA, 17 nt, Shigella flexneri 2a str. 301
accagcaauaacaacac

SEQ ID NO: 2023626 - RNA, 12 nt, Shigella flexneri 2a str. 301
accagcaaauau

SEQ ID NO: 2023627 - RNA, 12 nt, Shigella flexneri 2a str. 301
accagcaacaaa

SEQ ID NO: 2023628 - RNA, 15 nt, Shigella flexneri 2a str. 301
accagcacaucauca

SEQ ID NO: 2023629 - RNA, 22 nt, Shigella flexneri 2a str. 301
accagcaccagcuccggcaccu

SEQ ID NO: 2023630 - RNA, 20 nt, Shigella flexneri 2a str. 301
accagagcugauacgggagg

SEQ ID NO: 2023631 - RNA, 18 nt, Shigella flexneri 2a str. 301
accagauggcuuuccacc

SEQ ID NO: 2023632 - RNA, 16 nt, Shigella flexneri 2a str. 301
accagauuaauuauug

SEQ ID NO: 2023633 - RNA, 20 nt, Shigella flexneri 2a str. 301
accagaugcucuuuucugaa

SEQ ID NO: 2023634 - RNA, 23 nt, Shigella flexneri 2a str. 301
accagaugcucuuuucugaagua

SEQ ID NO: 2023635 - RNA, 19 nt, Shigella flexneri 2a str. 301
accagaucggucagugcca

SEQ ID NO: 2023636 - RNA, 22 nt, Shigella flexneri 2a str. 301
accaucgagaaucagcgagaca

SEQ ID NO: 2023637 - RNA, 23 nt, Shigella flexneri 2a str. 301
accaucgagaaucagcgagacaa

SEQ ID NO: 2023638 - RNA, 19 nt, Shigella flexneri 2a str. 301
accauauuuaugcagugca

SEQ ID NO: 2023639 - RNA, 18 nt, Shigella flexneri 2a str. 301
accauccgcucacugaua

SEQ ID NO: 2023640 - RNA, 18 nt, Shigella flexneri 2a str. 301
accaucgcaaacaguaca

SEQ ID NO: 2023641 - RNA, 16 nt, Shigella flexneri 2a str. 301
accaucgccauuuaac

SEQ ID NO: 2023642 - RNA, 17 nt, Shigella flexneri 2a str. 301
accaucguaagcgccag

SEQ ID NO: 2023643 - RNA, 21 nt, Shigella flexneri 2a str. 301
accauauaugauaauuauuau

SEQ ID NO: 2023644 - RNA, 16 nt, Shigella flexneri 2a str. 301
accauauucagcagca

SEQ ID NO: 2023645 - RNA, 15 nt, Shigella flexneri 2a str. 301
accauauucagcagc

SEQ ID NO: 2023646 - RNA, 17 nt, Shigella flexneri 2a str. 301
accauauucagcagcag

SEQ ID NO: 2023647 - RNA, 18 nt, Shigella flexneri 2a str. 301
accauauguguuugugcc

SEQ ID NO: 2023648 - RNA, 22 nt, Shigella flexneri 2a str. 301
accauaaauuucacgucacgcu

SEQ ID NO: 2023649 - RNA, 14 nt, Shigella flexneri 2a str. 301
accauaaauuucac

SEQ ID NO: 2023650 - RNA, 14 nt, Shigella flexneri 2a str. 301
accauaaaucagau

SEQ ID NO: 2023651 - RNA, 20 nt, Shigella flexneri 2a str. 301
accauaaauccaacaacaca

SEQ ID NO: 2023652 - RNA, 18 nt, Shigella flexneri 2a str. 301
accauaaauauggugaaa

SEQ ID NO: 2023653 - RNA, 20 nt, Shigella flexneri 2a str. 301
accagugcaggcaccagccc

SEQ ID NO: 2023654 - RNA, 22 nt, Shigella flexneri 2a str. 301
accagucagcgaacaccagcag

SEQ ID NO: 2023655 - RNA, 15 nt, Shigella flexneri 2a str. 301
accaguaugaugacg

SEQ ID NO: 2023656 - RNA, 18 nt, Shigella flexneri 2a str. 301
accaguacgcccacgcca

SEQ ID NO: 2023657 - RNA, 23 nt, Shigella flexneri 2a str. 301
accagucagcgaacaccagcagu

SEQ ID NO: 2023658 - RNA, 14 nt, Shigella flexneri 2a str. 301
accaguccacccac

SEQ ID NO: 2023659 - RNA, 16 nt, Shigella flexneri 2a str. 301
accaguccaucggcau

SEQ ID NO: 2023660 - RNA, 20 nt, Shigella flexneri 2a str. 301
accaguccuacacacgccag

SEQ ID NO: 2023661 - RNA, 22 nt, Shigella flexneri 2a str. 301
accaguugguagguccagccgc

SEQ ID NO: 2023662 - RNA, 21 nt, Shigella flexneri 2a str. 301
accauaaaacaaauccgcuug

SEQ ID NO: 2023663 - RNA, 17 nt, Shigella flexneri 2a str. 301
accaggaagcgacccgg

SEQ ID NO: 2023664 - RNA, 20 nt, Shigella flexneri 2a str. 301
accaggaagcgacccgguuc

SEQ ID NO: 2023665 - RNA, 14 nt, Shigella flexneri 2a str. 301
accaggaaacccaa

SEQ ID NO: 2023666 - RNA, 20 nt, Shigella flexneri 2a str. 301
accaggaagauguacgccag

SEQ ID NO: 2023667 - RNA, 23 nt, Shigella flexneri 2a str. 301
accaggaaacccaacgcaaagag

SEQ ID NO: 2023668 - RNA, 23 nt, Shigella flexneri 2a str. 301
accagcuguccgauuuguucucu

SEQ ID NO: 2023669 - RNA, 11 nt, Shigella flexneri 2a str. 301
accagcugccg

SEQ ID NO: 2023670 - RNA, 16 nt, Shigella flexneri 2a str. 301
accagcuaccacgccg

SEQ ID NO: 2023671 - RNA, 13 nt, Shigella flexneri 2a str. 301
accagcguuucca

SEQ ID NO: 2023672 - RNA, 16 nt, Shigella flexneri 2a str. 301
accaguaccgccacca

SEQ ID NO: 2023673 - RNA, 22 nt, Shigella flexneri 2a str. 301
accaguaccgccgccauaaaca

SEQ ID NO: 2023674 - RNA, 13 nt, Shigella flexneri 2a str. 301
accaguaccgccg

SEQ ID NO: 2023675 - RNA, 15 nt, Shigella flexneri 2a str. 301
accaguaaggcaucu

SEQ ID NO: 2023676 - RNA, 20 nt, Shigella flexneri 2a str. 301
accaguaaggcgagaauauu

SEQ ID NO: 2023677 - RNA, 14 nt, Shigella flexneri 2a str. 301
accaguaaaccaau

SEQ ID NO: 2023678 - RNA, 14 nt, Shigella flexneri 2a str. 301
accaggcguggaua

SEQ ID NO: 2023679 - RNA, 22 nt, Shigella flexneri 2a str. 301
accaucguugcuaacggccacg

SEQ ID NO: 2023680 - RNA, 21 nt, Shigella flexneri 2a str. 301
accaucuucuucacuucuuca

SEQ ID NO: 2023681 - RNA, 16 nt, Shigella flexneri 2a str. 301
accaucugcgccgcca

SEQ ID NO: 2023682 - RNA, 14 nt, Shigella flexneri 2a str. 301
accaucuuuuuuug

SEQ ID NO: 2023683 - RNA, 13 nt, Shigella flexneri 2a str. 301
accaucuuugcug

SEQ ID NO: 2023684 - RNA, 19 nt, Shigella flexneri 2a str. 301
acccagaaucucuuuuguu

SEQ ID NO: 2023685 - RNA, 14 nt, Shigella flexneri 2a str. 301
acccagaugucuuu

SEQ ID NO: 2023686 - RNA, 20 nt, Shigella flexneri 2a str. 301
acccacggauagauuuuuaa

SEQ ID NO: 2023687 - RNA, 20 nt, Shigella flexneri 2a str. 301
acccacgguacucaucacgu

SEQ ID NO: 2023688 - RNA, 14 nt, Shigella flexneri 2a str. 301
acccacugacuucu

SEQ ID NO: 2023689 - RNA, 20 nt, Shigella flexneri 2a str. 301
acccagggaaaggauugcga

SEQ ID NO: 2023690 - RNA, 15 nt, Shigella flexneri 2a str. 301
acccagguagacacc

SEQ ID NO: 2023691 - RNA, 22 nt, Shigella flexneri 2a str. 301
acccaguuucaugauauguuuu

SEQ ID NO: 2023692 - RNA, 23 nt, Shigella flexneri 2a str. 301
acccaguuucggcaucagcagaa

SEQ ID NO: 2023693 - RNA, 18 nt, Shigella flexneri 2a str. 301
acccagcaccaguaccau

SEQ ID NO: 2023694 - RNA, 13 nt, Shigella flexneri 2a str. 301
acccagcagcagc

SEQ ID NO: 2023695 - RNA, 19 nt, Shigella flexneri 2a str. 301
acccagcagcgccgcgccu

SEQ ID NO: 2023696 - RNA, 21 nt, Shigella flexneri 2a str. 301
acccagcagguccccgagcac

SEQ ID NO: 2023697 - RNA, 21 nt, Shigella flexneri 2a str. 301
acccauuuauccagcggcagc

SEQ ID NO: 2023698 - RNA, 22 nt, Shigella flexneri 2a str. 301
acccauguuuaauucacgcagg

SEQ ID NO: 2023699 - RNA, 21 nt, Shigella flexneri 2a str. 301
accccaaaaagauuaaaaaaa

SEQ ID NO: 2023700 - RNA, 21 nt, Shigella flexneri 2a str. 301
acccaugugauuuaaaucaaa

SEQ ID NO: 2023701 - RNA, 21 nt, Shigella flexneri 2a str. 301
accccaauuaauugccagccg

SEQ ID NO: 2023702 - RNA, 18 nt, Shigella flexneri 2a str. 301
accccgucaccacuucac

SEQ ID NO: 2023703 - RNA, 17 nt, Shigella flexneri 2a str. 301
accccggcccucucccu

SEQ ID NO: 2023704 - RNA, 22 nt, Shigella flexneri 2a str. 301
accccggcggccggaugacaga

SEQ ID NO: 2023705 - RNA, 18 nt, Shigella flexneri 2a str. 301
acccgcaacaaugccgau

SEQ ID NO: 2023706 - RNA, 14 nt, Shigella flexneri 2a str. 301
acccgaugcgcuuu

SEQ ID NO: 2023707 - RNA, 17 nt, Shigella flexneri 2a str. 301
acccgauggcgugcccg

SEQ ID NO: 2023708 - RNA, 22 nt, Shigella flexneri 2a str. 301
acccgaucgccaucaugcacac

SEQ ID NO: 2023709 - RNA, 12 nt, Shigella flexneri 2a str. 301
acccgcaacagc

SEQ ID NO: 2023710 - RNA, 19 nt, Shigella flexneri 2a str. 301
acccgcaacauacugcccg

SEQ ID NO: 2023711 - RNA, 14 nt, Shigella flexneri 2a str. 301
acccgcacagucac

SEQ ID NO: 2023712 - RNA, 15 nt, Shigella flexneri 2a str. 301
acccgcagccagcac

SEQ ID NO: 2023713 - RNA, 17 nt, Shigella flexneri 2a str. 301
acccgccaugugcuuuu

SEQ ID NO: 2023714 - RNA, 21 nt, Shigella flexneri 2a str. 301
acccgcaggcgcaauggcgca

SEQ ID NO: 2023715 - RNA, 15 nt, Shigella flexneri 2a str. 301
acccuaacccucucc

SEQ ID NO: 2023716 - RNA, 14 nt, Shigella flexneri 2a str. 301
acccuaacaucauc

SEQ ID NO: 2023717 - RNA, 21 nt, Shigella flexneri 2a str. 301
acccguagcuguucaggagaa

SEQ ID NO: 2023718 - RNA, 16 nt, Shigella flexneri 2a str. 301
acccguacuucugacc

SEQ ID NO: 2023719 - RNA, 13 nt, Shigella flexneri 2a str. 301
acccuuuauuuuc

SEQ ID NO: 2023720 - RNA, 18 nt, Shigella flexneri 2a str. 301
acccuucugcacgccagg

SEQ ID NO: 2023721 - RNA, 14 nt, Shigella flexneri 2a str. 301
acccuugugcucaa

SEQ ID NO: 2023722 - RNA, 12 nt, Shigella flexneri 2a str. 301
acccuucuucca

SEQ ID NO: 2023723 - RNA, 15 nt, Shigella flexneri 2a str. 301
acccugguucgcaac

SEQ ID NO: 2023724 - RNA, 21 nt, Shigella flexneri 2a str. 301
acccuuacucacuaaauuagg

SEQ ID NO: 2023725 - RNA, 17 nt, Shigella flexneri 2a str. 301
acccuucauauuccuga

SEQ ID NO: 2023726 - RNA, 22 nt, Shigella flexneri 2a str. 301
acccuucaaucccgccaaugca

SEQ ID NO: 2023727 - RNA, 14 nt, Shigella flexneri 2a str. 301
acccucaacaacag

SEQ ID NO: 2023728 - RNA, 21 nt, Shigella flexneri 2a str. 301
acccucacgcauucucuuuuc

SEQ ID NO: 2023729 - RNA, 15 nt, Shigella flexneri 2a str. 301
acccugaguuuucag

SEQ ID NO: 2023730 - RNA, 11 nt, Shigella flexneri 2a str. 301
acccugaguga

SEQ ID NO: 2023731 - RNA, 18 nt, Shigella flexneri 2a str. 301
acccugagugaauuguuu

SEQ ID NO: 2023732 - RNA, 14 nt, Shigella flexneri 2a str. 301
acccugacgaccac

SEQ ID NO: 2023733 - RNA, 21 nt, Shigella flexneri 2a str. 301
acccugaguuuucaguaccgc

SEQ ID NO: 2023734 - RNA, 16 nt, Shigella flexneri 2a str. 301
acccugaucaaucacu

SEQ ID NO: 2023735 - RNA, 23 nt, Shigella flexneri 2a str. 301
acccugcguugucgcagugaagu

SEQ ID NO: 2023736 - RNA, 14 nt, Shigella flexneri 2a str. 301
acccugcggcugcu

SEQ ID NO: 2023737 - RNA, 16 nt, Shigella flexneri 2a str. 301
accgaacagaucacgu

SEQ ID NO: 2023738 - RNA, 15 nt, Shigella flexneri 2a str. 301
accgaacaaaacagc

SEQ ID NO: 2023739 - RNA, 12 nt, Shigella flexneri 2a str. 301
accgaacaacaa

SEQ ID NO: 2023740 - RNA, 16 nt, Shigella flexneri 2a str. 301
accgaaccuguuuuca

SEQ ID NO: 2023741 - RNA, 14 nt, Shigella flexneri 2a str. 301
accgaaccaaaaua

SEQ ID NO: 2023742 - RNA, 13 nt, Shigella flexneri 2a str. 301
accgaaaucgcca

SEQ ID NO: 2023743 - RNA, 13 nt, Shigella flexneri 2a str. 301
acccuuuuuuaaa

SEQ ID NO: 2023744 - RNA, 15 nt, Shigella flexneri 2a str. 301
accgaacggagucgg

SEQ ID NO: 2023745 - RNA, 23 nt, Shigella flexneri 2a str. 301
accgaaguggacgaacaguucaa

SEQ ID NO: 2023746 - RNA, 12 nt, Shigella flexneri 2a str. 301
accgaaguugua

SEQ ID NO: 2023747 - RNA, 17 nt, Shigella flexneri 2a str. 301
accgacaauauugaugc

SEQ ID NO: 2023748 - RNA, 15 nt, Shigella flexneri 2a str. 301
accgacaaauuucau

SEQ ID NO: 2023749 - RNA, 17 nt, Shigella flexneri 2a str. 301
accgauaaaagcccugg

SEQ ID NO: 2023750 - RNA, 14 nt, Shigella flexneri 2a str. 301
accgauaaaagccc

SEQ ID NO: 2023751 - RNA, 15 nt, Shigella flexneri 2a str. 301
accgaccaucggcac

SEQ ID NO: 2023752 - RNA, 18 nt, Shigella flexneri 2a str. 301
accgacauggugcgauua

SEQ ID NO: 2023753 - RNA, 17 nt, Shigella flexneri 2a str. 301
accgacguagccccaau

SEQ ID NO: 2023754 - RNA, 19 nt, Shigella flexneri 2a str. 301
accgacugcggccugaguu

SEQ ID NO: 2023755 - RNA, 14 nt, Shigella flexneri 2a str. 301
accgacgauuaaac

SEQ ID NO: 2023756 - RNA, 19 nt, Shigella flexneri 2a str. 301
agcuccguccagccaccgc

SEQ ID NO: 2023757 - RNA, 23 nt, Shigella flexneri 2a str. 301
agcuccucgaguccuuccagguc

SEQ ID NO: 2023758 - RNA, 17 nt, Shigella flexneri 2a str. 301
agcuccucuuucaucuc

SEQ ID NO: 2023759 - RNA, 15 nt, Shigella flexneri 2a str. 301
agcgucuggaagaag

SEQ ID NO: 2023760 - RNA, 18 nt, Shigella flexneri 2a str. 301
agcgucaaggucaacagu

SEQ ID NO: 2023761 - RNA, 16 nt, Shigella flexneri 2a str. 301
agcgucgcauccgaca

SEQ ID NO: 2023762 - RNA, 18 nt, Shigella flexneri 2a str. 301
agcucgcaagccacgccg

SEQ ID NO: 2023763 - RNA, 16 nt, Shigella flexneri 2a str. 301
agcucgacuccugacu

SEQ ID NO: 2023764 - RNA, 16 nt, Shigella flexneri 2a str. 301
agcucgacaccaaaca

SEQ ID NO: 2023765 - RNA, 14 nt, Shigella flexneri 2a str. 301
agcucggauaaggc

SEQ ID NO: 2023766 - RNA, 16 nt, Shigella flexneri 2a str. 301
agcucgcuucaucugc

SEQ ID NO: 2023767 - RNA, 18 nt, Shigella flexneri 2a str. 301
agcucugguguggagugc

SEQ ID NO: 2023768 - RNA, 18 nt, Shigella flexneri 2a str. 301
agcucuguauauaaaugu

SEQ ID NO: 2023769 - RNA, 19 nt, Shigella flexneri 2a str. 301
agcucuggcauaacgccac

SEQ ID NO: 2023770 - RNA, 19 nt, Shigella flexneri 2a str. 301
agcucgguauggccuuucu

SEQ ID NO: 2023771 - RNA, 20 nt, Shigella flexneri 2a str. 301
agcucguuguuuaugccgga

SEQ ID NO: 2023772 - RNA, 14 nt, Shigella flexneri 2a str. 301
agcucuucuucacu

SEQ ID NO: 2023773 - RNA, 23 nt, Shigella flexneri 2a str. 301
agcucuucuucacucucaccacg

SEQ ID NO: 2023774 - RNA, 13 nt, Shigella flexneri 2a str. 301
agcugaacaaagc

SEQ ID NO: 2023775 - RNA, 13 nt, Shigella flexneri 2a str. 301
agcugaauuucau

SEQ ID NO: 2023776 - RNA, 16 nt, Shigella flexneri 2a str. 301
agcugacgacgaagaa

SEQ ID NO: 2023777 - RNA, 18 nt, Shigella flexneri 2a str. 301
agcugacgacgaagaaac

SEQ ID NO: 2023778 - RNA, 16 nt, Shigella flexneri 2a str. 301
agcugacuuccagccg

SEQ ID NO: 2023779 - RNA, 16 nt, Shigella flexneri 2a str. 301
agcugagcacaaaaca

SEQ ID NO: 2023780 - RNA, 15 nt, Shigella flexneri 2a str. 301
agcuggguacgaaaa

SEQ ID NO: 2023781 - RNA, 14 nt, Shigella flexneri 2a str. 301
agcugggcgguggc

SEQ ID NO: 2023782 - RNA, 15 nt, Shigella flexneri 2a str. 301
agcuguucaggagaa

SEQ ID NO: 2023783 - RNA, 17 nt, Shigella flexneri 2a str. 301
agcuggcagaaguuguc

SEQ ID NO: 2023784 - RNA, 12 nt, Shigella flexneri 2a str. 301
agcuggcaaagu

SEQ ID NO: 2023785 - RNA, 23 nt, Shigella flexneri 2a str. 301
agcugcacacagggcgcuagcca

SEQ ID NO: 2023786 - RNA, 15 nt, Shigella flexneri 2a str. 301
agcugcaagaugaau

SEQ ID NO: 2023787 - RNA, 16 nt, Shigella flexneri 2a str. 301
agcugauucagauaau

SEQ ID NO: 2023788 - RNA, 19 nt, Shigella flexneri 2a str. 301
agcugauccuucuguucuu

SEQ ID NO: 2023789 - RNA, 17 nt, Shigella flexneri 2a str. 301
agcugcgcguuaucuac

SEQ ID NO: 2023790 - RNA, 22 nt, Shigella flexneri 2a str. 301
agcugcggauccugagcaaaca

SEQ ID NO: 2023791 - RNA, 14 nt, Shigella flexneri 2a str. 301
agcuuguuugaagu

SEQ ID NO: 2023792 - RNA, 13 nt, Shigella flexneri 2a str. 301
agcuuggcagagc

SEQ ID NO: 2023793 - RNA, 11 nt, Shigella flexneri 2a str. 301
agcuucuuccu

SEQ ID NO: 2023794 - RNA, 16 nt, Shigella flexneri 2a str. 301
agcuucuguuauucca

SEQ ID NO: 2023795 - RNA, 18 nt, Shigella flexneri 2a str. 301
agcuugcgauccugcaga

SEQ ID NO: 2023796 - RNA, 16 nt, Shigella flexneri 2a str. 301
agcuugcgucgccagu

SEQ ID NO: 2023797 - RNA, 17 nt, Shigella flexneri 2a str. 301
agcuugaaggguuuuau

SEQ ID NO: 2023798 - RNA, 22 nt, Shigella flexneri 2a str. 301
agcuucaaaucauuacaguuuc

SEQ ID NO: 2023799 - RNA, 15 nt, Shigella flexneri 2a str. 301
agcuucaccuuccag

SEQ ID NO: 2023800 - RNA, 19 nt, Shigella flexneri 2a str. 301
agcuucacgcgccagcuua

SEQ ID NO: 2023801 - RNA, 19 nt, Shigella flexneri 2a str. 301
agcuucuuauccagcugcg

SEQ ID NO: 2023802 - RNA, 12 nt, Shigella flexneri 2a str. 301
agcuucagauug

SEQ ID NO: 2023803 - RNA, 18 nt, Shigella flexneri 2a str. 301
agcuuauuaacagucagu

SEQ ID NO: 2023804 - RNA, 14 nt, Shigella flexneri 2a str. 301
agcuuaucuuuuuc

SEQ ID NO: 2023805 - RNA, 15 nt, Shigella flexneri 2a str. 301
agcuuauuucuguga

SEQ ID NO: 2023806 - RNA, 20 nt, Shigella flexneri 2a str. 301
aggacgaaaaaucaauaaac

SEQ ID NO: 2023807 - RNA, 16 nt, Shigella flexneri 2a str. 301
aggaaucgcuguugag

SEQ ID NO: 2023808 - RNA, 17 nt, Shigella flexneri 2a str. 301
aggaauaugguuagaga

SEQ ID NO: 2023809 - RNA, 21 nt, Shigella flexneri 2a str. 301
aggaaacucucaaaacaacac

SEQ ID NO: 2023810 - RNA, 18 nt, Shigella flexneri 2a str. 301
aggaaaauacagcaaugg

SEQ ID NO: 2023811 - RNA, 12 nt, Shigella flexneri 2a str. 301
aggaaaaucagc

SEQ ID NO: 2023812 - RNA, 15 nt, Shigella flexneri 2a str. 301
aggaaaauacagcaa

SEQ ID NO: 2023813 - RNA, 14 nt, Shigella flexneri 2a str. 301
aggaaaauaagcau

SEQ ID NO: 2023814 - RNA, 13 nt, Shigella flexneri 2a str. 301
aggaaaauacagc

SEQ ID NO: 2023815 - RNA, 23 nt, Shigella flexneri 2a str. 301
aggaaaacaauguucaucugcau

SEQ ID NO: 2023816 - RNA, 14 nt, Shigella flexneri 2a str. 301
aggaaaaccagaau

SEQ ID NO: 2023817 - RNA, 18 nt, Shigella flexneri 2a str. 301
aggaaaaccagaaucugg

SEQ ID NO: 2023818 - RNA, 11 nt, Shigella flexneri 2a str. 301
aggaaaaaaua

SEQ ID NO: 2023819 - RNA, 22 nt, Shigella flexneri 2a str. 301
aggaggucgcacugcucuuuuu

SEQ ID NO: 2023820 - RNA, 23 nt, Shigella flexneri 2a str. 301
aggagucauccucccuuacccuu

SEQ ID NO: 2023821 - RNA, 22 nt, Shigella flexneri 2a str. 301
aggacguucaccgucaccccug

SEQ ID NO: 2023822 - RNA, 16 nt, Shigella flexneri 2a str. 301
aggauaaacuccugca

SEQ ID NO: 2023823 - RNA, 19 nt, Shigella flexneri 2a str. 301
aggauaaacuccugcacgc

SEQ ID NO: 2023824 - RNA, 20 nt, Shigella flexneri 2a str. 301
aggaguuugaacauaucagc

SEQ ID NO: 2023825 - RNA, 15 nt, Shigella flexneri 2a str. 301
aggauacuuaucugg

SEQ ID NO: 2023826 - RNA, 21 nt, Shigella flexneri 2a str. 301
aggauaugcaucaugaaaacc

SEQ ID NO: 2023827 - RNA, 21 nt, Shigella flexneri 2a str. 301
aggauauguaagcagaaaagc

SEQ ID NO: 2023828 - RNA, 23 nt, Shigella flexneri 2a str. 301
aggauauguaagcagaaaagcca

SEQ ID NO: 2023829 - RNA, 16 nt, Shigella flexneri 2a str. 301
aggaucacaagaccua

SEQ ID NO: 2023830 - RNA, 21 nt, Shigella flexneri 2a str. 301
aggaugcacucgcauccucuu

SEQ ID NO: 2023831 - RNA, 17 nt, Shigella flexneri 2a str. 301
aggaucggugcugccag

SEQ ID NO: 2023832 - RNA, 16 nt, Shigella flexneri 2a str. 301
aggaucguuacgcccc

SEQ ID NO: 2023833 - RNA, 15 nt, Shigella flexneri 2a str. 301
aggccggagccagcc

SEQ ID NO: 2023834 - RNA, 14 nt, Shigella flexneri 2a str. 301
aggccggagcaugc

SEQ ID NO: 2023835 - RNA, 22 nt, Shigella flexneri 2a str. 301
aggccgccgucaucacgcaggc

SEQ ID NO: 2023836 - RNA, 16 nt, Shigella flexneri 2a str. 301
aggccaucacauccug

SEQ ID NO: 2023837 - RNA, 13 nt, Shigella flexneri 2a str. 301
aggccaucagcag

SEQ ID NO: 2023838 - RNA, 16 nt, Shigella flexneri 2a str. 301
aggcccgcgugccgga

SEQ ID NO: 2023839 - RNA, 12 nt, Shigella flexneri 2a str. 301
aggccagccaga

SEQ ID NO: 2023840 - RNA, 19 nt, Shigella flexneri 2a str. 301
aggcaguuuauccagccac

SEQ ID NO: 2023841 - RNA, 20 nt, Shigella flexneri 2a str. 301
aggcaucacuuuaccgguuu

SEQ ID NO: 2023842 - RNA, 13 nt, Shigella flexneri 2a str. 301
aggcaucagcaau

SEQ ID NO: 2023843 - RNA, 14 nt, Shigella flexneri 2a str. 301
aggcaucagacaaa

SEQ ID NO: 2023844 - RNA, 14 nt, Shigella flexneri 2a str. 301
aggcaucagcaauu

SEQ ID NO: 2023845 - RNA, 17 nt, Shigella flexneri 2a str. 301
aggcaucccgcaccagc

SEQ ID NO: 2023846 - RNA, 16 nt, Shigella flexneri 2a str. 301
aggcagcuuagaaauc

SEQ ID NO: 2023847 - RNA, 19 nt, Shigella flexneri 2a str. 301
aggcaggcaucaaugaaag

SEQ ID NO: 2023848 - RNA, 16 nt, Shigella flexneri 2a str. 301
aggcaggcaucaucag

SEQ ID NO: 2023849 - RNA, 20 nt, Shigella flexneri 2a str. 301
aggcagggcuaucuggagau

SEQ ID NO: 2023850 - RNA, 18 nt, Shigella flexneri 2a str. 301
aggcaggucuuucaccug

SEQ ID NO: 2023851 - RNA, 15 nt, Shigella flexneri 2a str. 301
aggcagauacaacca

SEQ ID NO: 2023852 - RNA, 19 nt, Shigella flexneri 2a str. 301
aggcagcaaucacugccag

SEQ ID NO: 2023853 - RNA, 14 nt, Shigella flexneri 2a str. 301
aggcacaaggguga

SEQ ID NO: 2023854 - RNA, 21 nt, Shigella flexneri 2a str. 301
aggcacaagggugagggagga

SEQ ID NO: 2023855 - RNA, 14 nt, Shigella flexneri 2a str. 301
aggcacaacugcga

SEQ ID NO: 2023856 - RNA, 17 nt, Shigella flexneri 2a str. 301
aggcaauauuuaaauau

SEQ ID NO: 2023857 - RNA, 15 nt, Shigella flexneri 2a str. 301
aggcacaaaaccugc

SEQ ID NO: 2023858 - RNA, 23 nt, Shigella flexneri 2a str. 301
aggcaaacugucuaauggugaac

SEQ ID NO: 2023859 - RNA, 19 nt, Shigella flexneri 2a str. 301
aggcaaagaguugccccuc

SEQ ID NO: 2023860 - RNA, 12 nt, Shigella flexneri 2a str. 301
aggcaaaccagu

SEQ ID NO: 2023861 - RNA, 15 nt, Shigella flexneri 2a str. 301
aggcaaacgaaaucu

SEQ ID NO: 2023862 - RNA, 20 nt, Shigella flexneri 2a str. 301
aggauuaauaaauuuuauau

SEQ ID NO: 2023863 - RNA, 17 nt, Shigella flexneri 2a str. 301
aggcaaaaugccagccc

SEQ ID NO: 2023864 - RNA, 15 nt, Shigella flexneri 2a str. 301
aggcaauaaugacgc

SEQ ID NO: 2023865 - RNA, 16 nt, Shigella flexneri 2a str. 301
aggauguuccggcaaa

SEQ ID NO: 2023866 - RNA, 18 nt, Shigella flexneri 2a str. 301
aggauguuccggcaaagu

SEQ ID NO: 2023867 - RNA, 14 nt, Shigella flexneri 2a str. 301
aggauggccgggca

SEQ ID NO: 2023868 - RNA, 23 nt, Shigella flexneri 2a str. 301
aggcuggcguguucugaauaaac

SEQ ID NO: 2023869 - RNA, 15 nt, Shigella flexneri 2a str. 301
aggcuggaucagacg

SEQ ID NO: 2023870 - RNA, 17 nt, Shigella flexneri 2a str. 301
aggcugccggggagaua

SEQ ID NO: 2023871 - RNA, 20 nt, Shigella flexneri 2a str. 301
aggcugcgaacgguuuucac

SEQ ID NO: 2023872 - RNA, 16 nt, Shigella flexneri 2a str. 301
aggcugcgaguccugu

SEQ ID NO: 2023873 - RNA, 13 nt, Shigella flexneri 2a str. 301
aggcugaugacaa

SEQ ID NO: 2023874 - RNA, 24 nt, Shigella flexneri 2a str. 301
aggcuauuuugcguuuagcaucag

SEQ ID NO: 2023875 - RNA, 23 nt, Shigella flexneri 2a str. 301
aggcuauuccacgcaucaagcau

SEQ ID NO: 2023876 - RNA, 19 nt, Shigella flexneri 2a str. 301
aggcugaaaaucuucucuc

SEQ ID NO: 2023877 - RNA, 20 nt, Shigella flexneri 2a str. 301
aggcugaccccaaccgcccu

SEQ ID NO: 2023878 - RNA, 16 nt, Shigella flexneri 2a str. 301
aggcucucauuuuuca

SEQ ID NO: 2023879 - RNA, 15 nt, Shigella flexneri 2a str. 301
aggcggcucaccugc

SEQ ID NO: 2023880 - RNA, 19 nt, Shigella flexneri 2a str. 301
aggcggcggcaaucagccg

SEQ ID NO: 2023881 - RNA, 22 nt, Shigella flexneri 2a str. 301
aggcggguacguuucgccugca

SEQ ID NO: 2023882 - RNA, 15 nt, Shigella flexneri 2a str. 301
aggcgguaaccgcca

SEQ ID NO: 2023883 - RNA, 22 nt, Shigella flexneri 2a str. 301
aggcuaauaccgucgaugccaa

SEQ ID NO: 2023884 - RNA, 19 nt, Shigella flexneri 2a str. 301
aggcuaaauaaccagcaua

SEQ ID NO: 2023885 - RNA, 23 nt, Shigella flexneri 2a str. 301
aggcguuuacgccgcauccggca

SEQ ID NO: 2023886 - RNA, 23 nt, Shigella flexneri 2a str. 301
aggcguucacgccgcauccgaca

SEQ ID NO: 2023887 - RNA, 23 nt, Shigella flexneri 2a str. 301
aggcguucacgccgcauccggca

SEQ ID NO: 2023888 - RNA, 17 nt, Shigella flexneri 2a str. 301
aggcguuaacagcgcau

SEQ ID NO: 2023889 - RNA, 16 nt, Shigella flexneri 2a str. 301
agggcuuucacugccc

SEQ ID NO: 2023890 - RNA, 20 nt, Shigella flexneri 2a str. 301
agggcuuuuucaauuccauu

SEQ ID NO: 2023891 - RNA, 18 nt, Shigella flexneri 2a str. 301
agggcuuuuuuauuucau

SEQ ID NO: 2023892 - RNA, 14 nt, Shigella flexneri 2a str. 301
aggggaacagacca

SEQ ID NO: 2023893 - RNA, 19 nt, Shigella flexneri 2a str. 301
aggggacguuauggugccu

SEQ ID NO: 2023894 - RNA, 15 nt, Shigella flexneri 2a str. 301
agggggauuuucacu

SEQ ID NO: 2023895 - RNA, 15 nt, Shigella flexneri 2a str. 301
aggggugaaaaaaac

SEQ ID NO: 2023896 - RNA, 18 nt, Shigella flexneri 2a str. 301
aggguuauauaaaaccgc

SEQ ID NO: 2023897 - RNA, 20 nt, Shigella flexneri 2a str. 301
aggguggcucaaucgccacc

SEQ ID NO: 2023898 - RNA, 20 nt, Shigella flexneri 2a str. 301
agggucuuuuaaauccugca

SEQ ID NO: 2023899 - RNA, 16 nt, Shigella flexneri 2a str. 301
aggcuuauccggcaug

SEQ ID NO: 2023900 - RNA, 18 nt, Shigella flexneri 2a str. 301
aggcuuagcgcaacaaac

SEQ ID NO: 2023901 - RNA, 14 nt, Shigella flexneri 2a str. 301
agggauauuucacc

SEQ ID NO: 2023902 - RNA, 13 nt, Shigella flexneri 2a str. 301
agggaucacgcgg

SEQ ID NO: 2023903 - RNA, 22 nt, Shigella flexneri 2a str. 301
agggaucauccacccgcagcaa

SEQ ID NO: 2023904 - RNA, 17 nt, Shigella flexneri 2a str. 301
agggcgaauucuugccu

SEQ ID NO: 2023905 - RNA, 13 nt, Shigella flexneri 2a str. 301
agggcaucaagaa

SEQ ID NO: 2023906 - RNA, 18 nt, Shigella flexneri 2a str. 301
agguucggaguggcagcc

SEQ ID NO: 2023907 - RNA, 22 nt, Shigella flexneri 2a str. 301
agguucggaguggcagccccag

SEQ ID NO: 2023908 - RNA, 20 nt, Shigella flexneri 2a str. 301
agguucucucagucuuuccc

SEQ ID NO: 2023909 - RNA, 12 nt, Shigella flexneri 2a str. 301
agguucuuugcu

SEQ ID NO: 2023910 - RNA, 16 nt, Shigella flexneri 2a str. 301
agguucuuugcugccg

SEQ ID NO: 2023911 - RNA, 16 nt, Shigella flexneri 2a str. 301
agguuuuaguuucgcc

SEQ ID NO: 2023912 - RNA, 12 nt, Shigella flexneri 2a str. 301
aguaaaaaaaca

SEQ ID NO: 2023913 - RNA, 12 nt, Shigella flexneri 2a str. 301
agguuuuuuccu

SEQ ID NO: 2023914 - RNA, 14 nt, Shigella flexneri 2a str. 301
aguaaaaaagaagg

SEQ ID NO: 2023915 - RNA, 12 nt, Shigella flexneri 2a str. 301
aguaaaguuacc

SEQ ID NO: 2023916 - RNA, 23 nt, Shigella flexneri 2a str. 301
aguaagcggcguugcucuucucc

SEQ ID NO: 2023917 - RNA, 15 nt, Shigella flexneri 2a str. 301
aguaacucauugcca

SEQ ID NO: 2023918 - RNA, 17 nt, Shigella flexneri 2a str. 301
aguaagcacucugacgg

SEQ ID NO: 2023919 - RNA, 10 nt, Shigella flexneri 2a str. 301
aguaaauggu

SEQ ID NO: 2023920 - RNA, 20 nt, Shigella flexneri 2a str. 301
aguaaaucguccguuugcgu

SEQ ID NO: 2023921 - RNA, 22 nt, Shigella flexneri 2a str. 301
aguaaccuucgcggcacuggua

SEQ ID NO: 2023922 - RNA, 15 nt, Shigella flexneri 2a str. 301
aguaaccuuucagau

SEQ ID NO: 2023923 - RNA, 14 nt, Shigella flexneri 2a str. 301
aguaaauauugucu

SEQ ID NO: 2023924 - RNA, 13 nt, Shigella flexneri 2a str. 301
aguaaauccauaa

SEQ ID NO: 2023925 - RNA, 15 nt, Shigella flexneri 2a str. 301
aguaaugcgcccaug

SEQ ID NO: 2023926 - RNA, 18 nt, Shigella flexneri 2a str. 301
aguaaugauuuaaaacca

SEQ ID NO: 2023927 - RNA, 20 nt, Shigella flexneri 2a str. 301
aguacagcgcauaaaagcua

SEQ ID NO: 2023928 - RNA, 20 nt, Shigella flexneri 2a str. 301
aguacagccgagaauaauuu

SEQ ID NO: 2023929 - RNA, 17 nt, Shigella flexneri 2a str. 301
aguacagccgccagaca

SEQ ID NO: 2023930 - RNA, 13 nt, Shigella flexneri 2a str. 301
aguacauuaaaau

SEQ ID NO: 2023931 - RNA, 19 nt, Shigella flexneri 2a str. 301
aguacauuaaaauuggcuu

SEQ ID NO: 2023932 - RNA, 22 nt, Shigella flexneri 2a str. 301
aguacaacgccaugcagguuac

SEQ ID NO: 2023933 - RNA, 23 nt, Shigella flexneri 2a str. 301
aguaauuaucuuuacugauaauu

SEQ ID NO: 2023934 - RNA, 15 nt, Shigella flexneri 2a str. 301
aguacgcuuucccuu

SEQ ID NO: 2023935 - RNA, 21 nt, Shigella flexneri 2a str. 301
aguacguuucgauuucugacu

SEQ ID NO: 2023936 - RNA, 14 nt, Shigella flexneri 2a str. 301
aguacgaaauaacu

SEQ ID NO: 2023937 - RNA, 15 nt, Shigella flexneri 2a str. 301
aguaccugcaaaccg

SEQ ID NO: 2023938 - RNA, 18 nt, Shigella flexneri 2a str. 301
aguaccucuucgcuggca

SEQ ID NO: 2023939 - RNA, 20 nt, Shigella flexneri 2a str. 301
aguaccuccuucacaguggc

SEQ ID NO: 2023940 - RNA, 19 nt, Shigella flexneri 2a str. 301
aguaccgccaccaccagac

SEQ ID NO: 2023941 - RNA, 23 nt, Shigella flexneri 2a str. 301
aguaccgccgccauaaacagcag

SEQ ID NO: 2023942 - RNA, 19 nt, Shigella flexneri 2a str. 301
aguaccgaacggagucggg

SEQ ID NO: 2023943 - RNA, 15 nt, Shigella flexneri 2a str. 301
aggugucacaugcag

SEQ ID NO: 2023944 - RNA, 20 nt, Shigella flexneri 2a str. 301
agguggcggaauugguagac

SEQ ID NO: 2023945 - RNA, 20 nt, Shigella flexneri 2a str. 301
aggugagggcuuaaaugaca

SEQ ID NO: 2023946 - RNA, 18 nt, Shigella flexneri 2a str. 301
aggugacgcgggcagcag

SEQ ID NO: 2023947 - RNA, 18 nt, Shigella flexneri 2a str. 301
aggugcaucggggaauug

SEQ ID NO: 2023948 - RNA, 18 nt, Shigella flexneri 2a str. 301
aggugagucgcaaaacuc

SEQ ID NO: 2023949 - RNA, 16 nt, Shigella flexneri 2a str. 301
aggugccuuaccacuc

SEQ ID NO: 2023950 - RNA, 21 nt, Shigella flexneri 2a str. 301
aggugucacaugcagcgccug

SEQ ID NO: 2023951 - RNA, 21 nt, Shigella flexneri 2a str. 301
aggugugaaaccuuuaugcag

SEQ ID NO: 2023952 - RNA, 19 nt, Shigella flexneri 2a str. 301
aggugugggcaaucacuuu

SEQ ID NO: 2023953 - RNA, 13 nt, Shigella flexneri 2a str. 301
agguguugcguuu

SEQ ID NO: 2023954 - RNA, 18 nt, Shigella flexneri 2a str. 301
agguuaauaaauauuaau

SEQ ID NO: 2023955 - RNA, 23 nt, Shigella flexneri 2a str. 301
agguuaauaaauauuaauacaac

SEQ ID NO: 2023956 - RNA, 22 nt, Shigella flexneri 2a str. 301
agguuaaugcuguuccagacca

SEQ ID NO: 2023957 - RNA, 13 nt, Shigella flexneri 2a str. 301
agguuaauauuuu

SEQ ID NO: 2023958 - RNA, 17 nt, Shigella flexneri 2a str. 301
agguuagaauaaacaaa

SEQ ID NO: 2023959 - RNA, 16 nt, Shigella flexneri 2a str. 301
aggucagagagccagc

SEQ ID NO: 2023960 - RNA, 17 nt, Shigella flexneri 2a str. 301
aggucagagagccagcc

SEQ ID NO: 2023961 - RNA, 20 nt, Shigella flexneri 2a str. 301
aggucagagagccagcccca

SEQ ID NO: 2023962 - RNA, 13 nt, Shigella flexneri 2a str. 301
aggucagagagcc

SEQ ID NO: 2023963 - RNA, 23 nt, Shigella flexneri 2a str. 301
aggucaggccguaaucacuguca

SEQ ID NO: 2023964 - RNA, 17 nt, Shigella flexneri 2a str. 301
aggucacccaacaugcc

SEQ ID NO: 2023965 - RNA, 18 nt, Shigella flexneri 2a str. 301
aggucacccaacaugccg

SEQ ID NO: 2023966 - RNA, 15 nt, Shigella flexneri 2a str. 301
aggucaaagaaucaa

SEQ ID NO: 2023967 - RNA, 17 nt, Shigella flexneri 2a str. 301
agguaacaauaaacacc

SEQ ID NO: 2023968 - RNA, 12 nt, Shigella flexneri 2a str. 301
agguaacaggga

SEQ ID NO: 2023969 - RNA, 22 nt, Shigella flexneri 2a str. 301
agguccuccuguaccuucacgc

SEQ ID NO: 2023970 - RNA, 20 nt, Shigella flexneri 2a str. 301
agguccuccuguaccuucac

SEQ ID NO: 2023971 - RNA, 18 nt, Shigella flexneri 2a str. 301
aggucagguuugacauaa

SEQ ID NO: 2023972 - RNA, 17 nt, Shigella flexneri 2a str. 301
aggucagucaguggcag

SEQ ID NO: 2023973 - RNA, 19 nt, Shigella flexneri 2a str. 301
agguccuucaggcccugcu

SEQ ID NO: 2023974 - RNA, 18 nt, Shigella flexneri 2a str. 301
agguccuguaaugagaau

SEQ ID NO: 2023975 - RNA, 15 nt, Shigella flexneri 2a str. 301
aggucgaucagcuga

SEQ ID NO: 2023976 - RNA, 19 nt, Shigella flexneri 2a str. 301
aggucgaucagcugacaac

SEQ ID NO: 2023977 - RNA, 21 nt, Shigella flexneri 2a str. 301
aggugacacuucauuaaccac

SEQ ID NO: 2023978 - RNA, 17 nt, Shigella flexneri 2a str. 301
aggugacacuucauuaa

SEQ ID NO: 2023979 - RNA, 15 nt, Shigella flexneri 2a str. 301
aggugaccagcagac

SEQ ID NO: 2023980 - RNA, 15 nt, Shigella flexneri 2a str. 301
aggugaaaaauaaaa

SEQ ID NO: 2023981 - RNA, 22 nt, Shigella flexneri 2a str. 301
agucagaugccucguuggucag

SEQ ID NO: 2023982 - RNA, 23 nt, Shigella flexneri 2a str. 301
agucagaaacuguaauugagaac

SEQ ID NO: 2023983 - RNA, 14 nt, Shigella flexneri 2a str. 301
agucacuuuuuucc

SEQ ID NO: 2023984 - RNA, 15 nt, Shigella flexneri 2a str. 301
agucacuuuuuuccg

SEQ ID NO: 2023985 - RNA, 20 nt, Shigella flexneri 2a str. 301
agucacggaaucccguaauc

SEQ ID NO: 2023986 - RNA, 17 nt, Shigella flexneri 2a str. 301
agucaccgcccagugca

SEQ ID NO: 2023987 - RNA, 16 nt, Shigella flexneri 2a str. 301
agucaccugcggugca

SEQ ID NO: 2023988 - RNA, 19 nt, Shigella flexneri 2a str. 301
agucaauuucugcaaaaua

SEQ ID NO: 2023989 - RNA, 18 nt, Shigella flexneri 2a str. 301
agucacaaacaucaugcc

SEQ ID NO: 2023990 - RNA, 14 nt, Shigella flexneri 2a str. 301
agucacaaaucucc

SEQ ID NO: 2023991 - RNA, 14 nt, Shigella flexneri 2a str. 301
agucaauuucugca

SEQ ID NO: 2023992 - RNA, 15 nt, Shigella flexneri 2a str. 301
agucaauuucugcaa

SEQ ID NO: 2023993 - RNA, 15 nt, Shigella flexneri 2a str. 301
agucaaucauccaua

SEQ ID NO: 2023994 - RNA, 15 nt, Shigella flexneri 2a str. 301
agucaauuaaaaaau

SEQ ID NO: 2023995 - RNA, 17 nt, Shigella flexneri 2a str. 301
agucaacgucauuaucu

SEQ ID NO: 2023996 - RNA, 13 nt, Shigella flexneri 2a str. 301
aguagagauaaac

SEQ ID NO: 2023997 - RNA, 14 nt, Shigella flexneri 2a str. 301
aguacuucacaauc

SEQ ID NO: 2023998 - RNA, 14 nt, Shigella flexneri 2a str. 301
aguacugaugaaua

SEQ ID NO: 2023999 - RNA, 18 nt, Shigella flexneri 2a str. 301
aguacugaugaauaaaua

SEQ ID NO: 2024000 - RNA, 15 nt, Shigella flexneri 2a str. 301
aguagaaacgaggua

SEQ ID NO: 2024001 - RNA, 18 nt, Shigella flexneri 2a str. 301
aguccauacccagcauca

SEQ ID NO: 2024002 - RNA, 15 nt, Shigella flexneri 2a str. 301
agucccaaacagcag

SEQ ID NO: 2024003 - RNA, 16 nt, Shigella flexneri 2a str. 301
agucccaggcagaagc

SEQ ID NO: 2024004 - RNA, 21 nt, Shigella flexneri 2a str. 301
aguccacguucaaaacgguga

SEQ ID NO: 2024005 - RNA, 22 nt, Shigella flexneri 2a str. 301
aguccagacuccgagaaucaua

SEQ ID NO: 2024006 - RNA, 21 nt, Shigella flexneri 2a str. 301
aguccagcugccguccccauc

SEQ ID NO: 2024007 - RNA, 24 nt, Shigella flexneri 2a str. 301
aguccagccccgcgcggcgcaggc

SEQ ID NO: 2024008 - RNA, 14 nt, Shigella flexneri 2a str. 301
aguccagcgccuga

SEQ ID NO: 2024009 - RNA, 16 nt, Shigella flexneri 2a str. 301
agucauuacccgugcu

SEQ ID NO: 2024010 - RNA, 20 nt, Shigella flexneri 2a str. 301
agucauuaccugaaaaaaca

SEQ ID NO: 2024011 - RNA, 13 nt, Shigella flexneri 2a str. 301
agucauuccuuca

SEQ ID NO: 2024012 - RNA, 22 nt, Shigella flexneri 2a str. 301
agucauugauucgaucaaacaa

SEQ ID NO: 2024013 - RNA, 15 nt, Shigella flexneri 2a str. 301
aguccaaaagguccu

SEQ ID NO: 2024014 - RNA, 16 nt, Shigella flexneri 2a str. 301
aguccaaaagguccuu

SEQ ID NO: 2024015 - RNA, 16 nt, Shigella flexneri 2a str. 301
agucauauuucuguuu

SEQ ID NO: 2024016 - RNA, 17 nt, Shigella flexneri 2a str. 301
agucaucacuuucagac

SEQ ID NO: 2024017 - RNA, 14 nt, Shigella flexneri 2a str. 301
agucaucaguugca

SEQ ID NO: 2024018 - RNA, 20 nt, Shigella flexneri 2a str. 301
agucaucaguugcaccugau

SEQ ID NO: 2024019 - RNA, 12 nt, Shigella flexneri 2a str. 301
agucaucaucag

SEQ ID NO: 2024020 - RNA, 14 nt, Shigella flexneri 2a str. 301
agucaugaaauaua

SEQ ID NO: 2024021 - RNA, 16 nt, Shigella flexneri 2a str. 301
agucaugcgagaagca

SEQ ID NO: 2024022 - RNA, 19 nt, Shigella flexneri 2a str. 301
agucaucgcuuucggaaag

SEQ ID NO: 2024023 - RNA, 14 nt, Shigella flexneri 2a str. 301
agucaguuaagcaa

SEQ ID NO: 2024024 - RNA, 24 nt, Shigella flexneri 2a str. 301
agucuugcuggaugccagcgaaga

SEQ ID NO: 2024025 - RNA, 19 nt, Shigella flexneri 2a str. 301
agugaaaauucuccggcgu

SEQ ID NO: 2024026 - RNA, 11 nt, Shigella flexneri 2a str. 301
agucuuccugc

SEQ ID NO: 2024027 - RNA, 14 nt, Shigella flexneri 2a str. 301
agucuucaucaucc

SEQ ID NO: 2024028 - RNA, 21 nt, Shigella flexneri 2a str. 301
agucugugcugaaccguaggc

SEQ ID NO: 2024029 - RNA, 18 nt, Shigella flexneri 2a str. 301
agugacccgcagccagca

SEQ ID NO: 2024030 - RNA, 20 nt, Shigella flexneri 2a str. 301
agugacccgcagccagcacu

SEQ ID NO: 2024031 - RNA, 21 nt, Shigella flexneri 2a str. 301
agugaccaucuuccagcauca

SEQ ID NO: 2024032 - RNA, 15 nt, Shigella flexneri 2a str. 301
agugaccuuaaucag

SEQ ID NO: 2024033 - RNA, 22 nt, Shigella flexneri 2a str. 301
agugaccgaaccuguuuucacc

SEQ ID NO: 2024034 - RNA, 13 nt, Shigella flexneri 2a str. 301
agugacgcggcga

SEQ ID NO: 2024035 - RNA, 19 nt, Shigella flexneri 2a str. 301
agugacucuuuauuucauu

SEQ ID NO: 2024036 - RNA, 21 nt, Shigella flexneri 2a str. 301
agugacaguguuauucccaac

SEQ ID NO: 2024037 - RNA, 22 nt, Shigella flexneri 2a str. 301
agugaauuguuuuauaaagaac

SEQ ID NO: 2024038 - RNA, 14 nt, Shigella flexneri 2a str. 301
agugaaauuaaacu

SEQ ID NO: 2024039 - RNA, 13 nt, Shigella flexneri 2a str. 301
agucucaagggag

SEQ ID NO: 2024040 - RNA, 12 nt, Shigella flexneri 2a str. 301
agucgccugcuu

SEQ ID NO: 2024041 - RNA, 19 nt, Shigella flexneri 2a str. 301
agucccgcgauggcccggc

SEQ ID NO: 2024042 - RNA, 21 nt, Shigella flexneri 2a str. 301
agucccgcgacaaucgccccc

SEQ ID NO: 2024043 - RNA, 15 nt, Shigella flexneri 2a str. 301
aguccccacaucacu

SEQ ID NO: 2024044 - RNA, 22 nt, Shigella flexneri 2a str. 301
agucccuugauaaacgccgcca

SEQ ID NO: 2024045 - RNA, 16 nt, Shigella flexneri 2a str. 301
agucgcacacaacaga

SEQ ID NO: 2024046 - RNA, 18 nt, Shigella flexneri 2a str. 301
aguccuguugucuuucca

SEQ ID NO: 2024047 - RNA, 21 nt, Shigella flexneri 2a str. 301
aguccuguugucuuuccagac

SEQ ID NO: 2024048 - RNA, 15 nt, Shigella flexneri 2a str. 301
aguccuguugucuuu

SEQ ID NO: 2024049 - RNA, 23 nt, Shigella flexneri 2a str. 301
agugaguguggcguggcgcucca

SEQ ID NO: 2024050 - RNA, 16 nt, Shigella flexneri 2a str. 301
agugagugaaauuuug

SEQ ID NO: 2024051 - RNA, 22 nt, Shigella flexneri 2a str. 301
agugagcuuuguucaugccgga

SEQ ID NO: 2024052 - RNA, 21 nt, Shigella flexneri 2a str. 301
agugagcacugaauaugaguc

SEQ ID NO: 2024053 - RNA, 17 nt, Shigella flexneri 2a str. 301
agugagcgauucaaauu

SEQ ID NO: 2024054 - RNA, 13 nt, Shigella flexneri 2a str. 301
agugacugggugc

SEQ ID NO: 2024055 - RNA, 15 nt, Shigella flexneri 2a str. 301
agugagaauuuuuca

SEQ ID NO: 2024056 - RNA, 15 nt, Shigella flexneri 2a str. 301
agugcgugcgcugcu

SEQ ID NO: 2024057 - RNA, 13 nt, Shigella flexneri 2a str. 301
agugcguacccag

SEQ ID NO: 2024058 - RNA, 16 nt, Shigella flexneri 2a str. 301
agugcguaagcgcgga

SEQ ID NO: 2024059 - RNA, 15 nt, Shigella flexneri 2a str. 301
agugcguaucaauag

SEQ ID NO: 2024060 - RNA, 23 nt, Shigella flexneri 2a str. 301
agugcguaucaauagcaguaauu

SEQ ID NO: 2024061 - RNA, 20 nt, Shigella flexneri 2a str. 301
agugcgucaucggcggcaga

SEQ ID NO: 2024062 - RNA, 19 nt, Shigella flexneri 2a str. 301
aguggaagacguugauuca

SEQ ID NO: 2024063 - RNA, 19 nt, Shigella flexneri 2a str. 301
agugcuuucugaacugaac

SEQ ID NO: 2024064 - RNA, 18 nt, Shigella flexneri 2a str. 301
aguggaaaaauaacaaau

SEQ ID NO: 2024065 - RNA, 19 nt, Shigella flexneri 2a str. 301
aguggaguccagcgccuga

SEQ ID NO: 2024066 - RNA, 21 nt, Shigella flexneri 2a str. 301
aguggacucuauggcuggcaa

SEQ ID NO: 2024067 - RNA, 20 nt, Shigella flexneri 2a str. 301
aguguaaaacagcacuccug

SEQ ID NO: 2024068 - RNA, 13 nt, Shigella flexneri 2a str. 301
aguguaaaauucu

SEQ ID NO: 2024069 - RNA, 12 nt, Shigella flexneri 2a str. 301
aguguaaaacag

SEQ ID NO: 2024070 - RNA, 19 nt, Shigella flexneri 2a str. 301
aguguagcgcaucaggcuu

SEQ ID NO: 2024071 - RNA, 19 nt, Shigella flexneri 2a str. 301
agugugggaaaaauuguuu

SEQ ID NO: 2024072 - RNA, 21 nt, Shigella flexneri 2a str. 301
aguguggggaaugauauuuuc

SEQ ID NO: 2024073 - RNA, 16 nt, Shigella flexneri 2a str. 301
aguguggccagagugc

SEQ ID NO: 2024074 - RNA, 13 nt, Shigella flexneri 2a str. 301
aguguggccagag

SEQ ID NO: 2024075 - RNA, 21 nt, Shigella flexneri 2a str. 301
aguguucuggcgacagcgaaa

SEQ ID NO: 2024076 - RNA, 22 nt, Shigella flexneri 2a str. 301
aguguucauaaagagguggggg

SEQ ID NO: 2024077 - RNA, 20 nt, Shigella flexneri 2a str. 301
aguuaaaauucaagacauca

SEQ ID NO: 2024078 - RNA, 17 nt, Shigella flexneri 2a str. 301
aguguuuuauguucaga

SEQ ID NO: 2024079 - RNA, 20 nt, Shigella flexneri 2a str. 301
aguguuuuauguucagauaa

SEQ ID NO: 2024080 - RNA, 21 nt, Shigella flexneri 2a str. 301
aguguuuuauguucagauaau

SEQ ID NO: 2024081 - RNA, 19 nt, Shigella flexneri 2a str. 301
aguguuucgacaauaauca

SEQ ID NO: 2024082 - RNA, 17 nt, Shigella flexneri 2a str. 301
aguguuggauggcggcu

SEQ ID NO: 2024083 - RNA, 19 nt, Shigella flexneri 2a str. 301
aguuaaacuuucauaaaca

SEQ ID NO: 2024084 - RNA, 22 nt, Shigella flexneri 2a str. 301
aguuaaccaaaaauuuccacaa

SEQ ID NO: 2024085 - RNA, 20 nt, Shigella flexneri 2a str. 301
aguuaaccaaaaauuuccac

SEQ ID NO: 2024086 - RNA, 19 nt, Shigella flexneri 2a str. 301
aguugcuucaucucaguga

SEQ ID NO: 2024087 - RNA, 17 nt, Shigella flexneri 2a str. 301
aguugcugacucgaacg

SEQ ID NO: 2024088 - RNA, 14 nt, Shigella flexneri 2a str. 301
aguugcucucaaag

SEQ ID NO: 2024089 - RNA, 18 nt, Shigella flexneri 2a str. 301
aguugcucugcagcagcc

SEQ ID NO: 2024090 - RNA, 14 nt, Shigella flexneri 2a str. 301
aguugcuccagcaa

SEQ ID NO: 2024091 - RNA, 15 nt, Shigella flexneri 2a str. 301
aguuggcagaauuug

SEQ ID NO: 2024092 - RNA, 21 nt, Shigella flexneri 2a str. 301
aguugagcaguccccacauca

SEQ ID NO: 2024093 - RNA, 14 nt, Shigella flexneri 2a str. 301
aguugaaaaacaug

SEQ ID NO: 2024094 - RNA, 20 nt, Shigella flexneri 2a str. 301
aguucuuucucugcaaauau

SEQ ID NO: 2024095 - RNA, 23 nt, Shigella flexneri 2a str. 301
aguucuuuuauuguuaaguuuau

SEQ ID NO: 2024096 - RNA, 14 nt, Shigella flexneri 2a str. 301
aguucgagaaaaau

SEQ ID NO: 2024097 - RNA, 13 nt, Shigella flexneri 2a str. 301
aguucgauuuccc

SEQ ID NO: 2024098 - RNA, 15 nt, Shigella flexneri 2a str. 301
aguucgccaucaaau

SEQ ID NO: 2024099 - RNA, 16 nt, Shigella flexneri 2a str. 301
aguucgcgaaaguuac

SEQ ID NO: 2024100 - RNA, 12 nt, Shigella flexneri 2a str. 301
aguucaagugcu

SEQ ID NO: 2024101 - RNA, 21 nt, Shigella flexneri 2a str. 301
aguucaacgccgcuaucagau

SEQ ID NO: 2024102 - RNA, 10 nt, Shigella flexneri 2a str. 301
aguucaacgg

SEQ ID NO: 2024103 - RNA, 18 nt, Shigella flexneri 2a str. 301
aguuaauccacagcaaug

SEQ ID NO: 2024104 - RNA, 19 nt, Shigella flexneri 2a str. 301
aguuccgggaucaccagac

SEQ ID NO: 2024105 - RNA, 15 nt, Shigella flexneri 2a str. 301
aguucccuacucucg

SEQ ID NO: 2024106 - RNA, 22 nt, Shigella flexneri 2a str. 301
aguucccuacucucgcaugggg

SEQ ID NO: 2024107 - RNA, 23 nt, Shigella flexneri 2a str. 301
aguucaguaugaucuugcccgga

SEQ ID NO: 2024108 - RNA, 16 nt, Shigella flexneri 2a str. 301
aguucaggcgcugcau

SEQ ID NO: 2024109 - RNA, 19 nt, Shigella flexneri 2a str. 301
aguucaguaugaucuugcc

SEQ ID NO: 2024110 - RNA, 19 nt, Shigella flexneri 2a str. 301
aguucacaccagccaccgc

SEQ ID NO: 2024111 - RNA, 17 nt, Shigella flexneri 2a str. 301
aguucauccccucuucc

SEQ ID NO: 2024112 - RNA, 16 nt, Shigella flexneri 2a str. 301
aguucaucacaccagu

SEQ ID NO: 2024113 - RNA, 19 nt, Shigella flexneri 2a str. 301
aguucaucacaccagucca

SEQ ID NO: 2024114 - RNA, 11 nt, Shigella flexneri 2a str. 301
auaagauacug

SEQ ID NO: 2024115 - RNA, 19 nt, Shigella flexneri 2a str. 301
auaagauaacccugcauau

SEQ ID NO: 2024116 - RNA, 20 nt, Shigella flexneri 2a str. 301
auaagacuggcaaaugacau

SEQ ID NO: 2024117 - RNA, 22 nt, Shigella flexneri 2a str. 301
auaagacuggcaaaugacauaa

SEQ ID NO: 2024118 - RNA, 17 nt, Shigella flexneri 2a str. 301
auaagacgcguuagcau

SEQ ID NO: 2024119 - RNA, 18 nt, Shigella flexneri 2a str. 301
auaacucaccaucaagua

SEQ ID NO: 2024120 - RNA, 15 nt, Shigella flexneri 2a str. 301
auaaauuggcugggg

SEQ ID NO: 2024121 - RNA, 13 nt, Shigella flexneri 2a str. 301
auaacuacugaug

SEQ ID NO: 2024122 - RNA, 15 nt, Shigella flexneri 2a str. 301
auaacgaucucuuuc

SEQ ID NO: 2024123 - RNA, 15 nt, Shigella flexneri 2a str. 301
auaagcgcaagggua

SEQ ID NO: 2024124 - RNA, 13 nt, Shigella flexneri 2a str. 301
auaagcgcagcgc

SEQ ID NO: 2024125 - RNA, 22 nt, Shigella flexneri 2a str. 301
auaagcggaaagaccacaguaa

SEQ ID NO: 2024126 - RNA, 19 nt, Shigella flexneri 2a str. 301
auaagcccagaacaaauaa

SEQ ID NO: 2024127 - RNA, 16 nt, Shigella flexneri 2a str. 301
auaagccaaauccagc

SEQ ID NO: 2024128 - RNA, 13 nt, Shigella flexneri 2a str. 301
auaaggcuuuaac

SEQ ID NO: 2024129 - RNA, 13 nt, Shigella flexneri 2a str. 301
auaaugcugacaa

SEQ ID NO: 2024130 - RNA, 14 nt, Shigella flexneri 2a str. 301
auaaugccggauac

SEQ ID NO: 2024131 - RNA, 11 nt, Shigella flexneri 2a str. 301
auaaugcccag

SEQ ID NO: 2024132 - RNA, 22 nt, Shigella flexneri 2a str. 301
auaaugcccgaugaccuuguca

SEQ ID NO: 2024133 - RNA, 21 nt, Shigella flexneri 2a str. 301
auaaucguaaucagcaucuca

SEQ ID NO: 2024134 - RNA, 23 nt, Shigella flexneri 2a str. 301
auaaucuauugauuuaacagcaa

SEQ ID NO: 2024135 - RNA, 19 nt, Shigella flexneri 2a str. 301
auaaucucccguuccuggu

SEQ ID NO: 2024136 - RNA, 19 nt, Shigella flexneri 2a str. 301
auaaucgcgaauagcuuca

SEQ ID NO: 2024137 - RNA, 16 nt, Shigella flexneri 2a str. 301
auaaucccggcaccaa

SEQ ID NO: 2024138 - RNA, 13 nt, Shigella flexneri 2a str. 301
auaauuaaaaaua

SEQ ID NO: 2024139 - RNA, 22 nt, Shigella flexneri 2a str. 301
auaauguggccccugaaguuca

SEQ ID NO: 2024140 - RNA, 22 nt, Shigella flexneri 2a str. 301
auaauguuauuuaauuacugag

SEQ ID NO: 2024141 - RNA, 20 nt, Shigella flexneri 2a str. 301
auaauuaugccgaucaucau

SEQ ID NO: 2024142 - RNA, 19 nt, Shigella flexneri 2a str. 301
auaauuaggauacuuaucu

SEQ ID NO: 2024143 - RNA, 14 nt, Shigella flexneri 2a str. 301
auaaguacgauaca

SEQ ID NO: 2024144 - RNA, 14 nt, Shigella flexneri 2a str. 301
auaaguaaugaacu

SEQ ID NO: 2024145 - RNA, 15 nt, Shigella flexneri 2a str. 301
auaauauccuuuccc

SEQ ID NO: 2024146 - RNA, 22 nt, Shigella flexneri 2a str. 301
auaauacucagugaacaauuaa

SEQ ID NO: 2024147 - RNA, 19 nt, Shigella flexneri 2a str. 301
auaaucaacgcaccgacaa

SEQ ID NO: 2024148 - RNA, 17 nt, Shigella flexneri 2a str. 301
auaaucaacaaaccaaa

SEQ ID NO: 2024149 - RNA, 15 nt, Shigella flexneri 2a str. 301
auaauaucuuuucuu

SEQ ID NO: 2024150 - RNA, 13 nt, Shigella flexneri 2a str. 301
auaauaucuccag

SEQ ID NO: 2024151 - RNA, 21 nt, Shigella flexneri 2a str. 301
auaauauuccgcugacuuuau

SEQ ID NO: 2024152 - RNA, 18 nt, Shigella flexneri 2a str. 301
auaauccaucacuucauc

SEQ ID NO: 2024153 - RNA, 17 nt, Shigella flexneri 2a str. 301
auaauccaucacuucau

SEQ ID NO: 2024154 - RNA, 15 nt, Shigella flexneri 2a str. 301
auaauccccauauca

SEQ ID NO: 2024155 - RNA, 20 nt, Shigella flexneri 2a str. 301
auaauccccauaucaggcac

SEQ ID NO: 2024156 - RNA, 21 nt, Shigella flexneri 2a str. 301
auaauccccauaucaggcaca

SEQ ID NO: 2024157 - RNA, 22 nt, Shigella flexneri 2a str. 301
auaauccaguacgcguacacuu

SEQ ID NO: 2024158 - RNA, 16 nt, Shigella flexneri 2a str. 301
auaaaagaaaaaauga

SEQ ID NO: 2024159 - RNA, 15 nt, Shigella flexneri 2a str. 301
auaaaacgccugaua

SEQ ID NO: 2024160 - RNA, 14 nt, Shigella flexneri 2a str. 301
auaaaaauuaaauc

SEQ ID NO: 2024161 - RNA, 11 nt, Shigella flexneri 2a str. 301
auaaaacacuc

SEQ ID NO: 2024162 - RNA, 16 nt, Shigella flexneri 2a str. 301
auaaaaauaagaaaga

SEQ ID NO: 2024163 - RNA, 23 nt, Shigella flexneri 2a str. 301
aguuuuugcaaucagauaaaaua

SEQ ID NO: 2024164 - RNA, 17 nt, Shigella flexneri 2a str. 301
aguuuuucaucccucuc

SEQ ID NO: 2024165 - RNA, 15 nt, Shigella flexneri 2a str. 301
aguuuuuccccugcc

SEQ ID NO: 2024166 - RNA, 17 nt, Shigella flexneri 2a str. 301
aguuuuuucuucccaag

SEQ ID NO: 2024167 - RNA, 16 nt, Shigella flexneri 2a str. 301
auaaaaaaaguauuuu

SEQ ID NO: 2024168 - RNA, 16 nt, Shigella flexneri 2a str. 301
aguugguuaaucuuuu

SEQ ID NO: 2024169 - RNA, 14 nt, Shigella flexneri 2a str. 301
aguuuucuuugcca

SEQ ID NO: 2024170 - RNA, 16 nt, Shigella flexneri 2a str. 301
aguuuuggggagaugu

SEQ ID NO: 2024171 - RNA, 18 nt, Shigella flexneri 2a str. 301
aguuguaaucauauuaaa

SEQ ID NO: 2024172 - RNA, 12 nt, Shigella flexneri 2a str. 301
aguuuucuuugc

SEQ ID NO: 2024173 - RNA, 15 nt, Shigella flexneri 2a str. 301
auaaacucaccaaau

SEQ ID NO: 2024174 - RNA, 22 nt, Shigella flexneri 2a str. 301
auaaacgccagguucaucaauu

SEQ ID NO: 2024175 - RNA, 14 nt, Shigella flexneri 2a str. 301
auaaacgccagguu

SEQ ID NO: 2024176 - RNA, 20 nt, Shigella flexneri 2a str. 301
auaaacgcgaccgccgccaa

SEQ ID NO: 2024177 - RNA, 18 nt, Shigella flexneri 2a str. 301
auaaacaccagcaauaau

SEQ ID NO: 2024178 - RNA, 17 nt, Shigella flexneri 2a str. 301
auaaacaccagcaauaa

SEQ ID NO: 2024179 - RNA, 15 nt, Shigella flexneri 2a str. 301
auaaacauagcgcau

SEQ ID NO: 2024180 - RNA, 23 nt, Shigella flexneri 2a str. 301
auaaacauccaccgccacgccga

SEQ ID NO: 2024181 - RNA, 20 nt, Shigella flexneri 2a str. 301
auaaacaguuucgccagggu

SEQ ID NO: 2024182 - RNA, 19 nt, Shigella flexneri 2a str. 301
auaaacaguuucgccaggg

SEQ ID NO: 2024183 - RNA, 15 nt, Shigella flexneri 2a str. 301
auaaacagcguaaau

SEQ ID NO: 2024184 - RNA, 12 nt, Shigella flexneri 2a str. 301
auaaacagcagg

SEQ ID NO: 2024185 - RNA, 13 nt, Shigella flexneri 2a str. 301
auaaagaaaaucu

SEQ ID NO: 2024186 - RNA, 21 nt, Shigella flexneri 2a str. 301
auaaacuuacugacaucaaac

SEQ ID NO: 2024187 - RNA, 20 nt, Shigella flexneri 2a str. 301
auaaacucucuauuccacca

SEQ ID NO: 2024188 - RNA, 22 nt, Shigella flexneri 2a str. 301
auaaagaugccauuggcauaaa

SEQ ID NO: 2024189 - RNA, 15 nt, Shigella flexneri 2a str. 301
auaaaugccgcaaug

SEQ ID NO: 2024190 - RNA, 15 nt, Shigella flexneri 2a str. 301
auaaauguguaauca

SEQ ID NO: 2024191 - RNA, 15 nt, Shigella flexneri 2a str. 301
auaaauguuaagacu

SEQ ID NO: 2024192 - RNA, 13 nt, Shigella flexneri 2a str. 301
auaaauuccccgc

SEQ ID NO: 2024193 - RNA, 24 nt, Shigella flexneri 2a str. 301
auaaauuaacugcgcgauuaucau

SEQ ID NO: 2024194 - RNA, 14 nt, Shigella flexneri 2a str. 301
auaaagucuuucuu

SEQ ID NO: 2024195 - RNA, 23 nt, Shigella flexneri 2a str. 301
auaaaguguugagcuuuauccug

SEQ ID NO: 2024196 - RNA, 13 nt, Shigella flexneri 2a str. 301
auaaauaaaaauu

SEQ ID NO: 2024197 - RNA, 19 nt, Shigella flexneri 2a str. 301
aucaucgcggcacacagca

SEQ ID NO: 2024198 - RNA, 18 nt, Shigella flexneri 2a str. 301
aucaucgcggcacacagc

SEQ ID NO: 2024199 - RNA, 15 nt, Shigella flexneri 2a str. 301
aucaucggcaaacau

SEQ ID NO: 2024200 - RNA, 20 nt, Shigella flexneri 2a str. 301
aucaucgcuuucaggucagc

SEQ ID NO: 2024201 - RNA, 18 nt, Shigella flexneri 2a str. 301
aaaacguggccuccaaaa

SEQ ID NO: 2024202 - RNA, 17 nt, Shigella flexneri 2a str. 301
aaaacguggccuccaaa

SEQ ID NO: 2024203 - RNA, 12 nt, Shigella flexneri 2a str. 301
aucauacugauu

SEQ ID NO: 2024204 - RNA, 12 nt, Shigella flexneri 2a str. 301
aucauaauggcu

SEQ ID NO: 2024205 - RNA, 17 nt, Shigella flexneri 2a str. 301
aucaucgguaccgccag

SEQ ID NO: 2024206 - RNA, 22 nt, Shigella flexneri 2a str. 301
aucaucgggcugagauuuauga

SEQ ID NO: 2024207 - RNA, 22 nt, Shigella flexneri 2a str. 301
aucaucgucguuucuuuuuuau

SEQ ID NO: 2024208 - RNA, 19 nt, Shigella flexneri 2a str. 301
aucaucguucauauauucc

SEQ ID NO: 2024209 - RNA, 16 nt, Shigella flexneri 2a str. 301
aucaucuuuauauauu

SEQ ID NO: 2024210 - RNA, 16 nt, Shigella flexneri 2a str. 301
aucaugcaauaaauau

SEQ ID NO: 2024211 - RNA, 19 nt, Shigella flexneri 2a str. 301
aucaugccuacaaccguug

SEQ ID NO: 2024212 - RNA, 17 nt, Shigella flexneri 2a str. 301
aucaugcaguaccagau

SEQ ID NO: 2024213 - RNA, 23 nt, Shigella flexneri 2a str. 301
aucaugagguuguggcauuagau

SEQ ID NO: 2024214 - RNA, 21 nt, Shigella flexneri 2a str. 301
aaaacugcccgugaugcaacu

SEQ ID NO: 2024215 - RNA, 12 nt, Shigella flexneri 2a str. 301
aaaacugccgca

SEQ ID NO: 2024216 - RNA, 23 nt, Shigella flexneri 2a str. 301
aaaacucucaucuuugaaaucac

SEQ ID NO: 2024217 - RNA, 21 nt, Shigella flexneri 2a str. 301
aucauggcauccuguuuucug

SEQ ID NO: 2024218 - RNA, 14 nt, Shigella flexneri 2a str. 301
aucauggaagcaga

SEQ ID NO: 2024219 - RNA, 19 nt, Shigella flexneri 2a str. 301
aucauggcgaugagaauca

SEQ ID NO: 2024220 - RNA, 14 nt, Shigella flexneri 2a str. 301
aucauggcucagau

SEQ ID NO: 2024221 - RNA, 22 nt, Shigella flexneri 2a str. 301
aucaugcucagaugccugaugc

SEQ ID NO: 2024222 - RNA, 22 nt, Shigella flexneri 2a str. 301
aaaacuggauuacaaauaaaua

SEQ ID NO: 2024223 - RNA, 19 nt, Shigella flexneri 2a str. 301
aaaacugccugauacugaa

SEQ ID NO: 2024224 - RNA, 14 nt, Shigella flexneri 2a str. 301
aaaacuggaaaaau

SEQ ID NO: 2024225 - RNA, 16 nt, Shigella flexneri 2a str. 301
aaaacuggaaaaauaa

SEQ ID NO: 2024226 - RNA, 17 nt, Shigella flexneri 2a str. 301
aucaugucgcccacgcc

SEQ ID NO: 2024227 - RNA, 23 nt, Shigella flexneri 2a str. 301
aucauucgccgguuccagcuuca

SEQ ID NO: 2024228 - RNA, 18 nt, Shigella flexneri 2a str. 301
aaaagaauggacacuauu

SEQ ID NO: 2024229 - RNA, 13 nt, Shigella flexneri 2a str. 301
aaaagaauaucag

SEQ ID NO: 2024230 - RNA, 13 nt, Shigella flexneri 2a str. 301
aaaagaagaccug

SEQ ID NO: 2024231 - RNA, 21 nt, Shigella flexneri 2a str. 301
auccaaccauccccaucugcu

SEQ ID NO: 2024232 - RNA, 21 nt, Shigella flexneri 2a str. 301
auccaacugauguagucauac

SEQ ID NO: 2024233 - RNA, 22 nt, Shigella flexneri 2a str. 301
auccacaggguguauucaugcc

SEQ ID NO: 2024234 - RNA, 15 nt, Shigella flexneri 2a str. 301
auccacgauuaucac

SEQ ID NO: 2024235 - RNA, 24 nt, Shigella flexneri 2a str. 301
auccagacuaauuuuucccucuuc

SEQ ID NO: 2024236 - RNA, 14 nt, Shigella flexneri 2a str. 301
auccagacugcuca

SEQ ID NO: 2024237 - RNA, 23 nt, Shigella flexneri 2a str. 301
auccagauggcuauaaucacuca

SEQ ID NO: 2024238 - RNA, 16 nt, Shigella flexneri 2a str. 301
auccagauuuauaaaa

SEQ ID NO: 2024239 - RNA, 20 nt, Shigella flexneri 2a str. 301
auccagauuuauaaaagaaa

SEQ ID NO: 2024240 - RNA, 22 nt, Shigella flexneri 2a str. 301
auccacggugcuuugacgaugc

SEQ ID NO: 2024241 - RNA, 19 nt, Shigella flexneri 2a str. 301
auccacgcauuaauaaggu

SEQ ID NO: 2024242 - RNA, 18 nt, Shigella flexneri 2a str. 301
auccagcucuucuucacu

SEQ ID NO: 2024243 - RNA, 13 nt, Shigella flexneri 2a str. 301
auccagcucaucc

SEQ ID NO: 2024244 - RNA, 23 nt, Shigella flexneri 2a str. 301
auccagcucuuuuccagccauca

SEQ ID NO: 2024245 - RNA, 21 nt, Shigella flexneri 2a str. 301
auccagcggugcgcgauuaug

SEQ ID NO: 2024246 - RNA, 15 nt, Shigella flexneri 2a str. 301
auccagcaacaacag

SEQ ID NO: 2024247 - RNA, 14 nt, Shigella flexneri 2a str. 301
auccagcaacaaca

SEQ ID NO: 2024248 - RNA, 19 nt, Shigella flexneri 2a str. 301
auccagcagcccuugcuuc

SEQ ID NO: 2024249 - RNA, 18 nt, Shigella flexneri 2a str. 301
auccaucacuucaucauc

SEQ ID NO: 2024250 - RNA, 19 nt, Shigella flexneri 2a str. 301
auccaucagacuuugcgcc

SEQ ID NO: 2024251 - RNA, 21 nt, Shigella flexneri 2a str. 301
auccaucagacuuugcgccau

SEQ ID NO: 2024252 - RNA, 19 nt, Shigella flexneri 2a str. 301
auccaucaaagguuuuuca

SEQ ID NO: 2024253 - RNA, 14 nt, Shigella flexneri 2a str. 301
auccaucaaagguu

SEQ ID NO: 2024254 - RNA, 18 nt, Shigella flexneri 2a str. 301
auccaucaaagguuuuuc

SEQ ID NO: 2024255 - RNA, 23 nt, Shigella flexneri 2a str. 301
auccauauuuucagcagugggua

SEQ ID NO: 2024256 - RNA, 19 nt, Shigella flexneri 2a str. 301
auccauaucgauuucuaca

SEQ ID NO: 2024257 - RNA, 18 nt, Shigella flexneri 2a str. 301
auccauaccagcacauaa

SEQ ID NO: 2024258 - RNA, 20 nt, Shigella flexneri 2a str. 301
auccagcuuuuagaucacuc

SEQ ID NO: 2024259 - RNA, 15 nt, Shigella flexneri 2a str. 301
auccaggaacagaag

SEQ ID NO: 2024260 - RNA, 17 nt, Shigella flexneri 2a str. 301
auccaguguaaaacagc

SEQ ID NO: 2024261 - RNA, 20 nt, Shigella flexneri 2a str. 301
auccagugcucauccuucag

SEQ ID NO: 2024262 - RNA, 17 nt, Shigella flexneri 2a str. 301
auccagugcuucaauau

SEQ ID NO: 2024263 - RNA, 13 nt, Shigella flexneri 2a str. 301
auccaguuucugc

SEQ ID NO: 2024264 - RNA, 13 nt, Shigella flexneri 2a str. 301
auccaguuuaauc

SEQ ID NO: 2024265 - RNA, 16 nt, Shigella flexneri 2a str. 301
aucccacauccuacca

SEQ ID NO: 2024266 - RNA, 18 nt, Shigella flexneri 2a str. 301
auccccagacaaaagcga

SEQ ID NO: 2024267 - RNA, 15 nt, Shigella flexneri 2a str. 301
aucccaaccauuuca

SEQ ID NO: 2024268 - RNA, 22 nt, Shigella flexneri 2a str. 301
auccaugcgcauuaagccauga

SEQ ID NO: 2024269 - RNA, 16 nt, Shigella flexneri 2a str. 301
auccaucgccagcuca

SEQ ID NO: 2024270 - RNA, 21 nt, Shigella flexneri 2a str. 301
auccccuucucaaucccuuuc

SEQ ID NO: 2024271 - RNA, 15 nt, Shigella flexneri 2a str. 301
aucccgauuaaucag

SEQ ID NO: 2024272 - RNA, 15 nt, Shigella flexneri 2a str. 301
aucccgccaacagga

SEQ ID NO: 2024273 - RNA, 23 nt, Shigella flexneri 2a str. 301
auccggcaucguuugcugccuuc

SEQ ID NO: 2024274 - RNA, 13 nt, Shigella flexneri 2a str. 301
auccggcaccaau

SEQ ID NO: 2024275 - RNA, 15 nt, Shigella flexneri 2a str. 301
auccggcaccuuuuc

SEQ ID NO: 2024276 - RNA, 14 nt, Shigella flexneri 2a str. 301
auccggcaggcggg

SEQ ID NO: 2024277 - RNA, 13 nt, Shigella flexneri 2a str. 301
auccggcaauaag

SEQ ID NO: 2024278 - RNA, 16 nt, Shigella flexneri 2a str. 301
auccggcacauuucac

SEQ ID NO: 2024279 - RNA, 12 nt, Shigella flexneri 2a str. 301
auccggcaccaa

SEQ ID NO: 2024280 - RNA, 14 nt, Shigella flexneri 2a str. 301
auccuaccaaagaa

SEQ ID NO: 2024281 - RNA, 15 nt, Shigella flexneri 2a str. 301
auccguuucucuguu

SEQ ID NO: 2024282 - RNA, 20 nt, Shigella flexneri 2a str. 301
auccggugccuuaccgcuug

SEQ ID NO: 2024283 - RNA, 18 nt, Shigella flexneri 2a str. 301
auccgguuaucagaagau

SEQ ID NO: 2024284 - RNA, 18 nt, Shigella flexneri 2a str. 301
auccgguuuacccgcuug

SEQ ID NO: 2024285 - RNA, 14 nt, Shigella flexneri 2a str. 301
auccgguuuacgca

SEQ ID NO: 2024286 - RNA, 13 nt, Shigella flexneri 2a str. 301
auccgguguggca

SEQ ID NO: 2024287 - RNA, 21 nt, Shigella flexneri 2a str. 301
auccgucagcgaguugaucac

SEQ ID NO: 2024288 - RNA, 20 nt, Shigella flexneri 2a str. 301
auccguccuacgaaucccgc

SEQ ID NO: 2024289 - RNA, 18 nt, Shigella flexneri 2a str. 301
auccuucacuuuugccag

SEQ ID NO: 2024290 - RNA, 18 nt, Shigella flexneri 2a str. 301
auccuuccagcuccagcc

SEQ ID NO: 2024291 - RNA, 13 nt, Shigella flexneri 2a str. 301
auccuuccagcuc

SEQ ID NO: 2024292 - RNA, 14 nt, Shigella flexneri 2a str. 301
auccugaucaagca

SEQ ID NO: 2024293 - RNA, 23 nt, Shigella flexneri 2a str. 301
auccugauagcacgucacggacu

SEQ ID NO: 2024294 - RNA, 21 nt, Shigella flexneri 2a str. 301
auccugauaggauuucugauu

SEQ ID NO: 2024295 - RNA, 18 nt, Shigella flexneri 2a str. 301
auccuguuuuuaagugau

SEQ ID NO: 2024296 - RNA, 15 nt, Shigella flexneri 2a str. 301
auccucaagaauaug

SEQ ID NO: 2024297 - RNA, 16 nt, Shigella flexneri 2a str. 301
auccucaguugucuga

SEQ ID NO: 2024298 - RNA, 20 nt, Shigella flexneri 2a str. 301
auccucuuuacgcaaaauca

SEQ ID NO: 2024299 - RNA, 20 nt, Shigella flexneri 2a str. 301
auccucuucaagaauacugu

SEQ ID NO: 2024300 - RNA, 19 nt, Shigella flexneri 2a str. 301
auccucuaucuguuugcca

SEQ ID NO: 2024301 - RNA, 14 nt, Shigella flexneri 2a str. 301
auccucuauauuuc

SEQ ID NO: 2024302 - RNA, 24 nt, Shigella flexneri 2a str. 301
aucgcgaugauuuucgcugcgcua

SEQ ID NO: 2024303 - RNA, 21 nt, Shigella flexneri 2a str. 301
aucgcgaaaaaaaagauggcu

SEQ ID NO: 2024304 - RNA, 17 nt, Shigella flexneri 2a str. 301
aucgcugaaagauggcg

SEQ ID NO: 2024305 - RNA, 18 nt, Shigella flexneri 2a str. 301
aucgcuggucacgggcuu

SEQ ID NO: 2024306 - RNA, 22 nt, Shigella flexneri 2a str. 301
aucgcguaaggcuucaaucaau

SEQ ID NO: 2024307 - RNA, 14 nt, Shigella flexneri 2a str. 301
aucgcguaaugcuu

SEQ ID NO: 2024308 - RNA, 14 nt, Shigella flexneri 2a str. 301
aucgcguugucaua

SEQ ID NO: 2024309 - RNA, 15 nt, Shigella flexneri 2a str. 301
aucgcguuguuuagc

SEQ ID NO: 2024310 - RNA, 19 nt, Shigella flexneri 2a str. 301
aucgccugguaccagcacc

SEQ ID NO: 2024311 - RNA, 16 nt, Shigella flexneri 2a str. 301
aucgccugccgcagga

SEQ ID NO: 2024312 - RNA, 16 nt, Shigella flexneri 2a str. 301
aucgccugaauuacug

SEQ ID NO: 2024313 - RNA, 14 nt, Shigella flexneri 2a str. 301
aucgccgcuggcca

SEQ ID NO: 2024314 - RNA, 12 nt, Shigella flexneri 2a str. 301
aucgcccgcuuc

SEQ ID NO: 2024315 - RNA, 21 nt, Shigella flexneri 2a str. 301
aucgcccccgucaccggcaca

SEQ ID NO: 2024316 - RNA, 16 nt, Shigella flexneri 2a str. 301
aucgagccgauuaaaa

SEQ ID NO: 2024317 - RNA, 17 nt, Shigella flexneri 2a str. 301
aucgagaucggccagca

SEQ ID NO: 2024318 - RNA, 15 nt, Shigella flexneri 2a str. 301
aucgagaugaucuuc

SEQ ID NO: 2024319 - RNA, 22 nt, Shigella flexneri 2a str. 301
aucgagcgccguugcgcccauc

SEQ ID NO: 2024320 - RNA, 19 nt, Shigella flexneri 2a str. 301
aucgaugggauauaacccu

SEQ ID NO: 2024321 - RNA, 15 nt, Shigella flexneri 2a str. 301
aucgaugcuguugcu

SEQ ID NO: 2024322 - RNA, 21 nt, Shigella flexneri 2a str. 301
aucgaugcuguugcuccuuaa

SEQ ID NO: 2024323 - RNA, 14 nt, Shigella flexneri 2a str. 301
aucgaggaaaacca

SEQ ID NO: 2024324 - RNA, 21 nt, Shigella flexneri 2a str. 301
aucgaggaaaaccagaaucug

SEQ ID NO: 2024325 - RNA, 14 nt, Shigella flexneri 2a str. 301
aucgcagaaaaaac

SEQ ID NO: 2024326 - RNA, 17 nt, Shigella flexneri 2a str. 301
aucgcagcacuggugcu

SEQ ID NO: 2024327 - RNA, 14 nt, Shigella flexneri 2a str. 301
aucgcacagaugcg

SEQ ID NO: 2024328 - RNA, 21 nt, Shigella flexneri 2a str. 301
aucgcacguugucagcaacug

SEQ ID NO: 2024329 - RNA, 19 nt, Shigella flexneri 2a str. 301
aucgcaauaccggcaaaga

SEQ ID NO: 2024330 - RNA, 16 nt, Shigella flexneri 2a str. 301
aucgccaucaggcaga

SEQ ID NO: 2024331 - RNA, 20 nt, Shigella flexneri 2a str. 301
aucgccauaauaagcgccau

SEQ ID NO: 2024332 - RNA, 18 nt, Shigella flexneri 2a str. 301
aucgccaguaguaaccac

SEQ ID NO: 2024333 - RNA, 21 nt, Shigella flexneri 2a str. 301
aucgccaucuuuacaccuuac

SEQ ID NO: 2024334 - RNA, 12 nt, Shigella flexneri 2a str. 301
aucgcagaugaa

SEQ ID NO: 2024335 - RNA, 13 nt, Shigella flexneri 2a str. 301
aucgcauaaaaca

SEQ ID NO: 2024336 - RNA, 18 nt, Shigella flexneri 2a str. 301
aucgcaucaaucuuuuuc

SEQ ID NO: 2024337 - RNA, 23 nt, Shigella flexneri 2a str. 301
aucgcaucgaugguugcccugcu

SEQ ID NO: 2024338 - RNA, 13 nt, Shigella flexneri 2a str. 301
aucuaaaacccgg

SEQ ID NO: 2024339 - RNA, 17 nt, Shigella flexneri 2a str. 301
aucuaaaugccacugaa

SEQ ID NO: 2024340 - RNA, 16 nt, Shigella flexneri 2a str. 301
aucuaaaugccacuga

SEQ ID NO: 2024341 - RNA, 20 nt, Shigella flexneri 2a str. 301
aucuaaccuacuuuuuaauu

SEQ ID NO: 2024342 - RNA, 19 nt, Shigella flexneri 2a str. 301
aucuaaccauuauuaaauu

SEQ ID NO: 2024343 - RNA, 22 nt, Shigella flexneri 2a str. 301
aucguucugugccgucugcccc

SEQ ID NO: 2024344 - RNA, 18 nt, Shigella flexneri 2a str. 301
aucguuugcauccagcuc

SEQ ID NO: 2024345 - RNA, 20 nt, Shigella flexneri 2a str. 301
aucuaagaucccugccauuu

SEQ ID NO: 2024346 - RNA, 19 nt, Shigella flexneri 2a str. 301
aucuaauguuggugugaca

SEQ ID NO: 2024347 - RNA, 18 nt, Shigella flexneri 2a str. 301
aucuaccguuacggcugg

SEQ ID NO: 2024348 - RNA, 15 nt, Shigella flexneri 2a str. 301
aucuaccacugccug

SEQ ID NO: 2024349 - RNA, 22 nt, Shigella flexneri 2a str. 301
aucuacucguuuauuaugccac

SEQ ID NO: 2024350 - RNA, 20 nt, Shigella flexneri 2a str. 301
aucuacgguggaacauuuac

SEQ ID NO: 2024351 - RNA, 15 nt, Shigella flexneri 2a str. 301
aucuaugguuuuuuc

SEQ ID NO: 2024352 - RNA, 14 nt, Shigella flexneri 2a str. 301
aucuaugguuuuuu

SEQ ID NO: 2024353 - RNA, 17 nt, Shigella flexneri 2a str. 301
aucuauucauuuauguu

SEQ ID NO: 2024354 - RNA, 20 nt, Shigella flexneri 2a str. 301
aucuauucaccgcaucaaua

SEQ ID NO: 2024355 - RNA, 17 nt, Shigella flexneri 2a str. 301
aucguccacgucaucaa

SEQ ID NO: 2024356 - RNA, 18 nt, Shigella flexneri 2a str. 301
aucguccacgucaucaaa

SEQ ID NO: 2024357 - RNA, 16 nt, Shigella flexneri 2a str. 301
aucguccacuugaaaa

SEQ ID NO: 2024358 - RNA, 17 nt, Shigella flexneri 2a str. 301
aucguccacuugaaaau

SEQ ID NO: 2024359 - RNA, 19 nt, Shigella flexneri 2a str. 301
aucguccacuugaaaauua

SEQ ID NO: 2024360 - RNA, 16 nt, Shigella flexneri 2a str. 301
aucguccagcagcaau

SEQ ID NO: 2024361 - RNA, 17 nt, Shigella flexneri 2a str. 301
aucguccgccagccuac

SEQ ID NO: 2024362 - RNA, 13 nt, Shigella flexneri 2a str. 301
aucguccauuucu

SEQ ID NO: 2024363 - RNA, 15 nt, Shigella flexneri 2a str. 301
aucgucgccagacca

SEQ ID NO: 2024364 - RNA, 18 nt, Shigella flexneri 2a str. 301
aucgcuucggucugcgga

SEQ ID NO: 2024365 - RNA, 17 nt, Shigella flexneri 2a str. 301
aucgcuucgucaagacg

SEQ ID NO: 2024366 - RNA, 15 nt, Shigella flexneri 2a str. 301
aucgcuucauuuaca

SEQ ID NO: 2024367 - RNA, 20 nt, Shigella flexneri 2a str. 301
aucgcuguccgcuucaccac

SEQ ID NO: 2024368 - RNA, 15 nt, Shigella flexneri 2a str. 301
aucguuaaauucuaa

SEQ ID NO: 2024369 - RNA, 20 nt, Shigella flexneri 2a str. 301
aucguuaaauucuaauguua

SEQ ID NO: 2024370 - RNA, 14 nt, Shigella flexneri 2a str. 301
aucguuaucaccaa

SEQ ID NO: 2024371 - RNA, 23 nt, Shigella flexneri 2a str. 301
aucguuacgccccgguuucucuu

SEQ ID NO: 2024372 - RNA, 15 nt, Shigella flexneri 2a str. 301
aucguucagggagua

SEQ ID NO: 2024373 - RNA, 18 nt, Shigella flexneri 2a str. 301
aucgugcaaauucaauau

SEQ ID NO: 2024374 - RNA, 14 nt, Shigella flexneri 2a str. 301
aucgugaaaaauca

SEQ ID NO: 2024375 - RNA, 17 nt, Shigella flexneri 2a str. 301
aucgucugcgccaccac

SEQ ID NO: 2024376 - RNA, 15 nt, Shigella flexneri 2a str. 301
aucguggugaugauc

SEQ ID NO: 2024377 - RNA, 20 nt, Shigella flexneri 2a str. 301
aucgugccaggaccauucac

SEQ ID NO: 2024378 - RNA, 14 nt, Shigella flexneri 2a str. 301
aucucuaaggcaug

SEQ ID NO: 2024379 - RNA, 17 nt, Shigella flexneri 2a str. 301
aucucgguggaaaauag

SEQ ID NO: 2024380 - RNA, 23 nt, Shigella flexneri 2a str. 301
aucucggggcuuauuaacuuccc

SEQ ID NO: 2024381 - RNA, 18 nt, Shigella flexneri 2a str. 301
aucucuacaccaacgccc

SEQ ID NO: 2024382 - RNA, 23 nt, Shigella flexneri 2a str. 301
aucucuacagcgcccgccagcac

SEQ ID NO: 2024383 - RNA, 12 nt, Shigella flexneri 2a str. 301
aucucuucccau

SEQ ID NO: 2024384 - RNA, 20 nt, Shigella flexneri 2a str. 301
aucucuuccggcaccacaaa

SEQ ID NO: 2024385 - RNA, 23 nt, Shigella flexneri 2a str. 301
aucucuucgccugccugcagcug

SEQ ID NO: 2024386 - RNA, 13 nt, Shigella flexneri 2a str. 301
aucucuucaccau

SEQ ID NO: 2024387 - RNA, 18 nt, Shigella flexneri 2a str. 301
aucucuuccagaauaucu

SEQ ID NO: 2024388 - RNA, 17 nt, Shigella flexneri 2a str. 301
aucuauuauuauuuuug

SEQ ID NO: 2024389 - RNA, 17 nt, Shigella flexneri 2a str. 301
aucucaaacgguucuuu

SEQ ID NO: 2024390 - RNA, 13 nt, Shigella flexneri 2a str. 301
aucucaauauuag

SEQ ID NO: 2024391 - RNA, 17 nt, Shigella flexneri 2a str. 301
aucucaaucgcacccgc

SEQ ID NO: 2024392 - RNA, 16 nt, Shigella flexneri 2a str. 301
aucuccagcuauaacg

SEQ ID NO: 2024393 - RNA, 18 nt, Shigella flexneri 2a str. 301
aucuggaauggaaacagc

SEQ ID NO: 2024394 - RNA, 18 nt, Shigella flexneri 2a str. 301
aucugccagauaauggcu

SEQ ID NO: 2024395 - RNA, 13 nt, Shigella flexneri 2a str. 301
aucugcuguucua

SEQ ID NO: 2024396 - RNA, 21 nt, Shigella flexneri 2a str. 301
aucugauuuuccuccagcagc

SEQ ID NO: 2024397 - RNA, 15 nt, Shigella flexneri 2a str. 301
aucucuucggcacug

SEQ ID NO: 2024398 - RNA, 13 nt, Shigella flexneri 2a str. 301
aucucuucuuccg

SEQ ID NO: 2024399 - RNA, 14 nt, Shigella flexneri 2a str. 301
aucucuucuucgcu

SEQ ID NO: 2024400 - RNA, 19 nt, Shigella flexneri 2a str. 301
aucugauagugauccauca

SEQ ID NO: 2024401 - RNA, 19 nt, Shigella flexneri 2a str. 301
aucugauaucucaccagau

SEQ ID NO: 2024402 - RNA, 22 nt, Shigella flexneri 2a str. 301
aucugaugauauuuuucccuga

SEQ ID NO: 2024403 - RNA, 20 nt, Shigella flexneri 2a str. 301
aucuuuaaaaaaagcauuua

SEQ ID NO: 2024404 - RNA, 18 nt, Shigella flexneri 2a str. 301
aucuuuaaaaaaagcauu

SEQ ID NO: 2024405 - RNA, 16 nt, Shigella flexneri 2a str. 301
aucuuguucauagugc

SEQ ID NO: 2024406 - RNA, 14 nt, Shigella flexneri 2a str. 301
aucuugucuuccau

SEQ ID NO: 2024407 - RNA, 21 nt, Shigella flexneri 2a str. 301
aucuuucugcgcaucuucccc

SEQ ID NO: 2024408 - RNA, 14 nt, Shigella flexneri 2a str. 301
aucuuuauauauug

SEQ ID NO: 2024409 - RNA, 18 nt, Shigella flexneri 2a str. 301
aucuuugacugaaauuua

SEQ ID NO: 2024410 - RNA, 12 nt, Shigella flexneri 2a str. 301
aucuuugaugcc

SEQ ID NO: 2024411 - RNA, 23 nt, Shigella flexneri 2a str. 301
aucuuugccagaucgccugccgc

SEQ ID NO: 2024412 - RNA, 15 nt, Shigella flexneri 2a str. 301
aucuuuucuuucgcc

SEQ ID NO: 2024413 - RNA, 13 nt, Shigella flexneri 2a str. 301
aucuuuucugagu

SEQ ID NO: 2024414 - RNA, 16 nt, Shigella flexneri 2a str. 301
aucuuuuugccugaga

SEQ ID NO: 2024415 - RNA, 23 nt, Shigella flexneri 2a str. 301
aucuuuuugggguuuuaauuccu

SEQ ID NO: 2024416 - RNA, 16 nt, Shigella flexneri 2a str. 301
aucuugaaaccagaca

SEQ ID NO: 2024417 - RNA, 14 nt, Shigella flexneri 2a str. 301
aucuucuucuaugc

SEQ ID NO: 2024418 - RNA, 20 nt, Shigella flexneri 2a str. 301
aucuucuugcagcuuaauca

SEQ ID NO: 2024419 - RNA, 21 nt, Shigella flexneri 2a str. 301
aucuugauaccaaaauggcgc

SEQ ID NO: 2024420 - RNA, 18 nt, Shigella flexneri 2a str. 301
aucugucugauaaaaaac

SEQ ID NO: 2024421 - RNA, 19 nt, Shigella flexneri 2a str. 301
aucugucugauaaaaaacc

SEQ ID NO: 2024422 - RNA, 16 nt, Shigella flexneri 2a str. 301
aucuguucagcaaaaa

SEQ ID NO: 2024423 - RNA, 14 nt, Shigella flexneri 2a str. 301
aucuguuaucacuu

SEQ ID NO: 2024424 - RNA, 22 nt, Shigella flexneri 2a str. 301
aucugguguuaaaucuguucau

SEQ ID NO: 2024425 - RNA, 18 nt, Shigella flexneri 2a str. 301
aucuucucuauaaaaaag

SEQ ID NO: 2024426 - RNA, 19 nt, Shigella flexneri 2a str. 301
augaccgacguuaugcucg

SEQ ID NO: 2024427 - RNA, 21 nt, Shigella flexneri 2a str. 301
augacacaucaccuccagcga

SEQ ID NO: 2024428 - RNA, 14 nt, Shigella flexneri 2a str. 301
augacacaucaccu

SEQ ID NO: 2024429 - RNA, 13 nt, Shigella flexneri 2a str. 301
augacacacucug

SEQ ID NO: 2024430 - RNA, 17 nt, Shigella flexneri 2a str. 301
augacaagguugauauu

SEQ ID NO: 2024431 - RNA, 20 nt, Shigella flexneri 2a str. 301
augaccagugaggaugcggg

SEQ ID NO: 2024432 - RNA, 18 nt, Shigella flexneri 2a str. 301
augagaaaauuucauuaa

SEQ ID NO: 2024433 - RNA, 15 nt, Shigella flexneri 2a str. 301
augagaacaguucag

SEQ ID NO: 2024434 - RNA, 14 nt, Shigella flexneri 2a str. 301
augagaauaccgaa

SEQ ID NO: 2024435 - RNA, 15 nt, Shigella flexneri 2a str. 301
augacgacaaggcag

SEQ ID NO: 2024436 - RNA, 16 nt, Shigella flexneri 2a str. 301
augacgaacuucauca

SEQ ID NO: 2024437 - RNA, 18 nt, Shigella flexneri 2a str. 301
augacgaucgcagaaaaa

SEQ ID NO: 2024438 - RNA, 17 nt, Shigella flexneri 2a str. 301
augaauguuuuccugcu

SEQ ID NO: 2024439 - RNA, 21 nt, Shigella flexneri 2a str. 301
augaauuaccaacgugcucac

SEQ ID NO: 2024440 - RNA, 12 nt, Shigella flexneri 2a str. 301
augaauauugcg

SEQ ID NO: 2024441 - RNA, 22 nt, Shigella flexneri 2a str. 301
augaaaaaaccagaaagggaag

SEQ ID NO: 2024442 - RNA, 14 nt, Shigella flexneri 2a str. 301
augaaaaaauagaa

SEQ ID NO: 2024443 - RNA, 18 nt, Shigella flexneri 2a str. 301
augaaagaagcuuuccac

SEQ ID NO: 2024444 - RNA, 16 nt, Shigella flexneri 2a str. 301
augaaacgcaaauacu

SEQ ID NO: 2024445 - RNA, 21 nt, Shigella flexneri 2a str. 301
augaaagccccaccagcaaau

SEQ ID NO: 2024446 - RNA, 20 nt, Shigella flexneri 2a str. 301
augaagaacaaguucaagau

SEQ ID NO: 2024447 - RNA, 17 nt, Shigella flexneri 2a str. 301
auaccuaacauuuuacu

SEQ ID NO: 2024448 - RNA, 13 nt, Shigella flexneri 2a str. 301
auaccuaaaaaau

SEQ ID NO: 2024449 - RNA, 18 nt, Shigella flexneri 2a str. 301
auaccguucucuuuaaaa

SEQ ID NO: 2024450 - RNA, 20 nt, Shigella flexneri 2a str. 301
auaccgucagcgaucagcau

SEQ ID NO: 2024451 - RNA, 17 nt, Shigella flexneri 2a str. 301
auacggguuuuccccuu

SEQ ID NO: 2024452 - RNA, 18 nt, Shigella flexneri 2a str. 301
auacguuucaccagcacu

SEQ ID NO: 2024453 - RNA, 22 nt, Shigella flexneri 2a str. 301
auacguugcauaaaugccgcaa

SEQ ID NO: 2024454 - RNA, 16 nt, Shigella flexneri 2a str. 301
auacugaucaucauua

SEQ ID NO: 2024455 - RNA, 23 nt, Shigella flexneri 2a str. 301
auacugauaauaaauaacagugc

SEQ ID NO: 2024456 - RNA, 17 nt, Shigella flexneri 2a str. 301
auacucuuugguauuca

SEQ ID NO: 2024457 - RNA, 22 nt, Shigella flexneri 2a str. 301
auacucuuugacaacaucaucu

SEQ ID NO: 2024458 - RNA, 13 nt, Shigella flexneri 2a str. 301
auacucuuuccau

SEQ ID NO: 2024459 - RNA, 12 nt, Shigella flexneri 2a str. 301
auagaccauugc

SEQ ID NO: 2024460 - RNA, 22 nt, Shigella flexneri 2a str. 301
auagaaagugacugcuggguua

SEQ ID NO: 2024461 - RNA, 19 nt, Shigella flexneri 2a str. 301
auagaacaucuuaccucug

SEQ ID NO: 2024462 - RNA, 20 nt, Shigella flexneri 2a str. 301
auagaaccuaagaaccagaa

SEQ ID NO: 2024463 - RNA, 22 nt, Shigella flexneri 2a str. 301
auacuguuuaucuucccagcgc

SEQ ID NO: 2024464 - RNA, 18 nt, Shigella flexneri 2a str. 301
auacuguuuaucuuccca

SEQ ID NO: 2024465 - RNA, 20 nt, Shigella flexneri 2a str. 301
auacuguuuaucuucccagc

SEQ ID NO: 2024466 - RNA, 16 nt, Shigella flexneri 2a str. 301
auacuuaaauaaugcu

SEQ ID NO: 2024467 - RNA, 21 nt, Shigella flexneri 2a str. 301
auacuuaaccccagaccaauc

SEQ ID NO: 2024468 - RNA, 17 nt, Shigella flexneri 2a str. 301
auaccacuuccagcaga

SEQ ID NO: 2024469 - RNA, 17 nt, Shigella flexneri 2a str. 301
auaccacgccaucaacg

SEQ ID NO: 2024470 - RNA, 16 nt, Shigella flexneri 2a str. 301
auaccaccagugccau

SEQ ID NO: 2024471 - RNA, 17 nt, Shigella flexneri 2a str. 301
auaccagccuucuucau

SEQ ID NO: 2024472 - RNA, 17 nt, Shigella flexneri 2a str. 301
auaccagauuaauuauu

SEQ ID NO: 2024473 - RNA, 18 nt, Shigella flexneri 2a str. 301
auaccagcccgucucagc

SEQ ID NO: 2024474 - RNA, 23 nt, Shigella flexneri 2a str. 301
auaccaagucucaagagugaaca

SEQ ID NO: 2024475 - RNA, 14 nt, Shigella flexneri 2a str. 301
auaccaaugauugg

SEQ ID NO: 2024476 - RNA, 18 nt, Shigella flexneri 2a str. 301
auacauuccacuuucagc

SEQ ID NO: 2024477 - RNA, 18 nt, Shigella flexneri 2a str. 301
auaccaaaaucaucaauu

SEQ ID NO: 2024478 - RNA, 12 nt, Shigella flexneri 2a str. 301
auacccagcacc

SEQ ID NO: 2024479 - RNA, 17 nt, Shigella flexneri 2a str. 301
auacccaguuucaugau

SEQ ID NO: 2024480 - RNA, 21 nt, Shigella flexneri 2a str. 301
auacccacugcgcaguguuug

SEQ ID NO: 2024481 - RNA, 21 nt, Shigella flexneri 2a str. 301
auacccagaaucucuuuuguu

SEQ ID NO: 2024482 - RNA, 13 nt, Shigella flexneri 2a str. 301
auaccccacagcc

SEQ ID NO: 2024483 - RNA, 16 nt, Shigella flexneri 2a str. 301
auaccccgccagcaga

SEQ ID NO: 2024484 - RNA, 17 nt, Shigella flexneri 2a str. 301
auacccgccaaaccacu

SEQ ID NO: 2024485 - RNA, 22 nt, Shigella flexneri 2a str. 301
auacccugaaucaaucagagcc

SEQ ID NO: 2024486 - RNA, 12 nt, Shigella flexneri 2a str. 301
auacccaaaaaa

SEQ ID NO: 2024487 - RNA, 20 nt, Shigella flexneri 2a str. 301
auaccaguccacccacguua

SEQ ID NO: 2024488 - RNA, 22 nt, Shigella flexneri 2a str. 301
auaccauccggcauaaacgcua

SEQ ID NO: 2024489 - RNA, 13 nt, Shigella flexneri 2a str. 301
auaccaucggcag

SEQ ID NO: 2024490 - RNA, 15 nt, Shigella flexneri 2a str. 301
auaccaucacaccuc

SEQ ID NO: 2024491 - RNA, 14 nt, Shigella flexneri 2a str. 301
auacauucagaauu

SEQ ID NO: 2024492 - RNA, 14 nt, Shigella flexneri 2a str. 301
auacaugcuuagca

SEQ ID NO: 2024493 - RNA, 13 nt, Shigella flexneri 2a str. 301
auacaugaaugau

SEQ ID NO: 2024494 - RNA, 17 nt, Shigella flexneri 2a str. 301
auacaucuucaucaucc

SEQ ID NO: 2024495 - RNA, 19 nt, Shigella flexneri 2a str. 301
auaauuccggcuuggugug

SEQ ID NO: 2024496 - RNA, 19 nt, Shigella flexneri 2a str. 301
auacagguuucaaugcaca

SEQ ID NO: 2024497 - RNA, 16 nt, Shigella flexneri 2a str. 301
auacauagaaacucau

SEQ ID NO: 2024498 - RNA, 18 nt, Shigella flexneri 2a str. 301
auacauagaaacucauau

SEQ ID NO: 2024499 - RNA, 22 nt, Shigella flexneri 2a str. 301
auacauagcgccucuuuauaaa

SEQ ID NO: 2024500 - RNA, 21 nt, Shigella flexneri 2a str. 301
auacauaaagucuuucuuacc

SEQ ID NO: 2024501 - RNA, 12 nt, Shigella flexneri 2a str. 301
auacaguuuuug

SEQ ID NO: 2024502 - RNA, 20 nt, Shigella flexneri 2a str. 301
auacaguuaucccguacucg

SEQ ID NO: 2024503 - RNA, 16 nt, Shigella flexneri 2a str. 301
auagagcgccugcaga

SEQ ID NO: 2024504 - RNA, 19 nt, Shigella flexneri 2a str. 301
auagagcaaccaccugcaa

SEQ ID NO: 2024505 - RNA, 22 nt, Shigella flexneri 2a str. 301
auagaggaauggcagauaaaau

SEQ ID NO: 2024506 - RNA, 15 nt, Shigella flexneri 2a str. 301
auagccgauaccuaa

SEQ ID NO: 2024507 - RNA, 15 nt, Shigella flexneri 2a str. 301
auagcgccugcugcu

SEQ ID NO: 2024508 - RNA, 20 nt, Shigella flexneri 2a str. 301
auaggaaagcuuauuuuaca

SEQ ID NO: 2024509 - RNA, 19 nt, Shigella flexneri 2a str. 301
auaggagucacucgacagc

SEQ ID NO: 2024510 - RNA, 14 nt, Shigella flexneri 2a str. 301
auaggcaccgccaa

SEQ ID NO: 2024511 - RNA, 19 nt, Shigella flexneri 2a str. 301
auaggcaaaaaaaaugccc

SEQ ID NO: 2024512 - RNA, 13 nt, Shigella flexneri 2a str. 301
auagcuucaaaua

SEQ ID NO: 2024513 - RNA, 14 nt, Shigella flexneri 2a str. 301
auagcggcugcgca

SEQ ID NO: 2024514 - RNA, 16 nt, Shigella flexneri 2a str. 301
auagguugaaauaaac

SEQ ID NO: 2024515 - RNA, 19 nt, Shigella flexneri 2a str. 301
auagguaaacaucacauau

SEQ ID NO: 2024516 - RNA, 21 nt, Shigella flexneri 2a str. 301
auaggcaggcaucaucagauu

SEQ ID NO: 2024517 - RNA, 14 nt, Shigella flexneri 2a str. 301
auaggcaucccgca

SEQ ID NO: 2024518 - RNA, 18 nt, Shigella flexneri 2a str. 301
auaggcggcaaacaguuu

SEQ ID NO: 2024519 - RNA, 14 nt, Shigella flexneri 2a str. 301
auaggcuuccaccg

SEQ ID NO: 2024520 - RNA, 13 nt, Shigella flexneri 2a str. 301
auaguaaccagac

SEQ ID NO: 2024521 - RNA, 21 nt, Shigella flexneri 2a str. 301
auaguagccagccagaaucau

SEQ ID NO: 2024522 - RNA, 19 nt, Shigella flexneri 2a str. 301
auaguacgggcaauuucac

SEQ ID NO: 2024523 - RNA, 14 nt, Shigella flexneri 2a str. 301
auagucaucucuuc

SEQ ID NO: 2024524 - RNA, 18 nt, Shigella flexneri 2a str. 301
auauccguagugaaaaag

SEQ ID NO: 2024525 - RNA, 15 nt, Shigella flexneri 2a str. 301
auauccgccaggcug

SEQ ID NO: 2024526 - RNA, 16 nt, Shigella flexneri 2a str. 301
auauccagcgccgagg

SEQ ID NO: 2024527 - RNA, 22 nt, Shigella flexneri 2a str. 301
auauccagcgcggcgaaggugc

SEQ ID NO: 2024528 - RNA, 16 nt, Shigella flexneri 2a str. 301
auauccucaagaauau

SEQ ID NO: 2024529 - RNA, 19 nt, Shigella flexneri 2a str. 301
auauccagauccagcaccu

SEQ ID NO: 2024530 - RNA, 16 nt, Shigella flexneri 2a str. 301
auauccagauggcuau

SEQ ID NO: 2024531 - RNA, 22 nt, Shigella flexneri 2a str. 301
auauccacgcgauacuuuuuca

SEQ ID NO: 2024532 - RNA, 18 nt, Shigella flexneri 2a str. 301
auauccacccgcagccau

SEQ ID NO: 2024533 - RNA, 22 nt, Shigella flexneri 2a str. 301
auauccaccuccagcuccgcca

SEQ ID NO: 2024534 - RNA, 21 nt, Shigella flexneri 2a str. 301
auaucacucggggcuuuucuc

SEQ ID NO: 2024535 - RNA, 18 nt, Shigella flexneri 2a str. 301
auaucacccuuuucugcc

SEQ ID NO: 2024536 - RNA, 22 nt, Shigella flexneri 2a str. 301
auauauuccuuacucauaaaua

SEQ ID NO: 2024537 - RNA, 17 nt, Shigella flexneri 2a str. 301
auaucaaacaguggugc

SEQ ID NO: 2024538 - RNA, 12 nt, Shigella flexneri 2a str. 301
auaucaaccuga

SEQ ID NO: 2024539 - RNA, 17 nt, Shigella flexneri 2a str. 301
auaucaaccaguugugc

SEQ ID NO: 2024540 - RNA, 13 nt, Shigella flexneri 2a str. 301
auaucaaauaaaa

SEQ ID NO: 2024541 - RNA, 20 nt, Shigella flexneri 2a str. 301
auaucaagaucaucaaacuu

SEQ ID NO: 2024542 - RNA, 14 nt, Shigella flexneri 2a str. 301
auauagccagccuc

SEQ ID NO: 2024543 - RNA, 23 nt, Shigella flexneri 2a str. 301
auauacaggcggguaaucuuucc

SEQ ID NO: 2024544 - RNA, 14 nt, Shigella flexneri 2a str. 301
auauacaaucacac

SEQ ID NO: 2024545 - RNA, 16 nt, Shigella flexneri 2a str. 301
auaguguuuuauguuc

SEQ ID NO: 2024546 - RNA, 22 nt, Shigella flexneri 2a str. 301
auaguguuuuauguucagauaa

SEQ ID NO: 2024547 - RNA, 20 nt, Shigella flexneri 2a str. 301
auaguuaaaauucaagacau

SEQ ID NO: 2024548 - RNA, 14 nt, Shigella flexneri 2a str. 301
auaguggcucagac

SEQ ID NO: 2024549 - RNA, 14 nt, Shigella flexneri 2a str. 301
auaguggcucaggc

SEQ ID NO: 2024550 - RNA, 22 nt, Shigella flexneri 2a str. 301
auaguccugagucagaaacugu

SEQ ID NO: 2024551 - RNA, 21 nt, Shigella flexneri 2a str. 301
auagucccuucgguagcagcu

SEQ ID NO: 2024552 - RNA, 12 nt, Shigella flexneri 2a str. 301
auauaaauuuca

SEQ ID NO: 2024553 - RNA, 21 nt, Shigella flexneri 2a str. 301
auauaaccccacagggugagc

SEQ ID NO: 2024554 - RNA, 20 nt, Shigella flexneri 2a str. 301
aucaaaaaacuggaaaaaua

SEQ ID NO: 2024555 - RNA, 19 nt, Shigella flexneri 2a str. 301
aucaaaaaaggcugacaaa

SEQ ID NO: 2024556 - RNA, 13 nt, Shigella flexneri 2a str. 301
auauuuuuuuagu

SEQ ID NO: 2024557 - RNA, 11 nt, Shigella flexneri 2a str. 301
auauuuuuccg

SEQ ID NO: 2024558 - RNA, 19 nt, Shigella flexneri 2a str. 301
auauuugaggaguuuaaua

SEQ ID NO: 2024559 - RNA, 14 nt, Shigella flexneri 2a str. 301
auauucuucaguau

SEQ ID NO: 2024560 - RNA, 16 nt, Shigella flexneri 2a str. 301
auauucucaaaauaca

SEQ ID NO: 2024561 - RNA, 22 nt, Shigella flexneri 2a str. 301
auauuucugcggcauucccagc

SEQ ID NO: 2024562 - RNA, 15 nt, Shigella flexneri 2a str. 301
auauuucuauauccu

SEQ ID NO: 2024563 - RNA, 16 nt, Shigella flexneri 2a str. 301
aucaacauauuccccu

SEQ ID NO: 2024564 - RNA, 18 nt, Shigella flexneri 2a str. 301
aucaaaugcguuaucggc

SEQ ID NO: 2024565 - RNA, 17 nt, Shigella flexneri 2a str. 301
aucaacaugaaaauaac

SEQ ID NO: 2024566 - RNA, 15 nt, Shigella flexneri 2a str. 301
aucaacaugaaaaua

SEQ ID NO: 2024567 - RNA, 18 nt, Shigella flexneri 2a str. 301
aucaacauguuccugcca

SEQ ID NO: 2024568 - RNA, 13 nt, Shigella flexneri 2a str. 301
aucaacaucaucu

SEQ ID NO: 2024569 - RNA, 18 nt, Shigella flexneri 2a str. 301
aucaacauucagaucggu

SEQ ID NO: 2024570 - RNA, 20 nt, Shigella flexneri 2a str. 301
aucaacggccugaccaugcu

SEQ ID NO: 2024571 - RNA, 14 nt, Shigella flexneri 2a str. 301
aucaacgcuggcau

SEQ ID NO: 2024572 - RNA, 22 nt, Shigella flexneri 2a str. 301
aucaacguuauucgcuuccuca

SEQ ID NO: 2024573 - RNA, 22 nt, Shigella flexneri 2a str. 301
aucaacguaguaucguaaucag

SEQ ID NO: 2024574 - RNA, 23 nt, Shigella flexneri 2a str. 301
aucaaccagaucgcucaucugcu

SEQ ID NO: 2024575 - RNA, 20 nt, Shigella flexneri 2a str. 301
aucaacccugcccuucaggg

SEQ ID NO: 2024576 - RNA, 21 nt, Shigella flexneri 2a str. 301
aucaaccgcacucuacuucuu

SEQ ID NO: 2024577 - RNA, 21 nt, Shigella flexneri 2a str. 301
aucaacuggcaaccagaagag

SEQ ID NO: 2024578 - RNA, 18 nt, Shigella flexneri 2a str. 301
aucaacuggcaaccagaa

SEQ ID NO: 2024579 - RNA, 20 nt, Shigella flexneri 2a str. 301
aucaacugcguucugucgau

SEQ ID NO: 2024580 - RNA, 11 nt, Shigella flexneri 2a str. 301
aucaaaucucg

SEQ ID NO: 2024581 - RNA, 18 nt, Shigella flexneri 2a str. 301
aucaaaugaaugccaaau

SEQ ID NO: 2024582 - RNA, 16 nt, Shigella flexneri 2a str. 301
aucaaaguuuuuauga

SEQ ID NO: 2024583 - RNA, 15 nt, Shigella flexneri 2a str. 301
aucaaagguuuuuca

SEQ ID NO: 2024584 - RNA, 14 nt, Shigella flexneri 2a str. 301
aucaaagguuuuuc

SEQ ID NO: 2024585 - RNA, 19 nt, Shigella flexneri 2a str. 301
aucaaagucuccuuugcca

SEQ ID NO: 2024586 - RNA, 13 nt, Shigella flexneri 2a str. 301
auauggaaaaaua

SEQ ID NO: 2024587 - RNA, 15 nt, Shigella flexneri 2a str. 301
auaugcuggcagugg

SEQ ID NO: 2024588 - RNA, 14 nt, Shigella flexneri 2a str. 301
auaugcuuaauguu

SEQ ID NO: 2024589 - RNA, 19 nt, Shigella flexneri 2a str. 301
auaugcgggcguuuugcuu

SEQ ID NO: 2024590 - RNA, 12 nt, Shigella flexneri 2a str. 301
auauccugcgcu

SEQ ID NO: 2024591 - RNA, 20 nt, Shigella flexneri 2a str. 301
auauccucauuucauugucc

SEQ ID NO: 2024592 - RNA, 14 nt, Shigella flexneri 2a str. 301
auaugcauaaaccg

SEQ ID NO: 2024593 - RNA, 17 nt, Shigella flexneri 2a str. 301
auaugcaucaugaaaac

SEQ ID NO: 2024594 - RNA, 22 nt, Shigella flexneri 2a str. 301
auaugccagccccagcgucagc

SEQ ID NO: 2024595 - RNA, 20 nt, Shigella flexneri 2a str. 301
auaugccgcccuaaagggcg

SEQ ID NO: 2024596 - RNA, 16 nt, Shigella flexneri 2a str. 301
auauggcccaucaucu

SEQ ID NO: 2024597 - RNA, 15 nt, Shigella flexneri 2a str. 301
auauggcggcggcuu

SEQ ID NO: 2024598 - RNA, 18 nt, Shigella flexneri 2a str. 301
auauggccguuuucccca

SEQ ID NO: 2024599 - RNA, 13 nt, Shigella flexneri 2a str. 301
auaugggugcaau

SEQ ID NO: 2024600 - RNA, 16 nt, Shigella flexneri 2a str. 301
auauggcucugcggcg

SEQ ID NO: 2024601 - RNA, 16 nt, Shigella flexneri 2a str. 301
auauguucccgcgccu

SEQ ID NO: 2024602 - RNA, 13 nt, Shigella flexneri 2a str. 301
auauguuuuaaag

SEQ ID NO: 2024603 - RNA, 21 nt, Shigella flexneri 2a str. 301
auaugucuuuuuuccagcaca

SEQ ID NO: 2024604 - RNA, 15 nt, Shigella flexneri 2a str. 301
auaugugaaauuuau

SEQ ID NO: 2024605 - RNA, 15 nt, Shigella flexneri 2a str. 301
auaugucguuauaua

SEQ ID NO: 2024606 - RNA, 17 nt, Shigella flexneri 2a str. 301
auaugucguuauauaaa

SEQ ID NO: 2024607 - RNA, 18 nt, Shigella flexneri 2a str. 301
auaugugaucgaauauau

SEQ ID NO: 2024608 - RNA, 19 nt, Shigella flexneri 2a str. 301
auauuacgagucacaaaca

SEQ ID NO: 2024609 - RNA, 23 nt, Shigella flexneri 2a str. 301
auauuacgagucacaaacaucau

SEQ ID NO: 2024610 - RNA, 17 nt, Shigella flexneri 2a str. 301
auauuacaucuuaaucu

SEQ ID NO: 2024611 - RNA, 19 nt, Shigella flexneri 2a str. 301
auauuaaggguaaaaggau

SEQ ID NO: 2024612 - RNA, 15 nt, Shigella flexneri 2a str. 301
auauuaaucaucauu

SEQ ID NO: 2024613 - RNA, 18 nt, Shigella flexneri 2a str. 301
auauuacaacguauuaua

SEQ ID NO: 2024614 - RNA, 16 nt, Shigella flexneri 2a str. 301
auauuacguuccuuua

SEQ ID NO: 2024615 - RNA, 12 nt, Shigella flexneri 2a str. 301
auauuaauacaa

SEQ ID NO: 2024616 - RNA, 16 nt, Shigella flexneri 2a str. 301
auauuaaauuuuuuca

SEQ ID NO: 2024617 - RNA, 21 nt, Shigella flexneri 2a str. 301
auauucgacaccaucuuccuc

SEQ ID NO: 2024618 - RNA, 21 nt, Shigella flexneri 2a str. 301
auauuccgcaccugccagcgc

SEQ ID NO: 2024619 - RNA, 13 nt, Shigella flexneri 2a str. 301
auauucgcuuuca

SEQ ID NO: 2024620 - RNA, 17 nt, Shigella flexneri 2a str. 301
auauucgccgcccugca

SEQ ID NO: 2024621 - RNA, 17 nt, Shigella flexneri 2a str. 301
auauuauugaaaucacu

SEQ ID NO: 2024622 - RNA, 22 nt, Shigella flexneri 2a str. 301
auauuaucagcaaagcaaauuu

SEQ ID NO: 2024623 - RNA, 20 nt, Shigella flexneri 2a str. 301
aucacaccgcgaucuuccac

SEQ ID NO: 2024624 - RNA, 19 nt, Shigella flexneri 2a str. 301
aucacaccgcgaucuucca

SEQ ID NO: 2024625 - RNA, 19 nt, Shigella flexneri 2a str. 301
aucacaccaguccagcgcc

SEQ ID NO: 2024626 - RNA, 18 nt, Shigella flexneri 2a str. 301
aucacauaaucgaaaaca

SEQ ID NO: 2024627 - RNA, 20 nt, Shigella flexneri 2a str. 301
aucacauccggcaauauuca

SEQ ID NO: 2024628 - RNA, 18 nt, Shigella flexneri 2a str. 301
aucaccaacgauuuuuuc

SEQ ID NO: 2024629 - RNA, 15 nt, Shigella flexneri 2a str. 301
aucacauccugauag

SEQ ID NO: 2024630 - RNA, 17 nt, Shigella flexneri 2a str. 301
aucacaauagaaauauu

SEQ ID NO: 2024631 - RNA, 20 nt, Shigella flexneri 2a str. 301
aucacaauuacugagagaaa

SEQ ID NO: 2024632 - RNA, 23 nt, Shigella flexneri 2a str. 301
aucacaaaacgaauaauugcugg

SEQ ID NO: 2024633 - RNA, 13 nt, Shigella flexneri 2a str. 301
aucacaagaccua

SEQ ID NO: 2024634 - RNA, 12 nt, Shigella flexneri 2a str. 301
aucaauuucaca

SEQ ID NO: 2024635 - RNA, 21 nt, Shigella flexneri 2a str. 301
aucaauuuaucguauuggccg

SEQ ID NO: 2024636 - RNA, 15 nt, Shigella flexneri 2a str. 301
aucaauugcaggaag

SEQ ID NO: 2024637 - RNA, 13 nt, Shigella flexneri 2a str. 301
aucaauuugccca

SEQ ID NO: 2024638 - RNA, 21 nt, Shigella flexneri 2a str. 301
aucaauuuucccuucugagau

SEQ ID NO: 2024639 - RNA, 19 nt, Shigella flexneri 2a str. 301
aucacccuuuucugccgcu

SEQ ID NO: 2024640 - RNA, 20 nt, Shigella flexneri 2a str. 301
aucaccaguaccgccgccau

SEQ ID NO: 2024641 - RNA, 16 nt, Shigella flexneri 2a str. 301
aucaccaugauuucug

SEQ ID NO: 2024642 - RNA, 15 nt, Shigella flexneri 2a str. 301
aucaccaccacgacc

SEQ ID NO: 2024643 - RNA, 22 nt, Shigella flexneri 2a str. 301
aucaccaccaacgcacacaugc

SEQ ID NO: 2024644 - RNA, 15 nt, Shigella flexneri 2a str. 301
aucaccagauugaac

SEQ ID NO: 2024645 - RNA, 23 nt, Shigella flexneri 2a str. 301
aucacuccauccagcaacaacag

SEQ ID NO: 2024646 - RNA, 17 nt, Shigella flexneri 2a str. 301
aucacuccauccagcaa

SEQ ID NO: 2024647 - RNA, 22 nt, Shigella flexneri 2a str. 301
aucacucccuuucugccacgcc

SEQ ID NO: 2024648 - RNA, 14 nt, Shigella flexneri 2a str. 301
aucacucggggcuu

SEQ ID NO: 2024649 - RNA, 13 nt, Shigella flexneri 2a str. 301
aucacugacugcg

SEQ ID NO: 2024650 - RNA, 15 nt, Shigella flexneri 2a str. 301
aucaccugcuggacg

SEQ ID NO: 2024651 - RNA, 19 nt, Shigella flexneri 2a str. 301
aucaccugcauacaaauaa

SEQ ID NO: 2024652 - RNA, 17 nt, Shigella flexneri 2a str. 301
aucacgaagcccauuuc

SEQ ID NO: 2024653 - RNA, 16 nt, Shigella flexneri 2a str. 301
aucagcccagcccuga

SEQ ID NO: 2024654 - RNA, 13 nt, Shigella flexneri 2a str. 301
aucagcaguucac

SEQ ID NO: 2024655 - RNA, 16 nt, Shigella flexneri 2a str. 301
aucagcagcggagaaa

SEQ ID NO: 2024656 - RNA, 21 nt, Shigella flexneri 2a str. 301
aucagcagaaucgcaaccagc

SEQ ID NO: 2024657 - RNA, 16 nt, Shigella flexneri 2a str. 301
aucagcaauuuuuccu

SEQ ID NO: 2024658 - RNA, 17 nt, Shigella flexneri 2a str. 301
aucagaauccggugccu

SEQ ID NO: 2024659 - RNA, 18 nt, Shigella flexneri 2a str. 301
aucagaaacacacuuucc

SEQ ID NO: 2024660 - RNA, 19 nt, Shigella flexneri 2a str. 301
aucagaaacacacuuucca

SEQ ID NO: 2024661 - RNA, 14 nt, Shigella flexneri 2a str. 301
aucacuuccagcag

SEQ ID NO: 2024662 - RNA, 14 nt, Shigella flexneri 2a str. 301
aucagaaaugccag

SEQ ID NO: 2024663 - RNA, 14 nt, Shigella flexneri 2a str. 301
aucagaacguaaac

SEQ ID NO: 2024664 - RNA, 22 nt, Shigella flexneri 2a str. 301
aucagcuaauggcugcgggcga

SEQ ID NO: 2024665 - RNA, 15 nt, Shigella flexneri 2a str. 301
aucagcuccggcagc

SEQ ID NO: 2024666 - RNA, 16 nt, Shigella flexneri 2a str. 301
aucagcuauucuuaua

SEQ ID NO: 2024667 - RNA, 22 nt, Shigella flexneri 2a str. 301
aucagcuccccuggauugcagg

SEQ ID NO: 2024668 - RNA, 19 nt, Shigella flexneri 2a str. 301
aucagcguccagcccuccg

SEQ ID NO: 2024669 - RNA, 16 nt, Shigella flexneri 2a str. 301
aucagcguaacggguc

SEQ ID NO: 2024670 - RNA, 16 nt, Shigella flexneri 2a str. 301
aaaacggaaagcagau

SEQ ID NO: 2024671 - RNA, 19 nt, Shigella flexneri 2a str. 301
aucaguuguucagaaugcc

SEQ ID NO: 2024672 - RNA, 19 nt, Shigella flexneri 2a str. 301
aaaacguccggcaauauag

SEQ ID NO: 2024673 - RNA, 17 nt, Shigella flexneri 2a str. 301
aaaacgucgccagcgcc

SEQ ID NO: 2024674 - RNA, 16 nt, Shigella flexneri 2a str. 301
aaaacgucaugguuau

SEQ ID NO: 2024675 - RNA, 18 nt, Shigella flexneri 2a str. 301
aaaacgucaugguuauuu

SEQ ID NO: 2024676 - RNA, 19 nt, Shigella flexneri 2a str. 301
aaaacgguaguugaacucg

SEQ ID NO: 2024677 - RNA, 22 nt, Shigella flexneri 2a str. 301
aaaacggugaucaaaacgggca

SEQ ID NO: 2024678 - RNA, 19 nt, Shigella flexneri 2a str. 301
aucaguuggaugcugcaua

SEQ ID NO: 2024679 - RNA, 21 nt, Shigella flexneri 2a str. 301
aaaacgaccaccuucaacguu

SEQ ID NO: 2024680 - RNA, 20 nt, Shigella flexneri 2a str. 301
aucagguaagcgauaaaaau

SEQ ID NO: 2024681 - RNA, 15 nt, Shigella flexneri 2a str. 301
aucagguauaccgaa

SEQ ID NO: 2024682 - RNA, 14 nt, Shigella flexneri 2a str. 301
aucaguaagccagc

SEQ ID NO: 2024683 - RNA, 21 nt, Shigella flexneri 2a str. 301
aucaggguuaaaauaccagau

SEQ ID NO: 2024684 - RNA, 14 nt, Shigella flexneri 2a str. 301
aucagguaagcaaa

SEQ ID NO: 2024685 - RNA, 17 nt, Shigella flexneri 2a str. 301
aucaggcuuauuuggca

SEQ ID NO: 2024686 - RNA, 18 nt, Shigella flexneri 2a str. 301
aucaggcaggucuuucac

SEQ ID NO: 2024687 - RNA, 20 nt, Shigella flexneri 2a str. 301
aucaggcaauguugcguuug

SEQ ID NO: 2024688 - RNA, 21 nt, Shigella flexneri 2a str. 301
aucaggcaaugcuuccugcuu

SEQ ID NO: 2024689 - RNA, 14 nt, Shigella flexneri 2a str. 301
aucaggcuaucuuc

SEQ ID NO: 2024690 - RNA, 21 nt, Shigella flexneri 2a str. 301
aucaggcugaaaaucuucucu

SEQ ID NO: 2024691 - RNA, 18 nt, Shigella flexneri 2a str. 301
aucaggcuguguuuaaga

SEQ ID NO: 2024692 - RNA, 19 nt, Shigella flexneri 2a str. 301
caaguauucacucugcugu

SEQ ID NO: 2024693 - RNA, 20 nt, Shigella flexneri 2a str. 301
caagucaacgucauuaucug

SEQ ID NO: 2024694 - RNA, 16 nt, Shigella flexneri 2a str. 301
caagucauuguccagu

SEQ ID NO: 2024695 - RNA, 19 nt, Shigella flexneri 2a str. 301
caaggcauauaccacaccc

SEQ ID NO: 2024696 - RNA, 18 nt, Shigella flexneri 2a str. 301
caaggcaggcaucaauga

SEQ ID NO: 2024697 - RNA, 16 nt, Shigella flexneri 2a str. 301
caaggccaauccagcc

SEQ ID NO: 2024698 - RNA, 12 nt, Shigella flexneri 2a str. 301
caaguaucuauu

SEQ ID NO: 2024699 - RNA, 20 nt, Shigella flexneri 2a str. 301
caagcugcgugagccgaaau

SEQ ID NO: 2024700 - RNA, 15 nt, Shigella flexneri 2a str. 301
caagucuucacugcu

SEQ ID NO: 2024701 - RNA, 18 nt, Shigella flexneri 2a str. 301
caauaaacuucaauauau

SEQ ID NO: 2024702 - RNA, 13 nt, Shigella flexneri 2a str. 301
caauaaaagaaau

SEQ ID NO: 2024703 - RNA, 16 nt, Shigella flexneri 2a str. 301
caaguuacuccuggua

SEQ ID NO: 2024704 - RNA, 17 nt, Shigella flexneri 2a str. 301
caaguucgaacgccgcc

SEQ ID NO: 2024705 - RNA, 23 nt, Shigella flexneri 2a str. 301
caaguucgaacgccgccaguacg

SEQ ID NO: 2024706 - RNA, 16 nt, Shigella flexneri 2a str. 301
caaguuuugucaguuc

SEQ ID NO: 2024707 - RNA, 23 nt, Shigella flexneri 2a str. 301
caauaaguuacacaucauuagua

SEQ ID NO: 2024708 - RNA, 17 nt, Shigella flexneri 2a str. 301
caauaauuucaacaggu

SEQ ID NO: 2024709 - RNA, 15 nt, Shigella flexneri 2a str. 301
caauaauuuacagcc

SEQ ID NO: 2024710 - RNA, 16 nt, Shigella flexneri 2a str. 301
caauaauuuacagccu

SEQ ID NO: 2024711 - RNA, 16 nt, Shigella flexneri 2a str. 301
caauacaccuccggcu

SEQ ID NO: 2024712 - RNA, 22 nt, Shigella flexneri 2a str. 301
caauaccuucugcgcccgcccg

SEQ ID NO: 2024713 - RNA, 12 nt, Shigella flexneri 2a str. 301
caauaccgucug

SEQ ID NO: 2024714 - RNA, 14 nt, Shigella flexneri 2a str. 301
caauaccugucaug

SEQ ID NO: 2024715 - RNA, 22 nt, Shigella flexneri 2a str. 301
caauacagccagccagcaccag

SEQ ID NO: 2024716 - RNA, 21 nt, Shigella flexneri 2a str. 301
caauaccgcguaauacaucag

SEQ ID NO: 2024717 - RNA, 21 nt, Shigella flexneri 2a str. 301
caauaccgccugcaaauaaau

SEQ ID NO: 2024718 - RNA, 14 nt, Shigella flexneri 2a str. 301
caauacgauuaacg

SEQ ID NO: 2024719 - RNA, 16 nt, Shigella flexneri 2a str. 301
caauacgcauaugcau

SEQ ID NO: 2024720 - RNA, 16 nt, Shigella flexneri 2a str. 301
caauacgcccacguuu

SEQ ID NO: 2024721 - RNA, 16 nt, Shigella flexneri 2a str. 301
caauauauugcaauca

SEQ ID NO: 2024722 - RNA, 18 nt, Shigella flexneri 2a str. 301
caauauauugaauuugca

SEQ ID NO: 2024723 - RNA, 13 nt, Shigella flexneri 2a str. 301
caauaucaaauaa

SEQ ID NO: 2024724 - RNA, 14 nt, Shigella flexneri 2a str. 301
caauaucaaauaaa

SEQ ID NO: 2024725 - RNA, 15 nt, Shigella flexneri 2a str. 301
caauauccaacaggu

SEQ ID NO: 2024726 - RNA, 23 nt, Shigella flexneri 2a str. 301
caauauccaccgggguaaaucca

SEQ ID NO: 2024727 - RNA, 17 nt, Shigella flexneri 2a str. 301
caauaucauuacgccag

SEQ ID NO: 2024728 - RNA, 23 nt, Shigella flexneri 2a str. 301
caauauccugcgcuuccugcaac

SEQ ID NO: 2024729 - RNA, 13 nt, Shigella flexneri 2a str. 301
caauauccugacc

SEQ ID NO: 2024730 - RNA, 19 nt, Shigella flexneri 2a str. 301
caaucacccccaccccggc

SEQ ID NO: 2024731 - RNA, 16 nt, Shigella flexneri 2a str. 301
caaucaccgccagcgg

SEQ ID NO: 2024732 - RNA, 19 nt, Shigella flexneri 2a str. 301
caaucaccgccagcggcgu

SEQ ID NO: 2024733 - RNA, 12 nt, Shigella flexneri 2a str. 301
caaucacgcccg

SEQ ID NO: 2024734 - RNA, 16 nt, Shigella flexneri 2a str. 301
caaucacgauagccag

SEQ ID NO: 2024735 - RNA, 15 nt, Shigella flexneri 2a str. 301
caaucaccgccagcg

SEQ ID NO: 2024736 - RNA, 15 nt, Shigella flexneri 2a str. 301
caaucacaaaaagua

SEQ ID NO: 2024737 - RNA, 16 nt, Shigella flexneri 2a str. 301
caaucaaacucaauua

SEQ ID NO: 2024738 - RNA, 12 nt, Shigella flexneri 2a str. 301
caaucacaaaua

SEQ ID NO: 2024739 - RNA, 12 nt, Shigella flexneri 2a str. 301
caauauuuugaa

SEQ ID NO: 2024740 - RNA, 12 nt, Shigella flexneri 2a str. 301
caaucaaaugac

SEQ ID NO: 2024741 - RNA, 11 nt, Shigella flexneri 2a str. 301
caaucaaauac

SEQ ID NO: 2024742 - RNA, 16 nt, Shigella flexneri 2a str. 301
caaucaaauuauccac

SEQ ID NO: 2024743 - RNA, 17 nt, Shigella flexneri 2a str. 301
caaucaaauuauccacg

SEQ ID NO: 2024744 - RNA, 14 nt, Shigella flexneri 2a str. 301
caaucaggcuaucg

SEQ ID NO: 2024745 - RNA, 21 nt, Shigella flexneri 2a str. 301
caaucagguaagcaaaggugc

SEQ ID NO: 2024746 - RNA, 23 nt, Shigella flexneri 2a str. 301
caaucagguaagcgauaaaaaua

SEQ ID NO: 2024747 - RNA, 12 nt, Shigella flexneri 2a str. 301
caaucagcaccg

SEQ ID NO: 2024748 - RNA, 12 nt, Shigella flexneri 2a str. 301
caaucagccaga

SEQ ID NO: 2024749 - RNA, 19 nt, Shigella flexneri 2a str. 301
caaucagcgcagcacccag

SEQ ID NO: 2024750 - RNA, 16 nt, Shigella flexneri 2a str. 301
caaucagauaaaauac

SEQ ID NO: 2024751 - RNA, 13 nt, Shigella flexneri 2a str. 301
caaucagagccau

SEQ ID NO: 2024752 - RNA, 12 nt, Shigella flexneri 2a str. 301
caaucagauaaa

SEQ ID NO: 2024753 - RNA, 14 nt, Shigella flexneri 2a str. 301
caaucagcaauaaa

SEQ ID NO: 2024754 - RNA, 12 nt, Shigella flexneri 2a str. 301
caaucacuuugu

SEQ ID NO: 2024755 - RNA, 14 nt, Shigella flexneri 2a str. 301
caaucacugccaga

SEQ ID NO: 2024756 - RNA, 14 nt, Shigella flexneri 2a str. 301
caaucccccacuuu

SEQ ID NO: 2024757 - RNA, 14 nt, Shigella flexneri 2a str. 301
caauccccgccagc

SEQ ID NO: 2024758 - RNA, 18 nt, Shigella flexneri 2a str. 301
caauccccagaccugcug

SEQ ID NO: 2024759 - RNA, 17 nt, Shigella flexneri 2a str. 301
caauccauaccagcaca

SEQ ID NO: 2024760 - RNA, 13 nt, Shigella flexneri 2a str. 301
caauccaguccac

SEQ ID NO: 2024761 - RNA, 23 nt, Shigella flexneri 2a str. 301
caauccaguacaugaagcacugc

SEQ ID NO: 2024762 - RNA, 13 nt, Shigella flexneri 2a str. 301
caauccagcccug

SEQ ID NO: 2024763 - RNA, 14 nt, Shigella flexneri 2a str. 301
caaucgaccaggcc

SEQ ID NO: 2024764 - RNA, 15 nt, Shigella flexneri 2a str. 301
caaucgacuuuucau

SEQ ID NO: 2024765 - RNA, 13 nt, Shigella flexneri 2a str. 301
caaucgagcccag

SEQ ID NO: 2024766 - RNA, 18 nt, Shigella flexneri 2a str. 301
caaucgagauacgacuga

SEQ ID NO: 2024767 - RNA, 20 nt, Shigella flexneri 2a str. 301
caaucgcagcacuggugcug

SEQ ID NO: 2024768 - RNA, 14 nt, Shigella flexneri 2a str. 301
caaucuacaaaaga

SEQ ID NO: 2024769 - RNA, 18 nt, Shigella flexneri 2a str. 301
caaucuacaaaagauuau

SEQ ID NO: 2024770 - RNA, 17 nt, Shigella flexneri 2a str. 301
caaucugcuggcaaacg

SEQ ID NO: 2024771 - RNA, 14 nt, Shigella flexneri 2a str. 301
caaucugauugaca

SEQ ID NO: 2024772 - RNA, 14 nt, Shigella flexneri 2a str. 301
caaucugcaaaaua

SEQ ID NO: 2024773 - RNA, 18 nt, Shigella flexneri 2a str. 301
caaucugauagugaucca

SEQ ID NO: 2024774 - RNA, 13 nt, Shigella flexneri 2a str. 301
caaucucacuccg

SEQ ID NO: 2024775 - RNA, 15 nt, Shigella flexneri 2a str. 301
caaucugaagccgca

SEQ ID NO: 2024776 - RNA, 16 nt, Shigella flexneri 2a str. 301
caagauacugcauaau

SEQ ID NO: 2024777 - RNA, 20 nt, Shigella flexneri 2a str. 301
caagauauuccgucuccgga

SEQ ID NO: 2024778 - RNA, 20 nt, Shigella flexneri 2a str. 301
caagauagcgcguugcgcca

SEQ ID NO: 2024779 - RNA, 18 nt, Shigella flexneri 2a str. 301
caagaucagcauccauau

SEQ ID NO: 2024780 - RNA, 14 nt, Shigella flexneri 2a str. 301
caagaucauacuga

SEQ ID NO: 2024781 - RNA, 21 nt, Shigella flexneri 2a str. 301
caagauauuucaccagcgcac

SEQ ID NO: 2024782 - RNA, 21 nt, Shigella flexneri 2a str. 301
caagaucucauuccaccgaaa

SEQ ID NO: 2024783 - RNA, 16 nt, Shigella flexneri 2a str. 301
caagaucgcccugagg

SEQ ID NO: 2024784 - RNA, 18 nt, Shigella flexneri 2a str. 301
caagaucgcgcaucagcu

SEQ ID NO: 2024785 - RNA, 15 nt, Shigella flexneri 2a str. 301
caagagcaaauaaaa

SEQ ID NO: 2024786 - RNA, 16 nt, Shigella flexneri 2a str. 301
caagaauuaaaauauc

SEQ ID NO: 2024787 - RNA, 17 nt, Shigella flexneri 2a str. 301
caagaauuacuucuuga

SEQ ID NO: 2024788 - RNA, 19 nt, Shigella flexneri 2a str. 301
caagaaugccugccagcuu

SEQ ID NO: 2024789 - RNA, 13 nt, Shigella flexneri 2a str. 301
caagaaucaugcc

SEQ ID NO: 2024790 - RNA, 16 nt, Shigella flexneri 2a str. 301
caagaaucaugccaaa

SEQ ID NO: 2024791 - RNA, 17 nt, Shigella flexneri 2a str. 301
caagaauacuguccaua

SEQ ID NO: 2024792 - RNA, 16 nt, Shigella flexneri 2a str. 301
caacuucgcuaaaucu

SEQ ID NO: 2024793 - RNA, 19 nt, Shigella flexneri 2a str. 301
caacuucaaggucaacauu

SEQ ID NO: 2024794 - RNA, 16 nt, Shigella flexneri 2a str. 301
caacuucagcagcagc

SEQ ID NO: 2024795 - RNA, 17 nt, Shigella flexneri 2a str. 301
caacuucagcaacaaaa

SEQ ID NO: 2024796 - RNA, 20 nt, Shigella flexneri 2a str. 301
caacuucagcaacaaaaugg

SEQ ID NO: 2024797 - RNA, 19 nt, Shigella flexneri 2a str. 301
caagcuaacgaacgcagug

SEQ ID NO: 2024798 - RNA, 15 nt, Shigella flexneri 2a str. 301
caagcucgcagagau

SEQ ID NO: 2024799 - RNA, 16 nt, Shigella flexneri 2a str. 301
caagcucgccaccauu

SEQ ID NO: 2024800 - RNA, 20 nt, Shigella flexneri 2a str. 301
caagcgauaacucgcuuugc

SEQ ID NO: 2024801 - RNA, 14 nt, Shigella flexneri 2a str. 301
caagcguugcuuca

SEQ ID NO: 2024802 - RNA, 15 nt, Shigella flexneri 2a str. 301
caagcgcagcgcccc

SEQ ID NO: 2024803 - RNA, 22 nt, Shigella flexneri 2a str. 301
caagccgaauaacggcucaaac

SEQ ID NO: 2024804 - RNA, 23 nt, Shigella flexneri 2a str. 301
caagccgaauaacggcucaaacu

SEQ ID NO: 2024805 - RNA, 22 nt, Shigella flexneri 2a str. 301
caagccacaauaaacgcgcagg

SEQ ID NO: 2024806 - RNA, 17 nt, Shigella flexneri 2a str. 301
caagaugcuugcgauau

SEQ ID NO: 2024807 - RNA, 18 nt, Shigella flexneri 2a str. 301
caagaucgcucaucagcu

SEQ ID NO: 2024808 - RNA, 19 nt, Shigella flexneri 2a str. 301
caagcaugggugaacugcu

SEQ ID NO: 2024809 - RNA, 23 nt, Shigella flexneri 2a str. 301
caagcaucguuguuacaacauca

SEQ ID NO: 2024810 - RNA, 19 nt, Shigella flexneri 2a str. 301
caagcaugaucgaggcaaa

SEQ ID NO: 2024811 - RNA, 20 nt, Shigella flexneri 2a str. 301
caagcaguugguuaaucuuu

SEQ ID NO: 2024812 - RNA, 23 nt, Shigella flexneri 2a str. 301
caagcaguugguuaaucuuuucu

SEQ ID NO: 2024813 - RNA, 17 nt, Shigella flexneri 2a str. 301
caacucauuuacagaaa

SEQ ID NO: 2024814 - RNA, 16 nt, Shigella flexneri 2a str. 301
caacucacgccccaga

SEQ ID NO: 2024815 - RNA, 23 nt, Shigella flexneri 2a str. 301
caacguuaucgccgacaaacaau

SEQ ID NO: 2024816 - RNA, 15 nt, Shigella flexneri 2a str. 301
caacguaacaaaacu

SEQ ID NO: 2024817 - RNA, 18 nt, Shigella flexneri 2a str. 301
caacguagcguuaaaacu

SEQ ID NO: 2024818 - RNA, 13 nt, Shigella flexneri 2a str. 301
caacguagccugc

SEQ ID NO: 2024819 - RNA, 17 nt, Shigella flexneri 2a str. 301
caacguacucugccacu

SEQ ID NO: 2024820 - RNA, 18 nt, Shigella flexneri 2a str. 301
caacgguugauggcaguc

SEQ ID NO: 2024821 - RNA, 18 nt, Shigella flexneri 2a str. 301
caacggugcggcucucuu

SEQ ID NO: 2024822 - RNA, 18 nt, Shigella flexneri 2a str. 301
caacucauuuacagaaac

SEQ ID NO: 2024823 - RNA, 19 nt, Shigella flexneri 2a str. 301
caacucauuuacagaaacu

SEQ ID NO: 2024824 - RNA, 13 nt, Shigella flexneri 2a str. 301
caacucaucgccg

SEQ ID NO: 2024825 - RNA, 16 nt, Shigella flexneri 2a str. 301
caacucuuuuuccugc

SEQ ID NO: 2024826 - RNA, 17 nt, Shigella flexneri 2a str. 301
caacucugggcugaaga

SEQ ID NO: 2024827 - RNA, 23 nt, Shigella flexneri 2a str. 301
caacugcuucaaaaaaauucuga

SEQ ID NO: 2024828 - RNA, 23 nt, Shigella flexneri 2a str. 301
caacugcugcgguugaacgccaa

SEQ ID NO: 2024829 - RNA, 20 nt, Shigella flexneri 2a str. 301
caacugcgugcugagcggcg

SEQ ID NO: 2024830 - RNA, 21 nt, Shigella flexneri 2a str. 301
caacuggagcaggaacuuggc

SEQ ID NO: 2024831 - RNA, 18 nt, Shigella flexneri 2a str. 301
caacugcuuuuugcucuc

SEQ ID NO: 2024832 - RNA, 19 nt, Shigella flexneri 2a str. 301
caaccguaaacgaucaucg

SEQ ID NO: 2024833 - RNA, 21 nt, Shigella flexneri 2a str. 301
caaccguggcguaaaucaucg

SEQ ID NO: 2024834 - RNA, 21 nt, Shigella flexneri 2a str. 301
caaccguugccgaacguaggc

SEQ ID NO: 2024835 - RNA, 19 nt, Shigella flexneri 2a str. 301
caaccguuugauugaaaaa

SEQ ID NO: 2024836 - RNA, 15 nt, Shigella flexneri 2a str. 301
caaccuagccuuccu

SEQ ID NO: 2024837 - RNA, 20 nt, Shigella flexneri 2a str. 301
caacgccuuccgucagcaaa

SEQ ID NO: 2024838 - RNA, 14 nt, Shigella flexneri 2a str. 301
caaccucuucuuuu

SEQ ID NO: 2024839 - RNA, 14 nt, Shigella flexneri 2a str. 301
caacgcgccaccga

SEQ ID NO: 2024840 - RNA, 14 nt, Shigella flexneri 2a str. 301
caacgcgccgccaa

SEQ ID NO: 2024841 - RNA, 12 nt, Shigella flexneri 2a str. 301
caacgcgcggcu

SEQ ID NO: 2024842 - RNA, 13 nt, Shigella flexneri 2a str. 301
caacgcgcgguga

SEQ ID NO: 2024843 - RNA, 20 nt, Shigella flexneri 2a str. 301
caacgcguuuuuucgauauc

SEQ ID NO: 2024844 - RNA, 19 nt, Shigella flexneri 2a str. 301
caacgcguggaucaagcaa

SEQ ID NO: 2024845 - RNA, 21 nt, Shigella flexneri 2a str. 301
caacgcguggaucaagcaaca

SEQ ID NO: 2024846 - RNA, 14 nt, Shigella flexneri 2a str. 301
caacgcucuccugc

SEQ ID NO: 2024847 - RNA, 17 nt, Shigella flexneri 2a str. 301
caacgcugaauggcgau

SEQ ID NO: 2024848 - RNA, 11 nt, Shigella flexneri 2a str. 301
caacgcugucc

SEQ ID NO: 2024849 - RNA, 20 nt, Shigella flexneri 2a str. 301
caacggaccaauaaacgcca

SEQ ID NO: 2024850 - RNA, 20 nt, Shigella flexneri 2a str. 301
caacggaacgaaaaaaauca

SEQ ID NO: 2024851 - RNA, 21 nt, Shigella flexneri 2a str. 301
caacggcaacaauucccgcag

SEQ ID NO: 2024852 - RNA, 15 nt, Shigella flexneri 2a str. 301
caacggcaaacacgc

SEQ ID NO: 2024853 - RNA, 15 nt, Shigella flexneri 2a str. 301
caacggauauuguuu

SEQ ID NO: 2024854 - RNA, 19 nt, Shigella flexneri 2a str. 301
caacggcgaaagcuggcac

SEQ ID NO: 2024855 - RNA, 22 nt, Shigella flexneri 2a str. 301
caacggcugcuucggucagcac

SEQ ID NO: 2024856 - RNA, 16 nt, Shigella flexneri 2a str. 301
caacgggcaccgccgc

SEQ ID NO: 2024857 - RNA, 23 nt, Shigella flexneri 2a str. 301
caaaucgucgguguccacuuccg

SEQ ID NO: 2024858 - RNA, 19 nt, Shigella flexneri 2a str. 301
caaaucugauuaauauuga

SEQ ID NO: 2024859 - RNA, 15 nt, Shigella flexneri 2a str. 301
caaaucuuauaugau

SEQ ID NO: 2024860 - RNA, 14 nt, Shigella flexneri 2a str. 301
caaaugaacaccaa

SEQ ID NO: 2024861 - RNA, 15 nt, Shigella flexneri 2a str. 301
caaaugucaccagcc

SEQ ID NO: 2024862 - RNA, 22 nt, Shigella flexneri 2a str. 301
caaauguaaaaccaacaguauc

SEQ ID NO: 2024863 - RNA, 19 nt, Shigella flexneri 2a str. 301
caacaaaaaucucgacuuc

SEQ ID NO: 2024864 - RNA, 19 nt, Shigella flexneri 2a str. 301
caaauucucuauuucaccc

SEQ ID NO: 2024865 - RNA, 19 nt, Shigella flexneri 2a str. 301
caaauguugucucagauuc

SEQ ID NO: 2024866 - RNA, 16 nt, Shigella flexneri 2a str. 301
caaauuccgaacaaaa

SEQ ID NO: 2024867 - RNA, 18 nt, Shigella flexneri 2a str. 301
caaauguugcaucgccug

SEQ ID NO: 2024868 - RNA, 22 nt, Shigella flexneri 2a str. 301
caaauguugcaucgccugcgcg

SEQ ID NO: 2024869 - RNA, 19 nt, Shigella flexneri 2a str. 301
caaauguugcguucaucag

SEQ ID NO: 2024870 - RNA, 17 nt, Shigella flexneri 2a str. 301
caaauuaaacgggcgau

SEQ ID NO: 2024871 - RNA, 14 nt, Shigella flexneri 2a str. 301
caaagucuccuuug

SEQ ID NO: 2024872 - RNA, 17 nt, Shigella flexneri 2a str. 301
caaaguacggacgcggc

SEQ ID NO: 2024873 - RNA, 21 nt, Shigella flexneri 2a str. 301
caaaguaccaucguccagcag

SEQ ID NO: 2024874 - RNA, 18 nt, Shigella flexneri 2a str. 301
caaauaucuuauagacua

SEQ ID NO: 2024875 - RNA, 20 nt, Shigella flexneri 2a str. 301
caaauaucuauauacaauca

SEQ ID NO: 2024876 - RNA, 15 nt, Shigella flexneri 2a str. 301
caaauauuucuuuau

SEQ ID NO: 2024877 - RNA, 20 nt, Shigella flexneri 2a str. 301
caaauagugccuggcugcgu

SEQ ID NO: 2024878 - RNA, 15 nt, Shigella flexneri 2a str. 301
caaaucggaacaaca

SEQ ID NO: 2024879 - RNA, 16 nt, Shigella flexneri 2a str. 301
caaaucggaacaacag

SEQ ID NO: 2024880 - RNA, 13 nt, Shigella flexneri 2a str. 301
caaaucgcugaau

SEQ ID NO: 2024881 - RNA, 16 nt, Shigella flexneri 2a str. 301
caaauccuuccagcuc

SEQ ID NO: 2024882 - RNA, 14 nt, Shigella flexneri 2a str. 301
caaaucgaaaucaa

SEQ ID NO: 2024883 - RNA, 14 nt, Shigella flexneri 2a str. 301
caaauccgcacuca

SEQ ID NO: 2024884 - RNA, 17 nt, Shigella flexneri 2a str. 301
caaauccgcacucaucu

SEQ ID NO: 2024885 - RNA, 18 nt, Shigella flexneri 2a str. 301
caaauccaucagaccuuc

SEQ ID NO: 2024886 - RNA, 17 nt, Shigella flexneri 2a str. 301
caaauccagcgccacau

SEQ ID NO: 2024887 - RNA, 16 nt, Shigella flexneri 2a str. 301
caaaucauccagaccg

SEQ ID NO: 2024888 - RNA, 19 nt, Shigella flexneri 2a str. 301
caaaucaguggcuggaaca

SEQ ID NO: 2024889 - RNA, 14 nt, Shigella flexneri 2a str. 301
caaaucauaaaaau

SEQ ID NO: 2024890 - RNA, 19 nt, Shigella flexneri 2a str. 301
caaaucacuauuaaagaaa

SEQ ID NO: 2024891 - RNA, 20 nt, Shigella flexneri 2a str. 301
caaaucacuauuaaagaaag

SEQ ID NO: 2024892 - RNA, 18 nt, Shigella flexneri 2a str. 301
caaccagcuuaugccugu

SEQ ID NO: 2024893 - RNA, 13 nt, Shigella flexneri 2a str. 301
caacauuuccccc

SEQ ID NO: 2024894 - RNA, 16 nt, Shigella flexneri 2a str. 301
caaccagcccaugaau

SEQ ID NO: 2024895 - RNA, 14 nt, Shigella flexneri 2a str. 301
caacaugaaacaga

SEQ ID NO: 2024896 - RNA, 15 nt, Shigella flexneri 2a str. 301
caacaugagaacagu

SEQ ID NO: 2024897 - RNA, 16 nt, Shigella flexneri 2a str. 301
caacaugagaacaguu

SEQ ID NO: 2024898 - RNA, 15 nt, Shigella flexneri 2a str. 301
caacaugcagcccag

SEQ ID NO: 2024899 - RNA, 20 nt, Shigella flexneri 2a str. 301
caacaugcggugauuuugcc

SEQ ID NO: 2024900 - RNA, 16 nt, Shigella flexneri 2a str. 301
caacccggcgaaagag

SEQ ID NO: 2024901 - RNA, 21 nt, Shigella flexneri 2a str. 301
caaccaugguuucgaacgcca

SEQ ID NO: 2024902 - RNA, 13 nt, Shigella flexneri 2a str. 301
caaccauccccaa

SEQ ID NO: 2024903 - RNA, 16 nt, Shigella flexneri 2a str. 301
caaccauccccaaaaa

SEQ ID NO: 2024904 - RNA, 19 nt, Shigella flexneri 2a str. 301
caaccauccgucauccaua

SEQ ID NO: 2024905 - RNA, 20 nt, Shigella flexneri 2a str. 301
caaccauccgucauccauac

SEQ ID NO: 2024906 - RNA, 23 nt, Shigella flexneri 2a str. 301
caaccaucgguacgcuuucaccc

SEQ ID NO: 2024907 - RNA, 19 nt, Shigella flexneri 2a str. 301
caaccaguugugcaccacc

SEQ ID NO: 2024908 - RNA, 12 nt, Shigella flexneri 2a str. 301
caacccugcccu

SEQ ID NO: 2024909 - RNA, 15 nt, Shigella flexneri 2a str. 301
caacccugcccuuca

SEQ ID NO: 2024910 - RNA, 22 nt, Shigella flexneri 2a str. 301
caacccuaaagcacccagcaau

SEQ ID NO: 2024911 - RNA, 17 nt, Shigella flexneri 2a str. 301
caacccggcgaaagagc

SEQ ID NO: 2024912 - RNA, 20 nt, Shigella flexneri 2a str. 301
caacccggcgaaagagcugg

SEQ ID NO: 2024913 - RNA, 20 nt, Shigella flexneri 2a str. 301
caacccgugagucuccuuua

SEQ ID NO: 2024914 - RNA, 19 nt, Shigella flexneri 2a str. 301
caaccgaacccagcagguc

SEQ ID NO: 2024915 - RNA, 16 nt, Shigella flexneri 2a str. 301
caacccuuuccagcgc

SEQ ID NO: 2024916 - RNA, 14 nt, Shigella flexneri 2a str. 301
caaccggcacaaua

SEQ ID NO: 2024917 - RNA, 22 nt, Shigella flexneri 2a str. 301
caacagcgugaacugggccugc

SEQ ID NO: 2024918 - RNA, 19 nt, Shigella flexneri 2a str. 301
caacagcguuucuucgaca

SEQ ID NO: 2024919 - RNA, 18 nt, Shigella flexneri 2a str. 301
caacagcgccgagcaccg

SEQ ID NO: 2024920 - RNA, 17 nt, Shigella flexneri 2a str. 301
caacagucgccacgcgc

SEQ ID NO: 2024921 - RNA, 11 nt, Shigella flexneri 2a str. 301
caacaucaucu

SEQ ID NO: 2024922 - RNA, 12 nt, Shigella flexneri 2a str. 301
caacaucaucuu

SEQ ID NO: 2024923 - RNA, 20 nt, Shigella flexneri 2a str. 301
caacauccgggcgaacuggc

SEQ ID NO: 2024924 - RNA, 23 nt, Shigella flexneri 2a str. 301
caacaucgcauucgacauugaau

SEQ ID NO: 2024925 - RNA, 14 nt, Shigella flexneri 2a str. 301
caacaccacugcca

SEQ ID NO: 2024926 - RNA, 12 nt, Shigella flexneri 2a str. 301
caacaacaccca

SEQ ID NO: 2024927 - RNA, 14 nt, Shigella flexneri 2a str. 301
caacaacacauuca

SEQ ID NO: 2024928 - RNA, 15 nt, Shigella flexneri 2a str. 301
caacaaauaaaagca

SEQ ID NO: 2024929 - RNA, 18 nt, Shigella flexneri 2a str. 301
caacaaauaaaagcaaaa

SEQ ID NO: 2024930 - RNA, 19 nt, Shigella flexneri 2a str. 301
caacaaagccacuuaauaa

SEQ ID NO: 2024931 - RNA, 16 nt, Shigella flexneri 2a str. 301
caacaaacgcaaacac

SEQ ID NO: 2024932 - RNA, 19 nt, Shigella flexneri 2a str. 301
caaauuuaucgauaacagg

SEQ ID NO: 2024933 - RNA, 16 nt, Shigella flexneri 2a str. 301
caacagcagccacacc

SEQ ID NO: 2024934 - RNA, 18 nt, Shigella flexneri 2a str. 301
caaaauagguaucguaau

SEQ ID NO: 2024935 - RNA, 19 nt, Shigella flexneri 2a str. 301
caaaauagccaaucauucc

SEQ ID NO: 2024936 - RNA, 14 nt, Shigella flexneri 2a str. 301
caaaauccaccagu

SEQ ID NO: 2024937 - RNA, 19 nt, Shigella flexneri 2a str. 301
caaaaucccacugccaauc

SEQ ID NO: 2024938 - RNA, 18 nt, Shigella flexneri 2a str. 301
caaaaucuauugcaacau

SEQ ID NO: 2024939 - RNA, 15 nt, Shigella flexneri 2a str. 301
caaaauccgccaccg

SEQ ID NO: 2024940 - RNA, 14 nt, Shigella flexneri 2a str. 301
caaaauuaucacaa

SEQ ID NO: 2024941 - RNA, 12 nt, Shigella flexneri 2a str. 301
caaaauuauucc

SEQ ID NO: 2024942 - RNA, 17 nt, Shigella flexneri 2a str. 301
caaaaucuuaaagaugc

SEQ ID NO: 2024943 - RNA, 17 nt, Shigella flexneri 2a str. 301
caaaauguuaucgggca

SEQ ID NO: 2024944 - RNA, 18 nt, Shigella flexneri 2a str. 301
caaaaggcaauucaauua

SEQ ID NO: 2024945 - RNA, 18 nt, Shigella flexneri 2a str. 301
caaaaggcgaaaccuccg

SEQ ID NO: 2024946 - RNA, 15 nt, Shigella flexneri 2a str. 301
caaaagcuaacagag

SEQ ID NO: 2024947 - RNA, 13 nt, Shigella flexneri 2a str. 301
caaaauaccaaua

SEQ ID NO: 2024948 - RNA, 18 nt, Shigella flexneri 2a str. 301
caaaagugguguugaaga

SEQ ID NO: 2024949 - RNA, 21 nt, Shigella flexneri 2a str. 301
caaaagugguguugaagaaac

SEQ ID NO: 2024950 - RNA, 20 nt, Shigella flexneri 2a str. 301
caaaauacguucucaccucu

SEQ ID NO: 2024951 - RNA, 16 nt, Shigella flexneri 2a str. 301
caaaauacuguuuauc

SEQ ID NO: 2024952 - RNA, 17 nt, Shigella flexneri 2a str. 301
caaaacgaauaauugcu

SEQ ID NO: 2024953 - RNA, 16 nt, Shigella flexneri 2a str. 301
caaaacgcgacugcaa

SEQ ID NO: 2024954 - RNA, 21 nt, Shigella flexneri 2a str. 301
caaaacgcgacugcaaaaagc

SEQ ID NO: 2024955 - RNA, 18 nt, Shigella flexneri 2a str. 301
caaaacgugcagcugccu

SEQ ID NO: 2024956 - RNA, 20 nt, Shigella flexneri 2a str. 301
caaaacguggccuccaaaaa

SEQ ID NO: 2024957 - RNA, 16 nt, Shigella flexneri 2a str. 301
caaaacgugacagcau

SEQ ID NO: 2024958 - RNA, 13 nt, Shigella flexneri 2a str. 301
caaaaacuuccau

SEQ ID NO: 2024959 - RNA, 12 nt, Shigella flexneri 2a str. 301
caaaaacgccau

SEQ ID NO: 2024960 - RNA, 16 nt, Shigella flexneri 2a str. 301
caaaaccucuuccagc

SEQ ID NO: 2024961 - RNA, 21 nt, Shigella flexneri 2a str. 301
caaaaccucuuccagcagaua

SEQ ID NO: 2024962 - RNA, 16 nt, Shigella flexneri 2a str. 301
caaaaagauuaaaaaa

SEQ ID NO: 2024963 - RNA, 19 nt, Shigella flexneri 2a str. 301
caaaacuggugguaagaau

SEQ ID NO: 2024964 - RNA, 14 nt, Shigella flexneri 2a str. 301
caaaagaacacgac

SEQ ID NO: 2024965 - RNA, 23 nt, Shigella flexneri 2a str. 301
caaaagcauuuggugucgcugaa

SEQ ID NO: 2024966 - RNA, 15 nt, Shigella flexneri 2a str. 301
caaaccucaggaaua

SEQ ID NO: 2024967 - RNA, 15 nt, Shigella flexneri 2a str. 301
caaaccucaccgcua

SEQ ID NO: 2024968 - RNA, 14 nt, Shigella flexneri 2a str. 301
caaaccucaccgcu

SEQ ID NO: 2024969 - RNA, 21 nt, Shigella flexneri 2a str. 301
caaacgugacauucugacugg

SEQ ID NO: 2024970 - RNA, 22 nt, Shigella flexneri 2a str. 301
caaacgugagcgguuucgccuc

SEQ ID NO: 2024971 - RNA, 15 nt, Shigella flexneri 2a str. 301
caaacuuaccgccgc

SEQ ID NO: 2024972 - RNA, 21 nt, Shigella flexneri 2a str. 301
caaacugguguugaaaccgcu

SEQ ID NO: 2024973 - RNA, 13 nt, Shigella flexneri 2a str. 301
caaacuuaacacu

SEQ ID NO: 2024974 - RNA, 17 nt, Shigella flexneri 2a str. 301
caaacuuaccgccgcuc

SEQ ID NO: 2024975 - RNA, 22 nt, Shigella flexneri 2a str. 301
caaacuugauagaacaaaagac

SEQ ID NO: 2024976 - RNA, 21 nt, Shigella flexneri 2a str. 301
caaacuugaacuuaucaucag

SEQ ID NO: 2024977 - RNA, 16 nt, Shigella flexneri 2a str. 301
caaacgcuuuacucaa

SEQ ID NO: 2024978 - RNA, 23 nt, Shigella flexneri 2a str. 301
caaacgcuuuacucaacuccccg

SEQ ID NO: 2024979 - RNA, 19 nt, Shigella flexneri 2a str. 301
caaaccugcaaugauguca

SEQ ID NO: 2024980 - RNA, 23 nt, Shigella flexneri 2a str. 301
caaaccuggcauguggcggcgcg

SEQ ID NO: 2024981 - RNA, 15 nt, Shigella flexneri 2a str. 301
caaacggcuggaaca

SEQ ID NO: 2024982 - RNA, 21 nt, Shigella flexneri 2a str. 301
caaacggcgcuuccagcaaau

SEQ ID NO: 2024983 - RNA, 13 nt, Shigella flexneri 2a str. 301
caaacggcuggaa

SEQ ID NO: 2024984 - RNA, 20 nt, Shigella flexneri 2a str. 301
caaacgugacauucugacug

SEQ ID NO: 2024985 - RNA, 17 nt, Shigella flexneri 2a str. 301
caaagaaauccacaaau

SEQ ID NO: 2024986 - RNA, 18 nt, Shigella flexneri 2a str. 301
caaagaaccaacgcugcc

SEQ ID NO: 2024987 - RNA, 20 nt, Shigella flexneri 2a str. 301
caaagacgcgguaaaagccc

SEQ ID NO: 2024988 - RNA, 23 nt, Shigella flexneri 2a str. 301
caaagauguugucauuacaacaa

SEQ ID NO: 2024989 - RNA, 16 nt, Shigella flexneri 2a str. 301
caaagauuuuaccaau

SEQ ID NO: 2024990 - RNA, 17 nt, Shigella flexneri 2a str. 301
caaagccgcgugcgcug

SEQ ID NO: 2024991 - RNA, 16 nt, Shigella flexneri 2a str. 301
caaaggcgugaacuuc

SEQ ID NO: 2024992 - RNA, 17 nt, Shigella flexneri 2a str. 301
caaaggcgaguucaauc

SEQ ID NO: 2024993 - RNA, 19 nt, Shigella flexneri 2a str. 301
caaaggccagcaaucccca

SEQ ID NO: 2024994 - RNA, 23 nt, Shigella flexneri 2a str. 301
caaagcgcacuuugucaaaaauc

SEQ ID NO: 2024995 - RNA, 13 nt, Shigella flexneri 2a str. 301
caaagcgcagccg

SEQ ID NO: 2024996 - RNA, 23 nt, Shigella flexneri 2a str. 301
caaagcgcacuuuacuggucugu

SEQ ID NO: 2024997 - RNA, 23 nt, Shigella flexneri 2a str. 301
cacccugcccguuucucuuaaau

SEQ ID NO: 2024998 - RNA, 15 nt, Shigella flexneri 2a str. 301
cacccuugaugcaga

SEQ ID NO: 2024999 - RNA, 15 nt, Shigella flexneri 2a str. 301
caccgaggcauucag

SEQ ID NO: 2025000 - RNA, 17 nt, Shigella flexneri 2a str. 301
caccgaggcauucagcc

SEQ ID NO: 2025001 - RNA, 18 nt, Shigella flexneri 2a str. 301
caccgacguuugcgccca

SEQ ID NO: 2025002 - RNA, 18 nt, Shigella flexneri 2a str. 301
caccgaccaucccaccac

SEQ ID NO: 2025003 - RNA, 20 nt, Shigella flexneri 2a str. 301
cacccguaacauggcgguaa

SEQ ID NO: 2025004 - RNA, 15 nt, Shigella flexneri 2a str. 301
cacccgucguugcaa

SEQ ID NO: 2025005 - RNA, 22 nt, Shigella flexneri 2a str. 301
cacccgccgcuauuauaucgcu

SEQ ID NO: 2025006 - RNA, 14 nt, Shigella flexneri 2a str. 301
cacccgcagugauu

SEQ ID NO: 2025007 - RNA, 24 nt, Shigella flexneri 2a str. 301
cacccgcauaugcggugcggagua

SEQ ID NO: 2025008 - RNA, 16 nt, Shigella flexneri 2a str. 301
caccccggcccucucc

SEQ ID NO: 2025009 - RNA, 15 nt, Shigella flexneri 2a str. 301
cacccagcagcgccg

SEQ ID NO: 2025010 - RNA, 11 nt, Shigella flexneri 2a str. 301
cacccagcccc

SEQ ID NO: 2025011 - RNA, 20 nt, Shigella flexneri 2a str. 301
cacccagcagcgccgcgccu

SEQ ID NO: 2025012 - RNA, 17 nt, Shigella flexneri 2a str. 301
cacccagcaucugcaug

SEQ ID NO: 2025013 - RNA, 23 nt, Shigella flexneri 2a str. 301
cacccagcgaagcaaaccaggcc

SEQ ID NO: 2025014 - RNA, 21 nt, Shigella flexneri 2a str. 301
cacccagcgcccccacaacag

SEQ ID NO: 2025015 - RNA, 22 nt, Shigella flexneri 2a str. 301
cacccagcgcccccacaacagu

SEQ ID NO: 2025016 - RNA, 22 nt, Shigella flexneri 2a str. 301
caccaguaaggcaucuucuuca

SEQ ID NO: 2025017 - RNA, 16 nt, Shigella flexneri 2a str. 301
caccaguaacaggauc

SEQ ID NO: 2025018 - RNA, 22 nt, Shigella flexneri 2a str. 301
caccagucagcgaacaccagca

SEQ ID NO: 2025019 - RNA, 13 nt, Shigella flexneri 2a str. 301
caccaguccagcg

SEQ ID NO: 2025020 - RNA, 14 nt, Shigella flexneri 2a str. 301
caccaguccaucgg

SEQ ID NO: 2025021 - RNA, 22 nt, Shigella flexneri 2a str. 301
caccagugccauuaacaggcca

SEQ ID NO: 2025022 - RNA, 19 nt, Shigella flexneri 2a str. 301
cacccacguuaguguggcc

SEQ ID NO: 2025023 - RNA, 22 nt, Shigella flexneri 2a str. 301
cacccacggcguuaacuguaca

SEQ ID NO: 2025024 - RNA, 17 nt, Shigella flexneri 2a str. 301
caccagugcggauacca

SEQ ID NO: 2025025 - RNA, 16 nt, Shigella flexneri 2a str. 301
caccccagacuucccc

SEQ ID NO: 2025026 - RNA, 11 nt, Shigella flexneri 2a str. 301
caccccagcag

SEQ ID NO: 2025027 - RNA, 13 nt, Shigella flexneri 2a str. 301
cacccccaccccg

SEQ ID NO: 2025028 - RNA, 11 nt, Shigella flexneri 2a str. 301
cacccccaccc

SEQ ID NO: 2025029 - RNA, 21 nt, Shigella flexneri 2a str. 301
cacccagucccguacccagca

SEQ ID NO: 2025030 - RNA, 16 nt, Shigella flexneri 2a str. 301
cacccauugccgccuc

SEQ ID NO: 2025031 - RNA, 19 nt, Shigella flexneri 2a str. 301
cacccauuuauccagcggc

SEQ ID NO: 2025032 - RNA, 22 nt, Shigella flexneri 2a str. 301
cacccauuuauccagcggcagc

SEQ ID NO: 2025033 - RNA, 20 nt, Shigella flexneri 2a str. 301
cacccauguuuaauucacgc

SEQ ID NO: 2025034 - RNA, 15 nt, Shigella flexneri 2a str. 301
cacccaugaagaaua

SEQ ID NO: 2025035 - RNA, 23 nt, Shigella flexneri 2a str. 301
caccguuuuuucugccucugcca

SEQ ID NO: 2025036 - RNA, 19 nt, Shigella flexneri 2a str. 301
caccucaggaaaagcaaaa

SEQ ID NO: 2025037 - RNA, 14 nt, Shigella flexneri 2a str. 301
caccguuauccuga

SEQ ID NO: 2025038 - RNA, 20 nt, Shigella flexneri 2a str. 301
caccguuucuuugccgagga

SEQ ID NO: 2025039 - RNA, 12 nt, Shigella flexneri 2a str. 301
caccguugcccg

SEQ ID NO: 2025040 - RNA, 17 nt, Shigella flexneri 2a str. 301
caccgucaaacacagca

SEQ ID NO: 2025041 - RNA, 15 nt, Shigella flexneri 2a str. 301
caccgucaccccugu

SEQ ID NO: 2025042 - RNA, 19 nt, Shigella flexneri 2a str. 301
caccgucaccccuguggaa

SEQ ID NO: 2025043 - RNA, 20 nt, Shigella flexneri 2a str. 301
caccggaaccgucgcgccag

SEQ ID NO: 2025044 - RNA, 22 nt, Shigella flexneri 2a str. 301
caccgagucgucugucgggaac

SEQ ID NO: 2025045 - RNA, 14 nt, Shigella flexneri 2a str. 301
caccgaguucuuca

SEQ ID NO: 2025046 - RNA, 12 nt, Shigella flexneri 2a str. 301
caccgcagaagc

SEQ ID NO: 2025047 - RNA, 15 nt, Shigella flexneri 2a str. 301
caccgcaucaauauu

SEQ ID NO: 2025048 - RNA, 15 nt, Shigella flexneri 2a str. 301
caccgcagccgccac

SEQ ID NO: 2025049 - RNA, 17 nt, Shigella flexneri 2a str. 301
caccgccaaagauaaaa

SEQ ID NO: 2025050 - RNA, 21 nt, Shigella flexneri 2a str. 301
caccgcgacaaucagguaagc

SEQ ID NO: 2025051 - RNA, 19 nt, Shigella flexneri 2a str. 301
caccgcgaauuuuuucgca

SEQ ID NO: 2025052 - RNA, 18 nt, Shigella flexneri 2a str. 301
caccgcgaggccuaacac

SEQ ID NO: 2025053 - RNA, 23 nt, Shigella flexneri 2a str. 301
caccgccaaagauaaaauaacca

SEQ ID NO: 2025054 - RNA, 18 nt, Shigella flexneri 2a str. 301
caccgccuaccauaauca

SEQ ID NO: 2025055 - RNA, 15 nt, Shigella flexneri 2a str. 301
caccgccugcgaugg

SEQ ID NO: 2025056 - RNA, 22 nt, Shigella flexneri 2a str. 301
caccgcguucagcagcucauca

SEQ ID NO: 2025057 - RNA, 23 nt, Shigella flexneri 2a str. 301
caccggaacaacccagcggauga

SEQ ID NO: 2025058 - RNA, 18 nt, Shigella flexneri 2a str. 301
caccgcuucaacagcggc

SEQ ID NO: 2025059 - RNA, 13 nt, Shigella flexneri 2a str. 301
caccgcuggcaga

SEQ ID NO: 2025060 - RNA, 13 nt, Shigella flexneri 2a str. 301
caccgcuccaucg

SEQ ID NO: 2025061 - RNA, 23 nt, Shigella flexneri 2a str. 301
caccgcguuccacggggacucca

SEQ ID NO: 2025062 - RNA, 18 nt, Shigella flexneri 2a str. 301
cacggcaacacgccuggc

SEQ ID NO: 2025063 - RNA, 19 nt, Shigella flexneri 2a str. 301
cacggaguugaccagcucc

SEQ ID NO: 2025064 - RNA, 13 nt, Shigella flexneri 2a str. 301
cacgcuaccuuga

SEQ ID NO: 2025065 - RNA, 19 nt, Shigella flexneri 2a str. 301
cacgcucacucaucacucc

SEQ ID NO: 2025066 - RNA, 14 nt, Shigella flexneri 2a str. 301
cacgcucagcaauu

SEQ ID NO: 2025067 - RNA, 16 nt, Shigella flexneri 2a str. 301
cacgcucacucaucac

SEQ ID NO: 2025068 - RNA, 23 nt, Shigella flexneri 2a str. 301
aaaauaggaauccgggucuguaa

SEQ ID NO: 2025069 - RNA, 22 nt, Shigella flexneri 2a str. 301
cacgggcuuaucaguucgcggc

SEQ ID NO: 2025070 - RNA, 17 nt, Shigella flexneri 2a str. 301
cacggcgcagcuucaca

SEQ ID NO: 2025071 - RNA, 17 nt, Shigella flexneri 2a str. 301
cacgggcgcuuguuauc

SEQ ID NO: 2025072 - RNA, 21 nt, Shigella flexneri 2a str. 301
cacgggcaauuuucgccaucu

SEQ ID NO: 2025073 - RNA, 22 nt, Shigella flexneri 2a str. 301
cacgggccgagugccuugcuga

SEQ ID NO: 2025074 - RNA, 13 nt, Shigella flexneri 2a str. 301
cacgcgcuucaca

SEQ ID NO: 2025075 - RNA, 14 nt, Shigella flexneri 2a str. 301
cacgcgcuccagga

SEQ ID NO: 2025076 - RNA, 23 nt, Shigella flexneri 2a str. 301
cacgccuugcggaaauuccagcg

SEQ ID NO: 2025077 - RNA, 15 nt, Shigella flexneri 2a str. 301
cacgccuucuccggc

SEQ ID NO: 2025078 - RNA, 16 nt, Shigella flexneri 2a str. 301
cacgccuggcucaagc

SEQ ID NO: 2025079 - RNA, 22 nt, Shigella flexneri 2a str. 301
cacgcgaacaacagaucaacau

SEQ ID NO: 2025080 - RNA, 19 nt, Shigella flexneri 2a str. 301
cacgccgacaaagaugcag

SEQ ID NO: 2025081 - RNA, 19 nt, Shigella flexneri 2a str. 301
cacgccuccuggcucagcg

SEQ ID NO: 2025082 - RNA, 23 nt, Shigella flexneri 2a str. 301
cacgccguuuuuacccagcagca

SEQ ID NO: 2025083 - RNA, 22 nt, Shigella flexneri 2a str. 301
cacgccgcauccggcaugaaca

SEQ ID NO: 2025084 - RNA, 15 nt, Shigella flexneri 2a str. 301
cacgcaacagaccag

SEQ ID NO: 2025085 - RNA, 22 nt, Shigella flexneri 2a str. 301
cacgcaaauguggcggaauacc

SEQ ID NO: 2025086 - RNA, 21 nt, Shigella flexneri 2a str. 301
cacgcaaaaucccacugccaa

SEQ ID NO: 2025087 - RNA, 13 nt, Shigella flexneri 2a str. 301
cacgauuuuguag

SEQ ID NO: 2025088 - RNA, 19 nt, Shigella flexneri 2a str. 301
caccuguugcgcgucgccc

SEQ ID NO: 2025089 - RNA, 22 nt, Shigella flexneri 2a str. 301
caccuguugccauuucugcugc

SEQ ID NO: 2025090 - RNA, 14 nt, Shigella flexneri 2a str. 301
caccuguuccauga

SEQ ID NO: 2025091 - RNA, 17 nt, Shigella flexneri 2a str. 301
caccuguuccaugacgu

SEQ ID NO: 2025092 - RNA, 15 nt, Shigella flexneri 2a str. 301
aaaauaccagcaauu

SEQ ID NO: 2025093 - RNA, 15 nt, Shigella flexneri 2a str. 301
aaaauaccaccaaug

SEQ ID NO: 2025094 - RNA, 12 nt, Shigella flexneri 2a str. 301
aaaauacaugac

SEQ ID NO: 2025095 - RNA, 22 nt, Shigella flexneri 2a str. 301
caccuuacggcacuccucuuca

SEQ ID NO: 2025096 - RNA, 14 nt, Shigella flexneri 2a str. 301
caccuuaaaacaau

SEQ ID NO: 2025097 - RNA, 18 nt, Shigella flexneri 2a str. 301
caccucaguacccgcguu

SEQ ID NO: 2025098 - RNA, 15 nt, Shigella flexneri 2a str. 301
caccucaucaccaca

SEQ ID NO: 2025099 - RNA, 12 nt, Shigella flexneri 2a str. 301
caccucaucaga

SEQ ID NO: 2025100 - RNA, 20 nt, Shigella flexneri 2a str. 301
caccucaucaccacagacaa

SEQ ID NO: 2025101 - RNA, 14 nt, Shigella flexneri 2a str. 301
caccugcugauuau

SEQ ID NO: 2025102 - RNA, 20 nt, Shigella flexneri 2a str. 301
caccucccgucgcccacacc

SEQ ID NO: 2025103 - RNA, 15 nt, Shigella flexneri 2a str. 301
caccucccagcgcgg

SEQ ID NO: 2025104 - RNA, 17 nt, Shigella flexneri 2a str. 301
caccuggggcuugccag

SEQ ID NO: 2025105 - RNA, 18 nt, Shigella flexneri 2a str. 301
caccugggucugcagaua

SEQ ID NO: 2025106 - RNA, 12 nt, Shigella flexneri 2a str. 301
caccugcuggac

SEQ ID NO: 2025107 - RNA, 23 nt, Shigella flexneri 2a str. 301
caccugcuuccugaacucgccag

SEQ ID NO: 2025108 - RNA, 14 nt, Shigella flexneri 2a str. 301
aaaauagccaauca

SEQ ID NO: 2025109 - RNA, 19 nt, Shigella flexneri 2a str. 301
aaaauagccaaucauuccc

SEQ ID NO: 2025110 - RNA, 15 nt, Shigella flexneri 2a str. 301
cacgaauucaacgcg

SEQ ID NO: 2025111 - RNA, 18 nt, Shigella flexneri 2a str. 301
cacgacaaaugcgccgcc

SEQ ID NO: 2025112 - RNA, 13 nt, Shigella flexneri 2a str. 301
aaaauagcauaau

SEQ ID NO: 2025113 - RNA, 16 nt, Shigella flexneri 2a str. 301
aaaauagcaauauuuu

SEQ ID NO: 2025114 - RNA, 14 nt, Shigella flexneri 2a str. 301
cacgaaacugcugg

SEQ ID NO: 2025115 - RNA, 18 nt, Shigella flexneri 2a str. 301
cacgaaccguaaaagccu

SEQ ID NO: 2025116 - RNA, 19 nt, Shigella flexneri 2a str. 301
cacgaaccguaaaagccug

SEQ ID NO: 2025117 - RNA, 22 nt, Shigella flexneri 2a str. 301
cacgaaccguccccucgccccu

SEQ ID NO: 2025118 - RNA, 21 nt, Shigella flexneri 2a str. 301
cacgacauaaacauuccacuu

SEQ ID NO: 2025119 - RNA, 17 nt, Shigella flexneri 2a str. 301
cacgaucgcgccagccu

SEQ ID NO: 2025120 - RNA, 14 nt, Shigella flexneri 2a str. 301
cacgaucucacgcu

SEQ ID NO: 2025121 - RNA, 16 nt, Shigella flexneri 2a str. 301
cacgaugcuaaaaaca

SEQ ID NO: 2025122 - RNA, 21 nt, Shigella flexneri 2a str. 301
cacgauggaaccguacagcau

SEQ ID NO: 2025123 - RNA, 23 nt, Shigella flexneri 2a str. 301
caccaaagaugucaccauuggca

SEQ ID NO: 2025124 - RNA, 17 nt, Shigella flexneri 2a str. 301
caccaaacuucagcccu

SEQ ID NO: 2025125 - RNA, 14 nt, Shigella flexneri 2a str. 301
caccaaaggcacaa

SEQ ID NO: 2025126 - RNA, 15 nt, Shigella flexneri 2a str. 301
caccaaacagaccau

SEQ ID NO: 2025127 - RNA, 17 nt, Shigella flexneri 2a str. 301
caccaacccuuaccccu

SEQ ID NO: 2025128 - RNA, 17 nt, Shigella flexneri 2a str. 301
caccaacaucaugccag

SEQ ID NO: 2025129 - RNA, 14 nt, Shigella flexneri 2a str. 301
caccaaccgcggua

SEQ ID NO: 2025130 - RNA, 16 nt, Shigella flexneri 2a str. 301
caccaacgauuuuuuc

SEQ ID NO: 2025131 - RNA, 14 nt, Shigella flexneri 2a str. 301
caccacacaaccga

SEQ ID NO: 2025132 - RNA, 17 nt, Shigella flexneri 2a str. 301
caccacacgaauuccaa

SEQ ID NO: 2025133 - RNA, 12 nt, Shigella flexneri 2a str. 301
caccaccaaaaa

SEQ ID NO: 2025134 - RNA, 11 nt, Shigella flexneri 2a str. 301
caccacauucu

SEQ ID NO: 2025135 - RNA, 21 nt, Shigella flexneri 2a str. 301
caccacagacaaacagcucga

SEQ ID NO: 2025136 - RNA, 12 nt, Shigella flexneri 2a str. 301
caccacaugccg

SEQ ID NO: 2025137 - RNA, 23 nt, Shigella flexneri 2a str. 301
cacaucgccgaccgcaaccggcc

SEQ ID NO: 2025138 - RNA, 20 nt, Shigella flexneri 2a str. 301
cacaucgcugugcugcugac

SEQ ID NO: 2025139 - RNA, 19 nt, Shigella flexneri 2a str. 301
cacauuacugcuugcucug

SEQ ID NO: 2025140 - RNA, 20 nt, Shigella flexneri 2a str. 301
cacauguuguacaugcugcu

SEQ ID NO: 2025141 - RNA, 18 nt, Shigella flexneri 2a str. 301
cacauguuuauaacuucc

SEQ ID NO: 2025142 - RNA, 17 nt, Shigella flexneri 2a str. 301
cacauuaucucaacaca

SEQ ID NO: 2025143 - RNA, 14 nt, Shigella flexneri 2a str. 301
cacauuaucaaacg

SEQ ID NO: 2025144 - RNA, 16 nt, Shigella flexneri 2a str. 301
cacauuccucugucag

SEQ ID NO: 2025145 - RNA, 13 nt, Shigella flexneri 2a str. 301
cacauucgccgcc

SEQ ID NO: 2025146 - RNA, 16 nt, Shigella flexneri 2a str. 301
cacauuccagaugugc

SEQ ID NO: 2025147 - RNA, 19 nt, Shigella flexneri 2a str. 301
caccaaaaccacagaaccu

SEQ ID NO: 2025148 - RNA, 16 nt, Shigella flexneri 2a str. 301
caccaaacugaugccc

SEQ ID NO: 2025149 - RNA, 20 nt, Shigella flexneri 2a str. 301
cacauacgacgcuucaguuc

SEQ ID NO: 2025150 - RNA, 16 nt, Shigella flexneri 2a str. 301
cacauacuuauuauga

SEQ ID NO: 2025151 - RNA, 20 nt, Shigella flexneri 2a str. 301
cacauagcgugacaccagca

SEQ ID NO: 2025152 - RNA, 22 nt, Shigella flexneri 2a str. 301
cacauaguagguccugaccaaa

SEQ ID NO: 2025153 - RNA, 17 nt, Shigella flexneri 2a str. 301
cacauauucacgggcgc

SEQ ID NO: 2025154 - RNA, 12 nt, Shigella flexneri 2a str. 301
cacagcucugcu

SEQ ID NO: 2025155 - RNA, 13 nt, Shigella flexneri 2a str. 301
cacagcucugcug

SEQ ID NO: 2025156 - RNA, 16 nt, Shigella flexneri 2a str. 301
cacagcgugcauagca

SEQ ID NO: 2025157 - RNA, 13 nt, Shigella flexneri 2a str. 301
cacaucaauuugc

SEQ ID NO: 2025158 - RNA, 13 nt, Shigella flexneri 2a str. 301
cacaucaccauaa

SEQ ID NO: 2025159 - RNA, 15 nt, Shigella flexneri 2a str. 301
cacaucaccauagcc

SEQ ID NO: 2025160 - RNA, 15 nt, Shigella flexneri 2a str. 301
cacaucaaaucccca

SEQ ID NO: 2025161 - RNA, 18 nt, Shigella flexneri 2a str. 301
cacaucaacucugcaaug

SEQ ID NO: 2025162 - RNA, 15 nt, Shigella flexneri 2a str. 301
cacauauugcagcuu

SEQ ID NO: 2025163 - RNA, 15 nt, Shigella flexneri 2a str. 301
cacaucaucaaagcc

SEQ ID NO: 2025164 - RNA, 17 nt, Shigella flexneri 2a str. 301
cacaucauccggcaccu

SEQ ID NO: 2025165 - RNA, 20 nt, Shigella flexneri 2a str. 301
cacaucauccugacccagca

SEQ ID NO: 2025166 - RNA, 19 nt, Shigella flexneri 2a str. 301
cacaucacuccauccagca

SEQ ID NO: 2025167 - RNA, 17 nt, Shigella flexneri 2a str. 301
cacaucaccuccagcga

SEQ ID NO: 2025168 - RNA, 20 nt, Shigella flexneri 2a str. 301
cacaucagccagaugcaccg

SEQ ID NO: 2025169 - RNA, 14 nt, Shigella flexneri 2a str. 301
cacauccaguacgc

SEQ ID NO: 2025170 - RNA, 13 nt, Shigella flexneri 2a str. 301
cacauccaguggc

SEQ ID NO: 2025171 - RNA, 14 nt, Shigella flexneri 2a str. 301
cacaucccagcaga

SEQ ID NO: 2025172 - RNA, 20 nt, Shigella flexneri 2a str. 301
caccagccagaauuaccccg

SEQ ID NO: 2025173 - RNA, 16 nt, Shigella flexneri 2a str. 301
caccagccaccgcguu

SEQ ID NO: 2025174 - RNA, 15 nt, Shigella flexneri 2a str. 301
caccagcaucaacaa

SEQ ID NO: 2025175 - RNA, 14 nt, Shigella flexneri 2a str. 301
caccagcgcgagga

SEQ ID NO: 2025176 - RNA, 14 nt, Shigella flexneri 2a str. 301
caccagggaaauaa

SEQ ID NO: 2025177 - RNA, 16 nt, Shigella flexneri 2a str. 301
caccagcggcacgcca

SEQ ID NO: 2025178 - RNA, 17 nt, Shigella flexneri 2a str. 301
caccagcgucagaaaca

SEQ ID NO: 2025179 - RNA, 21 nt, Shigella flexneri 2a str. 301
caccagcgucagaaacaguug

SEQ ID NO: 2025180 - RNA, 14 nt, Shigella flexneri 2a str. 301
caccaccagcagcu

SEQ ID NO: 2025181 - RNA, 15 nt, Shigella flexneri 2a str. 301
caccaccagcagcug

SEQ ID NO: 2025182 - RNA, 14 nt, Shigella flexneri 2a str. 301
caccaccagcgaaa

SEQ ID NO: 2025183 - RNA, 18 nt, Shigella flexneri 2a str. 301
caccacgcugcaugggga

SEQ ID NO: 2025184 - RNA, 19 nt, Shigella flexneri 2a str. 301
caccacgccggaugaaauc

SEQ ID NO: 2025185 - RNA, 15 nt, Shigella flexneri 2a str. 301
caccacgcuccauca

SEQ ID NO: 2025186 - RNA, 15 nt, Shigella flexneri 2a str. 301
caccacuccucaaca

SEQ ID NO: 2025187 - RNA, 18 nt, Shigella flexneri 2a str. 301
caccacuccccuccugca

SEQ ID NO: 2025188 - RNA, 22 nt, Shigella flexneri 2a str. 301
caccacuggcgauauugccgcg

SEQ ID NO: 2025189 - RNA, 11 nt, Shigella flexneri 2a str. 301
caccacuuccc

SEQ ID NO: 2025190 - RNA, 19 nt, Shigella flexneri 2a str. 301
caccagauuauaagccagu

SEQ ID NO: 2025191 - RNA, 23 nt, Shigella flexneri 2a str. 301
caccagauugugaaucgccugga

SEQ ID NO: 2025192 - RNA, 17 nt, Shigella flexneri 2a str. 301
caccagcaacaagccag

SEQ ID NO: 2025193 - RNA, 13 nt, Shigella flexneri 2a str. 301
caccagcaaauau

SEQ ID NO: 2025194 - RNA, 16 nt, Shigella flexneri 2a str. 301
caccagcaacaagcca

SEQ ID NO: 2025195 - RNA, 13 nt, Shigella flexneri 2a str. 301
caccagcaacagc

SEQ ID NO: 2025196 - RNA, 16 nt, Shigella flexneri 2a str. 301
caccagauaaugagaa

SEQ ID NO: 2025197 - RNA, 18 nt, Shigella flexneri 2a str. 301
caccagcaauaaugccag

SEQ ID NO: 2025198 - RNA, 14 nt, Shigella flexneri 2a str. 301
cacacgcucuucca

SEQ ID NO: 2025199 - RNA, 16 nt, Shigella flexneri 2a str. 301
cacacauuucucggua

SEQ ID NO: 2025200 - RNA, 22 nt, Shigella flexneri 2a str. 301
cacacgagaguuaguguuaacc

SEQ ID NO: 2025201 - RNA, 14 nt, Shigella flexneri 2a str. 301
cacacagacaauaa

SEQ ID NO: 2025202 - RNA, 22 nt, Shigella flexneri 2a str. 301
cacaaucgcagcgcaagcugaa

SEQ ID NO: 2025203 - RNA, 14 nt, Shigella flexneri 2a str. 301
cacacacgcccagc

SEQ ID NO: 2025204 - RNA, 14 nt, Shigella flexneri 2a str. 301
cacacacguugagc

SEQ ID NO: 2025205 - RNA, 20 nt, Shigella flexneri 2a str. 301
cacaaugcaauaauguggcc

SEQ ID NO: 2025206 - RNA, 19 nt, Shigella flexneri 2a str. 301
cacaaugccaccaauaaug

SEQ ID NO: 2025207 - RNA, 20 nt, Shigella flexneri 2a str. 301
cacaaucggcuuucaccgcc

SEQ ID NO: 2025208 - RNA, 14 nt, Shigella flexneri 2a str. 301
cacagcaguccagc

SEQ ID NO: 2025209 - RNA, 15 nt, Shigella flexneri 2a str. 301
cacagcagccuucgc

SEQ ID NO: 2025210 - RNA, 11 nt, Shigella flexneri 2a str. 301
cacagaaguga

SEQ ID NO: 2025211 - RNA, 15 nt, Shigella flexneri 2a str. 301
cacagaaggccagga

SEQ ID NO: 2025212 - RNA, 13 nt, Shigella flexneri 2a str. 301
cacagaacaaaau

SEQ ID NO: 2025213 - RNA, 17 nt, Shigella flexneri 2a str. 301
cacagaugcaggauuuc

SEQ ID NO: 2025214 - RNA, 23 nt, Shigella flexneri 2a str. 301
cacacuguucauuaaagccgccc

SEQ ID NO: 2025215 - RNA, 16 nt, Shigella flexneri 2a str. 301
cacacuuuccaguucc

SEQ ID NO: 2025216 - RNA, 16 nt, Shigella flexneri 2a str. 301
cacacuucuucagcca

SEQ ID NO: 2025217 - RNA, 20 nt, Shigella flexneri 2a str. 301
cacacuucauuuuccacaau

SEQ ID NO: 2025218 - RNA, 14 nt, Shigella flexneri 2a str. 301
cacagaaacgccau

SEQ ID NO: 2025219 - RNA, 21 nt, Shigella flexneri 2a str. 301
cacaagccaggacgcagucca

SEQ ID NO: 2025220 - RNA, 13 nt, Shigella flexneri 2a str. 301
cacaagaaauaua

SEQ ID NO: 2025221 - RNA, 18 nt, Shigella flexneri 2a str. 301
cacaagaaguaacaacug

SEQ ID NO: 2025222 - RNA, 18 nt, Shigella flexneri 2a str. 301
cacaagacuguaaauacu

SEQ ID NO: 2025223 - RNA, 13 nt, Shigella flexneri 2a str. 301
cacaagcuccggc

SEQ ID NO: 2025224 - RNA, 17 nt, Shigella flexneri 2a str. 301
cacaaggccauugacgc

SEQ ID NO: 2025225 - RNA, 22 nt, Shigella flexneri 2a str. 301
cacaaguugucccauacuugca

SEQ ID NO: 2025226 - RNA, 21 nt, Shigella flexneri 2a str. 301
cacaaguuguuuacaguauga

SEQ ID NO: 2025227 - RNA, 16 nt, Shigella flexneri 2a str. 301
cacaauagaaauauug

SEQ ID NO: 2025228 - RNA, 21 nt, Shigella flexneri 2a str. 301
cacaaucaaaucgacagccag

SEQ ID NO: 2025229 - RNA, 19 nt, Shigella flexneri 2a str. 301
cacaaucagacgcaggcgc

SEQ ID NO: 2025230 - RNA, 17 nt, Shigella flexneri 2a str. 301
cacaaucccuuaguaac

SEQ ID NO: 2025231 - RNA, 17 nt, Shigella flexneri 2a str. 301
cacaaccugcacgaaac

SEQ ID NO: 2025232 - RNA, 20 nt, Shigella flexneri 2a str. 301
cacaaccaccguuuuuucug

SEQ ID NO: 2025233 - RNA, 13 nt, Shigella flexneri 2a str. 301
caauuugcccaug

SEQ ID NO: 2025234 - RNA, 15 nt, Shigella flexneri 2a str. 301
caauggcauuuaucu

SEQ ID NO: 2025235 - RNA, 19 nt, Shigella flexneri 2a str. 301
caauggagcacauugccug

SEQ ID NO: 2025236 - RNA, 23 nt, Shigella flexneri 2a str. 301
caaugggguaacagguuuaaaca

SEQ ID NO: 2025237 - RNA, 16 nt, Shigella flexneri 2a str. 301
caauggcggugauccc

SEQ ID NO: 2025238 - RNA, 18 nt, Shigella flexneri 2a str. 301
caauggcgacuucugcuu

SEQ ID NO: 2025239 - RNA, 14 nt, Shigella flexneri 2a str. 301
caauggcccgccgc

SEQ ID NO: 2025240 - RNA, 15 nt, Shigella flexneri 2a str. 301
caaugucgaaagccc

SEQ ID NO: 2025241 - RNA, 21 nt, Shigella flexneri 2a str. 301
caaugucaucagcauucucau

SEQ ID NO: 2025242 - RNA, 13 nt, Shigella flexneri 2a str. 301
caauggugaacug

SEQ ID NO: 2025243 - RNA, 19 nt, Shigella flexneri 2a str. 301
caaugguggcaaucugaau

SEQ ID NO: 2025244 - RNA, 17 nt, Shigella flexneri 2a str. 301
caauggguaacggcaga

SEQ ID NO: 2025245 - RNA, 20 nt, Shigella flexneri 2a str. 301
caaugaccgcgccauccaua

SEQ ID NO: 2025246 - RNA, 21 nt, Shigella flexneri 2a str. 301
caaugaaugcuucgcucucuu

SEQ ID NO: 2025247 - RNA, 15 nt, Shigella flexneri 2a str. 301
caaucuucucuuccc

SEQ ID NO: 2025248 - RNA, 14 nt, Shigella flexneri 2a str. 301
caaucuuaggggac

SEQ ID NO: 2025249 - RNA, 19 nt, Shigella flexneri 2a str. 301
caaucuuaggggacauuua

SEQ ID NO: 2025250 - RNA, 12 nt, Shigella flexneri 2a str. 301
caaucugugccg

SEQ ID NO: 2025251 - RNA, 20 nt, Shigella flexneri 2a str. 301
caaugacuagcgccauaaua

SEQ ID NO: 2025252 - RNA, 17 nt, Shigella flexneri 2a str. 301
caaugacgggcuuaacu

SEQ ID NO: 2025253 - RNA, 18 nt, Shigella flexneri 2a str. 301
caaugcucucuucgccaa

SEQ ID NO: 2025254 - RNA, 19 nt, Shigella flexneri 2a str. 301
caauugcauauuucaacga

SEQ ID NO: 2025255 - RNA, 23 nt, Shigella flexneri 2a str. 301
caauucuucuugaccguuuuacu

SEQ ID NO: 2025256 - RNA, 17 nt, Shigella flexneri 2a str. 301
caauugccccccauaac

SEQ ID NO: 2025257 - RNA, 22 nt, Shigella flexneri 2a str. 301
caauugucccguuuugaaaagc

SEQ ID NO: 2025258 - RNA, 17 nt, Shigella flexneri 2a str. 301
caauugcucccugaaua

SEQ ID NO: 2025259 - RNA, 21 nt, Shigella flexneri 2a str. 301
caauuggccugauaagacagc

SEQ ID NO: 2025260 - RNA, 14 nt, Shigella flexneri 2a str. 301
caauuucccgcuca

SEQ ID NO: 2025261 - RNA, 21 nt, Shigella flexneri 2a str. 301
caauuucccgcucauagccac

SEQ ID NO: 2025262 - RNA, 19 nt, Shigella flexneri 2a str. 301
caauuucccgcguccgcuc

SEQ ID NO: 2025263 - RNA, 13 nt, Shigella flexneri 2a str. 301
caauuucaucacu

SEQ ID NO: 2025264 - RNA, 15 nt, Shigella flexneri 2a str. 301
caauuucaucacuga

SEQ ID NO: 2025265 - RNA, 15 nt, Shigella flexneri 2a str. 301
caauuccuauuuugu

SEQ ID NO: 2025266 - RNA, 23 nt, Shigella flexneri 2a str. 301
caauucccggaccgucaucuucc

SEQ ID NO: 2025267 - RNA, 23 nt, Shigella flexneri 2a str. 301
caauguuaccgaucgccagcagg

SEQ ID NO: 2025268 - RNA, 14 nt, Shigella flexneri 2a str. 301
caaugugcuaauca

SEQ ID NO: 2025269 - RNA, 15 nt, Shigella flexneri 2a str. 301
caauucuaaauguuc

SEQ ID NO: 2025270 - RNA, 14 nt, Shigella flexneri 2a str. 301
caauucuaccguug

SEQ ID NO: 2025271 - RNA, 22 nt, Shigella flexneri 2a str. 301
caauucgcgucggcgucagcgc

SEQ ID NO: 2025272 - RNA, 23 nt, Shigella flexneri 2a str. 301
caauucgcguaguaaagccuuca

SEQ ID NO: 2025273 - RNA, 12 nt, Shigella flexneri 2a str. 301
caauuccuucug

SEQ ID NO: 2025274 - RNA, 22 nt, Shigella flexneri 2a str. 301
augcaagaggguuauuuguuca

SEQ ID NO: 2025275 - RNA, 18 nt, Shigella flexneri 2a str. 301
augcaagaggguuauuug

SEQ ID NO: 2025276 - RNA, 20 nt, Shigella flexneri 2a str. 301
augcaagaggguuauuuguu

SEQ ID NO: 2025277 - RNA, 18 nt, Shigella flexneri 2a str. 301
augcaaugauucaggcau

SEQ ID NO: 2025278 - RNA, 19 nt, Shigella flexneri 2a str. 301
augcacaaucguguggcau

SEQ ID NO: 2025279 - RNA, 19 nt, Shigella flexneri 2a str. 301
augcaauuaccgccaccag

SEQ ID NO: 2025280 - RNA, 18 nt, Shigella flexneri 2a str. 301
augcaacaacugaaaaaa

SEQ ID NO: 2025281 - RNA, 19 nt, Shigella flexneri 2a str. 301
augauuucgucauccggug

SEQ ID NO: 2025282 - RNA, 15 nt, Shigella flexneri 2a str. 301
augauuucugccagc

SEQ ID NO: 2025283 - RNA, 17 nt, Shigella flexneri 2a str. 301
augauuuugauggaaga

SEQ ID NO: 2025284 - RNA, 12 nt, Shigella flexneri 2a str. 301
augauuuuccug

SEQ ID NO: 2025285 - RNA, 15 nt, Shigella flexneri 2a str. 301
augauuuuccugagg

SEQ ID NO: 2025286 - RNA, 15 nt, Shigella flexneri 2a str. 301
augauuuaaaaaaug

SEQ ID NO: 2025287 - RNA, 13 nt, Shigella flexneri 2a str. 301
augauuagugcca

SEQ ID NO: 2025288 - RNA, 20 nt, Shigella flexneri 2a str. 301
augauuagucuuuaucugcc

SEQ ID NO: 2025289 - RNA, 15 nt, Shigella flexneri 2a str. 301
augauguaaauaaca

SEQ ID NO: 2025290 - RNA, 20 nt, Shigella flexneri 2a str. 301
augauggccuuuuugugcuu

SEQ ID NO: 2025291 - RNA, 18 nt, Shigella flexneri 2a str. 301
augauggcauucucacuc

SEQ ID NO: 2025292 - RNA, 15 nt, Shigella flexneri 2a str. 301
augaugcgucucauc

SEQ ID NO: 2025293 - RNA, 16 nt, Shigella flexneri 2a str. 301
augauggcgauaaucu

SEQ ID NO: 2025294 - RNA, 19 nt, Shigella flexneri 2a str. 301
augaugcgacuugucauca

SEQ ID NO: 2025295 - RNA, 13 nt, Shigella flexneri 2a str. 301
augaugcaaacau

SEQ ID NO: 2025296 - RNA, 20 nt, Shigella flexneri 2a str. 301
augaugcaaacauggaaacc

SEQ ID NO: 2025297 - RNA, 20 nt, Shigella flexneri 2a str. 301
augaugaucuuaugauguaa

SEQ ID NO: 2025298 - RNA, 23 nt, Shigella flexneri 2a str. 301
augaugaucuuaugauguaaaua

SEQ ID NO: 2025299 - RNA, 17 nt, Shigella flexneri 2a str. 301
augaugaaacugauaau

SEQ ID NO: 2025300 - RNA, 15 nt, Shigella flexneri 2a str. 301
augagcagaccaaua

SEQ ID NO: 2025301 - RNA, 13 nt, Shigella flexneri 2a str. 301
augagcagaccaa

SEQ ID NO: 2025302 - RNA, 17 nt, Shigella flexneri 2a str. 301
augagcaguuugguuaa

SEQ ID NO: 2025303 - RNA, 12 nt, Shigella flexneri 2a str. 301
augagcaccgca

SEQ ID NO: 2025304 - RNA, 18 nt, Shigella flexneri 2a str. 301
augagcaccgcaccuaaa

SEQ ID NO: 2025305 - RNA, 17 nt, Shigella flexneri 2a str. 301
augccucguuggucagc

SEQ ID NO: 2025306 - RNA, 13 nt, Shigella flexneri 2a str. 301
augccucuccugu

SEQ ID NO: 2025307 - RNA, 18 nt, Shigella flexneri 2a str. 301
augccuaccaaaccugca

SEQ ID NO: 2025308 - RNA, 15 nt, Shigella flexneri 2a str. 301
augccgccguagaaa

SEQ ID NO: 2025309 - RNA, 18 nt, Shigella flexneri 2a str. 301
augccuuguuugaucauc

SEQ ID NO: 2025310 - RNA, 13 nt, Shigella flexneri 2a str. 301
augccuuucucag

SEQ ID NO: 2025311 - RNA, 22 nt, Shigella flexneri 2a str. 301
augccuugugggccugaaagcu

SEQ ID NO: 2025312 - RNA, 18 nt, Shigella flexneri 2a str. 301
augccucuuucauccgau

SEQ ID NO: 2025313 - RNA, 20 nt, Shigella flexneri 2a str. 301
augccugaugcgacgcuugc

SEQ ID NO: 2025314 - RNA, 16 nt, Shigella flexneri 2a str. 301
augcgcauuaagccau

SEQ ID NO: 2025315 - RNA, 15 nt, Shigella flexneri 2a str. 301
augcgacccaugcac

SEQ ID NO: 2025316 - RNA, 13 nt, Shigella flexneri 2a str. 301
augcgacgcuugc

SEQ ID NO: 2025317 - RNA, 14 nt, Shigella flexneri 2a str. 301
augcgaaugccaau

SEQ ID NO: 2025318 - RNA, 22 nt, Shigella flexneri 2a str. 301
augcgacauagaucuaaaugcc

SEQ ID NO: 2025319 - RNA, 15 nt, Shigella flexneri 2a str. 301
augcgacaacagaaa

SEQ ID NO: 2025320 - RNA, 14 nt, Shigella flexneri 2a str. 301
augcgacaacuggc

SEQ ID NO: 2025321 - RNA, 14 nt, Shigella flexneri 2a str. 301
augcgaagguggcg

SEQ ID NO: 2025322 - RNA, 15 nt, Shigella flexneri 2a str. 301
augcgcgacaaaaau

SEQ ID NO: 2025323 - RNA, 23 nt, Shigella flexneri 2a str. 301
augcgccagguaacgaagauggc

SEQ ID NO: 2025324 - RNA, 17 nt, Shigella flexneri 2a str. 301
augccacgccacagccg

SEQ ID NO: 2025325 - RNA, 23 nt, Shigella flexneri 2a str. 301
augccaucauggcgaugagaauc

SEQ ID NO: 2025326 - RNA, 20 nt, Shigella flexneri 2a str. 301
augccauaacgcgucucaug

SEQ ID NO: 2025327 - RNA, 22 nt, Shigella flexneri 2a str. 301
augccgaaaaaagucauuacca

SEQ ID NO: 2025328 - RNA, 12 nt, Shigella flexneri 2a str. 301
augccauuuucc

SEQ ID NO: 2025329 - RNA, 17 nt, Shigella flexneri 2a str. 301
augccauuuccagcgcu

SEQ ID NO: 2025330 - RNA, 12 nt, Shigella flexneri 2a str. 301
augccauuugcc

SEQ ID NO: 2025331 - RNA, 15 nt, Shigella flexneri 2a str. 301
augccauuggcauaa

SEQ ID NO: 2025332 - RNA, 22 nt, Shigella flexneri 2a str. 301
augccaucgcauagcgcaauaa

SEQ ID NO: 2025333 - RNA, 18 nt, Shigella flexneri 2a str. 301
augccaucugccagcaag

SEQ ID NO: 2025334 - RNA, 19 nt, Shigella flexneri 2a str. 301
augccgauaaauacagcgu

SEQ ID NO: 2025335 - RNA, 22 nt, Shigella flexneri 2a str. 301
augccgaucaauuucacaguaa

SEQ ID NO: 2025336 - RNA, 23 nt, Shigella flexneri 2a str. 301
augccgaucgucugggcauugaa

SEQ ID NO: 2025337 - RNA, 18 nt, Shigella flexneri 2a str. 301
augccgccgacaguuauc

SEQ ID NO: 2025338 - RNA, 14 nt, Shigella flexneri 2a str. 301
augccgcagcaccc

SEQ ID NO: 2025339 - RNA, 21 nt, Shigella flexneri 2a str. 301
augccgcagcggcgauuucuu

SEQ ID NO: 2025340 - RNA, 15 nt, Shigella flexneri 2a str. 301
augcaccaucucuua

SEQ ID NO: 2025341 - RNA, 14 nt, Shigella flexneri 2a str. 301
augcagauaaucgu

SEQ ID NO: 2025342 - RNA, 20 nt, Shigella flexneri 2a str. 301
augcagcauggucagguauu

SEQ ID NO: 2025343 - RNA, 22 nt, Shigella flexneri 2a str. 301
augcagcauugccugaugcgcu

SEQ ID NO: 2025344 - RNA, 18 nt, Shigella flexneri 2a str. 301
augcagcccagcaucaga

SEQ ID NO: 2025345 - RNA, 19 nt, Shigella flexneri 2a str. 301
augccacaaacgccgugca

SEQ ID NO: 2025346 - RNA, 20 nt, Shigella flexneri 2a str. 301
augccacauuagauaaaaau

SEQ ID NO: 2025347 - RNA, 18 nt, Shigella flexneri 2a str. 301
augccaauccccagaccu

SEQ ID NO: 2025348 - RNA, 19 nt, Shigella flexneri 2a str. 301
augccaaucagcagaaccg

SEQ ID NO: 2025349 - RNA, 17 nt, Shigella flexneri 2a str. 301
augcugugaagauggcu

SEQ ID NO: 2025350 - RNA, 20 nt, Shigella flexneri 2a str. 301
augcugcgccaguugcuuau

SEQ ID NO: 2025351 - RNA, 19 nt, Shigella flexneri 2a str. 301
augcugccgauggcgcaaa

SEQ ID NO: 2025352 - RNA, 14 nt, Shigella flexneri 2a str. 301
augcugccgucuuc

SEQ ID NO: 2025353 - RNA, 23 nt, Shigella flexneri 2a str. 301
augcugauuuuggucaugcuaag

SEQ ID NO: 2025354 - RNA, 14 nt, Shigella flexneri 2a str. 301
augcucugccagcg

SEQ ID NO: 2025355 - RNA, 13 nt, Shigella flexneri 2a str. 301
augcucuccacca

SEQ ID NO: 2025356 - RNA, 15 nt, Shigella flexneri 2a str. 301
augcucucccaaaua

SEQ ID NO: 2025357 - RNA, 18 nt, Shigella flexneri 2a str. 301
augcucgaacgccucugc

SEQ ID NO: 2025358 - RNA, 16 nt, Shigella flexneri 2a str. 301
augcucgcuggcaggc

SEQ ID NO: 2025359 - RNA, 23 nt, Shigella flexneri 2a str. 301
augcuguugcuccuuaauaaaau

SEQ ID NO: 2025360 - RNA, 20 nt, Shigella flexneri 2a str. 301
augcugucggcugccagcca

SEQ ID NO: 2025361 - RNA, 17 nt, Shigella flexneri 2a str. 301
augcuuugcaucccaga

SEQ ID NO: 2025362 - RNA, 16 nt, Shigella flexneri 2a str. 301
augcuugacucuguag

SEQ ID NO: 2025363 - RNA, 22 nt, Shigella flexneri 2a str. 301
augcuuuacgcuuaucccagcc

SEQ ID NO: 2025364 - RNA, 18 nt, Shigella flexneri 2a str. 301
auggaucccucuuucugg

SEQ ID NO: 2025365 - RNA, 20 nt, Shigella flexneri 2a str. 301
auggaucagaguugaaaaac

SEQ ID NO: 2025366 - RNA, 13 nt, Shigella flexneri 2a str. 301
auggagugagaau

SEQ ID NO: 2025367 - RNA, 18 nt, Shigella flexneri 2a str. 301
auggcagauaaaauacuu

SEQ ID NO: 2025368 - RNA, 17 nt, Shigella flexneri 2a str. 301
auggacgcagaccaaag

SEQ ID NO: 2025369 - RNA, 14 nt, Shigella flexneri 2a str. 301
auggacacaggccu

SEQ ID NO: 2025370 - RNA, 13 nt, Shigella flexneri 2a str. 301
auggacuuuauga

SEQ ID NO: 2025371 - RNA, 18 nt, Shigella flexneri 2a str. 301
auggagcaaaaguggugu

SEQ ID NO: 2025372 - RNA, 18 nt, Shigella flexneri 2a str. 301
auggaagacauagcacau

SEQ ID NO: 2025373 - RNA, 17 nt, Shigella flexneri 2a str. 301
auggaaggucacgccag

SEQ ID NO: 2025374 - RNA, 19 nt, Shigella flexneri 2a str. 301
auggaauggucaauggugg

SEQ ID NO: 2025375 - RNA, 21 nt, Shigella flexneri 2a str. 301
auggaaaaucaucaggggcag

SEQ ID NO: 2025376 - RNA, 19 nt, Shigella flexneri 2a str. 301
augcuuuuuacuagccugc

SEQ ID NO: 2025377 - RNA, 18 nt, Shigella flexneri 2a str. 301
auggaaccguacagcaug

SEQ ID NO: 2025378 - RNA, 15 nt, Shigella flexneri 2a str. 301
auggaaaucacccag

SEQ ID NO: 2025379 - RNA, 19 nt, Shigella flexneri 2a str. 301
auggcguucgcaacaccgu

SEQ ID NO: 2025380 - RNA, 16 nt, Shigella flexneri 2a str. 301
auggcuacguagcuca

SEQ ID NO: 2025381 - RNA, 14 nt, Shigella flexneri 2a str. 301
auggcucaccagca

SEQ ID NO: 2025382 - RNA, 14 nt, Shigella flexneri 2a str. 301
auggcucagauuga

SEQ ID NO: 2025383 - RNA, 14 nt, Shigella flexneri 2a str. 301
auggcuaucaagau

SEQ ID NO: 2025384 - RNA, 21 nt, Shigella flexneri 2a str. 301
auggcguugucggcagauaac

SEQ ID NO: 2025385 - RNA, 16 nt, Shigella flexneri 2a str. 301
auggcgugagcugccu

SEQ ID NO: 2025386 - RNA, 19 nt, Shigella flexneri 2a str. 301
auggcccgccgcauuggua

SEQ ID NO: 2025387 - RNA, 18 nt, Shigella flexneri 2a str. 301
auggcaggcucagacuga

SEQ ID NO: 2025388 - RNA, 15 nt, Shigella flexneri 2a str. 301
auggcaucaccaucg

SEQ ID NO: 2025389 - RNA, 16 nt, Shigella flexneri 2a str. 301
augguaacaccagagu

SEQ ID NO: 2025390 - RNA, 21 nt, Shigella flexneri 2a str. 301
auggcucugauugauucaggg

SEQ ID NO: 2025391 - RNA, 16 nt, Shigella flexneri 2a str. 301
auggcucugcggcgga

SEQ ID NO: 2025392 - RNA, 22 nt, Shigella flexneri 2a str. 301
auggcuccgggugugacaacaa

SEQ ID NO: 2025393 - RNA, 21 nt, Shigella flexneri 2a str. 301
auggcuguuuucagcaccaga

SEQ ID NO: 2025394 - RNA, 17 nt, Shigella flexneri 2a str. 301
augggcgccauuuuuca

SEQ ID NO: 2025395 - RNA, 23 nt, Shigella flexneri 2a str. 301
auggcugccuuuuuuacaggugu

SEQ ID NO: 2025396 - RNA, 18 nt, Shigella flexneri 2a str. 301
auggcugaccagaauuua

SEQ ID NO: 2025397 - RNA, 16 nt, Shigella flexneri 2a str. 301
augguaggccggauaa

SEQ ID NO: 2025398 - RNA, 17 nt, Shigella flexneri 2a str. 301
augguaucgggcaguuu

SEQ ID NO: 2025399 - RNA, 17 nt, Shigella flexneri 2a str. 301
augguguucagauggcc

SEQ ID NO: 2025400 - RNA, 22 nt, Shigella flexneri 2a str. 301
augguguuggcaaucagcggca

SEQ ID NO: 2025401 - RNA, 22 nt, Shigella flexneri 2a str. 301
auggugucgguauaccauuucu

SEQ ID NO: 2025402 - RNA, 17 nt, Shigella flexneri 2a str. 301
augguguaaaugccggu

SEQ ID NO: 2025403 - RNA, 13 nt, Shigella flexneri 2a str. 301
auggugguggggg

SEQ ID NO: 2025404 - RNA, 14 nt, Shigella flexneri 2a str. 301
auggugguggggga

SEQ ID NO: 2025405 - RNA, 20 nt, Shigella flexneri 2a str. 301
augguggagauaaacuccac

SEQ ID NO: 2025406 - RNA, 14 nt, Shigella flexneri 2a str. 301
augguggagauaaa

SEQ ID NO: 2025407 - RNA, 19 nt, Shigella flexneri 2a str. 301
augguugaacggauauuuu

SEQ ID NO: 2025408 - RNA, 13 nt, Shigella flexneri 2a str. 301
augguuacgcaua

SEQ ID NO: 2025409 - RNA, 17 nt, Shigella flexneri 2a str. 301
augguuacuuuuuaugu

SEQ ID NO: 2025410 - RNA, 15 nt, Shigella flexneri 2a str. 301
augucgguuguacaa

SEQ ID NO: 2025411 - RNA, 19 nt, Shigella flexneri 2a str. 301
augucgguuguacaaaaaa

SEQ ID NO: 2025412 - RNA, 16 nt, Shigella flexneri 2a str. 301
augucgguacagagca

SEQ ID NO: 2025413 - RNA, 23 nt, Shigella flexneri 2a str. 301
augucgcucaaugcgcugagugu

SEQ ID NO: 2025414 - RNA, 15 nt, Shigella flexneri 2a str. 301
augucgcgccaggcg

SEQ ID NO: 2025415 - RNA, 16 nt, Shigella flexneri 2a str. 301
augucgcgcacuggau

SEQ ID NO: 2025416 - RNA, 23 nt, Shigella flexneri 2a str. 301
auguacaugucgcuguuucugga

SEQ ID NO: 2025417 - RNA, 17 nt, Shigella flexneri 2a str. 301
auguacauggugcacau

SEQ ID NO: 2025418 - RNA, 14 nt, Shigella flexneri 2a str. 301
augugcaguuccug

SEQ ID NO: 2025419 - RNA, 16 nt, Shigella flexneri 2a str. 301
augugcaccuuuucca

SEQ ID NO: 2025420 - RNA, 19 nt, Shigella flexneri 2a str. 301
augugcaggauuaauaaau

SEQ ID NO: 2025421 - RNA, 15 nt, Shigella flexneri 2a str. 301
augugauaaauacga

SEQ ID NO: 2025422 - RNA, 14 nt, Shigella flexneri 2a str. 301
augugacagagcca

SEQ ID NO: 2025423 - RNA, 17 nt, Shigella flexneri 2a str. 301
augugaauggccagaca

SEQ ID NO: 2025424 - RNA, 18 nt, Shigella flexneri 2a str. 301
augucuuuuuuccagcac

SEQ ID NO: 2025425 - RNA, 21 nt, Shigella flexneri 2a str. 301
augucuggcugagcaaacagu

SEQ ID NO: 2025426 - RNA, 17 nt, Shigella flexneri 2a str. 301
augucugucugacaacc

SEQ ID NO: 2025427 - RNA, 16 nt, Shigella flexneri 2a str. 301
augucugaucggcaau

SEQ ID NO: 2025428 - RNA, 12 nt, Shigella flexneri 2a str. 301
augucuggaacg

SEQ ID NO: 2025429 - RNA, 17 nt, Shigella flexneri 2a str. 301
auguguuaaaugauacc

SEQ ID NO: 2025430 - RNA, 23 nt, Shigella flexneri 2a str. 301
auguguuaaugaaaccuucuuga

SEQ ID NO: 2025431 - RNA, 13 nt, Shigella flexneri 2a str. 301
auguguuagcccu

SEQ ID NO: 2025432 - RNA, 15 nt, Shigella flexneri 2a str. 301
auguggcugggguac

SEQ ID NO: 2025433 - RNA, 21 nt, Shigella flexneri 2a str. 301
auguguaaguaaugacaaaau

SEQ ID NO: 2025434 - RNA, 15 nt, Shigella flexneri 2a str. 301
augugccguaaccaa

SEQ ID NO: 2025435 - RNA, 16 nt, Shigella flexneri 2a str. 301
augugcaguuccugca

SEQ ID NO: 2025436 - RNA, 11 nt, Shigella flexneri 2a str. 301
augugccauua

SEQ ID NO: 2025437 - RNA, 22 nt, Shigella flexneri 2a str. 301
augugccagcgauuuugccagc

SEQ ID NO: 2025438 - RNA, 14 nt, Shigella flexneri 2a str. 301
augugcuucaucag

SEQ ID NO: 2025439 - RNA, 11 nt, Shigella flexneri 2a str. 301
augugcuuuug

SEQ ID NO: 2025440 - RNA, 16 nt, Shigella flexneri 2a str. 301
auguggaaacagugau

SEQ ID NO: 2025441 - RNA, 17 nt, Shigella flexneri 2a str. 301
auguuauuuaauuacug

SEQ ID NO: 2025442 - RNA, 20 nt, Shigella flexneri 2a str. 301
auguucaucaagcugugccu

SEQ ID NO: 2025443 - RNA, 14 nt, Shigella flexneri 2a str. 301
auguuauucaugcc

SEQ ID NO: 2025444 - RNA, 17 nt, Shigella flexneri 2a str. 301
auguuccaucaccagau

SEQ ID NO: 2025445 - RNA, 20 nt, Shigella flexneri 2a str. 301
auguuccagggccuccugca

SEQ ID NO: 2025446 - RNA, 13 nt, Shigella flexneri 2a str. 301
auguuccuccucg

SEQ ID NO: 2025447 - RNA, 19 nt, Shigella flexneri 2a str. 301
auguuaucaagauauuuca

SEQ ID NO: 2025448 - RNA, 23 nt, Shigella flexneri 2a str. 301
auguguuuacgcguuuuucagaa

SEQ ID NO: 2025449 - RNA, 17 nt, Shigella flexneri 2a str. 301
auguguuuauaagccau

SEQ ID NO: 2025450 - RNA, 15 nt, Shigella flexneri 2a str. 301
auguuaaccaucuca

SEQ ID NO: 2025451 - RNA, 14 nt, Shigella flexneri 2a str. 301
auguuaaccgccug

SEQ ID NO: 2025452 - RNA, 18 nt, Shigella flexneri 2a str. 301
auguuacgaccuuccuga

SEQ ID NO: 2025453 - RNA, 17 nt, Shigella flexneri 2a str. 301
auguuacaaccuccucc

SEQ ID NO: 2025454 - RNA, 14 nt, Shigella flexneri 2a str. 301
auguucuaucuuuc

SEQ ID NO: 2025455 - RNA, 13 nt, Shigella flexneri 2a str. 301
auguugaaucuuc

SEQ ID NO: 2025456 - RNA, 22 nt, Shigella flexneri 2a str. 301
auguucgccagauuuuuaucca

SEQ ID NO: 2025457 - RNA, 17 nt, Shigella flexneri 2a str. 301
auguuaggcaagccaca

SEQ ID NO: 2025458 - RNA, 18 nt, Shigella flexneri 2a str. 301
auguuccuucugucauga

SEQ ID NO: 2025459 - RNA, 17 nt, Shigella flexneri 2a str. 301
auguucgccagauuuuu

SEQ ID NO: 2025460 - RNA, 21 nt, Shigella flexneri 2a str. 301
auguuuuaacacacaauuacc

SEQ ID NO: 2025461 - RNA, 14 nt, Shigella flexneri 2a str. 301
auguuuuccagcac

SEQ ID NO: 2025462 - RNA, 16 nt, Shigella flexneri 2a str. 301
auuaaaaagccugcca

SEQ ID NO: 2025463 - RNA, 12 nt, Shigella flexneri 2a str. 301
auuaaagaaagu

SEQ ID NO: 2025464 - RNA, 14 nt, Shigella flexneri 2a str. 301
auuaaagagaucga

SEQ ID NO: 2025465 - RNA, 21 nt, Shigella flexneri 2a str. 301
auuaaaggaaggucauccaaa

SEQ ID NO: 2025466 - RNA, 19 nt, Shigella flexneri 2a str. 301
auuaaauccggcguuuuca

SEQ ID NO: 2025467 - RNA, 15 nt, Shigella flexneri 2a str. 301
auuaaaggcaccaau

SEQ ID NO: 2025468 - RNA, 17 nt, Shigella flexneri 2a str. 301
auuaaaggcaccaauau

SEQ ID NO: 2025469 - RNA, 18 nt, Shigella flexneri 2a str. 301
auuaagccaugaaugaug

SEQ ID NO: 2025470 - RNA, 21 nt, Shigella flexneri 2a str. 301
auuaagccaugaaugauguaa

SEQ ID NO: 2025471 - RNA, 17 nt, Shigella flexneri 2a str. 301
auuaaggcaagaaaauu

SEQ ID NO: 2025472 - RNA, 15 nt, Shigella flexneri 2a str. 301
auuaaggcaagaaaa

SEQ ID NO: 2025473 - RNA, 22 nt, Shigella flexneri 2a str. 301
auuaagcgcaaaggccagcaau

SEQ ID NO: 2025474 - RNA, 20 nt, Shigella flexneri 2a str. 301
auuaauacaacaacacccau

SEQ ID NO: 2025475 - RNA, 14 nt, Shigella flexneri 2a str. 301
auuaacgcugggga

SEQ ID NO: 2025476 - RNA, 15 nt, Shigella flexneri 2a str. 301
auuaacgcaauaaug

SEQ ID NO: 2025477 - RNA, 22 nt, Shigella flexneri 2a str. 301
auuaacgacgcauacucuuuga

SEQ ID NO: 2025478 - RNA, 20 nt, Shigella flexneri 2a str. 301
auuaacgacacucucuucaa

SEQ ID NO: 2025479 - RNA, 22 nt, Shigella flexneri 2a str. 301
auuaaccgggcguuauuuccag

SEQ ID NO: 2025480 - RNA, 16 nt, Shigella flexneri 2a str. 301
auuaacuuuucauccu

SEQ ID NO: 2025481 - RNA, 22 nt, Shigella flexneri 2a str. 301
auuaacugcgcgauuaucauuu

SEQ ID NO: 2025482 - RNA, 13 nt, Shigella flexneri 2a str. 301
auuaacguaucaa

SEQ ID NO: 2025483 - RNA, 14 nt, Shigella flexneri 2a str. 301
auuaacguuuccau

SEQ ID NO: 2025484 - RNA, 22 nt, Shigella flexneri 2a str. 301
auuaacucagcauuauuuuuaa

SEQ ID NO: 2025485 - RNA, 20 nt, Shigella flexneri 2a str. 301
auuaacugcgcgauuaucau

SEQ ID NO: 2025486 - RNA, 19 nt, Shigella flexneri 2a str. 301
auuauaguaucguuaaauu

SEQ ID NO: 2025487 - RNA, 17 nt, Shigella flexneri 2a str. 301
auuaucgcgucuaaauu

SEQ ID NO: 2025488 - RNA, 17 nt, Shigella flexneri 2a str. 301
auuagugcugcuggaag

SEQ ID NO: 2025489 - RNA, 16 nt, Shigella flexneri 2a str. 301
auuagucuuuaucugc

SEQ ID NO: 2025490 - RNA, 15 nt, Shigella flexneri 2a str. 301
auuaugccugauuac

SEQ ID NO: 2025491 - RNA, 17 nt, Shigella flexneri 2a str. 301
auuaucgucauggcugu

SEQ ID NO: 2025492 - RNA, 23 nt, Shigella flexneri 2a str. 301
auuaucggcucgaucuggugcaa

SEQ ID NO: 2025493 - RNA, 16 nt, Shigella flexneri 2a str. 301
auuauggaucaccauc

SEQ ID NO: 2025494 - RNA, 20 nt, Shigella flexneri 2a str. 301
auuaugucgcucaaugcgcu

SEQ ID NO: 2025495 - RNA, 22 nt, Shigella flexneri 2a str. 301
auuaugucgcucaaugugcuga

SEQ ID NO: 2025496 - RNA, 15 nt, Shigella flexneri 2a str. 301
auuauuaaauuuaau

SEQ ID NO: 2025497 - RNA, 15 nt, Shigella flexneri 2a str. 301
auucaaaauccgcca

SEQ ID NO: 2025498 - RNA, 22 nt, Shigella flexneri 2a str. 301
auucaaagcgauuauagcuaac

SEQ ID NO: 2025499 - RNA, 15 nt, Shigella flexneri 2a str. 301
auucaaguaucuauu

SEQ ID NO: 2025500 - RNA, 16 nt, Shigella flexneri 2a str. 301
auucaaguaucuauuc

SEQ ID NO: 2025501 - RNA, 19 nt, Shigella flexneri 2a str. 301
auucaagauuagccugaau

SEQ ID NO: 2025502 - RNA, 18 nt, Shigella flexneri 2a str. 301
auucaagacaucaauaaa

SEQ ID NO: 2025503 - RNA, 13 nt, Shigella flexneri 2a str. 301
auucaagaucaug

SEQ ID NO: 2025504 - RNA, 16 nt, Shigella flexneri 2a str. 301
auucaagacaucaaua

SEQ ID NO: 2025505 - RNA, 19 nt, Shigella flexneri 2a str. 301
auuauuucuuuuacauuau

SEQ ID NO: 2025506 - RNA, 20 nt, Shigella flexneri 2a str. 301
auuauuucaaugcauuauca

SEQ ID NO: 2025507 - RNA, 13 nt, Shigella flexneri 2a str. 301
auuauuucccggc

SEQ ID NO: 2025508 - RNA, 12 nt, Shigella flexneri 2a str. 301
auuauuuuaaau

SEQ ID NO: 2025509 - RNA, 14 nt, Shigella flexneri 2a str. 301
auuauuuuuaaaca

SEQ ID NO: 2025510 - RNA, 22 nt, Shigella flexneri 2a str. 301
auuauuaaagagcgccucccuu

SEQ ID NO: 2025511 - RNA, 12 nt, Shigella flexneri 2a str. 301
auuacucagcaa

SEQ ID NO: 2025512 - RNA, 15 nt, Shigella flexneri 2a str. 301
auuacucagcgcugc

SEQ ID NO: 2025513 - RNA, 16 nt, Shigella flexneri 2a str. 301
auuacucaacagguaa

SEQ ID NO: 2025514 - RNA, 22 nt, Shigella flexneri 2a str. 301
auuacugagcaauugcucauag

SEQ ID NO: 2025515 - RNA, 22 nt, Shigella flexneri 2a str. 301
auuaccuuaucaaucucagcaa

SEQ ID NO: 2025516 - RNA, 23 nt, Shigella flexneri 2a str. 301
auuaccuuauaacgcuuauaaau

SEQ ID NO: 2025517 - RNA, 18 nt, Shigella flexneri 2a str. 301
auuaccguuaaaaccauc

SEQ ID NO: 2025518 - RNA, 13 nt, Shigella flexneri 2a str. 301
auuaccuuccuca

SEQ ID NO: 2025519 - RNA, 17 nt, Shigella flexneri 2a str. 301
auuacggaucuuuucuu

SEQ ID NO: 2025520 - RNA, 14 nt, Shigella flexneri 2a str. 301
auuacggauuaaau

SEQ ID NO: 2025521 - RNA, 15 nt, Shigella flexneri 2a str. 301
auuacggucaaauua

SEQ ID NO: 2025522 - RNA, 19 nt, Shigella flexneri 2a str. 301
auuacguccaucacaauca

SEQ ID NO: 2025523 - RNA, 22 nt, Shigella flexneri 2a str. 301
auuacguggguaggaucacaag

SEQ ID NO: 2025524 - RNA, 20 nt, Shigella flexneri 2a str. 301
auuacguggguaggaucaga

SEQ ID NO: 2025525 - RNA, 21 nt, Shigella flexneri 2a str. 301
auuaccgaacaacaagaagcg

SEQ ID NO: 2025526 - RNA, 23 nt, Shigella flexneri 2a str. 301
auuacuuuauuuauaucagugau

SEQ ID NO: 2025527 - RNA, 15 nt, Shigella flexneri 2a str. 301
auuacuuuauuuaua

SEQ ID NO: 2025528 - RNA, 18 nt, Shigella flexneri 2a str. 301
auuacuuuccaucuuucc

SEQ ID NO: 2025529 - RNA, 20 nt, Shigella flexneri 2a str. 301
auuagacgaacguuuaauaa

SEQ ID NO: 2025530 - RNA, 21 nt, Shigella flexneri 2a str. 301
auuacuucuugaugcggauaa

SEQ ID NO: 2025531 - RNA, 22 nt, Shigella flexneri 2a str. 301
auuacuuaucccugucuaacca

SEQ ID NO: 2025532 - RNA, 14 nt, Shigella flexneri 2a str. 301
auuacuuacacauc

SEQ ID NO: 2025533 - RNA, 21 nt, Shigella flexneri 2a str. 301
auuagcaaugcgcuguaauuu

SEQ ID NO: 2025534 - RNA, 17 nt, Shigella flexneri 2a str. 301
auuagcaauauuuuuau

SEQ ID NO: 2025535 - RNA, 17 nt, Shigella flexneri 2a str. 301
auuagcacgauuuugua

SEQ ID NO: 2025536 - RNA, 17 nt, Shigella flexneri 2a str. 301
auuagauaaaaaugaag

SEQ ID NO: 2025537 - RNA, 13 nt, Shigella flexneri 2a str. 301
auuagauaaaaau

SEQ ID NO: 2025538 - RNA, 14 nt, Shigella flexneri 2a str. 301
aaaagccuaagaag

SEQ ID NO: 2025539 - RNA, 19 nt, Shigella flexneri 2a str. 301
auuagcccgguagcaugaa

SEQ ID NO: 2025540 - RNA, 20 nt, Shigella flexneri 2a str. 301
auuagccgguaaaucaccag

SEQ ID NO: 2025541 - RNA, 22 nt, Shigella flexneri 2a str. 301
auuagcaucgcgauggcaagcg

SEQ ID NO: 2025542 - RNA, 17 nt, Shigella flexneri 2a str. 301
auuagcauggccgccaa

SEQ ID NO: 2025543 - RNA, 12 nt, Shigella flexneri 2a str. 301
auuagccaggca

SEQ ID NO: 2025544 - RNA, 19 nt, Shigella flexneri 2a str. 301
auuccacgauaaaauuccu

SEQ ID NO: 2025545 - RNA, 19 nt, Shigella flexneri 2a str. 301
auucauuuugcuggaaaag

SEQ ID NO: 2025546 - RNA, 16 nt, Shigella flexneri 2a str. 301
auuccacgggcaauau

SEQ ID NO: 2025547 - RNA, 14 nt, Shigella flexneri 2a str. 301
auuccacuuuuucg

SEQ ID NO: 2025548 - RNA, 22 nt, Shigella flexneri 2a str. 301
auuccacuuuuucgaacgcugc

SEQ ID NO: 2025549 - RNA, 14 nt, Shigella flexneri 2a str. 301
auuccacucauuaa

SEQ ID NO: 2025550 - RNA, 21 nt, Shigella flexneri 2a str. 301
auuccaguucgaucucuucgc

SEQ ID NO: 2025551 - RNA, 22 nt, Shigella flexneri 2a str. 301
auuccauuucccugacaaauca

SEQ ID NO: 2025552 - RNA, 16 nt, Shigella flexneri 2a str. 301
auuccuuaugguucac

SEQ ID NO: 2025553 - RNA, 17 nt, Shigella flexneri 2a str. 301
auuccuccgguagccau

SEQ ID NO: 2025554 - RNA, 16 nt, Shigella flexneri 2a str. 301
auuccuaugcaacaac

SEQ ID NO: 2025555 - RNA, 24 nt, Shigella flexneri 2a str. 301
auucccugcagucaccugcccucc

SEQ ID NO: 2025556 - RNA, 19 nt, Shigella flexneri 2a str. 301
auucccgcgaacuaaacaa

SEQ ID NO: 2025557 - RNA, 16 nt, Shigella flexneri 2a str. 301
auucccggaaauugcc

SEQ ID NO: 2025558 - RNA, 14 nt, Shigella flexneri 2a str. 301
auucccguuuucuu

SEQ ID NO: 2025559 - RNA, 17 nt, Shigella flexneri 2a str. 301
auucaugaacacacccg

SEQ ID NO: 2025560 - RNA, 13 nt, Shigella flexneri 2a str. 301
auucaucaaaugg

SEQ ID NO: 2025561 - RNA, 12 nt, Shigella flexneri 2a str. 301
auucaucaauuc

SEQ ID NO: 2025562 - RNA, 19 nt, Shigella flexneri 2a str. 301
auucaucgcccuuuuuuca

SEQ ID NO: 2025563 - RNA, 15 nt, Shigella flexneri 2a str. 301
auucauuacucaacg

SEQ ID NO: 2025564 - RNA, 16 nt, Shigella flexneri 2a str. 301
auucauuaguuuggcc

SEQ ID NO: 2025565 - RNA, 14 nt, Shigella flexneri 2a str. 301
auucauuaaaacug

SEQ ID NO: 2025566 - RNA, 22 nt, Shigella flexneri 2a str. 301
auucauuuugcuggaaaaguaa

SEQ ID NO: 2025567 - RNA, 20 nt, Shigella flexneri 2a str. 301
auucgcuccccugcaaauua

SEQ ID NO: 2025568 - RNA, 18 nt, Shigella flexneri 2a str. 301
auuccuuucccuauuuuu

SEQ ID NO: 2025569 - RNA, 21 nt, Shigella flexneri 2a str. 301
auucgcuuccucaaccacuuu

SEQ ID NO: 2025570 - RNA, 19 nt, Shigella flexneri 2a str. 301
auucgucguauagaucacu

SEQ ID NO: 2025571 - RNA, 17 nt, Shigella flexneri 2a str. 301
auucucaauaucaucau

SEQ ID NO: 2025572 - RNA, 16 nt, Shigella flexneri 2a str. 301
auucucaaaauacagu

SEQ ID NO: 2025573 - RNA, 19 nt, Shigella flexneri 2a str. 301
auucuaucgcccccucuuc

SEQ ID NO: 2025574 - RNA, 20 nt, Shigella flexneri 2a str. 301
auucucaaaauacaguagaa

SEQ ID NO: 2025575 - RNA, 17 nt, Shigella flexneri 2a str. 301
auucuccggcaggaaau

SEQ ID NO: 2025576 - RNA, 16 nt, Shigella flexneri 2a str. 301
auucuacagaaaugaa

SEQ ID NO: 2025577 - RNA, 13 nt, Shigella flexneri 2a str. 301
auucuaagugaua

SEQ ID NO: 2025578 - RNA, 16 nt, Shigella flexneri 2a str. 301
auucugagagcaugaa

SEQ ID NO: 2025579 - RNA, 21 nt, Shigella flexneri 2a str. 301
auucugagagcaugaaaugaa

SEQ ID NO: 2025580 - RNA, 23 nt, Shigella flexneri 2a str. 301
auucucuuuucacgcaauaccug

SEQ ID NO: 2025581 - RNA, 16 nt, Shigella flexneri 2a str. 301
auucuugccuuuccuc

SEQ ID NO: 2025582 - RNA, 16 nt, Shigella flexneri 2a str. 301
auucugggaacuauau

SEQ ID NO: 2025583 - RNA, 17 nt, Shigella flexneri 2a str. 301
auucuggcggcaauaac

SEQ ID NO: 2025584 - RNA, 20 nt, Shigella flexneri 2a str. 301
auucuggcaccaccuggcuu

SEQ ID NO: 2025585 - RNA, 17 nt, Shigella flexneri 2a str. 301
auucugcgcugacucua

SEQ ID NO: 2025586 - RNA, 19 nt, Shigella flexneri 2a str. 301
auucugcuggccuggcugg

SEQ ID NO: 2025587 - RNA, 15 nt, Shigella flexneri 2a str. 301
auucugcugauuaac

SEQ ID NO: 2025588 - RNA, 20 nt, Shigella flexneri 2a str. 301
auugaucuaccgcuucccuu

SEQ ID NO: 2025589 - RNA, 18 nt, Shigella flexneri 2a str. 301
auugauccgcgauaaguc

SEQ ID NO: 2025590 - RNA, 15 nt, Shigella flexneri 2a str. 301
auugaugcacaccau

SEQ ID NO: 2025591 - RNA, 20 nt, Shigella flexneri 2a str. 301
auugaaaaagugccaaaaau

SEQ ID NO: 2025592 - RNA, 19 nt, Shigella flexneri 2a str. 301
auugaaaaguccaggcugc

SEQ ID NO: 2025593 - RNA, 14 nt, Shigella flexneri 2a str. 301
auugcaaccacaca

SEQ ID NO: 2025594 - RNA, 15 nt, Shigella flexneri 2a str. 301
auugcaaaccucagg

SEQ ID NO: 2025595 - RNA, 19 nt, Shigella flexneri 2a str. 301
auugcacauucccugcagu

SEQ ID NO: 2025596 - RNA, 14 nt, Shigella flexneri 2a str. 301
auugcagacaaagu

SEQ ID NO: 2025597 - RNA, 17 nt, Shigella flexneri 2a str. 301
auugcagaguacagccu

SEQ ID NO: 2025598 - RNA, 17 nt, Shigella flexneri 2a str. 301
auugcagauaccacauc

SEQ ID NO: 2025599 - RNA, 15 nt, Shigella flexneri 2a str. 301
auugcaggagcggug

SEQ ID NO: 2025600 - RNA, 13 nt, Shigella flexneri 2a str. 301
auugcagucauaa

SEQ ID NO: 2025601 - RNA, 18 nt, Shigella flexneri 2a str. 301
auugcggaacaucgccug

SEQ ID NO: 2025602 - RNA, 21 nt, Shigella flexneri 2a str. 301
auugcggaacaucgccugccg

SEQ ID NO: 2025603 - RNA, 15 nt, Shigella flexneri 2a str. 301
auugcgacgagaaaa

SEQ ID NO: 2025604 - RNA, 20 nt, Shigella flexneri 2a str. 301
auugcgaauuauaauuccuu

SEQ ID NO: 2025605 - RNA, 21 nt, Shigella flexneri 2a str. 301
auugccugaugcgacgcugcg

SEQ ID NO: 2025606 - RNA, 18 nt, Shigella flexneri 2a str. 301
auugccgggugcaagagu

SEQ ID NO: 2025607 - RNA, 19 nt, Shigella flexneri 2a str. 301
auugccguuucgcagguuc

SEQ ID NO: 2025608 - RNA, 11 nt, Shigella flexneri 2a str. 301
auugcugccag

SEQ ID NO: 2025609 - RNA, 18 nt, Shigella flexneri 2a str. 301
auugcgugucccacuggu

SEQ ID NO: 2025610 - RNA, 15 nt, Shigella flexneri 2a str. 301
auugcgugucccacu

SEQ ID NO: 2025611 - RNA, 15 nt, Shigella flexneri 2a str. 301
auugcgugguuuuug

SEQ ID NO: 2025612 - RNA, 16 nt, Shigella flexneri 2a str. 301
auugcguaaucuuuuc

SEQ ID NO: 2025613 - RNA, 20 nt, Shigella flexneri 2a str. 301
auugccagaugcgacgcugg

SEQ ID NO: 2025614 - RNA, 17 nt, Shigella flexneri 2a str. 301
auugccagagcccauca

SEQ ID NO: 2025615 - RNA, 13 nt, Shigella flexneri 2a str. 301
auugccagaugcg

SEQ ID NO: 2025616 - RNA, 12 nt, Shigella flexneri 2a str. 301
auugccagccgu

SEQ ID NO: 2025617 - RNA, 11 nt, Shigella flexneri 2a str. 301
auugccaguaa

SEQ ID NO: 2025618 - RNA, 20 nt, Shigella flexneri 2a str. 301
auugccaguaacagaacgca

SEQ ID NO: 2025619 - RNA, 19 nt, Shigella flexneri 2a str. 301
auugccacccugcggcugc

SEQ ID NO: 2025620 - RNA, 17 nt, Shigella flexneri 2a str. 301
auugccccagaugccag

SEQ ID NO: 2025621 - RNA, 20 nt, Shigella flexneri 2a str. 301
auugccgggcuaacuucuuu

SEQ ID NO: 2025622 - RNA, 23 nt, Shigella flexneri 2a str. 301
auugccgcgucguccucuucacc

SEQ ID NO: 2025623 - RNA, 20 nt, Shigella flexneri 2a str. 301
auugccgcgucguccucuuc

SEQ ID NO: 2025624 - RNA, 16 nt, Shigella flexneri 2a str. 301
auuguuauaucaauua

SEQ ID NO: 2025625 - RNA, 19 nt, Shigella flexneri 2a str. 301
auuguuauaucaauuauua

SEQ ID NO: 2025626 - RNA, 14 nt, Shigella flexneri 2a str. 301
auugucgccacaaa

SEQ ID NO: 2025627 - RNA, 17 nt, Shigella flexneri 2a str. 301
auugucguuguacaaca

SEQ ID NO: 2025628 - RNA, 16 nt, Shigella flexneri 2a str. 301
auuguggcguccagga

SEQ ID NO: 2025629 - RNA, 17 nt, Shigella flexneri 2a str. 301
auugugugauacuucuu

SEQ ID NO: 2025630 - RNA, 18 nt, Shigella flexneri 2a str. 301
auugugugauacuucuuc

SEQ ID NO: 2025631 - RNA, 21 nt, Shigella flexneri 2a str. 301
auuguguaaauucaauaaauu

SEQ ID NO: 2025632 - RNA, 18 nt, Shigella flexneri 2a str. 301
auuguguagccagaaugc

SEQ ID NO: 2025633 - RNA, 16 nt, Shigella flexneri 2a str. 301
auuuaacaguugucca

SEQ ID NO: 2025634 - RNA, 23 nt, Shigella flexneri 2a str. 301
auuuaacaccaucauauuuucca

SEQ ID NO: 2025635 - RNA, 12 nt, Shigella flexneri 2a str. 301
auuuaacaccau

SEQ ID NO: 2025636 - RNA, 13 nt, Shigella flexneri 2a str. 301
auuuaacagcaaa

SEQ ID NO: 2025637 - RNA, 14 nt, Shigella flexneri 2a str. 301
auuuaaaucaaacg

SEQ ID NO: 2025638 - RNA, 18 nt, Shigella flexneri 2a str. 301
auuguuugcaaaaucaaa

SEQ ID NO: 2025639 - RNA, 19 nt, Shigella flexneri 2a str. 301
auuguuugcaaaaucaaau

SEQ ID NO: 2025640 - RNA, 17 nt, Shigella flexneri 2a str. 301
auuguuuccauauguac

SEQ ID NO: 2025641 - RNA, 16 nt, Shigella flexneri 2a str. 301
auuguagaaaaucuca

SEQ ID NO: 2025642 - RNA, 14 nt, Shigella flexneri 2a str. 301
auuguaaucuauug

SEQ ID NO: 2025643 - RNA, 22 nt, Shigella flexneri 2a str. 301
auugguugcgcuucuuccagca

SEQ ID NO: 2025644 - RNA, 13 nt, Shigella flexneri 2a str. 301
auugcugcugccg

SEQ ID NO: 2025645 - RNA, 14 nt, Shigella flexneri 2a str. 301
auugcugguauaaa

SEQ ID NO: 2025646 - RNA, 22 nt, Shigella flexneri 2a str. 301
auugcugguauaaaauagcaau

SEQ ID NO: 2025647 - RNA, 16 nt, Shigella flexneri 2a str. 301
auugcuucaccagcag

SEQ ID NO: 2025648 - RNA, 21 nt, Shigella flexneri 2a str. 301
auuggcgcgcguaugcgucag

SEQ ID NO: 2025649 - RNA, 13 nt, Shigella flexneri 2a str. 301
auugcuucaagau

SEQ ID NO: 2025650 - RNA, 19 nt, Shigella flexneri 2a str. 301
auugcugugccggaagggg

SEQ ID NO: 2025651 - RNA, 17 nt, Shigella flexneri 2a str. 301
auuggcggcguccugga

SEQ ID NO: 2025652 - RNA, 23 nt, Shigella flexneri 2a str. 301
auuggcggcguccuggaacuggu

SEQ ID NO: 2025653 - RNA, 14 nt, Shigella flexneri 2a str. 301
auuggcugggguac

SEQ ID NO: 2025654 - RNA, 16 nt, Shigella flexneri 2a str. 301
auugggcgaaagaaaa

SEQ ID NO: 2025655 - RNA, 15 nt, Shigella flexneri 2a str. 301
auugggcgaucuccc

SEQ ID NO: 2025656 - RNA, 18 nt, Shigella flexneri 2a str. 301
aaaagggagcuaucuccc

SEQ ID NO: 2025657 - RNA, 15 nt, Shigella flexneri 2a str. 301
aaaagggcuggaagc

SEQ ID NO: 2025658 - RNA, 17 nt, Shigella flexneri 2a str. 301
caaaaaaggcugacaaa

SEQ ID NO: 2025659 - RNA, 20 nt, Shigella flexneri 2a str. 301
caaaaaaggcugacaaauca

SEQ ID NO: 2025660 - RNA, 19 nt, Shigella flexneri 2a str. 301
caaaaaaagaauucagacc

SEQ ID NO: 2025661 - RNA, 17 nt, Shigella flexneri 2a str. 301
caaaaaaggugcugaaa

SEQ ID NO: 2025662 - RNA, 19 nt, Shigella flexneri 2a str. 301
caaaaaaucaacgacaaaa

SEQ ID NO: 2025663 - RNA, 22 nt, Shigella flexneri 2a str. 301
auuuuuucacauguucauuuau

SEQ ID NO: 2025664 - RNA, 12 nt, Shigella flexneri 2a str. 301
auuuuuucccau

SEQ ID NO: 2025665 - RNA, 14 nt, Shigella flexneri 2a str. 301
auuuuuuuucaacc

SEQ ID NO: 2025666 - RNA, 16 nt, Shigella flexneri 2a str. 301
auuuuuuuucaggaaa

SEQ ID NO: 2025667 - RNA, 21 nt, Shigella flexneri 2a str. 301
auuuuuuuucaggaaauaaau

SEQ ID NO: 2025668 - RNA, 19 nt, Shigella flexneri 2a str. 301
caaaaaaaccgccucaggc

SEQ ID NO: 2025669 - RNA, 15 nt, Shigella flexneri 2a str. 301
auuuuucgcuaaaaa

SEQ ID NO: 2025670 - RNA, 16 nt, Shigella flexneri 2a str. 301
auuuuucgcuaaaaaa

SEQ ID NO: 2025671 - RNA, 22 nt, Shigella flexneri 2a str. 301
auuuuucgagggugcgaauaag

SEQ ID NO: 2025672 - RNA, 13 nt, Shigella flexneri 2a str. 301
auuuuuuauagua

SEQ ID NO: 2025673 - RNA, 18 nt, Shigella flexneri 2a str. 301
auuuucgccaucucaaaa

SEQ ID NO: 2025674 - RNA, 16 nt, Shigella flexneri 2a str. 301
auuuucgaaaaaaaag

SEQ ID NO: 2025675 - RNA, 19 nt, Shigella flexneri 2a str. 301
auuuucgaaaaaaaagaag

SEQ ID NO: 2025676 - RNA, 16 nt, Shigella flexneri 2a str. 301
auuuugcuggaaaagu

SEQ ID NO: 2025677 - RNA, 15 nt, Shigella flexneri 2a str. 301
auuuugcuuccggca

SEQ ID NO: 2025678 - RNA, 23 nt, Shigella flexneri 2a str. 301
auuuugcuuccggcaagcaaaug

SEQ ID NO: 2025679 - RNA, 16 nt, Shigella flexneri 2a str. 301
auuuugugauauguau

SEQ ID NO: 2025680 - RNA, 15 nt, Shigella flexneri 2a str. 301
auuuuuaaacaucaa

SEQ ID NO: 2025681 - RNA, 20 nt, Shigella flexneri 2a str. 301
auuuugugauauguaugaag

SEQ ID NO: 2025682 - RNA, 16 nt, Shigella flexneri 2a str. 301
auuuugugcagcaugc

SEQ ID NO: 2025683 - RNA, 17 nt, Shigella flexneri 2a str. 301
auuuuucacuuaaugaa

SEQ ID NO: 2025684 - RNA, 14 nt, Shigella flexneri 2a str. 301
auuuuucaauaucc

SEQ ID NO: 2025685 - RNA, 16 nt, Shigella flexneri 2a str. 301
auuuuuccagcauuuc

SEQ ID NO: 2025686 - RNA, 17 nt, Shigella flexneri 2a str. 301
auuuuuccagcauuucu

SEQ ID NO: 2025687 - RNA, 16 nt, Shigella flexneri 2a str. 301
auuugaggaguuuaau

SEQ ID NO: 2025688 - RNA, 20 nt, Shigella flexneri 2a str. 301
auuugaggaguuuaauaaau

SEQ ID NO: 2025689 - RNA, 13 nt, Shigella flexneri 2a str. 301
auuugauauuuau

SEQ ID NO: 2025690 - RNA, 16 nt, Shigella flexneri 2a str. 301
auuugaucaaauacuu

SEQ ID NO: 2025691 - RNA, 14 nt, Shigella flexneri 2a str. 301
auuuuaagcaagug

SEQ ID NO: 2025692 - RNA, 13 nt, Shigella flexneri 2a str. 301
auuuuacauccug

SEQ ID NO: 2025693 - RNA, 20 nt, Shigella flexneri 2a str. 301
auuuuacaggguaaaaccau

SEQ ID NO: 2025694 - RNA, 20 nt, Shigella flexneri 2a str. 301
auuuuauuucuguauuacag

SEQ ID NO: 2025695 - RNA, 17 nt, Shigella flexneri 2a str. 301
auuuucaauaaccugca

SEQ ID NO: 2025696 - RNA, 14 nt, Shigella flexneri 2a str. 301
auuuucauccugca

SEQ ID NO: 2025697 - RNA, 20 nt, Shigella flexneri 2a str. 301
auuucugugcagccaaaaau

SEQ ID NO: 2025698 - RNA, 16 nt, Shigella flexneri 2a str. 301
auuucuuauuacagau

SEQ ID NO: 2025699 - RNA, 13 nt, Shigella flexneri 2a str. 301
auuucuguuugcg

SEQ ID NO: 2025700 - RNA, 13 nt, Shigella flexneri 2a str. 301
auuucuucugguu

SEQ ID NO: 2025701 - RNA, 22 nt, Shigella flexneri 2a str. 301
auuucuuccagcguuucaagug

SEQ ID NO: 2025702 - RNA, 21 nt, Shigella flexneri 2a str. 301
auuucuucauacuaccuggac

SEQ ID NO: 2025703 - RNA, 15 nt, Shigella flexneri 2a str. 301
auuugaaaccgucuu

SEQ ID NO: 2025704 - RNA, 21 nt, Shigella flexneri 2a str. 301
auuucugccuugaguuuuuca

SEQ ID NO: 2025705 - RNA, 18 nt, Shigella flexneri 2a str. 301
auuucugcgggggcggca

SEQ ID NO: 2025706 - RNA, 16 nt, Shigella flexneri 2a str. 301
auuucugcuucguuaa

SEQ ID NO: 2025707 - RNA, 23 nt, Shigella flexneri 2a str. 301
auuucugcugccacuuucucacu

SEQ ID NO: 2025708 - RNA, 19 nt, Shigella flexneri 2a str. 301
auuucuggcggcuuauaua

SEQ ID NO: 2025709 - RNA, 22 nt, Shigella flexneri 2a str. 301
auuucuggcggcuuauauauua

SEQ ID NO: 2025710 - RNA, 15 nt, Shigella flexneri 2a str. 301
auuucucgugccacc

SEQ ID NO: 2025711 - RNA, 18 nt, Shigella flexneri 2a str. 301
auuucucguuggucauca

SEQ ID NO: 2025712 - RNA, 16 nt, Shigella flexneri 2a str. 301
auuucugauuguuaac

SEQ ID NO: 2025713 - RNA, 20 nt, Shigella flexneri 2a str. 301
auuucguccagcgaaccuuc

SEQ ID NO: 2025714 - RNA, 16 nt, Shigella flexneri 2a str. 301
auuucgucuucaucaa

SEQ ID NO: 2025715 - RNA, 17 nt, Shigella flexneri 2a str. 301
auuucucggcaaauuca

SEQ ID NO: 2025716 - RNA, 19 nt, Shigella flexneri 2a str. 301
auuuccauugcucuggcaa

SEQ ID NO: 2025717 - RNA, 20 nt, Shigella flexneri 2a str. 301
auuuccauugcucuggcaaa

SEQ ID NO: 2025718 - RNA, 16 nt, Shigella flexneri 2a str. 301
auuuccaucuccagcu

SEQ ID NO: 2025719 - RNA, 21 nt, Shigella flexneri 2a str. 301
auuucagcgcagacaaucaca

SEQ ID NO: 2025720 - RNA, 18 nt, Shigella flexneri 2a str. 301
auuucacaguacgcuuga

SEQ ID NO: 2025721 - RNA, 13 nt, Shigella flexneri 2a str. 301
auuucacaguaau

SEQ ID NO: 2025722 - RNA, 15 nt, Shigella flexneri 2a str. 301
auuucaccagcgcac

SEQ ID NO: 2025723 - RNA, 16 nt, Shigella flexneri 2a str. 301
auuucacaccaucaac

SEQ ID NO: 2025724 - RNA, 20 nt, Shigella flexneri 2a str. 301
auuucaccgucaucgacaaa

SEQ ID NO: 2025725 - RNA, 14 nt, Shigella flexneri 2a str. 301
auuucagccccagc

SEQ ID NO: 2025726 - RNA, 17 nt, Shigella flexneri 2a str. 301
auuucggcgugcgcgcc

SEQ ID NO: 2025727 - RNA, 14 nt, Shigella flexneri 2a str. 301
auuucgcugcccau

SEQ ID NO: 2025728 - RNA, 21 nt, Shigella flexneri 2a str. 301
auuuccggcggcggaaaguau

SEQ ID NO: 2025729 - RNA, 16 nt, Shigella flexneri 2a str. 301
auuuccgguacuggcu

SEQ ID NO: 2025730 - RNA, 18 nt, Shigella flexneri 2a str. 301
auuuccccuguugcaaac

SEQ ID NO: 2025731 - RNA, 19 nt, Shigella flexneri 2a str. 301
auuucccagcaagaaccau

SEQ ID NO: 2025732 - RNA, 22 nt, Shigella flexneri 2a str. 301
auuucccagcaagaaccaugca

SEQ ID NO: 2025733 - RNA, 14 nt, Shigella flexneri 2a str. 301
auuucccagcaaga

SEQ ID NO: 2025734 - RNA, 20 nt, Shigella flexneri 2a str. 301
auuucccagauagcaacagc

SEQ ID NO: 2025735 - RNA, 15 nt, Shigella flexneri 2a str. 301
auuuccauuuuugac

SEQ ID NO: 2025736 - RNA, 13 nt, Shigella flexneri 2a str. 301
auuucccugacaa

SEQ ID NO: 2025737 - RNA, 15 nt, Shigella flexneri 2a str. 301
auuucccggccacgc

SEQ ID NO: 2025738 - RNA, 16 nt, Shigella flexneri 2a str. 301
auuucccggcugauaa

SEQ ID NO: 2025739 - RNA, 13 nt, Shigella flexneri 2a str. 301
auuucccgcucau

SEQ ID NO: 2025740 - RNA, 16 nt, Shigella flexneri 2a str. 301
auuuccgcgaaacagg

SEQ ID NO: 2025741 - RNA, 16 nt, Shigella flexneri 2a str. 301
auuucccugacaaauc

SEQ ID NO: 2025742 - RNA, 22 nt, Shigella flexneri 2a str. 301
auuuaugccauguucaucaagc

SEQ ID NO: 2025743 - RNA, 21 nt, Shigella flexneri 2a str. 301
auuuaugcuguccuaaaaaau

SEQ ID NO: 2025744 - RNA, 14 nt, Shigella flexneri 2a str. 301
auuuaugauauuuu

SEQ ID NO: 2025745 - RNA, 21 nt, Shigella flexneri 2a str. 301
auuuauuaucuggcaagccug

SEQ ID NO: 2025746 - RNA, 20 nt, Shigella flexneri 2a str. 301
auuucaauaucgccuuuugc

SEQ ID NO: 2025747 - RNA, 22 nt, Shigella flexneri 2a str. 301
auuucaauaucgccuuuugccc

SEQ ID NO: 2025748 - RNA, 20 nt, Shigella flexneri 2a str. 301
auuucaauaugauaaaccuc

SEQ ID NO: 2025749 - RNA, 22 nt, Shigella flexneri 2a str. 301
auuucacaacgguccgguugca

SEQ ID NO: 2025750 - RNA, 17 nt, Shigella flexneri 2a str. 301
auuucacacauaucaca

SEQ ID NO: 2025751 - RNA, 22 nt, Shigella flexneri 2a str. 301
auuucaaugggguaacagguuu

SEQ ID NO: 2025752 - RNA, 13 nt, Shigella flexneri 2a str. 301
auuucaaugcauu

SEQ ID NO: 2025753 - RNA, 21 nt, Shigella flexneri 2a str. 301
auuuauuuccuucgcuuuaau

SEQ ID NO: 2025754 - RNA, 14 nt, Shigella flexneri 2a str. 301
auuuauuucagaac

SEQ ID NO: 2025755 - RNA, 13 nt, Shigella flexneri 2a str. 301
auuuauuucucac

SEQ ID NO: 2025756 - RNA, 15 nt, Shigella flexneri 2a str. 301
auuuauuugcaaagu

SEQ ID NO: 2025757 - RNA, 12 nt, Shigella flexneri 2a str. 301
auuuauuuucca

SEQ ID NO: 2025758 - RNA, 19 nt, Shigella flexneri 2a str. 301
auuuauuuuuccuccauug

SEQ ID NO: 2025759 - RNA, 12 nt, Shigella flexneri 2a str. 301
auuuaucuuccc

SEQ ID NO: 2025760 - RNA, 15 nt, Shigella flexneri 2a str. 301
auuuaucuucccagc

SEQ ID NO: 2025761 - RNA, 19 nt, Shigella flexneri 2a str. 301
auuuauauaaauauaauca

SEQ ID NO: 2025762 - RNA, 20 nt, Shigella flexneri 2a str. 301
auuuauaaucuuuaaaaaaa

SEQ ID NO: 2025763 - RNA, 18 nt, Shigella flexneri 2a str. 301
auuuaaccaacaauaaaa

SEQ ID NO: 2025764 - RNA, 15 nt, Shigella flexneri 2a str. 301
auuuaacagcaaaac

SEQ ID NO: 2025765 - RNA, 17 nt, Shigella flexneri 2a str. 301
cagcguuuccagcacca

SEQ ID NO: 2025766 - RNA, 16 nt, Shigella flexneri 2a str. 301
cagcguuuccagcacc

SEQ ID NO: 2025767 - RNA, 21 nt, Shigella flexneri 2a str. 301
cagcguuuccagcaccaguuc

SEQ ID NO: 2025768 - RNA, 14 nt, Shigella flexneri 2a str. 301
cagcguuugaacau

SEQ ID NO: 2025769 - RNA, 23 nt, Shigella flexneri 2a str. 301
cagcguuugaacauuauuuuugc

SEQ ID NO: 2025770 - RNA, 16 nt, Shigella flexneri 2a str. 301
cagcucgugcagaaca

SEQ ID NO: 2025771 - RNA, 18 nt, Shigella flexneri 2a str. 301
cagcugaccgguugcugg

SEQ ID NO: 2025772 - RNA, 18 nt, Shigella flexneri 2a str. 301
cagcugccgaaccacuga

SEQ ID NO: 2025773 - RNA, 16 nt, Shigella flexneri 2a str. 301
cagcugccgacgccag

SEQ ID NO: 2025774 - RNA, 17 nt, Shigella flexneri 2a str. 301
cagcugcucauuacagu

SEQ ID NO: 2025775 - RNA, 14 nt, Shigella flexneri 2a str. 301
cagcugcucccagc

SEQ ID NO: 2025776 - RNA, 15 nt, Shigella flexneri 2a str. 301
caggaauggcgaagg

SEQ ID NO: 2025777 - RNA, 17 nt, Shigella flexneri 2a str. 301
caggaacuguugcaaaa

SEQ ID NO: 2025778 - RNA, 13 nt, Shigella flexneri 2a str. 301
caggaaaugggug

SEQ ID NO: 2025779 - RNA, 15 nt, Shigella flexneri 2a str. 301
caggaaacccaacgc

SEQ ID NO: 2025780 - RNA, 14 nt, Shigella flexneri 2a str. 301
cagcuuucccuuca

SEQ ID NO: 2025781 - RNA, 13 nt, Shigella flexneri 2a str. 301
cagcuuucagaga

SEQ ID NO: 2025782 - RNA, 18 nt, Shigella flexneri 2a str. 301
cagcuuucagcagcggcu

SEQ ID NO: 2025783 - RNA, 16 nt, Shigella flexneri 2a str. 301
cagcuuucaccugcgc

SEQ ID NO: 2025784 - RNA, 22 nt, Shigella flexneri 2a str. 301
cagcuugucuacgccuuguuuc

SEQ ID NO: 2025785 - RNA, 15 nt, Shigella flexneri 2a str. 301
cagcuugcuuuccag

SEQ ID NO: 2025786 - RNA, 19 nt, Shigella flexneri 2a str. 301
cagcuucuuauccagcugc

SEQ ID NO: 2025787 - RNA, 20 nt, Shigella flexneri 2a str. 301
cagcuucgccaguuuuucaa

SEQ ID NO: 2025788 - RNA, 19 nt, Shigella flexneri 2a str. 301
cagcuggucgcccuucauc

SEQ ID NO: 2025789 - RNA, 21 nt, Shigella flexneri 2a str. 301
caggauggcuggccgugcaga

SEQ ID NO: 2025790 - RNA, 12 nt, Shigella flexneri 2a str. 301
caggaugggcaa

SEQ ID NO: 2025791 - RNA, 21 nt, Shigella flexneri 2a str. 301
caggauggcguucgcaacacc

SEQ ID NO: 2025792 - RNA, 23 nt, Shigella flexneri 2a str. 301
caggauggcguucgcaacaccgu

SEQ ID NO: 2025793 - RNA, 17 nt, Shigella flexneri 2a str. 301
caggauguuccggcaaa

SEQ ID NO: 2025794 - RNA, 20 nt, Shigella flexneri 2a str. 301
caggauuauguugcgccugc

SEQ ID NO: 2025795 - RNA, 13 nt, Shigella flexneri 2a str. 301
caggauucacaau

SEQ ID NO: 2025796 - RNA, 16 nt, Shigella flexneri 2a str. 301
caggaugcggcuaauu

SEQ ID NO: 2025797 - RNA, 13 nt, Shigella flexneri 2a str. 301
caggaucagcucc

SEQ ID NO: 2025798 - RNA, 18 nt, Shigella flexneri 2a str. 301
caggaccguucgcuaccu

SEQ ID NO: 2025799 - RNA, 17 nt, Shigella flexneri 2a str. 301
caggaccugcucugcca

SEQ ID NO: 2025800 - RNA, 15 nt, Shigella flexneri 2a str. 301
caggaccauucacac

SEQ ID NO: 2025801 - RNA, 16 nt, Shigella flexneri 2a str. 301
caggacagucagaccg

SEQ ID NO: 2025802 - RNA, 17 nt, Shigella flexneri 2a str. 301
caggacagucagaccgu

SEQ ID NO: 2025803 - RNA, 12 nt, Shigella flexneri 2a str. 301
caggacagagac

SEQ ID NO: 2025804 - RNA, 17 nt, Shigella flexneri 2a str. 301
aaaauuuauugacaauc

SEQ ID NO: 2025805 - RNA, 19 nt, Shigella flexneri 2a str. 301
caggaccuugacgaauacu

SEQ ID NO: 2025806 - RNA, 19 nt, Shigella flexneri 2a str. 301
caggagcgguguaggccug

SEQ ID NO: 2025807 - RNA, 13 nt, Shigella flexneri 2a str. 301
aaaauuucaugcu

SEQ ID NO: 2025808 - RNA, 19 nt, Shigella flexneri 2a str. 301
caggaggcguaauuuccac

SEQ ID NO: 2025809 - RNA, 17 nt, Shigella flexneri 2a str. 301
caggcaccagccccugg

SEQ ID NO: 2025810 - RNA, 14 nt, Shigella flexneri 2a str. 301
caggcaaccgcuga

SEQ ID NO: 2025811 - RNA, 15 nt, Shigella flexneri 2a str. 301
caggcaauccauaac

SEQ ID NO: 2025812 - RNA, 21 nt, Shigella flexneri 2a str. 301
caggcaaucgagcccagaugc

SEQ ID NO: 2025813 - RNA, 22 nt, Shigella flexneri 2a str. 301
caggcaagccgcuaacagcagc

SEQ ID NO: 2025814 - RNA, 22 nt, Shigella flexneri 2a str. 301
caggcaaacuucacgcauuuac

SEQ ID NO: 2025815 - RNA, 18 nt, Shigella flexneri 2a str. 301
caggcaguuuauccagcc

SEQ ID NO: 2025816 - RNA, 19 nt, Shigella flexneri 2a str. 301
caggcauuugcuccagacg

SEQ ID NO: 2025817 - RNA, 18 nt, Shigella flexneri 2a str. 301
caggcaggucuuucaccu

SEQ ID NO: 2025818 - RNA, 21 nt, Shigella flexneri 2a str. 301
caggcagggcuaucuggagau

SEQ ID NO: 2025819 - RNA, 20 nt, Shigella flexneri 2a str. 301
caggcagucugcgcccuggg

SEQ ID NO: 2025820 - RNA, 14 nt, Shigella flexneri 2a str. 301
caggcagcugccag

SEQ ID NO: 2025821 - RNA, 15 nt, Shigella flexneri 2a str. 301
caggcagcuuagaaa

SEQ ID NO: 2025822 - RNA, 18 nt, Shigella flexneri 2a str. 301
caggcagauccaguuacc

SEQ ID NO: 2025823 - RNA, 21 nt, Shigella flexneri 2a str. 301
caggcagauacaaccaaucgc

SEQ ID NO: 2025824 - RNA, 18 nt, Shigella flexneri 2a str. 301
caggcgagaucggcaggc

SEQ ID NO: 2025825 - RNA, 15 nt, Shigella flexneri 2a str. 301
caggcgcgugaaugc

SEQ ID NO: 2025826 - RNA, 15 nt, Shigella flexneri 2a str. 301
caggcgcugaaagaa

SEQ ID NO: 2025827 - RNA, 19 nt, Shigella flexneri 2a str. 301
caggcgcugauagguuuca

SEQ ID NO: 2025828 - RNA, 13 nt, Shigella flexneri 2a str. 301
caggcgcgccugg

SEQ ID NO: 2025829 - RNA, 14 nt, Shigella flexneri 2a str. 301
caggcgcgccuggu

SEQ ID NO: 2025830 - RNA, 20 nt, Shigella flexneri 2a str. 301
caggccaaaaaacagccccu

SEQ ID NO: 2025831 - RNA, 16 nt, Shigella flexneri 2a str. 301
caggcauuuuuaucac

SEQ ID NO: 2025832 - RNA, 15 nt, Shigella flexneri 2a str. 301
caggccaaaaaacag

SEQ ID NO: 2025833 - RNA, 23 nt, Shigella flexneri 2a str. 301
caggccaaaagcuaacagagccg

SEQ ID NO: 2025834 - RNA, 14 nt, Shigella flexneri 2a str. 301
caggccaacagucu

SEQ ID NO: 2025835 - RNA, 14 nt, Shigella flexneri 2a str. 301
caggccaauagugc

SEQ ID NO: 2025836 - RNA, 16 nt, Shigella flexneri 2a str. 301
caggccuaacacaugc

SEQ ID NO: 2025837 - RNA, 14 nt, Shigella flexneri 2a str. 301
caggccaccaggcc

SEQ ID NO: 2025838 - RNA, 17 nt, Shigella flexneri 2a str. 301
caggccuacaaguccgu

SEQ ID NO: 2025839 - RNA, 18 nt, Shigella flexneri 2a str. 301
caggccuacaaguccguu

SEQ ID NO: 2025840 - RNA, 14 nt, Shigella flexneri 2a str. 301
caggccuacaaaau

SEQ ID NO: 2025841 - RNA, 19 nt, Shigella flexneri 2a str. 301
caggccuacaauguuucug

SEQ ID NO: 2025842 - RNA, 16 nt, Shigella flexneri 2a str. 301
caggccuacauuuucu

SEQ ID NO: 2025843 - RNA, 16 nt, Shigella flexneri 2a str. 301
caggcgaaggccucuc

SEQ ID NO: 2025844 - RNA, 16 nt, Shigella flexneri 2a str. 301
cagggagucuugcugg

SEQ ID NO: 2025845 - RNA, 23 nt, Shigella flexneri 2a str. 301
cagggaaaugacggucaucaccu

SEQ ID NO: 2025846 - RNA, 23 nt, Shigella flexneri 2a str. 301
caggcuuuauucugacgccacca

SEQ ID NO: 2025847 - RNA, 20 nt, Shigella flexneri 2a str. 301
caggcuuuauucugacgcca

SEQ ID NO: 2025848 - RNA, 15 nt, Shigella flexneri 2a str. 301
caggcuuuauucuga

SEQ ID NO: 2025849 - RNA, 23 nt, Shigella flexneri 2a str. 301
caggcugaacaacaguuuuaucu

SEQ ID NO: 2025850 - RNA, 19 nt, Shigella flexneri 2a str. 301
caggcugcaaagucugggc

SEQ ID NO: 2025851 - RNA, 13 nt, Shigella flexneri 2a str. 301
caggcugcacugg

SEQ ID NO: 2025852 - RNA, 17 nt, Shigella flexneri 2a str. 301
caggcucgccgccgcug

SEQ ID NO: 2025853 - RNA, 13 nt, Shigella flexneri 2a str. 301
caggcucuuuaaa

SEQ ID NO: 2025854 - RNA, 15 nt, Shigella flexneri 2a str. 301
caggcucuuuaaaca

SEQ ID NO: 2025855 - RNA, 15 nt, Shigella flexneri 2a str. 301
caggcucgccgccgc

SEQ ID NO: 2025856 - RNA, 19 nt, Shigella flexneri 2a str. 301
caggcuagccgccagccgg

SEQ ID NO: 2025857 - RNA, 16 nt, Shigella flexneri 2a str. 301
caggcuacucccagua

SEQ ID NO: 2025858 - RNA, 14 nt, Shigella flexneri 2a str. 301
caggcuacucccag

SEQ ID NO: 2025859 - RNA, 22 nt, Shigella flexneri 2a str. 301
caggcguuuguaacccaccaug

SEQ ID NO: 2025860 - RNA, 17 nt, Shigella flexneri 2a str. 301
caggcuaccgcagugaa

SEQ ID NO: 2025861 - RNA, 16 nt, Shigella flexneri 2a str. 301
caggcgcuguaugccu

SEQ ID NO: 2025862 - RNA, 20 nt, Shigella flexneri 2a str. 301
caggcgcuggguaaagagcg

SEQ ID NO: 2025863 - RNA, 23 nt, Shigella flexneri 2a str. 301
caggcgcugcauaucucccagua

SEQ ID NO: 2025864 - RNA, 13 nt, Shigella flexneri 2a str. 301
caggcgcuuggcu

SEQ ID NO: 2025865 - RNA, 21 nt, Shigella flexneri 2a str. 301
caggcgcuugucgucccaggc

SEQ ID NO: 2025866 - RNA, 20 nt, Shigella flexneri 2a str. 301
caggcggauugcuucugcuu

SEQ ID NO: 2025867 - RNA, 22 nt, Shigella flexneri 2a str. 301
caggcggcuaugcuggagaaga

SEQ ID NO: 2025868 - RNA, 17 nt, Shigella flexneri 2a str. 301
caggggcagcaccauca

SEQ ID NO: 2025869 - RNA, 22 nt, Shigella flexneri 2a str. 301
cagggcuuucgcaauaaucauc

SEQ ID NO: 2025870 - RNA, 20 nt, Shigella flexneri 2a str. 301
caggguagacuuggcuuucu

SEQ ID NO: 2025871 - RNA, 18 nt, Shigella flexneri 2a str. 301
caggguaccgauagauuu

SEQ ID NO: 2025872 - RNA, 15 nt, Shigella flexneri 2a str. 301
caggguaucccgccu

SEQ ID NO: 2025873 - RNA, 18 nt, Shigella flexneri 2a str. 301
caggguaucccgccugag

SEQ ID NO: 2025874 - RNA, 24 nt, Shigella flexneri 2a str. 301
caggguauuaucaauaccgauggc

SEQ ID NO: 2025875 - RNA, 19 nt, Shigella flexneri 2a str. 301
caggguauggaucccucuu

SEQ ID NO: 2025876 - RNA, 19 nt, Shigella flexneri 2a str. 301
cagggaugaagugaagaug

SEQ ID NO: 2025877 - RNA, 22 nt, Shigella flexneri 2a str. 301
cagggaugaagugaagaugaau

SEQ ID NO: 2025878 - RNA, 15 nt, Shigella flexneri 2a str. 301
cagggauggcuuuua

SEQ ID NO: 2025879 - RNA, 15 nt, Shigella flexneri 2a str. 301
cagggaugaagugaa

SEQ ID NO: 2025880 - RNA, 21 nt, Shigella flexneri 2a str. 301
cagggcaaacucugagagauc

SEQ ID NO: 2025881 - RNA, 16 nt, Shigella flexneri 2a str. 301
cagggaucaacauuca

SEQ ID NO: 2025882 - RNA, 17 nt, Shigella flexneri 2a str. 301
cagggaucauccacccg

SEQ ID NO: 2025883 - RNA, 18 nt, Shigella flexneri 2a str. 301
cagggaucaacauucaga

SEQ ID NO: 2025884 - RNA, 18 nt, Shigella flexneri 2a str. 301
cagggauauuucaccgcc

SEQ ID NO: 2025885 - RNA, 13 nt, Shigella flexneri 2a str. 301
aaaauuuuuuugc

SEQ ID NO: 2025886 - RNA, 15 nt, Shigella flexneri 2a str. 301
cagggcgauaucuuu

SEQ ID NO: 2025887 - RNA, 14 nt, Shigella flexneri 2a str. 301
cagguacuggaaaa

SEQ ID NO: 2025888 - RNA, 16 nt, Shigella flexneri 2a str. 301
cagguagguuggugaa

SEQ ID NO: 2025889 - RNA, 14 nt, Shigella flexneri 2a str. 301
cagguaaucugcca

SEQ ID NO: 2025890 - RNA, 15 nt, Shigella flexneri 2a str. 301
cagguaaucugccau

SEQ ID NO: 2025891 - RNA, 22 nt, Shigella flexneri 2a str. 301
cagguaagagugaauucacaau

SEQ ID NO: 2025892 - RNA, 22 nt, Shigella flexneri 2a str. 301
cagggugacaaauuugugcucu

SEQ ID NO: 2025893 - RNA, 17 nt, Shigella flexneri 2a str. 301
cagggugaucaccagua

SEQ ID NO: 2025894 - RNA, 17 nt, Shigella flexneri 2a str. 301
cagggugcuggcgcuca

SEQ ID NO: 2025895 - RNA, 16 nt, Shigella flexneri 2a str. 301
caggguuuugcccagc

SEQ ID NO: 2025896 - RNA, 13 nt, Shigella flexneri 2a str. 301
cagguaaagacca

SEQ ID NO: 2025897 - RNA, 20 nt, Shigella flexneri 2a str. 301
cagguaaacaccuucaucca

SEQ ID NO: 2025898 - RNA, 19 nt, Shigella flexneri 2a str. 301
cagccuauaacgaaacccg

SEQ ID NO: 2025899 - RNA, 15 nt, Shigella flexneri 2a str. 301
cagccuacaaaaacu

SEQ ID NO: 2025900 - RNA, 22 nt, Shigella flexneri 2a str. 301
cagccuaagccauuuaacucac

SEQ ID NO: 2025901 - RNA, 13 nt, Shigella flexneri 2a str. 301
cagccgugcccaa

SEQ ID NO: 2025902 - RNA, 17 nt, Shigella flexneri 2a str. 301
cagccgucugcgcgcgu

SEQ ID NO: 2025903 - RNA, 22 nt, Shigella flexneri 2a str. 301
cagccggguaagaaaagcugca

SEQ ID NO: 2025904 - RNA, 17 nt, Shigella flexneri 2a str. 301
cagccgguauccagcgc

SEQ ID NO: 2025905 - RNA, 23 nt, Shigella flexneri 2a str. 301
cagccgcgcgcuucugguuauau

SEQ ID NO: 2025906 - RNA, 13 nt, Shigella flexneri 2a str. 301
cagccgcgcgcuu

SEQ ID NO: 2025907 - RNA, 22 nt, Shigella flexneri 2a str. 301
cagccgcuaacuuccugcuggc

SEQ ID NO: 2025908 - RNA, 20 nt, Shigella flexneri 2a str. 301
cagccgcuaccagcgcggca

SEQ ID NO: 2025909 - RNA, 13 nt, Shigella flexneri 2a str. 301
cagccgcgucuga

SEQ ID NO: 2025910 - RNA, 13 nt, Shigella flexneri 2a str. 301
cagccgggaugaa

SEQ ID NO: 2025911 - RNA, 15 nt, Shigella flexneri 2a str. 301
cagccuuaaacucaa

SEQ ID NO: 2025912 - RNA, 17 nt, Shigella flexneri 2a str. 301
cagccugugccugagcc

SEQ ID NO: 2025913 - RNA, 12 nt, Shigella flexneri 2a str. 301
cagccuucuuca

SEQ ID NO: 2025914 - RNA, 19 nt, Shigella flexneri 2a str. 301
cagccuucuucauccagcg

SEQ ID NO: 2025915 - RNA, 16 nt, Shigella flexneri 2a str. 301
cagcgacagggccagg

SEQ ID NO: 2025916 - RNA, 22 nt, Shigella flexneri 2a str. 301
cagcgagcuggcgcugauaaau

SEQ ID NO: 2025917 - RNA, 17 nt, Shigella flexneri 2a str. 301
cagcgagcuggcgcuga

SEQ ID NO: 2025918 - RNA, 15 nt, Shigella flexneri 2a str. 301
cagcgauuugcggaa

SEQ ID NO: 2025919 - RNA, 16 nt, Shigella flexneri 2a str. 301
cagcgauuuaucggca

SEQ ID NO: 2025920 - RNA, 14 nt, Shigella flexneri 2a str. 301
cagcgcaaaacgca

SEQ ID NO: 2025921 - RNA, 13 nt, Shigella flexneri 2a str. 301
cagcgcaggaaag

SEQ ID NO: 2025922 - RNA, 23 nt, Shigella flexneri 2a str. 301
cagcgauuuuggguuccacuucu

SEQ ID NO: 2025923 - RNA, 20 nt, Shigella flexneri 2a str. 301
cagcgaugacuguacagauc

SEQ ID NO: 2025924 - RNA, 20 nt, Shigella flexneri 2a str. 301
cagcgauuacuguacagauc

SEQ ID NO: 2025925 - RNA, 22 nt, Shigella flexneri 2a str. 301
cagcgaugcuuugcgcuuuucu

SEQ ID NO: 2025926 - RNA, 21 nt, Shigella flexneri 2a str. 301
cagcgauucaacaguagccuc

SEQ ID NO: 2025927 - RNA, 18 nt, Shigella flexneri 2a str. 301
cagcgauugucagcuggu

SEQ ID NO: 2025928 - RNA, 12 nt, Shigella flexneri 2a str. 301
cagcgaguugau

SEQ ID NO: 2025929 - RNA, 13 nt, Shigella flexneri 2a str. 301
cagcgauaaaaau

SEQ ID NO: 2025930 - RNA, 13 nt, Shigella flexneri 2a str. 301
cagcgaucgcuuu

SEQ ID NO: 2025931 - RNA, 17 nt, Shigella flexneri 2a str. 301
cagcgaguucaggcgcu

SEQ ID NO: 2025932 - RNA, 15 nt, Shigella flexneri 2a str. 301
cagccagcagaggga

SEQ ID NO: 2025933 - RNA, 15 nt, Shigella flexneri 2a str. 301
cagccagcacugccg

SEQ ID NO: 2025934 - RNA, 15 nt, Shigella flexneri 2a str. 301
cagccagcaccaggc

SEQ ID NO: 2025935 - RNA, 12 nt, Shigella flexneri 2a str. 301
cagccagcacug

SEQ ID NO: 2025936 - RNA, 12 nt, Shigella flexneri 2a str. 301
cagccagcagcg

SEQ ID NO: 2025937 - RNA, 15 nt, Shigella flexneri 2a str. 301
cagccagcagcgaau

SEQ ID NO: 2025938 - RNA, 23 nt, Shigella flexneri 2a str. 301
cagccauaaagaaaucaccugcc

SEQ ID NO: 2025939 - RNA, 21 nt, Shigella flexneri 2a str. 301
cagccaguuuuucagcgccag

SEQ ID NO: 2025940 - RNA, 22 nt, Shigella flexneri 2a str. 301
cagccauaaauuuaccugaucc

SEQ ID NO: 2025941 - RNA, 14 nt, Shigella flexneri 2a str. 301
cagccaguugaucu

SEQ ID NO: 2025942 - RNA, 16 nt, Shigella flexneri 2a str. 301
cagccagaauuacccc

SEQ ID NO: 2025943 - RNA, 16 nt, Shigella flexneri 2a str. 301
cagccagaaugucccc

SEQ ID NO: 2025944 - RNA, 22 nt, Shigella flexneri 2a str. 301
cagccacuuccugcucgguaaa

SEQ ID NO: 2025945 - RNA, 15 nt, Shigella flexneri 2a str. 301
cagccacuucuucca

SEQ ID NO: 2025946 - RNA, 23 nt, Shigella flexneri 2a str. 301
cagccagacgccagccacaggcu

SEQ ID NO: 2025947 - RNA, 16 nt, Shigella flexneri 2a str. 301
cagccagagccaccaa

SEQ ID NO: 2025948 - RNA, 20 nt, Shigella flexneri 2a str. 301
cagccagagccaccaacucu

SEQ ID NO: 2025949 - RNA, 19 nt, Shigella flexneri 2a str. 301
cagcagccgcgcuuucuuc

SEQ ID NO: 2025950 - RNA, 23 nt, Shigella flexneri 2a str. 301
cagcagccacaccaaucaacaau

SEQ ID NO: 2025951 - RNA, 19 nt, Shigella flexneri 2a str. 301
cagcagcgaaucagcccag

SEQ ID NO: 2025952 - RNA, 15 nt, Shigella flexneri 2a str. 301
cagccaaccacauga

SEQ ID NO: 2025953 - RNA, 17 nt, Shigella flexneri 2a str. 301
cagccacucggacaccu

SEQ ID NO: 2025954 - RNA, 14 nt, Shigella flexneri 2a str. 301
cagccccgguuuuu

SEQ ID NO: 2025955 - RNA, 20 nt, Shigella flexneri 2a str. 301
cagccccgccgggaucugga

SEQ ID NO: 2025956 - RNA, 21 nt, Shigella flexneri 2a str. 301
cagccccgaaaaagagccagu

SEQ ID NO: 2025957 - RNA, 17 nt, Shigella flexneri 2a str. 301
cagccccugcgccagcg

SEQ ID NO: 2025958 - RNA, 16 nt, Shigella flexneri 2a str. 301
cagccccaggauugau

SEQ ID NO: 2025959 - RNA, 13 nt, Shigella flexneri 2a str. 301
cagccccacagca

SEQ ID NO: 2025960 - RNA, 14 nt, Shigella flexneri 2a str. 301
cagccccacagcag

SEQ ID NO: 2025961 - RNA, 12 nt, Shigella flexneri 2a str. 301
cagcccaugaau

SEQ ID NO: 2025962 - RNA, 12 nt, Shigella flexneri 2a str. 301
cagcccaaagca

SEQ ID NO: 2025963 - RNA, 22 nt, Shigella flexneri 2a str. 301
cagcccaaucaucgcggcacac

SEQ ID NO: 2025964 - RNA, 20 nt, Shigella flexneri 2a str. 301
cagccauugcuaccgcuucg

SEQ ID NO: 2025965 - RNA, 16 nt, Shigella flexneri 2a str. 301
cagcggcaguaaauau

SEQ ID NO: 2025966 - RNA, 18 nt, Shigella flexneri 2a str. 301
cagcggcauuacgcgccc

SEQ ID NO: 2025967 - RNA, 21 nt, Shigella flexneri 2a str. 301
cagcggcauuacgcgccccuu

SEQ ID NO: 2025968 - RNA, 22 nt, Shigella flexneri 2a str. 301
cagcggcauuacgcgccccuuc

SEQ ID NO: 2025969 - RNA, 19 nt, Shigella flexneri 2a str. 301
cagcggcaaacgacgcaga

SEQ ID NO: 2025970 - RNA, 15 nt, Shigella flexneri 2a str. 301
cagcggccagcgcac

SEQ ID NO: 2025971 - RNA, 19 nt, Shigella flexneri 2a str. 301
aaaauguugcgccucaaga

SEQ ID NO: 2025972 - RNA, 13 nt, Shigella flexneri 2a str. 301
aaaauuaacaaaa

SEQ ID NO: 2025973 - RNA, 22 nt, Shigella flexneri 2a str. 301
aaaauuaacaaaacaaugggaa

SEQ ID NO: 2025974 - RNA, 23 nt, Shigella flexneri 2a str. 301
aaaauguuuaugccugguugagu

SEQ ID NO: 2025975 - RNA, 21 nt, Shigella flexneri 2a str. 301
cagcggcgaauguuccaucac

SEQ ID NO: 2025976 - RNA, 23 nt, Shigella flexneri 2a str. 301
aaaauuacaaaaagugcuuucug

SEQ ID NO: 2025977 - RNA, 12 nt, Shigella flexneri 2a str. 301
aaaauuacaaaa

SEQ ID NO: 2025978 - RNA, 23 nt, Shigella flexneri 2a str. 301
cagcggcccggagacgccgaggg

SEQ ID NO: 2025979 - RNA, 15 nt, Shigella flexneri 2a str. 301
cagcggcuccuggcg

SEQ ID NO: 2025980 - RNA, 16 nt, Shigella flexneri 2a str. 301
cagcggcugcugaugu

SEQ ID NO: 2025981 - RNA, 15 nt, Shigella flexneri 2a str. 301
cagcggcggcacagc

SEQ ID NO: 2025982 - RNA, 18 nt, Shigella flexneri 2a str. 301
cagcgcguucugguaaac

SEQ ID NO: 2025983 - RNA, 14 nt, Shigella flexneri 2a str. 301
cagcggacagccau

SEQ ID NO: 2025984 - RNA, 14 nt, Shigella flexneri 2a str. 301
cagcggacgcugcu

SEQ ID NO: 2025985 - RNA, 23 nt, Shigella flexneri 2a str. 301
cagcggaaugcagucacgccagu

SEQ ID NO: 2025986 - RNA, 16 nt, Shigella flexneri 2a str. 301
cagcggauacaggaag

SEQ ID NO: 2025987 - RNA, 14 nt, Shigella flexneri 2a str. 301
cagcggaugaccca

SEQ ID NO: 2025988 - RNA, 23 nt, Shigella flexneri 2a str. 301
cagcggaaauuaccgcaccacca

SEQ ID NO: 2025989 - RNA, 19 nt, Shigella flexneri 2a str. 301
cagcgccuggcugcauggc

SEQ ID NO: 2025990 - RNA, 13 nt, Shigella flexneri 2a str. 301
cagcgccuucaga

SEQ ID NO: 2025991 - RNA, 18 nt, Shigella flexneri 2a str. 301
cagcgccuggcugcaugg

SEQ ID NO: 2025992 - RNA, 22 nt, Shigella flexneri 2a str. 301
cagcgcggaagggaugaaauag

SEQ ID NO: 2025993 - RNA, 14 nt, Shigella flexneri 2a str. 301
cagcgcgcucgcca

SEQ ID NO: 2025994 - RNA, 14 nt, Shigella flexneri 2a str. 301
cagcgccaacgcac

SEQ ID NO: 2025995 - RNA, 12 nt, Shigella flexneri 2a str. 301
cagcgcauugcu

SEQ ID NO: 2025996 - RNA, 15 nt, Shigella flexneri 2a str. 301
cagcgccugcugcac

SEQ ID NO: 2025997 - RNA, 14 nt, Shigella flexneri 2a str. 301
cagcgccugcugca

SEQ ID NO: 2025998 - RNA, 16 nt, Shigella flexneri 2a str. 301
cagcgccugcgcggca

SEQ ID NO: 2025999 - RNA, 14 nt, Shigella flexneri 2a str. 301
cagcgcaucagaca

SEQ ID NO: 2026000 - RNA, 20 nt, Shigella flexneri 2a str. 301
cagcgcauccauuacaucac

SEQ ID NO: 2026001 - RNA, 19 nt, Shigella flexneri 2a str. 301
cagcgcauagcuaaucccc

SEQ ID NO: 2026002 - RNA, 23 nt, Shigella flexneri 2a str. 301
cagcgcauggcggcagcgugcca

SEQ ID NO: 2026003 - RNA, 14 nt, Shigella flexneri 2a str. 301
aaaauucaagacau

SEQ ID NO: 2026004 - RNA, 19 nt, Shigella flexneri 2a str. 301
aaaauucaagacaucaaua

SEQ ID NO: 2026005 - RNA, 21 nt, Shigella flexneri 2a str. 301
cagcgggguucuccugagaau

SEQ ID NO: 2026006 - RNA, 22 nt, Shigella flexneri 2a str. 301
aaaauuacucccgugccagagc

SEQ ID NO: 2026007 - RNA, 21 nt, Shigella flexneri 2a str. 301
cagcgggcgaaucaacuccag

SEQ ID NO: 2026008 - RNA, 22 nt, Shigella flexneri 2a str. 301
cagcgggaucggcguacuggca

SEQ ID NO: 2026009 - RNA, 16 nt, Shigella flexneri 2a str. 301
cagcgucagccagaaa

SEQ ID NO: 2026010 - RNA, 17 nt, Shigella flexneri 2a str. 301
cagcguauucgcgcaga

SEQ ID NO: 2026011 - RNA, 21 nt, Shigella flexneri 2a str. 301
cagcgucacaucaggccaucc

SEQ ID NO: 2026012 - RNA, 19 nt, Shigella flexneri 2a str. 301
cagcguaccaugauccugc

SEQ ID NO: 2026013 - RNA, 17 nt, Shigella flexneri 2a str. 301
cagcguacccugaucaa

SEQ ID NO: 2026014 - RNA, 17 nt, Shigella flexneri 2a str. 301
cagcguaucccagugcg

SEQ ID NO: 2026015 - RNA, 17 nt, Shigella flexneri 2a str. 301
cagcguaugcagccagg

SEQ ID NO: 2026016 - RNA, 21 nt, Shigella flexneri 2a str. 301
cagcguaauaaccaacggcga

SEQ ID NO: 2026017 - RNA, 19 nt, Shigella flexneri 2a str. 301
cagcguacguuggcaaagu

SEQ ID NO: 2026018 - RNA, 22 nt, Shigella flexneri 2a str. 301
cagcguaaaggcggcagaacag

SEQ ID NO: 2026019 - RNA, 12 nt, Shigella flexneri 2a str. 301
cagcgguuuugc

SEQ ID NO: 2026020 - RNA, 19 nt, Shigella flexneri 2a str. 301
cagcgguuuugcuauccag

SEQ ID NO: 2026021 - RNA, 22 nt, Shigella flexneri 2a str. 301
cagcgggugcauuuucacuuca

SEQ ID NO: 2026022 - RNA, 19 nt, Shigella flexneri 2a str. 301
cagcgguugggcaucggca

SEQ ID NO: 2026023 - RNA, 15 nt, Shigella flexneri 2a str. 301
cagcgguugagagaa

SEQ ID NO: 2026024 - RNA, 18 nt, Shigella flexneri 2a str. 301
cagcgguucacuccacug

SEQ ID NO: 2026025 - RNA, 16 nt, Shigella flexneri 2a str. 301
cagcgguguacccugc

SEQ ID NO: 2026026 - RNA, 22 nt, Shigella flexneri 2a str. 301
aaaauucuacagaaaugaaaaa

SEQ ID NO: 2026027 - RNA, 22 nt, Shigella flexneri 2a str. 301
aaaauucauucaauuaauaaca

SEQ ID NO: 2026028 - RNA, 19 nt, Shigella flexneri 2a str. 301
cagcguugcccccugaagc

SEQ ID NO: 2026029 - RNA, 13 nt, Shigella flexneri 2a str. 301
aaaauucaucaaa

SEQ ID NO: 2026030 - RNA, 15 nt, Shigella flexneri 2a str. 301
aaaauucaucaaaug

SEQ ID NO: 2026031 - RNA, 14 nt, Shigella flexneri 2a str. 301
cagcgucgucagca

SEQ ID NO: 2026032 - RNA, 22 nt, Shigella flexneri 2a str. 301
cagcgucgugaaacgcgucuga

SEQ ID NO: 2026033 - RNA, 17 nt, Shigella flexneri 2a str. 301
cagcgucggacuaaaua

SEQ ID NO: 2026034 - RNA, 15 nt, Shigella flexneri 2a str. 301
cagcgucuucugguu

SEQ ID NO: 2026035 - RNA, 13 nt, Shigella flexneri 2a str. 301
cagcgucaucaac

SEQ ID NO: 2026036 - RNA, 17 nt, Shigella flexneri 2a str. 301
cacugccguacagacag

SEQ ID NO: 2026037 - RNA, 19 nt, Shigella flexneri 2a str. 301
cacugcccacgcgcacgcu

SEQ ID NO: 2026038 - RNA, 15 nt, Shigella flexneri 2a str. 301
cacugcgagaaaaag

SEQ ID NO: 2026039 - RNA, 13 nt, Shigella flexneri 2a str. 301
cacugcgcccgcc

SEQ ID NO: 2026040 - RNA, 20 nt, Shigella flexneri 2a str. 301
cacugccguacaggcagcuu

SEQ ID NO: 2026041 - RNA, 22 nt, Shigella flexneri 2a str. 301
cacugcuuuggcucuucgcucc

SEQ ID NO: 2026042 - RNA, 17 nt, Shigella flexneri 2a str. 301
cacugcucaaucaucac

SEQ ID NO: 2026043 - RNA, 14 nt, Shigella flexneri 2a str. 301
cacugcucaccgaa

SEQ ID NO: 2026044 - RNA, 18 nt, Shigella flexneri 2a str. 301
cacugcucgcagaaauac

SEQ ID NO: 2026045 - RNA, 17 nt, Shigella flexneri 2a str. 301
cacugcgcccgccagca

SEQ ID NO: 2026046 - RNA, 18 nt, Shigella flexneri 2a str. 301
cacugcgcccgccagcau

SEQ ID NO: 2026047 - RNA, 19 nt, Shigella flexneri 2a str. 301
cacugcgcauaauccacuu

SEQ ID NO: 2026048 - RNA, 16 nt, Shigella flexneri 2a str. 301
cacugcgcccgccagc

SEQ ID NO: 2026049 - RNA, 14 nt, Shigella flexneri 2a str. 301
cacugcgcucuucu

SEQ ID NO: 2026050 - RNA, 15 nt, Shigella flexneri 2a str. 301
cacugcggcauuucc

SEQ ID NO: 2026051 - RNA, 20 nt, Shigella flexneri 2a str. 301
cacugccagauucuccaaca

SEQ ID NO: 2026052 - RNA, 13 nt, Shigella flexneri 2a str. 301
cacugccagauuc

SEQ ID NO: 2026053 - RNA, 16 nt, Shigella flexneri 2a str. 301
cacugcaucauggcau

SEQ ID NO: 2026054 - RNA, 15 nt, Shigella flexneri 2a str. 301
cacugcaggcugaug

SEQ ID NO: 2026055 - RNA, 13 nt, Shigella flexneri 2a str. 301
cacugcaggcuga

SEQ ID NO: 2026056 - RNA, 15 nt, Shigella flexneri 2a str. 301
cacugcaacagcugu

SEQ ID NO: 2026057 - RNA, 16 nt, Shigella flexneri 2a str. 301
cacugcaaaucaccac

SEQ ID NO: 2026058 - RNA, 22 nt, Shigella flexneri 2a str. 301
cacugcaaauacccaaaaaaua

SEQ ID NO: 2026059 - RNA, 19 nt, Shigella flexneri 2a str. 301
cacugauggaauuucauca

SEQ ID NO: 2026060 - RNA, 16 nt, Shigella flexneri 2a str. 301
cacugacgggaaacuc

SEQ ID NO: 2026061 - RNA, 18 nt, Shigella flexneri 2a str. 301
cacugacugccggaugca

SEQ ID NO: 2026062 - RNA, 18 nt, Shigella flexneri 2a str. 301
cacugacgcgucuuaucu

SEQ ID NO: 2026063 - RNA, 20 nt, Shigella flexneri 2a str. 301
cacugacgcgucuuaucugg

SEQ ID NO: 2026064 - RNA, 21 nt, Shigella flexneri 2a str. 301
cacugacgcccguuaaccgcu

SEQ ID NO: 2026065 - RNA, 15 nt, Shigella flexneri 2a str. 301
cacugacgggaaacu

SEQ ID NO: 2026066 - RNA, 20 nt, Shigella flexneri 2a str. 301
cacugagucagcccaacaaa

SEQ ID NO: 2026067 - RNA, 22 nt, Shigella flexneri 2a str. 301
cacugauaagcugagcacaaaa

SEQ ID NO: 2026068 - RNA, 21 nt, Shigella flexneri 2a str. 301
cacugauauggugguaacuac

SEQ ID NO: 2026069 - RNA, 18 nt, Shigella flexneri 2a str. 301
cacugacacggaacaacg

SEQ ID NO: 2026070 - RNA, 14 nt, Shigella flexneri 2a str. 301
cacugacaccagca

SEQ ID NO: 2026071 - RNA, 21 nt, Shigella flexneri 2a str. 301
cacugaccaccaccaccugca

SEQ ID NO: 2026072 - RNA, 17 nt, Shigella flexneri 2a str. 301
cacugaaaaucaccuca

SEQ ID NO: 2026073 - RNA, 14 nt, Shigella flexneri 2a str. 301
cacugaaaaucacc

SEQ ID NO: 2026074 - RNA, 20 nt, Shigella flexneri 2a str. 301
cacugaaccgaaauggcugc

SEQ ID NO: 2026075 - RNA, 15 nt, Shigella flexneri 2a str. 301
cacucuuucagcacc

SEQ ID NO: 2026076 - RNA, 16 nt, Shigella flexneri 2a str. 301
cacucuuuauugagau

SEQ ID NO: 2026077 - RNA, 21 nt, Shigella flexneri 2a str. 301
cacucucaaucgucaaacgca

SEQ ID NO: 2026078 - RNA, 12 nt, Shigella flexneri 2a str. 301
cacucugacgga

SEQ ID NO: 2026079 - RNA, 17 nt, Shigella flexneri 2a str. 301
cacucugaaaacgcugu

SEQ ID NO: 2026080 - RNA, 16 nt, Shigella flexneri 2a str. 301
cacucugaccugccgc

SEQ ID NO: 2026081 - RNA, 19 nt, Shigella flexneri 2a str. 301
cacucggggcuuuucucua

SEQ ID NO: 2026082 - RNA, 16 nt, Shigella flexneri 2a str. 301
cacucgccccgagaaa

SEQ ID NO: 2026083 - RNA, 22 nt, Shigella flexneri 2a str. 301
cacucgccagaccgcagaagcc

SEQ ID NO: 2026084 - RNA, 15 nt, Shigella flexneri 2a str. 301
cacucgcauccucuu

SEQ ID NO: 2026085 - RNA, 21 nt, Shigella flexneri 2a str. 301
cacuccgguaauaucgcgcag

SEQ ID NO: 2026086 - RNA, 20 nt, Shigella flexneri 2a str. 301
cacucccuuucugccacgcc

SEQ ID NO: 2026087 - RNA, 16 nt, Shigella flexneri 2a str. 301
cacucccugccccauc

SEQ ID NO: 2026088 - RNA, 23 nt, Shigella flexneri 2a str. 301
cacucccggauaaaucuccauuu

SEQ ID NO: 2026089 - RNA, 22 nt, Shigella flexneri 2a str. 301
cacuccauccagcaacaacagc

SEQ ID NO: 2026090 - RNA, 14 nt, Shigella flexneri 2a str. 301
cacuaagcaccaaa

SEQ ID NO: 2026091 - RNA, 19 nt, Shigella flexneri 2a str. 301
cacuaaaaucauucgugag

SEQ ID NO: 2026092 - RNA, 16 nt, Shigella flexneri 2a str. 301
cacuaaagccugcuuu

SEQ ID NO: 2026093 - RNA, 20 nt, Shigella flexneri 2a str. 301
cacuaacgcauugaacucuu

SEQ ID NO: 2026094 - RNA, 16 nt, Shigella flexneri 2a str. 301
cacuaacagaacaaua

SEQ ID NO: 2026095 - RNA, 15 nt, Shigella flexneri 2a str. 301
cacuaccuucuuccc

SEQ ID NO: 2026096 - RNA, 20 nt, Shigella flexneri 2a str. 301
cacuacgcagggauauuuca

SEQ ID NO: 2026097 - RNA, 16 nt, Shigella flexneri 2a str. 301
cacuaccguaauagug

SEQ ID NO: 2026098 - RNA, 20 nt, Shigella flexneri 2a str. 301
cacuaccauaaaaaaacaca

SEQ ID NO: 2026099 - RNA, 12 nt, Shigella flexneri 2a str. 301
cacuacacccca

SEQ ID NO: 2026100 - RNA, 17 nt, Shigella flexneri 2a str. 301
cacguucaucccacucu

SEQ ID NO: 2026101 - RNA, 17 nt, Shigella flexneri 2a str. 301
cacguuccccagaugcg

SEQ ID NO: 2026102 - RNA, 23 nt, Shigella flexneri 2a str. 301
cacguuccuggaaccagugaaua

SEQ ID NO: 2026103 - RNA, 16 nt, Shigella flexneri 2a str. 301
cacguuuaacacgcuc

SEQ ID NO: 2026104 - RNA, 13 nt, Shigella flexneri 2a str. 301
cacguucacccau

SEQ ID NO: 2026105 - RNA, 21 nt, Shigella flexneri 2a str. 301
cacguucaaaacggugaucaa

SEQ ID NO: 2026106 - RNA, 18 nt, Shigella flexneri 2a str. 301
cacguuagaaacaaaaaa

SEQ ID NO: 2026107 - RNA, 15 nt, Shigella flexneri 2a str. 301
cacuaugaaaauaaa

SEQ ID NO: 2026108 - RNA, 18 nt, Shigella flexneri 2a str. 301
cacuauccgacaucccgc

SEQ ID NO: 2026109 - RNA, 13 nt, Shigella flexneri 2a str. 301
cacuaugacugcc

SEQ ID NO: 2026110 - RNA, 20 nt, Shigella flexneri 2a str. 301
cacuauacaaccagauaacc

SEQ ID NO: 2026111 - RNA, 13 nt, Shigella flexneri 2a str. 301
cacuauaaaauaa

SEQ ID NO: 2026112 - RNA, 15 nt, Shigella flexneri 2a str. 301
cacuacucugaccca

SEQ ID NO: 2026113 - RNA, 16 nt, Shigella flexneri 2a str. 301
cacuacggucacgcca

SEQ ID NO: 2026114 - RNA, 14 nt, Shigella flexneri 2a str. 301
cacuagguuuucgu

SEQ ID NO: 2026115 - RNA, 23 nt, Shigella flexneri 2a str. 301
cacuagguuuucgucguacugac

SEQ ID NO: 2026116 - RNA, 18 nt, Shigella flexneri 2a str. 301
cacuaguauuuauuugca

SEQ ID NO: 2026117 - RNA, 22 nt, Shigella flexneri 2a str. 301
cacuaguauuuauuugcaaagu

SEQ ID NO: 2026118 - RNA, 15 nt, Shigella flexneri 2a str. 301
cacucaaauaucuau

SEQ ID NO: 2026119 - RNA, 22 nt, Shigella flexneri 2a str. 301
cacucaugauccuggauuuccu

SEQ ID NO: 2026120 - RNA, 22 nt, Shigella flexneri 2a str. 301
cacucauuaagacuguaaauaa

SEQ ID NO: 2026121 - RNA, 16 nt, Shigella flexneri 2a str. 301
cacuccagccagagcc

SEQ ID NO: 2026122 - RNA, 22 nt, Shigella flexneri 2a str. 301
cacucauacucaccguucaaag

SEQ ID NO: 2026123 - RNA, 16 nt, Shigella flexneri 2a str. 301
cacucaucacuccccg

SEQ ID NO: 2026124 - RNA, 23 nt, Shigella flexneri 2a str. 301
cacucagguaacagggaacuuau

SEQ ID NO: 2026125 - RNA, 21 nt, Shigella flexneri 2a str. 301
cacuuaacccauuacaagccc

SEQ ID NO: 2026126 - RNA, 20 nt, Shigella flexneri 2a str. 301
cacuguuaccgcugcuggcg

SEQ ID NO: 2026127 - RNA, 17 nt, Shigella flexneri 2a str. 301
cacugugggauugcuuc

SEQ ID NO: 2026128 - RNA, 19 nt, Shigella flexneri 2a str. 301
cacuguuggcgaaaauccu

SEQ ID NO: 2026129 - RNA, 13 nt, Shigella flexneri 2a str. 301
cacuuaaugaauc

SEQ ID NO: 2026130 - RNA, 19 nt, Shigella flexneri 2a str. 301
cacuuaauuauuaacaaaa

SEQ ID NO: 2026131 - RNA, 13 nt, Shigella flexneri 2a str. 301
cacuuacuuuccu

SEQ ID NO: 2026132 - RNA, 18 nt, Shigella flexneri 2a str. 301
cacugggagaacgcugcu

SEQ ID NO: 2026133 - RNA, 19 nt, Shigella flexneri 2a str. 301
cacuggcgcgaauagcuuc

SEQ ID NO: 2026134 - RNA, 18 nt, Shigella flexneri 2a str. 301
cacuggcgauauugccgc

SEQ ID NO: 2026135 - RNA, 17 nt, Shigella flexneri 2a str. 301
cacuggcagccaggcgc

SEQ ID NO: 2026136 - RNA, 14 nt, Shigella flexneri 2a str. 301
cacuggcaaugacg

SEQ ID NO: 2026137 - RNA, 18 nt, Shigella flexneri 2a str. 301
cacuguaugaaacaacgu

SEQ ID NO: 2026138 - RNA, 16 nt, Shigella flexneri 2a str. 301
cacuguaagccaccga

SEQ ID NO: 2026139 - RNA, 18 nt, Shigella flexneri 2a str. 301
cacugucgagaucgcggc

SEQ ID NO: 2026140 - RNA, 18 nt, Shigella flexneri 2a str. 301
cacugucaaauccagacu

SEQ ID NO: 2026141 - RNA, 15 nt, Shigella flexneri 2a str. 301
cacugguucaaagua

SEQ ID NO: 2026142 - RNA, 17 nt, Shigella flexneri 2a str. 301
cacugguucccaacaac

SEQ ID NO: 2026143 - RNA, 19 nt, Shigella flexneri 2a str. 301
cacuggugcuguaaaacca

SEQ ID NO: 2026144 - RNA, 16 nt, Shigella flexneri 2a str. 301
cacuugcgcauaauaa

SEQ ID NO: 2026145 - RNA, 12 nt, Shigella flexneri 2a str. 301
cacuugcagacc

SEQ ID NO: 2026146 - RNA, 14 nt, Shigella flexneri 2a str. 301
cacuugcagcuccu

SEQ ID NO: 2026147 - RNA, 22 nt, Shigella flexneri 2a str. 301
cacuugcagucggcuuucucau

SEQ ID NO: 2026148 - RNA, 17 nt, Shigella flexneri 2a str. 301
cacuucuucagccaguu

SEQ ID NO: 2026149 - RNA, 16 nt, Shigella flexneri 2a str. 301
cacuugaccaacuuca

SEQ ID NO: 2026150 - RNA, 23 nt, Shigella flexneri 2a str. 301
cacuucugaguucggcauggggu

SEQ ID NO: 2026151 - RNA, 12 nt, Shigella flexneri 2a str. 301
cacuucugccuc

SEQ ID NO: 2026152 - RNA, 22 nt, Shigella flexneri 2a str. 301
cacuucugaguucggcaugggg

SEQ ID NO: 2026153 - RNA, 19 nt, Shigella flexneri 2a str. 301
cacuucguucuguuugcag

SEQ ID NO: 2026154 - RNA, 17 nt, Shigella flexneri 2a str. 301
cacuucacggcugcuaa

SEQ ID NO: 2026155 - RNA, 23 nt, Shigella flexneri 2a str. 301
cacuucaucacuaccuucuuccc

SEQ ID NO: 2026156 - RNA, 20 nt, Shigella flexneri 2a str. 301
cacuucauacggcacuuuca

SEQ ID NO: 2026157 - RNA, 19 nt, Shigella flexneri 2a str. 301
cacuucauuaaccacgauc

SEQ ID NO: 2026158 - RNA, 23 nt, Shigella flexneri 2a str. 301
cacuucgcgcaaccaguccuccg

SEQ ID NO: 2026159 - RNA, 11 nt, Shigella flexneri 2a str. 301
cacuuuacugg

SEQ ID NO: 2026160 - RNA, 18 nt, Shigella flexneri 2a str. 301
cacuuuacgaccagccga

SEQ ID NO: 2026161 - RNA, 20 nt, Shigella flexneri 2a str. 301
aaaauauccguagugaaaaa

SEQ ID NO: 2026162 - RNA, 21 nt, Shigella flexneri 2a str. 301
cagaaagcgacuuugccuggc

SEQ ID NO: 2026163 - RNA, 15 nt, Shigella flexneri 2a str. 301
cagaaagcgccagca

SEQ ID NO: 2026164 - RNA, 18 nt, Shigella flexneri 2a str. 301
cagaaagcgccagcaaga

SEQ ID NO: 2026165 - RNA, 17 nt, Shigella flexneri 2a str. 301
cagaaaagagacgcuga

SEQ ID NO: 2026166 - RNA, 13 nt, Shigella flexneri 2a str. 301
cagaaaagaaccu

SEQ ID NO: 2026167 - RNA, 23 nt, Shigella flexneri 2a str. 301
cagaaaauuacggauuacaugga

SEQ ID NO: 2026168 - RNA, 19 nt, Shigella flexneri 2a str. 301
cagaaacggauaaucaugc

SEQ ID NO: 2026169 - RNA, 17 nt, Shigella flexneri 2a str. 301
cacuuugugucagcgcc

SEQ ID NO: 2026170 - RNA, 17 nt, Shigella flexneri 2a str. 301
cacuuugccagaaaucc

SEQ ID NO: 2026171 - RNA, 18 nt, Shigella flexneri 2a str. 301
cacuuugcccuucacgca

SEQ ID NO: 2026172 - RNA, 23 nt, Shigella flexneri 2a str. 301
cacuuugccgucagccacuucuu

SEQ ID NO: 2026173 - RNA, 15 nt, Shigella flexneri 2a str. 301
cacuuuuauuucacc

SEQ ID NO: 2026174 - RNA, 15 nt, Shigella flexneri 2a str. 301
cacuuuugaaaucaa

SEQ ID NO: 2026175 - RNA, 23 nt, Shigella flexneri 2a str. 301
cagaaaaagagcaucagcagugc

SEQ ID NO: 2026176 - RNA, 15 nt, Shigella flexneri 2a str. 301
cagaaccgcuucuuc

SEQ ID NO: 2026177 - RNA, 21 nt, Shigella flexneri 2a str. 301
cagaacgcgccuuaaaaacca

SEQ ID NO: 2026178 - RNA, 16 nt, Shigella flexneri 2a str. 301
cagaacguaaacgcag

SEQ ID NO: 2026179 - RNA, 20 nt, Shigella flexneri 2a str. 301
cagaaagucauggcaaacug

SEQ ID NO: 2026180 - RNA, 14 nt, Shigella flexneri 2a str. 301
cagaaagucauggc

SEQ ID NO: 2026181 - RNA, 16 nt, Shigella flexneri 2a str. 301
cagaaagggaagaaca

SEQ ID NO: 2026182 - RNA, 19 nt, Shigella flexneri 2a str. 301
cagaaagugaguuuugcau

SEQ ID NO: 2026183 - RNA, 14 nt, Shigella flexneri 2a str. 301
cagaacagcuacag

SEQ ID NO: 2026184 - RNA, 20 nt, Shigella flexneri 2a str. 301
cagaaccagggaaaaaagcc

SEQ ID NO: 2026185 - RNA, 13 nt, Shigella flexneri 2a str. 301
cagaagcugcagg

SEQ ID NO: 2026186 - RNA, 13 nt, Shigella flexneri 2a str. 301
cagaaggccagga

SEQ ID NO: 2026187 - RNA, 22 nt, Shigella flexneri 2a str. 301
cagaacuucgcuaacaaucuca

SEQ ID NO: 2026188 - RNA, 16 nt, Shigella flexneri 2a str. 301
cagaacuucugguaac

SEQ ID NO: 2026189 - RNA, 18 nt, Shigella flexneri 2a str. 301
cagaaguaucguuaauuc

SEQ ID NO: 2026190 - RNA, 18 nt, Shigella flexneri 2a str. 301
cagaaggauaauuaaucu

SEQ ID NO: 2026191 - RNA, 19 nt, Shigella flexneri 2a str. 301
cagaaguccggaaagccau

SEQ ID NO: 2026192 - RNA, 17 nt, Shigella flexneri 2a str. 301
cagaaggugacccguuu

SEQ ID NO: 2026193 - RNA, 17 nt, Shigella flexneri 2a str. 301
cagaaguugcacccagu

SEQ ID NO: 2026194 - RNA, 14 nt, Shigella flexneri 2a str. 301
cagaaguugcucaa

SEQ ID NO: 2026195 - RNA, 16 nt, Shigella flexneri 2a str. 301
cagaaguugcucaagc

SEQ ID NO: 2026196 - RNA, 16 nt, Shigella flexneri 2a str. 301
cagaccgcacaccgag

SEQ ID NO: 2026197 - RNA, 19 nt, Shigella flexneri 2a str. 301
cagaccgcugacggcagcg

SEQ ID NO: 2026198 - RNA, 16 nt, Shigella flexneri 2a str. 301
cagaccuaccaucucc

SEQ ID NO: 2026199 - RNA, 20 nt, Shigella flexneri 2a str. 301
cagaccuacaaaaccugcac

SEQ ID NO: 2026200 - RNA, 21 nt, Shigella flexneri 2a str. 301
cagacccagguagacaccaag

SEQ ID NO: 2026201 - RNA, 16 nt, Shigella flexneri 2a str. 301
cagaccauuccucuuc

SEQ ID NO: 2026202 - RNA, 15 nt, Shigella flexneri 2a str. 301
cagaccaaucaccac

SEQ ID NO: 2026203 - RNA, 21 nt, Shigella flexneri 2a str. 301
cagaccaauccagccggcaaa

SEQ ID NO: 2026204 - RNA, 18 nt, Shigella flexneri 2a str. 301
cagaccaaucccgccaua

SEQ ID NO: 2026205 - RNA, 18 nt, Shigella flexneri 2a str. 301
cagacccuucaucgcucc

SEQ ID NO: 2026206 - RNA, 12 nt, Shigella flexneri 2a str. 301
cagacggccaaa

SEQ ID NO: 2026207 - RNA, 17 nt, Shigella flexneri 2a str. 301
cagaccugcgucaccac

SEQ ID NO: 2026208 - RNA, 22 nt, Shigella flexneri 2a str. 301
cagaccugcgucaccacaucca

SEQ ID NO: 2026209 - RNA, 16 nt, Shigella flexneri 2a str. 301
cagaccugcgucacca

SEQ ID NO: 2026210 - RNA, 17 nt, Shigella flexneri 2a str. 301
cagaccugaauuugcuc

SEQ ID NO: 2026211 - RNA, 21 nt, Shigella flexneri 2a str. 301
cagaccuucgcuaucaaacug

SEQ ID NO: 2026212 - RNA, 17 nt, Shigella flexneri 2a str. 301
cagaccugcguucagca

SEQ ID NO: 2026213 - RNA, 16 nt, Shigella flexneri 2a str. 301
cagacgaagucaacaa

SEQ ID NO: 2026214 - RNA, 22 nt, Shigella flexneri 2a str. 301
cagacgagaaguuccagggcag

SEQ ID NO: 2026215 - RNA, 13 nt, Shigella flexneri 2a str. 301
cagaccuuuuaau

SEQ ID NO: 2026216 - RNA, 12 nt, Shigella flexneri 2a str. 301
cagacgaaaucg

SEQ ID NO: 2026217 - RNA, 19 nt, Shigella flexneri 2a str. 301
cagacgugauaaacaucca

SEQ ID NO: 2026218 - RNA, 13 nt, Shigella flexneri 2a str. 301
cagacuccugaag

SEQ ID NO: 2026219 - RNA, 14 nt, Shigella flexneri 2a str. 301
cagacuccugaaga

SEQ ID NO: 2026220 - RNA, 16 nt, Shigella flexneri 2a str. 301
cagacugaauacgcuc

SEQ ID NO: 2026221 - RNA, 16 nt, Shigella flexneri 2a str. 301
cagacucucauuuuuc

SEQ ID NO: 2026222 - RNA, 21 nt, Shigella flexneri 2a str. 301
cagacugaucaucgcccaguu

SEQ ID NO: 2026223 - RNA, 16 nt, Shigella flexneri 2a str. 301
cagacugcucagcucc

SEQ ID NO: 2026224 - RNA, 14 nt, Shigella flexneri 2a str. 301
cagaaucgccagca

SEQ ID NO: 2026225 - RNA, 18 nt, Shigella flexneri 2a str. 301
cagaauccccacugcaug

SEQ ID NO: 2026226 - RNA, 19 nt, Shigella flexneri 2a str. 301
cagaaucaggccauuacua

SEQ ID NO: 2026227 - RNA, 15 nt, Shigella flexneri 2a str. 301
cagaaucaggccauu

SEQ ID NO: 2026228 - RNA, 20 nt, Shigella flexneri 2a str. 301
cagaaucaccucuuuuucca

SEQ ID NO: 2026229 - RNA, 18 nt, Shigella flexneri 2a str. 301
cagaaucacgccaacaaa

SEQ ID NO: 2026230 - RNA, 15 nt, Shigella flexneri 2a str. 301
cagaaucaccucuuu

SEQ ID NO: 2026231 - RNA, 12 nt, Shigella flexneri 2a str. 301
cagaauccagga

SEQ ID NO: 2026232 - RNA, 14 nt, Shigella flexneri 2a str. 301
cagaauauccggca

SEQ ID NO: 2026233 - RNA, 22 nt, Shigella flexneri 2a str. 301
cagaauauuugauugcagauuc

SEQ ID NO: 2026234 - RNA, 23 nt, Shigella flexneri 2a str. 301
cagaauaucguucaagagacugc

SEQ ID NO: 2026235 - RNA, 19 nt, Shigella flexneri 2a str. 301
cagaauauucgaaaucugu

SEQ ID NO: 2026236 - RNA, 13 nt, Shigella flexneri 2a str. 301
cagaaucaagucu

SEQ ID NO: 2026237 - RNA, 20 nt, Shigella flexneri 2a str. 301
cagaaguugcucaagcugaa

SEQ ID NO: 2026238 - RNA, 15 nt, Shigella flexneri 2a str. 301
cagaauaacggcaga

SEQ ID NO: 2026239 - RNA, 22 nt, Shigella flexneri 2a str. 301
cagaauaacggcagaagcugca

SEQ ID NO: 2026240 - RNA, 21 nt, Shigella flexneri 2a str. 301
cagaauaacgugaucgaacau

SEQ ID NO: 2026241 - RNA, 18 nt, Shigella flexneri 2a str. 301
cagaauaccuugcugcuc

SEQ ID NO: 2026242 - RNA, 21 nt, Shigella flexneri 2a str. 301
cagaauaccuugcugcuccag

SEQ ID NO: 2026243 - RNA, 23 nt, Shigella flexneri 2a str. 301
cagaauaccuugcugcuccagcg

SEQ ID NO: 2026244 - RNA, 20 nt, Shigella flexneri 2a str. 301
cagacaaaaagaauacgcaa

SEQ ID NO: 2026245 - RNA, 22 nt, Shigella flexneri 2a str. 301
cagaauuuuucgcuaaaaaaug

SEQ ID NO: 2026246 - RNA, 20 nt, Shigella flexneri 2a str. 301
cagacaaaauccugccagcg

SEQ ID NO: 2026247 - RNA, 19 nt, Shigella flexneri 2a str. 301
cagacaaaugucacugcuu

SEQ ID NO: 2026248 - RNA, 14 nt, Shigella flexneri 2a str. 301
cagacaaaugaaca

SEQ ID NO: 2026249 - RNA, 15 nt, Shigella flexneri 2a str. 301
cagacaacaugagaa

SEQ ID NO: 2026250 - RNA, 23 nt, Shigella flexneri 2a str. 301
cagacauuauaaauucuggccac

SEQ ID NO: 2026251 - RNA, 15 nt, Shigella flexneri 2a str. 301
cagacaucaccagua

SEQ ID NO: 2026252 - RNA, 17 nt, Shigella flexneri 2a str. 301
cagaaugacaucaucgc

SEQ ID NO: 2026253 - RNA, 15 nt, Shigella flexneri 2a str. 301
cagaauuugaggaag

SEQ ID NO: 2026254 - RNA, 14 nt, Shigella flexneri 2a str. 301
cagaauuugaggaa

SEQ ID NO: 2026255 - RNA, 17 nt, Shigella flexneri 2a str. 301
cagaauuugaggaagcu

SEQ ID NO: 2026256 - RNA, 18 nt, Shigella flexneri 2a str. 301
cagaaugccgcaaaacuu

SEQ ID NO: 2026257 - RNA, 20 nt, Shigella flexneri 2a str. 301
cagaaugcgggcgaaaacau

SEQ ID NO: 2026258 - RNA, 21 nt, Shigella flexneri 2a str. 301
cagagcaaaaaucgacagcag

SEQ ID NO: 2026259 - RNA, 18 nt, Shigella flexneri 2a str. 301
cagagauuugcuccagcg

SEQ ID NO: 2026260 - RNA, 19 nt, Shigella flexneri 2a str. 301
cagagauuugcuccagcga

SEQ ID NO: 2026261 - RNA, 17 nt, Shigella flexneri 2a str. 301
cagagauuugcuccagc

SEQ ID NO: 2026262 - RNA, 16 nt, Shigella flexneri 2a str. 301
cagagauucgguaacc

SEQ ID NO: 2026263 - RNA, 20 nt, Shigella flexneri 2a str. 301
cagagccgcgauaaaauccc

SEQ ID NO: 2026264 - RNA, 12 nt, Shigella flexneri 2a str. 301
cagagccugaau

SEQ ID NO: 2026265 - RNA, 13 nt, Shigella flexneri 2a str. 301
cagagaucuuuca

SEQ ID NO: 2026266 - RNA, 15 nt, Shigella flexneri 2a str. 301
cagagauagaacugc

SEQ ID NO: 2026267 - RNA, 22 nt, Shigella flexneri 2a str. 301
cagagauacaggccaccgccua

SEQ ID NO: 2026268 - RNA, 21 nt, Shigella flexneri 2a str. 301
cagagauauucagcccggcaa

SEQ ID NO: 2026269 - RNA, 13 nt, Shigella flexneri 2a str. 301
cagagauucuuuu

SEQ ID NO: 2026270 - RNA, 15 nt, Shigella flexneri 2a str. 301
cagagauucuuuucc

SEQ ID NO: 2026271 - RNA, 22 nt, Shigella flexneri 2a str. 301
cagagauggccgguuuguuauc

SEQ ID NO: 2026272 - RNA, 13 nt, Shigella flexneri 2a str. 301
cagagauuacuuu

SEQ ID NO: 2026273 - RNA, 15 nt, Shigella flexneri 2a str. 301
cagacuuuuugcggc

SEQ ID NO: 2026274 - RNA, 18 nt, Shigella flexneri 2a str. 301
cagacuuuuugcggcagc

SEQ ID NO: 2026275 - RNA, 15 nt, Shigella flexneri 2a str. 301
cagagaaacgccagc

SEQ ID NO: 2026276 - RNA, 16 nt, Shigella flexneri 2a str. 301
cagagauacaggccac

SEQ ID NO: 2026277 - RNA, 20 nt, Shigella flexneri 2a str. 301
cagagaaaccacaucaaucc

SEQ ID NO: 2026278 - RNA, 22 nt, Shigella flexneri 2a str. 301
aaaaucaccucaucaccacaga

SEQ ID NO: 2026279 - RNA, 13 nt, Shigella flexneri 2a str. 301
aaaaucaccauuu

SEQ ID NO: 2026280 - RNA, 15 nt, Shigella flexneri 2a str. 301
cagacugcacauggc

SEQ ID NO: 2026281 - RNA, 15 nt, Shigella flexneri 2a str. 301
cagacuggagcacug

SEQ ID NO: 2026282 - RNA, 13 nt, Shigella flexneri 2a str. 301
cagagccugccaa

SEQ ID NO: 2026283 - RNA, 16 nt, Shigella flexneri 2a str. 301
cagagcgaucaaccca

SEQ ID NO: 2026284 - RNA, 22 nt, Shigella flexneri 2a str. 301
cagagcgauauccagugccaga

SEQ ID NO: 2026285 - RNA, 11 nt, Shigella flexneri 2a str. 301
cagauaaaaua

SEQ ID NO: 2026286 - RNA, 12 nt, Shigella flexneri 2a str. 301
cagaguuuuuua

SEQ ID NO: 2026287 - RNA, 23 nt, Shigella flexneri 2a str. 301
aaaauccauuuucuauuuugcau

SEQ ID NO: 2026288 - RNA, 22 nt, Shigella flexneri 2a str. 301
aaaauccagauuuauaaaagaa

SEQ ID NO: 2026289 - RNA, 23 nt, Shigella flexneri 2a str. 301
cagauagagcgccugcagacggc

SEQ ID NO: 2026290 - RNA, 14 nt, Shigella flexneri 2a str. 301
cagauaaugagaaa

SEQ ID NO: 2026291 - RNA, 21 nt, Shigella flexneri 2a str. 301
cagauaaugcccgaugaccuu

SEQ ID NO: 2026292 - RNA, 23 nt, Shigella flexneri 2a str. 301
cagauaacccaggggucaguucc

SEQ ID NO: 2026293 - RNA, 14 nt, Shigella flexneri 2a str. 301
cagauaacaccaua

SEQ ID NO: 2026294 - RNA, 22 nt, Shigella flexneri 2a str. 301
cagauaauggcuguugaaugcc

SEQ ID NO: 2026295 - RNA, 20 nt, Shigella flexneri 2a str. 301
cagauacgauguuguagcau

SEQ ID NO: 2026296 - RNA, 15 nt, Shigella flexneri 2a str. 301
aaaaucgcaagaucu

SEQ ID NO: 2026297 - RNA, 16 nt, Shigella flexneri 2a str. 301
aaaaucgacagcagga

SEQ ID NO: 2026298 - RNA, 17 nt, Shigella flexneri 2a str. 301
aaaauccugccagcgug

SEQ ID NO: 2026299 - RNA, 13 nt, Shigella flexneri 2a str. 301
cagaucagaccaa

SEQ ID NO: 2026300 - RNA, 15 nt, Shigella flexneri 2a str. 301
cagaucaacauacuu

SEQ ID NO: 2026301 - RNA, 22 nt, Shigella flexneri 2a str. 301
cagauauugcaccccgagcuua

SEQ ID NO: 2026302 - RNA, 21 nt, Shigella flexneri 2a str. 301
cagauauucguucagauaggc

SEQ ID NO: 2026303 - RNA, 21 nt, Shigella flexneri 2a str. 301
cagauaucccgccagcaccag

SEQ ID NO: 2026304 - RNA, 23 nt, Shigella flexneri 2a str. 301
aaaaucgcaaauugacuacacca

SEQ ID NO: 2026305 - RNA, 16 nt, Shigella flexneri 2a str. 301
cagauaguugauuaau

SEQ ID NO: 2026306 - RNA, 14 nt, Shigella flexneri 2a str. 301
cagauaguuagucu

SEQ ID NO: 2026307 - RNA, 15 nt, Shigella flexneri 2a str. 301
cagcaccgcagagau

SEQ ID NO: 2026308 - RNA, 14 nt, Shigella flexneri 2a str. 301
cagcaccgcagaga

SEQ ID NO: 2026309 - RNA, 14 nt, Shigella flexneri 2a str. 301
cagcacccugaguu

SEQ ID NO: 2026310 - RNA, 23 nt, Shigella flexneri 2a str. 301
cagcacgaaugucguuuccaugg

SEQ ID NO: 2026311 - RNA, 14 nt, Shigella flexneri 2a str. 301
cagcacggagagac

SEQ ID NO: 2026312 - RNA, 19 nt, Shigella flexneri 2a str. 301
cagcaccuuaugcgggcca

SEQ ID NO: 2026313 - RNA, 15 nt, Shigella flexneri 2a str. 301
cagcaccugcuugaa

SEQ ID NO: 2026314 - RNA, 19 nt, Shigella flexneri 2a str. 301
cagcaccugcuugaacgca

SEQ ID NO: 2026315 - RNA, 14 nt, Shigella flexneri 2a str. 301
cagcaccaccgccc

SEQ ID NO: 2026316 - RNA, 13 nt, Shigella flexneri 2a str. 301
cagcaaucacugc

SEQ ID NO: 2026317 - RNA, 12 nt, Shigella flexneri 2a str. 301
cagcaaucacug

SEQ ID NO: 2026318 - RNA, 22 nt, Shigella flexneri 2a str. 301
cagcaauaaucagauggcggcu

SEQ ID NO: 2026319 - RNA, 16 nt, Shigella flexneri 2a str. 301
cagcaauaaucagaug

SEQ ID NO: 2026320 - RNA, 18 nt, Shigella flexneri 2a str. 301
cagcaauacguuucauau

SEQ ID NO: 2026321 - RNA, 13 nt, Shigella flexneri 2a str. 301
cagcaccagcaac

SEQ ID NO: 2026322 - RNA, 12 nt, Shigella flexneri 2a str. 301
cagcaccagaga

SEQ ID NO: 2026323 - RNA, 12 nt, Shigella flexneri 2a str. 301
cagcaccaucau

SEQ ID NO: 2026324 - RNA, 23 nt, Shigella flexneri 2a str. 301
cagcaccaguucacccucauuca

SEQ ID NO: 2026325 - RNA, 18 nt, Shigella flexneri 2a str. 301
cagcaccagcuccggcac

SEQ ID NO: 2026326 - RNA, 21 nt, Shigella flexneri 2a str. 301
cagcagauauugccccacacc

SEQ ID NO: 2026327 - RNA, 15 nt, Shigella flexneri 2a str. 301
cagcagauaugccag

SEQ ID NO: 2026328 - RNA, 16 nt, Shigella flexneri 2a str. 301
cagcagauaugccagu

SEQ ID NO: 2026329 - RNA, 14 nt, Shigella flexneri 2a str. 301
cagcacugauaauc

SEQ ID NO: 2026330 - RNA, 18 nt, Shigella flexneri 2a str. 301
cagcacugauuuuuucca

SEQ ID NO: 2026331 - RNA, 17 nt, Shigella flexneri 2a str. 301
cagcacuccugccacca

SEQ ID NO: 2026332 - RNA, 15 nt, Shigella flexneri 2a str. 301
cagcacguugaacug

SEQ ID NO: 2026333 - RNA, 20 nt, Shigella flexneri 2a str. 301
cagcacgucuuccauugccg

SEQ ID NO: 2026334 - RNA, 15 nt, Shigella flexneri 2a str. 301
cagcagcaccaccgc

SEQ ID NO: 2026335 - RNA, 18 nt, Shigella flexneri 2a str. 301
cagcagauugcgaauaug

SEQ ID NO: 2026336 - RNA, 13 nt, Shigella flexneri 2a str. 301
aaaaugugccaga

SEQ ID NO: 2026337 - RNA, 15 nt, Shigella flexneri 2a str. 301
aaaaugugaugccua

SEQ ID NO: 2026338 - RNA, 23 nt, Shigella flexneri 2a str. 301
cagcagcagacagccuaccagac

SEQ ID NO: 2026339 - RNA, 16 nt, Shigella flexneri 2a str. 301
cagcagcagacagccu

SEQ ID NO: 2026340 - RNA, 14 nt, Shigella flexneri 2a str. 301
cagcagcagacagc

SEQ ID NO: 2026341 - RNA, 11 nt, Shigella flexneri 2a str. 301
cagcagcagcg

SEQ ID NO: 2026342 - RNA, 14 nt, Shigella flexneri 2a str. 301
cagauugccacagg

SEQ ID NO: 2026343 - RNA, 16 nt, Shigella flexneri 2a str. 301
cagauuuugccagcau

SEQ ID NO: 2026344 - RNA, 23 nt, Shigella flexneri 2a str. 301
cagauucucauauaucccuucca

SEQ ID NO: 2026345 - RNA, 20 nt, Shigella flexneri 2a str. 301
cagauucaggcgcagcaagu

SEQ ID NO: 2026346 - RNA, 17 nt, Shigella flexneri 2a str. 301
cagcaaaaucaccauca

SEQ ID NO: 2026347 - RNA, 14 nt, Shigella flexneri 2a str. 301
cagcaaacaggugc

SEQ ID NO: 2026348 - RNA, 21 nt, Shigella flexneri 2a str. 301
aaaaucuucguuaucccaggc

SEQ ID NO: 2026349 - RNA, 21 nt, Shigella flexneri 2a str. 301
cagauucagauuaugucgcuc

SEQ ID NO: 2026350 - RNA, 14 nt, Shigella flexneri 2a str. 301
cagauucagcagcg

SEQ ID NO: 2026351 - RNA, 21 nt, Shigella flexneri 2a str. 301
aaaaucuauugcaacauguug

SEQ ID NO: 2026352 - RNA, 14 nt, Shigella flexneri 2a str. 301
aaaaucgcuucagc

SEQ ID NO: 2026353 - RNA, 16 nt, Shigella flexneri 2a str. 301
aaaaucguaagcagga

SEQ ID NO: 2026354 - RNA, 18 nt, Shigella flexneri 2a str. 301
cagauccgccauuucucc

SEQ ID NO: 2026355 - RNA, 22 nt, Shigella flexneri 2a str. 301
cagauccgccaguuuguagcca

SEQ ID NO: 2026356 - RNA, 15 nt, Shigella flexneri 2a str. 301
cagauccgcacccgc

SEQ ID NO: 2026357 - RNA, 24 nt, Shigella flexneri 2a str. 301
cagauccugaaauuccugagagga

SEQ ID NO: 2026358 - RNA, 23 nt, Shigella flexneri 2a str. 301
cagauccauaagguccuccagcu

SEQ ID NO: 2026359 - RNA, 22 nt, Shigella flexneri 2a str. 301
cagaucccaauucauuccugga

SEQ ID NO: 2026360 - RNA, 21 nt, Shigella flexneri 2a str. 301
cagauccaaaccgacugccug

SEQ ID NO: 2026361 - RNA, 14 nt, Shigella flexneri 2a str. 301
cagaucauccaucg

SEQ ID NO: 2026362 - RNA, 17 nt, Shigella flexneri 2a str. 301
cagaucagccacuuccu

SEQ ID NO: 2026363 - RNA, 13 nt, Shigella flexneri 2a str. 301
cagaucagccacu

SEQ ID NO: 2026364 - RNA, 13 nt, Shigella flexneri 2a str. 301
cagaucagggaag

SEQ ID NO: 2026365 - RNA, 19 nt, Shigella flexneri 2a str. 301
aaaaugagugccaaaaaaa

SEQ ID NO: 2026366 - RNA, 14 nt, Shigella flexneri 2a str. 301
aaaaugacuuaaua

SEQ ID NO: 2026367 - RNA, 11 nt, Shigella flexneri 2a str. 301
cagcaaaggaa

SEQ ID NO: 2026368 - RNA, 16 nt, Shigella flexneri 2a str. 301
cagcaaacuaucccag

SEQ ID NO: 2026369 - RNA, 18 nt, Shigella flexneri 2a str. 301
cagcaaacuaucccagcc

SEQ ID NO: 2026370 - RNA, 20 nt, Shigella flexneri 2a str. 301
cagcaaaucaugaaugcaag

SEQ ID NO: 2026371 - RNA, 21 nt, Shigella flexneri 2a str. 301
cagcaacacaaucagacgcag

SEQ ID NO: 2026372 - RNA, 22 nt, Shigella flexneri 2a str. 301
cagcaacaaauaaccgccugau

SEQ ID NO: 2026373 - RNA, 13 nt, Shigella flexneri 2a str. 301
cagcaacaacagc

SEQ ID NO: 2026374 - RNA, 18 nt, Shigella flexneri 2a str. 301
cagcaacagcgccgagca

SEQ ID NO: 2026375 - RNA, 22 nt, Shigella flexneri 2a str. 301
cagcaacaagccaguccagaaa

SEQ ID NO: 2026376 - RNA, 19 nt, Shigella flexneri 2a str. 301
cagcaacaagcccaccguu

SEQ ID NO: 2026377 - RNA, 17 nt, Shigella flexneri 2a str. 301
cagcaacaaauaaccgc

SEQ ID NO: 2026378 - RNA, 15 nt, Shigella flexneri 2a str. 301
aaaaugcgaaaaaaa

SEQ ID NO: 2026379 - RNA, 21 nt, Shigella flexneri 2a str. 301
aaaaugcaucggcauaaucau

SEQ ID NO: 2026380 - RNA, 14 nt, Shigella flexneri 2a str. 301
cagcaacggccaaa

SEQ ID NO: 2026381 - RNA, 15 nt, Shigella flexneri 2a str. 301
cagcaacgcuucaac

SEQ ID NO: 2026382 - RNA, 23 nt, Shigella flexneri 2a str. 301
cagcaacgcuucaaccaacgcac

SEQ ID NO: 2026383 - RNA, 23 nt, Shigella flexneri 2a str. 301
aaaaugcgcggucggaaaauuau

SEQ ID NO: 2026384 - RNA, 17 nt, Shigella flexneri 2a str. 301
cagcaagagcaaauaaa

SEQ ID NO: 2026385 - RNA, 16 nt, Shigella flexneri 2a str. 301
cagcaacuuaaucauc

SEQ ID NO: 2026386 - RNA, 20 nt, Shigella flexneri 2a str. 301
cagcaacuguaguuguuaau

SEQ ID NO: 2026387 - RNA, 17 nt, Shigella flexneri 2a str. 301
cagcaagaccgcgacca

SEQ ID NO: 2026388 - RNA, 19 nt, Shigella flexneri 2a str. 301
cagugcggauaccaccagu

SEQ ID NO: 2026389 - RNA, 18 nt, Shigella flexneri 2a str. 301
cagugccggaugauucac

SEQ ID NO: 2026390 - RNA, 12 nt, Shigella flexneri 2a str. 301
cagugccgcgcc

SEQ ID NO: 2026391 - RNA, 20 nt, Shigella flexneri 2a str. 301
cagugccugcgccaccguuu

SEQ ID NO: 2026392 - RNA, 20 nt, Shigella flexneri 2a str. 301
cagugccucacgaucacagc

SEQ ID NO: 2026393 - RNA, 22 nt, Shigella flexneri 2a str. 301
cagugccucacgaucacagcag

SEQ ID NO: 2026394 - RNA, 20 nt, Shigella flexneri 2a str. 301
cagguauaccgaaaucgcca

SEQ ID NO: 2026395 - RNA, 22 nt, Shigella flexneri 2a str. 301
cagugccagguagucacgguag

SEQ ID NO: 2026396 - RNA, 14 nt, Shigella flexneri 2a str. 301
cagugccccgagcg

SEQ ID NO: 2026397 - RNA, 20 nt, Shigella flexneri 2a str. 301
cagugccauuaacaggccaa

SEQ ID NO: 2026398 - RNA, 22 nt, Shigella flexneri 2a str. 301
cagugccgcacauagcaccacc

SEQ ID NO: 2026399 - RNA, 15 nt, Shigella flexneri 2a str. 301
cagugccgcauugac

SEQ ID NO: 2026400 - RNA, 18 nt, Shigella flexneri 2a str. 301
cagugcccgaccacuuca

SEQ ID NO: 2026401 - RNA, 12 nt, Shigella flexneri 2a str. 301
cagugcuuuauc

SEQ ID NO: 2026402 - RNA, 21 nt, Shigella flexneri 2a str. 301
caguggauaauacacuaacag

SEQ ID NO: 2026403 - RNA, 21 nt, Shigella flexneri 2a str. 301
caguggaugcgccauaccaug

SEQ ID NO: 2026404 - RNA, 20 nt, Shigella flexneri 2a str. 301
cagugcugauuuugcaacaa

SEQ ID NO: 2026405 - RNA, 20 nt, Shigella flexneri 2a str. 301
cagugcuccaccuugcggaa

SEQ ID NO: 2026406 - RNA, 20 nt, Shigella flexneri 2a str. 301
cagugggcgcugcuguacuu

SEQ ID NO: 2026407 - RNA, 14 nt, Shigella flexneri 2a str. 301
cagugggauuaaaa

SEQ ID NO: 2026408 - RNA, 16 nt, Shigella flexneri 2a str. 301
caguggcucuuguucg

SEQ ID NO: 2026409 - RNA, 15 nt, Shigella flexneri 2a str. 301
caguguaucggcggc

SEQ ID NO: 2026410 - RNA, 18 nt, Shigella flexneri 2a str. 301
caguggugcggcugaugg

SEQ ID NO: 2026411 - RNA, 20 nt, Shigella flexneri 2a str. 301
caguggcuuaucuuccuguu

SEQ ID NO: 2026412 - RNA, 18 nt, Shigella flexneri 2a str. 301
caguuacugccaccaucc

SEQ ID NO: 2026413 - RNA, 17 nt, Shigella flexneri 2a str. 301
caguuacugccaccauc

SEQ ID NO: 2026414 - RNA, 17 nt, Shigella flexneri 2a str. 301
caguuacugcugacgcu

SEQ ID NO: 2026415 - RNA, 14 nt, Shigella flexneri 2a str. 301
caguuacgcagacg

SEQ ID NO: 2026416 - RNA, 13 nt, Shigella flexneri 2a str. 301
caguuaagcaacu

SEQ ID NO: 2026417 - RNA, 16 nt, Shigella flexneri 2a str. 301
caguguccagcggcau

SEQ ID NO: 2026418 - RNA, 20 nt, Shigella flexneri 2a str. 301
cagugugcuacggucugccg

SEQ ID NO: 2026419 - RNA, 16 nt, Shigella flexneri 2a str. 301
caguucacaccagcca

SEQ ID NO: 2026420 - RNA, 22 nt, Shigella flexneri 2a str. 301
caguucacccucauucaccagu

SEQ ID NO: 2026421 - RNA, 23 nt, Shigella flexneri 2a str. 301
caguucaacgcggcgcugccgug

SEQ ID NO: 2026422 - RNA, 16 nt, Shigella flexneri 2a str. 301
caguucacgaauauuu

SEQ ID NO: 2026423 - RNA, 19 nt, Shigella flexneri 2a str. 301
caguucacgaauauuuccc

SEQ ID NO: 2026424 - RNA, 17 nt, Shigella flexneri 2a str. 301
caguuauagcgcagacg

SEQ ID NO: 2026425 - RNA, 19 nt, Shigella flexneri 2a str. 301
caguuaucaaauucauugc

SEQ ID NO: 2026426 - RNA, 21 nt, Shigella flexneri 2a str. 301
caguucaucaacgcccauaaa

SEQ ID NO: 2026427 - RNA, 19 nt, Shigella flexneri 2a str. 301
caguucagucagcaguguc

SEQ ID NO: 2026428 - RNA, 22 nt, Shigella flexneri 2a str. 301
caguucagcgauauccagcgau

SEQ ID NO: 2026429 - RNA, 21 nt, Shigella flexneri 2a str. 301
caguucagcagcacuacaccc

SEQ ID NO: 2026430 - RNA, 13 nt, Shigella flexneri 2a str. 301
caguuggcugugg

SEQ ID NO: 2026431 - RNA, 16 nt, Shigella flexneri 2a str. 301
caguuggaugcugcau

SEQ ID NO: 2026432 - RNA, 14 nt, Shigella flexneri 2a str. 301
caguugcuuuacuc

SEQ ID NO: 2026433 - RNA, 16 nt, Shigella flexneri 2a str. 301
caguugcgcgcgcacc

SEQ ID NO: 2026434 - RNA, 14 nt, Shigella flexneri 2a str. 301
caguugcacgccac

SEQ ID NO: 2026435 - RNA, 17 nt, Shigella flexneri 2a str. 301
caguucuucaaaaauaa

SEQ ID NO: 2026436 - RNA, 16 nt, Shigella flexneri 2a str. 301
caguucuuccaguucc

SEQ ID NO: 2026437 - RNA, 15 nt, Shigella flexneri 2a str. 301
caguucuuccuggcu

SEQ ID NO: 2026438 - RNA, 14 nt, Shigella flexneri 2a str. 301
caguucuucucaac

SEQ ID NO: 2026439 - RNA, 15 nt, Shigella flexneri 2a str. 301
caguucuucuucaau

SEQ ID NO: 2026440 - RNA, 13 nt, Shigella flexneri 2a str. 301
caguucuuuuauu

SEQ ID NO: 2026441 - RNA, 16 nt, Shigella flexneri 2a str. 301
caguugaucagccagg

SEQ ID NO: 2026442 - RNA, 19 nt, Shigella flexneri 2a str. 301
caguugauacaggaacagc

SEQ ID NO: 2026443 - RNA, 20 nt, Shigella flexneri 2a str. 301
caguucuaccaucaauggcu

SEQ ID NO: 2026444 - RNA, 16 nt, Shigella flexneri 2a str. 301
caguucuacuggaauu

SEQ ID NO: 2026445 - RNA, 18 nt, Shigella flexneri 2a str. 301
caguucuaccaucaaugg

SEQ ID NO: 2026446 - RNA, 13 nt, Shigella flexneri 2a str. 301
caguucgcggcgu

SEQ ID NO: 2026447 - RNA, 17 nt, Shigella flexneri 2a str. 301
caguucggaaacagugc

SEQ ID NO: 2026448 - RNA, 24 nt, Shigella flexneri 2a str. 301
caguucgcccgcuucaucgugcuc

SEQ ID NO: 2026449 - RNA, 15 nt, Shigella flexneri 2a str. 301
caguucccccugcca

SEQ ID NO: 2026450 - RNA, 16 nt, Shigella flexneri 2a str. 301
caguucgauuucccag

SEQ ID NO: 2026451 - RNA, 18 nt, Shigella flexneri 2a str. 301
caguucgaaauccagacg

SEQ ID NO: 2026452 - RNA, 14 nt, Shigella flexneri 2a str. 301
caguuccugcaacu

SEQ ID NO: 2026453 - RNA, 17 nt, Shigella flexneri 2a str. 301
caguuccugcaacuucu

SEQ ID NO: 2026454 - RNA, 23 nt, Shigella flexneri 2a str. 301
caguugguuagagcacaucacuc

SEQ ID NO: 2026455 - RNA, 14 nt, Shigella flexneri 2a str. 301
caguugguguccaa

SEQ ID NO: 2026456 - RNA, 19 nt, Shigella flexneri 2a str. 301
caguugucagcccuuuuuc

SEQ ID NO: 2026457 - RNA, 17 nt, Shigella flexneri 2a str. 301
caguuguugcugccgac

SEQ ID NO: 2026458 - RNA, 20 nt, Shigella flexneri 2a str. 301
caguuguucagaaugcccac

SEQ ID NO: 2026459 - RNA, 14 nt, Shigella flexneri 2a str. 301
caguuucacagggu

SEQ ID NO: 2026460 - RNA, 14 nt, Shigella flexneri 2a str. 301
caguuucaccagca

SEQ ID NO: 2026461 - RNA, 15 nt, Shigella flexneri 2a str. 301
caguuuauccagcca

SEQ ID NO: 2026462 - RNA, 13 nt, Shigella flexneri 2a str. 301
caguuuauuuucu

SEQ ID NO: 2026463 - RNA, 17 nt, Shigella flexneri 2a str. 301
caguuuuuaauuuucgu

SEQ ID NO: 2026464 - RNA, 24 nt, Shigella flexneri 2a str. 301
caguuuucgcaccgcguuuagcgu

SEQ ID NO: 2026465 - RNA, 18 nt, Shigella flexneri 2a str. 301
caguuuuuccccugccag

SEQ ID NO: 2026466 - RNA, 21 nt, Shigella flexneri 2a str. 301
caguuuuucgucaacauacug

SEQ ID NO: 2026467 - RNA, 23 nt, Shigella flexneri 2a str. 301
caguuuuucgucaacauacugcu

SEQ ID NO: 2026468 - RNA, 15 nt, Shigella flexneri 2a str. 301
caguuuuuguuucug

SEQ ID NO: 2026469 - RNA, 12 nt, Shigella flexneri 2a str. 301
cauaaaaaaacg

SEQ ID NO: 2026470 - RNA, 22 nt, Shigella flexneri 2a str. 301
caguuuggucuggcaaaaauaa

SEQ ID NO: 2026471 - RNA, 15 nt, Shigella flexneri 2a str. 301
caguuucugcagcuc

SEQ ID NO: 2026472 - RNA, 11 nt, Shigella flexneri 2a str. 301
caguuucugau

SEQ ID NO: 2026473 - RNA, 16 nt, Shigella flexneri 2a str. 301
caguuugccgaacagc

SEQ ID NO: 2026474 - RNA, 17 nt, Shigella flexneri 2a str. 301
caguuugagauugaaaa

SEQ ID NO: 2026475 - RNA, 16 nt, Shigella flexneri 2a str. 301
cauaccccacauaguu

SEQ ID NO: 2026476 - RNA, 21 nt, Shigella flexneri 2a str. 301
cauaccuaaaagcacgccaga

SEQ ID NO: 2026477 - RNA, 16 nt, Shigella flexneri 2a str. 301
cauaccuaccugcagu

SEQ ID NO: 2026478 - RNA, 17 nt, Shigella flexneri 2a str. 301
cauaccuaccugcaguu

SEQ ID NO: 2026479 - RNA, 15 nt, Shigella flexneri 2a str. 301
cauaccuaaaaaauc

SEQ ID NO: 2026480 - RNA, 14 nt, Shigella flexneri 2a str. 301
cauaccuaaaagca

SEQ ID NO: 2026481 - RNA, 20 nt, Shigella flexneri 2a str. 301
cauaccgugguacguuaaag

SEQ ID NO: 2026482 - RNA, 17 nt, Shigella flexneri 2a str. 301
cauaccugaguggcaau

SEQ ID NO: 2026483 - RNA, 20 nt, Shigella flexneri 2a str. 301
cauacgcggcagaaugguuu

SEQ ID NO: 2026484 - RNA, 18 nt, Shigella flexneri 2a str. 301
cauacgcguaaaacagcc

SEQ ID NO: 2026485 - RNA, 22 nt, Shigella flexneri 2a str. 301
cauacagaucgugcaucuccug

SEQ ID NO: 2026486 - RNA, 17 nt, Shigella flexneri 2a str. 301
cauacagcggacagcca

SEQ ID NO: 2026487 - RNA, 15 nt, Shigella flexneri 2a str. 301
cauacagacacccac

SEQ ID NO: 2026488 - RNA, 22 nt, Shigella flexneri 2a str. 301
cauacaccguuuuacaacgcug

SEQ ID NO: 2026489 - RNA, 20 nt, Shigella flexneri 2a str. 301
cauacaugguuugaucgcua

SEQ ID NO: 2026490 - RNA, 14 nt, Shigella flexneri 2a str. 301
cauaccacagcaaa

SEQ ID NO: 2026491 - RNA, 20 nt, Shigella flexneri 2a str. 301
cauacagcuuuuacagccaa

SEQ ID NO: 2026492 - RNA, 19 nt, Shigella flexneri 2a str. 301
cauacagcuuuuacagcca

SEQ ID NO: 2026493 - RNA, 17 nt, Shigella flexneri 2a str. 301
cauaaucuguuucaucu

SEQ ID NO: 2026494 - RNA, 16 nt, Shigella flexneri 2a str. 301
cauaaucggcgcggcg

SEQ ID NO: 2026495 - RNA, 22 nt, Shigella flexneri 2a str. 301
cauaaugguggaguggcccagg

SEQ ID NO: 2026496 - RNA, 13 nt, Shigella flexneri 2a str. 301
cauaaugcugaca

SEQ ID NO: 2026497 - RNA, 12 nt, Shigella flexneri 2a str. 301
cauacaaauaag

SEQ ID NO: 2026498 - RNA, 17 nt, Shigella flexneri 2a str. 301
cauaauuuccagcagug

SEQ ID NO: 2026499 - RNA, 18 nt, Shigella flexneri 2a str. 301
cauaauguugcugccuug

SEQ ID NO: 2026500 - RNA, 20 nt, Shigella flexneri 2a str. 301
cauaauguccugcggacagu

SEQ ID NO: 2026501 - RNA, 13 nt, Shigella flexneri 2a str. 301
cauaauguccugc

SEQ ID NO: 2026502 - RNA, 15 nt, Shigella flexneri 2a str. 301
cauaaugugcgcaca

SEQ ID NO: 2026503 - RNA, 13 nt, Shigella flexneri 2a str. 301
cauaauccagguu

SEQ ID NO: 2026504 - RNA, 20 nt, Shigella flexneri 2a str. 301
cauaaucauuacaaccgcug

SEQ ID NO: 2026505 - RNA, 23 nt, Shigella flexneri 2a str. 301
cauaauauucauuacaccaauac

SEQ ID NO: 2026506 - RNA, 20 nt, Shigella flexneri 2a str. 301
cauaauauucauuacaccaa

SEQ ID NO: 2026507 - RNA, 18 nt, Shigella flexneri 2a str. 301
cauaauaaagaugccauu

SEQ ID NO: 2026508 - RNA, 19 nt, Shigella flexneri 2a str. 301
cauaauaagcuuuuucugc

SEQ ID NO: 2026509 - RNA, 15 nt, Shigella flexneri 2a str. 301
cauaaacaccagcaa

SEQ ID NO: 2026510 - RNA, 22 nt, Shigella flexneri 2a str. 301
cauaaagaaaucaccugccgga

SEQ ID NO: 2026511 - RNA, 21 nt, Shigella flexneri 2a str. 301
cauaaacgccgucaucacacc

SEQ ID NO: 2026512 - RNA, 15 nt, Shigella flexneri 2a str. 301
cauaaaccacagacc

SEQ ID NO: 2026513 - RNA, 22 nt, Shigella flexneri 2a str. 301
cauaaaaaugcccgauaagcaa

SEQ ID NO: 2026514 - RNA, 22 nt, Shigella flexneri 2a str. 301
cauaaaucucagcccgaugaua

SEQ ID NO: 2026515 - RNA, 17 nt, Shigella flexneri 2a str. 301
cauaaauacuccauaac

SEQ ID NO: 2026516 - RNA, 15 nt, Shigella flexneri 2a str. 301
cauaaauugcagcga

SEQ ID NO: 2026517 - RNA, 16 nt, Shigella flexneri 2a str. 301
cauaaauugcuguaaa

SEQ ID NO: 2026518 - RNA, 20 nt, Shigella flexneri 2a str. 301
cauaaauuccggcuuguuca

SEQ ID NO: 2026519 - RNA, 16 nt, Shigella flexneri 2a str. 301
cauaaagucuuucuua

SEQ ID NO: 2026520 - RNA, 22 nt, Shigella flexneri 2a str. 301
cauaaagccugcuucaaacgcu

SEQ ID NO: 2026521 - RNA, 15 nt, Shigella flexneri 2a str. 301
cauaaagccugcuuc

SEQ ID NO: 2026522 - RNA, 18 nt, Shigella flexneri 2a str. 301
cauaaagcgguuuucaaa

SEQ ID NO: 2026523 - RNA, 15 nt, Shigella flexneri 2a str. 301
cauaacucauacuga

SEQ ID NO: 2026524 - RNA, 13 nt, Shigella flexneri 2a str. 301
cauaacucaccau

SEQ ID NO: 2026525 - RNA, 18 nt, Shigella flexneri 2a str. 301
cauaacuggucaucaaau

SEQ ID NO: 2026526 - RNA, 13 nt, Shigella flexneri 2a str. 301
cauaacugccgga

SEQ ID NO: 2026527 - RNA, 20 nt, Shigella flexneri 2a str. 301
cauaagagauggaaugagca

SEQ ID NO: 2026528 - RNA, 20 nt, Shigella flexneri 2a str. 301
cauaaauuucacgucacgcu

SEQ ID NO: 2026529 - RNA, 21 nt, Shigella flexneri 2a str. 301
cauaacacagguaacuuaaau

SEQ ID NO: 2026530 - RNA, 12 nt, Shigella flexneri 2a str. 301
cauaacagagcg

SEQ ID NO: 2026531 - RNA, 13 nt, Shigella flexneri 2a str. 301
cauaaccacucac

SEQ ID NO: 2026532 - RNA, 17 nt, Shigella flexneri 2a str. 301
cauaaccacucaccgcc

SEQ ID NO: 2026533 - RNA, 22 nt, Shigella flexneri 2a str. 301
cauaacgcaucggcuaaaccau

SEQ ID NO: 2026534 - RNA, 18 nt, Shigella flexneri 2a str. 301
cauaaccugugcaccaga

SEQ ID NO: 2026535 - RNA, 19 nt, Shigella flexneri 2a str. 301
cauaacgcugauauuucgg

SEQ ID NO: 2026536 - RNA, 14 nt, Shigella flexneri 2a str. 301
cauaacgcgucuca

SEQ ID NO: 2026537 - RNA, 21 nt, Shigella flexneri 2a str. 301
cauaacgcuccuacaccgaac

SEQ ID NO: 2026538 - RNA, 21 nt, Shigella flexneri 2a str. 301
cauaacgccaauucauuccuu

SEQ ID NO: 2026539 - RNA, 18 nt, Shigella flexneri 2a str. 301
cauaacgccgguauuuuu

SEQ ID NO: 2026540 - RNA, 20 nt, Shigella flexneri 2a str. 301
cauaacgccgguauuuuuau

SEQ ID NO: 2026541 - RNA, 18 nt, Shigella flexneri 2a str. 301
cauaaccacucaccgccg

SEQ ID NO: 2026542 - RNA, 15 nt, Shigella flexneri 2a str. 301
cauaaccagagagcu

SEQ ID NO: 2026543 - RNA, 17 nt, Shigella flexneri 2a str. 301
caucaaccagcacaaag

SEQ ID NO: 2026544 - RNA, 22 nt, Shigella flexneri 2a str. 301
caucaacccgcucauaauacag

SEQ ID NO: 2026545 - RNA, 15 nt, Shigella flexneri 2a str. 301
caucaacguuuuuuu

SEQ ID NO: 2026546 - RNA, 13 nt, Shigella flexneri 2a str. 301
caucaauauuaag

SEQ ID NO: 2026547 - RNA, 22 nt, Shigella flexneri 2a str. 301
caucaagcuaacgaacgcagug

SEQ ID NO: 2026548 - RNA, 22 nt, Shigella flexneri 2a str. 301
caucaaacaacggcacuucaau

SEQ ID NO: 2026549 - RNA, 14 nt, Shigella flexneri 2a str. 301
cauauucagcagca

SEQ ID NO: 2026550 - RNA, 13 nt, Shigella flexneri 2a str. 301
cauauucagcagc

SEQ ID NO: 2026551 - RNA, 12 nt, Shigella flexneri 2a str. 301
cauauucaccac

SEQ ID NO: 2026552 - RNA, 16 nt, Shigella flexneri 2a str. 301
cauauucaauuugcaa

SEQ ID NO: 2026553 - RNA, 14 nt, Shigella flexneri 2a str. 301
cauauuuaaagaag

SEQ ID NO: 2026554 - RNA, 12 nt, Shigella flexneri 2a str. 301
cauauuguuuca

SEQ ID NO: 2026555 - RNA, 15 nt, Shigella flexneri 2a str. 301
cauauguugaaaagc

SEQ ID NO: 2026556 - RNA, 14 nt, Shigella flexneri 2a str. 301
cauauuaaauuuuu

SEQ ID NO: 2026557 - RNA, 14 nt, Shigella flexneri 2a str. 301
cauaugcagcaucc

SEQ ID NO: 2026558 - RNA, 16 nt, Shigella flexneri 2a str. 301
cauaugcacaugauga

SEQ ID NO: 2026559 - RNA, 15 nt, Shigella flexneri 2a str. 301
cauaucagcaacucu

SEQ ID NO: 2026560 - RNA, 18 nt, Shigella flexneri 2a str. 301
cauaucaccguucacugc

SEQ ID NO: 2026561 - RNA, 20 nt, Shigella flexneri 2a str. 301
cauauccccgggcggccucu

SEQ ID NO: 2026562 - RNA, 17 nt, Shigella flexneri 2a str. 301
cauaucucccaguaagc

SEQ ID NO: 2026563 - RNA, 18 nt, Shigella flexneri 2a str. 301
cauagugcaaauccacuc

SEQ ID NO: 2026564 - RNA, 10 nt, Shigella flexneri 2a str. 301
cauauaccuc

SEQ ID NO: 2026565 - RNA, 22 nt, Shigella flexneri 2a str. 301
cauauacgccaucgccagcagc

SEQ ID NO: 2026566 - RNA, 16 nt, Shigella flexneri 2a str. 301
cauauaaugcaacauu

SEQ ID NO: 2026567 - RNA, 20 nt, Shigella flexneri 2a str. 301
cauacggaaaaucucauuug

SEQ ID NO: 2026568 - RNA, 15 nt, Shigella flexneri 2a str. 301
cauacguuucaccag

SEQ ID NO: 2026569 - RNA, 17 nt, Shigella flexneri 2a str. 301
cauaguagccagccaga

SEQ ID NO: 2026570 - RNA, 14 nt, Shigella flexneri 2a str. 301
cauaguagccagcc

SEQ ID NO: 2026571 - RNA, 20 nt, Shigella flexneri 2a str. 301
caucagcgccugauggacau

SEQ ID NO: 2026572 - RNA, 18 nt, Shigella flexneri 2a str. 301
caucagcgccaccagcgc

SEQ ID NO: 2026573 - RNA, 22 nt, Shigella flexneri 2a str. 301
caucagaucguugaacccggca

SEQ ID NO: 2026574 - RNA, 14 nt, Shigella flexneri 2a str. 301
caucagaggcgaac

SEQ ID NO: 2026575 - RNA, 18 nt, Shigella flexneri 2a str. 301
caucagcgguacucgcgc

SEQ ID NO: 2026576 - RNA, 20 nt, Shigella flexneri 2a str. 301
caucagcgguaaaacgccca

SEQ ID NO: 2026577 - RNA, 12 nt, Shigella flexneri 2a str. 301
caucagcugcca

SEQ ID NO: 2026578 - RNA, 15 nt, Shigella flexneri 2a str. 301
caucagcgucgguuu

SEQ ID NO: 2026579 - RNA, 13 nt, Shigella flexneri 2a str. 301
caucagcuccggu

SEQ ID NO: 2026580 - RNA, 11 nt, Shigella flexneri 2a str. 301
caucaggaaac

SEQ ID NO: 2026581 - RNA, 14 nt, Shigella flexneri 2a str. 301
caucaggaaacccg

SEQ ID NO: 2026582 - RNA, 18 nt, Shigella flexneri 2a str. 301
caucaggaccugcucugc

SEQ ID NO: 2026583 - RNA, 20 nt, Shigella flexneri 2a str. 301
caucaggaugacaaacuuga

SEQ ID NO: 2026584 - RNA, 22 nt, Shigella flexneri 2a str. 301
caucaggcaucgugcaccaauu

SEQ ID NO: 2026585 - RNA, 14 nt, Shigella flexneri 2a str. 301
caucaggcaucugc

SEQ ID NO: 2026586 - RNA, 19 nt, Shigella flexneri 2a str. 301
caucaggcauuuuuaucac

SEQ ID NO: 2026587 - RNA, 21 nt, Shigella flexneri 2a str. 301
caucaggcaaugggcaaacgc

SEQ ID NO: 2026588 - RNA, 21 nt, Shigella flexneri 2a str. 301
caucaggcaacccagaagaaa

SEQ ID NO: 2026589 - RNA, 16 nt, Shigella flexneri 2a str. 301
caucaaugaccuuuuu

SEQ ID NO: 2026590 - RNA, 14 nt, Shigella flexneri 2a str. 301
caucaaugaccuga

SEQ ID NO: 2026591 - RNA, 15 nt, Shigella flexneri 2a str. 301
caucaauggaugaac

SEQ ID NO: 2026592 - RNA, 22 nt, Shigella flexneri 2a str. 301
caucacgaucgcuucggucugc

SEQ ID NO: 2026593 - RNA, 20 nt, Shigella flexneri 2a str. 301
caucacgcgguuacgcaccg

SEQ ID NO: 2026594 - RNA, 15 nt, Shigella flexneri 2a str. 301
caucacgcccgcuuu

SEQ ID NO: 2026595 - RNA, 14 nt, Shigella flexneri 2a str. 301
caucacgcaaaugu

SEQ ID NO: 2026596 - RNA, 19 nt, Shigella flexneri 2a str. 301
caucacgguugagggcaaa

SEQ ID NO: 2026597 - RNA, 21 nt, Shigella flexneri 2a str. 301
caucagaagauggugaauggu

SEQ ID NO: 2026598 - RNA, 15 nt, Shigella flexneri 2a str. 301
caucaucgauaccaa

SEQ ID NO: 2026599 - RNA, 16 nt, Shigella flexneri 2a str. 301
caucaucgccccgcuc

SEQ ID NO: 2026600 - RNA, 13 nt, Shigella flexneri 2a str. 301
caucaucucccac

SEQ ID NO: 2026601 - RNA, 18 nt, Shigella flexneri 2a str. 301
caucaucuuuauauauug

SEQ ID NO: 2026602 - RNA, 20 nt, Shigella flexneri 2a str. 301
caucaucucugucgcugaaa

SEQ ID NO: 2026603 - RNA, 12 nt, Shigella flexneri 2a str. 301
caucaucagaaa

SEQ ID NO: 2026604 - RNA, 22 nt, Shigella flexneri 2a str. 301
caucaucagaaaugccaguaac

SEQ ID NO: 2026605 - RNA, 19 nt, Shigella flexneri 2a str. 301
caucaucagaaaugccagu

SEQ ID NO: 2026606 - RNA, 19 nt, Shigella flexneri 2a str. 301
caucauccccguaucuuca

SEQ ID NO: 2026607 - RNA, 16 nt, Shigella flexneri 2a str. 301
caucauccucuucagc

SEQ ID NO: 2026608 - RNA, 19 nt, Shigella flexneri 2a str. 301
caucauccugacccagcaa

SEQ ID NO: 2026609 - RNA, 20 nt, Shigella flexneri 2a str. 301
caucaucaggaacaucccuu

SEQ ID NO: 2026610 - RNA, 18 nt, Shigella flexneri 2a str. 301
caucaggggcagcaccau

SEQ ID NO: 2026611 - RNA, 21 nt, Shigella flexneri 2a str. 301
caucaggcguucgcggcggca

SEQ ID NO: 2026612 - RNA, 17 nt, Shigella flexneri 2a str. 301
caucaguagcauccccg

SEQ ID NO: 2026613 - RNA, 15 nt, Shigella flexneri 2a str. 301
caucagugaacccau

SEQ ID NO: 2026614 - RNA, 21 nt, Shigella flexneri 2a str. 301
caucaguugaugaaucugcuu

SEQ ID NO: 2026615 - RNA, 12 nt, Shigella flexneri 2a str. 301
caucaguuucaa

SEQ ID NO: 2026616 - RNA, 15 nt, Shigella flexneri 2a str. 301
caucauaaccgagca

SEQ ID NO: 2026617 - RNA, 21 nt, Shigella flexneri 2a str. 301
caucauacgggucauugccag

SEQ ID NO: 2026618 - RNA, 16 nt, Shigella flexneri 2a str. 301
caucgauuuugcaaua

SEQ ID NO: 2026619 - RNA, 21 nt, Shigella flexneri 2a str. 301
caucgcaaaccagacgcgcgu

SEQ ID NO: 2026620 - RNA, 23 nt, Shigella flexneri 2a str. 301
caucgcaacgccuaaauccgcca

SEQ ID NO: 2026621 - RNA, 15 nt, Shigella flexneri 2a str. 301
caucgcauaaaacaa

SEQ ID NO: 2026622 - RNA, 17 nt, Shigella flexneri 2a str. 301
caucgcauaacagagcg

SEQ ID NO: 2026623 - RNA, 16 nt, Shigella flexneri 2a str. 301
caucgcgcccaaacca

SEQ ID NO: 2026624 - RNA, 17 nt, Shigella flexneri 2a str. 301
caucgcgcccaaaccac

SEQ ID NO: 2026625 - RNA, 16 nt, Shigella flexneri 2a str. 301
caucgccuuccagcga

SEQ ID NO: 2026626 - RNA, 19 nt, Shigella flexneri 2a str. 301
cauccugcggcagcuccag

SEQ ID NO: 2026627 - RNA, 18 nt, Shigella flexneri 2a str. 301
cauccugcggcagcucca

SEQ ID NO: 2026628 - RNA, 14 nt, Shigella flexneri 2a str. 301
cauccugcucaagu

SEQ ID NO: 2026629 - RNA, 12 nt, Shigella flexneri 2a str. 301
cauccugcugca

SEQ ID NO: 2026630 - RNA, 22 nt, Shigella flexneri 2a str. 301
cauccuggggguucaucaccac

SEQ ID NO: 2026631 - RNA, 18 nt, Shigella flexneri 2a str. 301
cauccuucacacugccuc

SEQ ID NO: 2026632 - RNA, 16 nt, Shigella flexneri 2a str. 301
caucgauaucaaccag

SEQ ID NO: 2026633 - RNA, 17 nt, Shigella flexneri 2a str. 301
caucgauaucaaccagu

SEQ ID NO: 2026634 - RNA, 15 nt, Shigella flexneri 2a str. 301
caucgaugagaugac

SEQ ID NO: 2026635 - RNA, 23 nt, Shigella flexneri 2a str. 301
caucgacggcggagucauucucc

SEQ ID NO: 2026636 - RNA, 16 nt, Shigella flexneri 2a str. 301
caucgacgccaucauu

SEQ ID NO: 2026637 - RNA, 18 nt, Shigella flexneri 2a str. 301
caucccugucguccagac

SEQ ID NO: 2026638 - RNA, 22 nt, Shigella flexneri 2a str. 301
caucccugaaauguuugcaaua

SEQ ID NO: 2026639 - RNA, 23 nt, Shigella flexneri 2a str. 301
caucccgguaucaaagcgccaga

SEQ ID NO: 2026640 - RNA, 17 nt, Shigella flexneri 2a str. 301
caucauuuaaaaagaaa

SEQ ID NO: 2026641 - RNA, 22 nt, Shigella flexneri 2a str. 301
caucauucccuacgcgauaaaa

SEQ ID NO: 2026642 - RNA, 15 nt, Shigella flexneri 2a str. 301
cauccgacacuggca

SEQ ID NO: 2026643 - RNA, 13 nt, Shigella flexneri 2a str. 301
cauccgacacugg

SEQ ID NO: 2026644 - RNA, 15 nt, Shigella flexneri 2a str. 301
cauccgacaucaacc

SEQ ID NO: 2026645 - RNA, 16 nt, Shigella flexneri 2a str. 301
cauccggcaaaaacaa

SEQ ID NO: 2026646 - RNA, 14 nt, Shigella flexneri 2a str. 301
cauccgcucccugg

SEQ ID NO: 2026647 - RNA, 21 nt, Shigella flexneri 2a str. 301
cauccgcgucggcaaguaccc

SEQ ID NO: 2026648 - RNA, 18 nt, Shigella flexneri 2a str. 301
cauccgcgugacgcuggc

SEQ ID NO: 2026649 - RNA, 21 nt, Shigella flexneri 2a str. 301
cauccggcaauuaaaaaagcg

SEQ ID NO: 2026650 - RNA, 14 nt, Shigella flexneri 2a str. 301
cauccggcaauauu

SEQ ID NO: 2026651 - RNA, 19 nt, Shigella flexneri 2a str. 301
cauccggcaauucucugcu

SEQ ID NO: 2026652 - RNA, 21 nt, Shigella flexneri 2a str. 301
cauccggcaaucggugcaaau

SEQ ID NO: 2026653 - RNA, 18 nt, Shigella flexneri 2a str. 301
cauccggauacagcccca

SEQ ID NO: 2026654 - RNA, 22 nt, Shigella flexneri 2a str. 301
cauccggucagacaacuucccu

SEQ ID NO: 2026655 - RNA, 16 nt, Shigella flexneri 2a str. 301
cauccucuauauuuca

SEQ ID NO: 2026656 - RNA, 15 nt, Shigella flexneri 2a str. 301
caucucauccaucaa

SEQ ID NO: 2026657 - RNA, 13 nt, Shigella flexneri 2a str. 301
caucucaaacacg

SEQ ID NO: 2026658 - RNA, 14 nt, Shigella flexneri 2a str. 301
caucuccagcugcu

SEQ ID NO: 2026659 - RNA, 15 nt, Shigella flexneri 2a str. 301
caucuauuauuguuu

SEQ ID NO: 2026660 - RNA, 19 nt, Shigella flexneri 2a str. 301
caucuacccgaugcaaaaa

SEQ ID NO: 2026661 - RNA, 16 nt, Shigella flexneri 2a str. 301
caucuacaaaaaacug

SEQ ID NO: 2026662 - RNA, 13 nt, Shigella flexneri 2a str. 301
caucguccagcuu

SEQ ID NO: 2026663 - RNA, 16 nt, Shigella flexneri 2a str. 301
caucguauuucagacc

SEQ ID NO: 2026664 - RNA, 22 nt, Shigella flexneri 2a str. 301
caucuaaccauuauuaaauuua

SEQ ID NO: 2026665 - RNA, 15 nt, Shigella flexneri 2a str. 301
caucgcuacaccaau

SEQ ID NO: 2026666 - RNA, 21 nt, Shigella flexneri 2a str. 301
caucguaguuuuugcccauca

SEQ ID NO: 2026667 - RNA, 13 nt, Shigella flexneri 2a str. 301
caucguaaagcug

SEQ ID NO: 2026668 - RNA, 13 nt, Shigella flexneri 2a str. 301
caucugcauggug

SEQ ID NO: 2026669 - RNA, 11 nt, Shigella flexneri 2a str. 301
caucugcccca

SEQ ID NO: 2026670 - RNA, 12 nt, Shigella flexneri 2a str. 301
caucucuuccca

SEQ ID NO: 2026671 - RNA, 22 nt, Shigella flexneri 2a str. 301
caucucuucuuccggcaccauu

SEQ ID NO: 2026672 - RNA, 20 nt, Shigella flexneri 2a str. 301
caucugaccacggccacagc

SEQ ID NO: 2026673 - RNA, 23 nt, Shigella flexneri 2a str. 301
caucugaaacucgcguaaaucca

SEQ ID NO: 2026674 - RNA, 17 nt, Shigella flexneri 2a str. 301
caucucgcgcucuucuu

SEQ ID NO: 2026675 - RNA, 18 nt, Shigella flexneri 2a str. 301
caucucgcgcucuucuuc

SEQ ID NO: 2026676 - RNA, 20 nt, Shigella flexneri 2a str. 301
caucucgcgcucuucuucgc

SEQ ID NO: 2026677 - RNA, 19 nt, Shigella flexneri 2a str. 301
caucucgcucaaaaaucca

SEQ ID NO: 2026678 - RNA, 22 nt, Shigella flexneri 2a str. 301
caucucugcaacgucuucccga

SEQ ID NO: 2026679 - RNA, 20 nt, Shigella flexneri 2a str. 301
caucucugcaacgucuuccc

SEQ ID NO: 2026680 - RNA, 16 nt, Shigella flexneri 2a str. 301
caucucuacagcgccc

SEQ ID NO: 2026681 - RNA, 23 nt, Shigella flexneri 2a str. 301
caucuguauggcccggaaacccu

SEQ ID NO: 2026682 - RNA, 14 nt, Shigella flexneri 2a str. 301
caucuguucuuuua

SEQ ID NO: 2026683 - RNA, 15 nt, Shigella flexneri 2a str. 301
caucuucaacugcca

SEQ ID NO: 2026684 - RNA, 15 nt, Shigella flexneri 2a str. 301
caucuggcauucaga

SEQ ID NO: 2026685 - RNA, 13 nt, Shigella flexneri 2a str. 301
caucugcuuuuug

SEQ ID NO: 2026686 - RNA, 12 nt, Shigella flexneri 2a str. 301
caucugcuucaa

SEQ ID NO: 2026687 - RNA, 17 nt, Shigella flexneri 2a str. 301
caucugcguggcgcgcg

SEQ ID NO: 2026688 - RNA, 16 nt, Shigella flexneri 2a str. 301
caucugcgccgccaau

SEQ ID NO: 2026689 - RNA, 23 nt, Shigella flexneri 2a str. 301
ccaaaucgcccagcaaauacgua

SEQ ID NO: 2026690 - RNA, 19 nt, Shigella flexneri 2a str. 301
ccaaauccuuccagcucca

SEQ ID NO: 2026691 - RNA, 17 nt, Shigella flexneri 2a str. 301
ccaaauccggcaaauaa

SEQ ID NO: 2026692 - RNA, 18 nt, Shigella flexneri 2a str. 301
ccaaaucgcugcugcuca

SEQ ID NO: 2026693 - RNA, 17 nt, Shigella flexneri 2a str. 301
ccaacaaaagcaacaaa

SEQ ID NO: 2026694 - RNA, 20 nt, Shigella flexneri 2a str. 301
ccaaauuuggugcucaguuu

SEQ ID NO: 2026695 - RNA, 14 nt, Shigella flexneri 2a str. 301
ccaacaacagcgcg

SEQ ID NO: 2026696 - RNA, 22 nt, Shigella flexneri 2a str. 301
ccaacaacacauucaauaacac

SEQ ID NO: 2026697 - RNA, 16 nt, Shigella flexneri 2a str. 301
ccaacaaucucuucca

SEQ ID NO: 2026698 - RNA, 17 nt, Shigella flexneri 2a str. 301
ccaacaaugcaaaauag

SEQ ID NO: 2026699 - RNA, 16 nt, Shigella flexneri 2a str. 301
ccaacagcagccacac

SEQ ID NO: 2026700 - RNA, 13 nt, Shigella flexneri 2a str. 301
ccaacagguuuug

SEQ ID NO: 2026701 - RNA, 16 nt, Shigella flexneri 2a str. 301
ccaacaguaucugaau

SEQ ID NO: 2026702 - RNA, 12 nt, Shigella flexneri 2a str. 301
ccaacaggcgag

SEQ ID NO: 2026703 - RNA, 15 nt, Shigella flexneri 2a str. 301
ccaacagcgacauca

SEQ ID NO: 2026704 - RNA, 13 nt, Shigella flexneri 2a str. 301
ccaacauauaagu

SEQ ID NO: 2026705 - RNA, 20 nt, Shigella flexneri 2a str. 301
ccaaaucauccagaccgcuc

SEQ ID NO: 2026706 - RNA, 21 nt, Shigella flexneri 2a str. 301
ccaaaucauccagacugcuca

SEQ ID NO: 2026707 - RNA, 20 nt, Shigella flexneri 2a str. 301
ccaaauaucuuauagacuaa

SEQ ID NO: 2026708 - RNA, 21 nt, Shigella flexneri 2a str. 301
ccaaagugacacaaucaaauc

SEQ ID NO: 2026709 - RNA, 14 nt, Shigella flexneri 2a str. 301
cauuuucauccauu

SEQ ID NO: 2026710 - RNA, 19 nt, Shigella flexneri 2a str. 301
cauuuucauccauuaccag

SEQ ID NO: 2026711 - RNA, 17 nt, Shigella flexneri 2a str. 301
ccaacgauaauucagca

SEQ ID NO: 2026712 - RNA, 13 nt, Shigella flexneri 2a str. 301
ccaacgauaauuc

SEQ ID NO: 2026713 - RNA, 15 nt, Shigella flexneri 2a str. 301
ccaacgauaauucag

SEQ ID NO: 2026714 - RNA, 16 nt, Shigella flexneri 2a str. 301
ccaaccuuguuucuga

SEQ ID NO: 2026715 - RNA, 20 nt, Shigella flexneri 2a str. 301
ccaacaucgaaaacgccacc

SEQ ID NO: 2026716 - RNA, 15 nt, Shigella flexneri 2a str. 301
ccaacgcagcaacau

SEQ ID NO: 2026717 - RNA, 14 nt, Shigella flexneri 2a str. 301
ccaacgcgccaccg

SEQ ID NO: 2026718 - RNA, 15 nt, Shigella flexneri 2a str. 301
ccaacggccuugcgg

SEQ ID NO: 2026719 - RNA, 20 nt, Shigella flexneri 2a str. 301
ccaacggcgaaagcuggcac

SEQ ID NO: 2026720 - RNA, 13 nt, Shigella flexneri 2a str. 301
ccaacggcgagcc

SEQ ID NO: 2026721 - RNA, 18 nt, Shigella flexneri 2a str. 301
ccaacggcauuucuuacu

SEQ ID NO: 2026722 - RNA, 18 nt, Shigella flexneri 2a str. 301
ccaacggugaaaaaccaa

SEQ ID NO: 2026723 - RNA, 15 nt, Shigella flexneri 2a str. 301
ccaacguaacaaaac

SEQ ID NO: 2026724 - RNA, 15 nt, Shigella flexneri 2a str. 301
ccaacugauccugac

SEQ ID NO: 2026725 - RNA, 20 nt, Shigella flexneri 2a str. 301
ccaagauuaaaggcaccaau

SEQ ID NO: 2026726 - RNA, 18 nt, Shigella flexneri 2a str. 301
ccaacugugccgccgcca

SEQ ID NO: 2026727 - RNA, 14 nt, Shigella flexneri 2a str. 301
ccaagauagaacca

SEQ ID NO: 2026728 - RNA, 15 nt, Shigella flexneri 2a str. 301
ccaacuucagcaaca

SEQ ID NO: 2026729 - RNA, 22 nt, Shigella flexneri 2a str. 301
ccaacuucagcaacaaaauggc

SEQ ID NO: 2026730 - RNA, 18 nt, Shigella flexneri 2a str. 301
ccaacuguugauccagga

SEQ ID NO: 2026731 - RNA, 19 nt, Shigella flexneri 2a str. 301
ccaaguucgaacgccgcca

SEQ ID NO: 2026732 - RNA, 14 nt, Shigella flexneri 2a str. 301
ccaagugauuuuua

SEQ ID NO: 2026733 - RNA, 22 nt, Shigella flexneri 2a str. 301
ccaaggcgaggggaccgccccu

SEQ ID NO: 2026734 - RNA, 19 nt, Shigella flexneri 2a str. 301
ccaagucaacgucauuauc

SEQ ID NO: 2026735 - RNA, 21 nt, Shigella flexneri 2a str. 301
ccaauauaauuccauucacca

SEQ ID NO: 2026736 - RNA, 14 nt, Shigella flexneri 2a str. 301
ccaauaucaaauaa

SEQ ID NO: 2026737 - RNA, 16 nt, Shigella flexneri 2a str. 301
ccaauaccgcccacca

SEQ ID NO: 2026738 - RNA, 14 nt, Shigella flexneri 2a str. 301
ccaauaccaaaauc

SEQ ID NO: 2026739 - RNA, 22 nt, Shigella flexneri 2a str. 301
ccaaucacacaaccaugcagga

SEQ ID NO: 2026740 - RNA, 20 nt, Shigella flexneri 2a str. 301
ccaaucacaagaccgcuucc

SEQ ID NO: 2026741 - RNA, 17 nt, Shigella flexneri 2a str. 301
ccaaucagcaauaaacg

SEQ ID NO: 2026742 - RNA, 16 nt, Shigella flexneri 2a str. 301
ccaaucagguaagcaa

SEQ ID NO: 2026743 - RNA, 16 nt, Shigella flexneri 2a str. 301
ccaaucagcaauaaac

SEQ ID NO: 2026744 - RNA, 19 nt, Shigella flexneri 2a str. 301
ccaaucaccgccagcaagg

SEQ ID NO: 2026745 - RNA, 14 nt, Shigella flexneri 2a str. 301
ccaauauucagaaa

SEQ ID NO: 2026746 - RNA, 19 nt, Shigella flexneri 2a str. 301
ccaauauagacaaaguaac

SEQ ID NO: 2026747 - RNA, 13 nt, Shigella flexneri 2a str. 301
ccaauauccugag

SEQ ID NO: 2026748 - RNA, 22 nt, Shigella flexneri 2a str. 301
ccaauccagaacaccauaauga

SEQ ID NO: 2026749 - RNA, 20 nt, Shigella flexneri 2a str. 301
ccaaucauucccauuuauuu

SEQ ID NO: 2026750 - RNA, 15 nt, Shigella flexneri 2a str. 301
ccaauccgccagcca

SEQ ID NO: 2026751 - RNA, 18 nt, Shigella flexneri 2a str. 301
ccaauugcacauauuuuu

SEQ ID NO: 2026752 - RNA, 10 nt, Shigella flexneri 2a str. 301
ccaauugccu

SEQ ID NO: 2026753 - RNA, 23 nt, Shigella flexneri 2a str. 301
ccacaauugaccaguaauauccc

SEQ ID NO: 2026754 - RNA, 23 nt, Shigella flexneri 2a str. 301
ccaauuucugugcagccaaaaau

SEQ ID NO: 2026755 - RNA, 17 nt, Shigella flexneri 2a str. 301
ccaauguggguagccaa

SEQ ID NO: 2026756 - RNA, 22 nt, Shigella flexneri 2a str. 301
ccaaucuuauaggucacaucau

SEQ ID NO: 2026757 - RNA, 15 nt, Shigella flexneri 2a str. 301
ccaaucucccagccg

SEQ ID NO: 2026758 - RNA, 19 nt, Shigella flexneri 2a str. 301
ccaaucucaccaaucgaaa

SEQ ID NO: 2026759 - RNA, 18 nt, Shigella flexneri 2a str. 301
ccaaucuucacaucauca

SEQ ID NO: 2026760 - RNA, 15 nt, Shigella flexneri 2a str. 301
ccacacccacaucaa

SEQ ID NO: 2026761 - RNA, 17 nt, Shigella flexneri 2a str. 301
ccacagacaaucgccag

SEQ ID NO: 2026762 - RNA, 22 nt, Shigella flexneri 2a str. 301
ccacagacauaaagccugcuuc

SEQ ID NO: 2026763 - RNA, 17 nt, Shigella flexneri 2a str. 301
ccacagaccggacugac

SEQ ID NO: 2026764 - RNA, 14 nt, Shigella flexneri 2a str. 301
ccacagcaaaacac

SEQ ID NO: 2026765 - RNA, 16 nt, Shigella flexneri 2a str. 301
ccacaccaaucaacaa

SEQ ID NO: 2026766 - RNA, 23 nt, Shigella flexneri 2a str. 301
ccacaccaaucaacaauugcggg

SEQ ID NO: 2026767 - RNA, 18 nt, Shigella flexneri 2a str. 301
ccacagcagccuucgcca

SEQ ID NO: 2026768 - RNA, 14 nt, Shigella flexneri 2a str. 301
ccacagccaacaca

SEQ ID NO: 2026769 - RNA, 22 nt, Shigella flexneri 2a str. 301
ccacagcauucucggcccggcc

SEQ ID NO: 2026770 - RNA, 13 nt, Shigella flexneri 2a str. 301
ccacagccagcca

SEQ ID NO: 2026771 - RNA, 22 nt, Shigella flexneri 2a str. 301
ccacagccccgaaaaagagcca

SEQ ID NO: 2026772 - RNA, 15 nt, Shigella flexneri 2a str. 301
ccacagcucugcugu

SEQ ID NO: 2026773 - RNA, 13 nt, Shigella flexneri 2a str. 301
ccacagcucugcu

SEQ ID NO: 2026774 - RNA, 12 nt, Shigella flexneri 2a str. 301
ccaccuccagcu

SEQ ID NO: 2026775 - RNA, 22 nt, Shigella flexneri 2a str. 301
ccaccucccgucgcccacacca

SEQ ID NO: 2026776 - RNA, 14 nt, Shigella flexneri 2a str. 301
ccaccuccacgccc

SEQ ID NO: 2026777 - RNA, 18 nt, Shigella flexneri 2a str. 301
ccaccucauuaagaugca

SEQ ID NO: 2026778 - RNA, 12 nt, Shigella flexneri 2a str. 301
ccaccgcccguu

SEQ ID NO: 2026779 - RNA, 23 nt, Shigella flexneri 2a str. 301
ccacgaccucaaaggccgacagc

SEQ ID NO: 2026780 - RNA, 16 nt, Shigella flexneri 2a str. 301
ccaccugauugcugcu

SEQ ID NO: 2026781 - RNA, 15 nt, Shigella flexneri 2a str. 301
ccacgcaacagacca

SEQ ID NO: 2026782 - RNA, 12 nt, Shigella flexneri 2a str. 301
ccacgcaauaaa

SEQ ID NO: 2026783 - RNA, 19 nt, Shigella flexneri 2a str. 301
ccacgauauguucaggaua

SEQ ID NO: 2026784 - RNA, 22 nt, Shigella flexneri 2a str. 301
ccacccuggcaacccgggcucc

SEQ ID NO: 2026785 - RNA, 15 nt, Shigella flexneri 2a str. 301
ccacccugacgacca

SEQ ID NO: 2026786 - RNA, 14 nt, Shigella flexneri 2a str. 301
ccacccgucgggca

SEQ ID NO: 2026787 - RNA, 18 nt, Shigella flexneri 2a str. 301
ccaccauuuugcuguuca

SEQ ID NO: 2026788 - RNA, 18 nt, Shigella flexneri 2a str. 301
ccaccauguucacugccg

SEQ ID NO: 2026789 - RNA, 12 nt, Shigella flexneri 2a str. 301
ccaccagugcca

SEQ ID NO: 2026790 - RNA, 17 nt, Shigella flexneri 2a str. 301
ccaccaguccuucuacc

SEQ ID NO: 2026791 - RNA, 13 nt, Shigella flexneri 2a str. 301
ccaccauaagccc

SEQ ID NO: 2026792 - RNA, 13 nt, Shigella flexneri 2a str. 301
ccaccacugcaau

SEQ ID NO: 2026793 - RNA, 17 nt, Shigella flexneri 2a str. 301
ccaccacguccagagug

SEQ ID NO: 2026794 - RNA, 12 nt, Shigella flexneri 2a str. 301
ccaccagcagcu

SEQ ID NO: 2026795 - RNA, 17 nt, Shigella flexneri 2a str. 301
ccaccagaaucgccagc

SEQ ID NO: 2026796 - RNA, 23 nt, Shigella flexneri 2a str. 301
ccaccagacaaccgcucaacaaa

SEQ ID NO: 2026797 - RNA, 14 nt, Shigella flexneri 2a str. 301
ccaccagacgugau

SEQ ID NO: 2026798 - RNA, 13 nt, Shigella flexneri 2a str. 301
ccaccagauggcu

SEQ ID NO: 2026799 - RNA, 17 nt, Shigella flexneri 2a str. 301
ccacaggaccacguucc

SEQ ID NO: 2026800 - RNA, 16 nt, Shigella flexneri 2a str. 301
ccacaggccggagcca

SEQ ID NO: 2026801 - RNA, 13 nt, Shigella flexneri 2a str. 301
ccaccacgccaag

SEQ ID NO: 2026802 - RNA, 18 nt, Shigella flexneri 2a str. 301
ccacggcggugucgccag

SEQ ID NO: 2026803 - RNA, 14 nt, Shigella flexneri 2a str. 301
ccacggcuccagca

SEQ ID NO: 2026804 - RNA, 14 nt, Shigella flexneri 2a str. 301
ccacgggcaauaag

SEQ ID NO: 2026805 - RNA, 15 nt, Shigella flexneri 2a str. 301
ccacgguauuaggca

SEQ ID NO: 2026806 - RNA, 22 nt, Shigella flexneri 2a str. 301
ccacggugcagcugcgggagga

SEQ ID NO: 2026807 - RNA, 19 nt, Shigella flexneri 2a str. 301
ccacgguugguuuuaucca

SEQ ID NO: 2026808 - RNA, 21 nt, Shigella flexneri 2a str. 301
ccacgguucuccacucugcca

SEQ ID NO: 2026809 - RNA, 14 nt, Shigella flexneri 2a str. 301
ccacgucacucuuu

SEQ ID NO: 2026810 - RNA, 23 nt, Shigella flexneri 2a str. 301
ccacuacgugaucgucuucaacc

SEQ ID NO: 2026811 - RNA, 15 nt, Shigella flexneri 2a str. 301
ccacuacucugaccc

SEQ ID NO: 2026812 - RNA, 21 nt, Shigella flexneri 2a str. 301
ccacuacaucaagucauugau

SEQ ID NO: 2026813 - RNA, 14 nt, Shigella flexneri 2a str. 301
ccacucaccgccgu

SEQ ID NO: 2026814 - RNA, 13 nt, Shigella flexneri 2a str. 301
ccacguucauuuc

SEQ ID NO: 2026815 - RNA, 14 nt, Shigella flexneri 2a str. 301
ccacguuccccaga

SEQ ID NO: 2026816 - RNA, 16 nt, Shigella flexneri 2a str. 301
ccacguuccccagaug

SEQ ID NO: 2026817 - RNA, 14 nt, Shigella flexneri 2a str. 301
ccacguucugaucu

SEQ ID NO: 2026818 - RNA, 16 nt, Shigella flexneri 2a str. 301
ccacgcgauacuuuuu

SEQ ID NO: 2026819 - RNA, 20 nt, Shigella flexneri 2a str. 301
ccacgcgggagagccccugc

SEQ ID NO: 2026820 - RNA, 18 nt, Shigella flexneri 2a str. 301
ccacgccugccgccagca

SEQ ID NO: 2026821 - RNA, 21 nt, Shigella flexneri 2a str. 301
ccacgccuuaugccacgugag

SEQ ID NO: 2026822 - RNA, 12 nt, Shigella flexneri 2a str. 301
ccacgcucagca

SEQ ID NO: 2026823 - RNA, 15 nt, Shigella flexneri 2a str. 301
ccacgcuuuuuugcu

SEQ ID NO: 2026824 - RNA, 16 nt, Shigella flexneri 2a str. 301
ccacgcuuaacaaccc

SEQ ID NO: 2026825 - RNA, 15 nt, Shigella flexneri 2a str. 301
ccacggccacagcca

SEQ ID NO: 2026826 - RNA, 17 nt, Shigella flexneri 2a str. 301
ccacggcgcagcuucac

SEQ ID NO: 2026827 - RNA, 15 nt, Shigella flexneri 2a str. 301
ccacggcaugaaagc

SEQ ID NO: 2026828 - RNA, 15 nt, Shigella flexneri 2a str. 301
cauguccgcggccuu

SEQ ID NO: 2026829 - RNA, 22 nt, Shigella flexneri 2a str. 301
caugucgguuguacaaaaaaug

SEQ ID NO: 2026830 - RNA, 17 nt, Shigella flexneri 2a str. 301
caugucgguacagagca

SEQ ID NO: 2026831 - RNA, 20 nt, Shigella flexneri 2a str. 301
cauguacgcguucaaucaaa

SEQ ID NO: 2026832 - RNA, 17 nt, Shigella flexneri 2a str. 301
cauguaacgaugcauga

SEQ ID NO: 2026833 - RNA, 14 nt, Shigella flexneri 2a str. 301
cauguaacgaugca

SEQ ID NO: 2026834 - RNA, 13 nt, Shigella flexneri 2a str. 301
cauggugcacauu

SEQ ID NO: 2026835 - RNA, 17 nt, Shigella flexneri 2a str. 301
cauggugagccugcugu

SEQ ID NO: 2026836 - RNA, 21 nt, Shigella flexneri 2a str. 301
cauggcugacugucgcagcca

SEQ ID NO: 2026837 - RNA, 20 nt, Shigella flexneri 2a str. 301
caugguaacgccccacaaac

SEQ ID NO: 2026838 - RNA, 20 nt, Shigella flexneri 2a str. 301
caugguaaaaccgacuuaaa

SEQ ID NO: 2026839 - RNA, 15 nt, Shigella flexneri 2a str. 301
caugguaaaaccgac

SEQ ID NO: 2026840 - RNA, 22 nt, Shigella flexneri 2a str. 301
caugggucugcggaucauggua

SEQ ID NO: 2026841 - RNA, 16 nt, Shigella flexneri 2a str. 301
caugggugaacugcuu

SEQ ID NO: 2026842 - RNA, 20 nt, Shigella flexneri 2a str. 301
caugggucacucaggccaaa

SEQ ID NO: 2026843 - RNA, 20 nt, Shigella flexneri 2a str. 301
cauggguggcagauccaaua

SEQ ID NO: 2026844 - RNA, 13 nt, Shigella flexneri 2a str. 301
caugcuuagcaca

SEQ ID NO: 2026845 - RNA, 16 nt, Shigella flexneri 2a str. 301
caugcuggaaccacag

SEQ ID NO: 2026846 - RNA, 18 nt, Shigella flexneri 2a str. 301
cauggaagcagaucugga

SEQ ID NO: 2026847 - RNA, 14 nt, Shigella flexneri 2a str. 301
cauggaaaccauca

SEQ ID NO: 2026848 - RNA, 22 nt, Shigella flexneri 2a str. 301
cauggagaacgccuguguccug

SEQ ID NO: 2026849 - RNA, 17 nt, Shigella flexneri 2a str. 301
cauggacgaaaucuacg

SEQ ID NO: 2026850 - RNA, 22 nt, Shigella flexneri 2a str. 301
cauggcaacuaacugacuuccg

SEQ ID NO: 2026851 - RNA, 14 nt, Shigella flexneri 2a str. 301
cauggcagaagcau

SEQ ID NO: 2026852 - RNA, 16 nt, Shigella flexneri 2a str. 301
cauggcagauaaacaa

SEQ ID NO: 2026853 - RNA, 19 nt, Shigella flexneri 2a str. 301
cauggcagauaaacaaccc

SEQ ID NO: 2026854 - RNA, 15 nt, Shigella flexneri 2a str. 301
caucuuccaguugca

SEQ ID NO: 2026855 - RNA, 18 nt, Shigella flexneri 2a str. 301
caucuuccagcaucagca

SEQ ID NO: 2026856 - RNA, 13 nt, Shigella flexneri 2a str. 301
caucuuccaccac

SEQ ID NO: 2026857 - RNA, 18 nt, Shigella flexneri 2a str. 301
caucuuccaccuggaacc

SEQ ID NO: 2026858 - RNA, 20 nt, Shigella flexneri 2a str. 301
caucuuccaguugcacgcca

SEQ ID NO: 2026859 - RNA, 17 nt, Shigella flexneri 2a str. 301
caucuucccagguuuca

SEQ ID NO: 2026860 - RNA, 14 nt, Shigella flexneri 2a str. 301
caucuucaucaucc

SEQ ID NO: 2026861 - RNA, 14 nt, Shigella flexneri 2a str. 301
cauuaccugacagc

SEQ ID NO: 2026862 - RNA, 16 nt, Shigella flexneri 2a str. 301
cauuaccugaaaaaac

SEQ ID NO: 2026863 - RNA, 23 nt, Shigella flexneri 2a str. 301
cauuacgcucacugcaaaacagg

SEQ ID NO: 2026864 - RNA, 15 nt, Shigella flexneri 2a str. 301
cauuaccgaacaaca

SEQ ID NO: 2026865 - RNA, 15 nt, Shigella flexneri 2a str. 301
cauuagauaaaaaug

SEQ ID NO: 2026866 - RNA, 17 nt, Shigella flexneri 2a str. 301
cauuagccauugagaua

SEQ ID NO: 2026867 - RNA, 19 nt, Shigella flexneri 2a str. 301
cauuacuguauacgggcuu

SEQ ID NO: 2026868 - RNA, 17 nt, Shigella flexneri 2a str. 301
cauuaaggcaagaaaau

SEQ ID NO: 2026869 - RNA, 19 nt, Shigella flexneri 2a str. 301
cauuaagggugaucagccc

SEQ ID NO: 2026870 - RNA, 16 nt, Shigella flexneri 2a str. 301
cauguuaaauuccggc

SEQ ID NO: 2026871 - RNA, 18 nt, Shigella flexneri 2a str. 301
cauguuaaauuccggcuc

SEQ ID NO: 2026872 - RNA, 17 nt, Shigella flexneri 2a str. 301
caugugcgacgggccaa

SEQ ID NO: 2026873 - RNA, 19 nt, Shigella flexneri 2a str. 301
caugugggcugccccagcc

SEQ ID NO: 2026874 - RNA, 17 nt, Shigella flexneri 2a str. 301
cauucaagauugcagga

SEQ ID NO: 2026875 - RNA, 19 nt, Shigella flexneri 2a str. 301
cauuauugcgcacaucaau

SEQ ID NO: 2026876 - RNA, 22 nt, Shigella flexneri 2a str. 301
cauuauugucgguggcgggcaa

SEQ ID NO: 2026877 - RNA, 14 nt, Shigella flexneri 2a str. 301
cauuagugauuaac

SEQ ID NO: 2026878 - RNA, 15 nt, Shigella flexneri 2a str. 301
cauuaggccauuuga

SEQ ID NO: 2026879 - RNA, 20 nt, Shigella flexneri 2a str. 301
cauucagugcaaaugccaga

SEQ ID NO: 2026880 - RNA, 15 nt, Shigella flexneri 2a str. 301
cauucauacccugaa

SEQ ID NO: 2026881 - RNA, 19 nt, Shigella flexneri 2a str. 301
cauucauacccugaaucaa

SEQ ID NO: 2026882 - RNA, 21 nt, Shigella flexneri 2a str. 301
cauucauacccugaaucaauc

SEQ ID NO: 2026883 - RNA, 18 nt, Shigella flexneri 2a str. 301
cauucagugcaaaugcca

SEQ ID NO: 2026884 - RNA, 20 nt, Shigella flexneri 2a str. 301
cauuccgggaaacgaaccau

SEQ ID NO: 2026885 - RNA, 19 nt, Shigella flexneri 2a str. 301
cauuccggaguuuaugagg

SEQ ID NO: 2026886 - RNA, 20 nt, Shigella flexneri 2a str. 301
cauucgccgguuccagcuuc

SEQ ID NO: 2026887 - RNA, 19 nt, Shigella flexneri 2a str. 301
cauucgccgguuccagcuu

SEQ ID NO: 2026888 - RNA, 20 nt, Shigella flexneri 2a str. 301
cauucgccgcuuaccauaac

SEQ ID NO: 2026889 - RNA, 21 nt, Shigella flexneri 2a str. 301
cauucgcaguugcaguaccag

SEQ ID NO: 2026890 - RNA, 19 nt, Shigella flexneri 2a str. 301
cauuccguuugcuguaucg

SEQ ID NO: 2026891 - RNA, 20 nt, Shigella flexneri 2a str. 301
cauugcucacuuccuuuuuu

SEQ ID NO: 2026892 - RNA, 15 nt, Shigella flexneri 2a str. 301
cauugcucacuuccu

SEQ ID NO: 2026893 - RNA, 20 nt, Shigella flexneri 2a str. 301
cauugcugccgccaguucuu

SEQ ID NO: 2026894 - RNA, 14 nt, Shigella flexneri 2a str. 301
cauugcuuugguaa

SEQ ID NO: 2026895 - RNA, 20 nt, Shigella flexneri 2a str. 301
cauugcuuuuuugauuacag

SEQ ID NO: 2026896 - RNA, 15 nt, Shigella flexneri 2a str. 301
cauugcgccugcagg

SEQ ID NO: 2026897 - RNA, 20 nt, Shigella flexneri 2a str. 301
cauugcgugauaucaccguu

SEQ ID NO: 2026898 - RNA, 23 nt, Shigella flexneri 2a str. 301
cauugccugaucgcgcaaacagu

SEQ ID NO: 2026899 - RNA, 20 nt, Shigella flexneri 2a str. 301
cauugccagagugaaaaugc

SEQ ID NO: 2026900 - RNA, 15 nt, Shigella flexneri 2a str. 301
cauugcaagauuuuu

SEQ ID NO: 2026901 - RNA, 23 nt, Shigella flexneri 2a str. 301
cauugcagucauaaccaguccau

SEQ ID NO: 2026902 - RNA, 20 nt, Shigella flexneri 2a str. 301
cauugcaucgaggaaaacca

SEQ ID NO: 2026903 - RNA, 17 nt, Shigella flexneri 2a str. 301
cauucgguuuucaaucg

SEQ ID NO: 2026904 - RNA, 13 nt, Shigella flexneri 2a str. 301
cauucggugcuca

SEQ ID NO: 2026905 - RNA, 15 nt, Shigella flexneri 2a str. 301
cauucgucuccuggc

SEQ ID NO: 2026906 - RNA, 17 nt, Shigella flexneri 2a str. 301
cauucgucuccuggccg

SEQ ID NO: 2026907 - RNA, 18 nt, Shigella flexneri 2a str. 301
cauugauguuuucagacc

SEQ ID NO: 2026908 - RNA, 20 nt, Shigella flexneri 2a str. 301
cauugauguuuucagaccag

SEQ ID NO: 2026909 - RNA, 22 nt, Shigella flexneri 2a str. 301
cauucgcuguguaaacccagcc

SEQ ID NO: 2026910 - RNA, 20 nt, Shigella flexneri 2a str. 301
cauucggauugcuauuuaac

SEQ ID NO: 2026911 - RNA, 19 nt, Shigella flexneri 2a str. 301
cauucggcgcagguuuaau

SEQ ID NO: 2026912 - RNA, 16 nt, Shigella flexneri 2a str. 301
cauucgcgguuuuaca

SEQ ID NO: 2026913 - RNA, 23 nt, Shigella flexneri 2a str. 301
cauugugaccuuugacucagcgu

SEQ ID NO: 2026914 - RNA, 14 nt, Shigella flexneri 2a str. 301
cauugugugaaauc

SEQ ID NO: 2026915 - RNA, 17 nt, Shigella flexneri 2a str. 301
cauugugugaaaucagc

SEQ ID NO: 2026916 - RNA, 13 nt, Shigella flexneri 2a str. 301
cauuguuugcaaa

SEQ ID NO: 2026917 - RNA, 20 nt, Shigella flexneri 2a str. 301
cauuguuugcaaaaucaaau

SEQ ID NO: 2026918 - RNA, 15 nt, Shigella flexneri 2a str. 301
cauuuaaaucaauaa

SEQ ID NO: 2026919 - RNA, 21 nt, Shigella flexneri 2a str. 301
cauugguugcuggaaagagaa

SEQ ID NO: 2026920 - RNA, 19 nt, Shigella flexneri 2a str. 301
cauuguccaguugcccggu

SEQ ID NO: 2026921 - RNA, 22 nt, Shigella flexneri 2a str. 301
cauuggccggaauaccacuuuc

SEQ ID NO: 2026922 - RNA, 14 nt, Shigella flexneri 2a str. 301
cauuggcaggcucu

SEQ ID NO: 2026923 - RNA, 16 nt, Shigella flexneri 2a str. 301
cauuggcauaaauaau

SEQ ID NO: 2026924 - RNA, 21 nt, Shigella flexneri 2a str. 301
cauuggcauaaauaauaagag

SEQ ID NO: 2026925 - RNA, 17 nt, Shigella flexneri 2a str. 301
cauuggagacugaugac

SEQ ID NO: 2026926 - RNA, 23 nt, Shigella flexneri 2a str. 301
cauuggggauuaucugaaucagc

SEQ ID NO: 2026927 - RNA, 14 nt, Shigella flexneri 2a str. 301
cauuucuggcguca

SEQ ID NO: 2026928 - RNA, 19 nt, Shigella flexneri 2a str. 301
cauuucuggcgucaaagcu

SEQ ID NO: 2026929 - RNA, 14 nt, Shigella flexneri 2a str. 301
cauuugaaacguua

SEQ ID NO: 2026930 - RNA, 16 nt, Shigella flexneri 2a str. 301
cauuugcacaagaugc

SEQ ID NO: 2026931 - RNA, 18 nt, Shigella flexneri 2a str. 301
cauuugcauacccagaac

SEQ ID NO: 2026932 - RNA, 21 nt, Shigella flexneri 2a str. 301
cauuugccgggguugugagca

SEQ ID NO: 2026933 - RNA, 20 nt, Shigella flexneri 2a str. 301
cauuugagcaggaugccuga

SEQ ID NO: 2026934 - RNA, 19 nt, Shigella flexneri 2a str. 301
cauuugacacgaacuuuau

SEQ ID NO: 2026935 - RNA, 16 nt, Shigella flexneri 2a str. 301
cauuugcuccagacgc

SEQ ID NO: 2026936 - RNA, 16 nt, Shigella flexneri 2a str. 301
cauuugugcauagcac

SEQ ID NO: 2026937 - RNA, 13 nt, Shigella flexneri 2a str. 301
cauuuguucuuuu

SEQ ID NO: 2026938 - RNA, 16 nt, Shigella flexneri 2a str. 301
cauuugugacauuaac

SEQ ID NO: 2026939 - RNA, 21 nt, Shigella flexneri 2a str. 301
cauuucagaaaguauauaaaa

SEQ ID NO: 2026940 - RNA, 22 nt, Shigella flexneri 2a str. 301
cauuucagaaaguauauaaaaa

SEQ ID NO: 2026941 - RNA, 20 nt, Shigella flexneri 2a str. 301
cauuucagaaaguauauaaa

SEQ ID NO: 2026942 - RNA, 16 nt, Shigella flexneri 2a str. 301
cauuucacucacgccg

SEQ ID NO: 2026943 - RNA, 20 nt, Shigella flexneri 2a str. 301
cauuuauuuuuccuccauug

SEQ ID NO: 2026944 - RNA, 14 nt, Shigella flexneri 2a str. 301
cauuuauuucucac

SEQ ID NO: 2026945 - RNA, 22 nt, Shigella flexneri 2a str. 301
cauuuagcgccggguuuuuuau

SEQ ID NO: 2026946 - RNA, 20 nt, Shigella flexneri 2a str. 301
cauuuagcgccggguuuuuu

SEQ ID NO: 2026947 - RNA, 23 nt, Shigella flexneri 2a str. 301
cauuuauguucagccgucaucca

SEQ ID NO: 2026948 - RNA, 12 nt, Shigella flexneri 2a str. 301
cauuuaugcugu

SEQ ID NO: 2026949 - RNA, 22 nt, Shigella flexneri 2a str. 301
cauuuaugcuguccuaaaaaau

SEQ ID NO: 2026950 - RNA, 23 nt, Shigella flexneri 2a str. 301
cauuuaugcuguccuaaaaaauu

SEQ ID NO: 2026951 - RNA, 15 nt, Shigella flexneri 2a str. 301
cauuucagggaugaa

SEQ ID NO: 2026952 - RNA, 15 nt, Shigella flexneri 2a str. 301
cauuuccauaaauug

SEQ ID NO: 2026953 - RNA, 12 nt, Shigella flexneri 2a str. 301
cauuuccauaaa

SEQ ID NO: 2026954 - RNA, 16 nt, Shigella flexneri 2a str. 301
cauuucccccuuccug

SEQ ID NO: 2026955 - RNA, 19 nt, Shigella flexneri 2a str. 301
cauuucccagcaagaacca

SEQ ID NO: 2026956 - RNA, 15 nt, Shigella flexneri 2a str. 301
cauuucccagcaaga

SEQ ID NO: 2026957 - RNA, 16 nt, Shigella flexneri 2a str. 301
cauuucccggaauaau

SEQ ID NO: 2026958 - RNA, 17 nt, Shigella flexneri 2a str. 301
cauuucccccuuccugc

SEQ ID NO: 2026959 - RNA, 14 nt, Shigella flexneri 2a str. 301
cauuucgaagaaac

SEQ ID NO: 2026960 - RNA, 17 nt, Shigella flexneri 2a str. 301
cauuuccgcugauucaa

SEQ ID NO: 2026961 - RNA, 22 nt, Shigella flexneri 2a str. 301
ccagcuugaaggguuuuauaau

SEQ ID NO: 2026962 - RNA, 11 nt, Shigella flexneri 2a str. 301
ccagcuugaag

SEQ ID NO: 2026963 - RNA, 15 nt, Shigella flexneri 2a str. 301
ccagcuucagauuca

SEQ ID NO: 2026964 - RNA, 23 nt, Shigella flexneri 2a str. 301
ccagcuuucgcuuaacgcccaug

SEQ ID NO: 2026965 - RNA, 19 nt, Shigella flexneri 2a str. 301
ccagcuuugcgccucgcca

SEQ ID NO: 2026966 - RNA, 23 nt, Shigella flexneri 2a str. 301
ccaggaagggcauaucagcaacu

SEQ ID NO: 2026967 - RNA, 23 nt, Shigella flexneri 2a str. 301
ccaggaaccugugacagcagcgg

SEQ ID NO: 2026968 - RNA, 16 nt, Shigella flexneri 2a str. 301
ccaggaaccugugaca

SEQ ID NO: 2026969 - RNA, 22 nt, Shigella flexneri 2a str. 301
ccaggaaccugugacagcagcg

SEQ ID NO: 2026970 - RNA, 13 nt, Shigella flexneri 2a str. 301
ccaggaaacccaa

SEQ ID NO: 2026971 - RNA, 13 nt, Shigella flexneri 2a str. 301
ccaggaacagaag

SEQ ID NO: 2026972 - RNA, 18 nt, Shigella flexneri 2a str. 301
ccagcucuucuucacucu

SEQ ID NO: 2026973 - RNA, 19 nt, Shigella flexneri 2a str. 301
ccagcucuucuucacucuc

SEQ ID NO: 2026974 - RNA, 23 nt, Shigella flexneri 2a str. 301
ccagcucuucuucacucucacca

SEQ ID NO: 2026975 - RNA, 15 nt, Shigella flexneri 2a str. 301
ccagcucuucuucac

SEQ ID NO: 2026976 - RNA, 22 nt, Shigella flexneri 2a str. 301
ccagcugacguagcaguucacc

SEQ ID NO: 2026977 - RNA, 21 nt, Shigella flexneri 2a str. 301
ccagcugcuguggauucagca

SEQ ID NO: 2026978 - RNA, 20 nt, Shigella flexneri 2a str. 301
ccagcugcucauagcggcug

SEQ ID NO: 2026979 - RNA, 12 nt, Shigella flexneri 2a str. 301
ccagcugucaaa

SEQ ID NO: 2026980 - RNA, 18 nt, Shigella flexneri 2a str. 301
ccagcuggcuaccgccgc

SEQ ID NO: 2026981 - RNA, 16 nt, Shigella flexneri 2a str. 301
ccagcuguccgauuug

SEQ ID NO: 2026982 - RNA, 22 nt, Shigella flexneri 2a str. 301
ccaggcaacgaaaggugaagug

SEQ ID NO: 2026983 - RNA, 19 nt, Shigella flexneri 2a str. 301
ccaggcagauuuuuuaacu

SEQ ID NO: 2026984 - RNA, 13 nt, Shigella flexneri 2a str. 301
ccaggcagaagcg

SEQ ID NO: 2026985 - RNA, 18 nt, Shigella flexneri 2a str. 301
ccaggccaaauccuucca

SEQ ID NO: 2026986 - RNA, 16 nt, Shigella flexneri 2a str. 301
ccaggccagcgcaacu

SEQ ID NO: 2026987 - RNA, 20 nt, Shigella flexneri 2a str. 301
ccaggccaaauccuuccagc

SEQ ID NO: 2026988 - RNA, 12 nt, Shigella flexneri 2a str. 301
ccaggccagcgc

SEQ ID NO: 2026989 - RNA, 17 nt, Shigella flexneri 2a str. 301
ccaggcauuaaauccug

SEQ ID NO: 2026990 - RNA, 17 nt, Shigella flexneri 2a str. 301
ccaggcaucguguugau

SEQ ID NO: 2026991 - RNA, 15 nt, Shigella flexneri 2a str. 301
ccaggacgauaaacc

SEQ ID NO: 2026992 - RNA, 16 nt, Shigella flexneri 2a str. 301
ccaggagcuccagguc

SEQ ID NO: 2026993 - RNA, 13 nt, Shigella flexneri 2a str. 301
ccaggagaugccc

SEQ ID NO: 2026994 - RNA, 21 nt, Shigella flexneri 2a str. 301
ccaggaucuuuugucaugacu

SEQ ID NO: 2026995 - RNA, 19 nt, Shigella flexneri 2a str. 301
ccaggcggauaauuucacu

SEQ ID NO: 2026996 - RNA, 16 nt, Shigella flexneri 2a str. 301
ccaggcgagaucggca

SEQ ID NO: 2026997 - RNA, 14 nt, Shigella flexneri 2a str. 301
ccagggccucuccu

SEQ ID NO: 2026998 - RNA, 19 nt, Shigella flexneri 2a str. 301
ccagggccuccugcagcgu

SEQ ID NO: 2026999 - RNA, 20 nt, Shigella flexneri 2a str. 301
ccaggucagagagccagccc

SEQ ID NO: 2027000 - RNA, 16 nt, Shigella flexneri 2a str. 301
ccaggcucgccgccgc

SEQ ID NO: 2027001 - RNA, 19 nt, Shigella flexneri 2a str. 301
ccaggcugcaaagucuggg

SEQ ID NO: 2027002 - RNA, 14 nt, Shigella flexneri 2a str. 301
ccaggcucgccgcc

SEQ ID NO: 2027003 - RNA, 21 nt, Shigella flexneri 2a str. 301
ccaggcugcgaacgguuuuca

SEQ ID NO: 2027004 - RNA, 16 nt, Shigella flexneri 2a str. 301
ccagcgcagacggcgc

SEQ ID NO: 2027005 - RNA, 20 nt, Shigella flexneri 2a str. 301
ccagcgcacaguuauaaaau

SEQ ID NO: 2027006 - RNA, 19 nt, Shigella flexneri 2a str. 301
ccagcgcaauuggcacgcc

SEQ ID NO: 2027007 - RNA, 18 nt, Shigella flexneri 2a str. 301
ccagcgccaccaccagca

SEQ ID NO: 2027008 - RNA, 18 nt, Shigella flexneri 2a str. 301
ccagcgcauggcggcagc

SEQ ID NO: 2027009 - RNA, 22 nt, Shigella flexneri 2a str. 301
ccagcgaugacuguacagaucc

SEQ ID NO: 2027010 - RNA, 13 nt, Shigella flexneri 2a str. 301
ccagcgacuccag

SEQ ID NO: 2027011 - RNA, 13 nt, Shigella flexneri 2a str. 301
ccagcgccuggcu

SEQ ID NO: 2027012 - RNA, 18 nt, Shigella flexneri 2a str. 301
ccagcgccgccagaauca

SEQ ID NO: 2027013 - RNA, 18 nt, Shigella flexneri 2a str. 301
ccagcgccgacagcagcc

SEQ ID NO: 2027014 - RNA, 20 nt, Shigella flexneri 2a str. 301
ccagcgccaucucuucggca

SEQ ID NO: 2027015 - RNA, 23 nt, Shigella flexneri 2a str. 301
ccacugacgggaaacucugcugg

SEQ ID NO: 2027016 - RNA, 14 nt, Shigella flexneri 2a str. 301
ccacugacuucucu

SEQ ID NO: 2027017 - RNA, 17 nt, Shigella flexneri 2a str. 301
ccacugcaacagcuguu

SEQ ID NO: 2027018 - RNA, 14 nt, Shigella flexneri 2a str. 301
ccacucugaccuga

SEQ ID NO: 2027019 - RNA, 23 nt, Shigella flexneri 2a str. 301
ccacugaauaacauuaugucugu

SEQ ID NO: 2027020 - RNA, 22 nt, Shigella flexneri 2a str. 301
ccacugaauagugccacaccag

SEQ ID NO: 2027021 - RNA, 21 nt, Shigella flexneri 2a str. 301
ccacucgccagaccgcagaag

SEQ ID NO: 2027022 - RNA, 21 nt, Shigella flexneri 2a str. 301
ccagccuucuucauccagcgc

SEQ ID NO: 2027023 - RNA, 20 nt, Shigella flexneri 2a str. 301
ccagccuguuccagacgcug

SEQ ID NO: 2027024 - RNA, 17 nt, Shigella flexneri 2a str. 301
ccagcgaccaagcgauu

SEQ ID NO: 2027025 - RNA, 16 nt, Shigella flexneri 2a str. 301
ccagccugcaaacgcu

SEQ ID NO: 2027026 - RNA, 23 nt, Shigella flexneri 2a str. 301
ccagcguuagauccccgcucucc

SEQ ID NO: 2027027 - RNA, 17 nt, Shigella flexneri 2a str. 301
ccagcguguugccgcuu

SEQ ID NO: 2027028 - RNA, 15 nt, Shigella flexneri 2a str. 301
ccagcguggcaugac

SEQ ID NO: 2027029 - RNA, 17 nt, Shigella flexneri 2a str. 301
ccagcguggucauggca

SEQ ID NO: 2027030 - RNA, 20 nt, Shigella flexneri 2a str. 301
ccagcgucuucugguuuuuc

SEQ ID NO: 2027031 - RNA, 13 nt, Shigella flexneri 2a str. 301
ccagcguggagag

SEQ ID NO: 2027032 - RNA, 18 nt, Shigella flexneri 2a str. 301
ccagcgucgcaucaggca

SEQ ID NO: 2027033 - RNA, 23 nt, Shigella flexneri 2a str. 301
ccagcgucaucauagacuucccu

SEQ ID NO: 2027034 - RNA, 18 nt, Shigella flexneri 2a str. 301
ccagcgucagcauaaaaa

SEQ ID NO: 2027035 - RNA, 15 nt, Shigella flexneri 2a str. 301
ccagcgucagccaga

SEQ ID NO: 2027036 - RNA, 16 nt, Shigella flexneri 2a str. 301
ccagcgucacccagac

SEQ ID NO: 2027037 - RNA, 17 nt, Shigella flexneri 2a str. 301
ccagcgucacccagaca

SEQ ID NO: 2027038 - RNA, 19 nt, Shigella flexneri 2a str. 301
ccagcgucacccagacaaa

SEQ ID NO: 2027039 - RNA, 20 nt, Shigella flexneri 2a str. 301
ccagcguacguaacuucuua

SEQ ID NO: 2027040 - RNA, 14 nt, Shigella flexneri 2a str. 301
ccagcguacccuga

SEQ ID NO: 2027041 - RNA, 16 nt, Shigella flexneri 2a str. 301
ccagcguagucggcag

SEQ ID NO: 2027042 - RNA, 12 nt, Shigella flexneri 2a str. 301
ccagcguaaauc

SEQ ID NO: 2027043 - RNA, 16 nt, Shigella flexneri 2a str. 301
ccagcgguucacucca

SEQ ID NO: 2027044 - RNA, 15 nt, Shigella flexneri 2a str. 301
ccagcuccggcaccu

SEQ ID NO: 2027045 - RNA, 16 nt, Shigella flexneri 2a str. 301
ccagcuccagcagacc

SEQ ID NO: 2027046 - RNA, 16 nt, Shigella flexneri 2a str. 301
ccagcuccauccacca

SEQ ID NO: 2027047 - RNA, 19 nt, Shigella flexneri 2a str. 301
ccagcuccccacgauugau

SEQ ID NO: 2027048 - RNA, 14 nt, Shigella flexneri 2a str. 301
ccagcucaaacgaa

SEQ ID NO: 2027049 - RNA, 12 nt, Shigella flexneri 2a str. 301
ccagcucaaacg

SEQ ID NO: 2027050 - RNA, 22 nt, Shigella flexneri 2a str. 301
ccagcguugauguuccuccucg

SEQ ID NO: 2027051 - RNA, 14 nt, Shigella flexneri 2a str. 301
ccagcguugagccc

SEQ ID NO: 2027052 - RNA, 17 nt, Shigella flexneri 2a str. 301
ccagcguuaucccaucc

SEQ ID NO: 2027053 - RNA, 18 nt, Shigella flexneri 2a str. 301
ccagcgcguaaauaccuu

SEQ ID NO: 2027054 - RNA, 22 nt, Shigella flexneri 2a str. 301
ccagcgcgccuucauucaggcc

SEQ ID NO: 2027055 - RNA, 14 nt, Shigella flexneri 2a str. 301
ccagcgcguucugu

SEQ ID NO: 2027056 - RNA, 22 nt, Shigella flexneri 2a str. 301
ccagcggaauucccgcuucuuc

SEQ ID NO: 2027057 - RNA, 14 nt, Shigella flexneri 2a str. 301
ccagcggagaaacu

SEQ ID NO: 2027058 - RNA, 21 nt, Shigella flexneri 2a str. 301
ccagcggagaaacuucugccg

SEQ ID NO: 2027059 - RNA, 13 nt, Shigella flexneri 2a str. 301
ccagcggcagcuc

SEQ ID NO: 2027060 - RNA, 16 nt, Shigella flexneri 2a str. 301
ccagcggcggcacagc

SEQ ID NO: 2027061 - RNA, 23 nt, Shigella flexneri 2a str. 301
ccagcgguggugacugguuuuuc

SEQ ID NO: 2027062 - RNA, 19 nt, Shigella flexneri 2a str. 301
ccagcgguaaagcggcgcu

SEQ ID NO: 2027063 - RNA, 21 nt, Shigella flexneri 2a str. 301
ccagcgggcgucaaaaucauc

SEQ ID NO: 2027064 - RNA, 15 nt, Shigella flexneri 2a str. 301
ccaucacaaaguggg

SEQ ID NO: 2027065 - RNA, 22 nt, Shigella flexneri 2a str. 301
ccaucacaauggcacaaauggc

SEQ ID NO: 2027066 - RNA, 13 nt, Shigella flexneri 2a str. 301
ccaucaaugccgc

SEQ ID NO: 2027067 - RNA, 22 nt, Shigella flexneri 2a str. 301
ccaucaccaacgauuuuuuccg

SEQ ID NO: 2027068 - RNA, 20 nt, Shigella flexneri 2a str. 301
ccaucaaucacuuugcgcuc

SEQ ID NO: 2027069 - RNA, 14 nt, Shigella flexneri 2a str. 301
ccaucaacuucucg

SEQ ID NO: 2027070 - RNA, 12 nt, Shigella flexneri 2a str. 301
ccaucaaccacu

SEQ ID NO: 2027071 - RNA, 15 nt, Shigella flexneri 2a str. 301
ccaucaaaucacuaa

SEQ ID NO: 2027072 - RNA, 20 nt, Shigella flexneri 2a str. 301
ccauaucuaugguuuuuucu

SEQ ID NO: 2027073 - RNA, 20 nt, Shigella flexneri 2a str. 301
ccauauagccccauaaacua

SEQ ID NO: 2027074 - RNA, 13 nt, Shigella flexneri 2a str. 301
ccauaucaagcau

SEQ ID NO: 2027075 - RNA, 21 nt, Shigella flexneri 2a str. 301
ccauaagcccagaacaaauaa

SEQ ID NO: 2027076 - RNA, 23 nt, Shigella flexneri 2a str. 301
ccauaagcccagaacaaauaaau

SEQ ID NO: 2027077 - RNA, 19 nt, Shigella flexneri 2a str. 301
ccauaacgccugcuccagu

SEQ ID NO: 2027078 - RNA, 19 nt, Shigella flexneri 2a str. 301
ccauaacggaggcuucuuu

SEQ ID NO: 2027079 - RNA, 21 nt, Shigella flexneri 2a str. 301
ccauaaucacucuuccccgcu

SEQ ID NO: 2027080 - RNA, 14 nt, Shigella flexneri 2a str. 301
ccauaauaaucauc

SEQ ID NO: 2027081 - RNA, 20 nt, Shigella flexneri 2a str. 301
ccauagcaucccaauacccg

SEQ ID NO: 2027082 - RNA, 18 nt, Shigella flexneri 2a str. 301
ccauaguuaucggugugu

SEQ ID NO: 2027083 - RNA, 17 nt, Shigella flexneri 2a str. 301
ccauagcaucccaauac

SEQ ID NO: 2027084 - RNA, 16 nt, Shigella flexneri 2a str. 301
ccaguuuacugucugc

SEQ ID NO: 2027085 - RNA, 12 nt, Shigella flexneri 2a str. 301
ccaguuucacag

SEQ ID NO: 2027086 - RNA, 14 nt, Shigella flexneri 2a str. 301
ccaguugaccugcg

SEQ ID NO: 2027087 - RNA, 13 nt, Shigella flexneri 2a str. 301
ccaguucuucuuc

SEQ ID NO: 2027088 - RNA, 13 nt, Shigella flexneri 2a str. 301
ccaguuguugcug

SEQ ID NO: 2027089 - RNA, 15 nt, Shigella flexneri 2a str. 301
ccaguucguuguagu

SEQ ID NO: 2027090 - RNA, 12 nt, Shigella flexneri 2a str. 301
ccaguucgauuu

SEQ ID NO: 2027091 - RNA, 20 nt, Shigella flexneri 2a str. 301
ccaguucgauuucccagcga

SEQ ID NO: 2027092 - RNA, 22 nt, Shigella flexneri 2a str. 301
ccauaaauugcuguaaauucuc

SEQ ID NO: 2027093 - RNA, 18 nt, Shigella flexneri 2a str. 301
ccauaaauccaacaacac

SEQ ID NO: 2027094 - RNA, 22 nt, Shigella flexneri 2a str. 301
ccaguuuguucagcugcgugcc

SEQ ID NO: 2027095 - RNA, 22 nt, Shigella flexneri 2a str. 301
ccauaaagacguuaacuacaau

SEQ ID NO: 2027096 - RNA, 12 nt, Shigella flexneri 2a str. 301
ccagugcuccac

SEQ ID NO: 2027097 - RNA, 15 nt, Shigella flexneri 2a str. 301
ccaguggcagcaauu

SEQ ID NO: 2027098 - RNA, 15 nt, Shigella flexneri 2a str. 301
ccaguuccggacugc

SEQ ID NO: 2027099 - RNA, 18 nt, Shigella flexneri 2a str. 301
ccaguuccggacugcuca

SEQ ID NO: 2027100 - RNA, 16 nt, Shigella flexneri 2a str. 301
ccauccuucuguggac

SEQ ID NO: 2027101 - RNA, 17 nt, Shigella flexneri 2a str. 301
ccauccgaauucacuua

SEQ ID NO: 2027102 - RNA, 13 nt, Shigella flexneri 2a str. 301
ccaucccuucacc

SEQ ID NO: 2027103 - RNA, 16 nt, Shigella flexneri 2a str. 301
ccaucgacgaaauggu

SEQ ID NO: 2027104 - RNA, 21 nt, Shigella flexneri 2a str. 301
ccaucgauuuugcaauaaugg

SEQ ID NO: 2027105 - RNA, 15 nt, Shigella flexneri 2a str. 301
ccaucuccuuacugc

SEQ ID NO: 2027106 - RNA, 19 nt, Shigella flexneri 2a str. 301
ccaucuccuuacugccccc

SEQ ID NO: 2027107 - RNA, 12 nt, Shigella flexneri 2a str. 301
ccaucuccagcu

SEQ ID NO: 2027108 - RNA, 14 nt, Shigella flexneri 2a str. 301
ccaugaugacaaca

SEQ ID NO: 2027109 - RNA, 22 nt, Shigella flexneri 2a str. 301
ccaugauccugcaauaccgccg

SEQ ID NO: 2027110 - RNA, 23 nt, Shigella flexneri 2a str. 301
ccaugauuucguagacugcagcg

SEQ ID NO: 2027111 - RNA, 20 nt, Shigella flexneri 2a str. 301
ccaugccggaugcgccagca

SEQ ID NO: 2027112 - RNA, 23 nt, Shigella flexneri 2a str. 301
ccaugccggaugcgccagcaucc

SEQ ID NO: 2027113 - RNA, 22 nt, Shigella flexneri 2a str. 301
ccaugccggugaugccgccaga

SEQ ID NO: 2027114 - RNA, 17 nt, Shigella flexneri 2a str. 301
ccaugauaguguccauu

SEQ ID NO: 2027115 - RNA, 14 nt, Shigella flexneri 2a str. 301
ccaugauauuggca

SEQ ID NO: 2027116 - RNA, 20 nt, Shigella flexneri 2a str. 301
ccaugauaauuccgccgccc

SEQ ID NO: 2027117 - RNA, 16 nt, Shigella flexneri 2a str. 301
ccaugauccugcaaua

SEQ ID NO: 2027118 - RNA, 15 nt, Shigella flexneri 2a str. 301
ccaucuguucugccg

SEQ ID NO: 2027119 - RNA, 15 nt, Shigella flexneri 2a str. 301
ccaucuuccagcauc

SEQ ID NO: 2027120 - RNA, 19 nt, Shigella flexneri 2a str. 301
ccaucugaugauauuuuuc

SEQ ID NO: 2027121 - RNA, 16 nt, Shigella flexneri 2a str. 301
ccaucucuuccagcga

SEQ ID NO: 2027122 - RNA, 21 nt, Shigella flexneri 2a str. 301
ccaucucugcaacgucuuccc

SEQ ID NO: 2027123 - RNA, 12 nt, Shigella flexneri 2a str. 301
ccaucacuucau

SEQ ID NO: 2027124 - RNA, 19 nt, Shigella flexneri 2a str. 301
ccaucagacuuugcgccau

SEQ ID NO: 2027125 - RNA, 15 nt, Shigella flexneri 2a str. 301
ccaucagcagcaaca

SEQ ID NO: 2027126 - RNA, 20 nt, Shigella flexneri 2a str. 301
ccaucaccucuucagcgucc

SEQ ID NO: 2027127 - RNA, 14 nt, Shigella flexneri 2a str. 301
ccaucaccucuuca

SEQ ID NO: 2027128 - RNA, 13 nt, Shigella flexneri 2a str. 301
ccaucaccucuuc

SEQ ID NO: 2027129 - RNA, 12 nt, Shigella flexneri 2a str. 301
ccaucagcagcg

SEQ ID NO: 2027130 - RNA, 18 nt, Shigella flexneri 2a str. 301
ccauccauuuuucacgca

SEQ ID NO: 2027131 - RNA, 16 nt, Shigella flexneri 2a str. 301
ccaucccaccaccagc

SEQ ID NO: 2027132 - RNA, 20 nt, Shigella flexneri 2a str. 301
ccaucccaccaccagcaaua

SEQ ID NO: 2027133 - RNA, 16 nt, Shigella flexneri 2a str. 301
ccaucccuaccgcccg

SEQ ID NO: 2027134 - RNA, 17 nt, Shigella flexneri 2a str. 301
ccaucccgcucuguaag

SEQ ID NO: 2027135 - RNA, 16 nt, Shigella flexneri 2a str. 301
ccaucaucgcuuucag

SEQ ID NO: 2027136 - RNA, 15 nt, Shigella flexneri 2a str. 301
ccaucaugcgccagg

SEQ ID NO: 2027137 - RNA, 19 nt, Shigella flexneri 2a str. 301
ccaucauuaugagugaugu

SEQ ID NO: 2027138 - RNA, 21 nt, Shigella flexneri 2a str. 301
aaacaauaagggcugacaguu

SEQ ID NO: 2027139 - RNA, 14 nt, Shigella flexneri 2a str. 301
ccaucauauuuucc

SEQ ID NO: 2027140 - RNA, 20 nt, Shigella flexneri 2a str. 301
ccaucauauuuuccaucauu

SEQ ID NO: 2027141 - RNA, 12 nt, Shigella flexneri 2a str. 301
aaacaauaauug

SEQ ID NO: 2027142 - RNA, 11 nt, Shigella flexneri 2a str. 301
aaacaauaugu

SEQ ID NO: 2027143 - RNA, 16 nt, Shigella flexneri 2a str. 301
aaacaagguuugaaaa

SEQ ID NO: 2027144 - RNA, 20 nt, Shigella flexneri 2a str. 301
aaacaagaucgcccugaggg

SEQ ID NO: 2027145 - RNA, 15 nt, Shigella flexneri 2a str. 301
aaacaagcguacaaa

SEQ ID NO: 2027146 - RNA, 15 nt, Shigella flexneri 2a str. 301
cccaccccggcccuc

SEQ ID NO: 2027147 - RNA, 14 nt, Shigella flexneri 2a str. 301
cccaccugcggcac

SEQ ID NO: 2027148 - RNA, 13 nt, Shigella flexneri 2a str. 301
cccacgagcaaaa

SEQ ID NO: 2027149 - RNA, 16 nt, Shigella flexneri 2a str. 301
cccacgaccgcagcau

SEQ ID NO: 2027150 - RNA, 13 nt, Shigella flexneri 2a str. 301
cccaccgcaauaa

SEQ ID NO: 2027151 - RNA, 13 nt, Shigella flexneri 2a str. 301
cccaccgcagccc

SEQ ID NO: 2027152 - RNA, 12 nt, Shigella flexneri 2a str. 301
cccacagacgac

SEQ ID NO: 2027153 - RNA, 13 nt, Shigella flexneri 2a str. 301
cccacagcucugc

SEQ ID NO: 2027154 - RNA, 14 nt, Shigella flexneri 2a str. 301
cccacagcucugcu

SEQ ID NO: 2027155 - RNA, 22 nt, Shigella flexneri 2a str. 301
cccacagcucuugcuccacaag

SEQ ID NO: 2027156 - RNA, 20 nt, Shigella flexneri 2a str. 301
cccacaguuucagccccauc

SEQ ID NO: 2027157 - RNA, 12 nt, Shigella flexneri 2a str. 301
cccacauccaug

SEQ ID NO: 2027158 - RNA, 14 nt, Shigella flexneri 2a str. 301
cccaccaccagcaa

SEQ ID NO: 2027159 - RNA, 20 nt, Shigella flexneri 2a str. 301
cccaccaccggcauccauuc

SEQ ID NO: 2027160 - RNA, 16 nt, Shigella flexneri 2a str. 301
cccagauagcaacagc

SEQ ID NO: 2027161 - RNA, 14 nt, Shigella flexneri 2a str. 301
cccagaccaccgac

SEQ ID NO: 2027162 - RNA, 16 nt, Shigella flexneri 2a str. 301
cccagacguuucgcca

SEQ ID NO: 2027163 - RNA, 13 nt, Shigella flexneri 2a str. 301
cccacugcucaau

SEQ ID NO: 2027164 - RNA, 19 nt, Shigella flexneri 2a str. 301
cccacugcucaaucaucac

SEQ ID NO: 2027165 - RNA, 13 nt, Shigella flexneri 2a str. 301
cccacucgccccg

SEQ ID NO: 2027166 - RNA, 12 nt, Shigella flexneri 2a str. 301
cccacuccagcu

SEQ ID NO: 2027167 - RNA, 23 nt, Shigella flexneri 2a str. 301
cccacgauugaucucguugauca

SEQ ID NO: 2027168 - RNA, 22 nt, Shigella flexneri 2a str. 301
cccacgcgguuugugcucugug

SEQ ID NO: 2027169 - RNA, 16 nt, Shigella flexneri 2a str. 301
cccacuaagcaccaaa

SEQ ID NO: 2027170 - RNA, 13 nt, Shigella flexneri 2a str. 301
cccacggcgguaa

SEQ ID NO: 2027171 - RNA, 20 nt, Shigella flexneri 2a str. 301
cccacgucagaccaaaacgc

SEQ ID NO: 2027172 - RNA, 23 nt, Shigella flexneri 2a str. 301
cccaaaaaaucaacgacaaaaau

SEQ ID NO: 2027173 - RNA, 19 nt, Shigella flexneri 2a str. 301
ccauuucccugacaaauca

SEQ ID NO: 2027174 - RNA, 13 nt, Shigella flexneri 2a str. 301
cccaaaaggcagc

SEQ ID NO: 2027175 - RNA, 22 nt, Shigella flexneri 2a str. 301
ccauuuauccagcggcagccau

SEQ ID NO: 2027176 - RNA, 15 nt, Shigella flexneri 2a str. 301
cccaaacuuaacacu

SEQ ID NO: 2027177 - RNA, 15 nt, Shigella flexneri 2a str. 301
cccaacaacagcgcg

SEQ ID NO: 2027178 - RNA, 16 nt, Shigella flexneri 2a str. 301
cccaauguucguccau

SEQ ID NO: 2027179 - RNA, 23 nt, Shigella flexneri 2a str. 301
cccacaacaguggcgacaucuuu

SEQ ID NO: 2027180 - RNA, 11 nt, Shigella flexneri 2a str. 301
cccacaaccgg

SEQ ID NO: 2027181 - RNA, 15 nt, Shigella flexneri 2a str. 301
cccacaaccggcggg

SEQ ID NO: 2027182 - RNA, 18 nt, Shigella flexneri 2a str. 301
cccacaaacccgccagac

SEQ ID NO: 2027183 - RNA, 22 nt, Shigella flexneri 2a str. 301
cccaauacgauuaacgccagac

SEQ ID NO: 2027184 - RNA, 15 nt, Shigella flexneri 2a str. 301
cccaaucccccacuu

SEQ ID NO: 2027185 - RNA, 14 nt, Shigella flexneri 2a str. 301
ccauuguuagcaac

SEQ ID NO: 2027186 - RNA, 20 nt, Shigella flexneri 2a str. 301
ccauugggccacucaacauc

SEQ ID NO: 2027187 - RNA, 15 nt, Shigella flexneri 2a str. 301
ccauugggcuguuau

SEQ ID NO: 2027188 - RNA, 22 nt, Shigella flexneri 2a str. 301
ccauugggcuguuaucccagca

SEQ ID NO: 2027189 - RNA, 16 nt, Shigella flexneri 2a str. 301
ccauuggcauaaauaa

SEQ ID NO: 2027190 - RNA, 23 nt, Shigella flexneri 2a str. 301
ccauugacagaauauacggaaug

SEQ ID NO: 2027191 - RNA, 18 nt, Shigella flexneri 2a str. 301
ccauugacguuccuuucu

SEQ ID NO: 2027192 - RNA, 19 nt, Shigella flexneri 2a str. 301
ccauugaagaauuuuugcg

SEQ ID NO: 2027193 - RNA, 21 nt, Shigella flexneri 2a str. 301
ccauugaagcaauccauacca

SEQ ID NO: 2027194 - RNA, 20 nt, Shigella flexneri 2a str. 301
ccauugagcuggucugaauc

SEQ ID NO: 2027195 - RNA, 23 nt, Shigella flexneri 2a str. 301
ccauugagcuggucugaaucaac

SEQ ID NO: 2027196 - RNA, 22 nt, Shigella flexneri 2a str. 301
ccauucacacuccagucccagu

SEQ ID NO: 2027197 - RNA, 16 nt, Shigella flexneri 2a str. 301
ccauucaccauuuuuu

SEQ ID NO: 2027198 - RNA, 11 nt, Shigella flexneri 2a str. 301
ccauucaggcu

SEQ ID NO: 2027199 - RNA, 13 nt, Shigella flexneri 2a str. 301
ccauucaaucuuc

SEQ ID NO: 2027200 - RNA, 12 nt, Shigella flexneri 2a str. 301
ccauuauuucca

SEQ ID NO: 2027201 - RNA, 15 nt, Shigella flexneri 2a str. 301
ccaugcugugcgcca

SEQ ID NO: 2027202 - RNA, 19 nt, Shigella flexneri 2a str. 301
ccaugcugucggcugccag

SEQ ID NO: 2027203 - RNA, 18 nt, Shigella flexneri 2a str. 301
ccaugcuaauagcugcgc

SEQ ID NO: 2027204 - RNA, 21 nt, Shigella flexneri 2a str. 301
ccaugcguugucgccauccag

SEQ ID NO: 2027205 - RNA, 17 nt, Shigella flexneri 2a str. 301
ccaugcggcgaggaauc

SEQ ID NO: 2027206 - RNA, 22 nt, Shigella flexneri 2a str. 301
ccaugcggauuuugcccugcug

SEQ ID NO: 2027207 - RNA, 23 nt, Shigella flexneri 2a str. 301
ccaugcgaagaccgcaucacgac

SEQ ID NO: 2027208 - RNA, 15 nt, Shigella flexneri 2a str. 301
ccaugcgcaucaucg

SEQ ID NO: 2027209 - RNA, 16 nt, Shigella flexneri 2a str. 301
cccgaaugcagcucca

SEQ ID NO: 2027210 - RNA, 14 nt, Shigella flexneri 2a str. 301
cccgaaugaccgcc

SEQ ID NO: 2027211 - RNA, 23 nt, Shigella flexneri 2a str. 301
cccgaacgcgcacaggcgcuggg

SEQ ID NO: 2027212 - RNA, 18 nt, Shigella flexneri 2a str. 301
cccgacaaccugaccuuu

SEQ ID NO: 2027213 - RNA, 13 nt, Shigella flexneri 2a str. 301
cccgacaccgccu

SEQ ID NO: 2027214 - RNA, 13 nt, Shigella flexneri 2a str. 301
cccgagaaaaaua

SEQ ID NO: 2027215 - RNA, 19 nt, Shigella flexneri 2a str. 301
cccgagauacaucaccgcc

SEQ ID NO: 2027216 - RNA, 14 nt, Shigella flexneri 2a str. 301
cccgauacgcuugc

SEQ ID NO: 2027217 - RNA, 21 nt, Shigella flexneri 2a str. 301
ccccgugaugaacugcgguaa

SEQ ID NO: 2027218 - RNA, 14 nt, Shigella flexneri 2a str. 301
ccccggguuuccug

SEQ ID NO: 2027219 - RNA, 19 nt, Shigella flexneri 2a str. 301
ccccuguugugccagacca

SEQ ID NO: 2027220 - RNA, 11 nt, Shigella flexneri 2a str. 301
ccccugcgguu

SEQ ID NO: 2027221 - RNA, 22 nt, Shigella flexneri 2a str. 301
cccgccgcugguuaccaccugc

SEQ ID NO: 2027222 - RNA, 17 nt, Shigella flexneri 2a str. 301
cccgccguugccgcagc

SEQ ID NO: 2027223 - RNA, 15 nt, Shigella flexneri 2a str. 301
cccgcagcuccagcc

SEQ ID NO: 2027224 - RNA, 14 nt, Shigella flexneri 2a str. 301
cccgcagcuccagc

SEQ ID NO: 2027225 - RNA, 16 nt, Shigella flexneri 2a str. 301
cccgcaugccuaccaa

SEQ ID NO: 2027226 - RNA, 18 nt, Shigella flexneri 2a str. 301
cccgcauccgcugaugca

SEQ ID NO: 2027227 - RNA, 20 nt, Shigella flexneri 2a str. 301
cccgauggucagcuucaccu

SEQ ID NO: 2027228 - RNA, 17 nt, Shigella flexneri 2a str. 301
cccgauggucagcuuca

SEQ ID NO: 2027229 - RNA, 18 nt, Shigella flexneri 2a str. 301
cccgauucggucauggua

SEQ ID NO: 2027230 - RNA, 14 nt, Shigella flexneri 2a str. 301
cccgaucgcucaua

SEQ ID NO: 2027231 - RNA, 17 nt, Shigella flexneri 2a str. 301
cccgaugaugaugggcg

SEQ ID NO: 2027232 - RNA, 14 nt, Shigella flexneri 2a str. 301
ccccacaccaccau

SEQ ID NO: 2027233 - RNA, 22 nt, Shigella flexneri 2a str. 301
ccccacucgccccgagaaaaau

SEQ ID NO: 2027234 - RNA, 16 nt, Shigella flexneri 2a str. 301
ccccagcggaaaauau

SEQ ID NO: 2027235 - RNA, 20 nt, Shigella flexneri 2a str. 301
ccccagggaacauuucuuau

SEQ ID NO: 2027236 - RNA, 18 nt, Shigella flexneri 2a str. 301
ccccaucugcuuuuaacc

SEQ ID NO: 2027237 - RNA, 19 nt, Shigella flexneri 2a str. 301
ccccaggguuucuccguca

SEQ ID NO: 2027238 - RNA, 17 nt, Shigella flexneri 2a str. 301
cccauugccccauguug

SEQ ID NO: 2027239 - RNA, 16 nt, Shigella flexneri 2a str. 301
cccagcauggcaauaa

SEQ ID NO: 2027240 - RNA, 16 nt, Shigella flexneri 2a str. 301
cccagcaucugcaugg

SEQ ID NO: 2027241 - RNA, 13 nt, Shigella flexneri 2a str. 301
ccccaauguucgu

SEQ ID NO: 2027242 - RNA, 22 nt, Shigella flexneri 2a str. 301
ccccaaggcgaggggaccgccc

SEQ ID NO: 2027243 - RNA, 21 nt, Shigella flexneri 2a str. 301
ccccaaggcgaggggaccgcc

SEQ ID NO: 2027244 - RNA, 15 nt, Shigella flexneri 2a str. 301
ccccaauccacgcgg

SEQ ID NO: 2027245 - RNA, 15 nt, Shigella flexneri 2a str. 301
ccccaaccgcccugc

SEQ ID NO: 2027246 - RNA, 12 nt, Shigella flexneri 2a str. 301
cccccacagcuc

SEQ ID NO: 2027247 - RNA, 23 nt, Shigella flexneri 2a str. 301
ccccauuaccugacagcagagca

SEQ ID NO: 2027248 - RNA, 17 nt, Shigella flexneri 2a str. 301
cccccaaauaaccccuc

SEQ ID NO: 2027249 - RNA, 21 nt, Shigella flexneri 2a str. 301
cccccuuugaccagccaguca

SEQ ID NO: 2027250 - RNA, 16 nt, Shigella flexneri 2a str. 301
ccccgaacucaucucu

SEQ ID NO: 2027251 - RNA, 21 nt, Shigella flexneri 2a str. 301
ccccggcgaucccagagcggg

SEQ ID NO: 2027252 - RNA, 22 nt, Shigella flexneri 2a str. 301
ccccggcggccggaugacagac

SEQ ID NO: 2027253 - RNA, 16 nt, Shigella flexneri 2a str. 301
ccccggcaaaaccauc

SEQ ID NO: 2027254 - RNA, 14 nt, Shigella flexneri 2a str. 301
ccccgcuuccugca

SEQ ID NO: 2027255 - RNA, 17 nt, Shigella flexneri 2a str. 301
ccccgcuucgcccgcca

SEQ ID NO: 2027256 - RNA, 17 nt, Shigella flexneri 2a str. 301
cccggaagcaucaaacg

SEQ ID NO: 2027257 - RNA, 20 nt, Shigella flexneri 2a str. 301
cccgcuuuuuugucaccuuu

SEQ ID NO: 2027258 - RNA, 16 nt, Shigella flexneri 2a str. 301
cccgcuucgcccgcca

SEQ ID NO: 2027259 - RNA, 15 nt, Shigella flexneri 2a str. 301
cccgcuucgcccgcc

SEQ ID NO: 2027260 - RNA, 17 nt, Shigella flexneri 2a str. 301
cccgcuguaaaugcugc

SEQ ID NO: 2027261 - RNA, 12 nt, Shigella flexneri 2a str. 301
cccgcuucgccc

SEQ ID NO: 2027262 - RNA, 15 nt, Shigella flexneri 2a str. 301
cccgcuucagccccg

SEQ ID NO: 2027263 - RNA, 11 nt, Shigella flexneri 2a str. 301
cccgcuuccag

SEQ ID NO: 2027264 - RNA, 21 nt, Shigella flexneri 2a str. 301
cccgcuguuuguucaagcgca

SEQ ID NO: 2027265 - RNA, 20 nt, Shigella flexneri 2a str. 301
cccgcucgaaguuuuccuca

SEQ ID NO: 2027266 - RNA, 13 nt, Shigella flexneri 2a str. 301
cccgcucacgcag

SEQ ID NO: 2027267 - RNA, 14 nt, Shigella flexneri 2a str. 301
cccgcucggcggcu

SEQ ID NO: 2027268 - RNA, 15 nt, Shigella flexneri 2a str. 301
cccgcugcugacuuu

SEQ ID NO: 2027269 - RNA, 23 nt, Shigella flexneri 2a str. 301
cccggcaaaauagaguguuccuc

SEQ ID NO: 2027270 - RNA, 20 nt, Shigella flexneri 2a str. 301
cccggcaacaaauucacgcc

SEQ ID NO: 2027271 - RNA, 19 nt, Shigella flexneri 2a str. 301
cccggauuuggcaaaugca

SEQ ID NO: 2027272 - RNA, 21 nt, Shigella flexneri 2a str. 301
cccggcaagaaauaccgaaga

SEQ ID NO: 2027273 - RNA, 23 nt, Shigella flexneri 2a str. 301
cccggcaagaaauaccgaagagu

SEQ ID NO: 2027274 - RNA, 18 nt, Shigella flexneri 2a str. 301
cccggcaaucaccgccag

SEQ ID NO: 2027275 - RNA, 12 nt, Shigella flexneri 2a str. 301
cccggcagagaa

SEQ ID NO: 2027276 - RNA, 15 nt, Shigella flexneri 2a str. 301
cccggcagagaaaau

SEQ ID NO: 2027277 - RNA, 20 nt, Shigella flexneri 2a str. 301
cccggcacguuuuggcagac

SEQ ID NO: 2027278 - RNA, 12 nt, Shigella flexneri 2a str. 301
cccggaagccac

SEQ ID NO: 2027279 - RNA, 17 nt, Shigella flexneri 2a str. 301
cccggauauccacccgc

SEQ ID NO: 2027280 - RNA, 20 nt, Shigella flexneri 2a str. 301
cccgcgaacggggcugccag

SEQ ID NO: 2027281 - RNA, 14 nt, Shigella flexneri 2a str. 301
cccgcgaucgccug

SEQ ID NO: 2027282 - RNA, 18 nt, Shigella flexneri 2a str. 301
cccgcgucguucaucgca

SEQ ID NO: 2027283 - RNA, 20 nt, Shigella flexneri 2a str. 301
cccggcgcauggccgggguu

SEQ ID NO: 2027284 - RNA, 17 nt, Shigella flexneri 2a str. 301
cccggcgcagcgcgcga

SEQ ID NO: 2027285 - RNA, 15 nt, Shigella flexneri 2a str. 301
cccggcgcagcgcgc

SEQ ID NO: 2027286 - RNA, 23 nt, Shigella flexneri 2a str. 301
cccggcgaugguuuucaucccga

SEQ ID NO: 2027287 - RNA, 16 nt, Shigella flexneri 2a str. 301
cccggccugcucccga

SEQ ID NO: 2027288 - RNA, 17 nt, Shigella flexneri 2a str. 301
cccggccacagcgccag

SEQ ID NO: 2027289 - RNA, 19 nt, Shigella flexneri 2a str. 301
cccgguuaucggcgcgcca

SEQ ID NO: 2027290 - RNA, 12 nt, Shigella flexneri 2a str. 301
cccgguccuggc

SEQ ID NO: 2027291 - RNA, 16 nt, Shigella flexneri 2a str. 301
cccguacuucugacca

SEQ ID NO: 2027292 - RNA, 16 nt, Shigella flexneri 2a str. 301
cccgguuuuacuuugc

SEQ ID NO: 2027293 - RNA, 14 nt, Shigella flexneri 2a str. 301
cccguacgcugugg

SEQ ID NO: 2027294 - RNA, 19 nt, Shigella flexneri 2a str. 301
aaacacugcgcucuucugg

SEQ ID NO: 2027295 - RNA, 16 nt, Shigella flexneri 2a str. 301
aaacacugaaccgaaa

SEQ ID NO: 2027296 - RNA, 15 nt, Shigella flexneri 2a str. 301
aaacacgacaugacc

SEQ ID NO: 2027297 - RNA, 23 nt, Shigella flexneri 2a str. 301
cccggucagcagcaccaccgccc

SEQ ID NO: 2027298 - RNA, 20 nt, Shigella flexneri 2a str. 301
cccgggccuccccggauuca

SEQ ID NO: 2027299 - RNA, 20 nt, Shigella flexneri 2a str. 301
cccggcggcgcgccaggcgc

SEQ ID NO: 2027300 - RNA, 18 nt, Shigella flexneri 2a str. 301
cccggcggccggaugaca

SEQ ID NO: 2027301 - RNA, 21 nt, Shigella flexneri 2a str. 301
ccgauaaucaacgcgccgcca

SEQ ID NO: 2027302 - RNA, 20 nt, Shigella flexneri 2a str. 301
ccgauaaucaacaaaccaaa

SEQ ID NO: 2027303 - RNA, 13 nt, Shigella flexneri 2a str. 301
ccgauaccaucac

SEQ ID NO: 2027304 - RNA, 16 nt, Shigella flexneri 2a str. 301
ccgauaccgacacagg

SEQ ID NO: 2027305 - RNA, 18 nt, Shigella flexneri 2a str. 301
ccgaucaucaaaaaacac

SEQ ID NO: 2027306 - RNA, 16 nt, Shigella flexneri 2a str. 301
ccgauccggcaccaau

SEQ ID NO: 2027307 - RNA, 17 nt, Shigella flexneri 2a str. 301
ccgaugaguuaagaaga

SEQ ID NO: 2027308 - RNA, 14 nt, Shigella flexneri 2a str. 301
ccgaucgugcuaaa

SEQ ID NO: 2027309 - RNA, 14 nt, Shigella flexneri 2a str. 301
ccgaucucaccgau

SEQ ID NO: 2027310 - RNA, 18 nt, Shigella flexneri 2a str. 301
ccgauccuagaucgggca

SEQ ID NO: 2027311 - RNA, 12 nt, Shigella flexneri 2a str. 301
ccgcaccgccgu

SEQ ID NO: 2027312 - RNA, 21 nt, Shigella flexneri 2a str. 301
ccgcaccccugauaaccgcau

SEQ ID NO: 2027313 - RNA, 17 nt, Shigella flexneri 2a str. 301
ccgcacucaucuuauug

SEQ ID NO: 2027314 - RNA, 23 nt, Shigella flexneri 2a str. 301
ccgcaacauacugcccgagcgcc

SEQ ID NO: 2027315 - RNA, 15 nt, Shigella flexneri 2a str. 301
ccgcaacagcaauac

SEQ ID NO: 2027316 - RNA, 14 nt, Shigella flexneri 2a str. 301
ccgcaacaaugccg

SEQ ID NO: 2027317 - RNA, 17 nt, Shigella flexneri 2a str. 301
ccgauggucagcuucac

SEQ ID NO: 2027318 - RNA, 11 nt, Shigella flexneri 2a str. 301
ccgcaaagccc

SEQ ID NO: 2027319 - RNA, 23 nt, Shigella flexneri 2a str. 301
ccgagcuuaugcaauagcgccug

SEQ ID NO: 2027320 - RNA, 23 nt, Shigella flexneri 2a str. 301
ccgaggcgcuggcagaaggccgc

SEQ ID NO: 2027321 - RNA, 20 nt, Shigella flexneri 2a str. 301
ccgaguggcauuucgccaaa

SEQ ID NO: 2027322 - RNA, 23 nt, Shigella flexneri 2a str. 301
ccgaguggcauuucgccaaacca

SEQ ID NO: 2027323 - RNA, 13 nt, Shigella flexneri 2a str. 301
ccgaguggcauuu

SEQ ID NO: 2027324 - RNA, 20 nt, Shigella flexneri 2a str. 301
ccgaguuguugagguucgga

SEQ ID NO: 2027325 - RNA, 23 nt, Shigella flexneri 2a str. 301
ccgauaaaacgguuuauccccaa

SEQ ID NO: 2027326 - RNA, 21 nt, Shigella flexneri 2a str. 301
ccgauaaaggucgacagcagc

SEQ ID NO: 2027327 - RNA, 18 nt, Shigella flexneri 2a str. 301
ccgauaaaggucgacagc

SEQ ID NO: 2027328 - RNA, 17 nt, Shigella flexneri 2a str. 301
ccgauaaccgcaaaacc

SEQ ID NO: 2027329 - RNA, 19 nt, Shigella flexneri 2a str. 301
ccgaguaaaaaaacaucau

SEQ ID NO: 2027330 - RNA, 23 nt, Shigella flexneri 2a str. 301
ccgagauaaugguuuccagcauc

SEQ ID NO: 2027331 - RNA, 13 nt, Shigella flexneri 2a str. 301
ccgacuuauucuu

SEQ ID NO: 2027332 - RNA, 19 nt, Shigella flexneri 2a str. 301
ccgacucacuugcagucgg

SEQ ID NO: 2027333 - RNA, 13 nt, Shigella flexneri 2a str. 301
ccgacgugcagca

SEQ ID NO: 2027334 - RNA, 18 nt, Shigella flexneri 2a str. 301
aaacacugggaugaaagu

SEQ ID NO: 2027335 - RNA, 16 nt, Shigella flexneri 2a str. 301
cccguccguuccgcca

SEQ ID NO: 2027336 - RNA, 14 nt, Shigella flexneri 2a str. 301
cccugcaauuauua

SEQ ID NO: 2027337 - RNA, 16 nt, Shigella flexneri 2a str. 301
cccugcaauccagggg

SEQ ID NO: 2027338 - RNA, 17 nt, Shigella flexneri 2a str. 301
cccgucgaagacucuua

SEQ ID NO: 2027339 - RNA, 15 nt, Shigella flexneri 2a str. 301
cccugcgauugugac

SEQ ID NO: 2027340 - RNA, 15 nt, Shigella flexneri 2a str. 301
cccugcgccagcggc

SEQ ID NO: 2027341 - RNA, 14 nt, Shigella flexneri 2a str. 301
cccugcagucaccu

SEQ ID NO: 2027342 - RNA, 23 nt, Shigella flexneri 2a str. 301
cccugcauauaaucgauccccaa

SEQ ID NO: 2027343 - RNA, 20 nt, Shigella flexneri 2a str. 301
cccugcacuuaacaggaucu

SEQ ID NO: 2027344 - RNA, 19 nt, Shigella flexneri 2a str. 301
cccugcaccggugcaucca

SEQ ID NO: 2027345 - RNA, 19 nt, Shigella flexneri 2a str. 301
cccuggcaacccgggcucc

SEQ ID NO: 2027346 - RNA, 15 nt, Shigella flexneri 2a str. 301
cccuggaugcaguca

SEQ ID NO: 2027347 - RNA, 16 nt, Shigella flexneri 2a str. 301
cccuggcucugcacua

SEQ ID NO: 2027348 - RNA, 22 nt, Shigella flexneri 2a str. 301
cccugcgcuaaacaggaucugg

SEQ ID NO: 2027349 - RNA, 19 nt, Shigella flexneri 2a str. 301
cccugcgcuaaacaggauc

SEQ ID NO: 2027350 - RNA, 22 nt, Shigella flexneri 2a str. 301
cccugcuguuuuuucaggcccu

SEQ ID NO: 2027351 - RNA, 15 nt, Shigella flexneri 2a str. 301
cccugcuuugcaagc

SEQ ID NO: 2027352 - RNA, 19 nt, Shigella flexneri 2a str. 301
cccuucuuuugucgugccc

SEQ ID NO: 2027353 - RNA, 16 nt, Shigella flexneri 2a str. 301
cccuucuuucacuuca

SEQ ID NO: 2027354 - RNA, 12 nt, Shigella flexneri 2a str. 301
cccuucuucaau

SEQ ID NO: 2027355 - RNA, 22 nt, Shigella flexneri 2a str. 301
cccuucuggucaugaaccugcc

SEQ ID NO: 2027356 - RNA, 16 nt, Shigella flexneri 2a str. 301
cccuucucgcucuugu

SEQ ID NO: 2027357 - RNA, 15 nt, Shigella flexneri 2a str. 301
cccuucugcacgcca

SEQ ID NO: 2027358 - RNA, 18 nt, Shigella flexneri 2a str. 301
cccuugauaaacgccgcc

SEQ ID NO: 2027359 - RNA, 21 nt, Shigella flexneri 2a str. 301
cccuugauaaacgccgccagu

SEQ ID NO: 2027360 - RNA, 23 nt, Shigella flexneri 2a str. 301
cccuugaugcagauucggguuca

SEQ ID NO: 2027361 - RNA, 15 nt, Shigella flexneri 2a str. 301
cccuugucgcagcau

SEQ ID NO: 2027362 - RNA, 21 nt, Shigella flexneri 2a str. 301
cccuugcucugguucaccauu

SEQ ID NO: 2027363 - RNA, 13 nt, Shigella flexneri 2a str. 301
cccuuuauuuucu

SEQ ID NO: 2027364 - RNA, 16 nt, Shigella flexneri 2a str. 301
cccuguaauugccuga

SEQ ID NO: 2027365 - RNA, 15 nt, Shigella flexneri 2a str. 301
cccuguaauugccug

SEQ ID NO: 2027366 - RNA, 19 nt, Shigella flexneri 2a str. 301
cccuucaucgcuccugccg

SEQ ID NO: 2027367 - RNA, 14 nt, Shigella flexneri 2a str. 301
cccuucaucacgca

SEQ ID NO: 2027368 - RNA, 13 nt, Shigella flexneri 2a str. 301
cccuguugccugc

SEQ ID NO: 2027369 - RNA, 12 nt, Shigella flexneri 2a str. 301
cccuuccagcuu

SEQ ID NO: 2027370 - RNA, 20 nt, Shigella flexneri 2a str. 301
cccuuccagauucaguuuca

SEQ ID NO: 2027371 - RNA, 18 nt, Shigella flexneri 2a str. 301
cccuuccccguucugcca

SEQ ID NO: 2027372 - RNA, 17 nt, Shigella flexneri 2a str. 301
cccuucguaggcagcau

SEQ ID NO: 2027373 - RNA, 14 nt, Shigella flexneri 2a str. 301
cccuucgccgccgc

SEQ ID NO: 2027374 - RNA, 13 nt, Shigella flexneri 2a str. 301
cccuuucugcauc

SEQ ID NO: 2027375 - RNA, 13 nt, Shigella flexneri 2a str. 301
aaacagaaauuca

SEQ ID NO: 2027376 - RNA, 15 nt, Shigella flexneri 2a str. 301
ccgaacagcacaacg

SEQ ID NO: 2027377 - RNA, 19 nt, Shigella flexneri 2a str. 301
aaacaugccaacaaaaucu

SEQ ID NO: 2027378 - RNA, 12 nt, Shigella flexneri 2a str. 301
aaacauggaaac

SEQ ID NO: 2027379 - RNA, 16 nt, Shigella flexneri 2a str. 301
aaacauggaaaccauc

SEQ ID NO: 2027380 - RNA, 20 nt, Shigella flexneri 2a str. 301
aaacauggaaaccaucaucu

SEQ ID NO: 2027381 - RNA, 17 nt, Shigella flexneri 2a str. 301
aaacaucgggacaugau

SEQ ID NO: 2027382 - RNA, 19 nt, Shigella flexneri 2a str. 301
aaacaucgcugauuucacc

SEQ ID NO: 2027383 - RNA, 19 nt, Shigella flexneri 2a str. 301
ccgaaccagugcuccaccu

SEQ ID NO: 2027384 - RNA, 22 nt, Shigella flexneri 2a str. 301
aaacagucacuuucgagcaauu

SEQ ID NO: 2027385 - RNA, 21 nt, Shigella flexneri 2a str. 301
aaacagugcccauacccgaug

SEQ ID NO: 2027386 - RNA, 17 nt, Shigella flexneri 2a str. 301
aaacaguuucugcagcu

SEQ ID NO: 2027387 - RNA, 15 nt, Shigella flexneri 2a str. 301
ccgacaccgccucca

SEQ ID NO: 2027388 - RNA, 23 nt, Shigella flexneri 2a str. 301
ccgaagaaauagaaacuggcccu

SEQ ID NO: 2027389 - RNA, 15 nt, Shigella flexneri 2a str. 301
ccgaacuuugcaccc

SEQ ID NO: 2027390 - RNA, 18 nt, Shigella flexneri 2a str. 301
ccgaaguuguagcuggcu

SEQ ID NO: 2027391 - RNA, 15 nt, Shigella flexneri 2a str. 301
ccgaaugcagcucca

SEQ ID NO: 2027392 - RNA, 16 nt, Shigella flexneri 2a str. 301
ccgaaugaccgccccu

SEQ ID NO: 2027393 - RNA, 13 nt, Shigella flexneri 2a str. 301
ccgaauucaaauc

SEQ ID NO: 2027394 - RNA, 22 nt, Shigella flexneri 2a str. 301
ccuguccagacggagcugccag

SEQ ID NO: 2027395 - RNA, 19 nt, Shigella flexneri 2a str. 301
ccuguaucccaguucgauu

SEQ ID NO: 2027396 - RNA, 20 nt, Shigella flexneri 2a str. 301
ccugucgcuuugacugcuuu

SEQ ID NO: 2027397 - RNA, 17 nt, Shigella flexneri 2a str. 301
ccuguaguguguugcaa

SEQ ID NO: 2027398 - RNA, 22 nt, Shigella flexneri 2a str. 301
ccuguaguguguugcaauacac

SEQ ID NO: 2027399 - RNA, 13 nt, Shigella flexneri 2a str. 301
ccuguaucccaga

SEQ ID NO: 2027400 - RNA, 22 nt, Shigella flexneri 2a str. 301
ccuguaucccagaucgcuuucc

SEQ ID NO: 2027401 - RNA, 18 nt, Shigella flexneri 2a str. 301
ccugguuucuggucauug

SEQ ID NO: 2027402 - RNA, 22 nt, Shigella flexneri 2a str. 301
ccuguaaaaaaguaaugccugc

SEQ ID NO: 2027403 - RNA, 22 nt, Shigella flexneri 2a str. 301
ccugcucgucggcaaagcgggc

SEQ ID NO: 2027404 - RNA, 17 nt, Shigella flexneri 2a str. 301
ccugcucugccagacgg

SEQ ID NO: 2027405 - RNA, 16 nt, Shigella flexneri 2a str. 301
ccugcugaauccccuu

SEQ ID NO: 2027406 - RNA, 18 nt, Shigella flexneri 2a str. 301
ccugcugcacgucauacu

SEQ ID NO: 2027407 - RNA, 16 nt, Shigella flexneri 2a str. 301
ccugcugcacgcccug

SEQ ID NO: 2027408 - RNA, 18 nt, Shigella flexneri 2a str. 301
ccugguuauuucacuuca

SEQ ID NO: 2027409 - RNA, 15 nt, Shigella flexneri 2a str. 301
ccugucuucccugcu

SEQ ID NO: 2027410 - RNA, 14 nt, Shigella flexneri 2a str. 301
ccugucuucccugc

SEQ ID NO: 2027411 - RNA, 16 nt, Shigella flexneri 2a str. 301
ccugugcaaccuuuuc

SEQ ID NO: 2027412 - RNA, 12 nt, Shigella flexneri 2a str. 301
ccugugcagcga

SEQ ID NO: 2027413 - RNA, 18 nt, Shigella flexneri 2a str. 301
ccugugccugagccggag

SEQ ID NO: 2027414 - RNA, 16 nt, Shigella flexneri 2a str. 301
ccugugucacuuugac

SEQ ID NO: 2027415 - RNA, 23 nt, Shigella flexneri 2a str. 301
ccuguggugcaggcgcagauaca

SEQ ID NO: 2027416 - RNA, 18 nt, Shigella flexneri 2a str. 301
ccugugggccgauggcua

SEQ ID NO: 2027417 - RNA, 22 nt, Shigella flexneri 2a str. 301
ccuguggaacgugcugcauuug

SEQ ID NO: 2027418 - RNA, 21 nt, Shigella flexneri 2a str. 301
ccuguugucuuuccagacuca

SEQ ID NO: 2027419 - RNA, 19 nt, Shigella flexneri 2a str. 301
ccuguugucuuuccagacu

SEQ ID NO: 2027420 - RNA, 18 nt, Shigella flexneri 2a str. 301
ccuguuucggacuucugu

SEQ ID NO: 2027421 - RNA, 17 nt, Shigella flexneri 2a str. 301
ccuuaaaagugaggugu

SEQ ID NO: 2027422 - RNA, 14 nt, Shigella flexneri 2a str. 301
ccuuaaaacaauau

SEQ ID NO: 2027423 - RNA, 13 nt, Shigella flexneri 2a str. 301
ccuuaaacaccug

SEQ ID NO: 2027424 - RNA, 15 nt, Shigella flexneri 2a str. 301
ccuguugcccuuugc

SEQ ID NO: 2027425 - RNA, 15 nt, Shigella flexneri 2a str. 301
ccuguugccugcacu

SEQ ID NO: 2027426 - RNA, 24 nt, Shigella flexneri 2a str. 301
ccuguugcgucgccgccuguucca

SEQ ID NO: 2027427 - RNA, 16 nt, Shigella flexneri 2a str. 301
ccuguugaaauuauug

SEQ ID NO: 2027428 - RNA, 21 nt, Shigella flexneri 2a str. 301
ccuguucgucccgauucagca

SEQ ID NO: 2027429 - RNA, 17 nt, Shigella flexneri 2a str. 301
ccuguuccagacgcugc

SEQ ID NO: 2027430 - RNA, 14 nt, Shigella flexneri 2a str. 301
ccuguucgccgccg

SEQ ID NO: 2027431 - RNA, 16 nt, Shigella flexneri 2a str. 301
ccuugauauaaauccc

SEQ ID NO: 2027432 - RNA, 14 nt, Shigella flexneri 2a str. 301
ccuucugagaucaa

SEQ ID NO: 2027433 - RNA, 18 nt, Shigella flexneri 2a str. 301
ccuugauuauuucccucg

SEQ ID NO: 2027434 - RNA, 22 nt, Shigella flexneri 2a str. 301
ccuugcaauaauuuacagccug

SEQ ID NO: 2027435 - RNA, 13 nt, Shigella flexneri 2a str. 301
ccuugcaacuccg

SEQ ID NO: 2027436 - RNA, 14 nt, Shigella flexneri 2a str. 301
ccuugaugaaaaaa

SEQ ID NO: 2027437 - RNA, 16 nt, Shigella flexneri 2a str. 301
ccuugccagauguugu

SEQ ID NO: 2027438 - RNA, 16 nt, Shigella flexneri 2a str. 301
ccuugccaaauguugu

SEQ ID NO: 2027439 - RNA, 16 nt, Shigella flexneri 2a str. 301
ccuugcggaaauucca

SEQ ID NO: 2027440 - RNA, 21 nt, Shigella flexneri 2a str. 301
ccuugcggaaauuccagcggc

SEQ ID NO: 2027441 - RNA, 22 nt, Shigella flexneri 2a str. 301
ccuugcgauuacgcucggcaaa

SEQ ID NO: 2027442 - RNA, 15 nt, Shigella flexneri 2a str. 301
ccuuccacaccacuu

SEQ ID NO: 2027443 - RNA, 14 nt, Shigella flexneri 2a str. 301
ccuucccagccggg

SEQ ID NO: 2027444 - RNA, 12 nt, Shigella flexneri 2a str. 301
ccuucccagccg

SEQ ID NO: 2027445 - RNA, 12 nt, Shigella flexneri 2a str. 301
ccuuccccgagc

SEQ ID NO: 2027446 - RNA, 20 nt, Shigella flexneri 2a str. 301
ccuucgggcuggcauuuuuu

SEQ ID NO: 2027447 - RNA, 17 nt, Shigella flexneri 2a str. 301
ccuucggcgucuccacc

SEQ ID NO: 2027448 - RNA, 13 nt, Shigella flexneri 2a str. 301
ccuucguucucug

SEQ ID NO: 2027449 - RNA, 12 nt, Shigella flexneri 2a str. 301
ccuucuccacac

SEQ ID NO: 2027450 - RNA, 13 nt, Shigella flexneri 2a str. 301
ccuucuaaagcaa

SEQ ID NO: 2027451 - RNA, 20 nt, Shigella flexneri 2a str. 301
ccuucaucuucaacugccau

SEQ ID NO: 2027452 - RNA, 14 nt, Shigella flexneri 2a str. 301
ccuucaucuucaac

SEQ ID NO: 2027453 - RNA, 20 nt, Shigella flexneri 2a str. 301
ccuucauuugccagcuucag

SEQ ID NO: 2027454 - RNA, 23 nt, Shigella flexneri 2a str. 301
ccuucauauuccugacccagcac

SEQ ID NO: 2027455 - RNA, 18 nt, Shigella flexneri 2a str. 301
ccuucauccagcaucaua

SEQ ID NO: 2027456 - RNA, 22 nt, Shigella flexneri 2a str. 301
ccuucauauuccugacccagca

SEQ ID NO: 2027457 - RNA, 16 nt, Shigella flexneri 2a str. 301
ccuuaacgcaaaaucu

SEQ ID NO: 2027458 - RNA, 19 nt, Shigella flexneri 2a str. 301
ccuuaacuucaucagcaaa

SEQ ID NO: 2027459 - RNA, 22 nt, Shigella flexneri 2a str. 301
ccuuaaguaugcaauaacaaua

SEQ ID NO: 2027460 - RNA, 16 nt, Shigella flexneri 2a str. 301
ccuuaauaaaauacuu

SEQ ID NO: 2027461 - RNA, 23 nt, Shigella flexneri 2a str. 301
ccuuaguaacgccagcggucaua

SEQ ID NO: 2027462 - RNA, 16 nt, Shigella flexneri 2a str. 301
ccuuagcaacaggcca

SEQ ID NO: 2027463 - RNA, 17 nt, Shigella flexneri 2a str. 301
ccuuacucauaaauacu

SEQ ID NO: 2027464 - RNA, 18 nt, Shigella flexneri 2a str. 301
ccuuacucaguugguguc

SEQ ID NO: 2027465 - RNA, 15 nt, Shigella flexneri 2a str. 301
ccuuucugagaggaa

SEQ ID NO: 2027466 - RNA, 13 nt, Shigella flexneri 2a str. 301
ccuuucugcaucc

SEQ ID NO: 2027467 - RNA, 23 nt, Shigella flexneri 2a str. 301
ccuuuucaguuggcugacaaagu

SEQ ID NO: 2027468 - RNA, 18 nt, Shigella flexneri 2a str. 301
ccuuuuccauugccgcag

SEQ ID NO: 2027469 - RNA, 16 nt, Shigella flexneri 2a str. 301
ccuuuucaccaugggc

SEQ ID NO: 2027470 - RNA, 21 nt, Shigella flexneri 2a str. 301
ccuuuuuuugucuguuugcuc

SEQ ID NO: 2027471 - RNA, 14 nt, Shigella flexneri 2a str. 301
cgaaaaaaaagaag

SEQ ID NO: 2027472 - RNA, 13 nt, Shigella flexneri 2a str. 301
cgaaaaaaaagau

SEQ ID NO: 2027473 - RNA, 15 nt, Shigella flexneri 2a str. 301
ccuuuuuuaaacauu

SEQ ID NO: 2027474 - RNA, 18 nt, Shigella flexneri 2a str. 301
ccuuuuucucugguccaa

SEQ ID NO: 2027475 - RNA, 12 nt, Shigella flexneri 2a str. 301
ccuuuuucuuca

SEQ ID NO: 2027476 - RNA, 13 nt, Shigella flexneri 2a str. 301
ccuuuuucccaaa

SEQ ID NO: 2027477 - RNA, 20 nt, Shigella flexneri 2a str. 301
cgaaaaagucccuucccagc

SEQ ID NO: 2027478 - RNA, 18 nt, Shigella flexneri 2a str. 301
cgaaaaccacuccugacg

SEQ ID NO: 2027479 - RNA, 11 nt, Shigella flexneri 2a str. 301
cgaaagaaaag

SEQ ID NO: 2027480 - RNA, 14 nt, Shigella flexneri 2a str. 301
cgaaacgauuaauu

SEQ ID NO: 2027481 - RNA, 15 nt, Shigella flexneri 2a str. 301
cgaaaccgcgcagcg

SEQ ID NO: 2027482 - RNA, 16 nt, Shigella flexneri 2a str. 301
cgaaacgccugcaauu

SEQ ID NO: 2027483 - RNA, 23 nt, Shigella flexneri 2a str. 301
cgaaauggugugcaugguguuca

SEQ ID NO: 2027484 - RNA, 14 nt, Shigella flexneri 2a str. 301
cgaaauuauggugu

SEQ ID NO: 2027485 - RNA, 17 nt, Shigella flexneri 2a str. 301
cgaaauggccauccauu

SEQ ID NO: 2027486 - RNA, 17 nt, Shigella flexneri 2a str. 301
cgaaaugagauauuuca

SEQ ID NO: 2027487 - RNA, 13 nt, Shigella flexneri 2a str. 301
cgaaaucgccauu

SEQ ID NO: 2027488 - RNA, 15 nt, Shigella flexneri 2a str. 301
cgaaaucgccuuugg

SEQ ID NO: 2027489 - RNA, 12 nt, Shigella flexneri 2a str. 301
cgaaaucgccau

SEQ ID NO: 2027490 - RNA, 20 nt, Shigella flexneri 2a str. 301
cgaaaucaccgccaccagcg

SEQ ID NO: 2027491 - RNA, 16 nt, Shigella flexneri 2a str. 301
cgaaagcagggcggca

SEQ ID NO: 2027492 - RNA, 13 nt, Shigella flexneri 2a str. 301
cgaaagccccagc

SEQ ID NO: 2027493 - RNA, 18 nt, Shigella flexneri 2a str. 301
cgaacgccuucgccaucu

SEQ ID NO: 2027494 - RNA, 15 nt, Shigella flexneri 2a str. 301
cgaacgccucugcaa

SEQ ID NO: 2027495 - RNA, 15 nt, Shigella flexneri 2a str. 301
cgaaccggaacauca

SEQ ID NO: 2027496 - RNA, 17 nt, Shigella flexneri 2a str. 301
cgaaccagugcuccacc

SEQ ID NO: 2027497 - RNA, 13 nt, Shigella flexneri 2a str. 301
cgaacccagcagg

SEQ ID NO: 2027498 - RNA, 14 nt, Shigella flexneri 2a str. 301
cgaacccagcaggu

SEQ ID NO: 2027499 - RNA, 24 nt, Shigella flexneri 2a str. 301
cgaaccagccguugucagucauca

SEQ ID NO: 2027500 - RNA, 24 nt, Shigella flexneri 2a str. 301
cgaacauauucgauacauucagaa

SEQ ID NO: 2027501 - RNA, 12 nt, Shigella flexneri 2a str. 301
cgaacaaaacca

SEQ ID NO: 2027502 - RNA, 14 nt, Shigella flexneri 2a str. 301
cgaacaacagauca

SEQ ID NO: 2027503 - RNA, 14 nt, Shigella flexneri 2a str. 301
cgaacaccagcagu

SEQ ID NO: 2027504 - RNA, 18 nt, Shigella flexneri 2a str. 301
cgaacagacaaaaagaau

SEQ ID NO: 2027505 - RNA, 15 nt, Shigella flexneri 2a str. 301
cgaacagcagcaggu

SEQ ID NO: 2027506 - RNA, 22 nt, Shigella flexneri 2a str. 301
cgaacagguugcccagcgcgcc

SEQ ID NO: 2027507 - RNA, 15 nt, Shigella flexneri 2a str. 301
cgaacaggccgacug

SEQ ID NO: 2027508 - RNA, 18 nt, Shigella flexneri 2a str. 301
cgaagucguucagaucuu

SEQ ID NO: 2027509 - RNA, 23 nt, Shigella flexneri 2a str. 301
cgaagucgaugacggcagauuua

SEQ ID NO: 2027510 - RNA, 13 nt, Shigella flexneri 2a str. 301
cgaaggugcauug

SEQ ID NO: 2027511 - RNA, 15 nt, Shigella flexneri 2a str. 301
cgaagguggcggaau

SEQ ID NO: 2027512 - RNA, 21 nt, Shigella flexneri 2a str. 301
cgaagguggcggaauugguag

SEQ ID NO: 2027513 - RNA, 20 nt, Shigella flexneri 2a str. 301
cgaaguauggaaaucaccca

SEQ ID NO: 2027514 - RNA, 16 nt, Shigella flexneri 2a str. 301
cgaagccggacugggc

SEQ ID NO: 2027515 - RNA, 16 nt, Shigella flexneri 2a str. 301
cgaagccucuuacacu

SEQ ID NO: 2027516 - RNA, 11 nt, Shigella flexneri 2a str. 301
cgaagaggggg

SEQ ID NO: 2027517 - RNA, 18 nt, Shigella flexneri 2a str. 301
cgaagauauucaucagcg

SEQ ID NO: 2027518 - RNA, 16 nt, Shigella flexneri 2a str. 301
cgaacgcuaugacgcc

SEQ ID NO: 2027519 - RNA, 16 nt, Shigella flexneri 2a str. 301
cgaacggcuguugaug

SEQ ID NO: 2027520 - RNA, 18 nt, Shigella flexneri 2a str. 301
cgaacgcguucacugccg

SEQ ID NO: 2027521 - RNA, 16 nt, Shigella flexneri 2a str. 301
cgaacgcgcacaggcg

SEQ ID NO: 2027522 - RNA, 13 nt, Shigella flexneri 2a str. 301
ccugacaaaucau

SEQ ID NO: 2027523 - RNA, 22 nt, Shigella flexneri 2a str. 301
ccugacaggcgggaagaacggc

SEQ ID NO: 2027524 - RNA, 13 nt, Shigella flexneri 2a str. 301
ccugaccaccaua

SEQ ID NO: 2027525 - RNA, 14 nt, Shigella flexneri 2a str. 301
ccugaccaccauau

SEQ ID NO: 2027526 - RNA, 17 nt, Shigella flexneri 2a str. 301
ccugaauggugaccugc

SEQ ID NO: 2027527 - RNA, 19 nt, Shigella flexneri 2a str. 301
ccugaauggugaccugcag

SEQ ID NO: 2027528 - RNA, 21 nt, Shigella flexneri 2a str. 301
ccugacaacaaaacgggggcu

SEQ ID NO: 2027529 - RNA, 21 nt, Shigella flexneri 2a str. 301
ccugacaagguacgaaaaaaa

SEQ ID NO: 2027530 - RNA, 20 nt, Shigella flexneri 2a str. 301
ccugaauuugcuccagaaac

SEQ ID NO: 2027531 - RNA, 24 nt, Shigella flexneri 2a str. 301
ccugacgcccguuaccaauaccaa

SEQ ID NO: 2027532 - RNA, 16 nt, Shigella flexneri 2a str. 301
ccugacgcaauaacac

SEQ ID NO: 2027533 - RNA, 19 nt, Shigella flexneri 2a str. 301
ccugaccauuaucaaacag

SEQ ID NO: 2027534 - RNA, 17 nt, Shigella flexneri 2a str. 301
ccugacccagcaaggcg

SEQ ID NO: 2027535 - RNA, 23 nt, Shigella flexneri 2a str. 301
ccugacccagcaccaguaccauu

SEQ ID NO: 2027536 - RNA, 21 nt, Shigella flexneri 2a str. 301
ccugacgagcuuucuuauuug

SEQ ID NO: 2027537 - RNA, 23 nt, Shigella flexneri 2a str. 301
ccugacgaccaaugacagccagc

SEQ ID NO: 2027538 - RNA, 20 nt, Shigella flexneri 2a str. 301
ccugacgaccacccagcauc

SEQ ID NO: 2027539 - RNA, 16 nt, Shigella flexneri 2a str. 301
ccugagucagaaacug

SEQ ID NO: 2027540 - RNA, 21 nt, Shigella flexneri 2a str. 301
ccugauaaaaaccauucaggc

SEQ ID NO: 2027541 - RNA, 16 nt, Shigella flexneri 2a str. 301
ccugauaaucugcuga

SEQ ID NO: 2027542 - RNA, 20 nt, Shigella flexneri 2a str. 301
ccugauaauggcguauuuca

SEQ ID NO: 2027543 - RNA, 23 nt, Shigella flexneri 2a str. 301
ccugagcuggcagaccugcuuug

SEQ ID NO: 2027544 - RNA, 18 nt, Shigella flexneri 2a str. 301
ccugagcgccauaaacag

SEQ ID NO: 2027545 - RNA, 15 nt, Shigella flexneri 2a str. 301
ccugagccggaguug

SEQ ID NO: 2027546 - RNA, 22 nt, Shigella flexneri 2a str. 301
ccugagaauuccggcagagaaa

SEQ ID NO: 2027547 - RNA, 17 nt, Shigella flexneri 2a str. 301
ccucuucuaccacauga

SEQ ID NO: 2027548 - RNA, 16 nt, Shigella flexneri 2a str. 301
ccucuucuuuuagcuc

SEQ ID NO: 2027549 - RNA, 16 nt, Shigella flexneri 2a str. 301
ccucuucacguuuuuc

SEQ ID NO: 2027550 - RNA, 14 nt, Shigella flexneri 2a str. 301
ccucuuacgccgcc

SEQ ID NO: 2027551 - RNA, 16 nt, Shigella flexneri 2a str. 301
ccucuuccacauuuuc

SEQ ID NO: 2027552 - RNA, 20 nt, Shigella flexneri 2a str. 301
ccucuuccauuucaucgcca

SEQ ID NO: 2027553 - RNA, 15 nt, Shigella flexneri 2a str. 301
ccucuucccagaccc

SEQ ID NO: 2027554 - RNA, 20 nt, Shigella flexneri 2a str. 301
ccugaaauguuugcaauaaa

SEQ ID NO: 2027555 - RNA, 18 nt, Shigella flexneri 2a str. 301
ccugaaccgaacuuuuug

SEQ ID NO: 2027556 - RNA, 22 nt, Shigella flexneri 2a str. 301
ccugaaacggaaucgcccgcug

SEQ ID NO: 2027557 - RNA, 21 nt, Shigella flexneri 2a str. 301
ccugaaacgcggcguaaccgc

SEQ ID NO: 2027558 - RNA, 16 nt, Shigella flexneri 2a str. 301
ccucuuuuuucagugc

SEQ ID NO: 2027559 - RNA, 14 nt, Shigella flexneri 2a str. 301
ccugaaaaaacaaa

SEQ ID NO: 2027560 - RNA, 17 nt, Shigella flexneri 2a str. 301
ccugaaaaaacaaauau

SEQ ID NO: 2027561 - RNA, 23 nt, Shigella flexneri 2a str. 301
ccugaauaaugucccccgggcgg

SEQ ID NO: 2027562 - RNA, 13 nt, Shigella flexneri 2a str. 301
ccugaaucaauca

SEQ ID NO: 2027563 - RNA, 18 nt, Shigella flexneri 2a str. 301
ccugaaucaccugauuga

SEQ ID NO: 2027564 - RNA, 20 nt, Shigella flexneri 2a str. 301
ccugaauaaucguaaucagc

SEQ ID NO: 2027565 - RNA, 11 nt, Shigella flexneri 2a str. 301
ccugaauaauc

SEQ ID NO: 2027566 - RNA, 19 nt, Shigella flexneri 2a str. 301
ccugaauaacaccagccag

SEQ ID NO: 2027567 - RNA, 16 nt, Shigella flexneri 2a str. 301
ccugaauaaacgccau

SEQ ID NO: 2027568 - RNA, 12 nt, Shigella flexneri 2a str. 301
ccugaauaaacg

SEQ ID NO: 2027569 - RNA, 22 nt, Shigella flexneri 2a str. 301
ccugaagcaguuucaccagcag

SEQ ID NO: 2027570 - RNA, 15 nt, Shigella flexneri 2a str. 301
ccugaagaugcugca

SEQ ID NO: 2027571 - RNA, 16 nt, Shigella flexneri 2a str. 301
ccugaugcgacgcuug

SEQ ID NO: 2027572 - RNA, 17 nt, Shigella flexneri 2a str. 301
ccugaugcguugcgcuu

SEQ ID NO: 2027573 - RNA, 17 nt, Shigella flexneri 2a str. 301
ccugaugcgcugcgcuu

SEQ ID NO: 2027574 - RNA, 19 nt, Shigella flexneri 2a str. 301
ccugaugcgaugcuugacg

SEQ ID NO: 2027575 - RNA, 18 nt, Shigella flexneri 2a str. 301
ccugaugcgauauguuua

SEQ ID NO: 2027576 - RNA, 16 nt, Shigella flexneri 2a str. 301
ccugaugugacgcuug

SEQ ID NO: 2027577 - RNA, 19 nt, Shigella flexneri 2a str. 301
ccugauuaacgacacucuc

SEQ ID NO: 2027578 - RNA, 19 nt, Shigella flexneri 2a str. 301
ccugauuauugauauccac

SEQ ID NO: 2027579 - RNA, 21 nt, Shigella flexneri 2a str. 301
ccugaugacaugcaaugauuc

SEQ ID NO: 2027580 - RNA, 15 nt, Shigella flexneri 2a str. 301
ccugauccugcaaca

SEQ ID NO: 2027581 - RNA, 17 nt, Shigella flexneri 2a str. 301
ccugauacucucgcucc

SEQ ID NO: 2027582 - RNA, 12 nt, Shigella flexneri 2a str. 301
ccugaucaagca

SEQ ID NO: 2027583 - RNA, 16 nt, Shigella flexneri 2a str. 301
ccugaucaagcacaug

SEQ ID NO: 2027584 - RNA, 16 nt, Shigella flexneri 2a str. 301
ccugaucaugugcagg

SEQ ID NO: 2027585 - RNA, 13 nt, Shigella flexneri 2a str. 301
ccugcaauuccug

SEQ ID NO: 2027586 - RNA, 17 nt, Shigella flexneri 2a str. 301
ccugcaaugucaucagc

SEQ ID NO: 2027587 - RNA, 19 nt, Shigella flexneri 2a str. 301
ccugcacaaauagccagca

SEQ ID NO: 2027588 - RNA, 23 nt, Shigella flexneri 2a str. 301
ccugcaauuuauugauuuugcaa

SEQ ID NO: 2027589 - RNA, 23 nt, Shigella flexneri 2a str. 301
ccugcacaaauagccagcagagc

SEQ ID NO: 2027590 - RNA, 15 nt, Shigella flexneri 2a str. 301
ccugcaaauaaauac

SEQ ID NO: 2027591 - RNA, 16 nt, Shigella flexneri 2a str. 301
ccugcaaaauagucau

SEQ ID NO: 2027592 - RNA, 14 nt, Shigella flexneri 2a str. 301
ccugauugaccgcc

SEQ ID NO: 2027593 - RNA, 15 nt, Shigella flexneri 2a str. 301
ccugcggacagucac

SEQ ID NO: 2027594 - RNA, 14 nt, Shigella flexneri 2a str. 301
ccugcgcuuccagc

SEQ ID NO: 2027595 - RNA, 17 nt, Shigella flexneri 2a str. 301
ccugcgauggugguugc

SEQ ID NO: 2027596 - RNA, 15 nt, Shigella flexneri 2a str. 301
ccugcgccagcgcgc

SEQ ID NO: 2027597 - RNA, 15 nt, Shigella flexneri 2a str. 301
ccugcgccagccagc

SEQ ID NO: 2027598 - RNA, 12 nt, Shigella flexneri 2a str. 301
ccugcagcugcu

SEQ ID NO: 2027599 - RNA, 23 nt, Shigella flexneri 2a str. 301
ccugcauaucgguaaaugcuuua

SEQ ID NO: 2027600 - RNA, 17 nt, Shigella flexneri 2a str. 301
ccugcauugacucgccu

SEQ ID NO: 2027601 - RNA, 22 nt, Shigella flexneri 2a str. 301
ccugcaugcgaaugcagggccg

SEQ ID NO: 2027602 - RNA, 12 nt, Shigella flexneri 2a str. 301
ccugccacauau

SEQ ID NO: 2027603 - RNA, 22 nt, Shigella flexneri 2a str. 301
ccugccggagcgccaccacccu

SEQ ID NO: 2027604 - RNA, 23 nt, Shigella flexneri 2a str. 301
ccucaaacgagggguuuuuuguu

SEQ ID NO: 2027605 - RNA, 16 nt, Shigella flexneri 2a str. 301
ccucaaccccuuccug

SEQ ID NO: 2027606 - RNA, 15 nt, Shigella flexneri 2a str. 301
ccucaagcucgccac

SEQ ID NO: 2027607 - RNA, 13 nt, Shigella flexneri 2a str. 301
ccucaagaaucac

SEQ ID NO: 2027608 - RNA, 16 nt, Shigella flexneri 2a str. 301
ccucacgaucacagca

SEQ ID NO: 2027609 - RNA, 17 nt, Shigella flexneri 2a str. 301
ccucaccuuccacgcgg

SEQ ID NO: 2027610 - RNA, 20 nt, Shigella flexneri 2a str. 301
ccucaguacccgcguucugg

SEQ ID NO: 2027611 - RNA, 12 nt, Shigella flexneri 2a str. 301
ccgugauucacg

SEQ ID NO: 2027612 - RNA, 18 nt, Shigella flexneri 2a str. 301
ccgugccgcuaauggugc

SEQ ID NO: 2027613 - RNA, 21 nt, Shigella flexneri 2a str. 301
ccgugaugcgcaagggucguc

SEQ ID NO: 2027614 - RNA, 15 nt, Shigella flexneri 2a str. 301
ccuaucuucauggag

SEQ ID NO: 2027615 - RNA, 16 nt, Shigella flexneri 2a str. 301
ccucccucgaagccgu

SEQ ID NO: 2027616 - RNA, 17 nt, Shigella flexneri 2a str. 301
ccucccgguaggugagg

SEQ ID NO: 2027617 - RNA, 14 nt, Shigella flexneri 2a str. 301
ccuccagcuccucg

SEQ ID NO: 2027618 - RNA, 13 nt, Shigella flexneri 2a str. 301
ccucccccugagc

SEQ ID NO: 2027619 - RNA, 22 nt, Shigella flexneri 2a str. 301
ccuccagcgagcuggcgcugau

SEQ ID NO: 2027620 - RNA, 15 nt, Shigella flexneri 2a str. 301
ccuccagcuccgcca

SEQ ID NO: 2027621 - RNA, 15 nt, Shigella flexneri 2a str. 301
ccucauucaccaguu

SEQ ID NO: 2027622 - RNA, 18 nt, Shigella flexneri 2a str. 301
ccucauuucccuguugcc

SEQ ID NO: 2027623 - RNA, 17 nt, Shigella flexneri 2a str. 301
aaacgcagucuucccag

SEQ ID NO: 2027624 - RNA, 14 nt, Shigella flexneri 2a str. 301
ccucaguugucuga

SEQ ID NO: 2027625 - RNA, 12 nt, Shigella flexneri 2a str. 301
ccuccugcagcg

SEQ ID NO: 2027626 - RNA, 14 nt, Shigella flexneri 2a str. 301
ccucgcccgcagaa

SEQ ID NO: 2027627 - RNA, 18 nt, Shigella flexneri 2a str. 301
ccucgcccauuuuucaug

SEQ ID NO: 2027628 - RNA, 14 nt, Shigella flexneri 2a str. 301
ccucgccccuccgg

SEQ ID NO: 2027629 - RNA, 19 nt, Shigella flexneri 2a str. 301
ccucgcguccgcguccgcu

SEQ ID NO: 2027630 - RNA, 22 nt, Shigella flexneri 2a str. 301
ccucgcgcguccacggugcgac

SEQ ID NO: 2027631 - RNA, 17 nt, Shigella flexneri 2a str. 301
ccucugcgcccagcaac

SEQ ID NO: 2027632 - RNA, 15 nt, Shigella flexneri 2a str. 301
ccucugcgcccagca

SEQ ID NO: 2027633 - RNA, 12 nt, Shigella flexneri 2a str. 301
ccucucuucgcu

SEQ ID NO: 2027634 - RNA, 15 nt, Shigella flexneri 2a str. 301
ccucuccccagcgga

SEQ ID NO: 2027635 - RNA, 21 nt, Shigella flexneri 2a str. 301
ccucuccccgaaggggcgagg

SEQ ID NO: 2027636 - RNA, 18 nt, Shigella flexneri 2a str. 301
ccucuaucuguuugccag

SEQ ID NO: 2027637 - RNA, 15 nt, Shigella flexneri 2a str. 301
ccucucagaaagggg

SEQ ID NO: 2027638 - RNA, 23 nt, Shigella flexneri 2a str. 301
ccucucaugagcagaccaauaac

SEQ ID NO: 2027639 - RNA, 16 nt, Shigella flexneri 2a str. 301
ccucgucccaaaagcu

SEQ ID NO: 2027640 - RNA, 15 nt, Shigella flexneri 2a str. 301
ccucguuuugccgcc

SEQ ID NO: 2027641 - RNA, 17 nt, Shigella flexneri 2a str. 301
ccucuaacucuucugaa

SEQ ID NO: 2027642 - RNA, 14 nt, Shigella flexneri 2a str. 301
ccucuaacagauca

SEQ ID NO: 2027643 - RNA, 12 nt, Shigella flexneri 2a str. 301
ccgcgccagcgg

SEQ ID NO: 2027644 - RNA, 15 nt, Shigella flexneri 2a str. 301
ccgcgccaaugccug

SEQ ID NO: 2027645 - RNA, 21 nt, Shigella flexneri 2a str. 301
ccgcgcaguaccacuucaucc

SEQ ID NO: 2027646 - RNA, 21 nt, Shigella flexneri 2a str. 301
ccgcgcagggacacucgcuga

SEQ ID NO: 2027647 - RNA, 16 nt, Shigella flexneri 2a str. 301
ccgcgcaggaugcaga

SEQ ID NO: 2027648 - RNA, 21 nt, Shigella flexneri 2a str. 301
ccgcgcaaucgcccagcgcgu

SEQ ID NO: 2027649 - RNA, 15 nt, Shigella flexneri 2a str. 301
ccgcgaucuuccacg

SEQ ID NO: 2027650 - RNA, 15 nt, Shigella flexneri 2a str. 301
ccgcgaguaaucaca

SEQ ID NO: 2027651 - RNA, 19 nt, Shigella flexneri 2a str. 301
ccgcgacugggaggacagc

SEQ ID NO: 2027652 - RNA, 20 nt, Shigella flexneri 2a str. 301
ccgcgacgacgacaggcaag

SEQ ID NO: 2027653 - RNA, 18 nt, Shigella flexneri 2a str. 301
ccgcgaauuaugcagccu

SEQ ID NO: 2027654 - RNA, 14 nt, Shigella flexneri 2a str. 301
ccgcgaccaccacc

SEQ ID NO: 2027655 - RNA, 13 nt, Shigella flexneri 2a str. 301
ccgcagccgccac

SEQ ID NO: 2027656 - RNA, 15 nt, Shigella flexneri 2a str. 301
ccgcagccgccagaa

SEQ ID NO: 2027657 - RNA, 20 nt, Shigella flexneri 2a str. 301
ccgcagcgauugucagcugg

SEQ ID NO: 2027658 - RNA, 15 nt, Shigella flexneri 2a str. 301
ccgcagccaucacca

SEQ ID NO: 2027659 - RNA, 14 nt, Shigella flexneri 2a str. 301
ccgcagccaucagc

SEQ ID NO: 2027660 - RNA, 21 nt, Shigella flexneri 2a str. 301
ccgccugaugggcgaagagaa

SEQ ID NO: 2027661 - RNA, 17 nt, Shigella flexneri 2a str. 301
ccgccugagccagugcc

SEQ ID NO: 2027662 - RNA, 19 nt, Shigella flexneri 2a str. 301
ccgcgaaccggaccagcaa

SEQ ID NO: 2027663 - RNA, 21 nt, Shigella flexneri 2a str. 301
ccgcgaaccggaccagcaaca

SEQ ID NO: 2027664 - RNA, 16 nt, Shigella flexneri 2a str. 301
ccgccuuucacgccgg

SEQ ID NO: 2027665 - RNA, 12 nt, Shigella flexneri 2a str. 301
ccgccuugcugu

SEQ ID NO: 2027666 - RNA, 13 nt, Shigella flexneri 2a str. 301
ccgccuguugccc

SEQ ID NO: 2027667 - RNA, 15 nt, Shigella flexneri 2a str. 301
ccgccuguugcccuu

SEQ ID NO: 2027668 - RNA, 22 nt, Shigella flexneri 2a str. 301
ccgcgccgugcaacugcggcgc

SEQ ID NO: 2027669 - RNA, 19 nt, Shigella flexneri 2a str. 301
aaacccugccgucugggca

SEQ ID NO: 2027670 - RNA, 13 nt, Shigella flexneri 2a str. 301
aaacccugcguca

SEQ ID NO: 2027671 - RNA, 21 nt, Shigella flexneri 2a str. 301
aaacccgugugguaaaguuug

SEQ ID NO: 2027672 - RNA, 17 nt, Shigella flexneri 2a str. 301
ccgcgcggcgcaggcgc

SEQ ID NO: 2027673 - RNA, 20 nt, Shigella flexneri 2a str. 301
ccgcgccuucgugcggcugc

SEQ ID NO: 2027674 - RNA, 23 nt, Shigella flexneri 2a str. 301
ccgcgcggguggugcguaccagg

SEQ ID NO: 2027675 - RNA, 23 nt, Shigella flexneri 2a str. 301
aaaccgcaccguauugcgccggu

SEQ ID NO: 2027676 - RNA, 20 nt, Shigella flexneri 2a str. 301
aaaccgaugcagugcggcug

SEQ ID NO: 2027677 - RNA, 13 nt, Shigella flexneri 2a str. 301
aaaccgacugccu

SEQ ID NO: 2027678 - RNA, 23 nt, Shigella flexneri 2a str. 301
aaaccgaaguuguagcuggcuuc

SEQ ID NO: 2027679 - RNA, 14 nt, Shigella flexneri 2a str. 301
aaaccgaccaauca

SEQ ID NO: 2027680 - RNA, 15 nt, Shigella flexneri 2a str. 301
ccgcgcuugccgccg

SEQ ID NO: 2027681 - RNA, 17 nt, Shigella flexneri 2a str. 301
ccgcgcugucgggcagc

SEQ ID NO: 2027682 - RNA, 22 nt, Shigella flexneri 2a str. 301
ccgcgcugcuguagcaguucca

SEQ ID NO: 2027683 - RNA, 19 nt, Shigella flexneri 2a str. 301
ccgcgcuuucuggcgcaga

SEQ ID NO: 2027684 - RNA, 21 nt, Shigella flexneri 2a str. 301
ccgcguaaacgugcggcugug

SEQ ID NO: 2027685 - RNA, 18 nt, Shigella flexneri 2a str. 301
ccgcgucauugacgcugg

SEQ ID NO: 2027686 - RNA, 22 nt, Shigella flexneri 2a str. 301
ccgcgggcgaauuaucggcagc

SEQ ID NO: 2027687 - RNA, 17 nt, Shigella flexneri 2a str. 301
ccgcggcucaggcgcac

SEQ ID NO: 2027688 - RNA, 16 nt, Shigella flexneri 2a str. 301
ccgcgugcgcggcagc

SEQ ID NO: 2027689 - RNA, 16 nt, Shigella flexneri 2a str. 301
ccgcguugcagcauau

SEQ ID NO: 2027690 - RNA, 14 nt, Shigella flexneri 2a str. 301
ccgcguugcagcau

SEQ ID NO: 2027691 - RNA, 20 nt, Shigella flexneri 2a str. 301
ccgcuaacugguggcaggaa

SEQ ID NO: 2027692 - RNA, 15 nt, Shigella flexneri 2a str. 301
ccgcuaacagcagca

SEQ ID NO: 2027693 - RNA, 15 nt, Shigella flexneri 2a str. 301
ccgcuaccgcccuga

SEQ ID NO: 2027694 - RNA, 13 nt, Shigella flexneri 2a str. 301
ccgcuacuggcaa

SEQ ID NO: 2027695 - RNA, 19 nt, Shigella flexneri 2a str. 301
ccgcuaccugccgccacca

SEQ ID NO: 2027696 - RNA, 15 nt, Shigella flexneri 2a str. 301
ccgcuaccugccgcc

SEQ ID NO: 2027697 - RNA, 19 nt, Shigella flexneri 2a str. 301
ccgcucacgcagcggcggc

SEQ ID NO: 2027698 - RNA, 11 nt, Shigella flexneri 2a str. 301
ccgcucaaaca

SEQ ID NO: 2027699 - RNA, 23 nt, Shigella flexneri 2a str. 301
ccgcuaucguccacgucaucaaa

SEQ ID NO: 2027700 - RNA, 23 nt, Shigella flexneri 2a str. 301
ccgcuauuauaucgcucucuuua

SEQ ID NO: 2027701 - RNA, 15 nt, Shigella flexneri 2a str. 301
ccgcucgaaguuuuc

SEQ ID NO: 2027702 - RNA, 16 nt, Shigella flexneri 2a str. 301
ccgcuucugcagcuuu

SEQ ID NO: 2027703 - RNA, 13 nt, Shigella flexneri 2a str. 301
ccgcuucugcuuu

SEQ ID NO: 2027704 - RNA, 14 nt, Shigella flexneri 2a str. 301
ccgcuucugcuuug

SEQ ID NO: 2027705 - RNA, 14 nt, Shigella flexneri 2a str. 301
ccgcuucugcagcu

SEQ ID NO: 2027706 - RNA, 15 nt, Shigella flexneri 2a str. 301
ccgcuucguuuucag

SEQ ID NO: 2027707 - RNA, 20 nt, Shigella flexneri 2a str. 301
ccgcuguaauaccagccuuc

SEQ ID NO: 2027708 - RNA, 22 nt, Shigella flexneri 2a str. 301
ccgcuugaguauuuaccagaau

SEQ ID NO: 2027709 - RNA, 23 nt, Shigella flexneri 2a str. 301
ccggaacaggcagggccaccagc

SEQ ID NO: 2027710 - RNA, 14 nt, Shigella flexneri 2a str. 301
ccggaacccaccgc

SEQ ID NO: 2027711 - RNA, 15 nt, Shigella flexneri 2a str. 301
ccggacugaaaguac

SEQ ID NO: 2027712 - RNA, 15 nt, Shigella flexneri 2a str. 301
ccggagaagcguagg

SEQ ID NO: 2027713 - RNA, 17 nt, Shigella flexneri 2a str. 301
ccggagacaaacagggu

SEQ ID NO: 2027714 - RNA, 14 nt, Shigella flexneri 2a str. 301
ccggagcgccacca

SEQ ID NO: 2027715 - RNA, 16 nt, Shigella flexneri 2a str. 301
ccggagcgccaccacc

SEQ ID NO: 2027716 - RNA, 13 nt, Shigella flexneri 2a str. 301
ccggaauaaugau

SEQ ID NO: 2027717 - RNA, 22 nt, Shigella flexneri 2a str. 301
ccgcucugcgaucugcgcguca

SEQ ID NO: 2027718 - RNA, 21 nt, Shigella flexneri 2a str. 301
ccgcucuucauacgcggcaga

SEQ ID NO: 2027719 - RNA, 22 nt, Shigella flexneri 2a str. 301
ccgcucucaaucucuuuuucca

SEQ ID NO: 2027720 - RNA, 18 nt, Shigella flexneri 2a str. 301
ccgcugaugcaacgucaa

SEQ ID NO: 2027721 - RNA, 14 nt, Shigella flexneri 2a str. 301
ccgcugagacgcgc

SEQ ID NO: 2027722 - RNA, 21 nt, Shigella flexneri 2a str. 301
ccgcugcuucucuucagccaa

SEQ ID NO: 2027723 - RNA, 21 nt, Shigella flexneri 2a str. 301
ccgcuggagcggggaacaccu

SEQ ID NO: 2027724 - RNA, 16 nt, Shigella flexneri 2a str. 301
ccgcuggcgucugggc

SEQ ID NO: 2027725 - RNA, 22 nt, Shigella flexneri 2a str. 301
ccgcuggcgcgguucccucauc

SEQ ID NO: 2027726 - RNA, 23 nt, Shigella flexneri 2a str. 301
ccgcuggcgcgguucccucaucu

SEQ ID NO: 2027727 - RNA, 11 nt, Shigella flexneri 2a str. 301
ccgcugccgcu

SEQ ID NO: 2027728 - RNA, 16 nt, Shigella flexneri 2a str. 301
aaaccugauuacgcac

SEQ ID NO: 2027729 - RNA, 17 nt, Shigella flexneri 2a str. 301
aaaccugacaacaaaac

SEQ ID NO: 2027730 - RNA, 15 nt, Shigella flexneri 2a str. 301
aaaccugacaacaaa

SEQ ID NO: 2027731 - RNA, 15 nt, Shigella flexneri 2a str. 301
aaaccucacgcaucc

SEQ ID NO: 2027732 - RNA, 17 nt, Shigella flexneri 2a str. 301
aaaccuccagcaucaga

SEQ ID NO: 2027733 - RNA, 21 nt, Shigella flexneri 2a str. 301
ccggggagauauuccccagac

SEQ ID NO: 2027734 - RNA, 21 nt, Shigella flexneri 2a str. 301
ccggggccucuuacgccgcca

SEQ ID NO: 2027735 - RNA, 18 nt, Shigella flexneri 2a str. 301
aaaccgggagaacauugg

SEQ ID NO: 2027736 - RNA, 17 nt, Shigella flexneri 2a str. 301
aaaccgucagcaccagg

SEQ ID NO: 2027737 - RNA, 23 nt, Shigella flexneri 2a str. 301
aaaccguaaguaagauaaaagca

SEQ ID NO: 2027738 - RNA, 14 nt, Shigella flexneri 2a str. 301
ccggcggcacagcc

SEQ ID NO: 2027739 - RNA, 17 nt, Shigella flexneri 2a str. 301
aaaccggauacccugcc

SEQ ID NO: 2027740 - RNA, 13 nt, Shigella flexneri 2a str. 301
aaaccgcugggca

SEQ ID NO: 2027741 - RNA, 19 nt, Shigella flexneri 2a str. 301
ccgggaaauccucaaccgg

SEQ ID NO: 2027742 - RNA, 22 nt, Shigella flexneri 2a str. 301
ccggcugaggcguuucaacucc

SEQ ID NO: 2027743 - RNA, 16 nt, Shigella flexneri 2a str. 301
ccggcuuaccgcuccg

SEQ ID NO: 2027744 - RNA, 18 nt, Shigella flexneri 2a str. 301
ccggcuuaaugcauggca

SEQ ID NO: 2027745 - RNA, 20 nt, Shigella flexneri 2a str. 301
ccggcgacguauugcgcaga

SEQ ID NO: 2027746 - RNA, 19 nt, Shigella flexneri 2a str. 301
ccggcgcaguaugacuaca

SEQ ID NO: 2027747 - RNA, 19 nt, Shigella flexneri 2a str. 301
ccggccuaccguucaggca

SEQ ID NO: 2027748 - RNA, 16 nt, Shigella flexneri 2a str. 301
ccggccagcgccacca

SEQ ID NO: 2027749 - RNA, 14 nt, Shigella flexneri 2a str. 301
ccggccauuccagc

SEQ ID NO: 2027750 - RNA, 12 nt, Shigella flexneri 2a str. 301
ccggccagagca

SEQ ID NO: 2027751 - RNA, 22 nt, Shigella flexneri 2a str. 301
ccggauaaauuuaaaacugccu

SEQ ID NO: 2027752 - RNA, 22 nt, Shigella flexneri 2a str. 301
ccggauaaggcauuuacgccgc

SEQ ID NO: 2027753 - RNA, 22 nt, Shigella flexneri 2a str. 301
ccggauaaggcguuuacgccgc

SEQ ID NO: 2027754 - RNA, 17 nt, Shigella flexneri 2a str. 301
ccggagcggacugcugc

SEQ ID NO: 2027755 - RNA, 22 nt, Shigella flexneri 2a str. 301
ccggucuaccgauccggcacca

SEQ ID NO: 2027756 - RNA, 21 nt, Shigella flexneri 2a str. 301
ccggucugguguaucugcugu

SEQ ID NO: 2027757 - RNA, 19 nt, Shigella flexneri 2a str. 301
ccgucacaggcacaccgcc

SEQ ID NO: 2027758 - RNA, 21 nt, Shigella flexneri 2a str. 301
ccgucacaggcacaccgccgc

SEQ ID NO: 2027759 - RNA, 17 nt, Shigella flexneri 2a str. 301
ccguauuacugagaugg

SEQ ID NO: 2027760 - RNA, 16 nt, Shigella flexneri 2a str. 301
ccguauaauaucuuuu

SEQ ID NO: 2027761 - RNA, 20 nt, Shigella flexneri 2a str. 301
ccguaaagcccauaccacag

SEQ ID NO: 2027762 - RNA, 16 nt, Shigella flexneri 2a str. 301
ccguaagcgccccgag

SEQ ID NO: 2027763 - RNA, 20 nt, Shigella flexneri 2a str. 301
ccgguuugcgccgugcgaau

SEQ ID NO: 2027764 - RNA, 22 nt, Shigella flexneri 2a str. 301
ccgguuucgugaaacucagcau

SEQ ID NO: 2027765 - RNA, 16 nt, Shigella flexneri 2a str. 301
ccgguuuugguuuucu

SEQ ID NO: 2027766 - RNA, 12 nt, Shigella flexneri 2a str. 301
ccguaaaaaaug

SEQ ID NO: 2027767 - RNA, 19 nt, Shigella flexneri 2a str. 301
ccguacaaagugccgccag

SEQ ID NO: 2027768 - RNA, 19 nt, Shigella flexneri 2a str. 301
ccguacaggcagcuuagaa

SEQ ID NO: 2027769 - RNA, 14 nt, Shigella flexneri 2a str. 301
ccguacugcauaau

SEQ ID NO: 2027770 - RNA, 21 nt, Shigella flexneri 2a str. 301
ccguaccgguaaaccuggugu

SEQ ID NO: 2027771 - RNA, 22 nt, Shigella flexneri 2a str. 301
ccguaccaucguaagcgccagg

SEQ ID NO: 2027772 - RNA, 16 nt, Shigella flexneri 2a str. 301
ccgucccuaccgguaa

SEQ ID NO: 2027773 - RNA, 13 nt, Shigella flexneri 2a str. 301
ccguccccucgcc

SEQ ID NO: 2027774 - RNA, 14 nt, Shigella flexneri 2a str. 301
ccguccccucgccc

SEQ ID NO: 2027775 - RNA, 15 nt, Shigella flexneri 2a str. 301
ccguccggcaucgca

SEQ ID NO: 2027776 - RNA, 12 nt, Shigella flexneri 2a str. 301
ccgucgcauggg

SEQ ID NO: 2027777 - RNA, 18 nt, Shigella flexneri 2a str. 301
aaacgauuaauuacacag

SEQ ID NO: 2027778 - RNA, 16 nt, Shigella flexneri 2a str. 301
ccgucuucccgcagcc

SEQ ID NO: 2027779 - RNA, 17 nt, Shigella flexneri 2a str. 301
ccgucuucccgcagcca

SEQ ID NO: 2027780 - RNA, 18 nt, Shigella flexneri 2a str. 301
ccgugaacguggccauga

SEQ ID NO: 2027781 - RNA, 14 nt, Shigella flexneri 2a str. 301
ccgucuuuuuucac

SEQ ID NO: 2027782 - RNA, 16 nt, Shigella flexneri 2a str. 301
aaacgaaucugcaaau

SEQ ID NO: 2027783 - RNA, 16 nt, Shigella flexneri 2a str. 301
aaacgaaccauaaaau

SEQ ID NO: 2027784 - RNA, 14 nt, Shigella flexneri 2a str. 301
aaacgaaagcaggg

SEQ ID NO: 2027785 - RNA, 22 nt, Shigella flexneri 2a str. 301
aaaccuuagguugugaucaucc

SEQ ID NO: 2027786 - RNA, 20 nt, Shigella flexneri 2a str. 301
aaaccuuagguugugaucau

SEQ ID NO: 2027787 - RNA, 15 nt, Shigella flexneri 2a str. 301
ccgucaugccgguaa

SEQ ID NO: 2027788 - RNA, 17 nt, Shigella flexneri 2a str. 301
ccgucaccggcacaaag

SEQ ID NO: 2027789 - RNA, 16 nt, Shigella flexneri 2a str. 301
ccgucaccccugugga

SEQ ID NO: 2027790 - RNA, 23 nt, Shigella flexneri 2a str. 301
ccgucaccauugguugcgcuucu

SEQ ID NO: 2027791 - RNA, 11 nt, Shigella flexneri 2a str. 301
ccgucagccgc

SEQ ID NO: 2027792 - RNA, 14 nt, Shigella flexneri 2a str. 301
ccgucagccacucc

SEQ ID NO: 2027793 - RNA, 16 nt, Shigella flexneri 2a str. 301
ccgucagaccaccggu

SEQ ID NO: 2027794 - RNA, 14 nt, Shigella flexneri 2a str. 301
ccgucagcaaaaua

SEQ ID NO: 2027795 - RNA, 20 nt, Shigella flexneri 2a str. 301
ccgucagccugacggaucug

SEQ ID NO: 2027796 - RNA, 16 nt, Shigella flexneri 2a str. 301
ccgucagcgcaugauu

SEQ ID NO: 2027797 - RNA, 15 nt, Shigella flexneri 2a str. 301
cgcgacuuuuuccug

SEQ ID NO: 2027798 - RNA, 17 nt, Shigella flexneri 2a str. 301
cgcgauaaaaucccaua

SEQ ID NO: 2027799 - RNA, 19 nt, Shigella flexneri 2a str. 301
cgccuuuuuucgccgcagc

SEQ ID NO: 2027800 - RNA, 12 nt, Shigella flexneri 2a str. 301
cgcgaccgccgc

SEQ ID NO: 2027801 - RNA, 16 nt, Shigella flexneri 2a str. 301
cgccugcggccagcag

SEQ ID NO: 2027802 - RNA, 14 nt, Shigella flexneri 2a str. 301
cgccugcggccagc

SEQ ID NO: 2027803 - RNA, 15 nt, Shigella flexneri 2a str. 301
cgccugcggcuucca

SEQ ID NO: 2027804 - RNA, 13 nt, Shigella flexneri 2a str. 301
cgccuguugcguc

SEQ ID NO: 2027805 - RNA, 17 nt, Shigella flexneri 2a str. 301
cgccugucaccgccucc

SEQ ID NO: 2027806 - RNA, 22 nt, Shigella flexneri 2a str. 301
cgccuuuaauauuaacgccagc

SEQ ID NO: 2027807 - RNA, 19 nt, Shigella flexneri 2a str. 301
cgccuuucuuaaacuucac

SEQ ID NO: 2027808 - RNA, 15 nt, Shigella flexneri 2a str. 301
cgccuugcgcgcagu

SEQ ID NO: 2027809 - RNA, 13 nt, Shigella flexneri 2a str. 301
cgccuucuugaac

SEQ ID NO: 2027810 - RNA, 16 nt, Shigella flexneri 2a str. 301
cgccuuauccgcccua

SEQ ID NO: 2027811 - RNA, 17 nt, Shigella flexneri 2a str. 301
cgccuucugcgccgccu

SEQ ID NO: 2027812 - RNA, 16 nt, Shigella flexneri 2a str. 301
cgccuucuacagcuuc

SEQ ID NO: 2027813 - RNA, 21 nt, Shigella flexneri 2a str. 301
cgcgccccacggauugccgcu

SEQ ID NO: 2027814 - RNA, 14 nt, Shigella flexneri 2a str. 301
cgcgccccacugga

SEQ ID NO: 2027815 - RNA, 13 nt, Shigella flexneri 2a str. 301
cgcgcccuccugc

SEQ ID NO: 2027816 - RNA, 17 nt, Shigella flexneri 2a str. 301
cgcgcccuccugcagcg

SEQ ID NO: 2027817 - RNA, 13 nt, Shigella flexneri 2a str. 301
cgcgcccgcgcag

SEQ ID NO: 2027818 - RNA, 17 nt, Shigella flexneri 2a str. 301
cgcgccaaucagcgcag

SEQ ID NO: 2027819 - RNA, 18 nt, Shigella flexneri 2a str. 301
cgcgccaaucagcgcagc

SEQ ID NO: 2027820 - RNA, 21 nt, Shigella flexneri 2a str. 301
cgcgccaaucagcgcagcacc

SEQ ID NO: 2027821 - RNA, 22 nt, Shigella flexneri 2a str. 301
cgcgccauuucggcgugcuguc

SEQ ID NO: 2027822 - RNA, 21 nt, Shigella flexneri 2a str. 301
cgcgccauuucggcgugcugu

SEQ ID NO: 2027823 - RNA, 18 nt, Shigella flexneri 2a str. 301
cgcgcccauacggcucag

SEQ ID NO: 2027824 - RNA, 21 nt, Shigella flexneri 2a str. 301
cgcgcaggaucgacugcaaac

SEQ ID NO: 2027825 - RNA, 22 nt, Shigella flexneri 2a str. 301
cgcgcagggugcagaaucaauc

SEQ ID NO: 2027826 - RNA, 22 nt, Shigella flexneri 2a str. 301
cgcgcaggcggauugcuucugc

SEQ ID NO: 2027827 - RNA, 22 nt, Shigella flexneri 2a str. 301
cgcgcagugccgguggaagggc

SEQ ID NO: 2027828 - RNA, 18 nt, Shigella flexneri 2a str. 301
cgcgcacgucagccucgc

SEQ ID NO: 2027829 - RNA, 20 nt, Shigella flexneri 2a str. 301
cgcgcacucgcccugaccug

SEQ ID NO: 2027830 - RNA, 13 nt, Shigella flexneri 2a str. 301
cgcgcagcuucac

SEQ ID NO: 2027831 - RNA, 15 nt, Shigella flexneri 2a str. 301
cgcgcaccuacagcc

SEQ ID NO: 2027832 - RNA, 14 nt, Shigella flexneri 2a str. 301
cgcgcaaacaguga

SEQ ID NO: 2027833 - RNA, 15 nt, Shigella flexneri 2a str. 301
cgcgcaaauccacgu

SEQ ID NO: 2027834 - RNA, 13 nt, Shigella flexneri 2a str. 301
cgcgaucgcgcca

SEQ ID NO: 2027835 - RNA, 19 nt, Shigella flexneri 2a str. 301
cgcgaucgcugagcuccug

SEQ ID NO: 2027836 - RNA, 20 nt, Shigella flexneri 2a str. 301
cgcgguguugauacaggcgc

SEQ ID NO: 2027837 - RNA, 17 nt, Shigella flexneri 2a str. 301
cgcgguaaacugcauga

SEQ ID NO: 2027838 - RNA, 15 nt, Shigella flexneri 2a str. 301
cgcgguaaaagccca

SEQ ID NO: 2027839 - RNA, 14 nt, Shigella flexneri 2a str. 301
cgcgguaucaccac

SEQ ID NO: 2027840 - RNA, 13 nt, Shigella flexneri 2a str. 301
cgcgguagcgggc

SEQ ID NO: 2027841 - RNA, 21 nt, Shigella flexneri 2a str. 301
cgcgguaaagcgcggcaguga

SEQ ID NO: 2027842 - RNA, 23 nt, Shigella flexneri 2a str. 301
cgcgguaagaguaaagcccgcca

SEQ ID NO: 2027843 - RNA, 17 nt, Shigella flexneri 2a str. 301
cgcggucagcugcuguu

SEQ ID NO: 2027844 - RNA, 19 nt, Shigella flexneri 2a str. 301
cgcguaugguuuuuccagc

SEQ ID NO: 2027845 - RNA, 16 nt, Shigella flexneri 2a str. 301
cgcguacacuuuccug

SEQ ID NO: 2027846 - RNA, 14 nt, Shigella flexneri 2a str. 301
cgcguaccgcagca

SEQ ID NO: 2027847 - RNA, 13 nt, Shigella flexneri 2a str. 301
cgcguaccgccga

SEQ ID NO: 2027848 - RNA, 17 nt, Shigella flexneri 2a str. 301
cgcguagagaauccagu

SEQ ID NO: 2027849 - RNA, 13 nt, Shigella flexneri 2a str. 301
cgcguaacugcug

SEQ ID NO: 2027850 - RNA, 17 nt, Shigella flexneri 2a str. 301
cgcguaaugcuucuacc

SEQ ID NO: 2027851 - RNA, 17 nt, Shigella flexneri 2a str. 301
cgcguuacccauucaag

SEQ ID NO: 2027852 - RNA, 17 nt, Shigella flexneri 2a str. 301
cgcguggugagugugcu

SEQ ID NO: 2027853 - RNA, 15 nt, Shigella flexneri 2a str. 301
cgcguuucugcgcuu

SEQ ID NO: 2027854 - RNA, 16 nt, Shigella flexneri 2a str. 301
cgcgucuuaucuggcc

SEQ ID NO: 2027855 - RNA, 15 nt, Shigella flexneri 2a str. 301
cgcgugacagccuug

SEQ ID NO: 2027856 - RNA, 19 nt, Shigella flexneri 2a str. 301
cgcgucggcgucagcgcca

SEQ ID NO: 2027857 - RNA, 20 nt, Shigella flexneri 2a str. 301
cgcggguaaguacgccauca

SEQ ID NO: 2027858 - RNA, 20 nt, Shigella flexneri 2a str. 301
cgcggcgaaggugccugccc

SEQ ID NO: 2027859 - RNA, 21 nt, Shigella flexneri 2a str. 301
cgcggcagccaccgccagcgg

SEQ ID NO: 2027860 - RNA, 22 nt, Shigella flexneri 2a str. 301
cgcggcaauuagcggccagcgg

SEQ ID NO: 2027861 - RNA, 20 nt, Shigella flexneri 2a str. 301
cgcggcauuaccggcaaugu

SEQ ID NO: 2027862 - RNA, 13 nt, Shigella flexneri 2a str. 301
cgcggagcgccug

SEQ ID NO: 2027863 - RNA, 19 nt, Shigella flexneri 2a str. 301
cgcgcuuaucgccagcgcc

SEQ ID NO: 2027864 - RNA, 16 nt, Shigella flexneri 2a str. 301
cgcgcuuaacgcgggc

SEQ ID NO: 2027865 - RNA, 16 nt, Shigella flexneri 2a str. 301
cgcgcugucgggcagc

SEQ ID NO: 2027866 - RNA, 22 nt, Shigella flexneri 2a str. 301
cgcgcuucgguguuaaaacgca

SEQ ID NO: 2027867 - RNA, 17 nt, Shigella flexneri 2a str. 301
cgcgcuucagucgccag

SEQ ID NO: 2027868 - RNA, 22 nt, Shigella flexneri 2a str. 301
cgcccgaugcauaauccgccgc

SEQ ID NO: 2027869 - RNA, 11 nt, Shigella flexneri 2a str. 301
cgcccgccaga

SEQ ID NO: 2027870 - RNA, 20 nt, Shigella flexneri 2a str. 301
cgcccgaccaucgccagcuc

SEQ ID NO: 2027871 - RNA, 22 nt, Shigella flexneri 2a str. 301
cgcccgaaugcgaaaauccuca

SEQ ID NO: 2027872 - RNA, 15 nt, Shigella flexneri 2a str. 301
cgccccggcacuuaa

SEQ ID NO: 2027873 - RNA, 19 nt, Shigella flexneri 2a str. 301
cgccccacagacccaggua

SEQ ID NO: 2027874 - RNA, 20 nt, Shigella flexneri 2a str. 301
cgccccacaaacccgccaga

SEQ ID NO: 2027875 - RNA, 13 nt, Shigella flexneri 2a str. 301
cgccccaacacaa

SEQ ID NO: 2027876 - RNA, 12 nt, Shigella flexneri 2a str. 301
cgcccagugcgg

SEQ ID NO: 2027877 - RNA, 18 nt, Shigella flexneri 2a str. 301
cgcccaguugaucaccag

SEQ ID NO: 2027878 - RNA, 15 nt, Shigella flexneri 2a str. 301
cgcccaguucuacaa

SEQ ID NO: 2027879 - RNA, 13 nt, Shigella flexneri 2a str. 301
cgcccagcgcagg

SEQ ID NO: 2027880 - RNA, 17 nt, Shigella flexneri 2a str. 301
cgccacgccgaggccaa

SEQ ID NO: 2027881 - RNA, 16 nt, Shigella flexneri 2a str. 301
cgccaucuggcugacg

SEQ ID NO: 2027882 - RNA, 18 nt, Shigella flexneri 2a str. 301
cgccauggcuucucgcca

SEQ ID NO: 2027883 - RNA, 17 nt, Shigella flexneri 2a str. 301
cgccgccaaucacgccc

SEQ ID NO: 2027884 - RNA, 23 nt, Shigella flexneri 2a str. 301
cgccgccagucgaauggcaucua

SEQ ID NO: 2027885 - RNA, 18 nt, Shigella flexneri 2a str. 301
cgccgcauaguaagccgg

SEQ ID NO: 2027886 - RNA, 22 nt, Shigella flexneri 2a str. 301
cgccgcauagcgacaggcuuuc

SEQ ID NO: 2027887 - RNA, 15 nt, Shigella flexneri 2a str. 301
cgccgcauccaacau

SEQ ID NO: 2027888 - RNA, 19 nt, Shigella flexneri 2a str. 301
cgccgcauccgacacuggc

SEQ ID NO: 2027889 - RNA, 16 nt, Shigella flexneri 2a str. 301
cgccgcaucguccugc

SEQ ID NO: 2027890 - RNA, 20 nt, Shigella flexneri 2a str. 301
cgccgcaucguccugcgcag

SEQ ID NO: 2027891 - RNA, 15 nt, Shigella flexneri 2a str. 301
cgccgcauccggcau

SEQ ID NO: 2027892 - RNA, 16 nt, Shigella flexneri 2a str. 301
cgccgagcaaaccaca

SEQ ID NO: 2027893 - RNA, 16 nt, Shigella flexneri 2a str. 301
cgccgagcaaugagcu

SEQ ID NO: 2027894 - RNA, 14 nt, Shigella flexneri 2a str. 301
cgccgacgcccugc

SEQ ID NO: 2027895 - RNA, 14 nt, Shigella flexneri 2a str. 301
cgcccggauuacag

SEQ ID NO: 2027896 - RNA, 13 nt, Shigella flexneri 2a str. 301
cgcccgcuugcga

SEQ ID NO: 2027897 - RNA, 18 nt, Shigella flexneri 2a str. 301
cgcccggaaacgggcgcu

SEQ ID NO: 2027898 - RNA, 22 nt, Shigella flexneri 2a str. 301
cgcccggauauccacccgcagc

SEQ ID NO: 2027899 - RNA, 18 nt, Shigella flexneri 2a str. 301
cgcccucagcccacaucc

SEQ ID NO: 2027900 - RNA, 14 nt, Shigella flexneri 2a str. 301
cgcccucacccgua

SEQ ID NO: 2027901 - RNA, 15 nt, Shigella flexneri 2a str. 301
cgcccuggaagaaaa

SEQ ID NO: 2027902 - RNA, 13 nt, Shigella flexneri 2a str. 301
cgcccuggaugca

SEQ ID NO: 2027903 - RNA, 23 nt, Shigella flexneri 2a str. 301
cgcccuucacccauugccgccuc

SEQ ID NO: 2027904 - RNA, 17 nt, Shigella flexneri 2a str. 301
cgccgaauaacgcgcag

SEQ ID NO: 2027905 - RNA, 18 nt, Shigella flexneri 2a str. 301
cgccgaauaacgcgcagc

SEQ ID NO: 2027906 - RNA, 23 nt, Shigella flexneri 2a str. 301
cgccggagagggaaauccccugg

SEQ ID NO: 2027907 - RNA, 14 nt, Shigella flexneri 2a str. 301
cgccggauuaugug

SEQ ID NO: 2027908 - RNA, 22 nt, Shigella flexneri 2a str. 301
cgccgggaugauggcuuuggcg

SEQ ID NO: 2027909 - RNA, 18 nt, Shigella flexneri 2a str. 301
cgccgggaaauuuuuccg

SEQ ID NO: 2027910 - RNA, 14 nt, Shigella flexneri 2a str. 301
cgccggucacgccc

SEQ ID NO: 2027911 - RNA, 15 nt, Shigella flexneri 2a str. 301
cgccggucacgcccg

SEQ ID NO: 2027912 - RNA, 14 nt, Shigella flexneri 2a str. 301
cgccgguagucacc

SEQ ID NO: 2027913 - RNA, 17 nt, Shigella flexneri 2a str. 301
cgccggugaccaucagc

SEQ ID NO: 2027914 - RNA, 14 nt, Shigella flexneri 2a str. 301
cgccguaacgcccu

SEQ ID NO: 2027915 - RNA, 18 nt, Shigella flexneri 2a str. 301
cgccguauaauaucuuuu

SEQ ID NO: 2027916 - RNA, 20 nt, Shigella flexneri 2a str. 301
aaacguugucaguucuuuua

SEQ ID NO: 2027917 - RNA, 14 nt, Shigella flexneri 2a str. 301
aaacguuucaaaca

SEQ ID NO: 2027918 - RNA, 21 nt, Shigella flexneri 2a str. 301
aaacguuccccaggguuucuc

SEQ ID NO: 2027919 - RNA, 14 nt, Shigella flexneri 2a str. 301
aaacgugcggcugu

SEQ ID NO: 2027920 - RNA, 20 nt, Shigella flexneri 2a str. 301
cgccgcuucuggcggcggca

SEQ ID NO: 2027921 - RNA, 23 nt, Shigella flexneri 2a str. 301
cgccgcuucuguuuuaccugcgc

SEQ ID NO: 2027922 - RNA, 20 nt, Shigella flexneri 2a str. 301
cgccggaaucaacggcaaca

SEQ ID NO: 2027923 - RNA, 19 nt, Shigella flexneri 2a str. 301
cgccggaaauuugcagugc

SEQ ID NO: 2027924 - RNA, 19 nt, Shigella flexneri 2a str. 301
cgccgcugucuaccagcac

SEQ ID NO: 2027925 - RNA, 23 nt, Shigella flexneri 2a str. 301
cgccgcuauuauaucgcucucuu

SEQ ID NO: 2027926 - RNA, 15 nt, Shigella flexneri 2a str. 301
cgccgcuaucggcaa

SEQ ID NO: 2027927 - RNA, 20 nt, Shigella flexneri 2a str. 301
cgccgcguuugcgcagccag

SEQ ID NO: 2027928 - RNA, 19 nt, Shigella flexneri 2a str. 301
cgccgcguuugcgcagcca

SEQ ID NO: 2027929 - RNA, 15 nt, Shigella flexneri 2a str. 301
cgccgcgacacaacg

SEQ ID NO: 2027930 - RNA, 22 nt, Shigella flexneri 2a str. 301
cgccgccguuagcuucagccgg

SEQ ID NO: 2027931 - RNA, 15 nt, Shigella flexneri 2a str. 301
cgauugcucaacgcc

SEQ ID NO: 2027932 - RNA, 19 nt, Shigella flexneri 2a str. 301
cgauuugucgccugcauca

SEQ ID NO: 2027933 - RNA, 23 nt, Shigella flexneri 2a str. 301
cgauugacuggaugccaguauua

SEQ ID NO: 2027934 - RNA, 17 nt, Shigella flexneri 2a str. 301
cgauguguugcaaauaa

SEQ ID NO: 2027935 - RNA, 23 nt, Shigella flexneri 2a str. 301
cgcaaacaucggcuuauucauau

SEQ ID NO: 2027936 - RNA, 20 nt, Shigella flexneri 2a str. 301
cgcaaacagugaccaucuuc

SEQ ID NO: 2027937 - RNA, 13 nt, Shigella flexneri 2a str. 301
cgcaaacaccagc

SEQ ID NO: 2027938 - RNA, 20 nt, Shigella flexneri 2a str. 301
cgcaaacaggcgcagaacuu

SEQ ID NO: 2027939 - RNA, 18 nt, Shigella flexneri 2a str. 301
cgcaaaauaccagcaauu

SEQ ID NO: 2027940 - RNA, 16 nt, Shigella flexneri 2a str. 301
cgcaaaaucagcaauu

SEQ ID NO: 2027941 - RNA, 20 nt, Shigella flexneri 2a str. 301
cgcaaaaucagcaauuuuuc

SEQ ID NO: 2027942 - RNA, 16 nt, Shigella flexneri 2a str. 301
cgcaaaacugccugau

SEQ ID NO: 2027943 - RNA, 14 nt, Shigella flexneri 2a str. 301
cgcaaacugccguu

SEQ ID NO: 2027944 - RNA, 14 nt, Shigella flexneri 2a str. 301
cgcaaagauguugu

SEQ ID NO: 2027945 - RNA, 12 nt, Shigella flexneri 2a str. 301
cgcaaaacccag

SEQ ID NO: 2027946 - RNA, 20 nt, Shigella flexneri 2a str. 301
cgcaaaaccucuuccagcag

SEQ ID NO: 2027947 - RNA, 21 nt, Shigella flexneri 2a str. 301
cgcaaaaccucuuccagcaga

SEQ ID NO: 2027948 - RNA, 13 nt, Shigella flexneri 2a str. 301
cgauuuuguaaaa

SEQ ID NO: 2027949 - RNA, 14 nt, Shigella flexneri 2a str. 301
cgauuuuccuccau

SEQ ID NO: 2027950 - RNA, 17 nt, Shigella flexneri 2a str. 301
cgaugcaaccgagcgcc

SEQ ID NO: 2027951 - RNA, 17 nt, Shigella flexneri 2a str. 301
cgauaugaccauuggua

SEQ ID NO: 2027952 - RNA, 16 nt, Shigella flexneri 2a str. 301
cgauauucuucaguau

SEQ ID NO: 2027953 - RNA, 16 nt, Shigella flexneri 2a str. 301
cgaugaucaacagcau

SEQ ID NO: 2027954 - RNA, 15 nt, Shigella flexneri 2a str. 301
cgauggucagcuuca

SEQ ID NO: 2027955 - RNA, 18 nt, Shigella flexneri 2a str. 301
cgauggucuggcgacggc

SEQ ID NO: 2027956 - RNA, 17 nt, Shigella flexneri 2a str. 301
cgaugggggaacaacca

SEQ ID NO: 2027957 - RNA, 19 nt, Shigella flexneri 2a str. 301
cgaugcuuugaccucccgc

SEQ ID NO: 2027958 - RNA, 13 nt, Shigella flexneri 2a str. 301
cgauggcuggggu

SEQ ID NO: 2027959 - RNA, 12 nt, Shigella flexneri 2a str. 301
cgauggcugggg

SEQ ID NO: 2027960 - RNA, 21 nt, Shigella flexneri 2a str. 301
cgaugcuuuccaacuguacca

SEQ ID NO: 2027961 - RNA, 23 nt, Shigella flexneri 2a str. 301
cgaugcuguugcuccuuaauaaa

SEQ ID NO: 2027962 - RNA, 20 nt, Shigella flexneri 2a str. 301
cgaugcugauuuuggucaug

SEQ ID NO: 2027963 - RNA, 15 nt, Shigella flexneri 2a str. 301
cgaugcugacgcauc

SEQ ID NO: 2027964 - RNA, 13 nt, Shigella flexneri 2a str. 301
cgaugcuaaaaac

SEQ ID NO: 2027965 - RNA, 21 nt, Shigella flexneri 2a str. 301
cgaugcgggauucccccaggc

SEQ ID NO: 2027966 - RNA, 12 nt, Shigella flexneri 2a str. 301
cgcaccugccag

SEQ ID NO: 2027967 - RNA, 22 nt, Shigella flexneri 2a str. 301
cgcaccagcggaaugcagucac

SEQ ID NO: 2027968 - RNA, 11 nt, Shigella flexneri 2a str. 301
cgcaccaccag

SEQ ID NO: 2027969 - RNA, 13 nt, Shigella flexneri 2a str. 301
cgcaccaacucca

SEQ ID NO: 2027970 - RNA, 20 nt, Shigella flexneri 2a str. 301
cgcaccaacuccacuucacc

SEQ ID NO: 2027971 - RNA, 13 nt, Shigella flexneri 2a str. 301
cgcaccacuuccc

SEQ ID NO: 2027972 - RNA, 14 nt, Shigella flexneri 2a str. 301
cgcaccaccagcag

SEQ ID NO: 2027973 - RNA, 16 nt, Shigella flexneri 2a str. 301
cgcagaaccagaagcg

SEQ ID NO: 2027974 - RNA, 19 nt, Shigella flexneri 2a str. 301
cgcacuuugucaucagucu

SEQ ID NO: 2027975 - RNA, 20 nt, Shigella flexneri 2a str. 301
cgcacuucuuccuugaaaug

SEQ ID NO: 2027976 - RNA, 23 nt, Shigella flexneri 2a str. 301
cgcacucguaucaccccgcccga

SEQ ID NO: 2027977 - RNA, 18 nt, Shigella flexneri 2a str. 301
cgcacguugucagcaacu

SEQ ID NO: 2027978 - RNA, 19 nt, Shigella flexneri 2a str. 301
cgcacguugucagcaacug

SEQ ID NO: 2027979 - RNA, 16 nt, Shigella flexneri 2a str. 301
cgcacuauacaaccag

SEQ ID NO: 2027980 - RNA, 20 nt, Shigella flexneri 2a str. 301
cgcacuaugugccagcuucc

SEQ ID NO: 2027981 - RNA, 21 nt, Shigella flexneri 2a str. 301
cgcacguucugucgcucugcu

SEQ ID NO: 2027982 - RNA, 20 nt, Shigella flexneri 2a str. 301
cgcacgaggaagauuacgcu

SEQ ID NO: 2027983 - RNA, 14 nt, Shigella flexneri 2a str. 301
cgcacacaacagac

SEQ ID NO: 2027984 - RNA, 19 nt, Shigella flexneri 2a str. 301
cgcacaaugccugaugcga

SEQ ID NO: 2027985 - RNA, 21 nt, Shigella flexneri 2a str. 301
cgcaacugguccagccccuga

SEQ ID NO: 2027986 - RNA, 16 nt, Shigella flexneri 2a str. 301
cgcaacugaggcaaua

SEQ ID NO: 2027987 - RNA, 20 nt, Shigella flexneri 2a str. 301
cgcaacugaggcaauaauga

SEQ ID NO: 2027988 - RNA, 14 nt, Shigella flexneri 2a str. 301
cgcaauuuccauug

SEQ ID NO: 2027989 - RNA, 19 nt, Shigella flexneri 2a str. 301
cgcaauuuccauugcucug

SEQ ID NO: 2027990 - RNA, 17 nt, Shigella flexneri 2a str. 301
cgcaaaggccagcaauc

SEQ ID NO: 2027991 - RNA, 19 nt, Shigella flexneri 2a str. 301
cgcaaaguagcgggcugac

SEQ ID NO: 2027992 - RNA, 18 nt, Shigella flexneri 2a str. 301
cgcaaaugaugcaccacc

SEQ ID NO: 2027993 - RNA, 13 nt, Shigella flexneri 2a str. 301
cgcaaauguaaaa

SEQ ID NO: 2027994 - RNA, 13 nt, Shigella flexneri 2a str. 301
cgcaacaaauaaa

SEQ ID NO: 2027995 - RNA, 17 nt, Shigella flexneri 2a str. 301
cgcaacauugcgccuca

SEQ ID NO: 2027996 - RNA, 13 nt, Shigella flexneri 2a str. 301
cgcaacaucgcaa

SEQ ID NO: 2027997 - RNA, 23 nt, Shigella flexneri 2a str. 301
cgcaaccacaaaacacucuucaa

SEQ ID NO: 2027998 - RNA, 20 nt, Shigella flexneri 2a str. 301
cgcaacgacaccguuaaaua

SEQ ID NO: 2027999 - RNA, 17 nt, Shigella flexneri 2a str. 301
cgcaacgccucaugcag

SEQ ID NO: 2028000 - RNA, 14 nt, Shigella flexneri 2a str. 301
cgcaacgcgcguga

SEQ ID NO: 2028001 - RNA, 12 nt, Shigella flexneri 2a str. 301
cgcaggcgcgcu

SEQ ID NO: 2028002 - RNA, 14 nt, Shigella flexneri 2a str. 301
cgcaggcgcugaaa

SEQ ID NO: 2028003 - RNA, 23 nt, Shigella flexneri 2a str. 301
cgcaggcuguuaccccugcggcc

SEQ ID NO: 2028004 - RNA, 13 nt, Shigella flexneri 2a str. 301
cgcaggccacgaa

SEQ ID NO: 2028005 - RNA, 14 nt, Shigella flexneri 2a str. 301
cgcaggccaacagu

SEQ ID NO: 2028006 - RNA, 14 nt, Shigella flexneri 2a str. 301
cgcaggccaauagc

SEQ ID NO: 2028007 - RNA, 19 nt, Shigella flexneri 2a str. 301
cgcagaguuuccaggcugg

SEQ ID NO: 2028008 - RNA, 15 nt, Shigella flexneri 2a str. 301
cgcagaguuuccagg

SEQ ID NO: 2028009 - RNA, 21 nt, Shigella flexneri 2a str. 301
cgcagauagagcgccugcaga

SEQ ID NO: 2028010 - RNA, 19 nt, Shigella flexneri 2a str. 301
cgcagauauucgcucgcca

SEQ ID NO: 2028011 - RNA, 20 nt, Shigella flexneri 2a str. 301
cgcagcgucagcaccagaga

SEQ ID NO: 2028012 - RNA, 13 nt, Shigella flexneri 2a str. 301
cgcagcggcggca

SEQ ID NO: 2028013 - RNA, 17 nt, Shigella flexneri 2a str. 301
cgcagcucaucaacacg

SEQ ID NO: 2028014 - RNA, 12 nt, Shigella flexneri 2a str. 301
cgcagcuccagc

SEQ ID NO: 2028015 - RNA, 13 nt, Shigella flexneri 2a str. 301
cgcagcuccagcc

SEQ ID NO: 2028016 - RNA, 19 nt, Shigella flexneri 2a str. 301
cgcagcuuugugcuucagu

SEQ ID NO: 2028017 - RNA, 17 nt, Shigella flexneri 2a str. 301
cgcaucggcgucgugga

SEQ ID NO: 2028018 - RNA, 20 nt, Shigella flexneri 2a str. 301
cgcaucggucagacccaguu

SEQ ID NO: 2028019 - RNA, 21 nt, Shigella flexneri 2a str. 301
cgcaucgacauauucaccauu

SEQ ID NO: 2028020 - RNA, 14 nt, Shigella flexneri 2a str. 301
cgcaucaggcaauu

SEQ ID NO: 2028021 - RNA, 19 nt, Shigella flexneri 2a str. 301
cgcaucagggcgcuggcga

SEQ ID NO: 2028022 - RNA, 15 nt, Shigella flexneri 2a str. 301
cgcaucagcuccggu

SEQ ID NO: 2028023 - RNA, 20 nt, Shigella flexneri 2a str. 301
aaacggcauaugccaugcga

SEQ ID NO: 2028024 - RNA, 18 nt, Shigella flexneri 2a str. 301
aaacggcguugagcaauc

SEQ ID NO: 2028025 - RNA, 23 nt, Shigella flexneri 2a str. 301
cgcauagcuaauccccuccagcg

SEQ ID NO: 2028026 - RNA, 16 nt, Shigella flexneri 2a str. 301
cgcauggcauuuugca

SEQ ID NO: 2028027 - RNA, 17 nt, Shigella flexneri 2a str. 301
cgcauucccagcgcguu

SEQ ID NO: 2028028 - RNA, 19 nt, Shigella flexneri 2a str. 301
cgcauuaagccaugaauga

SEQ ID NO: 2028029 - RNA, 15 nt, Shigella flexneri 2a str. 301
cgcauugccagagug

SEQ ID NO: 2028030 - RNA, 13 nt, Shigella flexneri 2a str. 301
cgcauugcauuuc

SEQ ID NO: 2028031 - RNA, 16 nt, Shigella flexneri 2a str. 301
cgcauugcucacuucc

SEQ ID NO: 2028032 - RNA, 15 nt, Shigella flexneri 2a str. 301
cgcauuuacucucau

SEQ ID NO: 2028033 - RNA, 14 nt, Shigella flexneri 2a str. 301
cgccaaagcggcag

SEQ ID NO: 2028034 - RNA, 15 nt, Shigella flexneri 2a str. 301
cgccaacaaaagcaa

SEQ ID NO: 2028035 - RNA, 21 nt, Shigella flexneri 2a str. 301
cgccaaaaggcaauucaauua

SEQ ID NO: 2028036 - RNA, 18 nt, Shigella flexneri 2a str. 301
cgccaaaaggcaauucaa

SEQ ID NO: 2028037 - RNA, 24 nt, Shigella flexneri 2a str. 301
cgccaaaccacuauuauggcgcag

SEQ ID NO: 2028038 - RNA, 16 nt, Shigella flexneri 2a str. 301
cgcauuuucuucauuc

SEQ ID NO: 2028039 - RNA, 19 nt, Shigella flexneri 2a str. 301
cgcauuuuuucuucaguuc

SEQ ID NO: 2028040 - RNA, 15 nt, Shigella flexneri 2a str. 301
cgccaaccugcuggu

SEQ ID NO: 2028041 - RNA, 16 nt, Shigella flexneri 2a str. 301
cgccaaccagcugacc

SEQ ID NO: 2028042 - RNA, 17 nt, Shigella flexneri 2a str. 301
cgccaacguucaccacg

SEQ ID NO: 2028043 - RNA, 21 nt, Shigella flexneri 2a str. 301
cgccaauaaccggcacuucaa

SEQ ID NO: 2028044 - RNA, 15 nt, Shigella flexneri 2a str. 301
cgccaauagcuggca

SEQ ID NO: 2028045 - RNA, 17 nt, Shigella flexneri 2a str. 301
cgccaagcagcgcgcag

SEQ ID NO: 2028046 - RNA, 21 nt, Shigella flexneri 2a str. 301
cgccaacggugaaaaaccaau

SEQ ID NO: 2028047 - RNA, 15 nt, Shigella flexneri 2a str. 301
cgccacaaccagcgc

SEQ ID NO: 2028048 - RNA, 19 nt, Shigella flexneri 2a str. 301
cgccaauucguaaguacau

SEQ ID NO: 2028049 - RNA, 20 nt, Shigella flexneri 2a str. 301
cgccaauugccuacguuuuu

SEQ ID NO: 2028050 - RNA, 19 nt, Shigella flexneri 2a str. 301
cgccacaauauuccggcau

SEQ ID NO: 2028051 - RNA, 23 nt, Shigella flexneri 2a str. 301
cgccacagcauucucggcccggc

SEQ ID NO: 2028052 - RNA, 22 nt, Shigella flexneri 2a str. 301
cgccacagcauucucggcccgg

SEQ ID NO: 2028053 - RNA, 18 nt, Shigella flexneri 2a str. 301
cgccacauaagaucaucg

SEQ ID NO: 2028054 - RNA, 21 nt, Shigella flexneri 2a str. 301
cgccaccggcuuucgcuucaa

SEQ ID NO: 2028055 - RNA, 13 nt, Shigella flexneri 2a str. 301
cgccaccgcgcgu

SEQ ID NO: 2028056 - RNA, 21 nt, Shigella flexneri 2a str. 301
cgccaccgaccaggcaaacca

SEQ ID NO: 2028057 - RNA, 15 nt, Shigella flexneri 2a str. 301
cgccaccacaacauu

SEQ ID NO: 2028058 - RNA, 13 nt, Shigella flexneri 2a str. 301
cgccaccacaaaa

SEQ ID NO: 2028059 - RNA, 14 nt, Shigella flexneri 2a str. 301
cgccaccacaacau

SEQ ID NO: 2028060 - RNA, 20 nt, Shigella flexneri 2a str. 301
aaacgccuugcgcgcagugc

SEQ ID NO: 2028061 - RNA, 16 nt, Shigella flexneri 2a str. 301
aaacgccuuauccggc

SEQ ID NO: 2028062 - RNA, 14 nt, Shigella flexneri 2a str. 301
aaacgcgccaggua

SEQ ID NO: 2028063 - RNA, 22 nt, Shigella flexneri 2a str. 301
aaacgcucccugccaguccugc

SEQ ID NO: 2028064 - RNA, 23 nt, Shigella flexneri 2a str. 301
cgagccguuccuaacaugccacu

SEQ ID NO: 2028065 - RNA, 19 nt, Shigella flexneri 2a str. 301
cgagcgacagauucaggcg

SEQ ID NO: 2028066 - RNA, 17 nt, Shigella flexneri 2a str. 301
cgagcgacucgaaggcc

SEQ ID NO: 2028067 - RNA, 11 nt, Shigella flexneri 2a str. 301
cgagcccuucg

SEQ ID NO: 2028068 - RNA, 19 nt, Shigella flexneri 2a str. 301
cgagcauccgauccuggac

SEQ ID NO: 2028069 - RNA, 18 nt, Shigella flexneri 2a str. 301
cgagccauaaacugagcc

SEQ ID NO: 2028070 - RNA, 14 nt, Shigella flexneri 2a str. 301
cgagcaacgcagcg

SEQ ID NO: 2028071 - RNA, 20 nt, Shigella flexneri 2a str. 301
cgagauuacugacaaagugc

SEQ ID NO: 2028072 - RNA, 21 nt, Shigella flexneri 2a str. 301
cgagcaaugagcuauguuuga

SEQ ID NO: 2028073 - RNA, 23 nt, Shigella flexneri 2a str. 301
cgagaucuuuaucaaucaccgcu

SEQ ID NO: 2028074 - RNA, 22 nt, Shigella flexneri 2a str. 301
cgagauccggaucccaccagac

SEQ ID NO: 2028075 - RNA, 17 nt, Shigella flexneri 2a str. 301
cgagauaccuaacauuu

SEQ ID NO: 2028076 - RNA, 23 nt, Shigella flexneri 2a str. 301
cgagauaaugguuuccagcaucg

SEQ ID NO: 2028077 - RNA, 14 nt, Shigella flexneri 2a str. 301
cgagcaguacagcc

SEQ ID NO: 2028078 - RNA, 13 nt, Shigella flexneri 2a str. 301
cgagcagcugacu

SEQ ID NO: 2028079 - RNA, 20 nt, Shigella flexneri 2a str. 301
cgagcacgccgccagugccg

SEQ ID NO: 2028080 - RNA, 12 nt, Shigella flexneri 2a str. 301
cgagcagccacu

SEQ ID NO: 2028081 - RNA, 18 nt, Shigella flexneri 2a str. 301
cgagaauacugaagucga

SEQ ID NO: 2028082 - RNA, 20 nt, Shigella flexneri 2a str. 301
cgagaaucagcgagacaaca

SEQ ID NO: 2028083 - RNA, 23 nt, Shigella flexneri 2a str. 301
cgagacgguuaaaaacagccagc

SEQ ID NO: 2028084 - RNA, 14 nt, Shigella flexneri 2a str. 301
cgagaguaacacau

SEQ ID NO: 2028085 - RNA, 21 nt, Shigella flexneri 2a str. 301
cgagagcaaugcgcaucaaag

SEQ ID NO: 2028086 - RNA, 15 nt, Shigella flexneri 2a str. 301
cgagagagaaaauaa

SEQ ID NO: 2028087 - RNA, 20 nt, Shigella flexneri 2a str. 301
cgagagacgcuugucaccgu

SEQ ID NO: 2028088 - RNA, 21 nt, Shigella flexneri 2a str. 301
cgagagaauggggucagcagg

SEQ ID NO: 2028089 - RNA, 23 nt, Shigella flexneri 2a str. 301
cgagagaauggggucagcaggug

SEQ ID NO: 2028090 - RNA, 14 nt, Shigella flexneri 2a str. 301
cgagacugcgcgcc

SEQ ID NO: 2028091 - RNA, 19 nt, Shigella flexneri 2a str. 301
cgagacugcgcgccgccgc

SEQ ID NO: 2028092 - RNA, 15 nt, Shigella flexneri 2a str. 301
cgacuucaucgccaa

SEQ ID NO: 2028093 - RNA, 13 nt, Shigella flexneri 2a str. 301
cgacuguugaaga

SEQ ID NO: 2028094 - RNA, 18 nt, Shigella flexneri 2a str. 301
cgacuucgauguccgcuc

SEQ ID NO: 2028095 - RNA, 10 nt, Shigella flexneri 2a str. 301
cgacuucugu

SEQ ID NO: 2028096 - RNA, 16 nt, Shigella flexneri 2a str. 301
cgacuucuucccacca

SEQ ID NO: 2028097 - RNA, 18 nt, Shigella flexneri 2a str. 301
cgacuucuucccaccaua

SEQ ID NO: 2028098 - RNA, 14 nt, Shigella flexneri 2a str. 301
cgacuuugccuggc

SEQ ID NO: 2028099 - RNA, 16 nt, Shigella flexneri 2a str. 301
cgacuuuggugccgug

SEQ ID NO: 2028100 - RNA, 22 nt, Shigella flexneri 2a str. 301
cgacuuuguuuuuaguuaaauc

SEQ ID NO: 2028101 - RNA, 17 nt, Shigella flexneri 2a str. 301
cgagaaaagccaaccug

SEQ ID NO: 2028102 - RNA, 23 nt, Shigella flexneri 2a str. 301
cgacuuuucauaagcgucagaaa

SEQ ID NO: 2028103 - RNA, 13 nt, Shigella flexneri 2a str. 301
cgacuuuuuccug

SEQ ID NO: 2028104 - RNA, 19 nt, Shigella flexneri 2a str. 301
cgagaagcagcaacacaau

SEQ ID NO: 2028105 - RNA, 14 nt, Shigella flexneri 2a str. 301
cgagaagagaggcg

SEQ ID NO: 2028106 - RNA, 19 nt, Shigella flexneri 2a str. 301
cgagaacucggaagcagcg

SEQ ID NO: 2028107 - RNA, 20 nt, Shigella flexneri 2a str. 301
cgacugcaaaccaugacgca

SEQ ID NO: 2028108 - RNA, 17 nt, Shigella flexneri 2a str. 301
cgacugauaucugcccg

SEQ ID NO: 2028109 - RNA, 15 nt, Shigella flexneri 2a str. 301
cgacugcccgcgagc

SEQ ID NO: 2028110 - RNA, 15 nt, Shigella flexneri 2a str. 301
cgacugccgcucacc

SEQ ID NO: 2028111 - RNA, 14 nt, Shigella flexneri 2a str. 301
cgacugccgcucac

SEQ ID NO: 2028112 - RNA, 16 nt, Shigella flexneri 2a str. 301
cgacugcgccaauacc

SEQ ID NO: 2028113 - RNA, 14 nt, Shigella flexneri 2a str. 301
cgacuauuaugaau

SEQ ID NO: 2028114 - RNA, 16 nt, Shigella flexneri 2a str. 301
cgacucaaaucacgca

SEQ ID NO: 2028115 - RNA, 18 nt, Shigella flexneri 2a str. 301
cgacucaaaucacgcagu

SEQ ID NO: 2028116 - RNA, 15 nt, Shigella flexneri 2a str. 301
cgacucaaaucacgc

SEQ ID NO: 2028117 - RNA, 13 nt, Shigella flexneri 2a str. 301
cgacucgccauua

SEQ ID NO: 2028118 - RNA, 16 nt, Shigella flexneri 2a str. 301
cgacgugaccuuucag

SEQ ID NO: 2028119 - RNA, 13 nt, Shigella flexneri 2a str. 301
cgacgugcgggcg

SEQ ID NO: 2028120 - RNA, 21 nt, Shigella flexneri 2a str. 301
cgacguucaggcgaaugcguu

SEQ ID NO: 2028121 - RNA, 17 nt, Shigella flexneri 2a str. 301
cgacuaacuuuacucuu

SEQ ID NO: 2028122 - RNA, 13 nt, Shigella flexneri 2a str. 301
cgacuacccgcgc

SEQ ID NO: 2028123 - RNA, 19 nt, Shigella flexneri 2a str. 301
cgacguuugcgcccagcca

SEQ ID NO: 2028124 - RNA, 16 nt, Shigella flexneri 2a str. 301
cgaauaccuucuuccu

SEQ ID NO: 2028125 - RNA, 12 nt, Shigella flexneri 2a str. 301
cgaauagaaagc

SEQ ID NO: 2028126 - RNA, 16 nt, Shigella flexneri 2a str. 301
cgaggcuuauccggca

SEQ ID NO: 2028127 - RNA, 20 nt, Shigella flexneri 2a str. 301
cgaggauucgaaccucggaa

SEQ ID NO: 2028128 - RNA, 20 nt, Shigella flexneri 2a str. 301
cgaggccaauuuggcugcca

SEQ ID NO: 2028129 - RNA, 19 nt, Shigella flexneri 2a str. 301
cgaggaagcuuucgcagua

SEQ ID NO: 2028130 - RNA, 22 nt, Shigella flexneri 2a str. 301
cgaggaaucguucauaccacgc

SEQ ID NO: 2028131 - RNA, 12 nt, Shigella flexneri 2a str. 301
cgaggacagcau

SEQ ID NO: 2028132 - RNA, 15 nt, Shigella flexneri 2a str. 301
aaacggauaaucaug

SEQ ID NO: 2028133 - RNA, 12 nt, Shigella flexneri 2a str. 301
aaacgcuuuuuu

SEQ ID NO: 2028134 - RNA, 15 nt, Shigella flexneri 2a str. 301
aaacggaaagcagau

SEQ ID NO: 2028135 - RNA, 12 nt, Shigella flexneri 2a str. 301
aaacggagcaaa

SEQ ID NO: 2028136 - RNA, 14 nt, Shigella flexneri 2a str. 301
aaacggagcaaaaa

SEQ ID NO: 2028137 - RNA, 23 nt, Shigella flexneri 2a str. 301
cgagcgguaaaccguuaucaccu

SEQ ID NO: 2028138 - RNA, 22 nt, Shigella flexneri 2a str. 301
cgagcuuauuuguugagcugga

SEQ ID NO: 2028139 - RNA, 23 nt, Shigella flexneri 2a str. 301
cgagcuuaauguuaaccaucuca

SEQ ID NO: 2028140 - RNA, 11 nt, Shigella flexneri 2a str. 301
cgaggaaaaua

SEQ ID NO: 2028141 - RNA, 17 nt, Shigella flexneri 2a str. 301
cgagcuuucgaccagcc

SEQ ID NO: 2028142 - RNA, 13 nt, Shigella flexneri 2a str. 301
cgagcuggaagcc

SEQ ID NO: 2028143 - RNA, 18 nt, Shigella flexneri 2a str. 301
cgauaaucucaauauccg

SEQ ID NO: 2028144 - RNA, 22 nt, Shigella flexneri 2a str. 301
cgauaaucucugcuuucgcauu

SEQ ID NO: 2028145 - RNA, 15 nt, Shigella flexneri 2a str. 301
cgauaaucagcgcca

SEQ ID NO: 2028146 - RNA, 18 nt, Shigella flexneri 2a str. 301
cgauaaccaucuucuuca

SEQ ID NO: 2028147 - RNA, 20 nt, Shigella flexneri 2a str. 301
cgauaauuuaugccugauac

SEQ ID NO: 2028148 - RNA, 16 nt, Shigella flexneri 2a str. 301
cgauacagaagcaccg

SEQ ID NO: 2028149 - RNA, 18 nt, Shigella flexneri 2a str. 301
cgauagccuucagugccg

SEQ ID NO: 2028150 - RNA, 20 nt, Shigella flexneri 2a str. 301
cgauagccacgcucauaugc

SEQ ID NO: 2028151 - RNA, 17 nt, Shigella flexneri 2a str. 301
cgauagagagcagucag

SEQ ID NO: 2028152 - RNA, 22 nt, Shigella flexneri 2a str. 301
cgauaccaauaucaacguaaug

SEQ ID NO: 2028153 - RNA, 16 nt, Shigella flexneri 2a str. 301
cgauagaauauuucua

SEQ ID NO: 2028154 - RNA, 12 nt, Shigella flexneri 2a str. 301
cgauaaaaccuu

SEQ ID NO: 2028155 - RNA, 19 nt, Shigella flexneri 2a str. 301
cgauaaauaacuuuuaucu

SEQ ID NO: 2028156 - RNA, 21 nt, Shigella flexneri 2a str. 301
cgauaaauaacuuuuaucugu

SEQ ID NO: 2028157 - RNA, 22 nt, Shigella flexneri 2a str. 301
cgauaacacgguaaugacucca

SEQ ID NO: 2028158 - RNA, 16 nt, Shigella flexneri 2a str. 301
cgauaaaccagcaacc

SEQ ID NO: 2028159 - RNA, 14 nt, Shigella flexneri 2a str. 301
cgauaaaaucccau

SEQ ID NO: 2028160 - RNA, 14 nt, Shigella flexneri 2a str. 301
cgauaaagcugggu

SEQ ID NO: 2028161 - RNA, 20 nt, Shigella flexneri 2a str. 301
cgauaaaggucgacagcagc

SEQ ID NO: 2028162 - RNA, 13 nt, Shigella flexneri 2a str. 301
cgauaaacucaau

SEQ ID NO: 2028163 - RNA, 16 nt, Shigella flexneri 2a str. 301
cgagucgucaguucca

SEQ ID NO: 2028164 - RNA, 20 nt, Shigella flexneri 2a str. 301
cgagucgcugagcgugcccc

SEQ ID NO: 2028165 - RNA, 15 nt, Shigella flexneri 2a str. 301
cgagucgcugagcgu

SEQ ID NO: 2028166 - RNA, 11 nt, Shigella flexneri 2a str. 301
cgaguccuguu

SEQ ID NO: 2028167 - RNA, 13 nt, Shigella flexneri 2a str. 301
cgaguaaucaggc

SEQ ID NO: 2028168 - RNA, 16 nt, Shigella flexneri 2a str. 301
cgaggguaaacaacau

SEQ ID NO: 2028169 - RNA, 19 nt, Shigella flexneri 2a str. 301
cgaggggacuguccgggca

SEQ ID NO: 2028170 - RNA, 16 nt, Shigella flexneri 2a str. 301
cgaggugcucuccacg

SEQ ID NO: 2028171 - RNA, 12 nt, Shigella flexneri 2a str. 301
cgaguaaaaaaa

SEQ ID NO: 2028172 - RNA, 13 nt, Shigella flexneri 2a str. 301
cgagguuuuccuu

SEQ ID NO: 2028173 - RNA, 22 nt, Shigella flexneri 2a str. 301
cgagguuaaugaucgcgccgcc

SEQ ID NO: 2028174 - RNA, 22 nt, Shigella flexneri 2a str. 301
cggcauucugcuggccuggcug

SEQ ID NO: 2028175 - RNA, 14 nt, Shigella flexneri 2a str. 301
cggccacagcgcca

SEQ ID NO: 2028176 - RNA, 14 nt, Shigella flexneri 2a str. 301
cggccacagccagc

SEQ ID NO: 2028177 - RNA, 13 nt, Shigella flexneri 2a str. 301
cggcauuuugugc

SEQ ID NO: 2028178 - RNA, 23 nt, Shigella flexneri 2a str. 301
cggcauuuuuuucaccaacgcaa

SEQ ID NO: 2028179 - RNA, 15 nt, Shigella flexneri 2a str. 301
cggcauuuugcugau

SEQ ID NO: 2028180 - RNA, 20 nt, Shigella flexneri 2a str. 301
cggcagaugaaaacgcugau

SEQ ID NO: 2028181 - RNA, 19 nt, Shigella flexneri 2a str. 301
cggccacucuuuggcaacc

SEQ ID NO: 2028182 - RNA, 20 nt, Shigella flexneri 2a str. 301
cggccacucugccuguaugu

SEQ ID NO: 2028183 - RNA, 12 nt, Shigella flexneri 2a str. 301
cggccagcaccu

SEQ ID NO: 2028184 - RNA, 23 nt, Shigella flexneri 2a str. 301
cggccaguaagcaguccagcgcc

SEQ ID NO: 2028185 - RNA, 18 nt, Shigella flexneri 2a str. 301
cggcccgcucggcggcug

SEQ ID NO: 2028186 - RNA, 19 nt, Shigella flexneri 2a str. 301
cggcccgcucggcggcugg

SEQ ID NO: 2028187 - RNA, 20 nt, Shigella flexneri 2a str. 301
cggccccgucucccgaugcc

SEQ ID NO: 2028188 - RNA, 20 nt, Shigella flexneri 2a str. 301
cggccuacacaugcgucccc

SEQ ID NO: 2028189 - RNA, 16 nt, Shigella flexneri 2a str. 301
cggcgaagagagcgcc

SEQ ID NO: 2028190 - RNA, 22 nt, Shigella flexneri 2a str. 301
cggcgaccguucgccaggucag

SEQ ID NO: 2028191 - RNA, 13 nt, Shigella flexneri 2a str. 301
cggccuuuuccuu

SEQ ID NO: 2028192 - RNA, 16 nt, Shigella flexneri 2a str. 301
cggccgcacuuacagc

SEQ ID NO: 2028193 - RNA, 17 nt, Shigella flexneri 2a str. 301
cggcccuuuuuuuacuu

SEQ ID NO: 2028194 - RNA, 14 nt, Shigella flexneri 2a str. 301
cggcgauuuacagc

SEQ ID NO: 2028195 - RNA, 13 nt, Shigella flexneri 2a str. 301
cgcuuuucagugc

SEQ ID NO: 2028196 - RNA, 16 nt, Shigella flexneri 2a str. 301
cgcuuuuggcaggaac

SEQ ID NO: 2028197 - RNA, 17 nt, Shigella flexneri 2a str. 301
cgcuuuuuucagcgcca

SEQ ID NO: 2028198 - RNA, 12 nt, Shigella flexneri 2a str. 301
cggaaaaaagaa

SEQ ID NO: 2028199 - RNA, 20 nt, Shigella flexneri 2a str. 301
cgcuuugggcucaucaauac

SEQ ID NO: 2028200 - RNA, 16 nt, Shigella flexneri 2a str. 301
cgcuuucucuucggcu

SEQ ID NO: 2028201 - RNA, 17 nt, Shigella flexneri 2a str. 301
cgcuuucgcuuucucuu

SEQ ID NO: 2028202 - RNA, 23 nt, Shigella flexneri 2a str. 301
cgcuuucugagcggccuuuuccu

SEQ ID NO: 2028203 - RNA, 19 nt, Shigella flexneri 2a str. 301
cgcuuucacuauuucuuug

SEQ ID NO: 2028204 - RNA, 18 nt, Shigella flexneri 2a str. 301
cgcuaccaggaagcgacc

SEQ ID NO: 2028205 - RNA, 19 nt, Shigella flexneri 2a str. 301
cgcuuuacucaacuccccg

SEQ ID NO: 2028206 - RNA, 22 nt, Shigella flexneri 2a str. 301
cgcuaacccgcagcuuaaugaa

SEQ ID NO: 2028207 - RNA, 13 nt, Shigella flexneri 2a str. 301
cgcuaaaugccgc

SEQ ID NO: 2028208 - RNA, 17 nt, Shigella flexneri 2a str. 301
cgcuaaacaggaucugg

SEQ ID NO: 2028209 - RNA, 12 nt, Shigella flexneri 2a str. 301
cggaagccacca

SEQ ID NO: 2028210 - RNA, 15 nt, Shigella flexneri 2a str. 301
cggaagcgucaaggu

SEQ ID NO: 2028211 - RNA, 12 nt, Shigella flexneri 2a str. 301
cggaagcuccac

SEQ ID NO: 2028212 - RNA, 20 nt, Shigella flexneri 2a str. 301
cggaaccggauuuucaccau

SEQ ID NO: 2028213 - RNA, 15 nt, Shigella flexneri 2a str. 301
cggaacgaaaaaaau

SEQ ID NO: 2028214 - RNA, 20 nt, Shigella flexneri 2a str. 301
cggaacgcagauauaaaaaa

SEQ ID NO: 2028215 - RNA, 13 nt, Shigella flexneri 2a str. 301
cggaacugaugau

SEQ ID NO: 2028216 - RNA, 15 nt, Shigella flexneri 2a str. 301
cggaacugugcugcc

SEQ ID NO: 2028217 - RNA, 22 nt, Shigella flexneri 2a str. 301
cggaagcaaaauaaccggcaag

SEQ ID NO: 2028218 - RNA, 12 nt, Shigella flexneri 2a str. 301
cggaacaggcag

SEQ ID NO: 2028219 - RNA, 19 nt, Shigella flexneri 2a str. 301
cggaacacucuuccagucg

SEQ ID NO: 2028220 - RNA, 15 nt, Shigella flexneri 2a str. 301
cggaacaacggcaaa

SEQ ID NO: 2028221 - RNA, 15 nt, Shigella flexneri 2a str. 301
cggaaauugccacug

SEQ ID NO: 2028222 - RNA, 23 nt, Shigella flexneri 2a str. 301
cggaaauuaccgcaccaccagca

SEQ ID NO: 2028223 - RNA, 15 nt, Shigella flexneri 2a str. 301
cggaacaucugcccc

SEQ ID NO: 2028224 - RNA, 14 nt, Shigella flexneri 2a str. 301
cggaacccagcgcg

SEQ ID NO: 2028225 - RNA, 21 nt, Shigella flexneri 2a str. 301
cggaacccagcgcgauacgca

SEQ ID NO: 2028226 - RNA, 17 nt, Shigella flexneri 2a str. 301
cggaaacugucaauaaa

SEQ ID NO: 2028227 - RNA, 15 nt, Shigella flexneri 2a str. 301
cggaaaucuccagau

SEQ ID NO: 2028228 - RNA, 23 nt, Shigella flexneri 2a str. 301
cggaaaucacgauugcugccgau

SEQ ID NO: 2028229 - RNA, 20 nt, Shigella flexneri 2a str. 301
cggaaaguuuaauugccauu

SEQ ID NO: 2028230 - RNA, 21 nt, Shigella flexneri 2a str. 301
cggaaaguuuaauugccauuu

SEQ ID NO: 2028231 - RNA, 12 nt, Shigella flexneri 2a str. 301
cggaaauauauu

SEQ ID NO: 2028232 - RNA, 15 nt, Shigella flexneri 2a str. 301
cggaggaaagcaccu

SEQ ID NO: 2028233 - RNA, 18 nt, Shigella flexneri 2a str. 301
cggagcuucacccgcagc

SEQ ID NO: 2028234 - RNA, 13 nt, Shigella flexneri 2a str. 301
cggagcugccagg

SEQ ID NO: 2028235 - RNA, 17 nt, Shigella flexneri 2a str. 301
cggagcggacugcugcg

SEQ ID NO: 2028236 - RNA, 14 nt, Shigella flexneri 2a str. 301
cggagccauucccc

SEQ ID NO: 2028237 - RNA, 22 nt, Shigella flexneri 2a str. 301
cggagccauugcccgaugcgca

SEQ ID NO: 2028238 - RNA, 20 nt, Shigella flexneri 2a str. 301
cggagccagccguugcccgu

SEQ ID NO: 2028239 - RNA, 17 nt, Shigella flexneri 2a str. 301
cggagcaaugaucucaa

SEQ ID NO: 2028240 - RNA, 15 nt, Shigella flexneri 2a str. 301
cggagcaaccugcac

SEQ ID NO: 2028241 - RNA, 17 nt, Shigella flexneri 2a str. 301
cggagaguaaacgguga

SEQ ID NO: 2028242 - RNA, 20 nt, Shigella flexneri 2a str. 301
cggagaucgagcgcgagcag

SEQ ID NO: 2028243 - RNA, 23 nt, Shigella flexneri 2a str. 301
cggacgcuaacccgcgucugcgu

SEQ ID NO: 2028244 - RNA, 22 nt, Shigella flexneri 2a str. 301
cggacguucgcccacuucuuuc

SEQ ID NO: 2028245 - RNA, 18 nt, Shigella flexneri 2a str. 301
cggacguaaugauguaaa

SEQ ID NO: 2028246 - RNA, 15 nt, Shigella flexneri 2a str. 301
cggacguuugccaug

SEQ ID NO: 2028247 - RNA, 15 nt, Shigella flexneri 2a str. 301
cggacuauccgccuc

SEQ ID NO: 2028248 - RNA, 22 nt, Shigella flexneri 2a str. 301
cggagagaaaaaccuccggcgu

SEQ ID NO: 2028249 - RNA, 21 nt, Shigella flexneri 2a str. 301
cggagagaaaagcaaaagaug

SEQ ID NO: 2028250 - RNA, 14 nt, Shigella flexneri 2a str. 301
cggagaacaggaau

SEQ ID NO: 2028251 - RNA, 14 nt, Shigella flexneri 2a str. 301
cggacacacuucau

SEQ ID NO: 2028252 - RNA, 18 nt, Shigella flexneri 2a str. 301
cggacacugcuuacaggc

SEQ ID NO: 2028253 - RNA, 19 nt, Shigella flexneri 2a str. 301
cggacaaacggcuggaaca

SEQ ID NO: 2028254 - RNA, 16 nt, Shigella flexneri 2a str. 301
cggaaucaccggcaaa

SEQ ID NO: 2028255 - RNA, 19 nt, Shigella flexneri 2a str. 301
cggaaugggcuguucacca

SEQ ID NO: 2028256 - RNA, 14 nt, Shigella flexneri 2a str. 301
cggacaguccccuc

SEQ ID NO: 2028257 - RNA, 23 nt, Shigella flexneri 2a str. 301
cggacagucacguagcggcggca

SEQ ID NO: 2028258 - RNA, 23 nt, Shigella flexneri 2a str. 301
cggacauugaguuuacgcagcag

SEQ ID NO: 2028259 - RNA, 17 nt, Shigella flexneri 2a str. 301
cggacauguuuuccagc

SEQ ID NO: 2028260 - RNA, 13 nt, Shigella flexneri 2a str. 301
cggaccagcaaca

SEQ ID NO: 2028261 - RNA, 15 nt, Shigella flexneri 2a str. 301
cggcacuccucuuca

SEQ ID NO: 2028262 - RNA, 14 nt, Shigella flexneri 2a str. 301
cggcacugaccacu

SEQ ID NO: 2028263 - RNA, 22 nt, Shigella flexneri 2a str. 301
cggcaccuaauaacucuccucc

SEQ ID NO: 2028264 - RNA, 17 nt, Shigella flexneri 2a str. 301
cggcaccuuuucaucag

SEQ ID NO: 2028265 - RNA, 22 nt, Shigella flexneri 2a str. 301
cggcacacagcacggcagcaac

SEQ ID NO: 2028266 - RNA, 14 nt, Shigella flexneri 2a str. 301
cggcaauggcugcg

SEQ ID NO: 2028267 - RNA, 14 nt, Shigella flexneri 2a str. 301
cggcaaugcgcccc

SEQ ID NO: 2028268 - RNA, 21 nt, Shigella flexneri 2a str. 301
cggcaauguuaccgaucgcca

SEQ ID NO: 2028269 - RNA, 16 nt, Shigella flexneri 2a str. 301
cggcaauuagcggcug

SEQ ID NO: 2028270 - RNA, 19 nt, Shigella flexneri 2a str. 301
cggcaauucucugcuccug

SEQ ID NO: 2028271 - RNA, 21 nt, Shigella flexneri 2a str. 301
cggcaauucucugcuccugau

SEQ ID NO: 2028272 - RNA, 23 nt, Shigella flexneri 2a str. 301
cggcacccaauccaguacaugaa

SEQ ID NO: 2028273 - RNA, 21 nt, Shigella flexneri 2a str. 301
cggcaccauuccaccucccgu

SEQ ID NO: 2028274 - RNA, 18 nt, Shigella flexneri 2a str. 301
cggcaccacauucugcau

SEQ ID NO: 2028275 - RNA, 20 nt, Shigella flexneri 2a str. 301
cggcaagauggauuacaccu

SEQ ID NO: 2028276 - RNA, 13 nt, Shigella flexneri 2a str. 301
cggcaagcaaaug

SEQ ID NO: 2028277 - RNA, 15 nt, Shigella flexneri 2a str. 301
cggcaagcaaaugaa

SEQ ID NO: 2028278 - RNA, 23 nt, Shigella flexneri 2a str. 301
cggcaagaucgcgaugggucgcc

SEQ ID NO: 2028279 - RNA, 17 nt, Shigella flexneri 2a str. 301
cggcaagaucaccguuu

SEQ ID NO: 2028280 - RNA, 19 nt, Shigella flexneri 2a str. 301
cggcaagaaauaccgaaga

SEQ ID NO: 2028281 - RNA, 22 nt, Shigella flexneri 2a str. 301
cggcaaucgccagaucagcuuc

SEQ ID NO: 2028282 - RNA, 20 nt, Shigella flexneri 2a str. 301
cggcaaucauucccagaccu

SEQ ID NO: 2028283 - RNA, 17 nt, Shigella flexneri 2a str. 301
cggcaaucacaucacca

SEQ ID NO: 2028284 - RNA, 23 nt, Shigella flexneri 2a str. 301
cggcaaucggugcaaaugccaga

SEQ ID NO: 2028285 - RNA, 17 nt, Shigella flexneri 2a str. 301
cggcaagguugaaggug

SEQ ID NO: 2028286 - RNA, 15 nt, Shigella flexneri 2a str. 301
cggcaagugccuguu

SEQ ID NO: 2028287 - RNA, 14 nt, Shigella flexneri 2a str. 301
cggcaaaaccguuc

SEQ ID NO: 2028288 - RNA, 12 nt, Shigella flexneri 2a str. 301
cggcaaacacgc

SEQ ID NO: 2028289 - RNA, 14 nt, Shigella flexneri 2a str. 301
cggcaaacgcaacc

SEQ ID NO: 2028290 - RNA, 13 nt, Shigella flexneri 2a str. 301
cggcaaacgucgc

SEQ ID NO: 2028291 - RNA, 23 nt, Shigella flexneri 2a str. 301
cggcaaacguaagcgucugcucc

SEQ ID NO: 2028292 - RNA, 16 nt, Shigella flexneri 2a str. 301
cggauuuggcugaaua

SEQ ID NO: 2028293 - RNA, 22 nt, Shigella flexneri 2a str. 301
cggauuuggcaaaugcaucagu

SEQ ID NO: 2028294 - RNA, 14 nt, Shigella flexneri 2a str. 301
cggcaaacugcuga

SEQ ID NO: 2028295 - RNA, 15 nt, Shigella flexneri 2a str. 301
cggcaaacugcugau

SEQ ID NO: 2028296 - RNA, 21 nt, Shigella flexneri 2a str. 301
cggcaaagaaccaacgcugcc

SEQ ID NO: 2028297 - RNA, 21 nt, Shigella flexneri 2a str. 301
cggcaaauucauuaccaaccu

SEQ ID NO: 2028298 - RNA, 17 nt, Shigella flexneri 2a str. 301
cggcaaccgcauccaga

SEQ ID NO: 2028299 - RNA, 17 nt, Shigella flexneri 2a str. 301
cggcaacacgccuggcu

SEQ ID NO: 2028300 - RNA, 22 nt, Shigella flexneri 2a str. 301
cggauuaacaguccgccguucu

SEQ ID NO: 2028301 - RNA, 18 nt, Shigella flexneri 2a str. 301
cggauguuucuucaacac

SEQ ID NO: 2028302 - RNA, 22 nt, Shigella flexneri 2a str. 301
cggaugugaugcauccggcaca

SEQ ID NO: 2028303 - RNA, 24 nt, Shigella flexneri 2a str. 301
cggaugcagcaucaugucgcccac

SEQ ID NO: 2028304 - RNA, 14 nt, Shigella flexneri 2a str. 301
cggaugauucacau

SEQ ID NO: 2028305 - RNA, 15 nt, Shigella flexneri 2a str. 301
cggaugaugcucccc

SEQ ID NO: 2028306 - RNA, 19 nt, Shigella flexneri 2a str. 301
cggaugaugcuccccaggg

SEQ ID NO: 2028307 - RNA, 14 nt, Shigella flexneri 2a str. 301
cggauggcagaguu

SEQ ID NO: 2028308 - RNA, 17 nt, Shigella flexneri 2a str. 301
cggauggcaaacugauu

SEQ ID NO: 2028309 - RNA, 16 nt, Shigella flexneri 2a str. 301
cggaugacccagcgcg

SEQ ID NO: 2028310 - RNA, 18 nt, Shigella flexneri 2a str. 301
cggaugaguacagcgcau

SEQ ID NO: 2028311 - RNA, 16 nt, Shigella flexneri 2a str. 301
cggaugaucauccggc

SEQ ID NO: 2028312 - RNA, 15 nt, Shigella flexneri 2a str. 301
cggaugaguacagcg

SEQ ID NO: 2028313 - RNA, 14 nt, Shigella flexneri 2a str. 301
cggaucauuaguca

SEQ ID NO: 2028314 - RNA, 19 nt, Shigella flexneri 2a str. 301
cggaucgaacuccgccccg

SEQ ID NO: 2028315 - RNA, 14 nt, Shigella flexneri 2a str. 301
cggaucgccgccgg

SEQ ID NO: 2028316 - RNA, 22 nt, Shigella flexneri 2a str. 301
cggauauccacccgcagccauc

SEQ ID NO: 2028317 - RNA, 14 nt, Shigella flexneri 2a str. 301
cggauauaaaaaac

SEQ ID NO: 2028318 - RNA, 14 nt, Shigella flexneri 2a str. 301
cggauaaggcauuu

SEQ ID NO: 2028319 - RNA, 18 nt, Shigella flexneri 2a str. 301
cggauaagacgcgccagc

SEQ ID NO: 2028320 - RNA, 22 nt, Shigella flexneri 2a str. 301
cggauaaucgcuggugccgugg

SEQ ID NO: 2028321 - RNA, 21 nt, Shigella flexneri 2a str. 301
cggauaauggagccagaucug

SEQ ID NO: 2028322 - RNA, 16 nt, Shigella flexneri 2a str. 301
cggauaauaauauccu

SEQ ID NO: 2028323 - RNA, 20 nt, Shigella flexneri 2a str. 301
cggauaccaccagugccauu

SEQ ID NO: 2028324 - RNA, 22 nt, Shigella flexneri 2a str. 301
cggauacgguuuuuugaacaga

SEQ ID NO: 2028325 - RNA, 14 nt, Shigella flexneri 2a str. 301
cggauagagcgcgg

SEQ ID NO: 2028326 - RNA, 22 nt, Shigella flexneri 2a str. 301
cggauagcguguuuuauaccuc

SEQ ID NO: 2028327 - RNA, 18 nt, Shigella flexneri 2a str. 301
cggauagcagaaaacuca

SEQ ID NO: 2028328 - RNA, 16 nt, Shigella flexneri 2a str. 301
cggagguuuuuuccuc

SEQ ID NO: 2028329 - RNA, 15 nt, Shigella flexneri 2a str. 301
cggagguuuuuuccu

SEQ ID NO: 2028330 - RNA, 22 nt, Shigella flexneri 2a str. 301
cggaggggcggcucuccugcca

SEQ ID NO: 2028331 - RNA, 19 nt, Shigella flexneri 2a str. 301
cggagggguuuuugccagc

SEQ ID NO: 2028332 - RNA, 19 nt, Shigella flexneri 2a str. 301
cggagggauguggcccagc

SEQ ID NO: 2028333 - RNA, 19 nt, Shigella flexneri 2a str. 301
cggagcuucacccgcagca

SEQ ID NO: 2028334 - RNA, 16 nt, Shigella flexneri 2a str. 301
cggaguuuaugaggca

SEQ ID NO: 2028335 - RNA, 16 nt, Shigella flexneri 2a str. 301
cggaguugcagauuug

SEQ ID NO: 2028336 - RNA, 14 nt, Shigella flexneri 2a str. 301
cggaguuuaugagg

SEQ ID NO: 2028337 - RNA, 22 nt, Shigella flexneri 2a str. 301
cggaguugaccagcuccagcag

SEQ ID NO: 2028338 - RNA, 23 nt, Shigella flexneri 2a str. 301
cggaguugaccagcuccagcaga

SEQ ID NO: 2028339 - RNA, 12 nt, Human
uuauuguagcau

SEQ ID NO: 2028340 - RNA, 14 nt, Human
uuaucuuuuuagua

SEQ ID NO: 2028341 - RNA, 21 nt, Human
uuaugguuguauuauuuuuua

SEQ ID NO: 2028342 - RNA, 16 nt, Human
uuaggauguugaaaaa

SEQ ID NO: 2028343 - RNA, 16 nt, Human
uuaaaagaaugauuau

SEQ ID NO: 2028344 - RNA, 19 nt, Human
uuaaguuuuuuuuuaaaaa

SEQ ID NO: 2028345 - RNA, 14 nt, Human
uuaaacuuugauuu

SEQ ID NO: 2028346 - RNA, 16 nt, Human
uuaaaguaaaggcaaa

SEQ ID NO: 2028347 - RNA, 16 nt, Human
ugacuauuauauuucc

SEQ ID NO: 2028348 - RNA, 18 nt, Human
ugacugcuaguuuauaua

SEQ ID NO: 2028349 - RNA, 14 nt, Human
ugaauauaaauuua

SEQ ID NO: 2028350 - RNA, 15 nt, Human
ugaaugaauggcuaa

SEQ ID NO: 2028351 - RNA, 23 nt, Human
ugaccaacaucgcagacacaugu

SEQ ID NO: 2028352 - RNA, 22 nt, Human
ugauauuggacaguaaaaucca

SEQ ID NO: 2028353 - RNA, 19 nt, Human
ugauggugguauguuuuca

SEQ ID NO: 2028354 - RNA, 16 nt, Human
ugagcuacaaaugcau

SEQ ID NO: 2028355 - RNA, 12 nt, Human
ugauacagaaaa

SEQ ID NO: 2028356 - RNA, 15 nt, Human
ucagaauuucuaaaa

SEQ ID NO: 2028357 - RNA, 18 nt, Human
ucacuggcuguuaaucuu

SEQ ID NO: 2028358 - RNA, 20 nt, Human
ucauucagauaugauucaaa

SEQ ID NO: 2028359 - RNA, 13 nt, Human
ucauccacuuucc

SEQ ID NO: 2028360 - RNA, 18 nt, Human
ugaacuagaguuuagcug

SEQ ID NO: 2028361 - RNA, 21 nt, Human
ugaaguccaagcauuuagaug

SEQ ID NO: 2028362 - RNA, 18 nt, Human
ugaaggauuuauguuuaa

SEQ ID NO: 2028363 - RNA, 16 nt, Human
ugaagauacugaaaua

SEQ ID NO: 2028364 - RNA, 15 nt, Human
ugaagcaaaauuuuu

SEQ ID NO: 2028365 - RNA, 16 nt, Human
uccacuuuccaauaaa

SEQ ID NO: 2028366 - RNA, 22 nt, Human
ucauuuaguuauaaaaauauau

SEQ ID NO: 2028367 - RNA, 15 nt, Human
uguuuauuuguuuuu

SEQ ID NO: 2028368 - RNA, 12 nt, Human
uguuuccaucaa

SEQ ID NO: 2028369 - RNA, 15 nt, Human
ugggaaaaaguaauu

SEQ ID NO: 2028370 - RNA, 19 nt, Human
uggagcugccucucucauc

SEQ ID NO: 2028371 - RNA, 17 nt, Human
uggacucaccuccccca

SEQ ID NO: 2028372 - RNA, 14 nt, Human
ugcagccaccaguc

SEQ ID NO: 2028373 - RNA, 23 nt, Human
ugcauacucauuaggauggcuag

SEQ ID NO: 2028374 - RNA, 20 nt, Human
ugcccuuccccuucccacac

SEQ ID NO: 2028375 - RNA, 15 nt, Human
ugccaucauuuacuu

SEQ ID NO: 2028376 - RNA, 18 nt, Human
uaucacuugucaauaaaa

SEQ ID NO: 2028377 - RNA, 19 nt, Human
uaucacuugucaauaaaau

SEQ ID NO: 2028378 - RNA, 14 nt, Human
ucaauauuucagau

SEQ ID NO: 2028379 - RNA, 16 nt, Human
ucaaugccccugaauu

SEQ ID NO: 2028380 - RNA, 14 nt, Human
uauaucuauauuuu

SEQ ID NO: 2028381 - RNA, 20 nt, Human
uauaguuacccaaauuaaga

SEQ ID NO: 2028382 - RNA, 14 nt, Human
uauauaagcuugua

SEQ ID NO: 2028383 - RNA, 12 nt, Human
uauauauauuuu

SEQ ID NO: 2028384 - RNA, 14 nt, Human
uagcuuuuuucucu

SEQ ID NO: 2028385 - RNA, 23 nt, Human
uagcauaguaccucugcuauuug

SEQ ID NO: 2028386 - RNA, 18 nt, Human
uagcauccuggaauaucu

SEQ ID NO: 2028387 - RNA, 20 nt, Human
uauaaauuuaucauuuaguu

SEQ ID NO: 2028388 - RNA, 23 nt, Human
uauagaaauguauucuuuuaguu

SEQ ID NO: 2028389 - RNA, 23 nt, Human
uaguuuauauagaaauguauucu

SEQ ID NO: 2028390 - RNA, 14 nt, Human
uauaaauaaaaaua

SEQ ID NO: 2028391 - RNA, 15 nt, Human
uaaauauauauuuua

SEQ ID NO: 2028392 - RNA, 14 nt, Human
uaacgauaaaagac

SEQ ID NO: 2028393 - RNA, 23 nt, Human
uaacaaugcuguauuuuaaaaga

SEQ ID NO: 2028394 - RNA, 20 nt, Human
uagaaccaccugccuauauu

SEQ ID NO: 2028395 - RNA, 23 nt, Human
uaagaagacugcauuauauuuau

SEQ ID NO: 2028396 - RNA, 16 nt, Human
guuuuuuccuagucug

SEQ ID NO: 2028397 - RNA, 22 nt, Human
uaaaacaagcacuaaacaaaga

SEQ ID NO: 2028398 - RNA, 14 nt, Human
guuugaaagcuuua

SEQ ID NO: 2028399 - RNA, 13 nt, Human
uaaauagcuuuuu

SEQ ID NO: 2028400 - RNA, 14 nt, Human
uaaaguaugugcau

SEQ ID NO: 2028401 - RNA, 18 nt, Human
gccuucggccuccauccu

SEQ ID NO: 2028402 - RNA, 16 nt, Human
guugaagagguuuuaa

SEQ ID NO: 2028403 - RNA, 19 nt, Human
guuuauauagaaauguauu

SEQ ID NO: 2028404 - RNA, 14 nt, Human
gcuagaauuugaua

SEQ ID NO: 2028405 - RNA, 12 nt, Human
gcuaguaucaaa

SEQ ID NO: 2028406 - RNA, 16 nt, Human
gcuauuugcuguuauu

SEQ ID NO: 2028407 - RNA, 21 nt, Human
cuauauuuuuuguuaaaugau

SEQ ID NO: 2028408 - RNA, 20 nt, Human
cuccaugaauaucaguuauu

SEQ ID NO: 2028409 - RNA, 18 nt, Human
cugauaugggucuugaua

SEQ ID NO: 2028410 - RNA, 21 nt, Human
cugaguguugccuaauuuguu

SEQ ID NO: 2028411 - RNA, 17 nt, Human
cugaggcuccacuuggu

SEQ ID NO: 2028412 - RNA, 22 nt, Human
uuaaaaugucuugcuugauugu

SEQ ID NO: 2028413 - RNA, 19 nt, Human
uuacaaaugggaaacaaaa

SEQ ID NO: 2028414 - RNA, 14 nt, Human
uuaaguauuuuauu

SEQ ID NO: 2028415 - RNA, 14 nt, Human
uuaaccucuaaauu

SEQ ID NO: 2028416 - RNA, 14 nt, Human
uuagggguagcauu

SEQ ID NO: 2028417 - RNA, 15 nt, Human
uuagagaauuuccuu

SEQ ID NO: 2028418 - RNA, 14 nt, Human
uuacucuugauugu

SEQ ID NO: 2028419 - RNA, 15 nt, Human
uuauaaaaauauaua

SEQ ID NO: 2028420 - RNA, 18 nt, Human
uuagugaaauauuauuuu

SEQ ID NO: 2028421 - RNA, 14 nt, Human
uuauaugcuauuua

SEQ ID NO: 2028422 - RNA, 22 nt, Human
uuauagcuacuaauuuuaaaau

SEQ ID NO: 2028423 - RNA, 18 nt, Human
uuauauauuguagauaau

SEQ ID NO: 2028424 - RNA, 14 nt, Human
uuauauuuuuguga

SEQ ID NO: 2028425 - RNA, 13 nt, Human
uuauuucacuuua

SEQ ID NO: 2028426 - RNA, 20 nt, Human
uucaaagugucuugaauugu

SEQ ID NO: 2028427 - RNA, 14 nt, Human
uucacauuggaaac

SEQ ID NO: 2028428 - RNA, 19 nt, Human
uuccacuuauaggaauuga

SEQ ID NO: 2028429 - RNA, 21 nt, Human
uucuuggucucagugucaaug

SEQ ID NO: 2028430 - RNA, 18 nt, Human
uugcauagguuuaauaau

SEQ ID NO: 2028431 - RNA, 16 nt, Human
uugggaaaaaguaauu

SEQ ID NO: 2028432 - RNA, 13 nt, Human
ccuuuuuuugaaa

SEQ ID NO: 2028433 - RNA, 20 nt, Human
ccuuguacuuuauuuucuau

SEQ ID NO: 2028434 - RNA, 12 nt, Human
ccuggugccuca

SEQ ID NO: 2028435 - RNA, 23 nt, Human
ccugcuagaacagucucuugagg

SEQ ID NO: 2028436 - RNA, 16 nt, Human
ccuacuuucauaauaa

SEQ ID NO: 2028437 - RNA, 16 nt, Human
gacaugggacauuugc

SEQ ID NO: 2028438 - RNA, 17 nt, Human
gacauucuuuaucuuuu

SEQ ID NO: 2028439 - RNA, 23 nt, Human
gaaugauuaugaauuacauuugu

SEQ ID NO: 2028440 - RNA, 16 nt, Human
gaauuucuaaaaguuu

SEQ ID NO: 2028441 - RNA, 14 nt, Human
gaaaaaaagcuuuu

SEQ ID NO: 2028442 - RNA, 20 nt, Human
cuuguacucugaaaguuuug

SEQ ID NO: 2028443 - RNA, 15 nt, Human
gaaauuguauuacaa

SEQ ID NO: 2028444 - RNA, 16 nt, Human
gaaauauuauguuaaa

SEQ ID NO: 2028445 - RNA, 15 nt, Human
gaauauaaauuuauc

SEQ ID NO: 2028446 - RNA, 12 nt, Human
gaauauauuucc

SEQ ID NO: 2028447 - RNA, 17 nt, Human
cuuucacauuuaaauaa

SEQ ID NO: 2028448 - RNA, 19 nt, Human
cuugaugaagaaguugaua

SEQ ID NO: 2028449 - RNA, 23 nt, Human
cuucagccugaaagaggaaugaa

SEQ ID NO: 2028450 - RNA, 19 nt, Human
cuucagcagagaaguuuuc

SEQ ID NO: 2028451 - RNA, 16 nt, Human
cuucacuguaaaauaa

SEQ ID NO: 2028452 - RNA, 22 nt, Human
cugcuaugcuauugaaguuuug

SEQ ID NO: 2028453 - RNA, 16 nt, Human
gagaaaacaauaacga

SEQ ID NO: 2028454 - RNA, 20 nt, Human
gagaugcuagaacucccuuu

SEQ ID NO: 2028455 - RNA, 15 nt, Human
gagauugugccccug

SEQ ID NO: 2028456 - RNA, 20 nt, Human
gagcacgcauggaaaaguuu

SEQ ID NO: 2028457 - RNA, 20 nt, Human
gauuauauauauuuuuuucu

SEQ ID NO: 2028458 - RNA, 22 nt, Human
gaucuggcucuggacaggcacu

SEQ ID NO: 2028459 - RNA, 20 nt, Human
gauacuauuuaauuauuuca

SEQ ID NO: 2028460 - RNA, 17 nt, Human
gauaaacaguagugaua

SEQ ID NO: 2028461 - RNA, 11 nt, Human
gauacagaaaa

SEQ ID NO: 2028462 - RNA, 17 nt, Human
gagugccuguaaucaca

SEQ ID NO: 2028463 - RNA, 15 nt, Human
gcaucccuagaaagc

SEQ ID NO: 2028464 - RNA, 19 nt, Human
gcacagugaucaaguuauu

SEQ ID NO: 2028465 - RNA, 15 nt, Human
aaaagaaacauuugg

SEQ ID NO: 2028466 - RNA, 14 nt, Human
aaaacguauugcau

SEQ ID NO: 2028467 - RNA, 19 nt, Human
aaaacguauugcauuuaau

SEQ ID NO: 2028468 - RNA, 18 nt, Human
aaaaaugguuuaaauggu

SEQ ID NO: 2028469 - RNA, 17 nt, Human
aaauuguauuacaaauc

SEQ ID NO: 2028470 - RNA, 20 nt, Human
aagucuuucacauuuaaaua

SEQ ID NO: 2028471 - RNA, 15 nt, Human
aaguccaagcauuua

SEQ ID NO: 2028472 - RNA, 20 nt, Human
aaguccaagcauuuagaugu

SEQ ID NO: 2028473 - RNA, 14 nt, Human
aagguacuucaaau

SEQ ID NO: 2028474 - RNA, 14 nt, Human
aaguaaugauaacu

SEQ ID NO: 2028475 - RNA, 16 nt, Human
aagcuucacuguaaaa

SEQ ID NO: 2028476 - RNA, 18 nt, Human
aaggauuuauguuuaauu

SEQ ID NO: 2028477 - RNA, 13 nt, Human
aaggagccaaaca

SEQ ID NO: 2028478 - RNA, 17 nt, Human
aaaguaacccuacaaaa

SEQ ID NO: 2028479 - RNA, 20 nt, Human
aaaguauguuagugcaaauu

SEQ ID NO: 2028480 - RNA, 12 nt, Human
aaguucuaguga

SEQ ID NO: 2028481 - RNA, 14 nt, Human
aaauauuauuuuau

SEQ ID NO: 2028482 - RNA, 23 nt, Human
aaauauugacuuuuuauggcacu

SEQ ID NO: 2028483 - RNA, 18 nt, Human
aaauggaauacucuuaua

SEQ ID NO: 2028484 - RNA, 21 nt, Human
aaauaauuuuuauauuugaaa

SEQ ID NO: 2028485 - RNA, 14 nt, Human
aacucaaauacgug

SEQ ID NO: 2028486 - RNA, 21 nt, Human
aacauaugaauuauguuugca

SEQ ID NO: 2028487 - RNA, 15 nt, Human
aacaauuugaauaua

SEQ ID NO: 2028488 - RNA, 14 nt, Human
aagaaaauaacgau

SEQ ID NO: 2028489 - RNA, 14 nt, Human
aagaaugauuauga

SEQ ID NO: 2028490 - RNA, 12 nt, Human
aagacaaaaagc

SEQ ID NO: 2028491 - RNA, 14 nt, Human
aagauuuaccacuu

SEQ ID NO: 2028492 - RNA, 21 nt, Human
aagauuuuguuguuguuuguu

SEQ ID NO: 2028493 - RNA, 16 nt, Human
aagcaacccaaauguu

SEQ ID NO: 2028494 - RNA, 17 nt, Human
aagauacugaaauaaac

SEQ ID NO: 2028495 - RNA, 13 nt, Human
aagcauuuagaug

SEQ ID NO: 2028496 - RNA, 21 nt, Human
uggggaauauguuagagaauu

SEQ ID NO: 2028497 - RNA, 16 nt, Human
ugggucgccggcaucu

SEQ ID NO: 2028498 - RNA, 18 nt, Human
uggacgagaaaacaauaa

SEQ ID NO: 2028499 - RNA, 14 nt, Human
uggaaguaaauguu

SEQ ID NO: 2028500 - RNA, 22 nt, Human
uguuuuauuuaaccucuaaauu

SEQ ID NO: 2028501 - RNA, 20 nt, Human
uguuucuuggggaauauguu

SEQ ID NO: 2028502 - RNA, 14 nt, Human
uguguuugaagcac

SEQ ID NO: 2028503 - RNA, 13 nt, Human
ugugcuaaaacaa

SEQ ID NO: 2028504 - RNA, 14 nt, Human
ugugaacccaaagu

SEQ ID NO: 2028505 - RNA, 22 nt, Human
ugugauauguaccuaacgaagu

SEQ ID NO: 2028506 - RNA, 20 nt, Human
ugucucuacuaaaaauacaa

SEQ ID NO: 2028507 - RNA, 22 nt, Human
uguagauaauacaguucgguga

SEQ ID NO: 2028508 - RNA, 19 nt, Human
uguaggugacuauuauauu

SEQ ID NO: 2028509 - RNA, 20 nt, Human
ugucaauaaaauccauacau

SEQ ID NO: 2028510 - RNA, 17 nt, Human
ugguagcuaaauauaua

SEQ ID NO: 2028511 - RNA, 19 nt, Human
uguaauaggcguaacuaau

SEQ ID NO: 2028512 - RNA, 20 nt, Human
uguaauaggcguaacuaauu

SEQ ID NO: 2028513 - RNA, 16 nt, Human
uguaaaauaauaacug

SEQ ID NO: 2028514 - RNA, 17 nt, Human
ugcuggagacauugagg

SEQ ID NO: 2028515 - RNA, 15 nt, Human
ugagagugaacaaau

SEQ ID NO: 2028516 - RNA, 22 nt, Human
ugaauuuaaauagcuuuuuucu

SEQ ID NO: 2028517 - RNA, 21 nt, Human
ugaacaguuguguuugaagca

SEQ ID NO: 2028518 - RNA, 13 nt, Human
ugaaaaaaagcuu

SEQ ID NO: 2028519 - RNA, 17 nt, Human
ugaaaaugucauuguuc

SEQ ID NO: 2028520 - RNA, 19 nt, Human
ucuuucaaagugucuugaa

SEQ ID NO: 2028521 - RNA, 16 nt, Human
uccccaugauguuuag

SEQ ID NO: 2028522 - RNA, 15 nt, Human
uccgucaacucauau

SEQ ID NO: 2028523 - RNA, 22 nt, Human
guuuuauaugcuucuguuuuau

SEQ ID NO: 2028524 - RNA, 15 nt, Human
gugacuauuauauuu

SEQ ID NO: 2028525 - RNA, 15 nt, Human
guuuaucguauuuga

SEQ ID NO: 2028526 - RNA, 16 nt, Human
gucaaauugugugaaa

SEQ ID NO: 2028527 - RNA, 17 nt, Human
gugaaagaaaauaacga

SEQ ID NO: 2028528 - RNA, 23 nt, Human
ggauaaugaauacuuuauaaagg

SEQ ID NO: 2028529 - RNA, 19 nt, Human
guagaggagaaacuggaac

SEQ ID NO: 2028530 - RNA, 14 nt, Human
uagguuuaauaauu

SEQ ID NO: 2028531 - RNA, 20 nt, Human
uaagcuucacuguaaaauaa

SEQ ID NO: 2028532 - RNA, 16 nt, Human
uagucucuaucauuaa

SEQ ID NO: 2028533 - RNA, 16 nt, Human
uaguuauaaaaauaua

SEQ ID NO: 2028534 - RNA, 23 nt, Human
uauauggcuugaguuuaaauugu

SEQ ID NO: 2028535 - RNA, 15 nt, Human
uauauuguagauaau

SEQ ID NO: 2028536 - RNA, 19 nt, Human
uauagaaauguauucuuuu

SEQ ID NO: 2028537 - RNA, 13 nt, Human
uaacgauaaaaga

SEQ ID NO: 2028538 - RNA, 22 nt, Human
uaagaauucuguugauggaaau

SEQ ID NO: 2028539 - RNA, 13 nt, Human
uaacaauaaaaga

SEQ ID NO: 2028540 - RNA, 14 nt, Human
uaacaauaaaagac

SEQ ID NO: 2028541 - RNA, 17 nt, Human
uaaauggaaguaaaugu

SEQ ID NO: 2028542 - RNA, 15 nt, Human
uaaauuuaucauuua

SEQ ID NO: 2028543 - RNA, 13 nt, Human
uaaacauguuuau

SEQ ID NO: 2028544 - RNA, 14 nt, Human
uaaaauaauaacug

SEQ ID NO: 2028545 - RNA, 17 nt, Human
uaaaauaauuuuuauau

SEQ ID NO: 2028546 - RNA, 22 nt, Human
uccaaacugacucuuaagaaga

SEQ ID NO: 2028547 - RNA, 15 nt, Human
uauuuuaauguuucu

SEQ ID NO: 2028548 - RNA, 12 nt, Human
uauuuuguuuca

SEQ ID NO: 2028549 - RNA, 16 nt, Human
uauuuuuuguuaaaug

SEQ ID NO: 2028550 - RNA, 18 nt, Human
uauuuuaauaauguuuca

SEQ ID NO: 2028551 - RNA, 21 nt, Human
uaucaaaagaaagaaaaucag

SEQ ID NO: 2028552 - RNA, 15 nt, Human
uaugccuuuucccaa

SEQ ID NO: 2028553 - RNA, 20 nt, Human
uauguagaauauauuuccuu

SEQ ID NO: 2028554 - RNA, 21 nt, Human
uauuugcuguuauuuuaucug

SEQ ID NO: 2028555 - RNA, 16 nt, Human
uauuuauuuuaauaau

SEQ ID NO: 2028556 - RNA, 17 nt, Human
uauuuacggaacucaaa

SEQ ID NO: 2028557 - RNA, 22 nt, Human
uauuuacggaacucaaauacgu

SEQ ID NO: 2028558 - RNA, 21 nt, Human
cuuccuggauuccucacuuug

SEQ ID NO: 2028559 - RNA, 15 nt, Human
cuuccucccauucag

SEQ ID NO: 2028560 - RNA, 14 nt, Human
gaauaucaguuauu

SEQ ID NO: 2028561 - RNA, 18 nt, Human
gaauaauccuaaacauau

SEQ ID NO: 2028562 - RNA, 16 nt, Human
gaagaagcaccaauca

SEQ ID NO: 2028563 - RNA, 15 nt, Human
cugggagccccaauu

SEQ ID NO: 2028564 - RNA, 15 nt, Human
cuguggauuuaaugu

SEQ ID NO: 2028565 - RNA, 17 nt, Human
cuguuaucuucacuuuu

SEQ ID NO: 2028566 - RNA, 14 nt, Human
cuagaacagucucu

SEQ ID NO: 2028567 - RNA, 21 nt, Human
cuggaauaauccuaaacauau

SEQ ID NO: 2028568 - RNA, 18 nt, Human
cuaagaaggcaccucucu

SEQ ID NO: 2028569 - RNA, 20 nt, Human
cuaaauugacacuuaaaaau

SEQ ID NO: 2028570 - RNA, 22 nt, Human
cuaaaacaagcacuaaacaaag

SEQ ID NO: 2028571 - RNA, 16 nt, Human
cuagaaaacaggcaaa

SEQ ID NO: 2028572 - RNA, 22 nt, Human
cgcuuccgcauccuagucucua

SEQ ID NO: 2028573 - RNA, 16 nt, Human
cguauugcauuuaauu

SEQ ID NO: 2028574 - RNA, 16 nt, Human
gauaaaagacagugaa

SEQ ID NO: 2028575 - RNA, 16 nt, Human
gcccauccugccccug

SEQ ID NO: 2028576 - RNA, 18 nt, Human
gacaaggaaaaaauaaca

SEQ ID NO: 2028577 - RNA, 14 nt, Human
gcuguuaaucuuuc

SEQ ID NO: 2028578 - RNA, 12 nt, Human
gcuguuauuuua

SEQ ID NO: 2028579 - RNA, 16 nt, Human
gcccugcugaguccca

SEQ ID NO: 2028580 - RNA, 21 nt, Human
ccaaagugugacucauuaaau

SEQ ID NO: 2028581 - RNA, 11 nt, Human
cauuugguaag

SEQ ID NO: 2028582 - RNA, 18 nt, Human
caugaaguccaagcauuu

SEQ ID NO: 2028583 - RNA, 21 nt, Human
cagccugaaagaggaaugaag

SEQ ID NO: 2028584 - RNA, 22 nt, Human
cagcacagccucuuagaugcag

SEQ ID NO: 2028585 - RNA, 17 nt, Human
cacagaccuuugaacua

SEQ ID NO: 2028586 - RNA, 23 nt, Human
caauucuugccaaauauaaauaa

SEQ ID NO: 2028587 - RNA, 21 nt, Human
caaugccccugaauuuaaaua

SEQ ID NO: 2028588 - RNA, 18 nt, Human
augccccauucaacaucu

SEQ ID NO: 2028589 - RNA, 16 nt, Human
auguagaauauauuuc

SEQ ID NO: 2028590 - RNA, 20 nt, Human
augugcauauuuuauuauag

SEQ ID NO: 2028591 - RNA, 18 nt, Human
auguauguacuucaugcu

SEQ ID NO: 2028592 - RNA, 21 nt, Human
auguauucuuuuaguuuuuaa

SEQ ID NO: 2028593 - RNA, 21 nt, Human
cccaaauguucaucaaugaau

SEQ ID NO: 2028594 - RNA, 17 nt, Human
ccauucaggaugcccac

SEQ ID NO: 2028595 - RNA, 19 nt, Human
ccacuuggucugugagaug

SEQ ID NO: 2028596 - RNA, 15 nt, Human
ccaguuguuucuacu

SEQ ID NO: 2028597 - RNA, 16 nt, Human
cccugaauuuaaauag

SEQ ID NO: 2028598 - RNA, 16 nt, Human
ccgguccuugcugcac

SEQ ID NO: 2028599 - RNA, 15 nt, Human
ccgugggguuccucc

SEQ ID NO: 2028600 - RNA, 14 nt, Human
ccuccauccugagg

SEQ ID NO: 2028601 - RNA, 21 nt, Human
ccucagucucccucccuuggg

SEQ ID NO: 2028602 - RNA, 15 nt, Human
cgcccacuagaccca

SEQ ID NO: 2028603 - RNA, 15 nt, Human
cgcauccuagucucu

SEQ ID NO: 2028604 - RNA, 14 nt, Human
ccuugaugaagaag

SEQ ID NO: 2028605 - RNA, 11 nt, Human
cgacggagccg

SEQ ID NO: 2028606 - RNA, 18 nt, Human
aggugacuauuauauuuc

SEQ ID NO: 2028607 - RNA, 15 nt, Human
agcagggacuugaac

SEQ ID NO: 2028608 - RNA, 19 nt, Human
agauaugauucaaaugucu

SEQ ID NO: 2028609 - RNA, 21 nt, Human
agagcuacaggccccaucugg

SEQ ID NO: 2028610 - RNA, 14 nt, Human
agagguccacaaca

SEQ ID NO: 2028611 - RNA, 15 nt, Human
agauacugaaauaaa

SEQ ID NO: 2028612 - RNA, 21 nt, Human
agcaaguauuagaauaccaca

SEQ ID NO: 2028613 - RNA, 14 nt, Human
agauugugccccug

SEQ ID NO: 2028614 - RNA, 13 nt, Human
agaaccaccugcc

SEQ ID NO: 2028615 - RNA, 22 nt, Human
agaaccaccugccuauauuuuu

SEQ ID NO: 2028616 - RNA, 17 nt, Human
agaagaugguaccacca

SEQ ID NO: 2028617 - RNA, 14 nt, Human
agaauaaccaacac

SEQ ID NO: 2028618 - RNA, 15 nt, Human
agaauuucuaaaagu

SEQ ID NO: 2028619 - RNA, 20 nt, Human
acuuuauuuucuauaauuua

SEQ ID NO: 2028620 - RNA, 14 nt, Human
acuuuccaauaaag

SEQ ID NO: 2028621 - RNA, 20 nt, Human
agaaaaguugaauuuuacau

SEQ ID NO: 2028622 - RNA, 22 nt, Human
acuuguaaaggaauuuaaaaau

SEQ ID NO: 2028623 - RNA, 15 nt, Human
acuugucaauaaaau

SEQ ID NO: 2028624 - RNA, 21 nt, Human
agugaaagaaaauaacaauaa

SEQ ID NO: 2028625 - RNA, 19 nt, Human
aguauccuucagccugaaa

SEQ ID NO: 2028626 - RNA, 15 nt, Human
aguacaagagcuuaa

SEQ ID NO: 2028627 - RNA, 21 nt, Human
auaucuccgucaacucauauu

SEQ ID NO: 2028628 - RNA, 16 nt, Human
auaugcuauuuauuaa

SEQ ID NO: 2028629 - RNA, 13 nt, Human
auauuuacaaaug

SEQ ID NO: 2028630 - RNA, 13 nt, Human
auauuuauuuuaa

SEQ ID NO: 2028631 - RNA, 16 nt, Human
auauuauguuaaaacu

SEQ ID NO: 2028632 - RNA, 17 nt, Human
auaucaguuauuuuuaa

SEQ ID NO: 2028633 - RNA, 17 nt, Human
auaucuauauuuuacau

SEQ ID NO: 2028634 - RNA, 20 nt, Human
auaucuccgucaacucauau

SEQ ID NO: 2028635 - RNA, 19 nt, Human
auauaguuacccaaauuaa

SEQ ID NO: 2028636 - RNA, 14 nt, Human
augcauuucuaaag

SEQ ID NO: 2028637 - RNA, 13 nt, Human
augaguaacugau

SEQ ID NO: 2028638 - RNA, 22 nt, Human
auggcuuccuggcaauagucaa

SEQ ID NO: 2028639 - RNA, 18 nt, Human
auggcuugaguuuaaauu

SEQ ID NO: 2028640 - RNA, 22 nt, Human
augcuagaacucccuuucaaca

SEQ ID NO: 2028641 - RNA, 12 nt, Human
auauuuuaaugu

SEQ ID NO: 2028642 - RNA, 14 nt, Human
auauuuuuuguuaa

SEQ ID NO: 2028643 - RNA, 10 nt, Human
auauuuuuuu

SEQ ID NO: 2028644 - RNA, 17 nt, Human
auauuuccuuauucaga

SEQ ID NO: 2028645 - RNA, 13 nt, Human
aucauuaaaguuc

SEQ ID NO: 2028646 - RNA, 17 nt, Human
aucaugaauuaguuuua

SEQ ID NO: 2028647 - RNA, 14 nt, Human
aagacaaaaagcua

SEQ ID NO: 2028648 - RNA, 14 nt, Human
aagaaguugauaug

SEQ ID NO: 2028649 - RNA, 24 nt, Human
aacguauugcauuuaauuuauuga

SEQ ID NO: 2028650 - RNA, 18 nt, Human
aacucuauaauguguuca

SEQ ID NO: 2028651 - RNA, 16 nt, Human
aacaauuugaauauaa

SEQ ID NO: 2028652 - RNA, 17 nt, Human
aacaaugcuguauuuua

SEQ ID NO: 2028653 - RNA, 19 nt, Human
aaauggugugaccacugca

SEQ ID NO: 2028654 - RNA, 20 nt, Human
aauuauguuugcauguucac

SEQ ID NO: 2028655 - RNA, 17 nt, Human
aauuauuucacuuuaga

SEQ ID NO: 2028656 - RNA, 15 nt, Human
aauuuaguauuuugu

SEQ ID NO: 2028657 - RNA, 14 nt, Human
aauuggagcucgug

SEQ ID NO: 2028658 - RNA, 17 nt, Human
aauuuuuauauuugaaa

SEQ ID NO: 2028659 - RNA, 19 nt, Human
aauuuccugggagcuuuug

SEQ ID NO: 2028660 - RNA, 23 nt, Human
aauuugguuuucacauuggaaac

SEQ ID NO: 2028661 - RNA, 16 nt, Human
aagacugcacaucaaa

SEQ ID NO: 2028662 - RNA, 18 nt, Human
aagagccggagccuccag

SEQ ID NO: 2028663 - RNA, 22 nt, Human
aagcagggacuugaacccauau

SEQ ID NO: 2028664 - RNA, 20 nt, Human
aagccagacaucaacagaua

SEQ ID NO: 2028665 - RNA, 13 nt, Human
acgucuuaaauau

SEQ ID NO: 2028666 - RNA, 19 nt, Human
acuaauuauacccccugca

SEQ ID NO: 2028667 - RNA, 20 nt, Human
acuaauuuuaacucuauaau

SEQ ID NO: 2028668 - RNA, 16 nt, Human
acuaugucauuugcug

SEQ ID NO: 2028669 - RNA, 15 nt, Human
acuaucucauuucca

SEQ ID NO: 2028670 - RNA, 14 nt, Human
acugccaucauuua

SEQ ID NO: 2028671 - RNA, 13 nt, Human
acuucaaauccuu

SEQ ID NO: 2028672 - RNA, 16 nt, Human
acucugaaaguuuugg

SEQ ID NO: 2028673 - RNA, 21 nt, Human
acucuuaagaagacugcauua

SEQ ID NO: 2028674 - RNA, 21 nt, Human
acuauuuaauuauuucacuuu

SEQ ID NO: 2028675 - RNA, 17 nt, Human
acaauuugaauauaaau

SEQ ID NO: 2028676 - RNA, 16 nt, Human
acaccuuguacuuuau

SEQ ID NO: 2028677 - RNA, 14 nt, Human
accugcccugcuga

SEQ ID NO: 2028678 - RNA, 17 nt, Human
uuugaaagcuuuauuua

SEQ ID NO: 2028679 - RNA, 11 nt, Human
uuucugaaauu

SEQ ID NO: 2028680 - RNA, 17 nt, Human
uuucacauuuaaauaaa

SEQ ID NO: 2028681 - RNA, 15 nt, Human
uuuucuuuucauuua

SEQ ID NO: 2028682 - RNA, 19 nt, Human
uuuucaguuauuauauuua

SEQ ID NO: 2028683 - RNA, 13 nt, Human
uuuuauuuaaccu

SEQ ID NO: 2028684 - RNA, 19 nt, Human
uuugcucauggaauuggag

SEQ ID NO: 2028685 - RNA, 18 nt, Human
uugccaaauauaaauaaa

SEQ ID NO: 2028686 - RNA, 19 nt, Human
uugaagagguuuuaaagcu

SEQ ID NO: 2028687 - RNA, 13 nt, Human
uuguuaaaugauu

SEQ ID NO: 2028688 - RNA, 20 nt, Human
uuguaauaggcguaacuaau

SEQ ID NO: 2028689 - RNA, 17 nt, Human
uguuaucuucacuuuua

SEQ ID NO: 2028690 - RNA, 15 nt, Human
uguuccuaauaaagc

SEQ ID NO: 2028691 - RNA, 22 nt, Human
uguucuaagaagugaaaaucua

SEQ ID NO: 2028692 - RNA, 22 nt, Human
ugugggauacuauuuaauuauu

SEQ ID NO: 2028693 - RNA, 18 nt, Human
ugugcuaguaauuggaaa

SEQ ID NO: 2028694 - RNA, 19 nt, Human
ugugcuaguaauuggaaag

SEQ ID NO: 2028695 - RNA, 22 nt, Human
uucauagcagcuuauucacaag

SEQ ID NO: 2028696 - RNA, 16 nt, Human
uucagacauagaauua

SEQ ID NO: 2028697 - RNA, 16 nt, Human
uuccugggagcuuuug

SEQ ID NO: 2028698 - RNA, 17 nt, Human
uucuauaauuuaaauau

SEQ ID NO: 2028699 - RNA, 13 nt, Human
uucuaagaaguga

SEQ ID NO: 2028700 - RNA, 12 nt, Human
uucggccuccau

SEQ ID NO: 2028701 - RNA, 22 nt, Human
ugggauacuauuuaauuauuuc

SEQ ID NO: 2028702 - RNA, 19 nt, Human
ugggagcuuuuguagaagu

SEQ ID NO: 2028703 - RNA, 17 nt, Human
ugaacaggauauucuca

SEQ ID NO: 2028704 - RNA, 17 nt, Human
ugaaauauugacuuuuu

SEQ ID NO: 2028705 - RNA, 18 nt, Human
ugaaagaaaauaacaaua

SEQ ID NO: 2028706 - RNA, 14 nt, Human
ugaaagcuuuauuu

SEQ ID NO: 2028707 - RNA, 15 nt, Human
ugguagcuaaauaua

SEQ ID NO: 2028708 - RNA, 16 nt, Human
ugguagcuaaauauau

SEQ ID NO: 2028709 - RNA, 17 nt, Human
uguauggguguugguga

SEQ ID NO: 2028710 - RNA, 15 nt, Human
uguauuccuuuuucu

SEQ ID NO: 2028711 - RNA, 13 nt, Human
uguagaauauauu

SEQ ID NO: 2028712 - RNA, 15 nt, Human
uguaguguuggagaa

SEQ ID NO: 2028713 - RNA, 20 nt, Human
ugucauaggcucuuuuggga

SEQ ID NO: 2028714 - RNA, 15 nt, Human
ucucauccacuuucc

SEQ ID NO: 2028715 - RNA, 16 nt, Human
ucuugauaaauggcuu

SEQ ID NO: 2028716 - RNA, 16 nt, Human
ucuguugauggaaaua

SEQ ID NO: 2028717 - RNA, 16 nt, Human
ucuauaauuuaaauau

SEQ ID NO: 2028718 - RNA, 20 nt, Human
ucuaugagggcuaauaucuu

SEQ ID NO: 2028719 - RNA, 18 nt, Human
ggugacuauuauauuucc

SEQ ID NO: 2028720 - RNA, 20 nt, Human
gggaaugaagauacugaaau

SEQ ID NO: 2028721 - RNA, 19 nt, Human
ggaaugaagauacugaaau

SEQ ID NO: 2028722 - RNA, 15 nt, Human
ggaaaugauguuuca

SEQ ID NO: 2028723 - RNA, 14 nt, Human
uccuagucucuauc

SEQ ID NO: 2028724 - RNA, 18 nt, Human
uccguagguuauuuucag

SEQ ID NO: 2028725 - RNA, 14 nt, Human
uauuuuuaaacugu

SEQ ID NO: 2028726 - RNA, 16 nt, Human
ucaacucauauuuuca

SEQ ID NO: 2028727 - RNA, 14 nt, Human
uaugugcauauuuu

SEQ ID NO: 2028728 - RNA, 19 nt, Human
uauuuaaccucuaaauucu

SEQ ID NO: 2028729 - RNA, 16 nt, Human
uauugaggcuuuaaaa

SEQ ID NO: 2028730 - RNA, 20 nt, Human
uauuguagcauccuggaaua

SEQ ID NO: 2028731 - RNA, 17 nt, Human
uauuuucaugcuguuca

SEQ ID NO: 2028732 - RNA, 19 nt, Human
uauuucagauaaucacaau

SEQ ID NO: 2028733 - RNA, 15 nt, Human
uacauuuguauaaaa

SEQ ID NO: 2028734 - RNA, 20 nt, Human
uacauuuguauaaaauaauu

SEQ ID NO: 2028735 - RNA, 13 nt, Human
uaugcuauuuauu

SEQ ID NO: 2028736 - RNA, 14 nt, Human
uaugcuauuuauua

SEQ ID NO: 2028737 - RNA, 15 nt, Human
uaugcuucuguuuua

SEQ ID NO: 2028738 - RNA, 17 nt, Human
uaugguuguauuauuuu

SEQ ID NO: 2028739 - RNA, 14 nt, Human
uauguagaauauau

SEQ ID NO: 2028740 - RNA, 21 nt, Human
uaauuuguaguguuggagaag

SEQ ID NO: 2028741 - RNA, 16 nt, Human
uacuaauuuuaaaaug

SEQ ID NO: 2028742 - RNA, 13 nt, Human
uacucuuauaucu

SEQ ID NO: 2028743 - RNA, 19 nt, Human
uacucuugauugugggaua

SEQ ID NO: 2028744 - RNA, 16 nt, Human
gugaaagaaaauaaca

SEQ ID NO: 2028745 - RNA, 15 nt, Human
gugcagauucuuuac

SEQ ID NO: 2028746 - RNA, 20 nt, Human
guauggcagcuuuccucaaa

SEQ ID NO: 2028747 - RNA, 11 nt, Human
uaauuggaaag

SEQ ID NO: 2028748 - RNA, 19 nt, Human
uaauaggcguaacuaauuu

SEQ ID NO: 2028749 - RNA, 23 nt, Human
uaauaggcguaacuaauuuuaac

SEQ ID NO: 2028750 - RNA, 13 nt, Human
uacagaauuuuau

SEQ ID NO: 2028751 - RNA, 20 nt, Human
uacaguggggaaugaagaua

SEQ ID NO: 2028752 - RNA, 21 nt, Human
uacaucccuuaccugggaaag

SEQ ID NO: 2028753 - RNA, 23 nt, Human
uacaaaaccacuggaaaguuuau

SEQ ID NO: 2028754 - RNA, 21 nt, Human
uaagacaaaaagcuacuuauu

SEQ ID NO: 2028755 - RNA, 14 nt, Human
uaagauauuaacug

SEQ ID NO: 2028756 - RNA, 16 nt, Human
guuauuauauuuacaa

SEQ ID NO: 2028757 - RNA, 20 nt, Human
aaagcuuugugcagauucuu

SEQ ID NO: 2028758 - RNA, 20 nt, Human
aaaguaugugcauauuuuau

SEQ ID NO: 2028759 - RNA, 20 nt, Human
aaauacacuguuaucuucac

SEQ ID NO: 2028760 - RNA, 14 nt, Human
aaauaacaauaaaa

SEQ ID NO: 2028761 - RNA, 21 nt, Human
aaacuucagacauagaauuaa

SEQ ID NO: 2028762 - RNA, 23 nt, Human
aaacuuuaugcuaagugaaauaa

SEQ ID NO: 2028763 - RNA, 13 nt, Human
aaacuuuuggaag

SEQ ID NO: 2028764 - RNA, 16 nt, Human
aaaauaauuuuuauau

SEQ ID NO: 2028765 - RNA, 17 nt, Human
aaaauccauacauuugu

SEQ ID NO: 2028766 - RNA, 13 nt, Human
aaacaauaacgau

SEQ ID NO: 2028767 - RNA, 14 nt, Human
aaaauggaauacuc

SEQ ID NO: 2028768 - RNA, 15 nt, Human
aaaaugugauaugua

SEQ ID NO: 2028769 - RNA, 16 nt, Human
agcuucacuguaaaau

SEQ ID NO: 2028770 - RNA, 22 nt, Human
agcuuauucacaagacccaaaa

SEQ ID NO: 2028771 - RNA, 17 nt, Human
agcuuauugucuaguga

SEQ ID NO: 2028772 - RNA, 22 nt, Human
agcucugcccauccugccccug

SEQ ID NO: 2028773 - RNA, 13 nt, Human
aguuauaaaaaua

SEQ ID NO: 2028774 - RNA, 18 nt, Human
aggcguaacuaauuuuaa

SEQ ID NO: 2028775 - RNA, 13 nt, Human
aguuuuauaugcu

SEQ ID NO: 2028776 - RNA, 15 nt, Human
aguuucccuugcaug

SEQ ID NO: 2028777 - RNA, 13 nt, Human
aguuuuuaaagua

SEQ ID NO: 2028778 - RNA, 23 nt, Human
auaaaacaccuuguacuuuauuu

SEQ ID NO: 2028779 - RNA, 19 nt, Human
auaaaguguuugaaagcuu

SEQ ID NO: 2028780 - RNA, 23 nt, Human
auaacuggaaacuucagcgguuu

SEQ ID NO: 2028781 - RNA, 22 nt, Human
auaauuuugugaagcaaaauuu

SEQ ID NO: 2028782 - RNA, 15 nt, Human
auacacuguuaucuu

SEQ ID NO: 2028783 - RNA, 13 nt, Human
auaauuuaaaaua

SEQ ID NO: 2028784 - RNA, 16 nt, Human
aauuacauuuguauaa

SEQ ID NO: 2028785 - RNA, 16 nt, Human
acagccucuuagaugc

SEQ ID NO: 2028786 - RNA, 22 nt, Human
acauauauaacaaugcuguauu

SEQ ID NO: 2028787 - RNA, 20 nt, Human
acaugaaguccaagcauuua

SEQ ID NO: 2028788 - RNA, 14 nt, Human
agcuacuaauuuua

SEQ ID NO: 2028789 - RNA, 13 nt, Human
agcuagaauuuga

SEQ ID NO: 2028790 - RNA, 14 nt, Human
caaauauaaauaaa

SEQ ID NO: 2028791 - RNA, 14 nt, Human
caaauguucaucaa

SEQ ID NO: 2028792 - RNA, 16 nt, Human
caaaugcauuucuaaa

SEQ ID NO: 2028793 - RNA, 21 nt, Human
cacuaaauugacacuuaaaaa

SEQ ID NO: 2028794 - RNA, 13 nt, Human
cacgcauggaaaa

SEQ ID NO: 2028795 - RNA, 22 nt, Human
auuuuauagcuacuaauuuuaa

SEQ ID NO: 2028796 - RNA, 16 nt, Human
auuuucaugcuguuca

SEQ ID NO: 2028797 - RNA, 18 nt, Human
auuuucuauaauuuaaau

SEQ ID NO: 2028798 - RNA, 21 nt, Human
auuugaaauuguauuacaaau

SEQ ID NO: 2028799 - RNA, 13 nt, Human
auuugcuguuauu

SEQ ID NO: 2028800 - RNA, 15 nt, Human
auuugguuuucacau

SEQ ID NO: 2028801 - RNA, 22 nt, Human
auuuguacaccaauauucauag

SEQ ID NO: 2028802 - RNA, 13 nt, Human
auuuguauaaaau

SEQ ID NO: 2028803 - RNA, 12 nt, Human
auuuacuuuuaa

SEQ ID NO: 2028804 - RNA, 18 nt, Human
auuuaguauuuuguuuca

SEQ ID NO: 2028805 - RNA, 15 nt, Human
auuuauugaggcuuu

SEQ ID NO: 2028806 - RNA, 22 nt, Human
auucagauaugauucaaauguc

SEQ ID NO: 2028807 - RNA, 15 nt, Human
auucacucaacaaac

SEQ ID NO: 2028808 - RNA, 13 nt, Human
auugaaguuuugg

SEQ ID NO: 2028809 - RNA, 14 nt, Human
auugucuagugaaa

SEQ ID NO: 2028810 - RNA, 15 nt, Human
auuauauuuauuacu

SEQ ID NO: 2028811 - RNA, 19 nt, Human
auuaugaauuacauuugua

SEQ ID NO: 2028812 - RNA, 17 nt, Human
auuagcauggccacauc

SEQ ID NO: 2028813 - RNA, 23 nt, Human
augagcacgcauggaaaaguuuc

SEQ ID NO: 2028814 - RNA, 18 nt, Human
auuacauuuguauaaaau

SEQ ID NO: 2028815 - RNA, 23 nt, Human
augacuuguacucugaaaguuuu

SEQ ID NO: 2028816 - RNA, 23 nt, Human
augaauuauguuugcauguucac

SEQ ID NO: 2028817 - RNA, 12 nt, Human
augaccaacauc

SEQ ID NO: 2028818 - RNA, 18 nt, Human
auacgugggcauucaaau

SEQ ID NO: 2028819 - RNA, 20 nt, Human
auacgugggcauucaaaugu

SEQ ID NO: 2028820 - RNA, 20 nt, Human
aucccuagaaagccaugugc

SEQ ID NO: 2028821 - RNA, 14 nt, Human
auaauuuuuauauu

SEQ ID NO: 2028822 - RNA, 15 nt, Human
auccuggaauaucuc

SEQ ID NO: 2028823 - RNA, 21 nt, Human
auccugcaauuccacuuauag

SEQ ID NO: 2028824 - RNA, 21 nt, Human
auccuagucucuaucauuaaa

SEQ ID NO: 2028825 - RNA, 16 nt, Human
aucuuauaauuuaaaa

SEQ ID NO: 2028826 - RNA, 16 nt, Human
aucuucacuuuuauaa

SEQ ID NO: 2028827 - RNA, 14 nt, Human
aucuccgucaacuc

SEQ ID NO: 2028828 - RNA, 18 nt, Human
aucuauguagaauauauu

SEQ ID NO: 2028829 - RNA, 14 nt, Human
augaaauauuaugu

SEQ ID NO: 2028830 - RNA, 20 nt, Human
augaauuaaguuuuuuuuua

SEQ ID NO: 2028831 - RNA, 13 nt, Human
augaaugaaugaa

SEQ ID NO: 2028832 - RNA, 19 nt, Human
aauauuccuuaagauauua

SEQ ID NO: 2028833 - RNA, 18 nt, Human
aauaugcucuaaacaugu

SEQ ID NO: 2028834 - RNA, 13 nt, Human
aauaucuuaucuu

SEQ ID NO: 2028835 - RNA, 15 nt, Human
aauaauuuuuauauu

SEQ ID NO: 2028836 - RNA, 22 nt, Human
aauaauuuuuauauuugaaaua

SEQ ID NO: 2028837 - RNA, 14 nt, Human
aauacacuguuauc

SEQ ID NO: 2028838 - RNA, 22 nt, Human
aaugauaacuggaaacuucagc

SEQ ID NO: 2028839 - RNA, 16 nt, Human
aaugcuuuccaugagu

SEQ ID NO: 2028840 - RNA, 12 nt, Human
aauggaauacuc

SEQ ID NO: 2028841 - RNA, 12 nt, Human
aauguguucauu

SEQ ID NO: 2028842 - RNA, 13 nt, Human
aauguuucaaaca

SEQ ID NO: 2028843 - RNA, 12 nt, Human
aaucaugaauua

SEQ ID NO: 2028844 - RNA, 17 nt, Human
aaugaagauacugaaau

SEQ ID NO: 2028845 - RNA, 18 nt, Human
aaugaaguacucauacau

SEQ ID NO: 2028846 - RNA, 18 nt, Human
aauauuuuaauguuucuu

SEQ ID NO: 2028847 - RNA, 17 nt, Human
aauauuauguuaaaacu

SEQ ID NO: 2028848 - RNA, 16 nt, Human
aaucacuggcuguuaa

SEQ ID NO: 2028849 - RNA, 17 nt, Human
acuuuauuuucuauaau

SEQ ID NO: 2028850 - RNA, 20 nt, Human
acuuguaaaggaauuuaaaa

SEQ ID NO: 2028851 - RNA, 18 nt, Human
aaguacucauacauguua

SEQ ID NO: 2028852 - RNA, 18 nt, Human
agaauuucuaaaaguuua

SEQ ID NO: 2028853 - RNA, 15 nt, Human
agaaucacuugaacc

SEQ ID NO: 2028854 - RNA, 19 nt, Human
aagucacauuccugaacag

SEQ ID NO: 2028855 - RNA, 21 nt, Human
accugggaaagggcuguuaua

SEQ ID NO: 2028856 - RNA, 23 nt, Human
accuuguacuuuauuuucuauaa

SEQ ID NO: 2028857 - RNA, 13 nt, Human
acgaaccuugaaa

SEQ ID NO: 2028858 - RNA, 20 nt, Human
acguauugcauuuaauuuau

SEQ ID NO: 2028859 - RNA, 21 nt, Human
acuagaguuuagcuggaaaag

SEQ ID NO: 2028860 - RNA, 17 nt, Human
acuguuaucuucacuuu

SEQ ID NO: 2028861 - RNA, 15 nt, Human
acugcacaucaaaau

SEQ ID NO: 2028862 - RNA, 11 nt, Human
acacuguuauc

SEQ ID NO: 2028863 - RNA, 20 nt, Human
acaauuugaauauaaauuua

SEQ ID NO: 2028864 - RNA, 23 nt, Human
acacacaugaaguccaagcauuu

SEQ ID NO: 2028865 - RNA, 15 nt, Human
acaggauuugaaauu

SEQ ID NO: 2028866 - RNA, 16 nt, Human
acaugggacauuugcu

SEQ ID NO: 2028867 - RNA, 19 nt, Human
accaaaaaucucaauauuu

SEQ ID NO: 2028868 - RNA, 22 nt, Human
acaguucggugagcuacaaaug

SEQ ID NO: 2028869 - RNA, 12 nt, Human
aauuuuguuaug

SEQ ID NO: 2028870 - RNA, 17 nt, Human
aauuuuuaauuauaugg

SEQ ID NO: 2028871 - RNA, 17 nt, Human
aauuuaaauagcuuuuu

SEQ ID NO: 2028872 - RNA, 12 nt, Human
aauuguaauagg

SEQ ID NO: 2028873 - RNA, 18 nt, Human
aauuguaggugacuauua

SEQ ID NO: 2028874 - RNA, 20 nt, Human
aauuguaggugacuauuaua

SEQ ID NO: 2028875 - RNA, 22 nt, Human
acaacacggacgaaccuugaaa

SEQ ID NO: 2028876 - RNA, 20 nt, Human
aauuccguagguuauuuuca

SEQ ID NO: 2028877 - RNA, 19 nt, Human
aauucugguagcuaaauau

SEQ ID NO: 2028878 - RNA, 15 nt, Human
aauuaacacaugauc

SEQ ID NO: 2028879 - RNA, 21 nt, Human
aauguugacaugggacauuug

SEQ ID NO: 2028880 - RNA, 22 nt, Human
aaugaauggcuaagcaaaaugu

SEQ ID NO: 2028881 - RNA, 15 nt, Human
aaugauuaugaauua

SEQ ID NO: 2028882 - RNA, 15 nt, Human
aaaaguugaauuuua

SEQ ID NO: 2028883 - RNA, 14 nt, Human
aaauaacgauaaaa

SEQ ID NO: 2028884 - RNA, 23 nt, Human
aaaacguauugcauuuaauuuau

SEQ ID NO: 2028885 - RNA, 11 nt, Human
aaaaauauaua

SEQ ID NO: 2028886 - RNA, 19 nt, Human
aaaaucucaauauuucaga

SEQ ID NO: 2028887 - RNA, 16 nt, Human
aaaauccuacuuucau

SEQ ID NO: 2028888 - RNA, 20 nt, Human
aaaauaauuuuuauauuuga

SEQ ID NO: 2028889 - RNA, 17 nt, Human
aaacgucuuaaauauuc

SEQ ID NO: 2028890 - RNA, 17 nt, Human
aaacaauaacgauaaaa

SEQ ID NO: 2028891 - RNA, 11 nt, Human
aaacacauguu

SEQ ID NO: 2028892 - RNA, 15 nt, Human
aaagaagagccggag

SEQ ID NO: 2028893 - RNA, 13 nt, Human
aaaggaauuuaaa

SEQ ID NO: 2028894 - RNA, 21 nt, Human
aaaggacaccauuuuggcaag

SEQ ID NO: 2028895 - RNA, 18 nt, Human
aaacuuugauuuuauaug

SEQ ID NO: 2028896 - RNA, 13 nt, Human
aaagaaacauuug

SEQ ID NO: 2028897 - RNA, 19 nt, Human
aaggcagcucuaaauguca

SEQ ID NO: 2028898 - RNA, 14 nt, Human
aaggguaauuauau

SEQ ID NO: 2028899 - RNA, 20 nt, Human
aaguaaacggucucucacuu

SEQ ID NO: 2028900 - RNA, 14 nt, Human
aauaagccagacau

SEQ ID NO: 2028901 - RNA, 19 nt, Human
aauacucuuauaucuauau

SEQ ID NO: 2028902 - RNA, 16 nt, Human
aauacacuguuaucuu

SEQ ID NO: 2028903 - RNA, 21 nt, Human
aauauuuauuuuaauaauguu

SEQ ID NO: 2028904 - RNA, 17 nt, Human
aauaucaguuauuuuua

SEQ ID NO: 2028905 - RNA, 19 nt, Human
aauaucuccgucaacucau

SEQ ID NO: 2028906 - RNA, 23 nt, Human
aauaugcucuaaacauguuuauc

SEQ ID NO: 2028907 - RNA, 18 nt, Human
aauagguuuggacaaaau

SEQ ID NO: 2028908 - RNA, 22 nt, Human
aaucaugaauuaguuuuauaug

SEQ ID NO: 2028909 - RNA, 19 nt, Human
cugcaaagcccagcuugaa

SEQ ID NO: 2028910 - RNA, 22 nt, Human
agaugcuagaacucccuuucaa

SEQ ID NO: 2028911 - RNA, 20 nt, Human
agauacugaaauaaacgucu

SEQ ID NO: 2028912 - RNA, 16 nt, Human
agauugugccccugca

SEQ ID NO: 2028913 - RNA, 17 nt, Human
cugaauuuaaauagcuu

SEQ ID NO: 2028914 - RNA, 14 nt, Human
cuauuuaauuauuu

SEQ ID NO: 2028915 - RNA, 15 nt, Human
cucaacaaacauaau

SEQ ID NO: 2028916 - RNA, 13 nt, Human
cauacauuugugu

SEQ ID NO: 2028917 - RNA, 19 nt, Human
caguuuuugugaaaagcuc

SEQ ID NO: 2028918 - RNA, 16 nt, Human
cuauauuuuuuguuaa

SEQ ID NO: 2028919 - RNA, 17 nt, Human
cuaguuguaauuuuuuu

SEQ ID NO: 2028920 - RNA, 18 nt, Human
cuauaaaccgaacugaug

SEQ ID NO: 2028921 - RNA, 21 nt, Human
caguaugaaaaugucauuguu

SEQ ID NO: 2028922 - RNA, 19 nt, Human
cagucugacuguuuccauc

SEQ ID NO: 2028923 - RNA, 22 nt, Human
cagugagccgagauugugcccc

SEQ ID NO: 2028924 - RNA, 23 nt, Human
cagugaucaaguuauuuuuaauu

SEQ ID NO: 2028925 - RNA, 17 nt, Human
gaaauauuuauuuuaau

SEQ ID NO: 2028926 - RNA, 18 nt, Human
gaaagaaaauaacgauaa

SEQ ID NO: 2028927 - RNA, 18 nt, Human
gacauugaggcaggcacu

SEQ ID NO: 2028928 - RNA, 15 nt, Human
gagaaucacuugaac

SEQ ID NO: 2028929 - RNA, 16 nt, Human
agcauuccaacuaucu

SEQ ID NO: 2028930 - RNA, 17 nt, Human
gaaaacaauaacgauaa

SEQ ID NO: 2028931 - RNA, 19 nt, Human
gaaaaucuuauaauuuaaa

SEQ ID NO: 2028932 - RNA, 22 nt, Human
gauguuuagaaacacaacuaua

SEQ ID NO: 2028933 - RNA, 14 nt, Human
gcauuccaacuauc

SEQ ID NO: 2028934 - RNA, 15 nt, Human
gcauggaaaaguuuc

SEQ ID NO: 2028935 - RNA, 14 nt, Human
gcagaacagugauu

SEQ ID NO: 2028936 - RNA, 14 nt, Human
gcagagaaguuuuc

SEQ ID NO: 2028937 - RNA, 22 nt, Human
gcacuaguauuucuaugaaaua

SEQ ID NO: 2028938 - RNA, 15 nt, Human
guggaaaugauguuu

SEQ ID NO: 2028939 - RNA, 21 nt, Human
guuauuuuuaauuugguuuuc

SEQ ID NO: 2028940 - RNA, 14 nt, Human
gguuuggacaaaau

SEQ ID NO: 2028941 - RNA, 17 nt, Human
guaaacggucucucacu

SEQ ID NO: 2028942 - RNA, 15 nt, Human
gguauuuuaaucacc

SEQ ID NO: 2028943 - RNA, 21 nt, Human
gguagcuaaauauauauuuua

SEQ ID NO: 2028944 - RNA, 13 nt, Human
gcuaguuuauaua

SEQ ID NO: 2028945 - RNA, 14 nt, Human
ugagcucaccaguc

SEQ ID NO: 2028946 - RNA, 21 nt, Human
ugaggagcuggaaacacaugu

SEQ ID NO: 2028947 - RNA, 13 nt, Human
ucuucaacucccu

SEQ ID NO: 2028948 - RNA, 21 nt, Human
ucuucaacucccugcccccca

SEQ ID NO: 2028949 - RNA, 20 nt, Human
ucuuccuauaauuuuagaca

SEQ ID NO: 2028950 - RNA, 20 nt, Human
ucuuauauauuguagauaau

SEQ ID NO: 2028951 - RNA, 21 nt, Human
ucuuaucuuccuauaauuuua

SEQ ID NO: 2028952 - RNA, 17 nt, Human
ucugugagaugcuagaa

SEQ ID NO: 2028953 - RNA, 13 nt, Human
ugauuaaguaaug

SEQ ID NO: 2028954 - RNA, 12 nt, Human
ugauucaaaugu

SEQ ID NO: 2028955 - RNA, 19 nt, Human
ugauaugggucuugauaaa

SEQ ID NO: 2028956 - RNA, 15 nt, Human
ucagucucccucccu

SEQ ID NO: 2028957 - RNA, 12 nt, Human
ucauauuuucau

SEQ ID NO: 2028958 - RNA, 19 nt, Human
ucaugaauuaguuuuauau

SEQ ID NO: 2028959 - RNA, 18 nt, Human
ucauucacucaacaaaca

SEQ ID NO: 2028960 - RNA, 12 nt, Human
ucggacggcucc

SEQ ID NO: 2028961 - RNA, 16 nt, Human
ucuaaauucuuucauu

SEQ ID NO: 2028962 - RNA, 13 nt, Human
ucuauguagaaua

SEQ ID NO: 2028963 - RNA, 18 nt, Human
ucuaggacugaauuauga

SEQ ID NO: 2028964 - RNA, 19 nt, Human
ucucagcuucacccugagg

SEQ ID NO: 2028965 - RNA, 13 nt, Human
ucucauccacuuu

SEQ ID NO: 2028966 - RNA, 14 nt, Human
ucucuacuaaaaau

SEQ ID NO: 2028967 - RNA, 13 nt, Human
ucugagccuuggg

SEQ ID NO: 2028968 - RNA, 15 nt, Human
ucacauuuaaauaaa

SEQ ID NO: 2028969 - RNA, 21 nt, Human
ucacaccuuaucuauguagaa

SEQ ID NO: 2028970 - RNA, 12 nt, Human
ucacuuguuuua

SEQ ID NO: 2028971 - RNA, 14 nt, Human
uagaauauauuucc

SEQ ID NO: 2028972 - RNA, 16 nt, Human
uagaacucccuuucaa

SEQ ID NO: 2028973 - RNA, 22 nt, Human
uacgugggcauucaaauguauu

SEQ ID NO: 2028974 - RNA, 16 nt, Human
ucaacagauaaauagu

SEQ ID NO: 2028975 - RNA, 13 nt, Human
uaaucuuucacag

SEQ ID NO: 2028976 - RNA, 14 nt, Human
uaauaauguuucaa

SEQ ID NO: 2028977 - RNA, 18 nt, Human
guugccuaauuuguuuuc

SEQ ID NO: 2028978 - RNA, 18 nt, Human
uaccucugccucagaaaa

SEQ ID NO: 2028979 - RNA, 19 nt, Human
uaauuccacagcugcucaa

SEQ ID NO: 2028980 - RNA, 14 nt, Human
uaauuugguuuuca

SEQ ID NO: 2028981 - RNA, 14 nt, Human
uaauuuuaaaaugu

SEQ ID NO: 2028982 - RNA, 17 nt, Human
agcuacuuauuguagca

SEQ ID NO: 2028983 - RNA, 20 nt, Human
agcuuuuuucucugauacag

SEQ ID NO: 2028984 - RNA, 17 nt, Human
aggaauacauaaaguau

SEQ ID NO: 2028985 - RNA, 19 nt, Human
aggcagaagcaacccaaau

SEQ ID NO: 2028986 - RNA, 20 nt, Human
aggucuaccaaaaaucucaa

SEQ ID NO: 2028987 - RNA, 18 nt, Human
agguuuaauaauuuuuaa

SEQ ID NO: 2028988 - RNA, 16 nt, Human
agucauucagauauga

SEQ ID NO: 2028989 - RNA, 17 nt, Human
aguuauuuuuaauuugg

SEQ ID NO: 2028990 - RNA, 18 nt, Human
agucucuaucauuaaagu

SEQ ID NO: 2028991 - RNA, 15 nt, Human
uuuaacucuauaaug

SEQ ID NO: 2028992 - RNA, 18 nt, Human
uuuaauagguuuggacaa

SEQ ID NO: 2028993 - RNA, 20 nt, Human
uuguaaaggaauuuaaaaau

SEQ ID NO: 2028994 - RNA, 13 nt, Human
uuguaaaauggug

SEQ ID NO: 2028995 - RNA, 14 nt, Human
uuguacuuuauuuu

SEQ ID NO: 2028996 - RNA, 14 nt, Human
uuguauaaaauaau

SEQ ID NO: 2028997 - RNA, 13 nt, Human
uuuagcuggaaaa

SEQ ID NO: 2028998 - RNA, 15 nt, Human
uuuaauuauuucacu

SEQ ID NO: 2028999 - RNA, 18 nt, Human
ugccaugugcuaguaauu

SEQ ID NO: 2029000 - RNA, 17 nt, Human
ugcauauuuuauuauag

SEQ ID NO: 2029001 - RNA, 17 nt, Human
ugcauagguuuaauaau

SEQ ID NO: 2029002 - RNA, 18 nt, Human
ugcauagguuuaauaauu

SEQ ID NO: 2029003 - RNA, 17 nt, Human
ugccaaauauaaauaaa

SEQ ID NO: 2029004 - RNA, 15 nt, Human
ugccaaauauaaaua

SEQ ID NO: 2029005 - RNA, 13 nt, Human
agccuccagcugc

SEQ ID NO: 2029006 - RNA, 16 nt, Human
agccugaucaccugcc

SEQ ID NO: 2029007 - RNA, 13 nt, Human
agcgguuuauaua

SEQ ID NO: 2029008 - RNA, 13 nt, Human
agcuaaauauaua

SEQ ID NO: 2029009 - RNA, 18 nt, Human
agcuacuaauuuuaaaau

SEQ ID NO: 2029010 - RNA, 19 nt, Human
uuuugaagcuguauacugu

SEQ ID NO: 2029011 - RNA, 19 nt, Human
auccacuuuccaauaaaga

SEQ ID NO: 2029012 - RNA, 17 nt, Human
aucauuuaguuauaaaa

SEQ ID NO: 2029013 - RNA, 19 nt, Human
aucaucaagucuuucacau

SEQ ID NO: 2029014 - RNA, 16 nt, Human
aucaguaugaaaaugu

SEQ ID NO: 2029015 - RNA, 18 nt, Human
aucaguuauuuuuaaacu

SEQ ID NO: 2029016 - RNA, 14 nt, Human
auaucuuuuuuuua

SEQ ID NO: 2029017 - RNA, 18 nt, Human
auaggaauugacccacaa

SEQ ID NO: 2029018 - RNA, 19 nt, Human
auauggcuugaguuuaaau

SEQ ID NO: 2029019 - RNA, 13 nt, Human
auaugauucaaau

SEQ ID NO: 2029020 - RNA, 15 nt, Human
auaugauucaaaugu

SEQ ID NO: 2029021 - RNA, 18 nt, Human
auaugcuauuuauuaagu

SEQ ID NO: 2029022 - RNA, 20 nt, Human
auaugcuauuuauuaaguau

SEQ ID NO: 2029023 - RNA, 18 nt, Human
auauuuuuuuuuuuaaaa

SEQ ID NO: 2029024 - RNA, 15 nt, Human
auauuuuuuuuuuua

SEQ ID NO: 2029025 - RNA, 23 nt, Human
auauucucacagcuccaagaauu

SEQ ID NO: 2029026 - RNA, 17 nt, Human
auauuuccaagaaauau

SEQ ID NO: 2029027 - RNA, 21 nt, Human
aguuuuauaugcuucuguuuu

SEQ ID NO: 2029028 - RNA, 20 nt, Human
aguuuaugauuccaccuaca

SEQ ID NO: 2029029 - RNA, 19 nt, Human
auaaaauccauacauuugu

SEQ ID NO: 2029030 - RNA, 13 nt, Human
auaaaccauuuuu

SEQ ID NO: 2029031 - RNA, 13 nt, Human
auaaauuuaucau

SEQ ID NO: 2029032 - RNA, 20 nt, Human
auaaauguugacaugggaca

SEQ ID NO: 2029033 - RNA, 16 nt, Human
auaaugaauacuuuau

SEQ ID NO: 2029034 - RNA, 14 nt, Human
auacauaaaguaug

SEQ ID NO: 2029035 - RNA, 12 nt, Human
auaauuuaaaua

SEQ ID NO: 2029036 - RNA, 20 nt, Human
auacuauuuaauuauuucac

SEQ ID NO: 2029037 - RNA, 14 nt, Human
auaggaaauauuuu

SEQ ID NO: 2029038 - RNA, 16 nt, Human
auacugugugcuaaaa

SEQ ID NO: 2029039 - RNA, 21 nt, Human
auacuucuuaggguuaugauu

SEQ ID NO: 2029040 - RNA, 19 nt, Human
auagugaggcaucgcaaug

SEQ ID NO: 2029041 - RNA, 18 nt, Human
auauaaauuuaucauuua

SEQ ID NO: 2029042 - RNA, 20 nt, Human
augauguuuagaaacacaac

SEQ ID NO: 2029043 - RNA, 14 nt, Human
augcuguauuuuaa

SEQ ID NO: 2029044 - RNA, 17 nt, Human
augcuucuguuuuauaa

SEQ ID NO: 2029045 - RNA, 13 nt, Human
auggaauuggagc

SEQ ID NO: 2029046 - RNA, 15 nt, Human
augaauuacauuugu

SEQ ID NO: 2029047 - RNA, 21 nt, Human
augaaagcagggacuugaacc

SEQ ID NO: 2029048 - RNA, 13 nt, Human
aucuuauaauuua

SEQ ID NO: 2029049 - RNA, 17 nt, Human
aucuuauaauuuaaaau

SEQ ID NO: 2029050 - RNA, 13 nt, Human
aucuauauuuuac

SEQ ID NO: 2029051 - RNA, 18 nt, Human
auccugaggcuccacuug

SEQ ID NO: 2029052 - RNA, 19 nt, Human
auguagaauauauuuccuu

SEQ ID NO: 2029053 - RNA, 22 nt, Human
auguauuacaguggggaaugaa

SEQ ID NO: 2029054 - RNA, 17 nt, Human
auggcacuaguauuucu

SEQ ID NO: 2029055 - RNA, 17 nt, Human
auggucaauuuuguuau

SEQ ID NO: 2029056 - RNA, 12 nt, Human
auguucaucaau

SEQ ID NO: 2029057 - RNA, 23 nt, Human
auguuucaaacauauauaacaau

SEQ ID NO: 2029058 - RNA, 19 nt, Human
auguuuucaggcuagaugu

SEQ ID NO: 2029059 - RNA, 14 nt, Human
auuaaaguucuagu

SEQ ID NO: 2029060 - RNA, 20 nt, Human
auuaaauggaaguaaauguu

SEQ ID NO: 2029061 - RNA, 15 nt, Human
auuauauuuacaaau

SEQ ID NO: 2029062 - RNA, 15 nt, Human
auuaugaauuacauu

SEQ ID NO: 2029063 - RNA, 18 nt, Human
ccauccugaggcuccacu

SEQ ID NO: 2029064 - RNA, 16 nt, Human
cccagagcuacaggcc

SEQ ID NO: 2029065 - RNA, 17 nt, Human
caugaauuaguuuuaua

SEQ ID NO: 2029066 - RNA, 13 nt, Human
cauggaauuggag

SEQ ID NO: 2029067 - RNA, 14 nt, Human
ccaagcaaguauua

SEQ ID NO: 2029068 - RNA, 18 nt, Human
cauuauauuuauuacugu

SEQ ID NO: 2029069 - RNA, 22 nt, Human
cauuuaaauaaaguguuugaaa

SEQ ID NO: 2029070 - RNA, 12 nt, Human
cauuuaauaugg

SEQ ID NO: 2029071 - RNA, 19 nt, Human
caugugcuaguaauuggaa

SEQ ID NO: 2029072 - RNA, 22 nt, Human
cauuaaauggaaguaaauguug

SEQ ID NO: 2029073 - RNA, 19 nt, Human
cagucauucagauaugauu

SEQ ID NO: 2029074 - RNA, 14 nt, Human
caucaaugaaugaa

SEQ ID NO: 2029075 - RNA, 17 nt, Human
caucgcagacacaugug

SEQ ID NO: 2029076 - RNA, 17 nt, Human
cauagguuuaauaauuu

SEQ ID NO: 2029077 - RNA, 14 nt, Human
caguuuuugugaaa

SEQ ID NO: 2029078 - RNA, 19 nt, Human
cagcuguaugauucccagc

SEQ ID NO: 2029079 - RNA, 15 nt, Human
auucuuccucccauu

SEQ ID NO: 2029080 - RNA, 19 nt, Human
auucuugccaaauauaaau

SEQ ID NO: 2029081 - RNA, 12 nt, Human
auucuuuaucuu

SEQ ID NO: 2029082 - RNA, 18 nt, Human
auugcauuuaauuuauug

SEQ ID NO: 2029083 - RNA, 17 nt, Human
auugaggcuuuaaaacu

SEQ ID NO: 2029084 - RNA, 20 nt, Human
auucaaugccccugaauuua

SEQ ID NO: 2029085 - RNA, 14 nt, Human
auuauuuuuuaaaa

SEQ ID NO: 2029086 - RNA, 16 nt, Human
auucaacaucuaguga

SEQ ID NO: 2029087 - RNA, 19 nt, Human
auugugggauacuauuuaa

SEQ ID NO: 2029088 - RNA, 19 nt, Human
auuuacggaacucaaauac

SEQ ID NO: 2029089 - RNA, 22 nt, Human
auuuccaagaaauauuccuuaa

SEQ ID NO: 2029090 - RNA, 18 nt, Human
auuuauguuuaauucuga

SEQ ID NO: 2029091 - RNA, 13 nt, Human
auuucuaugaaau

SEQ ID NO: 2029092 - RNA, 21 nt, Human
auuugaaauauugacuuuuua

SEQ ID NO: 2029093 - RNA, 13 nt, Human
auuucuccuugga

SEQ ID NO: 2029094 - RNA, 19 nt, Human
caaaaugugauauguaccu

SEQ ID NO: 2029095 - RNA, 15 nt, Human
caaacaauuugaaua

SEQ ID NO: 2029096 - RNA, 22 nt, Human
caaaccagagccugaguguugc

SEQ ID NO: 2029097 - RNA, 14 nt, Human
auuuuacauaaauu

SEQ ID NO: 2029098 - RNA, 23 nt, Human
auuuguaacaagccuccuuuuaa

SEQ ID NO: 2029099 - RNA, 22 nt, Human
auuuuagggguagcauuugugu

SEQ ID NO: 2029100 - RNA, 21 nt, Human
auuuuuaaacuguaaagcuuu

SEQ ID NO: 2029101 - RNA, 16 nt, Human
auuuuuuucugaaauu

SEQ ID NO: 2029102 - RNA, 16 nt, Human
caacacggacgaaccu

SEQ ID NO: 2029103 - RNA, 23 nt, Human
caacacggacgaaccuugaaaac

SEQ ID NO: 2029104 - RNA, 16 nt, Human
caaaugggaaacaaaa

SEQ ID NO: 2029105 - RNA, 20 nt, Human
caaauacgugggcauucaaa

SEQ ID NO: 2029106 - RNA, 17 nt, Human
caagcauuuagauguau

SEQ ID NO: 2029107 - RNA, 21 nt, Human
caauagucaaauugugugaaa

SEQ ID NO: 2029108 - RNA, 21 nt, Human
cacauuccugaacaggauauu

SEQ ID NO: 2029109 - RNA, 15 nt, Human
cagauaugauucaaa

SEQ ID NO: 2029110 - RNA, 21 nt, Human
cagaccuuugaacuagaguuu

SEQ ID NO: 2029111 - RNA, 18 nt, Human
cacuuuuauaagaaauag

SEQ ID NO: 2029112 - RNA, 14 nt, Human
cacuguuaucuuca

SEQ ID NO: 2029113 - RNA, 15 nt, Human
cacuuaaaaaugguu

SEQ ID NO: 2029114 - RNA, 22 nt, Human
gaggggagcaugggaagugacg

SEQ ID NO: 2029115 - RNA, 21 nt, Human
auacuauuuaauuauuucacu

SEQ ID NO: 2029116 - RNA, 22 nt, Human
aaagacagugaaagaaaauaac

SEQ ID NO: 2029117 - RNA, 19 nt, Human
agguaaccucauuaucagu

SEQ ID NO: 2029118 - RNA, 23 nt, Human
uacaaaugggaaacaaaaggaua

SEQ ID NO: 2029119 - RNA, 15 nt, Human
ggccugagaccaagg

SEQ ID NO: 2029120 - RNA, 19 nt, Human
aguuguaauuuuuuugugg

SEQ ID NO: 2029121 - RNA, 20 nt, Human
agaaggcuguggauuuaaug

SEQ ID NO: 2029122 - RNA, 22 nt, Human
uaauaucuuaucuuccuauaau

SEQ ID NO: 2029123 - RNA, 14 nt, Human
auuuccaagaaaua

SEQ ID NO: 2029124 - RNA, 22 nt, Human
aggaugccccgucccccucugg

SEQ ID NO: 2029125 - RNA, 14 nt, Human
gcaaagcccagcuu

SEQ ID NO: 2029126 - RNA, 19 nt, Human
acuuuuauaagaaauagga

SEQ ID NO: 2029127 - RNA, 15 nt, Human
cagccagcacagccu

SEQ ID NO: 2029128 - RNA, 15 nt, Human
ugauaugugaacagu

SEQ ID NO: 2029129 - RNA, 19 nt, Human
cuucacccugaggugagca

SEQ ID NO: 2029130 - RNA, 14 nt, Human
cucaccagucccuc

SEQ ID NO: 2029131 - RNA, 19 nt, Human
gcuuguauuccuuuuucuc

SEQ ID NO: 2029132 - RNA, 13 nt, Human
aaguaaaggcaaa

SEQ ID NO: 2029133 - RNA, 17 nt, Human
caggaaucacuggcugu

SEQ ID NO: 2029134 - RNA, 15 nt, Human
aagugaaaaucuaca

SEQ ID NO: 2029135 - RNA, 14 nt, Human
ggcaauagucaaau

SEQ ID NO: 2029136 - RNA, 23 nt, Human
aacuccugcuagaacagucucuu

SEQ ID NO: 2029137 - RNA, 19 nt, Human
auagcuacuaauuuuaaaa

SEQ ID NO: 2029138 - RNA, 14 nt, Human
uuaauuauuucacu

SEQ ID NO: 2029139 - RNA, 21 nt, Human
aauuuuuauauuugaaauauu

SEQ ID NO: 2029140 - RNA, 15 nt, Human
gaagauguagaggag

SEQ ID NO: 2029141 - RNA, 22 nt, Human
agaagcaccaaucaugaauuag

SEQ ID NO: 2029142 - RNA, 16 nt, Human
gcgcagcucaggcugg

SEQ ID NO: 2029143 - RNA, 14 nt, Human
ccugagaccaaggc

SEQ ID NO: 2029144 - RNA, 19 nt, Human
caacucccugccccccagc

SEQ ID NO: 2029145 - RNA, 12 nt, Human
aauaauuuuuaa

SEQ ID NO: 2029146 - RNA, 21 nt, Human
cgaaguauccuucagccugaa

SEQ ID NO: 2029147 - RNA, 20 nt, Human
gaugcccacggcuggagcug

SEQ ID NO: 2029148 - RNA, 17 nt, Human
auauuugaaauauugac

SEQ ID NO: 2029149 - RNA, 16 nt, Human
uucaugcuguucauga

SEQ ID NO: 2029150 - RNA, 14 nt, Human
aguuuuuuuuuaaa

SEQ ID NO: 2029151 - RNA, 11 nt, Human
ugugugcagca

SEQ ID NO: 2029152 - RNA, 17 nt, Human
gcaagcucuaucaccaa

SEQ ID NO: 2029153 - RNA, 20 nt, Human
ccagugagacagcucugcau

SEQ ID NO: 2029154 - RNA, 13 nt, Human
cugggucgccggc

SEQ ID NO: 2029155 - RNA, 23 nt, Human
aggugaucuggcucuggacaggc

SEQ ID NO: 2029156 - RNA, 15 nt, Human
auauagaaauguauu

SEQ ID NO: 2029157 - RNA, 17 nt, Human
ugacuauuauauuucca

SEQ ID NO: 2029158 - RNA, 17 nt, Human
aacugccaucauuuacu

SEQ ID NO: 2029159 - RNA, 13 nt, Human
guuauuuuuaaac

SEQ ID NO: 2029160 - RNA, 18 nt, Human
ggggcuuuaacuccugcu

SEQ ID NO: 2029161 - RNA, 22 nt, Human
gugccucaccccuugccauaau

SEQ ID NO: 2029162 - RNA, 18 nt, Human
gcauggccacaucugagc

SEQ ID NO: 2029163 - RNA, 15 nt, Human
uuauuuuuaaacugu

SEQ ID NO: 2029164 - RNA, 20 nt, Human
gacauuugcucauggaauug

SEQ ID NO: 2029165 - RNA, 17 nt, Human
ucucuggccuucggccu

SEQ ID NO: 2029166 - RNA, 20 nt, Human
gcggggcggggagcgagccc

SEQ ID NO: 2029167 - RNA, 13 nt, Human
ccccagcccuccu

SEQ ID NO: 2029168 - RNA, 15 nt, Human
uaggaaauauuuauu

SEQ ID NO: 2029169 - RNA, 21 nt, Human
aacuuguaaaggaauuuaaaa

SEQ ID NO: 2029170 - RNA, 15 nt, Human
uucacauuuaaauaa

SEQ ID NO: 2029171 - RNA, 19 nt, Human
aacaguuguguuugaagca

SEQ ID NO: 2029172 - RNA, 17 nt, Human
uaugcuaagugaaauaa

SEQ ID NO: 2029173 - RNA, 22 nt, Human
cccacuuccucccggccgcgcu

SEQ ID NO: 2029174 - RNA, 18 nt, Human
uucaaugccccugaauuu

SEQ ID NO: 2029175 - RNA, 12 nt, Human
ucuuucaugaag

SEQ ID NO: 2029176 - RNA, 19 nt, Human
cuggacucaccucccccau

SEQ ID NO: 2029177 - RNA, 12 nt, Human
agcuuuuuucuc

SEQ ID NO: 2029178 - RNA, 14 nt, Human
uacuaauuuuaaaa

SEQ ID NO: 2029179 - RNA, 20 nt, Human
uuuagacauucuuuaucuuu

SEQ ID NO: 2029180 - RNA, 23 nt, Human
gaaaaucuuauaauuuaaaauau

SEQ ID NO: 2029181 - RNA, 13 nt, Human
gaagaacugaaau

SEQ ID NO: 2029182 - RNA, 23 nt, Human
auaaaguaugugcauauuuuauu

SEQ ID NO: 2029183 - RNA, 16 nt, Human
uguugagguaccucca

SEQ ID NO: 2029184 - RNA, 14 nt, Human
aagucccugcugcc

SEQ ID NO: 2029185 - RNA, 22 nt, Human
acuuauuguagcauccuggaau

SEQ ID NO: 2029186 - RNA, 15 nt, Human
cccugcugcccuucc

SEQ ID NO: 2029187 - RNA, 23 nt, Human
gaaaacaauaacgauaaaagaca

SEQ ID NO: 2029188 - RNA, 12 nt, Human
aggaaauauuuu

SEQ ID NO: 2029189 - RNA, 17 nt, Human
uaugccacaagaacccc

SEQ ID NO: 2029190 - RNA, 13 nt, Human
caucccacccgcc

SEQ ID NO: 2029191 - RNA, 19 nt, Human
gacagucaccucauggaau

SEQ ID NO: 2029192 - RNA, 17 nt, Human
acuccugcuagaacagu

SEQ ID NO: 2029193 - RNA, 15 nt, Human
cgaagcaccaucauu

SEQ ID NO: 2029194 - RNA, 20 nt, Human
uaugcuauuuauuaaguauu

SEQ ID NO: 2029195 - RNA, 15 nt, Human
acuuuuauaagaaau

SEQ ID NO: 2029196 - RNA, 14 nt, Human
uccagauccuggaa

SEQ ID NO: 2029197 - RNA, 20 nt, Human
cagcugccccggggaggggc

SEQ ID NO: 2029198 - RNA, 22 nt, Human
aaccuacacgagauacagaauu

SEQ ID NO: 2029199 - RNA, 11 nt, Human
cuguuuuauaa

SEQ ID NO: 2029200 - RNA, 14 nt, Human
ugacacuuaaaaau

SEQ ID NO: 2029201 - RNA, 17 nt, Human
agcccuuccccucugca

SEQ ID NO: 2029202 - RNA, 14 nt, Human
gaaugauuaugaau

SEQ ID NO: 2029203 - RNA, 21 nt, Human
acaugagguacugagagugaa

SEQ ID NO: 2029204 - RNA, 14 nt, Human
cccugccucaagcu

SEQ ID NO: 2029205 - RNA, 17 nt, Human
aaggugaucuggcucug

SEQ ID NO: 2029206 - RNA, 16 nt, Human
guccauucuuccuccc

SEQ ID NO: 2029207 - RNA, 13 nt, Human
uuuuauaugcuau

SEQ ID NO: 2029208 - RNA, 18 nt, Human
uuccuaauaaagcuucug

SEQ ID NO: 2029209 - RNA, 20 nt, Human
cugucacgugugggcaaugu

SEQ ID NO: 2029210 - RNA, 23 nt, Human
uuuuauagcuacuaauuuuaaaa

SEQ ID NO: 2029211 - RNA, 20 nt, Human
cuacuuccccuuccuaauuc

SEQ ID NO: 2029212 - RNA, 12 nt, Human
acaccuuaucua

SEQ ID NO: 2029213 - RNA, 21 nt, Human
aagcuccauuuuuagugaaau

SEQ ID NO: 2029214 - RNA, 16 nt, Human
uucugaaauuuccugg

SEQ ID NO: 2029215 - RNA, 17 nt, Human
acagaaaaguugaauuu

SEQ ID NO: 2029216 - RNA, 18 nt, Human
ugcaccugugccgucccc

SEQ ID NO: 2029217 - RNA, 18 nt, Human
gcuccgcgcagcucaggc

SEQ ID NO: 2029218 - RNA, 15 nt, Human
ugcagauaaacagua

SEQ ID NO: 2029219 - RNA, 15 nt, Human
ccucccggccgcgcu

SEQ ID NO: 2029220 - RNA, 17 nt, Human
agugagacagcucugca

SEQ ID NO: 2029221 - RNA, 12 nt, Human
gcgagcgcgcgc

SEQ ID NO: 2029222 - RNA, 20 nt, Human
ggcuccggacgcugcugccg

SEQ ID NO: 2029223 - RNA, 15 nt, Human
ucccuuuguccacaa

SEQ ID NO: 2029224 - RNA, 15 nt, Human
ccaucucaggugugu

SEQ ID NO: 2029225 - RNA, 15 nt, Human
guccuugcugcaccu

SEQ ID NO: 2029226 - RNA, 14 nt, Human
gaacgagacaagca

SEQ ID NO: 2029227 - RNA, 14 nt, Human
auuauauauauuuu

SEQ ID NO: 2029228 - RNA, 19 nt, Human
uuuccaagaaauauuccuu

SEQ ID NO: 2029229 - RNA, 18 nt, Human
auuuuuagugaaauauua

SEQ ID NO: 2029230 - RNA, 13 nt, Human
ccuuccccuuccc

SEQ ID NO: 2029231 - RNA, 22 nt, Human
caugaguaacugauuuguaaca

SEQ ID NO: 2029232 - RNA, 22 nt, Human
caauaaaagacaaggaaaaaau

SEQ ID NO: 2029233 - RNA, 13 nt, Human
gccuccagcugcc

SEQ ID NO: 2029234 - RNA, 13 nt, Human
uuuucuuuucauu

SEQ ID NO: 2029235 - RNA, 19 nt, Human
gugaacuugguuuuaauua

SEQ ID NO: 2029236 - RNA, 22 nt, Human
acacuguccauucuuccuccca

SEQ ID NO: 2029237 - RNA, 21 nt, Human
gaaaacaauaacgauaaaaga

SEQ ID NO: 2029238 - RNA, 19 nt, Human
ugcucgcccacuuccuccc

SEQ ID NO: 2029239 - RNA, 16 nt, Human
aaugaaagcagggacu

SEQ ID NO: 2029240 - RNA, 17 nt, Human
auucaaugccccugaau

SEQ ID NO: 2029241 - RNA, 16 nt, Human
aagguccuggcaaaga

SEQ ID NO: 2029242 - RNA, 23 nt, Human
aguaauuggaaaggcagcucuaa

SEQ ID NO: 2029243 - RNA, 19 nt, Human
uuauauauauauauuuuuu

SEQ ID NO: 2029244 - RNA, 20 nt, Human
caaauguucaucaaugaaug

SEQ ID NO: 2029245 - RNA, 16 nt, Human
ccucauuaucagucca

SEQ ID NO: 2029246 - RNA, 15 nt, Human
augcccauaccccug

SEQ ID NO: 2029247 - RNA, 19 nt, Human
aaaauaacgauaaaagaca

SEQ ID NO: 2029248 - RNA, 19 nt, Human
uuuccugaaaacccuugcc

SEQ ID NO: 2029249 - RNA, 13 nt, Human
cgcugcgcgccgc

SEQ ID NO: 2029250 - RNA, 21 nt, Human
uguaaaauggugugaccacug

SEQ ID NO: 2029251 - RNA, 14 nt, Human
uauuauauuuccaa

SEQ ID NO: 2029252 - RNA, 15 nt, Human
uauuuauuuuaauaa

SEQ ID NO: 2029253 - RNA, 15 nt, Human
auuucacuuuagaaa

SEQ ID NO: 2029254 - RNA, 17 nt, Human
acuauuuaauuauuuca

SEQ ID NO: 2029255 - RNA, 17 nt, Human
cugcacuccagccugag

SEQ ID NO: 2029256 - RNA, 23 nt, Human
cacagaaacuccuguucaugccc

SEQ ID NO: 2029257 - RNA, 15 nt, Human
ggccaccugcugagc

SEQ ID NO: 2029258 - RNA, 17 nt, Human
cguaaucguguccccua

SEQ ID NO: 2029259 - RNA, 19 nt, Human
auuuacagagacagaaagc

SEQ ID NO: 2029260 - RNA, 13 nt, Human
gcccccgggccga

SEQ ID NO: 2029261 - RNA, 23 nt, Human
acuggcuaauuagcauggccaca

SEQ ID NO: 2029262 - RNA, 12 nt, Human
aguguuugaaag

SEQ ID NO: 2029263 - RNA, 18 nt, Human
cccacuggacucaccucc

SEQ ID NO: 2029264 - RNA, 14 nt, Human
cucaggcuggcacc

SEQ ID NO: 2029265 - RNA, 15 nt, Human
gcuaauaucuuaucu

SEQ ID NO: 2029266 - RNA, 22 nt, Human
gcugccucucucauccacuuuc

SEQ ID NO: 2029267 - RNA, 22 nt, Human
uuuaauaauguuucaaacauau

SEQ ID NO: 2029268 - RNA, 22 nt, Human
guacacugccuucucaacucca

SEQ ID NO: 2029269 - RNA, 18 nt, Human
aaaagacaaggaaaaaau

SEQ ID NO: 2029270 - RNA, 20 nt, Human
aucccggccggcgcgcucau

SEQ ID NO: 2029271 - RNA, 22 nt, Human
uucauucacucaacaaacauaa

SEQ ID NO: 2029272 - RNA, 14 nt, Human
uuagagaauuuccu

SEQ ID NO: 2029273 - RNA, 16 nt, Human
cgcccacuuccucccg

SEQ ID NO: 2029274 - RNA, 18 nt, Human
gaagagccggagccucca

SEQ ID NO: 2029275 - RNA, 16 nt, Human
uacaaaugggaaacaa

SEQ ID NO: 2029276 - RNA, 16 nt, Human
aauuucuucaacuccc

SEQ ID NO: 2029277 - RNA, 19 nt, Human
acagugauuaccagggacu

SEQ ID NO: 2029278 - RNA, 22 nt, Human
uaagaauucuguugauggaaau

SEQ ID NO: 2029279 - RNA, 14 nt, Human
ugagcucaccaguc

SEQ ID NO: 2029280 - RNA, 23 nt, Human
caaauacgugggcauucaaaugu

SEQ ID NO: 2029281 - RNA, 14 nt, Human
guaacuaauuuuaa

SEQ ID NO: 2029282 - RNA, 14 nt, Human
cugcugguggcgcu

SEQ ID NO: 2029283 - RNA, 21 nt, Human
ccucccuuggggccuaugcag

SEQ ID NO: 2029284 - RNA, 21 nt, Human
ccaguccauugggcaggcaga

SEQ ID NO: 2029285 - RNA, 17 nt, Human
gccggagccuccagcug

SEQ ID NO: 2029286 - RNA, 12 nt, Human
uaagaaggcacc

SEQ ID NO: 2029287 - RNA, 19 nt, Human
agcuacuaauuuuaaaaug

SEQ ID NO: 2029288 - RNA, 21 nt, Human
cugaaauaaacgucuuaaaua

SEQ ID NO: 2029289 - RNA, 20 nt, Human
ugagagacacacugaagaag

SEQ ID NO: 2029290 - RNA, 19 nt, Human
ugaacaaauuuacagagac

SEQ ID NO: 2029291 - RNA, 13 nt, Human
ccuuugcaccucc

SEQ ID NO: 2029292 - RNA, 16 nt, Human
gcuuccauuguugucu

SEQ ID NO: 2029293 - RNA, 17 nt, Human
aaauguucaucaaugaa

SEQ ID NO: 2029294 - RNA, 19 nt, Human
aaaccgaacugauguaagu

SEQ ID NO: 2029295 - RNA, 18 nt, Human
aaauaacgauaaaagaca

SEQ ID NO: 2029296 - RNA, 15 nt, Human
auaucuauauuuuac

SEQ ID NO: 2029297 - RNA, 17 nt, Human
acuaguuguaauuuuuu

SEQ ID NO: 2029298 - RNA, 16 nt, Human
auuuuuagugaaauau

SEQ ID NO: 2029299 - RNA, 15 nt, Human
ucuaggacugaauua

SEQ ID NO: 2029300 - RNA, 13 nt, Human
cugcacuccagcc

SEQ ID NO: 2029301 - RNA, 20 nt, Human
augguuuagaaagcuugccc

SEQ ID NO: 2029302 - RNA, 17 nt, Human
acaucgcagacacaugu

SEQ ID NO: 2029303 - RNA, 16 nt, Human
cagggacuugaaccca

SEQ ID NO: 2029304 - RNA, 14 nt, Human
caucauuuacuuuu

SEQ ID NO: 2029305 - RNA, 14 nt, Human
uaaaguaugugcau

SEQ ID NO: 2029306 - RNA, 11 nt, Human
ccuucccacac

SEQ ID NO: 2029307 - RNA, 17 nt, Human
gggagcgagccccaggc

SEQ ID NO: 2029308 - RNA, 21 nt, Human
ugggaggcugagaugggagaa

SEQ ID NO: 2029309 - RNA, 19 nt, Human
acucuuauaucuauauuuu

SEQ ID NO: 2029310 - RNA, 20 nt, Human
augaagauacugaaauaaac

SEQ ID NO: 2029311 - RNA, 15 nt, Human
ccacaggaaccacaa

SEQ ID NO: 2029312 - RNA, 15 nt, Human
caggaaguagaggag

SEQ ID NO: 2029313 - RNA, 21 nt, Human
gaagugaaaaucuacacucca

SEQ ID NO: 2029314 - RNA, 13 nt, Human
ucuaagaagugaa

SEQ ID NO: 2029315 - RNA, 18 nt, Human
uuacuguaagaaaauauc

SEQ ID NO: 2029316 - RNA, 14 nt, Human
cuuguacucugaaa

SEQ ID NO: 2029317 - RNA, 17 nt, Human
agcuacuaauuuuaaaa

SEQ ID NO: 2029318 - RNA, 18 nt, Human
acaaaugggaaacaaaag

SEQ ID NO: 2029319 - RNA, 17 nt, Human
acacuaagagagaauga

SEQ ID NO: 2029320 - RNA, 20 nt, Human
aacaaugcuguauuuuaaaa

SEQ ID NO: 2029321 - RNA, 22 nt, Human
caaggaugccccgucccccucu

SEQ ID NO: 2029322 - RNA, 19 nt, Human
cccuuccccucugcagcuu

SEQ ID NO: 2029323 - RNA, 20 nt, Human
aauaauuuuuauauuugaaa

SEQ ID NO: 2029324 - RNA, 20 nt, Human
ggguuccuuccucugagccu

SEQ ID NO: 2029325 - RNA, 17 nt, Human
ugcagcgaguacuuccc

SEQ ID NO: 2029326 - RNA, 21 nt, Human
caucuagcaugucgucaaagc

SEQ ID NO: 2029327 - RNA, 17 nt, Human
uaauuuuuauauuugaa

SEQ ID NO: 2029328 - RNA, 15 nt, Human
aauaacgauaaaaga

SEQ ID NO: 2029329 - RNA, 12 nt, Human
ccagucccuccc

SEQ ID NO: 2029330 - RNA, 14 nt, Human
gagcuuuuguagaa

SEQ ID NO: 2029331 - RNA, 21 nt, Human
cacuugaacccgggaggcaga

SEQ ID NO: 2029332 - RNA, 15 nt, Human
aacgauaaaagacag

SEQ ID NO: 2029333 - RNA, 23 nt, Human
gauagauaggucagugcaaauac

SEQ ID NO: 2029334 - RNA, 15 nt, Human
uccgcauccuagucu

SEQ ID NO: 2029335 - RNA, 22 nt, Human
cugcuggagacauugaggcagg

SEQ ID NO: 2029336 - RNA, 14 nt, Human
acgagaaaacaaua

SEQ ID NO: 2029337 - RNA, 13 nt, Human
gcuguacgcgagc

SEQ ID NO: 2029338 - RNA, 12 nt, Human
uauuuuaauguu

SEQ ID NO: 2029339 - RNA, 16 nt, Human
gacauuugcucaugga

SEQ ID NO: 2029340 - RNA, 18 nt, Human
auggaaguaaauguuguu

SEQ ID NO: 2029341 - RNA, 18 nt, Human
ccuuugcaccuccaugga

SEQ ID NO: 2029342 - RNA, 20 nt, Human
acuucuuaggguuaugauua

SEQ ID NO: 2029343 - RNA, 16 nt, Human
uggucugugagaugcu

SEQ ID NO: 2029344 - RNA, 16 nt, Human
ggccuccauccugagg

SEQ ID NO: 2029345 - RNA, 18 nt, Human
auaaaguguuugaaagcu

SEQ ID NO: 2029346 - RNA, 16 nt, Human
ugaaauuguauuacaa

SEQ ID NO: 2029347 - RNA, 23 nt, Human
cucaggggggugguuuucccauc

SEQ ID NO: 2029348 - RNA, 18 nt, Human
uaaguuuuuuuuuaaaaa

SEQ ID NO: 2029349 - RNA, 19 nt, Human
gcugccccggggaggggcg

SEQ ID NO: 2029350 - RNA, 11 nt, Human
gcaugguuuag

SEQ ID NO: 2029351 - RNA, 16 nt, Human
aaaaauuccaagugau

SEQ ID NO: 2029352 - RNA, 18 nt, Human
cagauaugauucaaaugu

SEQ ID NO: 2029353 - RNA, 16 nt, Human
cacacuguccauucuu

SEQ ID NO: 2029354 - RNA, 16 nt, Human
aagaagcuagaaaaca

SEQ ID NO: 2029355 - RNA, 17 nt, Human
agcuaaauauauauuuu

SEQ ID NO: 2029356 - RNA, 21 nt, Human
cuccagggagucucagcuuca

SEQ ID NO: 2029357 - RNA, 12 nt, Human
cggcccugugcg

SEQ ID NO: 2029358 - RNA, 16 nt, Human
agugagacagcucugc

SEQ ID NO: 2029359 - RNA, 17 nt, Human
uaaaagacaaggaaaaa

SEQ ID NO: 2029360 - RNA, 13 nt, Human
uaagugcagcccc

SEQ ID NO: 2029361 - RNA, 18 nt, Human
gaaaugaaagcagggacu

SEQ ID NO: 2029362 - RNA, 18 nt, Human
gaauuuccuuacucuuga

SEQ ID NO: 2029363 - RNA, 19 nt, Human
ucccgcuguuccucgccac

SEQ ID NO: 2029364 - RNA, 15 nt, Human
uuucccagucuucag

SEQ ID NO: 2029365 - RNA, 12 nt, Human
ucccccucuggc

SEQ ID NO: 2029366 - RNA, 12 nt, Human
cuuuaucuuuuu

SEQ ID NO: 2029367 - RNA, 12 nt, Human
uaagaagacugc

SEQ ID NO: 2029368 - RNA, 14 nt, Human
ugcuucuguuuuau

SEQ ID NO: 2029369 - RNA, 20 nt, Human
aaauccuugaagauuuacca

SEQ ID NO: 2029370 - RNA, 15 nt, Human
cuucugaggagcugu

SEQ ID NO: 2029371 - RNA, 20 nt, Human
gcuugcagagaugaggccgc

SEQ ID NO: 2029372 - RNA, 14 nt, Human
uaauccuaaacaua

SEQ ID NO: 2029373 - RNA, 20 nt, Human
agcuuauugucuagugaaac

SEQ ID NO: 2029374 - RNA, 14 nt, Human
uugacccacaagaa

SEQ ID NO: 2029375 - RNA, 17 nt, Human
aguuuauauagaaaugu

SEQ ID NO: 2029376 - RNA, 18 nt, Human
aaaguaacccuacaaaac

SEQ ID NO: 2029377 - RNA, 23 nt, Human
cccacuggacucaccucccccau

SEQ ID NO: 2029378 - RNA, 19 nt, Human
cugguccuaagucccugcu

SEQ ID NO: 2029379 - RNA, 17 nt, Human
aagacaaggaaaaaaua

SEQ ID NO: 2029380 - RNA, 16 nt, Human
caaaaggauaaugaau

SEQ ID NO: 2029381 - RNA, 21 nt, Human
aagaagagccggagccuccag

SEQ ID NO: 2029382 - RNA, 23 nt, Human
cuagaauuugauaugugaacagu

SEQ ID NO: 2029383 - RNA, 15 nt, Human
agacaaggaaaaaau

SEQ ID NO: 2029384 - RNA, 20 nt, Human
cccugcacuccagccugagc

SEQ ID NO: 2029385 - RNA, 13 nt, Human
uuccuucugcucc

SEQ ID NO: 2029386 - RNA, 12 nt, Human
uuaauaaaccau

SEQ ID NO: 2029387 - RNA, 19 nt, Human
cuuccagauccuggaaauc

SEQ ID NO: 2029388 - RNA, 22 nt, Human
agacucugucucaguccaugaa

SEQ ID NO: 2029389 - RNA, 21 nt, Human
uuauguuuaauucugaaagca

SEQ ID NO: 2029390 - RNA, 13 nt, Human
cgcgcccucuggc

SEQ ID NO: 2029391 - RNA, 17 nt, Human
auguugacaugggacau

SEQ ID NO: 2029392 - RNA, 12 nt, Human
gucccaggcuga

SEQ ID NO: 2029393 - RNA, 21 nt, Human
ccaaauauaaauaaaaauaau

SEQ ID NO: 2029394 - RNA, 21 nt, Human
gaaaaguauguuagugcaaau

SEQ ID NO: 2029395 - RNA, 21 nt, Human
gcgcucaucccacccgcccac

SEQ ID NO: 2029396 - RNA, 15 nt, Human
aagaagugaaaaucu

SEQ ID NO: 2029397 - RNA, 18 nt, Human
auguuagagaauuuccuu

SEQ ID NO: 2029398 - RNA, 20 nt, Human
cagcuggccgggagccugau

SEQ ID NO: 2029399 - RNA, 21 nt, Human
auuuacaaaugggaaacaaaa

SEQ ID NO: 2029400 - RNA, 14 nt, Human
cgcgcccucuggcu

SEQ ID NO: 2029401 - RNA, 13 nt, Human
ucuauaauuuaaa

SEQ ID NO: 2029402 - RNA, 23 nt, Human
gcuaugcuauugaaguuuuggca

SEQ ID NO: 2029403 - RNA, 19 nt, Human
agaaaauaacaauaaaaga

SEQ ID NO: 2029404 - RNA, 17 nt, Human
gccuaagugcagccccg

SEQ ID NO: 2029405 - RNA, 16 nt, Human
ccuccuuuuaaaguaa

SEQ ID NO: 2029406 - RNA, 14 nt, Human
acgcauggaaaagu

SEQ ID NO: 2029407 - RNA, 17 nt, Human
agucuucagcagagaag

SEQ ID NO: 2029408 - RNA, 21 nt, Human
gccaaauauaaauaaaaauaa

SEQ ID NO: 2029409 - RNA, 14 nt, Human
cuauuauauuucca

SEQ ID NO: 2029410 - RNA, 14 nt, Human
auauauuuuagaua

SEQ ID NO: 2029411 - RNA, 17 nt, Human
ucucucacuuguuuuau

SEQ ID NO: 2029412 - RNA, 16 nt, Human
cacuggacucaccucc

SEQ ID NO: 2029413 - RNA, 22 nt, Human
ggcauuuaggccaugggacagg

SEQ ID NO: 2029414 - RNA, 14 nt, Human
acccugaggugagc

SEQ ID NO: 2029415 - RNA, 17 nt, Human
cuauauuuuacauaaau

SEQ ID NO: 2029416 - RNA, 23 nt, Human
gucucagcuucacccugagguga

SEQ ID NO: 2029417 - RNA, 14 nt, Human
ucccugcugcccuu

SEQ ID NO: 2029418 - RNA, 18 nt, Human
uaauagguuuggacaaaa

SEQ ID NO: 2029419 - RNA, 16 nt, Human
acggagccgggaaaga

SEQ ID NO: 2029420 - RNA, 15 nt, Human
uugacccacaagaaa

SEQ ID NO: 2029421 - RNA, 17 nt, Human
uuagauagaugaagaag

SEQ ID NO: 2029422 - RNA, 12 nt, Human
aauacuuuauaa

SEQ ID NO: 2029423 - RNA, 16 nt, Human
uuuauauuugaaauau

SEQ ID NO: 2029424 - RNA, 20 nt, Human
cugagaccaaggcccccggg

SEQ ID NO: 2029425 - RNA, 18 nt, Human
ggcuccggacgcugcugc

SEQ ID NO: 2029426 - RNA, 11 nt, Human
acuuugaagag

SEQ ID NO: 2029427 - RNA, 13 nt, Human
aaauccuugaaga

SEQ ID NO: 2029428 - RNA, 17 nt, Human
aagcuuccauuguuguc

SEQ ID NO: 2029429 - RNA, 20 nt, Human
guucugcagauaaacaguag

SEQ ID NO: 2029430 - RNA, 20 nt, Human
ugagucccaggcugagccuc

SEQ ID NO: 2029431 - RNA, 19 nt, Human
caccugugccguccccaga

SEQ ID NO: 2029432 - RNA, 23 nt, Human
ggaugguucccuugaugaagaag

SEQ ID NO: 2029433 - RNA, 19 nt, Human
aauuuuuauauuugaaaua

SEQ ID NO: 2029434 - RNA, 18 nt, Human
gccccgucccccucuggc

SEQ ID NO: 2029435 - RNA, 18 nt, Human
ugggcacaggguuuaugu

SEQ ID NO: 2029436 - RNA, 13 nt, Human
aucuggcucugga

SEQ ID NO: 2029437 - RNA, 14 nt, Human
uauauauauauuuu

SEQ ID NO: 2029438 - RNA, 13 nt, Human
aagugcagccccg

SEQ ID NO: 2029439 - RNA, 15 nt, Human
ucaaaggacaccauu

SEQ ID NO: 2029440 - RNA, 22 nt, Human
auuacuguaagaaaauaucacu

SEQ ID NO: 2029441 - RNA, 21 nt, Human
ugaauuaugaaacuuuuggaa

SEQ ID NO: 2029442 - RNA, 12 nt, Human
accccugagcuu

SEQ ID NO: 2029443 - RNA, 22 nt, Human
cagacacaugugcuggccaccu

SEQ ID NO: 2029444 - RNA, 16 nt, Human
ugcuaagucuuauaua

SEQ ID NO: 2029445 - RNA, 17 nt, Human
uaucaauuuaaaaaaaa

SEQ ID NO: 2029446 - RNA, 17 nt, Human
uagaauauauuuccuua

SEQ ID NO: 2029447 - RNA, 21 nt, Human
agaagcuagaaaacaggcaaa

SEQ ID NO: 2029448 - RNA, 22 nt, Human
aggcccccgggccgacggagcc

SEQ ID NO: 2029449 - RNA, 22 nt, Human
uuccuagucuguuuucccuccu

SEQ ID NO: 2029450 - RNA, 20 nt, Human
ucagaauuucuaaaaguuua

SEQ ID NO: 2029451 - RNA, 17 nt, Human
ccuacuuccccuuccua

SEQ ID NO: 2029452 - RNA, 17 nt, Human
agguuuuaaagcuucca

SEQ ID NO: 2029453 - RNA, 19 nt, Human
cagagucaagggugugugc

SEQ ID NO: 2029454 - RNA, 18 nt, Human
uuaucauuuaguuauaaa

SEQ ID NO: 2029455 - RNA, 13 nt, Human
acagcccuucuuu

SEQ ID NO: 2029456 - RNA, 21 nt, Human
cuuuuguagaagucacauucc

SEQ ID NO: 2029457 - RNA, 22 nt, Human
cuggguuccuuccucugagccu

SEQ ID NO: 2029458 - RNA, 14 nt, Human
cccacacuguccau

SEQ ID NO: 2029459 - RNA, 22 nt, Human
cucagcccuggugggcagagag

SEQ ID NO: 2029460 - RNA, 20 nt, Human
agcuucacuguaaaauaaua

SEQ ID NO: 2029461 - RNA, 17 nt, Human
guuagagaauuuccuua

SEQ ID NO: 2029462 - RNA, 17 nt, Human
aauaacgauaaaagaca

SEQ ID NO: 2029463 - RNA, 21 nt, Human
accaccugccuauauuuuuug

SEQ ID NO: 2029464 - RNA, 15 nt, Human
guugaagagguuuua

SEQ ID NO: 2029465 - RNA, 14 nt, Human
auuuauuaaguauu

SEQ ID NO: 2029466 - RNA, 17 nt, Human
ccugcugcccuuccccu

SEQ ID NO: 2029467 - RNA, 15 nt, Human
ccaugugcagccacc

SEQ ID NO: 2029468 - RNA, 23 nt, Human
uuuccaucaaggguacacugccu

SEQ ID NO: 2029469 - RNA, 15 nt, Human
cccugagguugugug

SEQ ID NO: 2029470 - RNA, 16 nt, Human
ggcuaauaucuuaucu

SEQ ID NO: 2029471 - RNA, 16 nt, Human
cuuuaugcuaagugaa

SEQ ID NO: 2029472 - RNA, 21 nt, Human
auauaugcuaagucuuauaua

SEQ ID NO: 2029473 - RNA, 14 nt, Human
cuggccgggagccu

SEQ ID NO: 2029474 - RNA, 20 nt, Human
guccccuauccuacuucccc

SEQ ID NO: 2029475 - RNA, 18 nt, Human
ugagcucagcccuggugg

SEQ ID NO: 2029476 - RNA, 19 nt, Human
uuguacucugaaaguuuug

SEQ ID NO: 2029477 - RNA, 18 nt, Human
aacaaugcuguauuuuaa

SEQ ID NO: 2029478 - RNA, 22 nt, Human
aauaauccuaaacauaugaauu

SEQ ID NO: 2029479 - RNA, 13 nt, Human
uaacgauaaaaga

SEQ ID NO: 2029480 - RNA, 14 nt, Human
gacaagaaggaaag

SEQ ID NO: 2029481 - RNA, 13 nt, Human
ccaaaagguauuu

SEQ ID NO: 2029482 - RNA, 17 nt, Human
auuauuuuuuaaaaaaa

SEQ ID NO: 2029483 - RNA, 15 nt, Human
auuucauucaauauc

SEQ ID NO: 2029484 - RNA, 20 nt, Human
gcgcugcgcgccgcgcuccu

SEQ ID NO: 2029485 - RNA, 15 nt, Human
uagggugauauuaac

SEQ ID NO: 2029486 - RNA, 19 nt, Human
guccauucuuccucccauu

SEQ ID NO: 2029487 - RNA, 16 nt, Human
gacauagaauuaacac

SEQ ID NO: 2029488 - RNA, 14 nt, Human
gcugcccuuccccu

SEQ ID NO: 2029489 - RNA, 19 nt, Human
auauauuuuuuuuuuuaaa

SEQ ID NO: 2029490 - RNA, 18 nt, Human
gaauaauccuaaacauau

SEQ ID NO: 2029491 - RNA, 14 nt, Human
cagugaaagaaaau

SEQ ID NO: 2029492 - RNA, 13 nt, Human
ccucauggaauug

SEQ ID NO: 2029493 - RNA, 13 nt, Human
uuucuaaaaguuu

SEQ ID NO: 2029494 - RNA, 15 nt, Human
caguuauuuuuaaac

SEQ ID NO: 2029495 - RNA, 15 nt, Human
gcgagcgcgcgcgcc

SEQ ID NO: 2029496 - RNA, 17 nt, Human
aggcuggcgugcagcau

SEQ ID NO: 2029497 - RNA, 12 nt, Human
gggaaagaagag

SEQ ID NO: 2029498 - RNA, 14 nt, Human
cacaagaaaugaaa

SEQ ID NO: 2029499 - RNA, 18 nt, Human
gccggagccuccagcugc

SEQ ID NO: 2029500 - RNA, 11 nt, Human
gccuccagcug

SEQ ID NO: 2029501 - RNA, 15 nt, Human
gaccacugcagaaga

SEQ ID NO: 2029502 - RNA, 16 nt, Human
aauaaaguguuugaaa

SEQ ID NO: 2029503 - RNA, 22 nt, Human
ccccuuccuaauuccacagcug

SEQ ID NO: 2029504 - RNA, 20 nt, Human
gcgcggggcggggagcgagc

SEQ ID NO: 2029505 - RNA, 19 nt, Human
ugcuugucccuguggaagu

SEQ ID NO: 2029506 - RNA, 16 nt, Human
uuauauuuccaagaaa

SEQ ID NO: 2029507 - RNA, 16 nt, Human
ggagccuccagcugcc

SEQ ID NO: 2029508 - RNA, 15 nt, Human
cuuuaaaacuuaucc

SEQ ID NO: 2029509 - RNA, 12 nt, Human
aaaauaacaaua

SEQ ID NO: 2029510 - RNA, 14 nt, Human
cauuaaaguucuag

SEQ ID NO: 2029511 - RNA, 22 nt, Human
ucugcuaugcuauugaaguuuu

SEQ ID NO: 2029512 - RNA, 21 nt, Human
ugaaacgaggauugggaaaaa

SEQ ID NO: 2029513 - RNA, 16 nt, Human
augagcacgcauggaa

SEQ ID NO: 2029514 - RNA, 16 nt, Human
cacgggggccaaggau

SEQ ID NO: 2029515 - RNA, 18 nt, Human
agccggagccuccagcug

SEQ ID NO: 2029516 - RNA, 21 nt, Human
aaaauuuuuucucuaggaaau

SEQ ID NO: 2029517 - RNA, 20 nt, Human
gaaaauaacaauaaaagaca

SEQ ID NO: 2029518 - RNA, 16 nt, Human
ccauuuuuagugaaau

SEQ ID NO: 2029519 - RNA, 24 nt, Human
auauucucacagcuccaagaauuu

SEQ ID NO: 2029520 - RNA, 19 nt, Human
cccugccucaagcuaugug

SEQ ID NO: 2029521 - RNA, 14 nt, Human
aucaccaaggcuga

SEQ ID NO: 2029522 - RNA, 14 nt, Human
ccucugcagcuucc

SEQ ID NO: 2029523 - RNA, 14 nt, Human
ggcauucaaaugua

SEQ ID NO: 2029524 - RNA, 21 nt, Human
auuuuuucucuaggaaauauu

SEQ ID NO: 2029525 - RNA, 13 nt, Human
gagacagcucugc

SEQ ID NO: 2029526 - RNA, 15 nt, Human
uccacaaguaaaagg

SEQ ID NO: 2029527 - RNA, 20 nt, Human
auuuugugauugauuauaug

SEQ ID NO: 2029528 - RNA, 21 nt, Human
augaauacuuuauaaaggauu

SEQ ID NO: 2029529 - RNA, 17 nt, Human
ugaaggauuuauguuua

SEQ ID NO: 2029530 - RNA, 14 nt, Human
agagaauuuccuua

SEQ ID NO: 2029531 - RNA, 14 nt, Human
guauuuuaaaagaa

SEQ ID NO: 2029532 - RNA, 18 nt, Human
aauuuuuuugugggaaau

SEQ ID NO: 2029533 - RNA, 18 nt, Human
agauauuaacugagaagg

SEQ ID NO: 2029534 - RNA, 13 nt, Human
agccuccagcugc

SEQ ID NO: 2029535 - RNA, 22 nt, Human
ggguuccuuccucugagccuug

SEQ ID NO: 2029536 - RNA, 22 nt, Human
cuagucucuaucauuaaaguuc

SEQ ID NO: 2029537 - RNA, 18 nt, Human
auuuuagacauucuuuau

SEQ ID NO: 2029538 - RNA, 22 nt, Human
gcuauuugcuguuauuuuaucu

SEQ ID NO: 2029539 - RNA, 19 nt, Human
auuuuagauagaugaagaa

SEQ ID NO: 2029540 - RNA, 18 nt, Human
gacauuugcucauggaau

SEQ ID NO: 2029541 - RNA, 17 nt, Human
cuaucucauuuccaagc

SEQ ID NO: 2029542 - RNA, 17 nt, Human
auaucuuaucuuccuau

SEQ ID NO: 2029543 - RNA, 15 nt, Human
ugguuuagaaagcuu

SEQ ID NO: 2029544 - RNA, 21 nt, Human
ccggccuuugcaccuccaugg

SEQ ID NO: 2029545 - RNA, 16 nt, Human
ccgcauccuagucucu

SEQ ID NO: 2029546 - RNA, 18 nt, Human
caagccucauguccacug

SEQ ID NO: 2029547 - RNA, 19 nt, Human
cuccuuggagacagggccc

SEQ ID NO: 2029548 - RNA, 14 nt, Human
uucacauuuaaaua

SEQ ID NO: 2029549 - RNA, 21 nt, Human
auccccaagccuggcaaggga

SEQ ID NO: 2029550 - RNA, 22 nt, Human
cagcccuggugggcagagaggu

SEQ ID NO: 2029551 - RNA, 21 nt, Human
ggcaccgcuguacgcgagcgc

SEQ ID NO: 2029552 - RNA, 18 nt, Human
uacauuuguauaaaauaa

SEQ ID NO: 2029553 - RNA, 21 nt, Human
uauuauuuuauagcuacuaau

SEQ ID NO: 2029554 - RNA, 16 nt, Human
aaaauaacaauaaaag

SEQ ID NO: 2029555 - RNA, 18 nt, Human
cacaaguaaaaggaaaug

SEQ ID NO: 2029556 - RNA, 22 nt, Human
acccugaggugagcaucaucuu

SEQ ID NO: 2029557 - RNA, 14 nt, Human
aaccugagccccaa

SEQ ID NO: 2029558 - RNA, 23 nt, Human
caaagcugaaauggacuuuugua

SEQ ID NO: 2029559 - RNA, 16 nt, Human
ugcagugucugcugga

SEQ ID NO: 2029560 - RNA, 20 nt, Human
uuuaaauaaaguguuugaaa

SEQ ID NO: 2029561 - RNA, 16 nt, Human
uauuuuaauguuucuu

SEQ ID NO: 2029562 - RNA, 15 nt, Human
caagcucacagaccu

SEQ ID NO: 2029563 - RNA, 17 nt, Human
cuagaaaacaggcaaau

SEQ ID NO: 2029564 - RNA, 18 nt, Human
gcuauaggauguggggaa

SEQ ID NO: 2029565 - RNA, 21 nt, Human
aaugugacuuaaugccacuaa

SEQ ID NO: 2029566 - RNA, 16 nt, Human
auuuguauaaaauaau

SEQ ID NO: 2029567 - RNA, 20 nt, Human
cccuuccuaauuccacagcu

SEQ ID NO: 2029568 - RNA, 20 nt, Human
cgcauccuagucucuaucau

SEQ ID NO: 2029569 - RNA, 22 nt, Human
gucacaggaaguagaggaggcc

SEQ ID NO: 2029570 - RNA, 17 nt, Human
agccgggaaagaagagc

SEQ ID NO: 2029571 - RNA, 23 nt, Human
ucggccuccauccugaggcucca

SEQ ID NO: 2029572 - RNA, 14 nt, Human
aauauuauguuaaa

SEQ ID NO: 2029573 - RNA, 16 nt, Human
aucaauuuaaaaaaaa

SEQ ID NO: 2029574 - RNA, 14 nt, Human
ucucagaaggaaag

SEQ ID NO: 2029575 - RNA, 19 nt, Human
cucacauuuauauuuuugu

SEQ ID NO: 2029576 - RNA, 13 nt, Human
guuguguguggaa

SEQ ID NO: 2029577 - RNA, 13 nt, Human
aauuuuuauauuu

SEQ ID NO: 2029578 - RNA, 12 nt, Human
cuguuaucuuca

SEQ ID NO: 2029579 - RNA, 23 nt, Human
cacacuguccauucuuccuccca

SEQ ID NO: 2029580 - RNA, 22 nt, Human
cuccugccuaagugcagccccg

SEQ ID NO: 2029581 - RNA, 21 nt, Human
ggcgcuggcugcgcucggccu

SEQ ID NO: 2029582 - RNA, 17 nt, Human
cgccuccgcuacuucca

SEQ ID NO: 2029583 - RNA, 21 nt, Human
gaagucacauuccugaacagg

SEQ ID NO: 2029584 - RNA, 13 nt, Human
aagacaaggaaaa

SEQ ID NO: 2029585 - RNA, 21 nt, Human
cccccucuccucucuuccucc

SEQ ID NO: 2029586 - RNA, 14 nt, Human
ccugccccugagcc

SEQ ID NO: 2029587 - RNA, 23 nt, Human
ugucuucaggggccacaccaacc

SEQ ID NO: 2029588 - RNA, 19 nt, Human
ggagccugaucaccugccc

SEQ ID NO: 2029589 - RNA, 20 nt, Human
ucagaaggaaagaauaacca

SEQ ID NO: 2029590 - RNA, 15 nt, Human
uagauaggccauggg

SEQ ID NO: 2029591 - RNA, 19 nt, Human
acaauaacgauaaaagaca

SEQ ID NO: 2029592 - RNA, 17 nt, Human
augaauaucaguuauuu

SEQ ID NO: 2029593 - RNA, 12 nt, Human
caaccugccagc

SEQ ID NO: 2029594 - RNA, 12 nt, Human
cuggcuccagcu

SEQ ID NO: 2029595 - RNA, 18 nt, Human
cagugaaagaaaauaaca

SEQ ID NO: 2029596 - RNA, 20 nt, Human
uuugcaagccagauuuuccu

SEQ ID NO: 2029597 - RNA, 16 nt, Human
ucccugccccccagcc

SEQ ID NO: 2029598 - RNA, 17 nt, Human
guggcucugugugcucu

SEQ ID NO: 2029599 - RNA, 17 nt, Human
uggcuaagcaaaaugug

SEQ ID NO: 2029600 - RNA, 10 nt, Human
uuuuuaaaaa

SEQ ID NO: 2029601 - RNA, 23 nt, Human
acgaggauugggaaaaaguaauu

SEQ ID NO: 2029602 - RNA, 14 nt, Human
uugugauugauuau

SEQ ID NO: 2029603 - RNA, 16 nt, Human
uucuauaauuuaaaua

SEQ ID NO: 2029604 - RNA, 15 nt, Human
gcuguauuuuaaaag

SEQ ID NO: 2029605 - RNA, 16 nt, Human
gaaguaucuugguugu

SEQ ID NO: 2029606 - RNA, 19 nt, Human
ccucucuuccucccuggaa

SEQ ID NO: 2029607 - RNA, 21 nt, Human
uacauaaauuuaguauuuugu

SEQ ID NO: 2029608 - RNA, 13 nt, Human
aguaugaaaaugu

SEQ ID NO: 2029609 - RNA, 11 nt, Human
aaccugagccc

SEQ ID NO: 2029610 - RNA, 19 nt, Human
guuauuauauuuacaaaug

SEQ ID NO: 2029611 - RNA, 16 nt, Human
uggggauagugaggca

SEQ ID NO: 2029612 - RNA, 13 nt, Human
cgagccccaggcg

SEQ ID NO: 2029613 - RNA, 17 nt, Human
acuguaaagcuuugugc

SEQ ID NO: 2029614 - RNA, 14 nt, Human
caugaacuuguaaa

SEQ ID NO: 2029615 - RNA, 19 nt, Human
agccuccagcugccccggg

SEQ ID NO: 2029616 - RNA, 15 nt, Human
uuaauucugaaagca

SEQ ID NO: 2029617 - RNA, 18 nt, Human
agcuuugugcagauucuu

SEQ ID NO: 2029618 - RNA, 23 nt, Human
ugaaaaucuuauaauuuaaaaua

SEQ ID NO: 2029619 - RNA, 21 nt, Human
gcuccgcgcagcucaggcugg

SEQ ID NO: 2029620 - RNA, 23 nt, Human
uguucuugugaacccaaagugug

SEQ ID NO: 2029621 - RNA, 15 nt, Human
agucaccucauggaa

SEQ ID NO: 2029622 - RNA, 22 nt, Human
aaacauccuacaagacacagug

SEQ ID NO: 2029623 - RNA, 15 nt, Human
guuuuucuuuucauu

SEQ ID NO: 2029624 - RNA, 21 nt, Human
cugagccucagucucccuccc

SEQ ID NO: 2029625 - RNA, 12 nt, Human
gaauuggagcuc

SEQ ID NO: 2029626 - RNA, 20 nt, Human
agcauuguuggcuguuccug

SEQ ID NO: 2029627 - RNA, 17 nt, Human
cuucacuguaaaauaau

SEQ ID NO: 2029628 - RNA, 23 nt, Human
cuagucuguuuucccuccuugga

SEQ ID NO: 2029629 - RNA, 19 nt, Human
ccccuucccacacugucca

SEQ ID NO: 2029630 - RNA, 22 nt, Human
ucccuagaaagccaugugcagc

SEQ ID NO: 2029631 - RNA, 16 nt, Human
ugaaguacucauacau

SEQ ID NO: 2029632 - RNA, 17 nt, Human
uaugcuauugaaguuuu

SEQ ID NO: 2029633 - RNA, 11 nt, Human
auacucuuaua

SEQ ID NO: 2029634 - RNA, 14 nt, Human
gcugauuaaaccaa

SEQ ID NO: 2029635 - RNA, 21 nt, Human
acucauuaaauggaaguaaau

SEQ ID NO: 2029636 - RNA, 20 nt, Human
guugagccaccaagcuggug

SEQ ID NO: 2029637 - RNA, 21 nt, Human
gaaggaaagaauaaccaacac

SEQ ID NO: 2029638 - RNA, 17 nt, Human
caccugcugagccccaa

SEQ ID NO: 2029639 - RNA, 21 nt, Human
cucaaaacuucagacauagaa

SEQ ID NO: 2029640 - RNA, 17 nt, Human
uuacagagacagaaagc

SEQ ID NO: 2029641 - RNA, 14 nt, Human
acauauauaacaau

SEQ ID NO: 2029642 - RNA, 22 nt, Human
ugaguguugccuaauuuguuuu

SEQ ID NO: 2029643 - RNA, 12 nt, Human
ccugccagcugg

SEQ ID NO: 2029644 - RNA, 22 nt, Human
cuaagucccugcugcccuuccc

SEQ ID NO: 2029645 - RNA, 16 nt, Human
agccucagucucccuc

SEQ ID NO: 2029646 - RNA, 14 nt, Human
ccaucccggccggc

SEQ ID NO: 2029647 - RNA, 14 nt, Human
acuauuauauuucc

SEQ ID NO: 2029648 - RNA, 20 nt, Human
cgcaggaccaucccggccgg

SEQ ID NO: 2029649 - RNA, 17 nt, Human
uuauuacuguaagaaaa

SEQ ID NO: 2029650 - RNA, 16 nt, Human
cuggguugaagggcag

SEQ ID NO: 2029651 - RNA, 14 nt, Human
cuucccacacuguc

SEQ ID NO: 2029652 - RNA, 22 nt, Human
ugaccauacuaauuauaccccc

SEQ ID NO: 2029653 - RNA, 13 nt, Human
gggaggggcgcuc

SEQ ID NO: 2029654 - RNA, 16 nt, Human
ccugagcuugcagaga

SEQ ID NO: 2029655 - RNA, 22 nt, Human
gcggguccgggucgcaggacca

SEQ ID NO: 2029656 - RNA, 11 nt, Human
aaagauucaau

SEQ ID NO: 2029657 - RNA, 17 nt, Human
uuccaagugauugaaac

SEQ ID NO: 2029658 - RNA, 13 nt, Human
auugauuauaugu

SEQ ID NO: 2029659 - RNA, 16 nt, Human
ugcacaucaaaauaug

SEQ ID NO: 2029660 - RNA, 22 nt, Human
aacugauguaaguaaacggucu

SEQ ID NO: 2029661 - RNA, 23 nt, Human
uacuuccagggcuacgcgcgcuc

SEQ ID NO: 2029662 - RNA, 17 nt, Human
cuggcugcugguggcgc

SEQ ID NO: 2029663 - RNA, 16 nt, Human
auacauguuacaacac

SEQ ID NO: 2029664 - RNA, 18 nt, Human
uguugcagugucugcugg

SEQ ID NO: 2029665 - RNA, 22 nt, Human
aaaaaaccugagccccaaaagg

SEQ ID NO: 2029666 - RNA, 16 nt, Human
aacgagacaagcagcc

SEQ ID NO: 2029667 - RNA, 14 nt, Human
aggggaccagagag

SEQ ID NO: 2029668 - RNA, 18 nt, Human
gccuccagcugccccggg

SEQ ID NO: 2029669 - RNA, 13 nt, Human
cacaacuauauug

SEQ ID NO: 2029670 - RNA, 15 nt, Human
cucccuuggggccua

SEQ ID NO: 2029671 - RNA, 20 nt, Human
ccccuauccuacuuccccuu

SEQ ID NO: 2029672 - RNA, 20 nt, Human
guuccuuccucugagccuug

SEQ ID NO: 2029673 - RNA, 24 nt, Human
ccccugagcuugcagagaugaggc

SEQ ID NO: 2029674 - RNA, 22 nt, Human
cggagccgggaaagaagagccg

SEQ ID NO: 2029675 - RNA, 20 nt, Human
aaaacuuauccuccaugaau

SEQ ID NO: 2029676 - RNA, 23 nt, Human
cucauguccacugguucuucuug

SEQ ID NO: 2029677 - RNA, 23 nt, Human
auucaauaucuuuuuuuuaauaa

SEQ ID NO: 2029678 - RNA, 23 nt, Human
ugauguuucauaagaauucuguu

SEQ ID NO: 2029679 - RNA, 21 nt, Human
ugccagcuggccuugugagga

SEQ ID NO: 2029680 - RNA, 12 nt, Human
uuauuauaguca

SEQ ID NO: 2029681 - RNA, 19 nt, Human
ugccucaagcuaugugagc

SEQ ID NO: 2029682 - RNA, 20 nt, Human
cugagccucagucucccucc

SEQ ID NO: 2029683 - RNA, 20 nt, Human
aaggagccaaacauccuaca

SEQ ID NO: 2029684 - RNA, 13 nt, Human
caucugagccccg

SEQ ID NO: 2029685 - RNA, 15 nt, Human
ugagcucagcccugg

SEQ ID NO: 2029686 - RNA, 15 nt, Human
uaacgauaaaagaca

SEQ ID NO: 2029687 - RNA, 20 nt, Human
ugaaaaucuuauaauuuaaa

SEQ ID NO: 2029688 - RNA, 22 nt, Human
gcugguggcgcuggcugcgcuc

SEQ ID NO: 2029689 - RNA, 21 nt, Human
ugaacaaauuuacagagacag

SEQ ID NO: 2029690 - RNA, 23 nt, Human
ucccgcuguuccucgccacgcuc

SEQ ID NO: 2029691 - RNA, 14 nt, Human
cugcuaguuuauau

SEQ ID NO: 2029692 - RNA, 19 nt, Human
ggagggcgcggggcgggga

SEQ ID NO: 2029693 - RNA, 17 nt, Human
cugccucucucauccac

SEQ ID NO: 2029694 - RNA, 21 nt, Human
uaucuuccuauaauuuuagac

SEQ ID NO: 2029695 - RNA, 19 nt, Human
uuguagaagucacauuccu

SEQ ID NO: 2029696 - RNA, 17 nt, Human
auuuuaauaauguuuca

SEQ ID NO: 2029697 - RNA, 14 nt, Human
ugcagcuuccaggc

SEQ ID NO: 2029698 - RNA, 13 nt, Human
caucgcagacaca

SEQ ID NO: 2029699 - RNA, 15 nt, Human
aguaaauguuguuuu

SEQ ID NO: 2029700 - RNA, 19 nt, Human
cuucccgcuguuccucgcc

SEQ ID NO: 2029701 - RNA, 23 nt, Human
aaaauaucacuugucaauaaaau

SEQ ID NO: 2029702 - RNA, 16 nt, Human
aagcuucacuguaaaa

SEQ ID NO: 2029703 - RNA, 19 nt, Human
auuuaguuauaaaaauaua

SEQ ID NO: 2029704 - RNA, 13 nt, Human
ggugugugcagca

SEQ ID NO: 2029705 - RNA, 11 nt, Human
uuauuuuuaaa

SEQ ID NO: 2029706 - RNA, 15 nt, Human
cucgcccacuuccuc

SEQ ID NO: 2029707 - RNA, 23 nt, Human
gcccuggugccucaccccuugcc

SEQ ID NO: 2029708 - RNA, 19 nt, Human
auacuaauuauacccccug

SEQ ID NO: 2029709 - RNA, 18 nt, Human
uauuuuguuucagugcac

SEQ ID NO: 2029710 - RNA, 21 nt, Human
ccuccccaaaugcuuuccaug

SEQ ID NO: 2029711 - RNA, 20 nt, Human
uagcauuuguguugaagagg

SEQ ID NO: 2029712 - RNA, 20 nt, Human
caagagccuuuuuuugaaaa

SEQ ID NO: 2029713 - RNA, 21 nt, Human
ccuccagcugccccggggagg

SEQ ID NO: 2029714 - RNA, 21 nt, Human
cagacacaugugcuggccacc

SEQ ID NO: 2029715 - RNA, 19 nt, Human
ugaucaccugcccugcuga

SEQ ID NO: 2029716 - RNA, 16 nt, Human
ugugcagccaccaguc

SEQ ID NO: 2029717 - RNA, 14 nt, Human
uggcucugugugcu

SEQ ID NO: 2029718 - RNA, 17 nt, Human
acaagaaaugaaagcag

SEQ ID NO: 2029719 - RNA, 19 nt, Human
uaucuauguagaauauauu

SEQ ID NO: 2029720 - RNA, 17 nt, Human
gugccuguaaucacagc

SEQ ID NO: 2029721 - RNA, 16 nt, Human
cucaauaaaguacaag

SEQ ID NO: 2029722 - RNA, 17 nt, Human
aaauaacgauaaaagac

SEQ ID NO: 2029723 - RNA, 16 nt, Human
gaaaaaauaacaauga

SEQ ID NO: 2029724 - RNA, 13 nt, Human
acaaggaaaaaau

SEQ ID NO: 2029725 - RNA, 14 nt, Human
acauagugaggagc

SEQ ID NO: 2029726 - RNA, 18 nt, Human
gaagcaaaauuuuuucuc

SEQ ID NO: 2029727 - RNA, 15 nt, Human
ugagguaaccucauu

SEQ ID NO: 2029728 - RNA, 19 nt, Human
uuauggcacuaguauuucu

SEQ ID NO: 2029729 - RNA, 19 nt, Human
ugcuauuugcuguuauuuu

SEQ ID NO: 2029730 - RNA, 15 nt, Human
uaucuucacuuuuau

SEQ ID NO: 2029731 - RNA, 18 nt, Human
uaaaauccauacauuugu

SEQ ID NO: 2029732 - RNA, 20 nt, Human
aucaaccugccagcuggccu

SEQ ID NO: 2029733 - RNA, 14 nt, Human
uccacaacacacag

SEQ ID NO: 2029734 - RNA, 15 nt, Human
aaucucaauauuuca

SEQ ID NO: 2029735 - RNA, 19 nt, Human
gcuccgcgcagcucaggcu

SEQ ID NO: 2029736 - RNA, 18 nt, Human
auuuaguauuuuguuuca

SEQ ID NO: 2029737 - RNA, 22 nt, Human
cuugaauuguaggugacuauua

SEQ ID NO: 2029738 - RNA, 15 nt, Human
ccccugagcuugcag

SEQ ID NO: 2029739 - RNA, 17 nt, Human
auaaguacaugauaagc

SEQ ID NO: 2029740 - RNA, 16 nt, Human
cuucccacacugucca

SEQ ID NO: 2029741 - RNA, 23 nt, Human
uaggauggcuaguaucaaaagaa

SEQ ID NO: 2029742 - RNA, 14 nt, Human
ccacccgcccaccg

SEQ ID NO: 2029743 - RNA, 19 nt, Human
cugcaaagcccagcuugaa

SEQ ID NO: 2029744 - RNA, 12 nt, Human
gaugagagaaca

SEQ ID NO: 2029745 - RNA, 11 nt, Human
aauuccacagc

SEQ ID NO: 2029746 - RNA, 15 nt, Human
cuggguuccuuccuc

SEQ ID NO: 2029747 - RNA, 13 nt, Human
uaaacauguuuau

SEQ ID NO: 2029748 - RNA, 13 nt, Human
aagaaaauaacga

SEQ ID NO: 2029749 - RNA, 22 nt, Human
ucaacuccaaacugacucuuaa

SEQ ID NO: 2029750 - RNA, 21 nt, Human
cgagccccaggcggguccggg

SEQ ID NO: 2029751 - RNA, 22 nt, Human
agcagcauaaauguugacaugg

SEQ ID NO: 2029752 - RNA, 15 nt, Human
aggguuuggaagcca

SEQ ID NO: 2029753 - RNA, 23 nt, Human
aggcuuuaaaacuuauccuccau

SEQ ID NO: 2029754 - RNA, 12 nt, Human
aauaaaguacaa

SEQ ID NO: 2029755 - RNA, 24 nt, Human
uggccgggagccugaucaccugcc

SEQ ID NO: 2029756 - RNA, 19 nt, Human
auuggagcucgugggacag

SEQ ID NO: 2029757 - RNA, 20 nt, Human
gcuuccaggcuggcgugcag

SEQ ID NO: 2029758 - RNA, 15 nt, Human
gaaaugauguuucau

SEQ ID NO: 2029759 - RNA, 15 nt, Human
ccaucccggccggcg

SEQ ID NO: 2029760 - RNA, 13 nt, Human
cccuccuuaucaa

SEQ ID NO: 2029761 - RNA, 18 nt, Human
accaccugccuauauuuu

SEQ ID NO: 2029762 - RNA, 14 nt, Human
agagguccacaaca

SEQ ID NO: 2029763 - RNA, 19 nt, Human
ccccuauccuacuuccccu

SEQ ID NO: 2029764 - RNA, 12 nt, Human
aucauuuacuuu

SEQ ID NO: 2029765 - RNA, 18 nt, Human
ccugcaaagcccagcuug

SEQ ID NO: 2029766 - RNA, 14 nt, Human
guagcuaaauauau

SEQ ID NO: 2029767 - RNA, 22 nt, Human
aacucccugccccccagcccuc

SEQ ID NO: 2029768 - RNA, 21 nt, Human
cccccauuguggucacaggaa

SEQ ID NO: 2029769 - RNA, 17 nt, Human
ggcuccggacgcugcug

SEQ ID NO: 2029770 - RNA, 20 nt, Human
augcaguuguugcccacagc

SEQ ID NO: 2029771 - RNA, 18 nt, Human
gaagcaccaaucaugaau

SEQ ID NO: 2029772 - RNA, 20 nt, Human
cucgcccacuuccucccggc

SEQ ID NO: 2029773 - RNA, 19 nt, Human
ccccugagcuugcagagau

SEQ ID NO: 2029774 - RNA, 20 nt, Human
uaucuucacuuuuauaagaa

SEQ ID NO: 2029775 - RNA, 21 nt, Human
aggacagcccuucuuuccaca

SEQ ID NO: 2029776 - RNA, 16 nt, Human
gcuguuaaucuuucaa

SEQ ID NO: 2029777 - RNA, 18 nt, Human
ggaccaucccggccggcg

SEQ ID NO: 2029778 - RNA, 16 nt, Human
ccacuuccucccggcc

SEQ ID NO: 2029779 - RNA, 15 nt, Human
auaucuuaucuuccu

SEQ ID NO: 2029780 - RNA, 22 nt, Human
auauuuacaaaugggaaacaaa

SEQ ID NO: 2029781 - RNA, 16 nt, Human
augcuguauuuuaaaa

SEQ ID NO: 2029782 - RNA, 21 nt, Human
uuauagcuacuaauuuuaaaa

SEQ ID NO: 2029783 - RNA, 22 nt, Human
augcagagguccacaacacaca

SEQ ID NO: 2029784 - RNA, 19 nt, Human
uuuauaucaauuuaaaaaa

SEQ ID NO: 2029785 - RNA, 20 nt, Human
uguaauaggcguaacuaauu

SEQ ID NO: 2029786 - RNA, 20 nt, Human
ugauuucugagcauuuaaua

SEQ ID NO: 2029787 - RNA, 14 nt, Human
cugccccccagccc

SEQ ID NO: 2029788 - RNA, 18 nt, Human
uuacaaaugggaaacaaa

SEQ ID NO: 2029789 - RNA, 14 nt, Human
cauagaaguaaaaa

SEQ ID NO: 2029790 - RNA, 17 nt, Human
uccuuggugccuggagc

SEQ ID NO: 2029791 - RNA, 14 nt, Human
aagaagugaaaauc

SEQ ID NO: 2029792 - RNA, 15 nt, Human
acagugaaagaaaau

SEQ ID NO: 2029793 - RNA, 17 nt, Human
ggaaauauuuauuuuaa

SEQ ID NO: 2029794 - RNA, 12 nt, Human
aauauauuuccu

SEQ ID NO: 2029795 - RNA, 14 nt, Human
cugaggcuccacuu

SEQ ID NO: 2029796 - RNA, 14 nt, Human
gaaagcagaacagu

SEQ ID NO: 2029797 - RNA, 15 nt, Human
uucugcacacagcac

SEQ ID NO: 2029798 - RNA, 22 nt, Human
agaaauaggaaauauuuuaaug

SEQ ID NO: 2029799 - RNA, 16 nt, Human
guuuuuuuuuaaaaaa

SEQ ID NO: 2029800 - RNA, 16 nt, Human
ugcuauugaaguuuug

SEQ ID NO: 2029801 - RNA, 16 nt, Human
cgcucaucccacccgc

SEQ ID NO: 2029802 - RNA, 23 nt, Human
caccucauggaauuggagcucgu

SEQ ID NO: 2029803 - RNA, 20 nt, Human
uaaaagacaaggaaaaaaua

SEQ ID NO: 2029804 - RNA, 19 nt, Human
aaaguaugugcauauuuua

SEQ ID NO: 2029805 - RNA, 13 nt, Human
ucuuauaauuuaa

SEQ ID NO: 2029806 - RNA, 19 nt, Human
cucugcauacucauuagga

SEQ ID NO: 2029807 - RNA, 17 nt, Human
aagcacagugaucaagu

SEQ ID NO: 2029808 - RNA, 13 nt, Human
cacaacacacaga

SEQ ID NO: 2029809 - RNA, 17 nt, Human
uccucacuuugaagagu

SEQ ID NO: 2029810 - RNA, 13 nt, Human
ugcauuucuaaag

SEQ ID NO: 2029811 - RNA, 17 nt, Human
uuauaaucuuucacagg

SEQ ID NO: 2029812 - RNA, 17 nt, Human
cgcgccuccgcuacuuc

SEQ ID NO: 2029813 - RNA, 13 nt, Human
ugaaaaucuuaua

SEQ ID NO: 2029814 - RNA, 12 nt, Human
gucauuguucuu

SEQ ID NO: 2029815 - RNA, 16 nt, Human
aacaauuugaauauaa

SEQ ID NO: 2029816 - RNA, 20 nt, Human
cacagcacgggggccaagga

SEQ ID NO: 2029817 - RNA, 19 nt, Human
cucggccugcucgcccacu

SEQ ID NO: 2029818 - RNA, 15 nt, Human
uccagauccuggaaa

SEQ ID NO: 2029819 - RNA, 21 nt, Human
guuguaauuuuuuugugggaa

SEQ ID NO: 2029820 - RNA, 16 nt, Human
gaguuccuucugcucc

SEQ ID NO: 2029821 - RNA, 14 nt, Human
ccaaugaaaugagu

SEQ ID NO: 2029822 - RNA, 16 nt, Human
cggggagcgagcccca

SEQ ID NO: 2029823 - RNA, 16 nt, Human
ggaggggcgcucgcuu

SEQ ID NO: 2029824 - RNA, 14 nt, Human
gcuggcaccgcugu

SEQ ID NO: 2029825 - RNA, 20 nt, Human
gagccucagucucccucccu

SEQ ID NO: 2029826 - RNA, 21 nt, Human
uaauaggcguaacuaauuuua

SEQ ID NO: 2029827 - RNA, 16 nt, Human
ccuacaugagguacug

SEQ ID NO: 2029828 - RNA, 16 nt, Human
aaaguugaauuuuaca

SEQ ID NO: 2029829 - RNA, 15 nt, Human
agacagcucugcaua

SEQ ID NO: 2029830 - RNA, 19 nt, Human
aauuuuguuauguauauuu

SEQ ID NO: 2029831 - RNA, 19 nt, Human
uguuaucuucacuuuuaua

SEQ ID NO: 2029832 - RNA, 15 nt, Human
uagaauauauuuccu

SEQ ID NO: 2029833 - RNA, 15 nt, Human
uaucaauuuaaaaaa

SEQ ID NO: 2029834 - RNA, 19 nt, Human
cugcgcgccgcgcuccucg

SEQ ID NO: 2029835 - RNA, 17 nt, Human
agcgacagugagacucu

SEQ ID NO: 2029836 - RNA, 18 nt, Human
cugcagcgaguacuuccc

SEQ ID NO: 2029837 - RNA, 12 nt, Human
gcgagccccagg

SEQ ID NO: 2029838 - RNA, 18 nt, Human
auccccaagccuggcaag

SEQ ID NO: 2029839 - RNA, 13 nt, Human
gcgcgccuccgcu

SEQ ID NO: 2029840 - RNA, 19 nt, Human
uucccuugaugaagaaguu

SEQ ID NO: 2029841 - RNA, 13 nt, Human
cagaaaaguugaa

SEQ ID NO: 2029842 - RNA, 19 nt, Human
cgcucugggucgccggcau

SEQ ID NO: 2029843 - RNA, 20 nt, Human
accugauuucugagcauuua

SEQ ID NO: 2029844 - RNA, 15 nt, Human
cacuuccucccggcc

SEQ ID NO: 2029845 - RNA, 22 nt, Human
cggccugcucgcccacuuccuc

SEQ ID NO: 2029846 - RNA, 15 nt, Human
uaguauggcaaacug

SEQ ID NO: 2029847 - RNA, 13 nt, Human
ggcaggcacugcc

SEQ ID NO: 2029848 - RNA, 15 nt, Human
guguugcagugucug

SEQ ID NO: 2029849 - RNA, 14 nt, Human
cacaacacacagau

SEQ ID NO: 2029850 - RNA, 23 nt, Human
ccccggggaggggcgcucgcuuc

SEQ ID NO: 2029851 - RNA, 18 nt, Human
ucuucaacucccugcccc

SEQ ID NO: 2029852 - RNA, 20 nt, Human
uuuaaauagcuuuuuucucu

SEQ ID NO: 2029853 - RNA, 19 nt, Human
caaagugucuugaauugua

SEQ ID NO: 2029854 - RNA, 18 nt, Human
uucugauauuggacagua

SEQ ID NO: 2029855 - RNA, 14 nt, Human
uggcuugaguuuaa

SEQ ID NO: 2029856 - RNA, 19 nt, Human
gcggcccugugcggccugg

SEQ ID NO: 2029857 - RNA, 17 nt, Human
ggagcucguggaacagu

SEQ ID NO: 2029858 - RNA, 12 nt, Human
auauaaauaaaa

SEQ ID NO: 2029859 - RNA, 19 nt, Human
aguauuucuaugaaauauu

SEQ ID NO: 2029860 - RNA, 19 nt, Human
agucccuccccaaaugcuu

SEQ ID NO: 2029861 - RNA, 14 nt, Human
aucucuucucagaa

SEQ ID NO: 2029862 - RNA, 23 nt, Human
cuuauuguagcauccuggaauau

SEQ ID NO: 2029863 - RNA, 16 nt, Human
aaauauuauguuaaaa

SEQ ID NO: 2029864 - RNA, 16 nt, Human
gaauggcuaagcaaaa

SEQ ID NO: 2029865 - RNA, 18 nt, Human
caaggcuagaaccaccug

SEQ ID NO: 2029866 - RNA, 21 nt, Human
aaaauaugccccauucaacau

SEQ ID NO: 2029867 - RNA, 18 nt, Human
ucaacucauauuuucaug

SEQ ID NO: 2029868 - RNA, 15 nt, Human
aaaauacaaaaaaaa

SEQ ID NO: 2029869 - RNA, 16 nt, Human
ucuucucagaaggaaa

SEQ ID NO: 2029870 - RNA, 19 nt, Human
cacggcuggagcugccucu

SEQ ID NO: 2029871 - RNA, 21 nt, Human
uacaugagguacugagaguga

SEQ ID NO: 2029872 - RNA, 20 nt, Human
cuuccaggcuggcgugcagc

SEQ ID NO: 2029873 - RNA, 18 nt, Human
uucagcagagaaguuuuc

SEQ ID NO: 2029874 - RNA, 18 nt, Human
uguccauucuuccuccca

SEQ ID NO: 2029875 - RNA, 20 nt, Human
uuugccgcuuaagcuuucag

SEQ ID NO: 2029876 - RNA, 18 nt, Human
gccccugcacuccagccu

SEQ ID NO: 2029877 - RNA, 14 nt, Human
agaauuugauaugu

SEQ ID NO: 2029878 - RNA, 16 nt, Human
gccucucucauccacu

SEQ ID NO: 2029879 - RNA, 23 nt, Human
agcccuccuuaucaaaggacacc

SEQ ID NO: 2029880 - RNA, 13 nt, Human
guggcgcuggcug

SEQ ID NO: 2029881 - RNA, 17 nt, Human
ugguucccuugaugaag

SEQ ID NO: 2029882 - RNA, 20 nt, Human
aagucuuucacauuuaaaua

SEQ ID NO: 2029883 - RNA, 14 nt, Human
cucccucccuuggg

SEQ ID NO: 2029884 - RNA, 16 nt, Human
uucccaacuccagaaa

SEQ ID NO: 2029885 - RNA, 22 nt, Human
agugagcagucaggaaagagaa

SEQ ID NO: 2029886 - RNA, 21 nt, Human
caaggaaaaaauaacaaugaa

SEQ ID NO: 2029887 - RNA, 15 nt, Human
gaaaacaaggaugaa

SEQ ID NO: 2029888 - RNA, 23 nt, Human
aaagcccagcuugaaaccuucac

SEQ ID NO: 2029889 - RNA, 20 nt, Human
ccgcagggugaacugcagcg

SEQ ID NO: 2029890 - RNA, 22 nt, Human
aauuuaaaaaaaaaccugagcc

SEQ ID NO: 2029891 - RNA, 15 nt, Human
ucuauauuuuacaua

SEQ ID NO: 2029892 - RNA, 22 nt, Human
caucgcaauguaagacucggga

SEQ ID NO: 2029893 - RNA, 21 nt, Human
aaagcugaaauggacuuuugu

SEQ ID NO: 2029894 - RNA, 22 nt, Human
cggggagcgagccccaggcggg

SEQ ID NO: 2029895 - RNA, 18 nt, Human
ggaaagaauaaccaacac

SEQ ID NO: 2029896 - RNA, 14 nt, Human
cauuuaguuauaaa

SEQ ID NO: 2029897 - RNA, 16 nt, Human
cagucucccucccuug

SEQ ID NO: 2029898 - RNA, 14 nt, Human
cagagguugcagug

SEQ ID NO: 2029899 - RNA, 20 nt, Human
aaggaugccccgucccccuc

SEQ ID NO: 2029900 - RNA, 22 nt, Human
ggaaaugauguuucauaagaau

SEQ ID NO: 2029901 - RNA, 15 nt, Human
ugccgugggccugag

SEQ ID NO: 2029902 - RNA, 15 nt, Human
gccgacggagccggg

SEQ ID NO: 2029903 - RNA, 23 nt, Human
caugcugucuacacuaagagaga

SEQ ID NO: 2029904 - RNA, 18 nt, Human
caaggcugauuaaaccaa

SEQ ID NO: 2029905 - RNA, 23 nt, Human
gccggcgcgcucaucccacccgc

SEQ ID NO: 2029906 - RNA, 20 nt, Human
aauucugguagcuaaauaua

SEQ ID NO: 2029907 - RNA, 21 nt, Human
uagaugagagaacagggcuga

SEQ ID NO: 2029908 - RNA, 21 nt, Human
gguuuucacauuggaaacaag

SEQ ID NO: 2029909 - RNA, 16 nt, Human
caaguaaaaggaaaug

SEQ ID NO: 2029910 - RNA, 13 nt, Human
aguguuugaaagc

SEQ ID NO: 2029911 - RNA, 17 nt, Human
uaaauuuaucauuuagu

SEQ ID NO: 2029912 - RNA, 12 nt, Human
acaugagguacu

SEQ ID NO: 2029913 - RNA, 21 nt, Human
cuuuccaauaaagaguuccuu

SEQ ID NO: 2029914 - RNA, 19 nt, Human
cccugcaaagcccagcuug

SEQ ID NO: 2029915 - RNA, 17 nt, Human
guuuaauucugaaagca

SEQ ID NO: 2029916 - RNA, 18 nt, Human
agaagcaacccaaauguu

SEQ ID NO: 2029917 - RNA, 18 nt, Human
acacuguccauucuuccu

SEQ ID NO: 2029918 - RNA, 17 nt, Human
caaauccaaugaaauga

SEQ ID NO: 2029919 - RNA, 14 nt, Human
acgcgcgcuccgcg

SEQ ID NO: 2029920 - RNA, 14 nt, Human
uguauucuuuuagu

SEQ ID NO: 2029921 - RNA, 20 nt, Human
aauuaaguuuuuuuuuaaaa

SEQ ID NO: 2029922 - RNA, 13 nt, Human
cacacugaagaag

SEQ ID NO: 2029923 - RNA, 19 nt, Human
ugagguaaccucauuauca

SEQ ID NO: 2029924 - RNA, 16 nt, Human
cugugccguccccaga

SEQ ID NO: 2029925 - RNA, 21 nt, Human
aacuuauccuccaugaauauc

SEQ ID NO: 2029926 - RNA, 13 nt, Human
uauuucuaugaaa

SEQ ID NO: 2029927 - RNA, 18 nt, Human
auauuuuuuucugaaauu

SEQ ID NO: 2029928 - RNA, 16 nt, Human
cuagaaccaccugccu

SEQ ID NO: 2029929 - RNA, 16 nt, Human
cucucuuccucccugg

SEQ ID NO: 2029930 - RNA, 18 nt, Human
augauguuucauaagaau

SEQ ID NO: 2029931 - RNA, 12 nt, Human
gccccugagccc

SEQ ID NO: 2029932 - RNA, 14 nt, Human
ccccugagcuugca

SEQ ID NO: 2029933 - RNA, 21 nt, Human
aauuuguuuucccuucuuaca

SEQ ID NO: 2029934 - RNA, 23 nt, Human
ugccccggggaggggcgcucgcu

SEQ ID NO: 2029935 - RNA, 21 nt, Human
aaauaauuuuuauauuugaaa

SEQ ID NO: 2029936 - RNA, 17 nt, Human
uucacuguaaaauaaua

SEQ ID NO: 2029937 - RNA, 15 nt, Human
ugucaauaaaaucca

SEQ ID NO: 2029938 - RNA, 22 nt, Human
cgcgcuccgcgcagcucaggcu

SEQ ID NO: 2029939 - RNA, 13 nt, Human
cugccuucucaac

SEQ ID NO: 2029940 - RNA, 13 nt, Human
ucacauuccugaa

SEQ ID NO: 2029941 - RNA, 22 nt, Human
caaaugggaaacaaaaggauaa

SEQ ID NO: 2029942 - RNA, 15 nt, Human
cccggccggcgcgcu

SEQ ID NO: 2029943 - RNA, 14 nt, Human
cucaacaaacauaa

SEQ ID NO: 2029944 - RNA, 21 nt, Human
cauucaaauguauuacagugg

SEQ ID NO: 2029945 - RNA, 17 nt, Human
ggcuggagcugccucuc

SEQ ID NO: 2029946 - RNA, 15 nt, Human
acuauuauauuucca

SEQ ID NO: 2029947 - RNA, 19 nt, Human
ggagcuggaaacacauguu

SEQ ID NO: 2029948 - RNA, 20 nt, Human
ccagcuugaaaccuucacuu

SEQ ID NO: 2029949 - RNA, 19 nt, Human
cucuaaauucuuucauuuu

SEQ ID NO: 2029950 - RNA, 17 nt, Human
aggcuagaaccaccugc

SEQ ID NO: 2029951 - RNA, 21 nt, Human
ugaauuguaggugacuauuau

SEQ ID NO: 2029952 - RNA, 18 nt, Human
ucucagguguguugcagu

SEQ ID NO: 2029953 - RNA, 14 nt, Human
ugcuggagcucugc

SEQ ID NO: 2029954 - RNA, 16 nt, Human
uacauuuguauaaaau

SEQ ID NO: 2029955 - RNA, 22 nt, Human
cucagcuucacccugaggugag

SEQ ID NO: 2029956 - RNA, 17 nt, Human
agggagucucagcuuca

SEQ ID NO: 2029957 - RNA, 14 nt, Human
cuaagcauuccaac

SEQ ID NO: 2029958 - RNA, 16 nt, Human
acuaaacaaagaguga

SEQ ID NO: 2029959 - RNA, 11 nt, Human
ucaccuccccc

SEQ ID NO: 2029960 - RNA, 14 nt, Human
caagaaggaaagau

SEQ ID NO: 2029961 - RNA, 21 nt, Human
cuggcugcgcucggccugcuc

SEQ ID NO: 2029962 - RNA, 13 nt, Human
gccguccccagag

SEQ ID NO: 2029963 - RNA, 11 nt, Human
agacacaugug

SEQ ID NO: 2029964 - RNA, 20 nt, Human
agggaagacaagaaggaaag

SEQ ID NO: 2029965 - RNA, 11 nt, Human
cgauaaaagac

SEQ ID NO: 2029966 - RNA, 21 nt, Human
gcccauccugccccugagccc

SEQ ID NO: 2029967 - RNA, 14 nt, Human
auuauuuuuuaaaa

SEQ ID NO: 2029968 - RNA, 14 nt, Human
uauaauuuaaaaua

SEQ ID NO: 2029969 - RNA, 17 nt, Human
gaucuggcucuggacag

SEQ ID NO: 2029970 - RNA, 22 nt, Human
agucauucagauaugauucaaa

SEQ ID NO: 2029971 - RNA, 13 nt, Human
cugaagcuguguc

SEQ ID NO: 2029972 - RNA, 15 nt, Human
aagaaggaaagauuu

SEQ ID NO: 2029973 - RNA, 16 nt, Human
caggcugagccucagu

SEQ ID NO: 2029974 - RNA, 14 nt, Human
gcuccgcgcagcuc

SEQ ID NO: 2029975 - RNA, 13 nt, Human
aauuauuucacuu

SEQ ID NO: 2029976 - RNA, 20 nt, Human
gcuggagacauugaggcagg

SEQ ID NO: 2029977 - RNA, 23 nt, Human
caacggggugaaacccugucucu

SEQ ID NO: 2029978 - RNA, 14 nt, Human
ggccuucggccucc

SEQ ID NO: 2029979 - RNA, 16 nt, Human
agguacuucaaauccu

SEQ ID NO: 2029980 - RNA, 17 nt, Human
ccaagcugguggcucug

SEQ ID NO: 2029981 - RNA, 22 nt, Human
gaaaaucuuauaauuuaaaaua

SEQ ID NO: 2029982 - RNA, 15 nt, Human
acaggguuuauguuu

SEQ ID NO: 2029983 - RNA, 22 nt, Human
uaaacuguaaagcuuugugcag

SEQ ID NO: 2029984 - RNA, 20 nt, Human
gagcaucaucuucuggguua

SEQ ID NO: 2029985 - RNA, 14 nt, Human
uauaaauaaaaaua

SEQ ID NO: 2029986 - RNA, 20 nt, Human
cuggcuaauuagcauggcca

SEQ ID NO: 2029987 - RNA, 20 nt, Human
uuccacagaagcuccaggua

SEQ ID NO: 2029988 - RNA, 22 nt, Human
gcuccuccagggagucucagcu

SEQ ID NO: 2029989 - RNA, 12 nt, Human
cuugguuuuaau

SEQ ID NO: 2029990 - RNA, 14 nt, Human
cgugcuugucccug

SEQ ID NO: 2029991 - RNA, 19 nt, Human
aagucagucauucagauau

SEQ ID NO: 2029992 - RNA, 14 nt, Human
aauauuuauuuuaa

SEQ ID NO: 2029993 - RNA, 18 nt, Human
ucaccagucccuccccaa

SEQ ID NO: 2029994 - RNA, 13 nt, Human
cccuuccccuucc

SEQ ID NO: 2029995 - RNA, 21 nt, Human
ugccuguaaucacagcuacuu

SEQ ID NO: 2029996 - RNA, 20 nt, Human
uugaacccgggaggcagagg

SEQ ID NO: 2029997 - RNA, 13 nt, Human
cacuguaaaauaa

SEQ ID NO: 2029998 - RNA, 14 nt, Human
aagcugaguguuuc

SEQ ID NO: 2029999 - RNA, 17 nt, Human
agaagagccggagccuc

SEQ ID NO: 2030000 - RNA, 15 nt, Human
gagaugcuagaacuc

SEQ ID NO: 2030001 - RNA, 19 nt, Human
cggccuccauccugaggcu

SEQ ID NO: 2030002 - RNA, 13 nt, Human
acuguaaaauaau

SEQ ID NO: 2030003 - RNA, 17 nt, Human
ccugucgguuuauucac

SEQ ID NO: 2030004 - RNA, 14 nt, Human
cucccugcccccca

SEQ ID NO: 2030005 - RNA, 18 nt, Human
ccacaucugagccccgaa

SEQ ID NO: 2030006 - RNA, 16 nt, Human
auuugaugcuacagga

SEQ ID NO: 2030007 - RNA, 18 nt, Human
uaggugacuauuauauuu

SEQ ID NO: 2030008 - RNA, 21 nt, Human
ugccuaggcauagcccugccu

SEQ ID NO: 2030009 - RNA, 16 nt, Human
auuuuaauaauguuuc

SEQ ID NO: 2030010 - RNA, 21 nt, Human
uggaaacguauucaaacaauu

SEQ ID NO: 2030011 - RNA, 22 nt, Human
agcuaaugaaguguuuagcaua

SEQ ID NO: 2030012 - RNA, 22 nt, Human
uaauucugguagcuaaauauau

SEQ ID NO: 2030013 - RNA, 13 nt, Human
uacuuuauuuucu

SEQ ID NO: 2030014 - RNA, 22 nt, Human
cgggucgcaggaccaucccggc

SEQ ID NO: 2030015 - RNA, 18 nt, Human
guauuauuuuuuaaaaaa

SEQ ID NO: 2030016 - RNA, 15 nt, Human
gagccuccagcugcc

SEQ ID NO: 2030017 - RNA, 22 nt, Human
aaacaaggaugaauuaaguuuu

SEQ ID NO: 2030018 - RNA, 18 nt, Human
ugaacuugguuuuaauua

SEQ ID NO: 2030019 - RNA, 14 nt, Human
cuccagugagacag

SEQ ID NO: 2030020 - RNA, 21 nt, Human
cauuuucuucucacauuuaua

SEQ ID NO: 2030021 - RNA, 13 nt, Human
agacacagugacc

SEQ ID NO: 2030022 - RNA, 17 nt, Human
ucuggaggucucugaac

SEQ ID NO: 2030023 - RNA, 22 nt, Human
cuuuccacagaagcuccaggua

SEQ ID NO: 2030024 - RNA, 13 nt, Human
ugauuauauguca

SEQ ID NO: 2030025 - RNA, 16 nt, Human
ccugcaaagcccagcu

SEQ ID NO: 2030026 - RNA, 12 nt, Human
uacuauuuaauu

SEQ ID NO: 2030027 - RNA, 12 nt, Human
ugagagacacac

SEQ ID NO: 2030028 - RNA, 21 nt, Human
gaagcuagaaaacaggcaaau

SEQ ID NO: 2030029 - RNA, 20 nt, Human
uccagccugagcgacaguga

SEQ ID NO: 2030030 - RNA, 15 nt, Human
ucauaauaaguugca

SEQ ID NO: 2030031 - RNA, 19 nt, Human
cagaaagcagaacagugau

SEQ ID NO: 2030032 - RNA, 20 nt, Human
guauuauuuuuuaaaaaaau

SEQ ID NO: 2030033 - RNA, 14 nt, Human
cagccaccagucca

SEQ ID NO: 2030034 - RNA, 19 nt, Human
agcguugagccaccaagcu

SEQ ID NO: 2030035 - RNA, 23 nt, Human
agccccaaguggaacgagacaag

SEQ ID NO: 2030036 - RNA, 16 nt, Human
augccccgucccccuc

SEQ ID NO: 2030037 - RNA, 14 nt, Human
agaauauauuuccu

SEQ ID NO: 2030038 - RNA, 12 nt, Human
uuuugaaaccaa

SEQ ID NO: 2030039 - RNA, 19 nt, Human
aaagacagugaaagaaaau

SEQ ID NO: 2030040 - RNA, 14 nt, Human
ugacuauuauauuu

SEQ ID NO: 2030041 - RNA, 18 nt, Human
uccuaauuccacagcugc

SEQ ID NO: 2030042 - RNA, 17 nt, Human
caagccuccuuuuaaag

SEQ ID NO: 2030043 - RNA, 13 nt, Human
aaaauaacgauaa

SEQ ID NO: 2030044 - RNA, 18 nt, Human
ccucuggcuccagcuggc

SEQ ID NO: 2030045 - RNA, 21 nt, Human
uccuucagccugaaagaggaa

SEQ ID NO: 2030046 - RNA, 14 nt, Human
cugaacccagggaa

SEQ ID NO: 2030047 - RNA, 15 nt, Human
cuacuaauuuuaaaa

SEQ ID NO: 2030048 - RNA, 17 nt, Human
cccugcugcccuucccc

SEQ ID NO: 2030049 - RNA, 16 nt, Human
gcugcgcgccgcgcuc

SEQ ID NO: 2030050 - RNA, 18 nt, Human
auuuguauaaaauaauuu

SEQ ID NO: 2030051 - RNA, 18 nt, Human
caagcuaugugagcucac

SEQ ID NO: 2030052 - RNA, 16 nt, Human
acuguauguccuuggu

SEQ ID NO: 2030053 - RNA, 13 nt, Human
aaagaagagccgg

SEQ ID NO: 2030054 - RNA, 13 nt, Human
ugugcuggccacc

SEQ ID NO: 2030055 - RNA, 14 nt, Human
acuuugauuuuaua

SEQ ID NO: 2030056 - RNA, 17 nt, Human
gcugccucucucaucca

SEQ ID NO: 2030057 - RNA, 22 nt, Human
ugcuggagacauugaggcaggc

SEQ ID NO: 2030058 - RNA, 19 nt, Human
ucagugucaaugcagcccc

SEQ ID NO: 2030059 - RNA, 11 nt, Human
guauggcaaac

SEQ ID NO: 2030060 - RNA, 16 nt, Human
cugagcgacagugaga

SEQ ID NO: 2030061 - RNA, 17 nt, Human
aauaacaauaaaagaca

SEQ ID NO: 2030062 - RNA, 14 nt, Human
uuuuaaaaaagaaa

SEQ ID NO: 2030063 - RNA, 23 nt, Human
ucccuagaaagccaugugcagcc

SEQ ID NO: 2030064 - RNA, 12 nt, Human
uacuaaaugcuc

SEQ ID NO: 2030065 - RNA, 22 nt, Human
uguuucagugcacuaaugugua

SEQ ID NO: 2030066 - RNA, 23 nt, Human
ugcagagguccacaacacacaga

SEQ ID NO: 2030067 - RNA, 23 nt, Human
aucacagcuacuugggaggcuga

SEQ ID NO: 2030068 - RNA, 13 nt, Human
gcucucuggccuu

SEQ ID NO: 2030069 - RNA, 22 nt, Human
uucaauaucuuuuuuuuaauaa

SEQ ID NO: 2030070 - RNA, 16 nt, Human
uggcaagcucuaucac

SEQ ID NO: 2030071 - RNA, 14 nt, Human
uaaaauccauacau

SEQ ID NO: 2030072 - RNA, 20 nt, Human
ccaaauguucaucaaugaau

SEQ ID NO: 2030073 - RNA, 18 nt, Human
agccugaucaccugcccu

SEQ ID NO: 2030074 - RNA, 15 nt, Human
uggacucaccucccc

SEQ ID NO: 2030075 - RNA, 22 nt, Human
agcuuguauuccuuuuucucuc

SEQ ID NO: 2030076 - RNA, 19 nt, Human
cucauggaauuggagcucg

SEQ ID NO: 2030077 - RNA, 20 nt, Human
agccuaguugaucagcuuau

SEQ ID NO: 2030078 - RNA, 21 nt, Human
aaaaaguucugcagauaaaca

SEQ ID NO: 2030079 - RNA, 20 nt, Human
cacuguggguagacacacau

SEQ ID NO: 2030080 - RNA, 14 nt, Human
aagcaucacaugaa

SEQ ID NO: 2030081 - RNA, 21 nt, Human
ccagggcuacgcgcgcuccgc

SEQ ID NO: 2030082 - RNA, 15 nt, Human
uggaaacgaagcacc

SEQ ID NO: 2030083 - RNA, 13 nt, Human
ugagcgacaguga

SEQ ID NO: 2030084 - RNA, 20 nt, Human
uuaacacaugauccugcaau

SEQ ID NO: 2030085 - RNA, 14 nt, Human
agauguagaggaga

SEQ ID NO: 2030086 - RNA, 16 nt, Human
auccuugaagauuuac

SEQ ID NO: 2030087 - RNA, 15 nt, Human
cgcgccgcgcuccuc

SEQ ID NO: 2030088 - RNA, 20 nt, Human
uaacaagccuccuuuuaaag

SEQ ID NO: 2030089 - RNA, 17 nt, Human
cccacggcuggagcugc

SEQ ID NO: 2030090 - RNA, 15 nt, Human
auauaaauaaaaaua

SEQ ID NO: 2030091 - RNA, 14 nt, Human
ggaaagaagagccg

SEQ ID NO: 2030092 - RNA, 22 nt, Human
cauaaauguugacaugggacau

SEQ ID NO: 2030093 - RNA, 22 nt, Human
ccgggaggcagagguugcagug

SEQ ID NO: 2030094 - RNA, 11 nt, Human
aauuuaaauau

SEQ ID NO: 2030095 - RNA, 16 nt, Human
gcagcaucagcauccc

SEQ ID NO: 2030096 - RNA, 13 nt, Human
aguuguaauuuuu

SEQ ID NO: 2030097 - RNA, 22 nt, Human
ggggugguuuucccaucucagg

SEQ ID NO: 2030098 - RNA, 14 nt, Human
gcguugagccacca

SEQ ID NO: 2030099 - RNA, 21 nt, Human
ccaugugcagccaccagucca

SEQ ID NO: 2030100 - RNA, 14 nt, Human
ucccacccgcccac

SEQ ID NO: 2030101 - RNA, 13 nt, Human
uccuacuuccccu

SEQ ID NO: 2030102 - RNA, 23 nt, Human
uguucccuggggcuuuaacuccu

SEQ ID NO: 2030103 - RNA, 20 nt, Human
gauugugccccugcacucca

SEQ ID NO: 2030104 - RNA, 18 nt, Human
gaaaauaacgauaaaaga

SEQ ID NO: 2030105 - RNA, 13 nt, Human
aaaugaaagcagg

SEQ ID NO: 2030106 - RNA, 12 nt, Human
ucuauguagaau

SEQ ID NO: 2030107 - RNA, 17 nt, Human
auauuuuuuuuuuuaaa

SEQ ID NO: 2030108 - RNA, 12 nt, Human
acacugaagaag

SEQ ID NO: 2030109 - RNA, 13 nt, Human
auuuuuuaaaaaa

SEQ ID NO: 2030110 - RNA, 13 nt, Human
aaacauccuacaa

SEQ ID NO: 2030111 - RNA, 13 nt, Human
auuauauauauuu

SEQ ID NO: 2030112 - RNA, 14 nt, Human
aaauaggaaauauu

SEQ ID NO: 2030113 - RNA, 14 nt, Human
accauuuuuacuug

SEQ ID NO: 2030114 - RNA, 23 nt, Human
augucaauucuugccaaauauaa

SEQ ID NO: 2030115 - RNA, 12 nt, Human
uucagccugaaa

SEQ ID NO: 2030116 - RNA, 23 nt, Human
ucuagcaugucgucaaagcugaa

SEQ ID NO: 2030117 - RNA, 17 nt, Human
aauaugcucuaaacaug

SEQ ID NO: 2030118 - RNA, 11 nt, Human
cauaugaaaag

SEQ ID NO: 2030119 - RNA, 14 nt, Human
gcuuuaacuccugc

SEQ ID NO: 2030120 - RNA, 16 nt, Human
ucuuauaauuuaaaau

SEQ ID NO: 2030121 - RNA, 20 nt, Human
aaaugauguuucauaagaau

SEQ ID NO: 2030122 - RNA, 19 nt, Human
augaaagcagggacuugaa

SEQ ID NO: 2030123 - RNA, 18 nt, Human
acaaaaggauaaugaaua

SEQ ID NO: 2030124 - RNA, 15 nt, Human
gugggccugagacca

SEQ ID NO: 2030125 - RNA, 14 nt, Human
ugaucaccugcccu

SEQ ID NO: 2030126 - RNA, 20 nt, Human
uuaaugccacuaaauugaca

SEQ ID NO: 2030127 - RNA, 18 nt, Human
uuucucugauacagaaaa

SEQ ID NO: 2030128 - RNA, 21 nt, Human
aaacgaggauugggaaaaagu

SEQ ID NO: 2030129 - RNA, 22 nt, Human
cgcuggcugcgcucggccugcu

SEQ ID NO: 2030130 - RNA, 13 nt, Human
aagcauuccaacu

SEQ ID NO: 2030131 - RNA, 22 nt, Human
uaucuauguagaauauauuucc

SEQ ID NO: 2030132 - RNA, 18 nt, Human
cuccauuuuuagugaaau

SEQ ID NO: 2030133 - RNA, 13 nt, Human
acaagagcuuaac

SEQ ID NO: 2030134 - RNA, 17 nt, Human
gcaucuccucaacucug

SEQ ID NO: 2030135 - RNA, 20 nt, Human
aucuauguagaauauauuuc

SEQ ID NO: 2030136 - RNA, 16 nt, Human
aucuauauuuuacaua

SEQ ID NO: 2030137 - RNA, 21 nt, Human
uauaaaauaauuuuuauauuu

SEQ ID NO: 2030138 - RNA, 16 nt, Human
uaucaaaagaaagaaa

SEQ ID NO: 2030139 - RNA, 21 nt, Human
cuccauggaaacgaagcacca

SEQ ID NO: 2030140 - RNA, 17 nt, Human
caaagagaaagaggguu

SEQ ID NO: 2030141 - RNA, 14 nt, Human
cuacaagacacagu

SEQ ID NO: 2030142 - RNA, 17 nt, Human
ugaacuugguuuuaauu

SEQ ID NO: 2030143 - RNA, 13 nt, Human
aucuacacuccag

SEQ ID NO: 2030144 - RNA, 24 nt, Human
cauucuggaauaauccuaaacaua

SEQ ID NO: 2030145 - RNA, 20 nt, Human
ggagccugaucaccugcccu

SEQ ID NO: 2030146 - RNA, 22 nt, Human
cuuguacucugaaaguuuugga

SEQ ID NO: 2030147 - RNA, 19 nt, Human
ccgggcgugguggugagug

SEQ ID NO: 2030148 - RNA, 14 nt, Human
gcgcugcgcgccgc

SEQ ID NO: 2030149 - RNA, 13 nt, Human
uuuuaauuugguu

SEQ ID NO: 2030150 - RNA, 19 nt, Human
uguuggacgagaaaacaau

SEQ ID NO: 2030151 - RNA, 18 nt, Human
uuuauggcacuaguauuu

SEQ ID NO: 2030152 - RNA, 16 nt, Human
gccgcgcugcgcgccg

SEQ ID NO: 2030153 - RNA, 14 nt, Human
auuucuaugaaaua

SEQ ID NO: 2030154 - RNA, 18 nt, Human
uaauuuuagacauucuuu

SEQ ID NO: 2030155 - RNA, 22 nt, Human
ccgcgcagcucaggcuggcacc

SEQ ID NO: 2030156 - RNA, 13 nt, Human
ucuacuaaaaaua

SEQ ID NO: 2030157 - RNA, 22 nt, Human
guggcgcuggcugcgcucggcc

SEQ ID NO: 2030158 - RNA, 19 nt, Human
uccacaaguaaaaggaaau

SEQ ID NO: 2030159 - RNA, 16 nt, Human
ugaagauacugaaaua

SEQ ID NO: 2030160 - RNA, 16 nt, Human
uucaguuauuauauuu

SEQ ID NO: 2030161 - RNA, 23 nt, Human
ggauguggggaaguuaggaacug

SEQ ID NO: 2030162 - RNA, 18 nt, Human
uuuguuaaaugauuucau

SEQ ID NO: 2030163 - RNA, 20 nt, Human
uaugcuucuguuuuauaauu

SEQ ID NO: 2030164 - RNA, 11 nt, Human
aauuuaaauag

SEQ ID NO: 2030165 - RNA, 20 nt, Human
acaugagguacugagaguga

SEQ ID NO: 2030166 - RNA, 13 nt, Human
guuuucccaucuc

SEQ ID NO: 2030167 - RNA, 13 nt, Human
cccugcacuccag

SEQ ID NO: 2030168 - RNA, 12 nt, Human
uaauuccacagc

SEQ ID NO: 2030169 - RNA, 11 nt, Human
caucuagugag

SEQ ID NO: 2030170 - RNA, 14 nt, Human
aguacuucccgcug

SEQ ID NO: 2030171 - RNA, 14 nt, Human
guuccuucugcucc

SEQ ID NO: 2030172 - RNA, 13 nt, Human
auaaauaaaaaua

SEQ ID NO: 2030173 - RNA, 19 nt, Human
gcacuaguauuucuaugaa

SEQ ID NO: 2030174 - RNA, 19 nt, Human
acggagccgggaaagaaga

SEQ ID NO: 2030175 - RNA, 17 nt, Human
ccgcgcagcucaggcug

SEQ ID NO: 2030176 - RNA, 15 nt, Human
uggcuaauuagcaug

SEQ ID NO: 2030177 - RNA, 16 nt, Human
ucgcuuccgcauccua

SEQ ID NO: 2030178 - RNA, 14 nt, Human
cgcucgcuuccgca

SEQ ID NO: 2030179 - RNA, 20 nt, Human
acuuuauuuucuauaauuua

SEQ ID NO: 2030180 - RNA, 16 nt, Human
aauauuuuaauguuuc

SEQ ID NO: 2030181 - RNA, 12 nt, Human
uaaauauauauu

SEQ ID NO: 2030182 - RNA, 23 nt, Human
cccuagaaagccaugugcagcca

SEQ ID NO: 2030183 - RNA, 16 nt, Human
gaucaaguuauuuuua

SEQ ID NO: 2030184 - RNA, 13 nt, Human
uggcuccagcugg

SEQ ID NO: 2030185 - RNA, 18 nt, Human
uggcuguuaaucuuucaa

SEQ ID NO: 2030186 - RNA, 16 nt, Human
cuggccuucggccucc

SEQ ID NO: 2030187 - RNA, 17 nt, Human
cauccuagucucuauca

SEQ ID NO: 2030188 - RNA, 16 nt, Human
uaaauaaaaauaaucc

SEQ ID NO: 2030189 - RNA, 16 nt, Human
agcuaaauauauauuu

SEQ ID NO: 2030190 - RNA, 13 nt, Human
uuuaacuccugcu

SEQ ID NO: 2030191 - RNA, 13 nt, Human
caacaucuaguga

SEQ ID NO: 2030192 - RNA, 12 nt, Human
gccggcgcgcuc

SEQ ID NO: 2030193 - RNA, 16 nt, Human
cacuaguauuucuaug

SEQ ID NO: 2030194 - RNA, 17 nt, Human
ccuuggugccuggagcc

SEQ ID NO: 2030195 - RNA, 11 nt, Human
gguuuuauuau

SEQ ID NO: 2030196 - RNA, 14 nt, Human
uauauuuccuuauu

SEQ ID NO: 2030197 - RNA, 20 nt, Human
agagacacacugaagaagca

SEQ ID NO: 2030198 - RNA, 23 nt, Human
acuaguuguaauuuuuuuguggg

SEQ ID NO: 2030199 - RNA, 12 nt, Human
uauaauuuaaaa

SEQ ID NO: 2030200 - RNA, 13 nt, Human
acaagaaggaaag

SEQ ID NO: 2030201 - RNA, 17 nt, Human
agcugccccggggaggg

SEQ ID NO: 2030202 - RNA, 17 nt, Human
uaucuuuuuuuuaauaa

SEQ ID NO: 2030203 - RNA, 14 nt, Human
uauuaaguauuuua

SEQ ID NO: 2030204 - RNA, 13 nt, Human
gcgcucggccugc

SEQ ID NO: 2030205 - RNA, 19 nt, Human
uucuuuaucuuuuuaguau

SEQ ID NO: 2030206 - RNA, 21 nt, Human
aagauacugaaauaaacgucu

SEQ ID NO: 2030207 - RNA, 13 nt, Human
uguuuucccuccu

SEQ ID NO: 2030208 - RNA, 21 nt, Human
ccuuuuuuugaaaaaaagcuu

SEQ ID NO: 2030209 - RNA, 11 nt, Human
ccggccgcgcu

SEQ ID NO: 2030210 - RNA, 17 nt, Human
cccacuggacucaccuc

SEQ ID NO: 2030211 - RNA, 22 nt, Human
caaacaauuugaauauaaauuu

SEQ ID NO: 2030212 - RNA, 16 nt, Human
cugcugagccccaagu

SEQ ID NO: 2030213 - RNA, 14 nt, Human
ucuaggaaauauuu

SEQ ID NO: 2030214 - RNA, 15 nt, Human
ggcaagcucuaucac

SEQ ID NO: 2030215 - RNA, 18 nt, Human
ugccauaauuacuauguc

SEQ ID NO: 2030216 - RNA, 23 nt, Human
gcauuguuggcuguuccugcagu

SEQ ID NO: 2030217 - RNA, 22 nt, Human
accuaacgaaguauccuucagc

SEQ ID NO: 2030218 - RNA, 22 nt, Human
ccaaacauccuacaagacacag

SEQ ID NO: 2030219 - RNA, 12 nt, Human
acagagacagaa

SEQ ID NO: 2030220 - RNA, 10 nt, Human
ggggaggggc

SEQ ID NO: 2030221 - RNA, 14 nt, Human
uauauauuuuagau

SEQ ID NO: 2030222 - RNA, 18 nt, Human
ccauccugccccugagcc

SEQ ID NO: 2030223 - RNA, 15 nt, Human
uccucaacucugagu

SEQ ID NO: 2030224 - RNA, 17 nt, Human
uaucaguuauuuuuaaa

SEQ ID NO: 2030225 - RNA, 19 nt, Human
ucuucacuuuuauaagaaa

SEQ ID NO: 2030226 - RNA, 16 nt, Human
ggggagcgagccccag

SEQ ID NO: 2030227 - RNA, 15 nt, Human
caaaauggaauacuc

SEQ ID NO: 2030228 - RNA, 19 nt, Human
ggcaccgcuguacgcgagc

SEQ ID NO: 2030229 - RNA, 15 nt, Human
gauccugcaauucca

SEQ ID NO: 2030230 - RNA, 20 nt, Human
aggauauucucacagcucca

SEQ ID NO: 2030231 - RNA, 15 nt, Human
cggagccuccagcug

SEQ ID NO: 2030232 - RNA, 12 nt, Human
caccuccuaaga

SEQ ID NO: 2030233 - RNA, 15 nt, Human
aaaaaauaacaauga

SEQ ID NO: 2030234 - RNA, 15 nt, Human
cuucucuucacaguc

SEQ ID NO: 2030235 - RNA, 19 nt, Human
ccugccuaagugcagcccc

SEQ ID NO: 2030236 - RNA, 19 nt, Human
agccugaucaccugcccug

SEQ ID NO: 2030237 - RNA, 18 nt, Human
cauagguuuaauaauuuu

SEQ ID NO: 2030238 - RNA, 20 nt, Human
cgcucggccugcucgcccac

SEQ ID NO: 2030239 - RNA, 17 nt, Human
cccaggcugagccucag

SEQ ID NO: 2030240 - RNA, 14 nt, Human
cauuuacuuuuaaa

SEQ ID NO: 2030241 - RNA, 12 nt, Human
agcuuucuuccu

SEQ ID NO: 2030242 - RNA, 13 nt, Human
acuaauuuuaaaa

SEQ ID NO: 2030243 - RNA, 18 nt, Human
gccguccccagagcuaca

SEQ ID NO: 2030244 - RNA, 21 nt, Human
guccccuauccuacuuccccu

SEQ ID NO: 2030245 - RNA, 14 nt, Human
agaauucauucacu

SEQ ID NO: 2030246 - RNA, 21 nt, Human
agcuacuuauuguagcauccu

SEQ ID NO: 2030247 - RNA, 16 nt, Human
gucuguuuucccuccu

SEQ ID NO: 2030248 - RNA, 14 nt, Human
cagauccccaagcc

SEQ ID NO: 2030249 - RNA, 17 nt, Human
uuuuauaugcuauuuau

SEQ ID NO: 2030250 - RNA, 18 nt, Human
uauuuucuauaauuuaaa

SEQ ID NO: 2030251 - RNA, 14 nt, Human
auuauuucacuuua

SEQ ID NO: 2030252 - RNA, 18 nt, Human
cagauuugagcucagccc

SEQ ID NO: 2030253 - RNA, 16 nt, Human
uaaaagacaaggaaaa

SEQ ID NO: 2030254 - RNA, 14 nt, Human
auugaggcaggcac

SEQ ID NO: 2030255 - RNA, 11 nt, Human
ccacaucugag

SEQ ID NO: 2030256 - RNA, 13 nt, Human
ugaaauuguauua

SEQ ID NO: 2030257 - RNA, 23 nt, Human
acuuauuguagcauccuggaaua

SEQ ID NO: 2030258 - RNA, 23 nt, Human
ugucaauucuugccaaauauaaa

SEQ ID NO: 2030259 - RNA, 14 nt, Human
gagagugaacaaau

SEQ ID NO: 2030260 - RNA, 20 nt, Human
cucgcuuccgcauccuaguc

SEQ ID NO: 2030261 - RNA, 17 nt, Human
accugugccguccccag

SEQ ID NO: 2030262 - RNA, 13 nt, Human
aggggcgcucgcu

SEQ ID NO: 2030263 - RNA, 18 nt, Human
ccuucggccuccauccug

SEQ ID NO: 2030264 - RNA, 18 nt, Human
ggaggacgcucucuggcc

SEQ ID NO: 2030265 - RNA, 11 nt, Human
uuauauuucca

SEQ ID NO: 2030266 - RNA, 21 nt, Human
ucgcccacuuccucccggccg

SEQ ID NO: 2030267 - RNA, 22 nt, Human
gggccugagaccaaggcccccg

SEQ ID NO: 2030268 - RNA, 14 nt, Human
gcuggcgugcagca

SEQ ID NO: 2030269 - RNA, 20 nt, Human
cuucaacucccugcccccca

SEQ ID NO: 2030270 - RNA, 16 nt, Human
aucaguuauuuuuaaa

SEQ ID NO: 2030271 - RNA, 19 nt, Human
acuaucucauuuccaagca

SEQ ID NO: 2030272 - RNA, 16 nt, Human
aacuugguuuuaauua

SEQ ID NO: 2030273 - RNA, 14 nt, Human
uugggaaaaaguaa

SEQ ID NO: 2030274 - RNA, 18 nt, Human
uuguaaaggaauuuaaaa

SEQ ID NO: 2030275 - RNA, 14 nt, Human
ugguauguuuucag

SEQ ID NO: 2030276 - RNA, 14 nt, Human
aaagaggaaugaag

SEQ ID NO: 2030277 - RNA, 20 nt, Human
aggugacuauuauauuucca

SEQ ID NO: 2030278 - RNA, 20 nt, Human
auguuucuuggggaauaugu

SEQ ID NO: 2030279 - RNA, 23 nt, Human
uggaaauguuuacagauccccaa

SEQ ID NO: 2030280 - RNA, 19 nt, Human
gucccugcugcccuucccc

SEQ ID NO: 2030281 - RNA, 16 nt, Human
cgcauggaaaaguuuc

SEQ ID NO: 2030282 - RNA, 19 nt, Human
gcacacagcacgggggcca

SEQ ID NO: 2030283 - RNA, 14 nt, Human
cagcaucagcaucc

SEQ ID NO: 2030284 - RNA, 14 nt, Human
cucccuuggggccu

SEQ ID NO: 2030285 - RNA, 17 nt, Human
cauuuguauaaaauaau

SEQ ID NO: 2030286 - RNA, 18 nt, Human
auaggaaauauuuuaaug

SEQ ID NO: 2030287 - RNA, 20 nt, Human
ucaagucuuucacauuuaaa

SEQ ID NO: 2030288 - RNA, 21 nt, Human
uuuguauaaaauaauuuuuau

SEQ ID NO: 2030289 - RNA, 19 nt, Human
acuauuuaauuauuucacu

SEQ ID NO: 2030290 - RNA, 13 nt, Human
acacacaugaagu

SEQ ID NO: 2030291 - RNA, 13 nt, Human
augcuagaacucc

SEQ ID NO: 2030292 - RNA, 18 nt, Human
gaaggugaucuggcucug

SEQ ID NO: 2030293 - RNA, 17 nt, Human
ucccuccccaaaugcuu

SEQ ID NO: 2030294 - RNA, 21 nt, Human
gaaaugaguuuuucuuuucau

SEQ ID NO: 2030295 - RNA, 15 nt, Human
aaggguacacugccu

SEQ ID NO: 2030296 - RNA, 19 nt, Human
auuaaguuuuuuuuuaaaa

SEQ ID NO: 2030297 - RNA, 13 nt, Human
uaggacugaauua

SEQ ID NO: 2030298 - RNA, 21 nt, Human
uuacaaugcauucugagguaa

SEQ ID NO: 2030299 - RNA, 19 nt, Human
gccgcgcugcgcgccgcgc

SEQ ID NO: 2030300 - RNA, 17 nt, Human
uccauucuuccucccau

SEQ ID NO: 2030301 - RNA, 16 nt, Human
gccaugugcuaguaau

SEQ ID NO: 2030302 - RNA, 13 nt, Human
augauuccaccua

SEQ ID NO: 2030303 - RNA, 18 nt, Human
uuuuaucugcuaugcuau

SEQ ID NO: 2030304 - RNA, 22 nt, Human
caccagucugacuguuuccauc

SEQ ID NO: 2030305 - RNA, 14 nt, Human
gucccaggcugagc

SEQ ID NO: 2030306 - RNA, 17 nt, Human
uucucuaggaaauauuu

SEQ ID NO: 2030307 - RNA, 12 nt, Human
cccccagcccuc

SEQ ID NO: 2030308 - RNA, 14 nt, Human
cggccggcgcgcuc

SEQ ID NO: 2030309 - RNA, 21 nt, Human
uugaggcacagaaacuccugu

SEQ ID NO: 2030310 - RNA, 16 nt, Human
cagauccccaagccug

SEQ ID NO: 2030311 - RNA, 21 nt, Human
ucuuaggguuaugauuaagua

SEQ ID NO: 2030312 - RNA, 16 nt, Human
gcauccuagucucuau

SEQ ID NO: 2030313 - RNA, 19 nt, Human
cuaccuguucgcgcgccuc

SEQ ID NO: 2030314 - RNA, 12 nt, Human
cuucaacucccu

SEQ ID NO: 2030315 - RNA, 13 nt, Human
uagcuuuuuucuc

SEQ ID NO: 2030316 - RNA, 21 nt, Human
uagggugauauuaaccagggg

SEQ ID NO: 2030317 - RNA, 15 nt, Human
cugacucuuaagaag

SEQ ID NO: 2030318 - RNA, 21 nt, Human
gaaauguuuacagauccccaa

SEQ ID NO: 2030319 - RNA, 12 nt, Human
auucugaaagca

SEQ ID NO: 2030320 - RNA, 22 nt, Human
uagaaauguauucuuuuaguuu

SEQ ID NO: 2030321 - RNA, 15 nt, Human
guuauaaaaauauau

SEQ ID NO: 2030322 - RNA, 13 nt, Human
aaaauaacaauga

SEQ ID NO: 2030323 - RNA, 14 nt, Human
uugauggaaauaca

SEQ ID NO: 2030324 - RNA, 16 nt, Human
ugagcucagcccuggu

SEQ ID NO: 2030325 - RNA, 14 nt, Human
caauugacuauagu

SEQ ID NO: 2030326 - RNA, 13 nt, Human
cuaggcauagccc

SEQ ID NO: 2030327 - RNA, 23 nt, Human
cauccucgaggcccuagcauuuc

SEQ ID NO: 2030328 - RNA, 18 nt, Human
auguuccuaauaaagcuu

SEQ ID NO: 2030329 - RNA, 12 nt, Human
cuacaagacaca

SEQ ID NO: 2030330 - RNA, 18 nt, Human
uauuuucaguuauuauau

SEQ ID NO: 2030331 - RNA, 19 nt, Human
gugacuuaaugccacuaaa

SEQ ID NO: 2030332 - RNA, 14 nt, Human
cacuguccauucuu

SEQ ID NO: 2030333 - RNA, 19 nt, Human
auuauuuuuuaaaaaaauu

SEQ ID NO: 2030334 - RNA, 19 nt, Human
cucucacuuguuuuauuua

SEQ ID NO: 2030335 - RNA, 16 nt, Human
uuuucucuaggaaaua

SEQ ID NO: 2030336 - RNA, 18 nt, Human
cagagacagaaagcagaa

SEQ ID NO: 2030337 - RNA, 14 nt, Human
auagguuuggacaa

SEQ ID NO: 2030338 - RNA, 16 nt, Human
uaacaauaaaagacaa

SEQ ID NO: 2030339 - RNA, 11 nt, Human
cuauuuaauua

SEQ ID NO: 2030340 - RNA, 16 nt, Human
ugaauuaguuuuauau

SEQ ID NO: 2030341 - RNA, 14 nt, Human
uaguaucaaaagaa

SEQ ID NO: 2030342 - RNA, 21 nt, Human
uuuucaggcuagauguaugua

SEQ ID NO: 2030343 - RNA, 16 nt, Human
uaaaggaauuuaaaaa

SEQ ID NO: 2030344 - RNA, 20 nt, Human
aaauaauuuuuauauuugaa

SEQ ID NO: 2030345 - RNA, 22 nt, Human
accccugagcuugcagagauga

SEQ ID NO: 2030346 - RNA, 16 nt, Human
ugugcauauuuuauua

SEQ ID NO: 2030347 - RNA, 12 nt, Human
ggcagcaccucc

SEQ ID NO: 2030348 - RNA, 19 nt, Human
cuaguaucaaaagaaagaa

SEQ ID NO: 2030349 - RNA, 20 nt, Human
agaugcaguucugaagaaga

SEQ ID NO: 2030350 - RNA, 19 nt, Human
gaauaucuccgucaacuca

SEQ ID NO: 2030351 - RNA, 19 nt, Human
uaucucauuuccaagcaag

SEQ ID NO: 2030352 - RNA, 13 nt, Human
agcugccucucuc

SEQ ID NO: 2030353 - RNA, 14 nt, Human
ggcuccagcuggcc

SEQ ID NO: 2030354 - RNA, 23 nt, Human
auuuuagauagaugaagaagcua

SEQ ID NO: 2030355 - RNA, 17 nt, Human
ugaaaaucuuauaauuu

SEQ ID NO: 2030356 - RNA, 11 nt, Human
agugucugcug

SEQ ID NO: 2030357 - RNA, 15 nt, Human
aauacuuuauaaagg

SEQ ID NO: 2030358 - RNA, 17 nt, Human
ccaccugcugagcccca

SEQ ID NO: 2030359 - RNA, 13 nt, Human
gccacaagaaccc

SEQ ID NO: 2030360 - RNA, 18 nt, Human
cagucucccucccuuggg

SEQ ID NO: 2030361 - RNA, 15 nt, Human
aucuuuaacccacua

SEQ ID NO: 2030362 - RNA, 15 nt, Human
auaaaguguuugaaa

SEQ ID NO: 2030363 - RNA, 21 nt, Human
cucaguccaugaagauguaga

SEQ ID NO: 2030364 - RNA, 19 nt, Human
cauuguugucugcaacucu

SEQ ID NO: 2030365 - RNA, 17 nt, Human
cagugaaagaaaauaac

SEQ ID NO: 2030366 - RNA, 16 nt, Human
auaucaguuauuuuua

SEQ ID NO: 2030367 - RNA, 15 nt, Human
gcaacccaaauguuc

SEQ ID NO: 2030368 - RNA, 16 nt, Human
cggagccuccagcugc

SEQ ID NO: 2030369 - RNA, 16 nt, Human
ccuggugggcagagag

SEQ ID NO: 2030370 - RNA, 13 nt, Human
cggccgcgcugcg

SEQ ID NO: 2030371 - RNA, 18 nt, Human
cagcuuauugucuaguga

SEQ ID NO: 2030372 - RNA, 14 nt, Human
agaaaauaacaaua

SEQ ID NO: 2030373 - RNA, 20 nt, Human
caccuccuaagaaggcaccu

SEQ ID NO: 2030374 - RNA, 15 nt, Human
cuggacucaccuccc

SEQ ID NO: 2030375 - RNA, 18 nt, Human
cccacuagacccacugga

SEQ ID NO: 2030376 - RNA, 23 nt, Human
ucaauaucuuuuuuuuaauaaac

SEQ ID NO: 2030377 - RNA, 22 nt, Human
cgguccuugcugcaccugugcc

SEQ ID NO: 2030378 - RNA, 20 nt, Human
aauaagccagacaucaacag

SEQ ID NO: 2030379 - RNA, 23 nt, Human
acucuauguucuaagaagugaaa

SEQ ID NO: 2030380 - RNA, 20 nt, Human
uaacgauaaaagacagugaa

SEQ ID NO: 2030381 - RNA, 18 nt, Human
uuauuauauauauauauu

SEQ ID NO: 2030382 - RNA, 19 nt, Human
gcucauggaauuggagcuc

SEQ ID NO: 2030383 - RNA, 19 nt, Human
cgccacgcucugggucgcc

SEQ ID NO: 2030384 - RNA, 13 nt, Human
gaaccuaggguga

SEQ ID NO: 2030385 - RNA, 16 nt, Human
cauuuaguuauaaaaa

SEQ ID NO: 2030386 - RNA, 20 nt, Human
ucauucacucaacaaacaua

SEQ ID NO: 2030387 - RNA, 14 nt, Human
uauuuauuuuaaua

SEQ ID NO: 2030388 - RNA, 18 nt, Human
aauaucaguuauuuuuaa

SEQ ID NO: 2030389 - RNA, 18 nt, Human
gagcgacagugagacucu

SEQ ID NO: 2030390 - RNA, 15 nt, Human
aggcaccucucuggg

SEQ ID NO: 2030391 - RNA, 19 nt, Human
acuccuguucaugcccaua

SEQ ID NO: 2030392 - RNA, 18 nt, Human
uguaaaggaauuuaaaaa

SEQ ID NO: 2030393 - RNA, 15 nt, Human
uggauuccucacuuu

SEQ ID NO: 2030394 - RNA, 12 nt, Human
cucauggaauug

SEQ ID NO: 2030395 - RNA, 17 nt, Human
ccccaguuguuucuacu

SEQ ID NO: 2030396 - RNA, 18 nt, Human
cuuccucugagccuuggg

SEQ ID NO: 2030397 - RNA, 16 nt, Human
uuguaaaggaauuuaa

SEQ ID NO: 2030398 - RNA, 21 nt, Human
aauuccugacugcuaguuuau

SEQ ID NO: 2030399 - RNA, 21 nt, Human
gcgcucggccugcucgcccac

SEQ ID NO: 2030400 - RNA, 21 nt, Human
aauucauucacucaacaaaca

SEQ ID NO: 2030401 - RNA, 17 nt, Human
ggcucuggacaggcacu

SEQ ID NO: 2030402 - RNA, 17 nt, Human
uuauauuugaaauauug

SEQ ID NO: 2030403 - RNA, 23 nt, Human
agccuugggaccccugagcuugc

SEQ ID NO: 2030404 - RNA, 22 nt, Human
uuugcuguuauuuuaucugcua

SEQ ID NO: 2030405 - RNA, 20 nt, Human
cuugccauaauuacuauguc

SEQ ID NO: 2030406 - RNA, 19 nt, Human
caucaaggguacacugccu

SEQ ID NO: 2030407 - RNA, 17 nt, Human
aaaguacaagagcuuaa

SEQ ID NO: 2030408 - RNA, 16 nt, Human
cugcacuccagccuga

SEQ ID NO: 2030409 - RNA, 19 nt, Human
gccccccagcccuccuuau

SEQ ID NO: 2030410 - RNA, 15 nt, Human
cuucaacucccugcc

SEQ ID NO: 2030411 - RNA, 13 nt, Human
cugagagugaaca

SEQ ID NO: 2030412 - RNA, 15 nt, Human
uaacaauaaaagaca

SEQ ID NO: 2030413 - RNA, 15 nt, Human
augguuguauuauuu

SEQ ID NO: 2030414 - RNA, 13 nt, Human
uccucccggccgc

SEQ ID NO: 2030415 - RNA, 12 nt, Human
acugaaaucaua

SEQ ID NO: 2030416 - RNA, 19 nt, Human
ggaaaaaauaacaaugaaa

SEQ ID NO: 2030417 - RNA, 13 nt, Human
uuuaaaaauccua

SEQ ID NO: 2030418 - RNA, 18 nt, Human
cuuuccaugaguugcagu

SEQ ID NO: 2030419 - RNA, 19 nt, Human
agagccuuuuuuugaaaaa

SEQ ID NO: 2030420 - RNA, 16 nt, Human
uggcgcuggcugcgcu

SEQ ID NO: 2030421 - RNA, 15 nt, Human
guucugcagauaaac

SEQ ID NO: 2030422 - RNA, 18 nt, Human
cauggaauuggagcucgu

SEQ ID NO: 2030423 - RNA, 16 nt, Human
ccagucccuccccaaa

SEQ ID NO: 2030424 - RNA, 15 nt, Human
aauucugaaagcaac

SEQ ID NO: 2030425 - RNA, 15 nt, Human
ggagccuccagcugc

SEQ ID NO: 2030426 - RNA, 21 nt, Human
gagcaucuccucaacucugag

SEQ ID NO: 2030427 - RNA, 16 nt, Human
uuagagaauuuccuua

SEQ ID NO: 2030428 - RNA, 22 nt, Human
aaagggcauggguuuuauuaua

SEQ ID NO: 2030429 - RNA, 20 nt, Human
cucuguucugcacacagcac

SEQ ID NO: 2030430 - RNA, 16 nt, Human
aaguaaaggcaaacuu

SEQ ID NO: 2030431 - RNA, 21 nt, Human
cuauuuaauuauuucacuuua

SEQ ID NO: 2030432 - RNA, 16 nt, Human
ugauacagaaaaguug

SEQ ID NO: 2030433 - RNA, 20 nt, Human
gaaacaagucagucauucag

SEQ ID NO: 2030434 - RNA, 22 nt, Human
gcggggagcgagccccaggcgg

SEQ ID NO: 2030435 - RNA, 23 nt, Human
guuguaauuuuuuugugggaaau

SEQ ID NO: 2030436 - RNA, 20 nt, Human
uaugaaaaggcuaagcuuca

SEQ ID NO: 2030437 - RNA, 15 nt, Human
agagugugaggaaaa

SEQ ID NO: 2030438 - RNA, 16 nt, Human
uuagauagaugaagaa

SEQ ID NO: 2030439 - RNA, 15 nt, Human
cagugaaagaaaaua

SEQ ID NO: 2030440 - RNA, 18 nt, Human
uaauuuuaacucuauaau

SEQ ID NO: 2030441 - RNA, 23 nt, Human
ggacggcuccggacgcugcugcc

SEQ ID NO: 2030442 - RNA, 16 nt, Human
cagcuuuccucaaaac

SEQ ID NO: 2030443 - RNA, 13 nt, Human
uuuuaaaaaagaa

SEQ ID NO: 2030444 - RNA, 22 nt, Human
aaacguauucaaacaauuugaa

SEQ ID NO: 2030445 - RNA, 20 nt, Human
aauuguaggugacuauuaua

SEQ ID NO: 2030446 - RNA, 14 nt, Human
uaauuauuucacuu

SEQ ID NO: 2030447 - RNA, 16 nt, Human
ugaaguccaagcauuu

SEQ ID NO: 2030448 - RNA, 18 nt, Human
gagccgggaaagaagagc

SEQ ID NO: 2030449 - RNA, 13 nt, Human
augaguugcaguu

SEQ ID NO: 2030450 - RNA, 13 nt, Human
uuuugaaucauca

SEQ ID NO: 2030451 - RNA, 15 nt, Human
uaaaaggaaaugcuc

SEQ ID NO: 2030452 - RNA, 23 nt, Human
auaucuuuuuuuuaauaaaccau

SEQ ID NO: 2030453 - RNA, 12 nt, Human
ccaggcugagcc

SEQ ID NO: 2030454 - RNA, 21 nt, Human
uuauauauauuuuuuucugaa

SEQ ID NO: 2030455 - RNA, 18 nt, Human
cccgggccgacggagccg

SEQ ID NO: 2030456 - RNA, 19 nt, Human
uauacugugugcuaaaaca

SEQ ID NO: 2030457 - RNA, 19 nt, Human
ugagcgcccacuagaccca

SEQ ID NO: 2030458 - RNA, 22 nt, Human
agaaaacaauaacgauaaaaga

SEQ ID NO: 2030459 - RNA, 22 nt, Human
ugaguuuuucuuuucauuuacc

SEQ ID NO: 2030460 - RNA, 13 nt, Human
uuauaaaaauaua

SEQ ID NO: 2030461 - RNA, 23 nt, Human
accuccauggaaacgaagcacca

SEQ ID NO: 2030462 - RNA, 20 nt, Human
gaaaauaacgauaaaagaca

SEQ ID NO: 2030463 - RNA, 16 nt, Human
uauaaauuuaucauuu

SEQ ID NO: 2030464 - RNA, 17 nt, Human
cuucugaggagcuguug

SEQ ID NO: 2030465 - RNA, 15 nt, Human
uccaagccucauguc

SEQ ID NO: 2030466 - RNA, 19 nt, Human
cacaggaaccacaagacug

SEQ ID NO: 2030467 - RNA, 22 nt, Human
gccccggggaggggcgcucgcu

SEQ ID NO: 2030468 - RNA, 21 nt, Human
uccccuugggggugguggaug

SEQ ID NO: 2030469 - RNA, 18 nt, Human
ugugcauauuuuauuaua

SEQ ID NO: 2030470 - RNA, 16 nt, Human
ugugagaugcuagaac

SEQ ID NO: 2030471 - RNA, 22 nt, Human
uuuccaagcaaguauuagaaua

SEQ ID NO: 2030472 - RNA, 15 nt, Human
gaauuuaaauagcuu

SEQ ID NO: 2030473 - RNA, 12 nt, Human
auuauauuucca

SEQ ID NO: 2030474 - RNA, 21 nt, Human
cuuccaggcuggcgugcagca

SEQ ID NO: 2030475 - RNA, 13 nt, Human
aaaaaugguuuaa

SEQ ID NO: 2030476 - RNA, 22 nt, Human
aucuauguagaauauauuuccu

SEQ ID NO: 2030477 - RNA, 13 nt, Human
uccagcugccccg

SEQ ID NO: 2030478 - RNA, 19 nt, Human
gagccugaucaccugcccu

SEQ ID NO: 2030479 - RNA, 12 nt, Human
uaaaugcucaau

SEQ ID NO: 2030480 - RNA, 17 nt, Human
aguauuucuaugaaaua

SEQ ID NO: 2030481 - RNA, 14 nt, Human
cucaccccuugcca

SEQ ID NO: 2030482 - RNA, 19 nt, Human
gcuggccuugugaggagcu

SEQ ID NO: 2030483 - RNA, 15 nt, Human
cgcauccuagucucu

SEQ ID NO: 2030484 - RNA, 14 nt, Human
aagugugacucauu

SEQ ID NO: 2030485 - RNA, 16 nt, Human
acauuuauauuuuugu

SEQ ID NO: 2030486 - RNA, 22 nt, Human
ugugagcucaccagucccuccc

SEQ ID NO: 2030487 - RNA, 16 nt, Human
cauuucuaaagccauu

SEQ ID NO: 2030488 - RNA, 13 nt, Human
aggcuagauguau

SEQ ID NO: 2030489 - RNA, 16 nt, Human
cagaagcaacccaaau

SEQ ID NO: 2030490 - RNA, 17 nt, Human
gacgagaaaacaauaac

SEQ ID NO: 2030491 - RNA, 18 nt, Human
agucuguuuucccuccuu

SEQ ID NO: 2030492 - RNA, 16 nt, Human
ugauaugugaacaguu

SEQ ID NO: 2030493 - RNA, 19 nt, Human
uguccauucuuccucccau

SEQ ID NO: 2030494 - RNA, 17 nt, Human
guccaaagggcaugggu

SEQ ID NO: 2030495 - RNA, 19 nt, Human
ccuccagggagucucagcu

SEQ ID NO: 2030496 - RNA, 13 nt, Human
guuuaaguucuau

SEQ ID NO: 2030497 - RNA, 16 nt, Human
augaauacuuuauaaa

SEQ ID NO: 2030498 - RNA, 21 nt, Human
uaguauuucuaugaaauauua

SEQ ID NO: 2030499 - RNA, 13 nt, Human
ccaaggaugcccc

SEQ ID NO: 2030500 - RNA, 15 nt, Human
ccacaucugagcccc

SEQ ID NO: 2030501 - RNA, 14 nt, Human
ccaaauauaaauaa

SEQ ID NO: 2030502 - RNA, 15 nt, Human
aaggaauuuaaaaau

SEQ ID NO: 2030503 - RNA, 17 nt, Human
gcuguacgcgagcgcgc

SEQ ID NO: 2030504 - RNA, 22 nt, Human
acaccuuguacuuuauuuucua

SEQ ID NO: 2030505 - RNA, 14 nt, Human
aaaggaauuuaaaa

SEQ ID NO: 2030506 - RNA, 17 nt, Human
cugguccuaagucccug

SEQ ID NO: 2030507 - RNA, 22 nt, Human
auauauauuuuuuuuuuuaaaa

SEQ ID NO: 2030508 - RNA, 12 nt, Human
gcaaagcccagc

SEQ ID NO: 2030509 - RNA, 23 nt, Human
caggaaucacuggcuguuaaucu

SEQ ID NO: 2030510 - RNA, 16 nt, Human
cuacacuccagugaga

SEQ ID NO: 2030511 - RNA, 13 nt, Human
cuuaucaaaggac

SEQ ID NO: 2030512 - RNA, 21 nt, Human
uggggcuuuaacuccugcuag

SEQ ID NO: 2030513 - RNA, 19 nt, Human
aaucuacacuccagugaga

SEQ ID NO: 2030514 - RNA, 12 nt, Human
ccuucagccuga

SEQ ID NO: 2030515 - RNA, 19 nt, Human
guacaagagcuuaacagug

SEQ ID NO: 2030516 - RNA, 20 nt, Human
gcgcgcucaucccacccgcc

SEQ ID NO: 2030517 - RNA, 21 nt, Human
ugcuggccaccugcugagccc

SEQ ID NO: 2030518 - RNA, 14 nt, Human
ugagcuugcagaga

SEQ ID NO: 2030519 - RNA, 14 nt, Human
cugccagcuggccu

SEQ ID NO: 2030520 - RNA, 15 nt, Human
cuaagugcagccccg

SEQ ID NO: 2030521 - RNA, 14 nt, Human
aauaguuuaugauu

SEQ ID NO: 2030522 - RNA, 13 nt, Human
gugagcaucaucu

SEQ ID NO: 2030523 - RNA, 14 nt, Human
aagagugaaggauu

SEQ ID NO: 2030524 - RNA, 20 nt, Human
agcucaggcuggcaccgcug

SEQ ID NO: 2030525 - RNA, 18 nt, Human
gcccuggugggcagagag

SEQ ID NO: 2030526 - RNA, 18 nt, Human
cuggaaacuucagcgguu

SEQ ID NO: 2030527 - RNA, 21 nt, Human
gcagcauuguuggcuguuccu

SEQ ID NO: 2030528 - RNA, 16 nt, Human
uaaacgucuuaaauau

SEQ ID NO: 2030529 - RNA, 23 nt, Human
aggagcuguugagguaccuccaa

SEQ ID NO: 2030530 - RNA, 15 nt, Human
accaaggcugauuaa

SEQ ID NO: 2030531 - RNA, 14 nt, Human
ggaccaucccggcc

SEQ ID NO: 2030532 - RNA, 17 nt, Human
uguucuaagaagugaaa

SEQ ID NO: 2030533 - RNA, 20 nt, Human
cccugccccccagcccuccu

SEQ ID NO: 2030534 - RNA, 18 nt, Human
aaauauaaauaaaaauaa

SEQ ID NO: 2030535 - RNA, 14 nt, Human
acuggacucaccuc

SEQ ID NO: 2030536 - RNA, 20 nt, Human
uccuccaugaauaucaguua

SEQ ID NO: 2030537 - RNA, 19 nt, Human
gaaagaaaauaacaauaaa

SEQ ID NO: 2030538 - RNA, 23 nt, Human
uaagaaauaggaaauauuuuaau

SEQ ID NO: 2030539 - RNA, 21 nt, Human
uuguaauuuuuuugugggaaa

SEQ ID NO: 2030540 - RNA, 14 nt, Human
ugagaugcuagaac

SEQ ID NO: 2030541 - RNA, 20 nt, Human
aaagacaaggaaaaaauaac

SEQ ID NO: 2030542 - RNA, 18 nt, Human
aucuauguagaauauauu

SEQ ID NO: 2030543 - RNA, 18 nt, Human
gcugcugccgugggccug

SEQ ID NO: 2030544 - RNA, 18 nt, Human
caugaauuaguuuuauau

SEQ ID NO: 2030545 - RNA, 19 nt, Human
guacugagagugaacaaau

SEQ ID NO: 2030546 - RNA, 13 nt, Human
uuaaauuguaaua

SEQ ID NO: 2030547 - RNA, 23 nt, Human
agcagcccuuagcccuuccccuc

SEQ ID NO: 2030548 - RNA, 20 nt, Human
accgcuguacgcgagcgcgc

SEQ ID NO: 2030549 - RNA, 16 nt, Human
auccuacaagacacag

SEQ ID NO: 2030550 - RNA, 23 nt, Human
cacaagaaaugaaagcagggacu

SEQ ID NO: 2030551 - RNA, 19 nt, Human
gaggcagagguugcaguga

SEQ ID NO: 2030552 - RNA, 20 nt, Human
ugcugcccuuccccuuccca

SEQ ID NO: 2030553 - RNA, 20 nt, Human
gagccugaucaccugcccug

SEQ ID NO: 2030554 - RNA, 18 nt, Human
ugaagcuguguccucaug

SEQ ID NO: 2030555 - RNA, 20 nt, Human
ugauuauaugucacuuugcu

SEQ ID NO: 2030556 - RNA, 14 nt, Human
cggagccuccagcu

SEQ ID NO: 2030557 - RNA, 17 nt, Human
caccucccccaucucuu

SEQ ID NO: 2030558 - RNA, 22 nt, Human
ucucagcuucacccugagguga

SEQ ID NO: 2030559 - RNA, 12 nt, Human
aaggaugccccg

SEQ ID NO: 2030560 - RNA, 17 nt, Human
cccacuagacccacugg

SEQ ID NO: 2030561 - RNA, 10 nt, Human
aaacacaugu

SEQ ID NO: 2030562 - RNA, 14 nt, Human
agcgcgcgcgcccu

SEQ ID NO: 2030563 - RNA, 17 nt, Human
caucagcaucccuagaa

SEQ ID NO: 2030564 - RNA, 18 nt, Human
ccucaagcuaugugagcu

SEQ ID NO: 2030565 - RNA, 23 nt, Human
aagagccuuuuuuugaaaaaaag

SEQ ID NO: 2030566 - RNA, 12 nt, Human
cuuaagcuuuca

SEQ ID NO: 2030567 - RNA, 22 nt, Human
ccuuccccucugcagcuuccag

SEQ ID NO: 2030568 - RNA, 19 nt, Human
ugaaauuguauuacaaauc

SEQ ID NO: 2030569 - RNA, 22 nt, Human
uacaugagguacugagagugaa

SEQ ID NO: 2030570 - RNA, 20 nt, Human
guaucaaaagaaagaaaauc

SEQ ID NO: 2030571 - RNA, 21 nt, Human
ugaaauaaacgucuuaaauau

SEQ ID NO: 2030572 - RNA, 18 nt, Human
aagaccucauuuugaagg

SEQ ID NO: 2030573 - RNA, 20 nt, Human
auuacuguaagaaaauauca

SEQ ID NO: 2030574 - RNA, 19 nt, Human
ucagguguguugcaguguc

SEQ ID NO: 2030575 - RNA, 17 nt, Human
ucuaaauucuuucauuu

SEQ ID NO: 2030576 - RNA, 22 nt, Human
ccauacuaauuauacccccugc

SEQ ID NO: 2030577 - RNA, 22 nt, Human
cuggugucuucaggggccacac

SEQ ID NO: 2030578 - RNA, 23 nt, Human
auuucugagcauuuaauauggau

SEQ ID NO: 2030579 - RNA, 18 nt, Human
acagucucuugaggcaca

SEQ ID NO: 2030580 - RNA, 16 nt, Human
cuuagcccuuccccuc

SEQ ID NO: 2030581 - RNA, 18 nt, Human
auggccacaucugagccc

SEQ ID NO: 2030582 - RNA, 22 nt, Human
ugggcacuguggguagacacac

SEQ ID NO: 2030583 - RNA, 15 nt, Human
augaauuaaguuuuu

SEQ ID NO: 2030584 - RNA, 18 nt, Human
cugcugcccuuccccuuc

SEQ ID NO: 2030585 - RNA, 14 nt, Human
uucagccugaaaga

SEQ ID NO: 2030586 - RNA, 15 nt, Human
agucuguuuucccuc

SEQ ID NO: 2030587 - RNA, 19 nt, Human
gcaggcacugccaaaacau

SEQ ID NO: 2030588 - RNA, 13 nt, Human
acggggugaaacc

SEQ ID NO: 2030589 - RNA, 18 nt, Human
acuggacucaccuccccc

SEQ ID NO: 2030590 - RNA, 17 nt, Human
cgucaacucauauuuuc

SEQ ID NO: 2030591 - RNA, 14 nt, Human
auguagaauauauu

SEQ ID NO: 2030592 - RNA, 23 nt, Human
agaguuuagcuggaaaaguaugu

SEQ ID NO: 2030593 - RNA, 13 nt, Human
uggacgagaaaac

SEQ ID NO: 2030594 - RNA, 16 nt, Human
uucaaugccccugaau

SEQ ID NO: 2030595 - RNA, 20 nt, Human
gaaauacacuguuaucuuca

SEQ ID NO: 2030596 - RNA, 17 nt, Human
agcuucacuguaaaaua

SEQ ID NO: 2030597 - RNA, 16 nt, Human
ucuucaacucccugcc

SEQ ID NO: 2030598 - RNA, 18 nt, Human
gcgcuggcugcgcucggc

SEQ ID NO: 2030599 - RNA, 20 nt, Human
uguuggugaacuugguuuua

SEQ ID NO: 2030600 - RNA, 23 nt, Human
aggaugguucccuugaugaagaa

SEQ ID NO: 2030601 - RNA, 20 nt, Human
cggagccuccagcugccccg

SEQ ID NO: 2030602 - RNA, 13 nt, Human
ccccucugcagcu

SEQ ID NO: 2030603 - RNA, 16 nt, Human
cacuuaaaaaugguuu

SEQ ID NO: 2030604 - RNA, 16 nt, Human
agcuugaaaccuucac

SEQ ID NO: 2030605 - RNA, 21 nt, Human
uuauuuucuauaauuuaaaua

SEQ ID NO: 2030606 - RNA, 23 nt, Human
uuauagcuacuaauuuuaaaaug

SEQ ID NO: 2030607 - RNA, 14 nt, Human
uuuuauaagaaaua

SEQ ID NO: 2030608 - RNA, 18 nt, Human
auaauccuaaacauauga

SEQ ID NO: 2030609 - RNA, 17 nt, Human
agugauuaccagggacu

SEQ ID NO: 2030610 - RNA, 10 nt, Human
accugagccc

SEQ ID NO: 2030611 - RNA, 19 nt, Human
cuccgcuacuuccagggcu

SEQ ID NO: 2030612 - RNA, 17 nt, Human
cuaagcuucacuguaaa

SEQ ID NO: 2030613 - RNA, 14 nt, Human
cugucucaguccau

SEQ ID NO: 2030614 - RNA, 14 nt, Human
auuuauuuuaauaa

SEQ ID NO: 2030615 - RNA, 17 nt, Human
ccaguaguuagcuuucu

SEQ ID NO: 2030616 - RNA, 15 nt, Human
aagaaaauaacaaua

SEQ ID NO: 2030617 - RNA, 15 nt, Human
cuccagggagucuca

SEQ ID NO: 2030618 - RNA, 22 nt, Human
aaacauguuuaucguauuugau

SEQ ID NO: 2030619 - RNA, 13 nt, Human
cucugagccuugg

SEQ ID NO: 2030620 - RNA, 18 nt, Human
ccugccuaagugcagccc

SEQ ID NO: 2030621 - RNA, 22 nt, Human
uuaaaaaaaaaacguauugcau

SEQ ID NO: 2030622 - RNA, 16 nt, Human
ccaggcugagccucag

SEQ ID NO: 2030623 - RNA, 14 nt, Human
gggcuggaugcucu

SEQ ID NO: 2030624 - RNA, 16 nt, Human
acugauguaaguaaac

SEQ ID NO: 2030625 - RNA, 16 nt, Human
gaagauguagaggaga

SEQ ID NO: 2030626 - RNA, 20 nt, Human
agggcaguguucccuggggc

SEQ ID NO: 2030627 - RNA, 22 nt, Human
aagagccuuuuuuugaaaaaaa

SEQ ID NO: 2030628 - RNA, 12 nt, Human
cuuccucugagc

SEQ ID NO: 2030629 - RNA, 11 nt, Human
acugggacagg

SEQ ID NO: 2030630 - RNA, 14 nt, Human
aucaaaagaaagaa

SEQ ID NO: 2030631 - RNA, 17 nt, Human
cuaauaucuuaucuucc

SEQ ID NO: 2030632 - RNA, 17 nt, Human
cucccuggaaucuugua

SEQ ID NO: 2030633 - RNA, 20 nt, Human
aagacagugaaagaaaauaa

SEQ ID NO: 2030634 - RNA, 12 nt, Human
ucuuaagaagac

SEQ ID NO: 2030635 - RNA, 15 nt, Human
uuuagugaaauauua

SEQ ID NO: 2030636 - RNA, 19 nt, Human
ugggacaggggagaaccua

SEQ ID NO: 2030637 - RNA, 20 nt, Human
aaaacaagcacuaaacaaag

SEQ ID NO: 2030638 - RNA, 22 nt, Human
caucucuucuggguuccuuccu

SEQ ID NO: 2030639 - RNA, 15 nt, Human
cccugccccccagcc

SEQ ID NO: 2030640 - RNA, 19 nt, Human
ucaguccaugaagauguag

SEQ ID NO: 2030641 - RNA, 21 nt, Human
cucaagcuaugugagcucacc

SEQ ID NO: 2030642 - RNA, 22 nt, Human
uaaaacaagcacuaaacaaaga

SEQ ID NO: 2030643 - RNA, 22 nt, Human
ccugcugcccuuccccuuccca

SEQ ID NO: 2030644 - RNA, 13 nt, Human
ccaccugccuaua

SEQ ID NO: 2030645 - RNA, 18 nt, Human
gaaaauaucacuugucaa

SEQ ID NO: 2030646 - RNA, 17 nt, Human
cucucauccacuuucca

SEQ ID NO: 2030647 - RNA, 18 nt, Human
uauuuuacauaaauuuag

SEQ ID NO: 2030648 - RNA, 15 nt, Human
cgagacaagcagccc

SEQ ID NO: 2030649 - RNA, 19 nt, Human
auuuugugaagcaaaauuu

SEQ ID NO: 2030650 - RNA, 18 nt, Human
ccuguucgcgcgccuccg

SEQ ID NO: 2030651 - RNA, 15 nt, Human
uauuucacuuuagaa

SEQ ID NO: 2030652 - RNA, 15 nt, Human
ugaaacccugucucu

SEQ ID NO: 2030653 - RNA, 14 nt, Human
auuuuaucugcuau

SEQ ID NO: 2030654 - RNA, 16 nt, Human
aagacugcacaucaaa

SEQ ID NO: 2030655 - RNA, 17 nt, Human
cuggagggaagccuugg

SEQ ID NO: 2030656 - RNA, 21 nt, Human
aggaagaucccuuuguccaca

SEQ ID NO: 2030657 - RNA, 19 nt, Human
cuaagcuucacuguaaaau

SEQ ID NO: 2030658 - RNA, 14 nt, Human
ucuccucaacucug

SEQ ID NO: 2030659 - RNA, 13 nt, Human
cuaugaaauauua

SEQ ID NO: 2030660 - RNA, 20 nt, Human
cuaaaugucaaucagccuag

SEQ ID NO: 2030661 - RNA, 15 nt, Human
aguaugugcauauuu

SEQ ID NO: 2030662 - RNA, 21 nt, Human
cucagcuucacccugagguga

SEQ ID NO: 2030663 - RNA, 18 nt, Human
caugaagauguagaggag

SEQ ID NO: 2030664 - RNA, 13 nt, Human
ugggcauucaaau

SEQ ID NO: 2030665 - RNA, 22 nt, Human
cccuauccuacuuccccuuccu

SEQ ID NO: 2030666 - RNA, 22 nt, Human
auaaaguaugugcauauuuuau

SEQ ID NO: 2030667 - RNA, 22 nt, Human
gcgcggcgggagggcgcggggc

SEQ ID NO: 2030668 - RNA, 22 nt, Human
uaccucugcuauuugcuguuau

SEQ ID NO: 2030669 - RNA, 20 nt, Human
uuaaauggucaauuuuguua

SEQ ID NO: 2030670 - RNA, 19 nt, Human
auugaggacacugauaugg

SEQ ID NO: 2030671 - RNA, 12 nt, Human
uguuugaaagcu

SEQ ID NO: 2030672 - RNA, 14 nt, Human
ccucuccucucuuc

SEQ ID NO: 2030673 - RNA, 18 nt, Human
cuuugagcgcccacuaga

SEQ ID NO: 2030674 - RNA, 13 nt, Human
cuuagcccuuccc

SEQ ID NO: 2030675 - RNA, 14 nt, Human
uaugaauuacauuu

SEQ ID NO: 2030676 - RNA, 21 nt, Human
gagccggagccuccagcugcc

SEQ ID NO: 2030677 - RNA, 18 nt, Human
ugcagugucugcuggaga

SEQ ID NO: 2030678 - RNA, 17 nt, Human
auauuuuacauaaauuu

SEQ ID NO: 2030679 - RNA, 18 nt, Human
caguuguugcccacagcu

SEQ ID NO: 2030680 - RNA, 15 nt, Human
uugccuaauuuguuu

SEQ ID NO: 2030681 - RNA, 17 nt, Human
aaucuuauaauuuaaaa

SEQ ID NO: 2030682 - RNA, 22 nt, Human
aggcuccacuuggucugugaga

SEQ ID NO: 2030683 - RNA, 19 nt, Human
cuucuggguuccuuccucu

SEQ ID NO: 2030684 - RNA, 19 nt, Human
aagcuuguauuccuuuuuc

SEQ ID NO: 2030685 - RNA, 14 nt, Human
auacaaaaaaaaaa

SEQ ID NO: 2030686 - RNA, 15 nt, Human
uaaauucuuucauuu

SEQ ID NO: 2030687 - RNA, 17 nt, Human
auaucaauuuaaaaaaa

SEQ ID NO: 2030688 - RNA, 17 nt, Human
uaacgauaaaagacagu

SEQ ID NO: 2030689 - RNA, 16 nt, Human
cuaggcauagcccugc

SEQ ID NO: 2030690 - RNA, 16 nt, Human
agggcaguguucccug

SEQ ID NO: 2030691 - RNA, 16 nt, Human
gcaucccuagaaagcc

SEQ ID NO: 2030692 - RNA, 23 nt, Human
aagagccggagccuccagcugcc

SEQ ID NO: 2030693 - RNA, 23 nt, Human
gaaaaugucauuguucuugugaa

SEQ ID NO: 2030694 - RNA, 17 nt, Human
cacauguuccccuuggg

SEQ ID NO: 2030695 - RNA, 15 nt, Human
aaaaauaacaaugaa

SEQ ID NO: 2030696 - RNA, 22 nt, Human
uacugagagugaacaaauuuac

SEQ ID NO: 2030697 - RNA, 21 nt, Human
cugauauuggacaguaaaauc

SEQ ID NO: 2030698 - RNA, 13 nt, Human
agaaguaaaaaca

SEQ ID NO: 2030699 - RNA, 14 nt, Human
guccacaaguaaaa

SEQ ID NO: 2030700 - RNA, 22 nt, Human
agcccuccuuaucaaaggacac

SEQ ID NO: 2030701 - RNA, 16 nt, Human
aucaaaagaaagaaaa

SEQ ID NO: 2030702 - RNA, 13 nt, Human
cgcgagcgcgcgc

SEQ ID NO: 2030703 - RNA, 17 nt, Human
ucauacuucuuaggguu

SEQ ID NO: 2030704 - RNA, 16 nt, Human
auaugauucaaauguc

SEQ ID NO: 2030705 - RNA, 21 nt, Human
cuagucuguuuucccuccuug

SEQ ID NO: 2030706 - RNA, 19 nt, Human
auuucuucaacucccugcc

SEQ ID NO: 2030707 - RNA, 13 nt, Human
uuuguuucagugc

SEQ ID NO: 2030708 - RNA, 21 nt, Human
aagucuuucacauuuaaauaa

SEQ ID NO: 2030709 - RNA, 17 nt, Human
uccagcuggccgggagc

SEQ ID NO: 2030710 - RNA, 22 nt, Human
uguauacugugugcuaaaacaa

SEQ ID NO: 2030711 - RNA, 15 nt, Human
cgggagccugaucac

SEQ ID NO: 2030712 - RNA, 13 nt, Human
uuuauuauauaua

SEQ ID NO: 2030713 - RNA, 13 nt, Human
ccagcacagccuc

SEQ ID NO: 2030714 - RNA, 12 nt, Human
aaaagaaagaaa

SEQ ID NO: 2030715 - RNA, 14 nt, Human
aagcucuaucacca

SEQ ID NO: 2030716 - RNA, 22 nt, Human
uugacccacaagaaaugaaagc

SEQ ID NO: 2030717 - RNA, 20 nt, Human
ucacuguauguccuuggugc

SEQ ID NO: 2030718 - RNA, 22 nt, Human
uauaagaaauaggaaauauuuu

SEQ ID NO: 2030719 - RNA, 23 nt, Human
uaagaauucuguugauggaaaua

SEQ ID NO: 2030720 - RNA, 18 nt, Human
uccaggcuggcgugcagc

SEQ ID NO: 2030721 - RNA, 17 nt, Human
guguccccuauccuacu

SEQ ID NO: 2030722 - RNA, 19 nt, Human
auaaaagacagugaaagaa

SEQ ID NO: 2030723 - RNA, 19 nt, Human
cuguacgcgagcgcgcgcg

SEQ ID NO: 2030724 - RNA, 19 nt, Human
gaaaaugucauuguucuug

SEQ ID NO: 2030725 - RNA, 20 nt, Human
ccuaagucccugcugcccuu

SEQ ID NO: 2030726 - RNA, 21 nt, Human
aauaauguuucaaacauauau

SEQ ID NO: 2030727 - RNA, 13 nt, Human
gguuuuaaagcuu

SEQ ID NO: 2030728 - RNA, 22 nt, Human
aaacuuuuggaagguauuuaau

SEQ ID NO: 2030729 - RNA, 14 nt, Human
cucagucucccucc

SEQ ID NO: 2030730 - RNA, 17 nt, Human
gucaaagcugaaaugga

SEQ ID NO: 2030731 - RNA, 23 nt, Human
cuuauaucuauauuuuacauaaa

SEQ ID NO: 2030732 - RNA, 21 nt, Human
aaguuuaugguuguauuauuu

SEQ ID NO: 2030733 - RNA, 18 nt, Human
cuuuucccaacuccagaa

SEQ ID NO: 2030734 - RNA, 14 nt, Human
gauaaaagacagug

SEQ ID NO: 2030735 - RNA, 18 nt, Human
gaaaauaacaauaaaaga

SEQ ID NO: 2030736 - RNA, 20 nt, Human
accucauggaauuggagcuc

SEQ ID NO: 2030737 - RNA, 13 nt, Human
uuccucugagccu

SEQ ID NO: 2030738 - RNA, 12 nt, Human
uuuuauauuuga

SEQ ID NO: 2030739 - RNA, 22 nt, Human
uuucuaggacugaauuaugaaa

SEQ ID NO: 2030740 - RNA, 19 nt, Human
aauauuauguuaaaacugg

SEQ ID NO: 2030741 - RNA, 16 nt, Human
cucgccacgcucuggg

SEQ ID NO: 2030742 - RNA, 12 nt, Human
aagaaaauaaca

SEQ ID NO: 2030743 - RNA, 14 nt, Human
cugggucgccggca

SEQ ID NO: 2030744 - RNA, 18 nt, Human
cuaauguguaagacaaaa

SEQ ID NO: 2030745 - RNA, 13 nt, Human
agccgggaaagaa

SEQ ID NO: 2030746 - RNA, 22 nt, Human
gcuaauuagcauggccacaucu

SEQ ID NO: 2030747 - RNA, 14 nt, Human
gcgcgcuccgcgca

SEQ ID NO: 2030748 - RNA, 19 nt, Human
uggugaacuugguuuuaau

SEQ ID NO: 2030749 - RNA, 15 nt, Human
gcugguggcgcuggc

SEQ ID NO: 2030750 - RNA, 20 nt, Human
auccucgaggcccuagcauu

SEQ ID NO: 2030751 - RNA, 20 nt, Human
ccaggcggguccgggucgca

SEQ ID NO: 2030752 - RNA, 12 nt, Human
ugugaggagcug

SEQ ID NO: 2030753 - RNA, 18 nt, Human
auccuucagccugaaaga

SEQ ID NO: 2030754 - RNA, 17 nt, Human
guuuuaggaauacauaa

SEQ ID NO: 2030755 - RNA, 23 nt, Human
agcaugucgucaaagcugaaaug

SEQ ID NO: 2030756 - RNA, 15 nt, Human
cuaucuuugagcgcc

SEQ ID NO: 2030757 - RNA, 21 nt, Human
auuauauggcuugaguuuaaa

SEQ ID NO: 2030758 - RNA, 20 nt, Human
ccagggcuacgcgcgcuccg

SEQ ID NO: 2030759 - RNA, 12 nt, Human
augaccaacauc

SEQ ID NO: 2030760 - RNA, 16 nt, Human
acaugaaguccaagca

SEQ ID NO: 2030761 - RNA, 17 nt, Human
auuagcauggccacauc

SEQ ID NO: 2030762 - RNA, 21 nt, Human
ucacaugaacuuguaaaggaa

SEQ ID NO: 2030763 - RNA, 21 nt, Human
auggaaauacacuguuaucuu

SEQ ID NO: 2030764 - RNA, 17 nt, Human
aaccucuaaauucuuuc

SEQ ID NO: 2030765 - RNA, 20 nt, Human
uauguccuuggugccuggag

SEQ ID NO: 2030766 - RNA, 18 nt, Human
accaagcugguggcucug

SEQ ID NO: 2030767 - RNA, 20 nt, Human
caaacauccuacaagacaca

SEQ ID NO: 2030768 - RNA, 21 nt, Human
gcggcgggagggcgcggggcg

SEQ ID NO: 2030769 - RNA, 23 nt, Human
ucugauacagaaaaguugaauuu

SEQ ID NO: 2030770 - RNA, 23 nt, Human
agaaugauuaugaauuacauuug

SEQ ID NO: 2030771 - RNA, 23 nt, Human
agccaccaguccauugggcaggc

SEQ ID NO: 2030772 - RNA, 22 nt, Human
caucaucuucuggguuaggccu

SEQ ID NO: 2030773 - RNA, 21 nt, Human
agagccggagccuccagcugc

SEQ ID NO: 2030774 - RNA, 22 nt, Human
ugaauggcuaagcaaaauguga

SEQ ID NO: 2030775 - RNA, 13 nt, Human
aacucuauaaugu

SEQ ID NO: 2030776 - RNA, 19 nt, Human
cagauccccaagccuggca

SEQ ID NO: 2030777 - RNA, 22 nt, Human
ccauuucuugagguaaaagcau

SEQ ID NO: 2030778 - RNA, 17 nt, Human
uugcaguuuuuuccuag

SEQ ID NO: 2030779 - RNA, 20 nt, Human
uaucauuuaguuauaaaaau

SEQ ID NO: 2030780 - RNA, 14 nt, Human
cacccugagguugu

SEQ ID NO: 2030781 - RNA, 18 nt, Human
uaaugaauacuuuauaaa

SEQ ID NO: 2030782 - RNA, 22 nt, Human
cucugagccuugggaccccuga

SEQ ID NO: 2030783 - RNA, 19 nt, Human
uguaaagguccuggcaaag

SEQ ID NO: 2030784 - RNA, 22 nt, Human
cuccagccugagcgacagugag

SEQ ID NO: 2030785 - RNA, 15 nt, Human
uuauaugcuauuuau

SEQ ID NO: 2030786 - RNA, 19 nt, Human
uugugggauacuauuuaau

SEQ ID NO: 2030787 - RNA, 22 nt, Human
ccauucuuccucccauucagga

SEQ ID NO: 2030788 - RNA, 15 nt, Human
auuuauuaaguauuu

SEQ ID NO: 2030789 - RNA, 23 nt, Human
ggcuaagcuucacuguaaaauaa

SEQ ID NO: 2030790 - RNA, 16 nt, Human
gugagacagcucugca

SEQ ID NO: 2030791 - RNA, 18 nt, Human
cuaauuagcauggccaca

SEQ ID NO: 2030792 - RNA, 17 nt, Human
cggccgcgcugcgcgcc

SEQ ID NO: 2030793 - RNA, 17 nt, Human
gccugagcgacagugag

SEQ ID NO: 2030794 - RNA, 19 nt, Human
uggugagugccuguaauca

SEQ ID NO: 2030795 - RNA, 21 nt, Human
gccucaagcuaugugagcuca

SEQ ID NO: 2030796 - RNA, 14 nt, Human
gugagcuacaaaug

SEQ ID NO: 2030797 - RNA, 23 nt, Human
gccgggaaagaagagccggagcc

SEQ ID NO: 2030798 - RNA, 16 nt, Human
ugagccccgaaucuga

SEQ ID NO: 2030799 - RNA, 14 nt, Human
ggagccuccagcug

SEQ ID NO: 2030800 - RNA, 15 nt, Human
gcagagguugcagug

SEQ ID NO: 2030801 - RNA, 21 nt, Human
gugccguccccagagcuacag

SEQ ID NO: 2030802 - RNA, 17 nt, Human
ccucagucucccucccu

SEQ ID NO: 2030803 - RNA, 20 nt, Human
gaaacgaggauugggaaaaa

SEQ ID NO: 2030804 - RNA, 20 nt, Human
cuaauguguaagacaaaaag

SEQ ID NO: 2030805 - RNA, 15 nt, Human
uuacagagacagaaa

SEQ ID NO: 2030806 - RNA, 23 nt, Human
cgcaggaccaucccggccggcgc

SEQ ID NO: 2030807 - RNA, 17 nt, Human
cauuguuggcuguuccu

SEQ ID NO: 2030808 - RNA, 18 nt, Human
ccugcucgcccacuuccu

SEQ ID NO: 2030809 - RNA, 20 nt, Human
cugauauuggacaguaaaau

SEQ ID NO: 2030810 - RNA, 16 nt, Human
cuucaacucccugccc

SEQ ID NO: 2030811 - RNA, 18 nt, Human
uauauuuuuuuuuuuaaa

SEQ ID NO: 2030812 - RNA, 20 nt, Human
caaacugccaucauuuacuu

SEQ ID NO: 2030813 - RNA, 14 nt, Human
uucuggaauaaucc

SEQ ID NO: 2030814 - RNA, 22 nt, Human
aucuccgucaacucauauuuuc

SEQ ID NO: 2030815 - RNA, 22 nt, Human
aaguggaacgagacaagcagcc

SEQ ID NO: 2030816 - RNA, 14 nt, Human
aacgucuuaaauau

SEQ ID NO: 2030817 - RNA, 23 nt, Human
ugucacgugugggcaauguuccc

SEQ ID NO: 2030818 - RNA, 17 nt, Human
cccggccggcgcgcuca

SEQ ID NO: 2030819 - RNA, 16 nt, Human
auuuaguuauaaaaau

SEQ ID NO: 2030820 - RNA, 14 nt, Human
augauguuuagaaa

SEQ ID NO: 2030821 - RNA, 23 nt, Human
acugcuaguuuauauagaaaugu

SEQ ID NO: 2030822 - RNA, 23 nt, Human
cugccucucucauccacuuucca

SEQ ID NO: 2030823 - RNA, 16 nt, Human
acauuugcucauggaa

SEQ ID NO: 2030824 - RNA, 21 nt, Human
ccuaauuuguuuucccuucuu

SEQ ID NO: 2030825 - RNA, 20 nt, Human
aaaaaccugagccccaaaag

SEQ ID NO: 2030826 - RNA, 15 nt, Human
cacaggacagcccuu

SEQ ID NO: 2030827 - RNA, 14 nt, Human
acaaauccaaugaa

SEQ ID NO: 2030828 - RNA, 15 nt, Human
ccaaggagccaaaca

SEQ ID NO: 2030829 - RNA, 13 nt, Human
ccaggcugagccu

SEQ ID NO: 2030830 - RNA, 21 nt, Human
auguuuacagauccccaagcc

SEQ ID NO: 2030831 - RNA, 17 nt, Human
uacagaaaaguugaauu

SEQ ID NO: 2030832 - RNA, 15 nt, Human
gccuugggaccccug

SEQ ID NO: 2030833 - RNA, 22 nt, Human
ggccggcgcgcucaucccaccc

SEQ ID NO: 2030834 - RNA, 20 nt, Human
gacggcuccggacgcugcug

SEQ ID NO: 2030835 - RNA, 15 nt, Human
gucaaugcagccccc

SEQ ID NO: 2030836 - RNA, 11 nt, Human
auacugaaaua

SEQ ID NO: 2030837 - RNA, 14 nt, Human
auuuguauaaaaua

SEQ ID NO: 2030838 - RNA, 20 nt, Human
ugcagccaccaguccauugg

SEQ ID NO: 2030839 - RNA, 16 nt, Human
cacgugugggcaaugu

SEQ ID NO: 2030840 - RNA, 20 nt, Human
uaaaagacagugaaagaaaa

SEQ ID NO: 2030841 - RNA, 19 nt, Human
uggcaagcucuaucaccaa

SEQ ID NO: 2030842 - RNA, 17 nt, Human
ucuuucacauuuaaaua

SEQ ID NO: 2030843 - RNA, 23 nt, Human
accucucuggguugaagggcagu

SEQ ID NO: 2030844 - RNA, 20 nt, Human
uguaaaggaauuuaaaaauc

SEQ ID NO: 2030845 - RNA, 22 nt, Human
acuuugauuuuauaugcuauuu

SEQ ID NO: 2030846 - RNA, 22 nt, Human
ggacagcccuucuuuccacaga

SEQ ID NO: 2030847 - RNA, 15 nt, Human
cuguauguccuuggu

SEQ ID NO: 2030848 - RNA, 22 nt, Human
aauuuuuucucuaggaaauauu

SEQ ID NO: 2030849 - RNA, 15 nt, Human
aagcacuaaacaaag

SEQ ID NO: 2030850 - RNA, 12 nt, Human
gaagaccucauu

SEQ ID NO: 2030851 - RNA, 12 nt, Human
aauuuuaaaaug

SEQ ID NO: 2030852 - RNA, 21 nt, Human
acuauuauauuuccaagaaau

SEQ ID NO: 2030853 - RNA, 20 nt, Human
cagagaaguuuucuggaggu

SEQ ID NO: 2030854 - RNA, 20 nt, Human
aagggcuguuauaaucuuuc

SEQ ID NO: 2030855 - RNA, 19 nt, Human
accauuuuggcaagcucua

SEQ ID NO: 2030856 - RNA, 22 nt, Human
aggacaccauuuuggcaagcuc

SEQ ID NO: 2030857 - RNA, 11 nt, Human
caacucccugc

SEQ ID NO: 2030858 - RNA, 17 nt, Human
uuugauaugugaacagu

SEQ ID NO: 2030859 - RNA, 16 nt, Human
gaagccagaucuaugc

SEQ ID NO: 2030860 - RNA, 20 nt, Human
ugaggcuccacuuggucugu

SEQ ID NO: 2030861 - RNA, 19 nt, Human
aauguuuacagauccccaa

SEQ ID NO: 2030862 - RNA, 19 nt, Human
uguauacugugugcuaaaa

SEQ ID NO: 2030863 - RNA, 16 nt, Human
ccccuucccacacugu

SEQ ID NO: 2030864 - RNA, 20 nt, Human
ucuucuggguuccuuccucu

SEQ ID NO: 2030865 - RNA, 19 nt, Human
acauuuguauaaaauaauu

SEQ ID NO: 2030866 - RNA, 20 nt, Human
cucagcuucacccugaggug

SEQ ID NO: 2030867 - RNA, 14 nt, Human
cucaacucugagug

SEQ ID NO: 2030868 - RNA, 23 nt, Human
cacagauuugagcucagcccugg

SEQ ID NO: 2030869 - RNA, 17 nt, Human
caggagcaucuccucaa

SEQ ID NO: 2030870 - RNA, 17 nt, Human
cugagaugggagaauca

SEQ ID NO: 2030871 - RNA, 23 nt, Human
uccacaaguaaaaggaaaugcuc

SEQ ID NO: 2030872 - RNA, 14 nt, Human
cucccggccgcgcu

SEQ ID NO: 2030873 - RNA, 17 nt, Human
agaugggagaaucacuu

SEQ ID NO: 2030874 - RNA, 14 nt, Human
cguguccccuaucc

SEQ ID NO: 2030875 - RNA, 18 nt, Human
acauuugcucauggaauu

SEQ ID NO: 2030876 - RNA, 21 nt, Human
accaacacccugagguugugu

SEQ ID NO: 2030877 - RNA, 19 nt, Human
cuuggggccuaugcagagg

SEQ ID NO: 2030878 - RNA, 18 nt, Human
uaauuauuucacuuuaga

SEQ ID NO: 2030879 - RNA, 16 nt, Human
uuugcuguuauuuuau

SEQ ID NO: 2030880 - RNA, 14 nt, Human
gcgcccucuggcug

SEQ ID NO: 2030881 - RNA, 16 nt, Human
gacaaggaaaaaauaa

SEQ ID NO: 2030882 - RNA, 22 nt, Human
aucaucaagucuuucacauuua

SEQ ID NO: 2030883 - RNA, 14 nt, Human
agccuccagcugcc

SEQ ID NO: 2030884 - RNA, 21 nt, Human
ugagcucagcccuggugggca

SEQ ID NO: 2030885 - RNA, 21 nt, Human
acagugaaagaaaauaacaau

SEQ ID NO: 2030886 - RNA, 22 nt, Human
cgcgcgccuccgcuacuuccag

SEQ ID NO: 2030887 - RNA, 16 nt, Human
auaacuggaaacuuca

SEQ ID NO: 2030888 - RNA, 23 nt, Human
cuagacccacuggacucaccucc

SEQ ID NO: 2030889 - RNA, 16 nt, Human
cuggcugcgcucggcc

SEQ ID NO: 2030890 - RNA, 15 nt, Human
gaaaugaaagcaggg

SEQ ID NO: 2030891 - RNA, 15 nt, Human
ucacaggacagcccu

SEQ ID NO: 2030892 - RNA, 19 nt, Human
cauggaauuggagcucgug

SEQ ID NO: 2030893 - RNA, 22 nt, Human
aauuguaggugacuauuauauu

SEQ ID NO: 2030894 - RNA, 21 nt, Human
gcgccgcgcuccucggacggc

SEQ ID NO: 2030895 - RNA, 16 nt, Human
ugagaugcuagaacuc

SEQ ID NO: 2030896 - RNA, 12 nt, Human
agcuuggaaugu

SEQ ID NO: 2030897 - RNA, 17 nt, Human
ugaauauaaauuuauca

SEQ ID NO: 2030898 - RNA, 14 nt, Human
ucuuuuuuuuaaua

SEQ ID NO: 2030899 - RNA, 19 nt, Human
ucugagcauuuaauaugga

SEQ ID NO: 2030900 - RNA, 20 nt, Human
uaggaauugacccacaagaa

SEQ ID NO: 2030901 - RNA, 16 nt, Human
cugagcuugcagagau

SEQ ID NO: 2030902 - RNA, 19 nt, Human
cugacugcuaguuuauaua

SEQ ID NO: 2030903 - RNA, 19 nt, Human
gcagggugaacugcagcga

SEQ ID NO: 2030904 - RNA, 12 nt, Human
agggauggggcu

SEQ ID NO: 2030905 - RNA, 19 nt, Human
aaaguucuagugaccgaga

SEQ ID NO: 2030906 - RNA, 20 nt, Human
uuaaguuuuuuuuuaaaaaa

SEQ ID NO: 2030907 - RNA, 17 nt, Human
ucgcagacacaugugcu

SEQ ID NO: 2030908 - RNA, 23 nt, Human
agcuggaaacacauguuccccuu

SEQ ID NO: 2030909 - RNA, 21 nt, Human
cuauguucuaagaagugaaaa

SEQ ID NO: 2030910 - RNA, 15 nt, Human
ggcaauagucaaauu

SEQ ID NO: 2030911 - RNA, 20 nt, Human
uuauugaggcuuuaaaacuu

SEQ ID NO: 2030912 - RNA, 21 nt, Human
ucuggguugaagggcaguguu

SEQ ID NO: 2030913 - RNA, 18 nt, Human
caaugccccugaauuuaa

SEQ ID NO: 2030914 - RNA, 14 nt, Human
uuucugaaauuucc

SEQ ID NO: 2030915 - RNA, 19 nt, Human
agcucugcccauccugccc

SEQ ID NO: 2030916 - RNA, 17 nt, Human
gggcaguguucccuggg

SEQ ID NO: 2030917 - RNA, 22 nt, Human
augguuguauuauuuuuuaaaa

SEQ ID NO: 2030918 - RNA, 19 nt, Human
gcccuuccccucugcagcu

SEQ ID NO: 2030919 - RNA, 18 nt, Human
cuaauaucuuaucuuccu

SEQ ID NO: 2030920 - RNA, 19 nt, Human
cuggggcuuuaacuccugc

SEQ ID NO: 2030921 - RNA, 22 nt, Human
cucuggccuucggccuccaucc

SEQ ID NO: 2030922 - RNA, 23 nt, Human
cagcaccuccuaagaaggcaccu

SEQ ID NO: 2030923 - RNA, 17 nt, Human
uccacaacacacagauu

SEQ ID NO: 2030924 - RNA, 17 nt, Human
gcagcaucagcaucccu

SEQ ID NO: 2030925 - RNA, 15 nt, Human
ucccacccgcccacc

SEQ ID NO: 2030926 - RNA, 18 nt, Human
auguuaaaacugggacag

SEQ ID NO: 2030927 - RNA, 15 nt, Human
agaauaccacaggaa

SEQ ID NO: 2030928 - RNA, 17 nt, Human
ggcccugugcggccugg

SEQ ID NO: 2030929 - RNA, 19 nt, Human
uuugccaaguucuccacua

SEQ ID NO: 2030930 - RNA, 14 nt, Human
cuugagguaaaagc

SEQ ID NO: 2030931 - RNA, 20 nt, Human
uccaagccucauguccacug

SEQ ID NO: 2030932 - RNA, 18 nt, Human
uucucuaggaaauauuua

SEQ ID NO: 2030933 - RNA, 23 nt, Human
aauaauccucaguuuuugugaaa

SEQ ID NO: 2030934 - RNA, 18 nt, Human
gccugagcgacagugaga

SEQ ID NO: 2030935 - RNA, 13 nt, Human
auaacgauaaaag

SEQ ID NO: 2030936 - RNA, 16 nt, Human
gaccaaggcccccggg

SEQ ID NO: 2030937 - RNA, 17 nt, Human
uugccaaauauaaauaa

SEQ ID NO: 2030938 - RNA, 13 nt, Human
ugccagcuggccu

SEQ ID NO: 2030939 - RNA, 21 nt, Human
cuguguccucaugagggcugg

SEQ ID NO: 2030940 - RNA, 20 nt, Human
ugagagugaacaaauuuaca

SEQ ID NO: 2030941 - RNA, 19 nt, Human
cagcacgggggccaaggau

SEQ ID NO: 2030942 - RNA, 22 nt, Human
cggagccuccagcugccccggg

SEQ ID NO: 2030943 - RNA, 16 nt, Human
cuaagucccugcugcc

SEQ ID NO: 2030944 - RNA, 18 nt, Human
gcccacuuccucccggcc

SEQ ID NO: 2030945 - RNA, 12 nt, Human
uauauuuccuua

SEQ ID NO: 2030946 - RNA, 15 nt, Human
auuugguaaggggaa

SEQ ID NO: 2030947 - RNA, 15 nt, Human
uggagcuagaauuug

SEQ ID NO: 2030948 - RNA, 13 nt, Human
cucugcagcuucc

SEQ ID NO: 2030949 - RNA, 14 nt, Human
ggccacaucugagc

SEQ ID NO: 2030950 - RNA, 23 nt, Human
augaauuaaguuuuuuuuuaaaa

SEQ ID NO: 2030951 - RNA, 18 nt, Human
cccaggcugagccucagu

SEQ ID NO: 2030952 - RNA, 17 nt, Human
aggguguguaaguagau

SEQ ID NO: 2030953 - RNA, 23 nt, Human
aucucuucuggguuccuuccucu

SEQ ID NO: 2030954 - RNA, 14 nt, Human
cucuugaggcacag

SEQ ID NO: 2030955 - RNA, 17 nt, Human
ccaaaaaucucaauauu

SEQ ID NO: 2030956 - RNA, 16 nt, Human
gccucagucucccucc

SEQ ID NO: 2030957 - RNA, 19 nt, Human
gaaugggggcagcaccucc

SEQ ID NO: 2030958 - RNA, 14 nt, Human
agguugcagugagc

SEQ ID NO: 2030959 - RNA, 15 nt, Human
aucaaaggacaccau

SEQ ID NO: 2030960 - RNA, 13 nt, Human
auccuagucucua

SEQ ID NO: 2030961 - RNA, 18 nt, Human
acaagccuccuuuuaaag

SEQ ID NO: 2030962 - RNA, 15 nt, Human
aaaaaagaaacauuu

SEQ ID NO: 2030963 - RNA, 16 nt, Human
uugccauaauuacuau

SEQ ID NO: 2030964 - RNA, 23 nt, Human
gaggcauuuaggccaugggacag

SEQ ID NO: 2030965 - RNA, 21 nt, Human
cauuucuugagguaaaagcau

SEQ ID NO: 2030966 - RNA, 20 nt, Human
uugauaaguacaugauaagc

SEQ ID NO: 2030967 - RNA, 16 nt, Human
ugcucgcccacuuccu

SEQ ID NO: 2030968 - RNA, 17 nt, Human
uucacuuuuauaagaaa

SEQ ID NO: 2030969 - RNA, 20 nt, Human
acaagacccaaaaggcagaa

SEQ ID NO: 2030970 - RNA, 16 nt, Human
agacauugaggcaggc

SEQ ID NO: 2030971 - RNA, 19 nt, Human
aagccaugugcagccacca

SEQ ID NO: 2030972 - RNA, 15 nt, Human
uuaaguauuuuauua

SEQ ID NO: 2030973 - RNA, 12 nt, Human
aaugcagccccc

SEQ ID NO: 2030974 - RNA, 17 nt, Human
cagucucuugaggcaca

SEQ ID NO: 2030975 - RNA, 15 nt, Human
acugaagaagcacca

SEQ ID NO: 2030976 - RNA, 19 nt, Human
cagauucuuuacccccugg

SEQ ID NO: 2030977 - RNA, 16 nt, Human
aaauccacacugagcu

SEQ ID NO: 2030978 - RNA, 12 nt, Human
gaaaauaacaau

SEQ ID NO: 2030979 - RNA, 18 nt, Human
ugggauacuauuuaauua

SEQ ID NO: 2030980 - RNA, 20 nt, Human
augucgucaaagcugaaaug

SEQ ID NO: 2030981 - RNA, 22 nt, Human
ugguccuaagucccugcugccc

SEQ ID NO: 2030982 - RNA, 20 nt, Human
ccuguucgcgcgccuccgcu

SEQ ID NO: 2030983 - RNA, 16 nt, Human
cuucacuguaaaauaa

SEQ ID NO: 2030984 - RNA, 20 nt, Human
auaauccuaaacauaugaau

SEQ ID NO: 2030985 - RNA, 24 nt, Human
gucgcaggaccaucccggccggcg

SEQ ID NO: 2030986 - RNA, 21 nt, Human
cuguuaucuucacuuuuauaa

SEQ ID NO: 2030987 - RNA, 17 nt, Human
cucacaggagcaucucc

SEQ ID NO: 2030988 - RNA, 21 nt, Human
aucuuuuuuuuaauaaaccau

SEQ ID NO: 2030989 - RNA, 20 nt, Human
uaucuccgucaacucauauu

SEQ ID NO: 2030990 - RNA, 14 nt, Human
gccccaucuggucc

SEQ ID NO: 2030991 - RNA, 19 nt, Human
gaaaauaacgauaaaagac

SEQ ID NO: 2030992 - RNA, 23 nt, Human
cuucaacucccugccccccagcc

SEQ ID NO: 2030993 - RNA, 16 nt, Human
ugcuguucaugaaaga

SEQ ID NO: 2030994 - RNA, 15 nt, Human
cccccagcccuccuu

SEQ ID NO: 2030995 - RNA, 20 nt, Human
agcagcccuuagcccuuccc

SEQ ID NO: 2030996 - RNA, 13 nt, Human
gggcggcggcccu

SEQ ID NO: 2030997 - RNA, 17 nt, Human
cuuccuaauuccacagc

SEQ ID NO: 2030998 - RNA, 19 nt, Human
aucuauguagaauauauuu

SEQ ID NO: 2030999 - RNA, 12 nt, Human
cauguuccccuu

SEQ ID NO: 2031000 - RNA, 17 nt, Human
gacagugaaagaaaaua

SEQ ID NO: 2031001 - RNA, 20 nt, Human
acagcccuucuuuccacaga

SEQ ID NO: 2031002 - RNA, 23 nt, Human
augaaacuuuuggaagguauuua

SEQ ID NO: 2031003 - RNA, 21 nt, Human
cggcuccggacgcugcugccg

SEQ ID NO: 2031004 - RNA, 14 nt, Human
uauauuuuacauaa

SEQ ID NO: 2031005 - RNA, 22 nt, Human
uguuuuuccaguaguuagcuuu

SEQ ID NO: 2031006 - RNA, 17 nt, Human
cuaccuguucgcgcgcc

SEQ ID NO: 2031007 - RNA, 22 nt, Human
uugccuaggcauagcccugccu

SEQ ID NO: 2031008 - RNA, 20 nt, Human
gcucgcccacuuccucccgg

SEQ ID NO: 2031009 - RNA, 14 nt, Human
ugcuagaacucccu

SEQ ID NO: 2031010 - RNA, 18 nt, Human
uagcccuuccccucugca

SEQ ID NO: 2031011 - RNA, 22 nt, Human
cuuccccucugcagcuuccagg

SEQ ID NO: 2031012 - RNA, 16 nt, Human
ccugccccccagcccu

SEQ ID NO: 2031013 - RNA, 14 nt, Human
cuggagcucugccc

SEQ ID NO: 2031014 - RNA, 17 nt, Human
agguccacaacacacag

SEQ ID NO: 2031015 - RNA, 15 nt, Human
uaucaguccaaaggg

SEQ ID NO: 2031016 - RNA, 19 nt, Human
cuccucggacggcuccgga

SEQ ID NO: 2031017 - RNA, 16 nt, Human
uucacauuuaaauaaa

SEQ ID NO: 2031018 - RNA, 13 nt, Human
auccugaggcucc

SEQ ID NO: 2031019 - RNA, 14 nt, Human
ugcuguauuuuaaa

SEQ ID NO: 2031020 - RNA, 17 nt, Human
cgcucaucccacccgcc

SEQ ID NO: 2031021 - RNA, 19 nt, Human
uguucaugcccauaccccu

SEQ ID NO: 2031022 - RNA, 14 nt, Human
cauggccacaucug

SEQ ID NO: 2031023 - RNA, 21 nt, Human
cuuucaugaaggggcggcggc

SEQ ID NO: 2031024 - RNA, 23 nt, Human
gggaaagaagagccggagccucc

SEQ ID NO: 2031025 - RNA, 20 nt, Human
ucucguugacccucacagga

SEQ ID NO: 2031026 - RNA, 19 nt, Human
acagucaccucauggaauu

SEQ ID NO: 2031027 - RNA, 19 nt, Human
uggagccuacuaaaugcuc

SEQ ID NO: 2031028 - RNA, 14 nt, Human
ggccgggagccuga

SEQ ID NO: 2031029 - RNA, 16 nt, Human
uuaauaauuuuuaauu

SEQ ID NO: 2031030 - RNA, 18 nt, Human
ugagccaccaagcuggug

SEQ ID NO: 2031031 - RNA, 13 nt, Human
gaagagccggagc

SEQ ID NO: 2031032 - RNA, 15 nt, Human
auaauccuaaacaua

SEQ ID NO: 2031033 - RNA, 12 nt, Human
gaaucuuguaaa

SEQ ID NO: 2031034 - RNA, 22 nt, Human
auauuuccuuauucagaauuuc

SEQ ID NO: 2031035 - RNA, 15 nt, Human
augggacagggagga

SEQ ID NO: 2031036 - RNA, 22 nt, Human
uucugguagcuaaauauauauu

SEQ ID NO: 2031037 - RNA, 21 nt, Human
ugcccauccugccccugagcc

SEQ ID NO: 2031038 - RNA, 18 nt, Human
aaacugccaucauuuacu

SEQ ID NO: 2031039 - RNA, 15 nt, Human
ugcuucuguuuuaua

SEQ ID NO: 2031040 - RNA, 17 nt, Human
aaagaaacauuugguaa

SEQ ID NO: 2031041 - RNA, 21 nt, Human
gacagucaccucauggaauug

SEQ ID NO: 2031042 - RNA, 14 nt, Human
cagucucccucccu

SEQ ID NO: 2031043 - RNA, 15 nt, Human
gucccaggcugagcc

SEQ ID NO: 2031044 - RNA, 20 nt, Human
auauguuagagaauuuccuu

SEQ ID NO: 2031045 - RNA, 21 nt, Human
ucauucagauaugauucaaau

SEQ ID NO: 2031046 - RNA, 13 nt, Human
cgcccucuggcug

SEQ ID NO: 2031047 - RNA, 15 nt, Human
guuuuauuauauaua

SEQ ID NO: 2031048 - RNA, 17 nt, Human
aauguuguuuuaggaau

SEQ ID NO: 2031049 - RNA, 16 nt, Human
auaucuauauuuuaca

SEQ ID NO: 2031050 - RNA, 19 nt, Human
gguuuaauaauuuuuaauu

SEQ ID NO: 2031051 - RNA, 19 nt, Human
uccagaaagugacaagcuc

SEQ ID NO: 2031052 - RNA, 21 nt, Human
auguuuaauucugaaagcaac

SEQ ID NO: 2031053 - RNA, 21 nt, Human
gccuuuucccaacuccagaaa

SEQ ID NO: 2031054 - RNA, 23 nt, Human
gcuggcgugcagcaucagcaucc

SEQ ID NO: 2031055 - RNA, 12 nt, Human
guaaaggcaaac

SEQ ID NO: 2031056 - RNA, 16 nt, Human
ggcgggagggcgcggg

SEQ ID NO: 2031057 - RNA, 16 nt, Human
ugcaugguuuagaaag

SEQ ID NO: 2031058 - RNA, 22 nt, Human
aggauggcuaguaucaaaagaa

SEQ ID NO: 2031059 - RNA, 14 nt, Human
aaccagagccugag

SEQ ID NO: 2031060 - RNA, 14 nt, Human
ggacucaccucccc

SEQ ID NO: 2031061 - RNA, 18 nt, Human
gcagugucugcuggagac

SEQ ID NO: 2031062 - RNA, 20 nt, Human
agccgguccuugcugcaccu

SEQ ID NO: 2031063 - RNA, 19 nt, Human
cccugccccccagcccucc

SEQ ID NO: 2031064 - RNA, 22 nt, Human
auaacaaugcuguauuuuaaaa

SEQ ID NO: 2031065 - RNA, 15 nt, Human
cuaagcaaaauguga

SEQ ID NO: 2031066 - RNA, 12 nt, Human
acucccugcccc

SEQ ID NO: 2031067 - RNA, 22 nt, Human
uuguucuugugaacccaaagug

SEQ ID NO: 2031068 - RNA, 22 nt, Human
gcuugcagagaugaggccgcca

SEQ ID NO: 2031069 - RNA, 11 nt, Human
ugcagugagcc

SEQ ID NO: 2031070 - RNA, 15 nt, Human
ccgugggccugagac

SEQ ID NO: 2031071 - RNA, 23 nt, Human
ugaaaugaguuuuucuuuucauu

SEQ ID NO: 2031072 - RNA, 14 nt, Human
accacaagacugca

SEQ ID NO: 2031073 - RNA, 23 nt, Human
uugacccucacaggagcaucucc

SEQ ID NO: 2031074 - RNA, 18 nt, Human
aagggaauuucuucaacu

SEQ ID NO: 2031075 - RNA, 17 nt, Human
gugggauacuauuuaau

SEQ ID NO: 2031076 - RNA, 18 nt, Human
aacugccaucauuuacuu

SEQ ID NO: 2031077 - RNA, 15 nt, Human
uuagugaaauauuau

SEQ ID NO: 2031078 - RNA, 19 nt, Human
uccauccugaggcuccacu

SEQ ID NO: 2031079 - RNA, 15 nt, Human
ggacucaccuccccc

SEQ ID NO: 2031080 - RNA, 23 nt, Human
gaaugagagacacacugaagaag

SEQ ID NO: 2031081 - RNA, 21 nt, Human
uggggaauauguuagagaauu

SEQ ID NO: 2031082 - RNA, 14 nt, Human
gaaaaaauaacaau

SEQ ID NO: 2031083 - RNA, 15 nt, Human
agggaagacaagaag

SEQ ID NO: 2031084 - RNA, 14 nt, Human
ucuuccucccauuc

SEQ ID NO: 2031085 - RNA, 15 nt, Human
cauuuaguuauaaaa

SEQ ID NO: 2031086 - RNA, 16 nt, Human
uagaauauauuuccuu

SEQ ID NO: 2031087 - RNA, 13 nt, Human
gggcggggagcga

SEQ ID NO: 2031088 - RNA, 21 nt, Human
uauacugugugcuaaaacaag

SEQ ID NO: 2031089 - RNA, 18 nt, Human
ugugcuggccaccugcug

SEQ ID NO: 2031090 - RNA, 22 nt, Human
gcuaaaacaagcacuaaacaaa

SEQ ID NO: 2031091 - RNA, 19 nt, Human
aaugagcacgcauggaaaa

SEQ ID NO: 2031092 - RNA, 16 nt, Human
gucucucacuuguuuu

SEQ ID NO: 2031093 - RNA, 21 nt, Human
cuggaaacacauguuccccuu

SEQ ID NO: 2031094 - RNA, 17 nt, Human
gccaugggacagggagg

SEQ ID NO: 2031095 - RNA, 19 nt, Human
guuguauuauuuuuuaaaa

SEQ ID NO: 2031096 - RNA, 23 nt, Human
gccugaguguugccuaauuuguu

SEQ ID NO: 2031097 - RNA, 19 nt, Human
uccccagagcuacaggccc

SEQ ID NO: 2031098 - RNA, 16 nt, Human
auccuccaugaauauc

SEQ ID NO: 2031099 - RNA, 17 nt, Human
agaaaugaaagcaggga

SEQ ID NO: 2031100 - RNA, 12 nt, Human
gacagugaaaga

SEQ ID NO: 2031101 - RNA, 18 nt, Human
aucuacacuccagugaga

SEQ ID NO: 2031102 - RNA, 12 nt, Human
cuaagaagugaa

SEQ ID NO: 2031103 - RNA, 15 nt, Human
ccuguucgcgcgccu

SEQ ID NO: 2031104 - RNA, 21 nt, Human
uccuacaagacacagugacca

SEQ ID NO: 2031105 - RNA, 19 nt, Human
agugaggagcuuugaaacg

SEQ ID NO: 2031106 - RNA, 19 nt, Human
uggaaguaaauguuguuuu

SEQ ID NO: 2031107 - RNA, 20 nt, Human
gggaggcagagguugcagug

SEQ ID NO: 2031108 - RNA, 20 nt, Human
aaagagugaaggauuuaugu

SEQ ID NO: 2031109 - RNA, 23 nt, Human
cuggggcuuuaacuccugcuaga

SEQ ID NO: 2031110 - RNA, 23 nt, Human
cccagcccuccuuaucaaaggac

SEQ ID NO: 2031111 - RNA, 23 nt, Human
auucugagguaaccucauuauca

SEQ ID NO: 2031112 - RNA, 13 nt, Human
cacauuuaaauaa

SEQ ID NO: 2031113 - RNA, 12 nt, Human
uagcauuucucc

SEQ ID NO: 2031114 - RNA, 19 nt, Human
auucuuuacccccugggag

SEQ ID NO: 2031115 - RNA, 16 nt, Human
cacuuuccaauaaaga

SEQ ID NO: 2031116 - RNA, 14 nt, Human
ugcucauggaauug

SEQ ID NO: 2031117 - RNA, 15 nt, Human
uauauauauauauuu

SEQ ID NO: 2031118 - RNA, 21 nt, Human
uucagcucagcuaaugaagug

SEQ ID NO: 2031119 - RNA, 15 nt, Human
aaagaaagaaaauca

SEQ ID NO: 2031120 - RNA, 18 nt, Human
gaugccccgucccccucu

SEQ ID NO: 2031121 - RNA, 12 nt, Human
auaacuggaaac

SEQ ID NO: 2031122 - RNA, 13 nt, Human
aggaaaaaauaac

SEQ ID NO: 2031123 - RNA, 22 nt, Human
auggaaauguuuacagaucccc

SEQ ID NO: 2031124 - RNA, 22 nt, Human
ccagcuggccuugugaggagcu

SEQ ID NO: 2031125 - RNA, 22 nt, Human
cgcgcagcucaggcuggcaccg

SEQ ID NO: 2031126 - RNA, 19 nt, Human
ucaguuauuauauuuacaa

SEQ ID NO: 2031127 - RNA, 18 nt, Human
uaguaucaaaagaaagaa

SEQ ID NO: 2031128 - RNA, 21 nt, Human
cccuauccuacuuccccuucc

SEQ ID NO: 2031129 - RNA, 19 nt, Human
aaauaugccccauucaaca

SEQ ID NO: 2031130 - RNA, 16 nt, Human
agagguccacaacaca

SEQ ID NO: 2031131 - RNA, 16 nt, Human
cuguccauucuuccuc

SEQ ID NO: 2031132 - RNA, 23 nt, Human
ucuaggacugaauuaugaaacuu

SEQ ID NO: 2031133 - RNA, 19 nt, Human
uuuuaucugcuaugcuauu

SEQ ID NO: 2031134 - RNA, 19 nt, Human
agaugcuagaacucccuuu

SEQ ID NO: 2031135 - RNA, 15 nt, Human
agccgggaaagaaga

SEQ ID NO: 2031136 - RNA, 16 nt, Human
ccaccugcugagcccc

SEQ ID NO: 2031137 - RNA, 19 nt, Human
uauguagaauauauuuccu

SEQ ID NO: 2031138 - RNA, 13 nt, Human
agcucugcccauc

SEQ ID NO: 2031139 - RNA, 23 nt, Human
cucagucucccucccuuggggcc

SEQ ID NO: 2031140 - RNA, 15 nt, Human
uccuacaagacacag

SEQ ID NO: 2031141 - RNA, 14 nt, Human
cacuaaacaaagag

SEQ ID NO: 2031142 - RNA, 22 nt, Human
gugugaccacugcagaagacag

SEQ ID NO: 2031143 - RNA, 14 nt, Human
gaggcacagaaacu

SEQ ID NO: 2031144 - RNA, 18 nt, Human
agugucaaugcagccccc

SEQ ID NO: 2031145 - RNA, 18 nt, Human
uuauuacuguaagaaaau

SEQ ID NO: 2031146 - RNA, 22 nt, Human
acauuggaaacaagucagucau

SEQ ID NO: 2031147 - RNA, 18 nt, Human
uguauucuuuuaguuuuu

SEQ ID NO: 2031148 - RNA, 18 nt, Human
aaauggaaguaaauguug

SEQ ID NO: 2031149 - RNA, 23 nt, Human
uugaaguuuuggcaauugacuau

SEQ ID NO: 2031150 - RNA, 19 nt, Human
ccagaucuaugccacaaga

SEQ ID NO: 2031151 - RNA, 21 nt, Human
ccugaucaccugcccugcuga

SEQ ID NO: 2031152 - RNA, 19 nt, Human
uaaccucuaaauucuuuca

SEQ ID NO: 2031153 - RNA, 19 nt, Human
uuccucccuucucuucaca

SEQ ID NO: 2031154 - RNA, 14 nt, Human
agcuggaaacacau

SEQ ID NO: 2031155 - RNA, 22 nt, Human
acagaaaaguugaauuuuacau

SEQ ID NO: 2031156 - RNA, 15 nt, Human
ugcuguauuuuaaaa

SEQ ID NO: 2031157 - RNA, 15 nt, Human
uguuaaaugauuuca

SEQ ID NO: 2031158 - RNA, 13 nt, Human
uuuaaaaaaaaac

SEQ ID NO: 2031159 - RNA, 15 nt, Human
agugacaagcucaca

SEQ ID NO: 2031160 - RNA, 17 nt, Human
gccccccagcccuccuu

SEQ ID NO: 2031161 - RNA, 14 nt, Human
cuaaacauaugaau

SEQ ID NO: 2031162 - RNA, 18 nt, Human
ccaagccuggcaagggaa

SEQ ID NO: 2031163 - RNA, 15 nt, Human
ccuggugggcagaga

SEQ ID NO: 2031164 - RNA, 12 nt, Human
gcccccgggccg

SEQ ID NO: 2031165 - RNA, 14 nt, Human
agcaaguauuagaa

SEQ ID NO: 2031166 - RNA, 13 nt, Human
ccucuggcuccag

SEQ ID NO: 2031167 - RNA, 17 nt, Human
aaaaauccuacuuucau

SEQ ID NO: 2031168 - RNA, 18 nt, Human
uucaauaucuuuuuuuua

SEQ ID NO: 2031169 - RNA, 16 nt, Human
acuuuuauaagaaaua

SEQ ID NO: 2031170 - RNA, 20 nt, Human
cacuagacccacuggacuca

SEQ ID NO: 2031171 - RNA, 21 nt, Human
gccugagaccaaggcccccgg

SEQ ID NO: 2031172 - RNA, 19 nt, Human
auaauuuuuauauuugaaa

SEQ ID NO: 2031173 - RNA, 22 nt, Human
auauaugcuaagucuuauauau

SEQ ID NO: 2031174 - RNA, 21 nt, Human
uuccuaauuccacagcugcuc

SEQ ID NO: 2031175 - RNA, 13 nt, Human
auuuuaaaagaau

SEQ ID NO: 2031176 - RNA, 18 nt, Human
ugaagagugugaggaaaa

SEQ ID NO: 2031177 - RNA, 19 nt, Human
uugugccccugcacuccag

SEQ ID NO: 2031178 - RNA, 16 nt, Human
auaguaccucugcuau

SEQ ID NO: 2031179 - RNA, 20 nt, Human
gaccauacuaauuauacccc

SEQ ID NO: 2031180 - RNA, 13 nt, Human
cugaaauuuccug

SEQ ID NO: 2031181 - RNA, 16 nt, Human
uccucacuuugaagag

SEQ ID NO: 2031182 - RNA, 14 nt, Human
cccggccggcgcgc

SEQ ID NO: 2031183 - RNA, 19 nt, Human
auagugaggagcuuugaaa

SEQ ID NO: 2031184 - RNA, 19 nt, Human
gcugcugguggcgcuggcu

SEQ ID NO: 2031185 - RNA, 20 nt, Human
gcagagaugaggccgccaug

SEQ ID NO: 2031186 - RNA, 21 nt, Human
guauacugugugcuaaaacaa

SEQ ID NO: 2031187 - RNA, 19 nt, Human
uccccuauccuacuucccc

SEQ ID NO: 2031188 - RNA, 18 nt, Human
ccugaggugagcaucauc

SEQ ID NO: 2031189 - RNA, 18 nt, Human
aaaaguucugcagauaaa

SEQ ID NO: 2031190 - RNA, 13 nt, Human
aucucaauauuuc

SEQ ID NO: 2031191 - RNA, 16 nt, Human
acuuguuuuauuuaac

SEQ ID NO: 2031192 - RNA, 16 nt, Human
augcuaagugaaauaa

SEQ ID NO: 2031193 - RNA, 21 nt, Human
aagaaauaggaaauauuuuaa

SEQ ID NO: 2031194 - RNA, 13 nt, Human
ggaaguagaggag

SEQ ID NO: 2031195 - RNA, 11 nt, Human
gagguaaaagc

SEQ ID NO: 2031196 - RNA, 21 nt, Human
cucuucuggguuccuuccucu

SEQ ID NO: 2031197 - RNA, 16 nt, Human
gcagugucugcuggag

SEQ ID NO: 2031198 - RNA, 16 nt, Human
ugacuauuauauuucc

SEQ ID NO: 2031199 - RNA, 17 nt, Human
gcgcccucuggcugcug

SEQ ID NO: 2031200 - RNA, 17 nt, Human
ucagacauagaauuaac

SEQ ID NO: 2031201 - RNA, 14 nt, Human
ggcaccucucuggg

SEQ ID NO: 2031202 - RNA, 15 nt, Human
cuugugaggagcugg

SEQ ID NO: 2031203 - RNA, 19 nt, Human
auuuccuuauucagaauuu

SEQ ID NO: 2031204 - RNA, 21 nt, Human
ccccugcaaagcccagcuuga

SEQ ID NO: 2031205 - RNA, 20 nt, Human
aauuuuuucucuaggaaaua

SEQ ID NO: 2031206 - RNA, 18 nt, Human
ugcuauuuauuaaguauu

SEQ ID NO: 2031207 - RNA, 12 nt, Human
uaccuccaagga

SEQ ID NO: 2031208 - RNA, 22 nt, Human
cgcccacuuccucccggccgcg

SEQ ID NO: 2031209 - RNA, 20 nt, Human
uaauucugguagcuaaauau

SEQ ID NO: 2031210 - RNA, 21 nt, Human
auauuuuuuuuuuuaaaaaaa

SEQ ID NO: 2031211 - RNA, 20 nt, Human
uacaucccuuaccugggaaa

SEQ ID NO: 2031212 - RNA, 18 nt, Human
ggcacagaaacuccuguu

SEQ ID NO: 2031213 - RNA, 15 nt, Human
ucaccagucccuccc

SEQ ID NO: 2031214 - RNA, 18 nt, Human
aaggaugccccguccccc

SEQ ID NO: 2031215 - RNA, 15 nt, Human
uccgcuacuuccagg

SEQ ID NO: 2031216 - RNA, 17 nt, Human
ccugccccccagcccuc

SEQ ID NO: 2031217 - RNA, 14 nt, Human
agcguugagccacc

SEQ ID NO: 2031218 - RNA, 17 nt, Human
auggcuaguaucaaaag

SEQ ID NO: 2031219 - RNA, 21 nt, Human
gcacuguggguagacacacau

SEQ ID NO: 2031220 - RNA, 23 nt, Human
cuuuccaauaaagaguuccuucu

SEQ ID NO: 2031221 - RNA, 19 nt, Human
aaacaaaaggauaaugaau

SEQ ID NO: 2031222 - RNA, 19 nt, Human
aaccgaacugauguaagua

SEQ ID NO: 2031223 - RNA, 19 nt, Human
augugcauauuuuauuaua

SEQ ID NO: 2031224 - RNA, 17 nt, Human
cgauaaaagacagugaa

SEQ ID NO: 2031225 - RNA, 18 nt, Human
gcagcccuuagcccuucc

SEQ ID NO: 2031226 - RNA, 18 nt, Human
aaaaucuuauaauuuaaa

SEQ ID NO: 2031227 - RNA, 15 nt, Human
aauauauuuccuuau

SEQ ID NO: 2031228 - RNA, 23 nt, Human
uuucccaucucagguguguugca

SEQ ID NO: 2031229 - RNA, 16 nt, Human
uaaacuuugauuuuau

SEQ ID NO: 2031230 - RNA, 12 nt, Human
cauaaaguaugu

SEQ ID NO: 2031231 - RNA, 22 nt, Human
gacacaugugcuggccaccugc

SEQ ID NO: 2031232 - RNA, 22 nt, Human
uggcgcuggcugcgcucggccu

SEQ ID NO: 2031233 - RNA, 16 nt, Human
cagggcuacgcgcgcu

SEQ ID NO: 2031234 - RNA, 23 nt, Human
aaccugccagcuggccuugugag

SEQ ID NO: 2031235 - RNA, 22 nt, Human
gauaaaagacagugaaagaaaa

SEQ ID NO: 2031236 - RNA, 22 nt, Human
agacucgggauuaguacacacu

SEQ ID NO: 2031237 - RNA, 19 nt, Human
cuuccuaauuccacagcug

SEQ ID NO: 2031238 - RNA, 15 nt, Human
uaaaagacaaggaaa

SEQ ID NO: 2031239 - RNA, 18 nt, Human
uuuuaaaaaagaaacauu

SEQ ID NO: 2031240 - RNA, 23 nt, Human
uuguaaagguccuggcaaagaug

SEQ ID NO: 2031241 - RNA, 17 nt, Human
uuucauaagaauucugu

SEQ ID NO: 2031242 - RNA, 22 nt, Human
gaauuucuucaacucccugccc

SEQ ID NO: 2031243 - RNA, 21 nt, Human
uguccucaugagggcuggaug

SEQ ID NO: 2031244 - RNA, 12 nt, Human
uauuauuuuuua

SEQ ID NO: 2031245 - RNA, 19 nt, Human
uguggauuuaauguggaaa

SEQ ID NO: 2031246 - RNA, 14 nt, Human
guccauugggcagg

SEQ ID NO: 2031247 - RNA, 14 nt, Human
uauaauuuaaauau

SEQ ID NO: 2031248 - RNA, 22 nt, Human
ucuuccuggauuccucacuuug

SEQ ID NO: 2031249 - RNA, 21 nt, Human
aagacucgggauuaguacaca

SEQ ID NO: 2031250 - RNA, 19 nt, Human
uaucacuugucaauaaaau

SEQ ID NO: 2031251 - RNA, 21 nt, Human
uuucaugcuguucaugaaaga

SEQ ID NO: 2031252 - RNA, 24 nt, Human
aucugguccuaagucccugcugcc

SEQ ID NO: 2031253 - RNA, 18 nt, Human
auagaauuaacacaugau

SEQ ID NO: 2031254 - RNA, 22 nt, Human
uuuauugaggcuuuaaaacuua

SEQ ID NO: 2031255 - RNA, 13 nt, Human
auuggacaguaaa

SEQ ID NO: 2031256 - RNA, 17 nt, Human
uauauuguagauaauac

SEQ ID NO: 2031257 - RNA, 17 nt, Human
ucugguagcuaaauaua

SEQ ID NO: 2031258 - RNA, 15 nt, Human
ccaggcggguccggg

SEQ ID NO: 2031259 - RNA, 18 nt, Human
cuaggcauagcccugccu

SEQ ID NO: 2031260 - RNA, 15 nt, Human
cucccugccccccag

SEQ ID NO: 2031261 - RNA, 20 nt, Human
uguaaagcuuugugcagauu

SEQ ID NO: 2031262 - RNA, 18 nt, Human
uuauuauagucacuaguu

SEQ ID NO: 2031263 - RNA, 21 nt, Human
auaguuguaccgcaaugugac

SEQ ID NO: 2031264 - RNA, 19 nt, Human
uggaaauguuuacagaucc

SEQ ID NO: 2031265 - RNA, 16 nt, Human
uuaaauuguaauaggc

SEQ ID NO: 2031266 - RNA, 14 nt, Human
acccgcccaccgca

SEQ ID NO: 2031267 - RNA, 21 nt, Human
cuugaggcacagaaacuccug

SEQ ID NO: 2031268 - RNA, 13 nt, Human
auguagaauauau

SEQ ID NO: 2031269 - RNA, 22 nt, Human
uuuuauagcuacuaauuuuaaa

SEQ ID NO: 2031270 - RNA, 20 nt, Human
ucugaaaguuuuggaaacgu

SEQ ID NO: 2031271 - RNA, 14 nt, Human
uauuugaaauauug

SEQ ID NO: 2031272 - RNA, 20 nt, Human
aaagacagugaaagaaaaua

SEQ ID NO: 2031273 - RNA, 20 nt, Human
uauacugugugcuaaaacaa

SEQ ID NO: 2031274 - RNA, 13 nt, Human
cgaguacuucccg

SEQ ID NO: 2031275 - RNA, 22 nt, Human
uagacacacaugaaguccaagc

SEQ ID NO: 2031276 - RNA, 13 nt, Human
auugggcaggcag

SEQ ID NO: 2031277 - RNA, 17 nt, Human
cccccugcaaagcccag

SEQ ID NO: 2031278 - RNA, 18 nt, Human
cucuauguucuaagaagu

SEQ ID NO: 2031279 - RNA, 16 nt, Human
gccaaggaagaucccu

SEQ ID NO: 2031280 - RNA, 16 nt, Human
gccuaagugcagcccc

SEQ ID NO: 2031281 - RNA, 15 nt, Human
auccuagucucuauc

SEQ ID NO: 2031282 - RNA, 11 nt, Human
aagucccugcu

SEQ ID NO: 2031283 - RNA, 23 nt, Human
ggaacaguuaccucugccucaga

SEQ ID NO: 2031284 - RNA, 19 nt, Human
acucugucucaguccauga

SEQ ID NO: 2031285 - RNA, 19 nt, Human
acuauuauauuuccaagaa

SEQ ID NO: 2031286 - RNA, 18 nt, Human
uagaauauauuuccuuau

SEQ ID NO: 2031287 - RNA, 23 nt, Human
caccaaggagccaaacauccuac

SEQ ID NO: 2031288 - RNA, 21 nt, Human
auucauagcagcuuauucaca

SEQ ID NO: 2031289 - RNA, 23 nt, Human
aauauuuauuuuaauaauguuuc

SEQ ID NO: 2031290 - RNA, 13 nt, Human
aaaaauccuacuu

SEQ ID NO: 2031291 - RNA, 18 nt, Human
uuuuauaucaauuuaaaa

SEQ ID NO: 2031292 - RNA, 20 nt, Human
ccaacacccugagguugugu

SEQ ID NO: 2031293 - RNA, 12 nt, Human
agacagugaaag

SEQ ID NO: 2031294 - RNA, 21 nt, Human
gaagagccggagccuccagcu

SEQ ID NO: 2031295 - RNA, 18 nt, Human
ucuaugaaauauuauguu

SEQ ID NO: 2031296 - RNA, 15 nt, Human
ccagcacagccucuu

SEQ ID NO: 2031297 - RNA, 14 nt, Human
aaagagaacuucca

SEQ ID NO: 2031298 - RNA, 20 nt, Human
aacagucucuugaggcacag

SEQ ID NO: 2031299 - RNA, 24 nt, Human
uuugugggaaauccacacugagcu

SEQ ID NO: 2031300 - RNA, 18 nt, Human
uguauuauuuuuuaaaaa

SEQ ID NO: 2031301 - RNA, 22 nt, Human
gaugcaguuguugcccacagcu

SEQ ID NO: 2031302 - RNA, 17 nt, Human
accugcugagccccaag

SEQ ID NO: 2031303 - RNA, 15 nt, Human
accucccccaucucu

SEQ ID NO: 2031304 - RNA, 15 nt, Human
acuuuauaaaggauu

SEQ ID NO: 2031305 - RNA, 14 nt, Human
aaaagaaagaaaau

SEQ ID NO: 2031306 - RNA, 15 nt, Human
uuuaauaauuuuuaa

SEQ ID NO: 2031307 - RNA, 14 nt, Human
agaaaugaaagcag

SEQ ID NO: 2031308 - RNA, 19 nt, Human
gacggagccgggaaagaag

SEQ ID NO: 2031309 - RNA, 20 nt, Human
auauuuuauaucaauuuaaa

SEQ ID NO: 2031310 - RNA, 20 nt, Human
auauauuuuuuuuuuuaaaa

SEQ ID NO: 2031311 - RNA, 12 nt, Human
cagugaaagaaa

SEQ ID NO: 2031312 - RNA, 22 nt, Human
ggcugcugguggcgcuggcugc

SEQ ID NO: 2031313 - RNA, 19 nt, Human
uguugaagagguuuuaaag

SEQ ID NO: 2031314 - RNA, 22 nt, Human
agcacagccucuuagaugcagu

SEQ ID NO: 2031315 - RNA, 16 nt, Human
cuuccucccuggaauc

SEQ ID NO: 2031316 - RNA, 12 nt, Human
ggaggcugagau

SEQ ID NO: 2031317 - RNA, 21 nt, Human
uuccuagucuguuuucccucc

SEQ ID NO: 2031318 - RNA, 22 nt, Human
ugauaguuguaccgcaauguga

SEQ ID NO: 2031319 - RNA, 21 nt, Human
aaacaauaacgauaaaagaca

SEQ ID NO: 2031320 - RNA, 16 nt, Human
cuagaacucccuuuca

SEQ ID NO: 2031321 - RNA, 20 nt, Human
uauuuauuacuguaagaaaa

SEQ ID NO: 2031322 - RNA, 14 nt, Human
uuauuauauuuaca

SEQ ID NO: 2031323 - RNA, 22 nt, Human
cccugaauuuaaauagcuuuuu

SEQ ID NO: 2031324 - RNA, 15 nt, Human
aaauauuuauuuuaa

SEQ ID NO: 2031325 - RNA, 14 nt, Human
uuaaacuuugauuu

SEQ ID NO: 2031326 - RNA, 18 nt, Human
auggcuugaguuuaaauu

SEQ ID NO: 2031327 - RNA, 23 nt, Human
ucaaugccccugaauuuaaauag

SEQ ID NO: 2031328 - RNA, 17 nt, Human
gccgcgcugcgcgccgc

SEQ ID NO: 2031329 - RNA, 18 nt, Human
auuuaggccaugggacag

SEQ ID NO: 2031330 - RNA, 20 nt, Human
aguuuuuuuuuaaaaaagaa

SEQ ID NO: 2031331 - RNA, 20 nt, Human
ggccuaugcagagguccaca

SEQ ID NO: 2031332 - RNA, 15 nt, Human
agcuaaauauauauu

SEQ ID NO: 2031333 - RNA, 17 nt, Human
uguaaaggaauuuaaaa

SEQ ID NO: 2031334 - RNA, 21 nt, Human
auggcagcuuuccucaaaacu

SEQ ID NO: 2031335 - RNA, 14 nt, Human
uaaaagacaaggaa

SEQ ID NO: 2031336 - RNA, 14 nt, Human
cggggagcgagccc

SEQ ID NO: 2031337 - RNA, 17 nt, Human
cuccuaagaaggcaccu

SEQ ID NO: 2031338 - RNA, 22 nt, Human
uggguuccuuccucugagccuu

SEQ ID NO: 2031339 - RNA, 13 nt, Human
uuggacgagaaaa

SEQ ID NO: 2031340 - RNA, 15 nt, Human
ccucagucucccucc

SEQ ID NO: 2031341 - RNA, 14 nt, Human
aaauuuaucauuua

SEQ ID NO: 2031342 - RNA, 17 nt, Human
uacaaaugcauuucuaa

SEQ ID NO: 2031343 - RNA, 14 nt, Human
cucuggcuccagcu

SEQ ID NO: 2031344 - RNA, 16 nt, Human
ccucagucucccuccc

SEQ ID NO: 2031345 - RNA, 16 nt, Human
gacuauuauauuucca

SEQ ID NO: 2031346 - RNA, 17 nt, Human
guuuaauaauuuuuaau

SEQ ID NO: 2031347 - RNA, 18 nt, Human
cagagucaagggugugug

SEQ ID NO: 2031348 - RNA, 17 nt, Human
aaauaacaauaaaagac

SEQ ID NO: 2031349 - RNA, 19 nt, Human
ugcacacagcacgggggcc

SEQ ID NO: 2031350 - RNA, 18 nt, Human
cuucucacauuuauauuu

SEQ ID NO: 2031351 - RNA, 15 nt, Human
cgcgcugcgcgccgc

SEQ ID NO: 2031352 - RNA, 13 nt, Human
uccccaaaugcuu

SEQ ID NO: 2031353 - RNA, 14 nt, Human
cccugaggugagca

SEQ ID NO: 2031354 - RNA, 13 nt, Human
gcggccuggucua

SEQ ID NO: 2031355 - RNA, 15 nt, Human
acaaggaaaaaauaa

SEQ ID NO: 2031356 - RNA, 16 nt, Human
gucuucaggggccaca

SEQ ID NO: 2031357 - RNA, 16 nt, Human
ccuagucucuaucauu

SEQ ID NO: 2031358 - RNA, 13 nt, Human
gguccacaacaca

SEQ ID NO: 2031359 - RNA, 20 nt, Human
uguaagaaaauaucacuugu

SEQ ID NO: 2031360 - RNA, 23 nt, Human
aacuuguaaaggaauuuaaaaau

SEQ ID NO: 2031361 - RNA, 22 nt, Human
gacucaccucccccaucucuuc

SEQ ID NO: 2031362 - RNA, 21 nt, Human
ucaagucuuucacauuuaaau

SEQ ID NO: 2031363 - RNA, 22 nt, Human
uuaccucugccucagaaaacaa

SEQ ID NO: 2031364 - RNA, 14 nt, Human
auaaauaaaaauaa

SEQ ID NO: 2031365 - RNA, 14 nt, Human
aaauauaaauaaaa

SEQ ID NO: 2031366 - RNA, 15 nt, Human
agaaaacaauaacga

SEQ ID NO: 2031367 - RNA, 17 nt, Human
ugaaauaagccagacau

SEQ ID NO: 2031368 - RNA, 17 nt, Human
cccaucucagguguguu

SEQ ID NO: 2031369 - RNA, 13 nt, Human
aggcauagcccug

SEQ ID NO: 2031370 - RNA, 16 nt, Human
acaccaaccuucugag

SEQ ID NO: 2031371 - RNA, 18 nt, Human
uaauuagcauggccacau

SEQ ID NO: 2031372 - RNA, 23 nt, Human
cuggccgggagccugaucaccug

SEQ ID NO: 2031373 - RNA, 12 nt, Human
ugacauuagaug

SEQ ID NO: 2031374 - RNA, 16 nt, Human
gacauugaggcaggca

SEQ ID NO: 2031375 - RNA, 19 nt, Human
gaaggcaccucucuggguu

SEQ ID NO: 2031376 - RNA, 23 nt, Human
uguggaaggugaucuggcucugg

SEQ ID NO: 2031377 - RNA, 17 nt, Human
gaagaccucauuuugaa

SEQ ID NO: 2031378 - RNA, 18 nt, Human
uaucaaaagaaagaaaau

SEQ ID NO: 2031379 - RNA, 15 nt, Human
ucuugaggcacagaa

SEQ ID NO: 2031380 - RNA, 19 nt, Human
uauuuaaccucuaaauucu

SEQ ID NO: 2031381 - RNA, 22 nt, Human
cugccaaaacaucaaccugcca

SEQ ID NO: 2031382 - RNA, 20 nt, Human
cuggccuucggccuccaucc

SEQ ID NO: 2031383 - RNA, 22 nt, Human
gaugcaguucugaagaagaugg

SEQ ID NO: 2031384 - RNA, 15 nt, Human
uaauuugguuuucac

SEQ ID NO: 2031385 - RNA, 22 nt, Human
cugcucaauaaaguacaagagc

SEQ ID NO: 2031386 - RNA, 12 nt, Human
gguuuauauaag

SEQ ID NO: 2031387 - RNA, 13 nt, Human
auugaggcaggca

SEQ ID NO: 2031388 - RNA, 21 nt, Human
aucuuguaaagguccuggcaa

SEQ ID NO: 2031389 - RNA, 18 nt, Human
cggagccuccagcugccc

SEQ ID NO: 2031390 - RNA, 19 nt, Human
agagaacagggcugaagcu

SEQ ID NO: 2031391 - RNA, 21 nt, Human
ccauaccccuggccaaggaag

SEQ ID NO: 2031392 - RNA, 18 nt, Human
gagccgguccuugcugca

SEQ ID NO: 2031393 - RNA, 23 nt, Human
cuaguaauuggaaaggcagcucu

SEQ ID NO: 2031394 - RNA, 23 nt, Human
ggucucagugucaaugcagcccc

SEQ ID NO: 2031395 - RNA, 20 nt, Human
aggcugagaugggagaauca

SEQ ID NO: 2031396 - RNA, 15 nt, Human
aucuuauaauuuaaa

SEQ ID NO: 2031397 - RNA, 22 nt, Human
ucuagcaugucgucaaagcuga

SEQ ID NO: 2031398 - RNA, 17 nt, Human
uaugugcauauuuuauu

SEQ ID NO: 2031399 - RNA, 15 nt, Human
ucuuauaauuuaaaa

SEQ ID NO: 2031400 - RNA, 12 nt, Human
gaaggggcggcg

SEQ ID NO: 2031401 - RNA, 11 nt, Human
auaauuuaaau

SEQ ID NO: 2031402 - RNA, 23 nt, Human
auuccugacugcuaguuuauaua

SEQ ID NO: 2031403 - RNA, 14 nt, Human
agacaucaacagau

SEQ ID NO: 2031404 - RNA, 21 nt, Human
gaaagcagggacuugaaccca

SEQ ID NO: 2031405 - RNA, 21 nt, Human
caagacccaaaaggcagaagc

SEQ ID NO: 2031406 - RNA, 17 nt, Human
uagaagucacauuccug

SEQ ID NO: 2031407 - RNA, 19 nt, Human
ucuugugaacccaaagugu

SEQ ID NO: 2031408 - RNA, 18 nt, Human
gcaaagcccagcuugaaa

SEQ ID NO: 2031409 - RNA, 22 nt, Human
auuuucuucucacauuuauauu

SEQ ID NO: 2031410 - RNA, 12 nt, Human
gcugaugcaguu

SEQ ID NO: 2031411 - RNA, 17 nt, Human
ugcacaucaaaauaugc

SEQ ID NO: 2031412 - RNA, 18 nt, Human
agucuucagcagagaagu

SEQ ID NO: 2031413 - RNA, 12 nt, Human
gcucagcccugg

SEQ ID NO: 2031414 - RNA, 16 nt, Human
ccugagcgacagugag

SEQ ID NO: 2031415 - RNA, 16 nt, Human
gcugcugguggcgcug

SEQ ID NO: 2031416 - RNA, 16 nt, Human
uggcaauugacuauag

SEQ ID NO: 2031417 - RNA, 18 nt, Human
guuaguauuguccagguc

SEQ ID NO: 2031418 - RNA, 12 nt, Human
cacaacacacag

SEQ ID NO: 2031419 - RNA, 18 nt, Human
guuucaaacauauauaac

SEQ ID NO: 2031420 - RNA, 19 nt, Human
agaguuuagcuggaaaagu

SEQ ID NO: 2031421 - RNA, 16 nt, Human
cuucggccuccauccu

SEQ ID NO: 2031422 - RNA, 22 nt, Human
aaaugauguuucauaagaauuc

SEQ ID NO: 2031423 - RNA, 13 nt, Human
uaacaauaaaaga

SEQ ID NO: 2031424 - RNA, 20 nt, Human
aucauuuaguuauaaaaaua

SEQ ID NO: 2031425 - RNA, 20 nt, Human
aauucuugccaaauauaaau

SEQ ID NO: 2031426 - RNA, 17 nt, Human
acuguccauucuuccuc

SEQ ID NO: 2031427 - RNA, 23 nt, Human
ggcugcgcucggccugcucgccc

SEQ ID NO: 2031428 - RNA, 20 nt, Human
accuacacgagauacagaau

SEQ ID NO: 2031429 - RNA, 20 nt, Human
ugguuguauuauuuuuuaaa

SEQ ID NO: 2031430 - RNA, 19 nt, Human
auccuacaagacacaguga

SEQ ID NO: 2031431 - RNA, 14 nt, Human
auuguccaggucua

SEQ ID NO: 2031432 - RNA, 21 nt, Human
ugagaaggcuguggauuuaau

SEQ ID NO: 2031433 - RNA, 15 nt, Human
caaauccaaugaaau

SEQ ID NO: 2031434 - RNA, 14 nt, Human
cagauccuggaaau

SEQ ID NO: 2031435 - RNA, 17 nt, Human
uuucccuccuuggagac

SEQ ID NO: 2031436 - RNA, 12 nt, Human
acacuuaaaaau

SEQ ID NO: 2031437 - RNA, 12 nt, Human
uuuuuucugaaa

SEQ ID NO: 2031438 - RNA, 23 nt, Human
aaagaugaucaguaugaaaaugu

SEQ ID NO: 2031439 - RNA, 21 nt, Human
cuucucacauuuauauuuuug

SEQ ID NO: 2031440 - RNA, 22 nt, Human
gcccacggcuggagcugccucu

SEQ ID NO: 2031441 - RNA, 15 nt, Human
ucccccaucucuucu

SEQ ID NO: 2031442 - RNA, 15 nt, Human
auuuuaaaagaauga

SEQ ID NO: 2031443 - RNA, 22 nt, Human
aaugauguuucauaagaauucu

SEQ ID NO: 2031444 - RNA, 13 nt, Human
cuucucaacucca

SEQ ID NO: 2031445 - RNA, 18 nt, Human
augggggcagcaccuccu

SEQ ID NO: 2031446 - RNA, 11 nt, Human
ugggggcagca

SEQ ID NO: 2031447 - RNA, 16 nt, Human
aggguguguaaguaga

SEQ ID NO: 2031448 - RNA, 16 nt, Human
uccuagucucuaucau

SEQ ID NO: 2031449 - RNA, 16 nt, Human
ccuaugcagaggucca

SEQ ID NO: 2031450 - RNA, 16 nt, Human
ccacaagaacccccuu

SEQ ID NO: 2031451 - RNA, 23 nt, Human
uuuauuaggaguaccauaauucu

SEQ ID NO: 2031452 - RNA, 21 nt, Human
gccggcgcgcucaucccaccc

SEQ ID NO: 2031453 - RNA, 14 nt, Human
aauggcuaagcaaa

SEQ ID NO: 2031454 - RNA, 22 nt, Human
ugucucuacuaaaaauacaaaa

SEQ ID NO: 2031455 - RNA, 17 nt, Human
auaauuuaaauauaugc

SEQ ID NO: 2031456 - RNA, 13 nt, Human
cucaccuccccca

SEQ ID NO: 2031457 - RNA, 15 nt, Human
aaauauaaauaaaaa

SEQ ID NO: 2031458 - RNA, 19 nt, Human
augcagagguccacaacac

SEQ ID NO: 2031459 - RNA, 18 nt, Human
gagucccaggcugagccu

SEQ ID NO: 2031460 - RNA, 16 nt, Human
ggaugccccguccccc

SEQ ID NO: 2031461 - RNA, 17 nt, Human
ugucuucaggggccaca

SEQ ID NO: 2031462 - RNA, 16 nt, Human
aaaauccauacauuug

SEQ ID NO: 2031463 - RNA, 15 nt, Human
ugggacagggaggac

SEQ ID NO: 2031464 - RNA, 14 nt, Human
aaucucaauauuuc

SEQ ID NO: 2031465 - RNA, 14 nt, Human
gcugguggcucugu

SEQ ID NO: 2031466 - RNA, 20 nt, Human
uagaugcaguucugaagaag

SEQ ID NO: 2031467 - RNA, 14 nt, Human
uggacucaccuccc

SEQ ID NO: 2031468 - RNA, 15 nt, Human
cuguaaaauaauaac

SEQ ID NO: 2031469 - RNA, 20 nt, Human
acuccagugagacagcucug

SEQ ID NO: 2031470 - RNA, 13 nt, Human
uuauguuuaauuc

SEQ ID NO: 2031471 - RNA, 22 nt, Human
auucugagguaaccucauuauc

SEQ ID NO: 2031472 - RNA, 18 nt, Human
uguacuuuauuuucuaua

SEQ ID NO: 2031473 - RNA, 16 nt, Human
cuaguuuauauagaaa

SEQ ID NO: 2031474 - RNA, 19 nt, Human
gucaaucagccuaguugau

SEQ ID NO: 2031475 - RNA, 15 nt, Human
auuuuacauggcugg

SEQ ID NO: 2031476 - RNA, 15 nt, Human
cagcgaguacuuccc

SEQ ID NO: 2031477 - RNA, 19 nt, Human
uauauuuuugugauuuugu

SEQ ID NO: 2031478 - RNA, 19 nt, Human
ggcgggagggcgcggggcg

SEQ ID NO: 2031479 - RNA, 23 nt, Human
gaccccugagcuugcagagauga

SEQ ID NO: 2031480 - RNA, 22 nt, Human
aucuucacuuuuauaagaaaua

SEQ ID NO: 2031481 - RNA, 19 nt, Human
cggggcggggagcgagccc

SEQ ID NO: 2031482 - RNA, 16 nt, Human
cugagccucagucucc

SEQ ID NO: 2031483 - RNA, 17 nt, Human
auuuaguuauaaaaaua

SEQ ID NO: 2031484 - RNA, 15 nt, Human
uauaauuuaaauaua

SEQ ID NO: 2031485 - RNA, 14 nt, Human
ccgcuuaagcuuuc

SEQ ID NO: 2031486 - RNA, 21 nt, Human
gggagccugaucaccugcccu

SEQ ID NO: 2031487 - RNA, 17 nt, Human
ccucuggcuccagcugg

SEQ ID NO: 2031488 - RNA, 16 nt, Human
caauguucccccucuc

SEQ ID NO: 2031489 - RNA, 21 nt, Human
aaugaauggcuaagcaaaaug

SEQ ID NO: 2031490 - RNA, 23 nt, Human
auguuaaaacugggacaggggag

SEQ ID NO: 2031491 - RNA, 15 nt, Human
ucuggcuccagcugg

SEQ ID NO: 2031492 - RNA, 13 nt, Human
aagacagugaaag

SEQ ID NO: 2031493 - RNA, 18 nt, Human
acauguuacaacacggac

SEQ ID NO: 2031494 - RNA, 18 nt, Human
cuggggcuuuaacuccug

SEQ ID NO: 2031495 - RNA, 15 nt, Human
ccggggaggggcgcu

SEQ ID NO: 2031496 - RNA, 20 nt, Human
acuagaguuuagcuggaaaa

SEQ ID NO: 2031497 - RNA, 16 nt, Human
gaauauaaauuuauca

SEQ ID NO: 2031498 - RNA, 14 nt, Human
auuuaauuauuuca

SEQ ID NO: 2031499 - RNA, 22 nt, Human
accaaucaugaauuaguuuuau

SEQ ID NO: 2031500 - RNA, 21 nt, Human
gcauggccacaucugagcccc

SEQ ID NO: 2031501 - RNA, 23 nt, Human
gcuguggauuuaauguggaaaug

SEQ ID NO: 2031502 - RNA, 22 nt, Human
aagucccugcugcccuuccccu

SEQ ID NO: 2031503 - RNA, 19 nt, Human
cucaagcuaugugagcuca

SEQ ID NO: 2031504 - RNA, 20 nt, Human
uggaauaauccuaaacauau

SEQ ID NO: 2031505 - RNA, 14 nt, Human
ucaacucauauuuu

SEQ ID NO: 2031506 - RNA, 15 nt, Human
auuauuuuuuaaaaa

SEQ ID NO: 2031507 - RNA, 17 nt, Human
agauagaugaagaagcu

SEQ ID NO: 2031508 - RNA, 17 nt, Human
agcuggaaacacauguu

SEQ ID NO: 2031509 - RNA, 23 nt, Human
agcucugcccauccugccccuga

SEQ ID NO: 2031510 - RNA, 19 nt, Human
gagccucagucucccuccc

SEQ ID NO: 2031511 - RNA, 15 nt, Human
aggaacuggugucuu

SEQ ID NO: 2031512 - RNA, 17 nt, Human
gcucggccugcucgccc

SEQ ID NO: 2031513 - RNA, 18 nt, Human
uaaauugacacuuaaaaa

SEQ ID NO: 2031514 - RNA, 18 nt, Human
uuugaagcacagugauca

SEQ ID NO: 2031515 - RNA, 16 nt, Human
cauagaaguaaaaaca

SEQ ID NO: 2031516 - RNA, 13 nt, Human
cauggaaaaguuu

SEQ ID NO: 2031517 - RNA, 15 nt, Human
aaacauaugaauuau

SEQ ID NO: 2031518 - RNA, 18 nt, Human
uaaaagacaaggaaaaaa

SEQ ID NO: 2031519 - RNA, 13 nt, Human
gauuguaaaaugg

SEQ ID NO: 2031520 - RNA, 18 nt, Human
acuuuaugcuaagugaaa

SEQ ID NO: 2031521 - RNA, 17 nt, Human
cugugcggccuggucua

SEQ ID NO: 2031522 - RNA, 20 nt, Human
ucacaugaacuuguaaagga

SEQ ID NO: 2031523 - RNA, 20 nt, Human
ucaauaaaauccauacauuu

SEQ ID NO: 2031524 - RNA, 17 nt, Human
uuucacauuuaaauaaa

SEQ ID NO: 2031525 - RNA, 23 nt, Human
cucuugaggcacagaaacuccug

SEQ ID NO: 2031526 - RNA, 15 nt, Human
ugccccgucccccuc

SEQ ID NO: 2031527 - RNA, 13 nt, Human
ccugagcuugcag

SEQ ID NO: 2031528 - RNA, 23 nt, Human
ggaugaauuaaguuuuuuuuuaa

SEQ ID NO: 2031529 - RNA, 11 nt, Human
ccugagcccca

SEQ ID NO: 2031530 - RNA, 15 nt, Human
agccugaaagaggaa

SEQ ID NO: 2031531 - RNA, 19 nt, Human
uaccccuggccaaggaaga

SEQ ID NO: 2031532 - RNA, 19 nt, Human
caggcagauguuccuaaua

SEQ ID NO: 2031533 - RNA, 15 nt, Human
gccuaagugcagccc

SEQ ID NO: 2031534 - RNA, 19 nt, Human
ccaaggcccccgggccgac

SEQ ID NO: 2031535 - RNA, 15 nt, Human
ggccuucggccucca

SEQ ID NO: 2031536 - RNA, 15 nt, Human
cugcacuccagccug

SEQ ID NO: 2031537 - RNA, 14 nt, Human
ccucggacggcucc

SEQ ID NO: 2031538 - RNA, 16 nt, Human
agugaaggauuuaugu

SEQ ID NO: 2031539 - RNA, 17 nt, Human
cuuccucugagccuugg

SEQ ID NO: 2031540 - RNA, 15 nt, Human
cucauccacuuucca

SEQ ID NO: 2031541 - RNA, 19 nt, Human
uuaaauggaaguaaauguu

SEQ ID NO: 2031542 - RNA, 13 nt, Human
gagccuccagcug

SEQ ID NO: 2031543 - RNA, 15 nt, Human
gaauaaccaacaccc

SEQ ID NO: 2031544 - RNA, 15 nt, Human
gcagcucaggcuggc

SEQ ID NO: 2031545 - RNA, 21 nt, Human
agucacuaguuguaauuuuuu

SEQ ID NO: 2031546 - RNA, 20 nt, Human
auuuccuuauucagaauuuc

SEQ ID NO: 2031547 - RNA, 15 nt, Human
gcccugugcggccug

SEQ ID NO: 2031548 - RNA, 15 nt, Human
ccgucccccucuggc

SEQ ID NO: 2031549 - RNA, 15 nt, Human
aucaguaugaaaaug

SEQ ID NO: 2031550 - RNA, 13 nt, Human
agacagcucugca

SEQ ID NO: 2031551 - RNA, 12 nt, Human
cucuaucauuaa

SEQ ID NO: 2031552 - RNA, 16 nt, Human
uccugcaauuccacuu

SEQ ID NO: 2031553 - RNA, 15 nt, Human
cucguggaacaguua

SEQ ID NO: 2031554 - RNA, 14 nt, Human
caguucugaagaag

SEQ ID NO: 2031555 - RNA, 18 nt, Human
ccgggccgacggagccgg

SEQ ID NO: 2031556 - RNA, 20 nt, Human
gaagagccggagccuccagc

SEQ ID NO: 2031557 - RNA, 16 nt, Human
ccuccuuaucaaagga

SEQ ID NO: 2031558 - RNA, 14 nt, Human
uaacuaauuuuaac

SEQ ID NO: 2031559 - RNA, 18 nt, Human
acaaaugcauuucuaaag

SEQ ID NO: 2031560 - RNA, 17 nt, Human
aaucuuucacaggggac

SEQ ID NO: 2031561 - RNA, 18 nt, Human
gaaacaaaaggauaauga

SEQ ID NO: 2031562 - RNA, 19 nt, Human
cgcccacuagacccacugg

SEQ ID NO: 2031563 - RNA, 23 nt, Human
aaauuuacagagacagaaagcag

SEQ ID NO: 2031564 - RNA, 12 nt, Human
uauucacaagac

SEQ ID NO: 2031565 - RNA, 22 nt, Human
gaaauaagccagacaucaacag

SEQ ID NO: 2031566 - RNA, 19 nt, Human
caaguaaaaggaaaugcuc

SEQ ID NO: 2031567 - RNA, 21 nt, Human
acagcccuucuuuccacagaa

SEQ ID NO: 2031568 - RNA, 14 nt, Human
uuucuaugaaauau

SEQ ID NO: 2031569 - RNA, 14 nt, Human
aaaacuucagacau

SEQ ID NO: 2031570 - RNA, 12 nt, Human
aauuuaaauaua

SEQ ID NO: 2031571 - RNA, 17 nt, Human
agucccaggcugagccu

SEQ ID NO: 2031572 - RNA, 16 nt, Human
aguaaaggcaaacuua

SEQ ID NO: 2031573 - RNA, 16 nt, Human
cugcgcgccgcgcucc

SEQ ID NO: 2031574 - RNA, 14 nt, Human
caucaucuucuggg

SEQ ID NO: 2031575 - RNA, 19 nt, Human
ugaaaccaaaccagagccu

SEQ ID NO: 2031576 - RNA, 23 nt, Human
ugaauuacauuuguauaaaauaa

SEQ ID NO: 2031577 - RNA, 12 nt, Human
cgcgccuccgcu

SEQ ID NO: 2031578 - RNA, 14 nt, Human
agcucaccaguccc

SEQ ID NO: 2031579 - RNA, 15 nt, Human
gacaguauggcagcu

SEQ ID NO: 2031580 - RNA, 16 nt, Human
ucagucucccucccuu

SEQ ID NO: 2031581 - RNA, 18 nt, Human
ugcucgcccacuuccucc

SEQ ID NO: 2031582 - RNA, 13 nt, Human
cagcucaggcugg

SEQ ID NO: 2031583 - RNA, 15 nt, Human
cgcccacuuccuccc

SEQ ID NO: 2031584 - RNA, 18 nt, Human
uacauaaaguaugugcau

SEQ ID NO: 2031585 - RNA, 15 nt, Human
cacuuggucugugag

SEQ ID NO: 2031586 - RNA, 18 nt, Human
gaggcuccacuuggucug

SEQ ID NO: 2031587 - RNA, 15 nt, Human
gugaacuugguuuua

SEQ ID NO: 2031588 - RNA, 13 nt, Human
guaacuaauuuua

SEQ ID NO: 2031589 - RNA, 22 nt, Human
ccgggagccugaucaccugccc

SEQ ID NO: 2031590 - RNA, 16 nt, Human
ggcagagagguaggga

SEQ ID NO: 2031591 - RNA, 12 nt, Human
cucccugccccc

SEQ ID NO: 2031592 - RNA, 18 nt, Human
acaaauccaaugaaauga

SEQ ID NO: 2031593 - RNA, 18 nt, Human
auagcuacuaauuuuaaa

SEQ ID NO: 2031594 - RNA, 17 nt, Human
cuggcugcgcucggccu

SEQ ID NO: 2031595 - RNA, 21 nt, Human
gacugcuaguuuauauagaaa

SEQ ID NO: 2031596 - RNA, 20 nt, Human
gaaacauuugguaaggggaa

SEQ ID NO: 2031597 - RNA, 15 nt, Human
auuucuaugaaauau

SEQ ID NO: 2031598 - RNA, 20 nt, Human
auaagccagacaucaacaga

SEQ ID NO: 2031599 - RNA, 22 nt, Human
ugguuguauuauuuuuuaaaaa

SEQ ID NO: 2031600 - RNA, 22 nt, Human
agaauuugauaugugaacaguu

SEQ ID NO: 2031601 - RNA, 23 nt, Human
ucuuagaugcaguucugaagaag

SEQ ID NO: 2031602 - RNA, 23 nt, Human
gcugccccggggaggggcgcucg

SEQ ID NO: 2031603 - RNA, 21 nt, Human
uauaagaaauaggaaauauuu

SEQ ID NO: 2031604 - RNA, 17 nt, Human
caucgcagacacaugug

SEQ ID NO: 2031605 - RNA, 17 nt, Human
cugaucaccugcccugc

SEQ ID NO: 2031606 - RNA, 18 nt, Human
aggcauagcccugccuca

SEQ ID NO: 2031607 - RNA, 17 nt, Human
acaaaugcauuucuaaa

SEQ ID NO: 2031608 - RNA, 19 nt, Human
guaaagcuuugugcagauu

SEQ ID NO: 2031609 - RNA, 15 nt, Human
augauaacuggaaac

SEQ ID NO: 2031610 - RNA, 15 nt, Human
cugcccuuccccuuc

SEQ ID NO: 2031611 - RNA, 15 nt, Human
aaacaauuugaauau

SEQ ID NO: 2031612 - RNA, 16 nt, Human
acaugugcuggccacc

SEQ ID NO: 2031613 - RNA, 16 nt, Human
agugucaaugcagccc

SEQ ID NO: 2031614 - RNA, 21 nt, Human
cccuagaaagccaugugcagc

SEQ ID NO: 2031615 - RNA, 13 nt, Human
agaauauauuucc

SEQ ID NO: 2031616 - RNA, 24 nt, Human
cuggcuaauuagcauggccacauc

SEQ ID NO: 2031617 - RNA, 23 nt, Human
cuuaagaagacugcauuauauuu

SEQ ID NO: 2031618 - RNA, 16 nt, Human
ccacuuggucugugag

SEQ ID NO: 2031619 - RNA, 16 nt, Human
cuuuuaguuuuuaaag

SEQ ID NO: 2031620 - RNA, 23 nt, Human
aucaccaaggcugauuaaaccaa

SEQ ID NO: 2031621 - RNA, 17 nt, Human
cggcccugugcggccug

SEQ ID NO: 2031622 - RNA, 14 nt, Human
auuuaaauauaugc

SEQ ID NO: 2031623 - RNA, 15 nt, Human
uauuuucaugcuguu

SEQ ID NO: 2031624 - RNA, 17 nt, Human
gcaccugugccgucccc

SEQ ID NO: 2031625 - RNA, 21 nt, Human
uuuuauggcacuaguauuucu

SEQ ID NO: 2031626 - RNA, 16 nt, Human
ucuuggggaauauguu

SEQ ID NO: 2031627 - RNA, 14 nt, Human
uaaauaguuuauga

SEQ ID NO: 2031628 - RNA, 20 nt, Human
cagucccuccccaaaugcuu

SEQ ID NO: 2031629 - RNA, 15 nt, Human
aaauguauucuuuua

SEQ ID NO: 2031630 - RNA, 16 nt, Human
gacaagcucacagacc

SEQ ID NO: 2031631 - RNA, 16 nt, Human
aaauauuccuuaagau

SEQ ID NO: 2031632 - RNA, 20 nt, Human
aagucacauuccugaacagg

SEQ ID NO: 2031633 - RNA, 18 nt, Human
auuauuuuuuaaaaaaau

SEQ ID NO: 2031634 - RNA, 19 nt, Human
ggagccuccagcugccccg

SEQ ID NO: 2031635 - RNA, 17 nt, Human
augccccgucccccucu

SEQ ID NO: 2031636 - RNA, 14 nt, Human
cucgcccacuuccu

SEQ ID NO: 2031637 - RNA, 19 nt, Human
gccugaucaccugcccugc

SEQ ID NO: 2031638 - RNA, 21 nt, Human
caccagucugacuguuuccau

SEQ ID NO: 2031639 - RNA, 23 nt, Human
gaaaaaguucugcagauaaacag

SEQ ID NO: 2031640 - RNA, 12 nt, Human
cugaggagcugu

SEQ ID NO: 2031641 - RNA, 16 nt, Human
agguugcagugagccg

SEQ ID NO: 2031642 - RNA, 15 nt, Human
cgcucggccugcucg

SEQ ID NO: 2031643 - RNA, 23 nt, Human
auuuaaauagcuuuuuucucuga

SEQ ID NO: 2031644 - RNA, 13 nt, Human
cgcgcugcgcgcc

SEQ ID NO: 2031645 - RNA, 17 nt, Human
augcccacggcuggagc

SEQ ID NO: 2031646 - RNA, 13 nt, Human
cagaaacuccugu

SEQ ID NO: 2031647 - RNA, 14 nt, Human
aucaguuauuuuua

SEQ ID NO: 2031648 - RNA, 16 nt, Human
ccuaagugcagccccg

SEQ ID NO: 2031649 - RNA, 17 nt, Human
augcuguucaugaaaga

SEQ ID NO: 2031650 - RNA, 12 nt, Human
uaguuuuuaaag

SEQ ID NO: 2031651 - RNA, 17 nt, Human
augaucaguaugaaaau

SEQ ID NO: 2031652 - RNA, 12 nt, Human
gacgagaaaaca

SEQ ID NO: 2031653 - RNA, 14 nt, Human
agaugcuagaacuc

SEQ ID NO: 2031654 - RNA, 19 nt, Human
agucaaauugugugaaagg

SEQ ID NO: 2031655 - RNA, 15 nt, Human
aagccuggcaaggga

SEQ ID NO: 2031656 - RNA, 16 nt, Human
auugucuagugaaacu

SEQ ID NO: 2031657 - RNA, 13 nt, Human
uauauuuuagaua

SEQ ID NO: 2031658 - RNA, 23 nt, Human
uaacgauaaaagacagugaaaga

SEQ ID NO: 2031659 - RNA, 21 nt, Human
cuggccaccugcugagcccca

SEQ ID NO: 2031660 - RNA, 19 nt, Human
uauuuuaauaauguuucaa

SEQ ID NO: 2031661 - RNA, 19 nt, Human
uuaauuugguuuucacauu

SEQ ID NO: 2031662 - RNA, 21 nt, Human
aggguuaugauuaaguaauga

SEQ ID NO: 2031663 - RNA, 17 nt, Human
ucaaguuauuuuuaauu

SEQ ID NO: 2031664 - RNA, 13 nt, Human
acaagaaaugaaa

SEQ ID NO: 2031665 - RNA, 20 nt, Human
gccgggcgugguggugagug

SEQ ID NO: 2031666 - RNA, 19 nt, Human
cuagaguuuagcuggaaaa

SEQ ID NO: 2031667 - RNA, 16 nt, Human
uauucagaauuucuaa

SEQ ID NO: 2031668 - RNA, 18 nt, Human
aguauuuuguuucagugc

SEQ ID NO: 2031669 - RNA, 15 nt, Human
auauuuuuuguuaaa

SEQ ID NO: 2031670 - RNA, 17 nt, Human
ccccugaauuuaaauag

SEQ ID NO: 2031671 - RNA, 16 nt, Human
cuaaauucuuucauuu

SEQ ID NO: 2031672 - RNA, 19 nt, Human
caagaaggaaagauuuugu

SEQ ID NO: 2031673 - RNA, 13 nt, Human
cucagaaaacaag

SEQ ID NO: 2031674 - RNA, 17 nt, Human
caaccuucugaggagcu

SEQ ID NO: 2031675 - RNA, 21 nt, Human
augugcauauuuuauuauagu

SEQ ID NO: 2031676 - RNA, 17 nt, Human
auuuucuauaauuuaaa

SEQ ID NO: 2031677 - RNA, 17 nt, Human
gcagcauuguuggcugu

SEQ ID NO: 2031678 - RNA, 15 nt, Human
ccugcaaagcccagc

SEQ ID NO: 2031679 - RNA, 20 nt, Human
aaacuuuaugcuaagugaaa

SEQ ID NO: 2031680 - RNA, 14 nt, Human
cggggaggggcgcu

SEQ ID NO: 2031681 - RNA, 22 nt, Human
uuuauagcuacuaauuuuaaaa

SEQ ID NO: 2031682 - RNA, 23 nt, Human
gcuuuggucuaucuuugagcgcc

SEQ ID NO: 2031683 - RNA, 14 nt, Human
auccuugaagauuu

SEQ ID NO: 2031684 - RNA, 22 nt, Human
aucaccaaggcugauuaaacca

SEQ ID NO: 2031685 - RNA, 21 nt, Human
cugcccugcugagucccaggc

SEQ ID NO: 2031686 - RNA, 20 nt, Human
aaugaauacuuuauaaagga

SEQ ID NO: 2031687 - RNA, 20 nt, Human
uaagugaaauaagccagaca

SEQ ID NO: 2031688 - RNA, 16 nt, Human
aggacugaauuaugaa

SEQ ID NO: 2031689 - RNA, 23 nt, Human
ucuaccaaaaaucucaauauuuc

SEQ ID NO: 2031690 - RNA, 12 nt, Human
acaagaaaugaa

SEQ ID NO: 2031691 - RNA, 17 nt, Human
auguuucauaagaauuc

SEQ ID NO: 2031692 - RNA, 23 nt, Human
aaguauccuucagccugaaagag

SEQ ID NO: 2031693 - RNA, 21 nt, Human
accagagccugaguguugccu

SEQ ID NO: 2031694 - RNA, 21 nt, Human
aaagaaaauaacgauaaaaga

SEQ ID NO: 2031695 - RNA, 14 nt, Human
cugcugagucccag

SEQ ID NO: 2031696 - RNA, 20 nt, Human
accucugccucagaaaacaa

SEQ ID NO: 2031697 - RNA, 15 nt, Human
ugcagccaccagucc

SEQ ID NO: 2031698 - RNA, 17 nt, Human
gccuccuuuuaaaguaa

SEQ ID NO: 2031699 - RNA, 17 nt, Human
ucuauaauguguucauu

SEQ ID NO: 2031700 - RNA, 17 nt, Human
aucauuuacuuuuaaac

SEQ ID NO: 2031701 - RNA, 22 nt, Human
gcacagccucuuagaugcaguu

SEQ ID NO: 2031702 - RNA, 21 nt, Human
agucaagggugugugcagcau

SEQ ID NO: 2031703 - RNA, 19 nt, Human
auuguaggugacuauuaua

SEQ ID NO: 2031704 - RNA, 20 nt, Human
aauaucuuuuuuuuaauaaa

SEQ ID NO: 2031705 - RNA, 19 nt, Human
ggcugcugguggcgcuggc

SEQ ID NO: 2031706 - RNA, 22 nt, Human
caggggccacaccaaccuucug

SEQ ID NO: 2031707 - RNA, 17 nt, Human
uccugccccugagccca

SEQ ID NO: 2031708 - RNA, 17 nt, Human
aaagacaaggaaaaaau

SEQ ID NO: 2031709 - RNA, 13 nt, Human
auuuucaugcugu

SEQ ID NO: 2031710 - RNA, 16 nt, Human
uuccuuacucuugauu

SEQ ID NO: 2031711 - RNA, 14 nt, Human
aagucagucauuca

SEQ ID NO: 2031712 - RNA, 23 nt, Human
uagacacacaugaaguccaagca

SEQ ID NO: 2031713 - RNA, 15 nt, Human
ccggagccuccagcu

SEQ ID NO: 2031714 - RNA, 16 nt, Human
uccuguaauggaagca

SEQ ID NO: 2031715 - RNA, 19 nt, Human
agcagcuuauucacaagac

SEQ ID NO: 2031716 - RNA, 16 nt, Human
agugaaauauuauuuu

SEQ ID NO: 2031717 - RNA, 17 nt, Human
caggcuggcgugcagca

SEQ ID NO: 2031718 - RNA, 17 nt, Human
aaccuucugaggagcug

SEQ ID NO: 2031719 - RNA, 17 nt, Human
ugugcauauuuuauuau

SEQ ID NO: 2031720 - RNA, 15 nt, Human
uuccaagaaauauuc

SEQ ID NO: 2031721 - RNA, 17 nt, Human
cauaguaccucugcuau

SEQ ID NO: 2031722 - RNA, 14 nt, Human
uugccaugugcuag

SEQ ID NO: 2031723 - RNA, 18 nt, Human
uuuaauuugguuuucaca

SEQ ID NO: 2031724 - RNA, 19 nt, Human
augaguaacugauuuguaa

SEQ ID NO: 2031725 - RNA, 19 nt, Human
auuuucaguuauuauauuu

SEQ ID NO: 2031726 - RNA, 16 nt, Human
gcuccggacgcugcug

SEQ ID NO: 2031727 - RNA, 16 nt, Human
auaaugaauacuuuau

SEQ ID NO: 2031728 - RNA, 21 nt, Human
cagagguccacaacacacaga

SEQ ID NO: 2031729 - RNA, 20 nt, Human
cugcugcccuuccccuuccc

SEQ ID NO: 2031730 - RNA, 20 nt, Human
acaagacacagugaccauac

SEQ ID NO: 2031731 - RNA, 14 nt, Human
uaaagcuuccauug

SEQ ID NO: 2031732 - RNA, 18 nt, Human
gcgcgcccucuggcugcu

SEQ ID NO: 2031733 - RNA, 18 nt, Human
auuugcuggagcucugcc

SEQ ID NO: 2031734 - RNA, 17 nt, Human
cagucauucagauauga

SEQ ID NO: 2031735 - RNA, 18 nt, Human
ggcccugugcggccuggu

SEQ ID NO: 2031736 - RNA, 17 nt, Human
guucgcgcgccuccgcu

SEQ ID NO: 2031737 - RNA, 15 nt, Human
uuauauauauuuuuu

SEQ ID NO: 2031738 - RNA, 17 nt, Human
gauaaaagacagugaaa

SEQ ID NO: 2031739 - RNA, 14 nt, Human
acaagcagcccuua

SEQ ID NO: 2031740 - RNA, 17 nt, Human
aaauauaaauaaaaaua

SEQ ID NO: 2031741 - RNA, 17 nt, Human
acacuguuaucuucacu

SEQ ID NO: 2031742 - RNA, 22 nt, Human
uuguaacaagccuccuuuuaaa

SEQ ID NO: 2031743 - RNA, 15 nt, Human
gccccauucaacauc

SEQ ID NO: 2031744 - RNA, 16 nt, Human
auuccaccuacaugag

SEQ ID NO: 2031745 - RNA, 16 nt, Human
ccuuccccucugcagc

SEQ ID NO: 2031746 - RNA, 16 nt, Human
cuuggagacagggccc

SEQ ID NO: 2031747 - RNA, 19 nt, Human
aagucuuucacauuuaaau

SEQ ID NO: 2031748 - RNA, 14 nt, Human
auugucuagugaaa

SEQ ID NO: 2031749 - RNA, 14 nt, Human
acugccaucauuua

SEQ ID NO: 2031750 - RNA, 21 nt, Human
auauauuuuuuuuuuuaaaaa

SEQ ID NO: 2031751 - RNA, 21 nt, Human
cugccccggggaggggcgcuc

SEQ ID NO: 2031752 - RNA, 18 nt, Human
agugcacuaauguguaag

SEQ ID NO: 2031753 - RNA, 14 nt, Human
uaauaucuuaucuu

SEQ ID NO: 2031754 - RNA, 16 nt, Human
ccugaucaccugcccu

SEQ ID NO: 2031755 - RNA, 15 nt, Human
agguguguugcagug

SEQ ID NO: 2031756 - RNA, 22 nt, Human
uggaagccagaucuaugccaca

SEQ ID NO: 2031757 - RNA, 12 nt, Human
acccccugggag

SEQ ID NO: 2031758 - RNA, 17 nt, Human
aaagcuccauuuuuagu

SEQ ID NO: 2031759 - RNA, 14 nt, Human
ucuauaauuuaaau

SEQ ID NO: 2031760 - RNA, 21 nt, Human
cuuguuggacgagaaaacaau

SEQ ID NO: 2031761 - RNA, 15 nt, Human
auuauagucacuagu

SEQ ID NO: 2031762 - RNA, 21 nt, Human
ccggggaggggcgcucgcuuc

SEQ ID NO: 2031763 - RNA, 17 nt, Human
caauucgauccccuguc

SEQ ID NO: 2031764 - RNA, 15 nt, Human
aaaaacguauugcau

SEQ ID NO: 2031765 - RNA, 15 nt, Human
gagccggagccucca

SEQ ID NO: 2031766 - RNA, 15 nt, Human
uuucucugauacaga

SEQ ID NO: 2031767 - RNA, 17 nt, Human
aguuauuuuuaaacugu

SEQ ID NO: 2031768 - RNA, 18 nt, Human
cugaaggguaauuauaua

SEQ ID NO: 2031769 - RNA, 11 nt, Human
ggucacaggaa

SEQ ID NO: 2031770 - RNA, 23 nt, Human
ggucuaucuuugagcgcccacua

SEQ ID NO: 2031771 - RNA, 12 nt, Human
agaauauauuuc

SEQ ID NO: 2031772 - RNA, 20 nt, Human
cuuccccucugcagcuucca

SEQ ID NO: 2031773 - RNA, 16 nt, Human
gcuccaagaauuucua

SEQ ID NO: 2031774 - RNA, 22 nt, Human
uggaaaguuuaugguuguauua

SEQ ID NO: 2031775 - RNA, 14 nt, Human
uauguauauuuuau

SEQ ID NO: 2031776 - RNA, 21 nt, Human
ccaaggaugccccgucccccu

SEQ ID NO: 2031777 - RNA, 19 nt, Human
cccacuggacucaccuccc

SEQ ID NO: 2031778 - RNA, 15 nt, Human
ccucucuuccucccu

SEQ ID NO: 2031779 - RNA, 16 nt, Human
aaagcuacuuauugua

SEQ ID NO: 2031780 - RNA, 19 nt, Human
aaaaucuuauaauuuaaaa

SEQ ID NO: 2031781 - RNA, 20 nt, Human
acggacgaaccuugaaaacu

SEQ ID NO: 2031782 - RNA, 14 nt, Human
cuucacccugaggu

SEQ ID NO: 2031783 - RNA, 13 nt, Human
ugugcggccuggu

SEQ ID NO: 2031784 - RNA, 21 nt, Human
gcugagucccaggcugagccu

SEQ ID NO: 2031785 - RNA, 21 nt, Human
cuggccuucggccuccauccu

SEQ ID NO: 2031786 - RNA, 18 nt, Human
cugcucaauaaaguacaa

SEQ ID NO: 2031787 - RNA, 13 nt, Human
augcuguucauga

SEQ ID NO: 2031788 - RNA, 14 nt, Human
gagcccauggcacu

SEQ ID NO: 2031789 - RNA, 19 nt, Human
cugccccccagcccuccuu

SEQ ID NO: 2031790 - RNA, 18 nt, Human
augagcacgcauggaaaa

SEQ ID NO: 2031791 - RNA, 21 nt, Human
uagaagucacauuccugaaca

SEQ ID NO: 2031792 - RNA, 22 nt, Human
uuuacauggcuggagcuagaau

SEQ ID NO: 2031793 - RNA, 15 nt, Human
guaaggggaauugag

SEQ ID NO: 2031794 - RNA, 13 nt, Human
acaauaaaagaca

SEQ ID NO: 2031795 - RNA, 17 nt, Human
gcugcccuuccccuucc

SEQ ID NO: 2031796 - RNA, 16 nt, Human
ccagggcuacgcgcgc

SEQ ID NO: 2031797 - RNA, 23 nt, Human
uaaguuuuuuuuuaaaaaagaaa

SEQ ID NO: 2031798 - RNA, 20 nt, Human
uccucaugagggcuggaugc

SEQ ID NO: 2031799 - RNA, 20 nt, Human
gauuauauauauuuuuuucu

SEQ ID NO: 2031800 - RNA, 17 nt, Human
caugagggcuggaugcu

SEQ ID NO: 2031801 - RNA, 19 nt, Human
caauucuugccaaauauaa

SEQ ID NO: 2031802 - RNA, 19 nt, Human
ugaaauggacuuuuguaca

SEQ ID NO: 2031803 - RNA, 16 nt, Human
caugggacagggagga

SEQ ID NO: 2031804 - RNA, 17 nt, Human
ucgggauuaguacacac

SEQ ID NO: 2031805 - RNA, 18 nt, Human
gaccccugagcuugcaga

SEQ ID NO: 2031806 - RNA, 23 nt, Human
auauaacaaugcuguauuuuaaa

SEQ ID NO: 2031807 - RNA, 18 nt, Human
uuuauguuuaauucugaa

SEQ ID NO: 2031808 - RNA, 23 nt, Human
uuuauaugcuucuguuuuauaau

SEQ ID NO: 2031809 - RNA, 16 nt, Human
cccacuggacucaccu

SEQ ID NO: 2031810 - RNA, 18 nt, Human
ccggggaggggcgcucgc

SEQ ID NO: 2031811 - RNA, 12 nt, Human
auggguuuuauu

SEQ ID NO: 2031812 - RNA, 17 nt, Human
ucccugcugcccuuccc

SEQ ID NO: 2031813 - RNA, 21 nt, Human
cucagugucaaugcagccccc

SEQ ID NO: 2031814 - RNA, 15 nt, Human
gagcgcgcgcgcccu

SEQ ID NO: 2031815 - RNA, 18 nt, Human
ugcccauaccccuggcca

SEQ ID NO: 2031816 - RNA, 22 nt, Human
uuugaugcuacaggauuugaaa

SEQ ID NO: 2031817 - RNA, 15 nt, Human
uacuaauuuuaaaau

SEQ ID NO: 2031818 - RNA, 19 nt, Human
uccuauaauuuuagacauu

SEQ ID NO: 2031819 - RNA, 16 nt, Human
uaaugaauacuuuaua

SEQ ID NO: 2031820 - RNA, 17 nt, Human
auuucuaaaaguuuaag

SEQ ID NO: 2031821 - RNA, 15 nt, Human
ccucauguccacugg

SEQ ID NO: 2031822 - RNA, 16 nt, Human
agugaaagaaaauaac

SEQ ID NO: 2031823 - RNA, 15 nt, Human
gaauauauuuccuua

SEQ ID NO: 2031824 - RNA, 13 nt, Human
ccacaacacacag

SEQ ID NO: 2031825 - RNA, 17 nt, Human
acuugaacccauauuug

SEQ ID NO: 2031826 - RNA, 20 nt, Human
acggagccgggaaagaagag

SEQ ID NO: 2031827 - RNA, 13 nt, Human
gagccggagccuc

SEQ ID NO: 2031828 - RNA, 16 nt, Human
cugaucaccugcccug

SEQ ID NO: 2031829 - RNA, 19 nt, Human
ccuuagcccuuccccucug

SEQ ID NO: 2031830 - RNA, 14 nt, Human
ccggggaggggcgc

SEQ ID NO: 2031831 - RNA, 13 nt, Human
ccuccuuuuaaag

SEQ ID NO: 2031832 - RNA, 23 nt, Human
gcugaguguuucacaccuuaucu

SEQ ID NO: 2031833 - RNA, 22 nt, Human
auauuuuagauagaugaagaag

SEQ ID NO: 2031834 - RNA, 14 nt, Human
aagcuacuuauugu

SEQ ID NO: 2031835 - RNA, 10 nt, Human
caacucccug

SEQ ID NO: 2031836 - RNA, 21 nt, Human
ggaagacaagaaggaaagauu

SEQ ID NO: 2031837 - RNA, 18 nt, Human
cugagggcauagaaguaa

SEQ ID NO: 2031838 - RNA, 14 nt, Human
ccaccugcugagcc

SEQ ID NO: 2031839 - RNA, 22 nt, Human
uauccuacuuccccuuccuaau

SEQ ID NO: 2031840 - RNA, 17 nt, Human
cuggacucaccuccccc

SEQ ID NO: 2031841 - RNA, 21 nt, Human
ugaugcuacaggauuugaaau

SEQ ID NO: 2031842 - RNA, 18 nt, Human
uccagcuggccgggagcc

SEQ ID NO: 2031843 - RNA, 23 nt, Human
augaauaucaguuauuuuuaaac

SEQ ID NO: 2031844 - RNA, 16 nt, Human
ugccucaccccuugcc

SEQ ID NO: 2031845 - RNA, 22 nt, Human
aaauguugacaugggacauuug

SEQ ID NO: 2031846 - RNA, 12 nt, Human
ucugcacacagc

SEQ ID NO: 2031847 - RNA, 19 nt, Human
uccuagucucuaucauuaa

SEQ ID NO: 2031848 - RNA, 18 nt, Human
ugccuaggcauagcccug

SEQ ID NO: 2031849 - RNA, 22 nt, Human
gucucuacuaaaaauacaaaaa

SEQ ID NO: 2031850 - RNA, 18 nt, Human
cucuggccuucggccucc

SEQ ID NO: 2031851 - RNA, 17 nt, Human
ucuauguagaauauauu

SEQ ID NO: 2031852 - RNA, 22 nt, Human
cauuuaaauaaaguguuugaaa

SEQ ID NO: 2031853 - RNA, 15 nt, Human
ugauucaaaugucua

SEQ ID NO: 2031854 - RNA, 17 nt, Human
gucucagcuucacccug

SEQ ID NO: 2031855 - RNA, 19 nt, Human
gaauacucuuauaucuaua

SEQ ID NO: 2031856 - RNA, 20 nt, Human
gcauuguuggcuguuccugc

SEQ ID NO: 2031857 - RNA, 17 nt, Human
cacuuuccaauaaagag

SEQ ID NO: 2031858 - RNA, 18 nt, Human
caaguaaaaggaaaugcu

SEQ ID NO: 2031859 - RNA, 20 nt, Human
uucuaggacugaauuaugaa

SEQ ID NO: 2031860 - RNA, 21 nt, Human
agucuguuuucccuccuugga

SEQ ID NO: 2031861 - RNA, 23 nt, Human
uauguuaaaacugggacagggga

SEQ ID NO: 2031862 - RNA, 19 nt, Human
acuucagcgguuuauauaa

SEQ ID NO: 2031863 - RNA, 18 nt, Human
acagaaagcagaacagug

SEQ ID NO: 2031864 - RNA, 16 nt, Human
aaaguguuugaaagcu

SEQ ID NO: 2031865 - RNA, 14 nt, Human
uccacuuggucugu

SEQ ID NO: 2031866 - RNA, 18 nt, Human
ccaaccuggaguugaaaa

SEQ ID NO: 2031867 - RNA, 14 nt, Human
cgucccccucuggc

SEQ ID NO: 2031868 - RNA, 23 nt, Human
gcuggccuugugaggagcuggaa

SEQ ID NO: 2031869 - RNA, 21 nt, Human
aagacaagaaggaaagauuuu

SEQ ID NO: 2031870 - RNA, 19 nt, Human
aaguugcauagguuuaaua

SEQ ID NO: 2031871 - RNA, 23 nt, Human
uagaagucacauuccugaacagg

SEQ ID NO: 2031872 - RNA, 12 nt, Human
cgcucggccugc

SEQ ID NO: 2031873 - RNA, 15 nt, Human
gugaccacugcagaa

SEQ ID NO: 2031874 - RNA, 17 nt, Human
ccagggcuacgcgcgcu

SEQ ID NO: 2031875 - RNA, 23 nt, Human
cuacacgagauacagaauuuuau

SEQ ID NO: 2031876 - RNA, 16 nt, Human
ucuugagguaaaagca

SEQ ID NO: 2031877 - RNA, 21 nt, Human
ucuucaacucccugcccccca

SEQ ID NO: 2031878 - RNA, 16 nt, Human
cagggcucacagaauu

SEQ ID NO: 2031879 - RNA, 17 nt, Human
cugccucagaaaacaag

SEQ ID NO: 2031880 - RNA, 16 nt, Human
caugguuuagaaagcu

SEQ ID NO: 2031881 - RNA, 15 nt, Human
gacagggaggacgcu

SEQ ID NO: 2031882 - RNA, 13 nt, Human
agcuucuguuccg

SEQ ID NO: 2031883 - RNA, 22 nt, Human
auaucuuuuuuuuaauaaacca

SEQ ID NO: 2031884 - RNA, 23 nt, Human
cugaaaucauacuucuuaggguu

SEQ ID NO: 2031885 - RNA, 23 nt, Human
uaucuauguagaauauauuuccu

SEQ ID NO: 2031886 - RNA, 15 nt, Human
cuacaagacacagug

SEQ ID NO: 2031887 - RNA, 17 nt, Human
cggcuggagcugccucu

SEQ ID NO: 2031888 - RNA, 19 nt, Human
aagcuaugugagcucacca

SEQ ID NO: 2031889 - RNA, 18 nt, Human
uuuuagugaaauauuauu

SEQ ID NO: 2031890 - RNA, 14 nt, Human
ugagguugugugug

SEQ ID NO: 2031891 - RNA, 17 nt, Human
agacacacugaagaagc

SEQ ID NO: 2031892 - RNA, 17 nt, Human
aagcuuuuuuugaauca

SEQ ID NO: 2031893 - RNA, 21 nt, Human
ucauucacucaacaaacauaa

SEQ ID NO: 2031894 - RNA, 13 nt, Human
ucucccucccuug

SEQ ID NO: 2031895 - RNA, 19 nt, Human
cuuacucuugauuguggga

SEQ ID NO: 2031896 - RNA, 12 nt, Human
caugggaaguga

SEQ ID NO: 2031897 - RNA, 22 nt, Human
auucaaugccccugaauuuaaa

SEQ ID NO: 2031898 - RNA, 12 nt, Human
ggcugaugcagu

SEQ ID NO: 2031899 - RNA, 14 nt, Human
ugcuaagucuuaua

SEQ ID NO: 2031900 - RNA, 23 nt, Human
aucauuaaaguucuagugaccga

SEQ ID NO: 2031901 - RNA, 20 nt, Human
acuaaauugacacuuaaaaa

SEQ ID NO: 2031902 - RNA, 23 nt, Human
gcccacggcuggagcugccucuc

SEQ ID NO: 2031903 - RNA, 23 nt, Human
acugucuuguuggacgagaaaac

SEQ ID NO: 2031904 - RNA, 21 nt, Human
uuacauuuguauaaaauaauu

SEQ ID NO: 2031905 - RNA, 15 nt, Human
cuggaaacacauguu

SEQ ID NO: 2031906 - RNA, 16 nt, Human
aacaauaaaagacaag

SEQ ID NO: 2031907 - RNA, 14 nt, Human
cuuggucugugaga

SEQ ID NO: 2031908 - RNA, 12 nt, Human
acaagacacagu

SEQ ID NO: 2031909 - RNA, 21 nt, Human
caucccacccgcccaccgcag

SEQ ID NO: 2031910 - RNA, 15 nt, Human
gccucuuagaugcag

SEQ ID NO: 2031911 - RNA, 14 nt, Human
uugaaauuguauua

SEQ ID NO: 2031912 - RNA, 16 nt, Human
uuacccccugggagcc

SEQ ID NO: 2031913 - RNA, 16 nt, Human
auuauacccccugcaa

SEQ ID NO: 2031914 - RNA, 15 nt, Human
aucaauuuaaaaaaa

SEQ ID NO: 2031915 - RNA, 17 nt, Human
ggccaugggacagggag

SEQ ID NO: 2031916 - RNA, 19 nt, Human
auuuucuauaauuuaaaua

SEQ ID NO: 2031917 - RNA, 18 nt, Human
auucugguagcuaaauau

SEQ ID NO: 2031918 - RNA, 22 nt, Human
gagccucagucucccucccuug

SEQ ID NO: 2031919 - RNA, 17 nt, Human
uuuuuaauuauauggcu

SEQ ID NO: 2031920 - RNA, 15 nt, Human
ucuaugaaauauuau

SEQ ID NO: 2031921 - RNA, 15 nt, Human
ucugcagauaaacag

SEQ ID NO: 2031922 - RNA, 18 nt, Human
ccaagcugguggcucugu

SEQ ID NO: 2031923 - RNA, 18 nt, Human
acaugaacuuguaaagga

SEQ ID NO: 2031924 - RNA, 13 nt, Human
ucugaaauuuccu

SEQ ID NO: 2031925 - RNA, 17 nt, Human
gaaagccaugugcagcc

SEQ ID NO: 2031926 - RNA, 18 nt, Human
cuccgucaacucauauuu

SEQ ID NO: 2031927 - RNA, 14 nt, Human
aucuaugccacaag

SEQ ID NO: 2031928 - RNA, 15 nt, Human
auaaauaaaaauaau

SEQ ID NO: 2031929 - RNA, 18 nt, Human
acagagacagaaagcaga

SEQ ID NO: 2031930 - RNA, 21 nt, Human
auauuuccuuauucagaauuu

SEQ ID NO: 2031931 - RNA, 18 nt, Human
cugagccuugggaccccu

SEQ ID NO: 2031932 - RNA, 14 nt, Human
uuccgcauccuagu

SEQ ID NO: 2031933 - RNA, 14 nt, Human
aaaauacaaaaaaa

SEQ ID NO: 2031934 - RNA, 16 nt, Human
uguucuaagaagugaa

SEQ ID NO: 2031935 - RNA, 15 nt, Human
ccacaagaaaugaaa

SEQ ID NO: 2031936 - RNA, 21 nt, Human
ugguccuaagucccugcugcc

SEQ ID NO: 2031937 - RNA, 19 nt, Human
guccaggucuaccaaaaau

SEQ ID NO: 2031938 - RNA, 13 nt, Human
aagcuucuguucc

SEQ ID NO: 2031939 - RNA, 14 nt, Human
guaacugauuugua

SEQ ID NO: 2031940 - RNA, 15 nt, Human
cucgugggacaguca

SEQ ID NO: 2031941 - RNA, 11 nt, Human
gccaugggaca

SEQ ID NO: 2031942 - RNA, 21 nt, Human
acaguuaccucugccucagaa

SEQ ID NO: 2031943 - RNA, 22 nt, Human
cugggacaggggagaaccuagg

SEQ ID NO: 2031944 - RNA, 16 nt, Human
aagaaauauuccuuaa

SEQ ID NO: 2031945 - RNA, 18 nt, Human
acuguuaucuucacuuuu

SEQ ID NO: 2031946 - RNA, 15 nt, Human
uaagucccugcugcc

SEQ ID NO: 2031947 - RNA, 16 nt, Human
ggcugagccucagucu

SEQ ID NO: 2031948 - RNA, 20 nt, Human
uuagcauaguaccucugcua

SEQ ID NO: 2031949 - RNA, 22 nt, Human
gugaacaaauuuacagagacag

SEQ ID NO: 2031950 - RNA, 15 nt, Human
uaaaguaaaggcaaa

SEQ ID NO: 2031951 - RNA, 19 nt, Human
ccccugcaaagcccagcuu

SEQ ID NO: 2031952 - RNA, 22 nt, Human
agucccugcugcccuuccccuu

SEQ ID NO: 2031953 - RNA, 21 nt, Human
cagugagacagcucugcauac

SEQ ID NO: 2031954 - RNA, 16 nt, Human
aagcauuuagauguau

SEQ ID NO: 2031955 - RNA, 18 nt, Human
uccucgccacgcucuggg

SEQ ID NO: 2031956 - RNA, 18 nt, Human
uuccaagaaauauuccuu

SEQ ID NO: 2031957 - RNA, 18 nt, Human
cuccagccugagcgacag

SEQ ID NO: 2031958 - RNA, 17 nt, Human
ugaaauauuauuuuaua

SEQ ID NO: 2031959 - RNA, 11 nt, Human
accauuuuuac

SEQ ID NO: 2031960 - RNA, 16 nt, Human
acggcuggagcugccu

SEQ ID NO: 2031961 - RNA, 14 nt, Human
agucucccucccuu

SEQ ID NO: 2031962 - RNA, 19 nt, Human
auucagaauuucuaaaagu

SEQ ID NO: 2031963 - RNA, 22 nt, Human
uuccccuuccuaauuccacagc

SEQ ID NO: 2031964 - RNA, 16 nt, Human
ugacaagcucacagac

SEQ ID NO: 2031965 - RNA, 16 nt, Human
uaggauguugaaaaag

SEQ ID NO: 2031966 - RNA, 21 nt, Human
cuaguaucaaaagaaagaaaa

SEQ ID NO: 2031967 - RNA, 17 nt, Human
uaauuccacagcugcuc

SEQ ID NO: 2031968 - RNA, 21 nt, Human
ugcucaauaaaguacaagagc

SEQ ID NO: 2031969 - RNA, 13 nt, Human
auuccucacuuug

SEQ ID NO: 2031970 - RNA, 16 nt, Human
acagagacagaaagca

SEQ ID NO: 2031971 - RNA, 22 nt, Human
agaagagccggagccuccagcu

SEQ ID NO: 2031972 - RNA, 15 nt, Human
guccauucuuccucc

SEQ ID NO: 2031973 - RNA, 19 nt, Human
aguuauuuuuaaacuguaa

SEQ ID NO: 2031974 - RNA, 18 nt, Human
agagaaugagagacacac

SEQ ID NO: 2031975 - RNA, 20 nt, Human
cuguccauucuuccucccau

SEQ ID NO: 2031976 - RNA, 13 nt, Human
uguccacaaguaa

SEQ ID NO: 2031977 - RNA, 19 nt, Human
cucaccucccccaucucuu

SEQ ID NO: 2031978 - RNA, 24 nt, Human
ucucuaucauuaaaguucuaguga

SEQ ID NO: 2031979 - RNA, 19 nt, Human
accccugagcuugcagaga

SEQ ID NO: 2031980 - RNA, 23 nt, Human
gcgcuggcugcgcucggccugcu

SEQ ID NO: 2031981 - RNA, 14 nt, Human
augcuccuccaggg

SEQ ID NO: 2031982 - RNA, 23 nt, Human
aaugcuccuccagggagucucag

SEQ ID NO: 2031983 - RNA, 21 nt, Human
auuuaauagguuuggacaaaa

SEQ ID NO: 2031984 - RNA, 22 nt, Human
uggacgagaaaacaauaacgau

SEQ ID NO: 2031985 - RNA, 16 nt, Human
cuguggauuuaaugug

SEQ ID NO: 2031986 - RNA, 17 nt, Human
uucugagcauuuaauau

SEQ ID NO: 2031987 - RNA, 12 nt, Human
uuccugaacagg

SEQ ID NO: 2031988 - RNA, 14 nt, Human
acaagagcuuaaca

SEQ ID NO: 2031989 - RNA, 13 nt, Human
caacucccugccc

SEQ ID NO: 2031990 - RNA, 17 nt, Human
uuuccugggagcuuuug

SEQ ID NO: 2031991 - RNA, 20 nt, Human
cuuccucccauucaggaugc

SEQ ID NO: 2031992 - RNA, 21 nt, Human
auaguuacccaaauuaagaga

SEQ ID NO: 2031993 - RNA, 21 nt, Human
gucucagugucaaugcagccc

SEQ ID NO: 2031994 - RNA, 19 nt, Human
augcccacggcuggagcug

SEQ ID NO: 2031995 - RNA, 19 nt, Human
uggcaaacugccaucauuu

SEQ ID NO: 2031996 - RNA, 19 nt, Human
uauuuaauuauuucacuuu

SEQ ID NO: 2031997 - RNA, 21 nt, Human
ccuggugccucaccccuugcc

SEQ ID NO: 2031998 - RNA, 12 nt, Human
cccucugcagcu

SEQ ID NO: 2031999 - RNA, 21 nt, Human
auuuuccugaaaacccuugcc

SEQ ID NO: 2032000 - RNA, 20 nt, Human
auucccagccagcacagccu

SEQ ID NO: 2032001 - RNA, 17 nt, Human
uauauuuccaagaaaua

SEQ ID NO: 2032002 - RNA, 17 nt, Human
gaagauacugaaauaaa

SEQ ID NO: 2032003 - RNA, 24 nt, Human
ugucuugaauuguaggugacuauu

SEQ ID NO: 2032004 - RNA, 13 nt, Human
agcccagcuugaa

SEQ ID NO: 2032005 - RNA, 18 nt, Human
cagaaagcagaacaguga

SEQ ID NO: 2032006 - RNA, 17 nt, Human
cucaggcuggcaccgcu

SEQ ID NO: 2032007 - RNA, 19 nt, Human
cuccagcuggccgggagcc

SEQ ID NO: 2032008 - RNA, 16 nt, Human
ccuucccacacugucc

SEQ ID NO: 2032009 - RNA, 14 nt, Human
ucccuugaugaaga

SEQ ID NO: 2032010 - RNA, 17 nt, Human
agacagugaaagaaaau

SEQ ID NO: 2032011 - RNA, 19 nt, Human
uguuugccgcuuaagcuuu

SEQ ID NO: 2032012 - RNA, 15 nt, Human
agucucuaucauuaa

SEQ ID NO: 2032013 - RNA, 18 nt, Human
aaagagugaaggauuuau

SEQ ID NO: 2032014 - RNA, 18 nt, Human
gacccacuggacucaccu

SEQ ID NO: 2032015 - RNA, 17 nt, Human
uuauaucaauuuaaaaa

SEQ ID NO: 2032016 - RNA, 19 nt, Human
gguuccuuccucugagccu

SEQ ID NO: 2032017 - RNA, 20 nt, Human
aguuguuucuacuacaugga

SEQ ID NO: 2032018 - RNA, 18 nt, Human
cauguuccccuugggggu

SEQ ID NO: 2032019 - RNA, 13 nt, Human
aucaaugaaugaa

SEQ ID NO: 2032020 - RNA, 14 nt, Human
ucucuaucauuaaa

SEQ ID NO: 2032021 - RNA, 17 nt, Human
ccccuggccaaggaaga

SEQ ID NO: 2032022 - RNA, 18 nt, Human
gccuuggggcugaugcag

SEQ ID NO: 2032023 - RNA, 21 nt, Human
gaacagucucuugaggcacag

SEQ ID NO: 2032024 - RNA, 20 nt, Human
uuauucacuguauguccuug

SEQ ID NO: 2032025 - RNA, 16 nt, Human
aauuccacagcugcuc

SEQ ID NO: 2032026 - RNA, 12 nt, Human
uaguacacacuu

SEQ ID NO: 2032027 - RNA, 11 nt, Human
uuauauuuauu

SEQ ID NO: 2032028 - RNA, 22 nt, Human
ugaaaaaguucugcagauaaac

SEQ ID NO: 2032029 - RNA, 18 nt, Human
aagucuuucacauuuaaa

SEQ ID NO: 2032030 - RNA, 19 nt, Human
cucugccucagaaaacaag

SEQ ID NO: 2032031 - RNA, 17 nt, Human
agcucugcccauccugc

SEQ ID NO: 2032032 - RNA, 16 nt, Human
ggcauggguuuuauua

SEQ ID NO: 2032033 - RNA, 14 nt, Human
acuuggucugugag

SEQ ID NO: 2032034 - RNA, 12 nt, Human
cuccauuuuuag

SEQ ID NO: 2032035 - RNA, 14 nt, Human
uauaucuauauuuu

SEQ ID NO: 2032036 - RNA, 14 nt, Human
gccucagucucccu

SEQ ID NO: 2032037 - RNA, 23 nt, Human
caauaacgauaaaagacagugaa

SEQ ID NO: 2032038 - RNA, 17 nt, Human
cugguggcgcuggcugc

SEQ ID NO: 2032039 - RNA, 16 nt, Human
gggccgacggagccgg

SEQ ID NO: 2032040 - RNA, 19 nt, Human
agacagugaaagaaaauaa

SEQ ID NO: 2032041 - RNA, 15 nt, Human
aaaaguugaauuuua

SEQ ID NO: 2032042 - RNA, 17 nt, Human
cugagcgacagugagac

SEQ ID NO: 2032043 - RNA, 23 nt, Human
uugauuuuauaugcuauuuauua

SEQ ID NO: 2032044 - RNA, 19 nt, Human
ucucuaucauuaaaguucu

SEQ ID NO: 2032045 - RNA, 19 nt, Human
uggggcuuuaacuccugcu

SEQ ID NO: 2032046 - RNA, 23 nt, Human
uguugagguaccuccaaggaccg

SEQ ID NO: 2032047 - RNA, 13 nt, Human
ucacuguaaaaua

SEQ ID NO: 2032048 - RNA, 22 nt, Human
uauuucagauaaucacaauaca

SEQ ID NO: 2032049 - RNA, 15 nt, Human
gcccacuagacccac

SEQ ID NO: 2032050 - RNA, 21 nt, Human
aaucaccaaggcugauuaaac

SEQ ID NO: 2032051 - RNA, 23 nt, Human
caaaauggaauacucuuauaucu

SEQ ID NO: 2032052 - RNA, 16 nt, Human
uauguucuaagaagug

SEQ ID NO: 2032053 - RNA, 13 nt, Human
uaccccuggccaa

SEQ ID NO: 2032054 - RNA, 22 nt, Human
uuugaaacgaggauugggaaaa

SEQ ID NO: 2032055 - RNA, 12 nt, Human
aguuauaaaaau

SEQ ID NO: 2032056 - RNA, 15 nt, Human
ugaaauuguauuaca

SEQ ID NO: 2032057 - RNA, 20 nt, Human
aauuuugugaagcaaaauuu

SEQ ID NO: 2032058 - RNA, 15 nt, Human
acucaccucccccau

SEQ ID NO: 2032059 - RNA, 20 nt, Human
caccgcagggugaacugcag

SEQ ID NO: 2032060 - RNA, 13 nt, Human
agaaaugaaagca

SEQ ID NO: 2032061 - RNA, 22 nt, Human
cuggagacauugaggcaggcac

SEQ ID NO: 2032062 - RNA, 14 nt, Human
caccaaccuucuga

SEQ ID NO: 2032063 - RNA, 13 nt, Human
cuuuccaugaguu

SEQ ID NO: 2032064 - RNA, 19 nt, Human
caugaguaacugauuugua

SEQ ID NO: 2032065 - RNA, 16 nt, Human
ucaaaagaaagaaaau

SEQ ID NO: 2032066 - RNA, 13 nt, Human
agagguccacaac

SEQ ID NO: 2032067 - RNA, 18 nt, Human
cgcgagcgcgcgcgcccu

SEQ ID NO: 2032068 - RNA, 20 nt, Human
gggagccccaauucgauccc

SEQ ID NO: 2032069 - RNA, 13 nt, Human
cguugagccacca

SEQ ID NO: 2032070 - RNA, 16 nt, Human
aauuacauuuguauaa

SEQ ID NO: 2032071 - RNA, 19 nt, Human
caguccauugggcaggcag

SEQ ID NO: 2032072 - RNA, 15 nt, Human
aauauauauuuuaga

SEQ ID NO: 2032073 - RNA, 21 nt, Human
agaauucuguugauggaaaua

SEQ ID NO: 2032074 - RNA, 17 nt, Human
aaccuagggugauauua

SEQ ID NO: 2032075 - RNA, 15 nt, Human
auccugccccugagc

SEQ ID NO: 2032076 - RNA, 20 nt, Human
ccauacuaauuauacccccu

SEQ ID NO: 2032077 - RNA, 16 nt, Human
acaaggaugaauuaag

SEQ ID NO: 2032078 - RNA, 23 nt, Human
uuuguauaaaauaauuuuuauau

SEQ ID NO: 2032079 - RNA, 14 nt, Human
ggagcaucuccuca

SEQ ID NO: 2032080 - RNA, 22 nt, Human
cagaucuaugccacaagaaccc

SEQ ID NO: 2032081 - RNA, 19 nt, Human
ucuguuuucccuccuugga

SEQ ID NO: 2032082 - RNA, 12 nt, Human
aaaugaaagcag

SEQ ID NO: 2032083 - RNA, 16 nt, Human
ugaauuuaaauagcuu

SEQ ID NO: 2032084 - RNA, 20 nt, Human
cuggccaccugcugagcccc

SEQ ID NO: 2032085 - RNA, 15 nt, Human
aagccuccuuuuaaa

SEQ ID NO: 2032086 - RNA, 16 nt, Human
aaaagcaucacaugaa

SEQ ID NO: 2032087 - RNA, 18 nt, Human
ucuauguagaauauauuu

SEQ ID NO: 2032088 - RNA, 18 nt, Human
agcugcucaauaaaguac

SEQ ID NO: 2032089 - RNA, 21 nt, Human
gcaaaauuuuuucucuaggaa

SEQ ID NO: 2032090 - RNA, 14 nt, Human
agagacagaaagca

SEQ ID NO: 2032091 - RNA, 20 nt, Human
cuuauucacaagacccaaaa

SEQ ID NO: 2032092 - RNA, 15 nt, Human
ucucagaaggaaaga

SEQ ID NO: 2032093 - RNA, 11 nt, Human
auuuuugaagc

SEQ ID NO: 2032094 - RNA, 20 nt, Human
auuacauuuguauaaaauaa

SEQ ID NO: 2032095 - RNA, 18 nt, Human
acucuuaagaagacugca

SEQ ID NO: 2032096 - RNA, 17 nt, Human
auaaaguacaagagcuu

SEQ ID NO: 2032097 - RNA, 14 nt, Human
aacuuugauuuuau

SEQ ID NO: 2032098 - RNA, 14 nt, Human
acccgggaggcaga

SEQ ID NO: 2032099 - RNA, 18 nt, Human
uuuugugggaaauccaca

SEQ ID NO: 2032100 - RNA, 14 nt, Human
auccaaugaaauga

SEQ ID NO: 2032101 - RNA, 15 nt, Human
ggccuccauccugag

SEQ ID NO: 2032102 - RNA, 17 nt, Human
uaaaagacagugaaaga

SEQ ID NO: 2032103 - RNA, 20 nt, Human
ucuguuuucccuccuuggag

SEQ ID NO: 2032104 - RNA, 13 nt, Human
cuugcugcaccug

SEQ ID NO: 2032105 - RNA, 21 nt, Human
cacaugaacuuguaaaggaau

SEQ ID NO: 2032106 - RNA, 15 nt, Human
aaaagacaaggaaaa

SEQ ID NO: 2032107 - RNA, 16 nt, Human
uuucugaaauuuccug

SEQ ID NO: 2032108 - RNA, 16 nt, Human
aaauauuuauuuuaau

SEQ ID NO: 2032109 - RNA, 16 nt, Human
aauugacccacaagaa

SEQ ID NO: 2032110 - RNA, 22 nt, Human
gagucaagggugugugcagcau

SEQ ID NO: 2032111 - RNA, 17 nt, Human
acccacuggacucaccu

SEQ ID NO: 2032112 - RNA, 14 nt, Human
auaaaauaauuuuu

SEQ ID NO: 2032113 - RNA, 10 nt, Human
ccugagcccc

SEQ ID NO: 2032114 - RNA, 16 nt, Human
uagaaaacaggcaaau

SEQ ID NO: 2032115 - RNA, 20 nt, Human
cuauguagaauauauuuccu

SEQ ID NO: 2032116 - RNA, 16 nt, Human
acuaguuucccuugca

SEQ ID NO: 2032117 - RNA, 20 nt, Human
aaaaucuuauaauuuaaaau

SEQ ID NO: 2032118 - RNA, 11 nt, Human
agaauauauuu

SEQ ID NO: 2032119 - RNA, 22 nt, Human
uggagacauugaggcaggcacu

SEQ ID NO: 2032120 - RNA, 19 nt, Human
cccauggcacucuauguuc

SEQ ID NO: 2032121 - RNA, 19 nt, Human
accuccuaagaaggcaccu

SEQ ID NO: 2032122 - RNA, 17 nt, Human
gacucaccucccccauc

SEQ ID NO: 2032123 - RNA, 18 nt, Human
uauaacaaugcuguauuu

SEQ ID NO: 2032124 - RNA, 16 nt, Human
acauccuacaagacac

SEQ ID NO: 2032125 - RNA, 18 nt, Human
uaaauguuguuuuaggaa

SEQ ID NO: 2032126 - RNA, 13 nt, Human
gggaaagaagagc

SEQ ID NO: 2032127 - RNA, 15 nt, Human
ugauuucauucaaua

SEQ ID NO: 2032128 - RNA, 20 nt, Human
auuuauugaggcuuuaaaac

SEQ ID NO: 2032129 - RNA, 15 nt, Human
agcaccaucauuccc

SEQ ID NO: 2032130 - RNA, 16 nt, Human
gcagcucaggcuggca

SEQ ID NO: 2032131 - RNA, 14 nt, Human
uacccccugggagc

SEQ ID NO: 2032132 - RNA, 16 nt, Human
cgcgcgcuccgcgcag

SEQ ID NO: 2032133 - RNA, 21 nt, Human
ccuuccccucugcagcuucca

SEQ ID NO: 2032134 - RNA, 13 nt, Human
cgggaggcagagg

SEQ ID NO: 2032135 - RNA, 21 nt, Human
agccgguccuugcugcaccug

SEQ ID NO: 2032136 - RNA, 21 nt, Human
gacagugaaagaaaauaacaa

SEQ ID NO: 2032137 - RNA, 21 nt, Human
aauuuacagagacagaaagca

SEQ ID NO: 2032138 - RNA, 13 nt, Human
aucauuaaaguuc

SEQ ID NO: 2032139 - RNA, 13 nt, Human
aaaguguuugaaa

SEQ ID NO: 2032140 - RNA, 16 nt, Human
gaaagaagagccggag

SEQ ID NO: 2032141 - RNA, 21 nt, Human
gcaggaccaucccggccggcg

SEQ ID NO: 2032142 - RNA, 14 nt, Human
ccugcugagcccca

SEQ ID NO: 2032143 - RNA, 19 nt, Human
agaugagagaacagggcug

SEQ ID NO: 2032144 - RNA, 24 nt, Human
cauaugaaaaggcuaagcuucacu

SEQ ID NO: 2032145 - RNA, 17 nt, Human
ugaucaccugcccugcu

SEQ ID NO: 2032146 - RNA, 15 nt, Human
acauccuacaagaca

SEQ ID NO: 2032147 - RNA, 18 nt, Human
ugcauagguuuaauaauu

SEQ ID NO: 2032148 - RNA, 14 nt, Human
uucccgcuguuccu

SEQ ID NO: 2032149 - RNA, 21 nt, Human
caacacacagauuugagcuca

SEQ ID NO: 2032150 - RNA, 15 nt, Human
uucacuguaaaauaa

SEQ ID NO: 2032151 - RNA, 15 nt, Human
aauuuaucauuuagu

SEQ ID NO: 2032152 - RNA, 21 nt, Human
gauaaaagacagugaaagaaa

SEQ ID NO: 2032153 - RNA, 14 nt, Human
caaggaaaaaauaa

SEQ ID NO: 2032154 - RNA, 20 nt, Human
ccucaagcuaugugagcuca

SEQ ID NO: 2032155 - RNA, 16 nt, Human
ucaucaaugaaugaau

SEQ ID NO: 2032156 - RNA, 16 nt, Human
aaaugggaaacaaaag

SEQ ID NO: 2032157 - RNA, 15 nt, Human
augugcagccaccag

SEQ ID NO: 2032158 - RNA, 12 nt, Human
gauaaaagacag

SEQ ID NO: 2032159 - RNA, 15 nt, Human
ccugccccccagccc

SEQ ID NO: 2032160 - RNA, 16 nt, Human
gaaucacuugaacccg

SEQ ID NO: 2032161 - RNA, 18 nt, Human
auuaaguuuuuuuuuaaa

SEQ ID NO: 2032162 - RNA, 21 nt, Human
aguuguugcccacagcuguau

SEQ ID NO: 2032163 - RNA, 19 nt, Human
cucuugaggcacagaaacu

SEQ ID NO: 2032164 - RNA, 22 nt, Human
auguccuuggugccuggagccu

SEQ ID NO: 2032165 - RNA, 20 nt, Human
uuacaaauccaaugaaauga

SEQ ID NO: 2032166 - RNA, 17 nt, Human
uauuuuuuucugaaauu

SEQ ID NO: 2032167 - RNA, 13 nt, Human
cuauuauauuucc

SEQ ID NO: 2032168 - RNA, 20 nt, Human
ugccccccagcccuccuuau

SEQ ID NO: 2032169 - RNA, 21 nt, Human
cgacagugagacucugucuca

SEQ ID NO: 2032170 - RNA, 13 nt, Human
gaugcccacggcu

SEQ ID NO: 2032171 - RNA, 13 nt, Human
cuccagcugcccc

SEQ ID NO: 2032172 - RNA, 15 nt, Human
uugcucauggaauug

SEQ ID NO: 2032173 - RNA, 23 nt, Human
uggcuugaguuuaaauuguaaua

SEQ ID NO: 2032174 - RNA, 13 nt, Human
uuuaaaaaagaaa

SEQ ID NO: 2032175 - RNA, 23 nt, Human
uaauuuguaguguuggagaagaa

SEQ ID NO: 2032176 - RNA, 20 nt, Human
uauaugcuaagucuuauaua

SEQ ID NO: 2032177 - RNA, 21 nt, Human
gguccuugcugcaccugugcc

SEQ ID NO: 2032178 - RNA, 13 nt, Human
gcuggagcucugc

SEQ ID NO: 2032179 - RNA, 14 nt, Human
cccauucaggaugc

SEQ ID NO: 2032180 - RNA, 21 nt, Human
gcucggccugcucgcccacuu

SEQ ID NO: 2032181 - RNA, 17 nt, Human
uaauuugguuuucacau

SEQ ID NO: 2032182 - RNA, 14 nt, Human
gagccgggaaagaa

SEQ ID NO: 2032183 - RNA, 22 nt, Human
aauuuuagacauucuuuaucuu

SEQ ID NO: 2032184 - RNA, 15 nt, Human
gcuguuaaucuuuca

SEQ ID NO: 2032185 - RNA, 18 nt, Human
cuguuuucccuccuugga

SEQ ID NO: 2032186 - RNA, 17 nt, Human
gcaaauugucacaggac

SEQ ID NO: 2032187 - RNA, 14 nt, Human
cacuuauaggaauu

SEQ ID NO: 2032188 - RNA, 18 nt, Human
aggaaaaaauaacaauga

SEQ ID NO: 2032189 - RNA, 22 nt, Human
ucugguagcuaaauauauauuu

SEQ ID NO: 2032190 - RNA, 16 nt, Human
agauagaugaagaagc

SEQ ID NO: 2032191 - RNA, 23 nt, Human
caucucuucuggguuccuuccuc

SEQ ID NO: 2032192 - RNA, 15 nt, Human
aauuauuucacuuua

SEQ ID NO: 2032193 - RNA, 21 nt, Human
acucuuauaucuauauuuuac

SEQ ID NO: 2032194 - RNA, 23 nt, Human
ggagcaucuccucaacucugagu

SEQ ID NO: 2032195 - RNA, 17 nt, Human
uuccaagccucaugucc

SEQ ID NO: 2032196 - RNA, 18 nt, Human
cagccucuuagaugcagu

SEQ ID NO: 2032197 - RNA, 19 nt, Human
gagguacugagagugaaca

SEQ ID NO: 2032198 - RNA, 22 nt, Human
cuccuccagggagucucagcuu

SEQ ID NO: 2032199 - RNA, 17 nt, Human
uuuaaaaaaaaaacgua

SEQ ID NO: 2032200 - RNA, 22 nt, Human
cuuaucuauguagaauauauuu

SEQ ID NO: 2032201 - RNA, 21 nt, Human
caagacugcacaucaaaauau

SEQ ID NO: 2032202 - RNA, 18 nt, Human
ucaagggugugugcagca

SEQ ID NO: 2032203 - RNA, 16 nt, Human
ccacuuauaggaauug

SEQ ID NO: 2032204 - RNA, 21 nt, Human
ccaaagugugacucauuaaau

SEQ ID NO: 2032205 - RNA, 16 nt, Human
ucucuaggaaauauuu

SEQ ID NO: 2032206 - RNA, 21 nt, Human
aaaagguauuuuaaucaccaa

SEQ ID NO: 2032207 - RNA, 15 nt, Human
uuggggaauauguua

SEQ ID NO: 2032208 - RNA, 18 nt, Human
auucuugccaaauauaaa

SEQ ID NO: 2032209 - RNA, 16 nt, Human
cuuauaauuuaaaaua

SEQ ID NO: 2032210 - RNA, 15 nt, Human
uagagaauuuccuua

SEQ ID NO: 2032211 - RNA, 21 nt, Human
caucucagguguguugcagug

SEQ ID NO: 2032212 - RNA, 18 nt, Human
aaauauuuauuuuaauaa

SEQ ID NO: 2032213 - RNA, 18 nt, Human
uacuuuauuuucuauaau

SEQ ID NO: 2032214 - RNA, 16 nt, Human
uucucuaggaaauauu

SEQ ID NO: 2032215 - RNA, 19 nt, Human
cuggcucuggacaggcacu

SEQ ID NO: 2032216 - RNA, 13 nt, Human
caauaaagaguuc

SEQ ID NO: 2032217 - RNA, 15 nt, Human
aagccaugugcagcc

SEQ ID NO: 2032218 - RNA, 15 nt, Human
cucaacaaacauaau

SEQ ID NO: 2032219 - RNA, 22 nt, Human
acauccuacaagacacagugac

SEQ ID NO: 2032220 - RNA, 22 nt, Human
uuuccuuauucagaauuucuaa

SEQ ID NO: 2032221 - RNA, 15 nt, Human
ugccucucucaucca

SEQ ID NO: 2032222 - RNA, 14 nt, Human
ugagacucugucuc

SEQ ID NO: 2032223 - RNA, 17 nt, Human
acaaaugggaaacaaaa

SEQ ID NO: 2032224 - RNA, 16 nt, Human
aagcuacuuauuguag

SEQ ID NO: 2032225 - RNA, 13 nt, Human
auugucuagugaa

SEQ ID NO: 2032226 - RNA, 16 nt, Human
aaaagcuccauuuuua

SEQ ID NO: 2032227 - RNA, 15 nt, Human
cagaauucauucacu

SEQ ID NO: 2032228 - RNA, 20 nt, Human
uuguaggugacuauuauauu

SEQ ID NO: 2032229 - RNA, 13 nt, Human
aacgucacaucuu

SEQ ID NO: 2032230 - RNA, 15 nt, Human
uuaguuuuuaaagua

SEQ ID NO: 2032231 - RNA, 23 nt, Human
gucucccucccuuggggccuaug

SEQ ID NO: 2032232 - RNA, 14 nt, Human
gcuggagcucugcc

SEQ ID NO: 2032233 - RNA, 17 nt, Human
uguuggcuguuccugca

SEQ ID NO: 2032234 - RNA, 22 nt, Human
cacuguccauucuuccucccau

SEQ ID NO: 2032235 - RNA, 13 nt, Human
cacuuugaagagu

SEQ ID NO: 2032236 - RNA, 15 nt, Human
uuugauaugugaaca

SEQ ID NO: 2032237 - RNA, 17 nt, Human
ggagggcgcggggcggg

SEQ ID NO: 2032238 - RNA, 19 nt, Human
cuggccuucggccuccauc

SEQ ID NO: 2032239 - RNA, 17 nt, Human
ccugcucgcccacuucc

SEQ ID NO: 2032240 - RNA, 20 nt, Human
cugcacuccagccugagcga

SEQ ID NO: 2032241 - RNA, 18 nt, Human
gcuccauuuuuagugaaa

SEQ ID NO: 2032242 - RNA, 18 nt, Human
cuccgcgcagcucaggcu

SEQ ID NO: 2032243 - RNA, 17 nt, Human
aggccaugggacaggga

SEQ ID NO: 2032244 - RNA, 18 nt, Human
uaauaauguuucaaacau

SEQ ID NO: 2032245 - RNA, 17 nt, Human
ccugagcuugcagagau

SEQ ID NO: 2032246 - RNA, 18 nt, Human
ccaaccuucugaggagcu

SEQ ID NO: 2032247 - RNA, 13 nt, Human
agccucagucucc

SEQ ID NO: 2032248 - RNA, 18 nt, Human
cagcugcucaauaaagua

SEQ ID NO: 2032249 - RNA, 18 nt, Human
ugaaaaaguucugcagau

SEQ ID NO: 2032250 - RNA, 17 nt, Human
gaaaaucaggcuggcca

SEQ ID NO: 2032251 - RNA, 20 nt, Human
ccaucugguccuaagucccu

SEQ ID NO: 2032252 - RNA, 16 nt, Human
uagcuacuaauuuuaa

SEQ ID NO: 2032253 - RNA, 17 nt, Human
uggacaaaauggaauac

SEQ ID NO: 2032254 - RNA, 22 nt, Human
uuauaagaaauaggaaauauuu

SEQ ID NO: 2032255 - RNA, 20 nt, Human
uuucauaagaauucuguuga

SEQ ID NO: 2032256 - RNA, 21 nt, Human
aauaauccucaguuuuuguga

SEQ ID NO: 2032257 - RNA, 15 nt, Human
ugagcgcccacuaga

SEQ ID NO: 2032258 - RNA, 12 nt, Human
aagagcuuaaca

SEQ ID NO: 2032259 - RNA, 15 nt, Human
uugaagcacagugau

SEQ ID NO: 2032260 - RNA, 14 nt, Human
caaggcuagaacca

SEQ ID NO: 2032261 - RNA, 22 nt, Human
gucucagcuucacccugaggug

SEQ ID NO: 2032262 - RNA, 14 nt, Human
agcucguggaacag

SEQ ID NO: 2032263 - RNA, 12 nt, Human
caagaaggaaag

SEQ ID NO: 2032264 - RNA, 17 nt, Human
cgcgcugcgcgccgcgc

SEQ ID NO: 2032265 - RNA, 20 nt, Human
ucucacuuguuuuauuuaac

SEQ ID NO: 2032266 - RNA, 16 nt, Human
aauuuaguauuuuguu

SEQ ID NO: 2032267 - RNA, 16 nt, Human
uuauaauuuaaaauau

SEQ ID NO: 2032268 - RNA, 18 nt, Human
uauguuagagaauuuccu

SEQ ID NO: 2032269 - RNA, 21 nt, Human
accaaggagccaaacauccua

SEQ ID NO: 2032270 - RNA, 22 nt, Human
cuaccuguucgcgcgccuccgc

SEQ ID NO: 2032271 - RNA, 22 nt, Human
cacuuccaagagccuuuuuuug

SEQ ID NO: 2032272 - RNA, 21 nt, Human
ucccugcugcccuuccccuuc

SEQ ID NO: 2032273 - RNA, 22 nt, Human
guguccccuauccuacuucccc

SEQ ID NO: 2032274 - RNA, 20 nt, Human
auaacaaugcuguauuuuaa

SEQ ID NO: 2032275 - RNA, 16 nt, Human
gagcaucaucuucugg

SEQ ID NO: 2032276 - RNA, 13 nt, Human
ccucccccaucuc

SEQ ID NO: 2032277 - RNA, 13 nt, Human
uaaauauauauuu

SEQ ID NO: 2032278 - RNA, 22 nt, Human
agcauuguuggcuguuccugca

SEQ ID NO: 2032279 - RNA, 17 nt, Human
ugaccacugcagaagac

SEQ ID NO: 2032280 - RNA, 22 nt, Human
aaaucaggguuaguauugucca

SEQ ID NO: 2032281 - RNA, 22 nt, Human
gaauaucuccgucaacucauau

SEQ ID NO: 2032282 - RNA, 22 nt, Human
cgugcuugucccuguggaagua

SEQ ID NO: 2032283 - RNA, 20 nt, Human
agaauucuguugauggaaau

SEQ ID NO: 2032284 - RNA, 21 nt, Human
cuaaauugacacuuaaaaaug

SEQ ID NO: 2032285 - RNA, 21 nt, Human
ggagacauugaggcaggcacu

SEQ ID NO: 2032286 - RNA, 16 nt, Human
cuucuggguuccuucc

SEQ ID NO: 2032287 - RNA, 15 nt, Human
ucugucucaguccau

SEQ ID NO: 2032288 - RNA, 23 nt, Human
gggagccugaucaccugcccugc

SEQ ID NO: 2032289 - RNA, 22 nt, Human
ggacaguaaaauccacagacca

SEQ ID NO: 2032290 - RNA, 19 nt, Human
cugagccucagucucccuc

SEQ ID NO: 2032291 - RNA, 15 nt, Human
cugaaagaggaauga

SEQ ID NO: 2032292 - RNA, 19 nt, Human
guauucuuuuaguuuuuaa

SEQ ID NO: 2032293 - RNA, 17 nt, Human
agaacucccuuucaaca

SEQ ID NO: 2032294 - RNA, 18 nt, Human
ccuuccuaauuccacagc

SEQ ID NO: 2032295 - RNA, 17 nt, Human
ugcccauaccccuggcc

SEQ ID NO: 2032296 - RNA, 16 nt, Human
uugucaauaaaaucca

SEQ ID NO: 2032297 - RNA, 16 nt, Human
aguuuauauagaaaug

SEQ ID NO: 2032298 - RNA, 18 nt, Human
uguggucacaggaaguag

SEQ ID NO: 2032299 - RNA, 16 nt, Human
aaauaacaaugaaagu

SEQ ID NO: 2032300 - RNA, 17 nt, Human
ucucacuuguuuuauuu

SEQ ID NO: 2032301 - RNA, 14 nt, Human
ucaaugcagccccc

SEQ ID NO: 2032302 - RNA, 17 nt, Human
cuacacuccagugagac

SEQ ID NO: 2032303 - RNA, 22 nt, Human
agcuguguccucaugagggcug

SEQ ID NO: 2032304 - RNA, 21 nt, Human
ggaaagaauaaccaacacccu

SEQ ID NO: 2032305 - RNA, 12 nt, Human
auucuuccuccc

SEQ ID NO: 2032306 - RNA, 22 nt, Human
caagcucuaucaccaaggagcc

SEQ ID NO: 2032307 - RNA, 16 nt, Human
ucuuuuaguuuuuaaa

SEQ ID NO: 2032308 - RNA, 21 nt, Human
guuuguuuauuuguuuuucca

SEQ ID NO: 2032309 - RNA, 17 nt, Human
cuauccuacuuccccuu

SEQ ID NO: 2032310 - RNA, 17 nt, Human
cucgugggacagucacc

SEQ ID NO: 2032311 - RNA, 21 nt, Human
acgcucucuggccuucggccu

SEQ ID NO: 2032312 - RNA, 17 nt, Human
aaacauccuacaagaca

SEQ ID NO: 2032313 - RNA, 14 nt, Human
gcgagcgcgcgcgc

SEQ ID NO: 2032314 - RNA, 17 nt, Human
uaagaaauaggaaauau

SEQ ID NO: 2032315 - RNA, 12 nt, Human
uauuuuuuucug

SEQ ID NO: 2032316 - RNA, 17 nt, Human
cuacaggccccaucugg

SEQ ID NO: 2032317 - RNA, 15 nt, Human
gggaaagaagagccg

SEQ ID NO: 2032318 - RNA, 16 nt, Human
gagcucgugggacagu

SEQ ID NO: 2032319 - RNA, 22 nt, Human
ggcagcuuuccucaaaacuuca

SEQ ID NO: 2032320 - RNA, 16 nt, Human
uuaaauagcuuuuuuc

SEQ ID NO: 2032321 - RNA, 22 nt, Human
cuuccuaauuccacagcugcuc

SEQ ID NO: 2032322 - RNA, 19 nt, Human
guggauuuaauguggaaau

SEQ ID NO: 2032323 - RNA, 23 nt, Human
auaauguguucauucuggaauaa

SEQ ID NO: 2032324 - RNA, 22 nt, Human
cacuaguauuucuaugaaauau

SEQ ID NO: 2032325 - RNA, 12 nt, Human
uuauuucacuuu

SEQ ID NO: 2032326 - RNA, 13 nt, Human
aguuaccucugcc

SEQ ID NO: 2032327 - RNA, 22 nt, Human
ugauugugggauacuauuuaau

SEQ ID NO: 2032328 - RNA, 18 nt, Human
ccugaaagaggaaugaag

SEQ ID NO: 2032329 - RNA, 15 nt, Human
acaaaugggaaacaa

SEQ ID NO: 2032330 - RNA, 19 nt, Human
uuucaugcuguucaugaaa

SEQ ID NO: 2032331 - RNA, 17 nt, Human
gcgccuccgcuacuucc

SEQ ID NO: 2032332 - RNA, 23 nt, Human
aauguauucuuuuaguuuuuaaa

SEQ ID NO: 2032333 - RNA, 13 nt, Human
cugugcggccugg

SEQ ID NO: 2032334 - RNA, 14 nt, Human
cgcgcugcgcgccg

SEQ ID NO: 2032335 - RNA, 22 nt, Human
gcauccuagucucuaucauuaa

SEQ ID NO: 2032336 - RNA, 14 nt, Human
gaaggugaucuggc

SEQ ID NO: 2032337 - RNA, 15 nt, Human
ugagcucaccagucc

SEQ ID NO: 2032338 - RNA, 18 nt, Human
aauccacacugagcugag

SEQ ID NO: 2032339 - RNA, 17 nt, Human
uccgucaacucauauuu

SEQ ID NO: 2032340 - RNA, 18 nt, Human
uagugaaauauuauuuua

SEQ ID NO: 2032341 - RNA, 22 nt, Human
uuuguagaagucacauuccuga

SEQ ID NO: 2032342 - RNA, 19 nt, Human
uacuucuuaggguuaugau

SEQ ID NO: 2032343 - RNA, 14 nt, Human
uuauaucuauauuu

SEQ ID NO: 2032344 - RNA, 17 nt, Human
gcccuuccccucugcag

SEQ ID NO: 2032345 - RNA, 20 nt, Human
cugagguuguguguggaagg

SEQ ID NO: 2032346 - RNA, 21 nt, Human
aauuaaguuuuuuuuuaaaaa

SEQ ID NO: 2032347 - RNA, 13 nt, Human
uauuuauuuuaau

SEQ ID NO: 2032348 - RNA, 14 nt, Human
uugcuggagcucug

SEQ ID NO: 2032349 - RNA, 18 nt, Human
auuuauuacuguaagaaa

SEQ ID NO: 2032350 - RNA, 21 nt, Human
uugccuaggcauagcccugcc

SEQ ID NO: 2032351 - RNA, 13 nt, Human
ccugccccccagc

SEQ ID NO: 2032352 - RNA, 18 nt, Human
aaguugauaugccuuuuc

SEQ ID NO: 2032353 - RNA, 17 nt, Human
agaaucacuugaacccg

SEQ ID NO: 2032354 - RNA, 17 nt, Human
aacaguuaccucugccu

SEQ ID NO: 2032355 - RNA, 23 nt, Human
ugcauagguuuaauaauuuuuaa

SEQ ID NO: 2032356 - RNA, 23 nt, Human
aauacacuguuaucuucacuuuu

SEQ ID NO: 2032357 - RNA, 19 nt, Human
uacucuuauaucuauauuu

SEQ ID NO: 2032358 - RNA, 23 nt, Human
ggccugagaccaaggcccccggg

SEQ ID NO: 2032359 - RNA, 15 nt, Human
uccauugggcaggca

SEQ ID NO: 2032360 - RNA, 19 nt, Human
uagugagcagucaggaaag

SEQ ID NO: 2032361 - RNA, 16 nt, Human
uaagaaauaggaaaua

SEQ ID NO: 2032362 - RNA, 19 nt, Human
uggaacaguuaccucugcc

SEQ ID NO: 2032363 - RNA, 15 nt, Human
aauauaaauaaaaau

SEQ ID NO: 2032364 - RNA, 15 nt, Human
uauaaauaaaaauaa

SEQ ID NO: 2032365 - RNA, 23 nt, Human
acuuuccaauaaagaguuccuuc

SEQ ID NO: 2032366 - RNA, 20 nt, Human
ucuucagcagagaaguuuuc

SEQ ID NO: 2032367 - RNA, 13 nt, Human
ugguccuaagucc

SEQ ID NO: 2032368 - RNA, 23 nt, Human
agggcgcggggcggggagcgagc

SEQ ID NO: 2032369 - RNA, 14 nt, Human
acagaauuuuaugc

SEQ ID NO: 2032370 - RNA, 11 nt, Human
gcgcuggcugc

SEQ ID NO: 2032371 - RNA, 21 nt, Human
caaagcccagcuugaaaccuu

SEQ ID NO: 2032372 - RNA, 13 nt, Human
ugaauauaaauuu

SEQ ID NO: 2032373 - RNA, 21 nt, Human
aguuagcuuucuuccuggauu

SEQ ID NO: 2032374 - RNA, 22 nt, Human
aagacccaaaaggcagaagcaa

SEQ ID NO: 2032375 - RNA, 18 nt, Human
auuuuaacucuauaaugu

SEQ ID NO: 2032376 - RNA, 21 nt, Human
aggcucuuuugggauuuuuga

SEQ ID NO: 2032377 - RNA, 15 nt, Human
uccuaagucccugcu

SEQ ID NO: 2032378 - RNA, 14 nt, Human
gauaugugaacagu

SEQ ID NO: 2032379 - RNA, 17 nt, Human
ucuuauaauuuaaaaua

SEQ ID NO: 2032380 - RNA, 22 nt, Human
uccgcauccuagucucuaucau

SEQ ID NO: 2032381 - RNA, 17 nt, Human
uccucugagccuuggga

SEQ ID NO: 2032382 - RNA, 14 nt, Human
auggaaguaaaugu

SEQ ID NO: 2032383 - RNA, 19 nt, Human
auucccagccagcacagcc

SEQ ID NO: 2032384 - RNA, 19 nt, Human
acuggacucaccuccccca

SEQ ID NO: 2032385 - RNA, 19 nt, Human
gagacauugaggcaggcac

SEQ ID NO: 2032386 - RNA, 15 nt, Human
agguauuuaauaggu

SEQ ID NO: 2032387 - RNA, 13 nt, Human
uuaugcuaaguga

SEQ ID NO: 2032388 - RNA, 19 nt, Human
aggucuaccaaaaaucuca

SEQ ID NO: 2032389 - RNA, 14 nt, Human
uuaugauuaaguaa

SEQ ID NO: 2032390 - RNA, 17 nt, Human
caauaacgauaaaagac

SEQ ID NO: 2032391 - RNA, 16 nt, Human
auuuuuuuuuuuaaaa

SEQ ID NO: 2032392 - RNA, 21 nt, Human
auuuguauaaaauaauuuuua

SEQ ID NO: 2032393 - RNA, 15 nt, Human
cuccucaacucugag

SEQ ID NO: 2032394 - RNA, 13 nt, Human
aguguuuagcaua

SEQ ID NO: 2032395 - RNA, 19 nt, Human
caagcagcccuuagcccuu

SEQ ID NO: 2032396 - RNA, 13 nt, Human
cccaaaaggcaga

SEQ ID NO: 2032397 - RNA, 15 nt, Human
aaaugauguuucaua

SEQ ID NO: 2032398 - RNA, 18 nt, Human
cuuucacauuuaaauaaa

SEQ ID NO: 2032399 - RNA, 13 nt, Human
uaaaaguuuaagu

SEQ ID NO: 2032400 - RNA, 19 nt, Human
uuggcaagcucuaucacca

SEQ ID NO: 2032401 - RNA, 17 nt, Human
aauucuugccaaauaua

SEQ ID NO: 2032402 - RNA, 21 nt, Human
aagauauuaacugagaaggcu

SEQ ID NO: 2032403 - RNA, 16 nt, Human
aucaaguuauuuuuaa

SEQ ID NO: 2032404 - RNA, 16 nt, Human
guucugcacacagcac

SEQ ID NO: 2032405 - RNA, 18 nt, Human
cccucuggcuccagcugg

SEQ ID NO: 2032406 - RNA, 14 nt, Human
uaguuucccuugca

SEQ ID NO: 2032407 - RNA, 17 nt, Human
ugcuguucaugaaagau

SEQ ID NO: 2032408 - RNA, 14 nt, Human
cagagucaagggug

SEQ ID NO: 2032409 - RNA, 20 nt, Human
guauuuaauagguuuggaca

SEQ ID NO: 2032410 - RNA, 19 nt, Human
cagagaugaggccgccaug

SEQ ID NO: 2032411 - RNA, 17 nt, Human
aagacagugaaagaaaa

SEQ ID NO: 2032412 - RNA, 21 nt, Human
uuuuagggguagcauuugugu

SEQ ID NO: 2032413 - RNA, 15 nt, Human
gcgcgccuccgcuac

SEQ ID NO: 2032414 - RNA, 19 nt, Human
gagcucaccagucccuccc

SEQ ID NO: 2032415 - RNA, 16 nt, Human
gccaaggaugccccgu

SEQ ID NO: 2032416 - RNA, 23 nt, Human
acguaaucguguccccuauccua

SEQ ID NO: 2032417 - RNA, 20 nt, Human
cugccgugggccugagacca

SEQ ID NO: 2032418 - RNA, 20 nt, Human
uuucuuccuggauuccucac

SEQ ID NO: 2032419 - RNA, 13 nt, Human
ucugcagcuucca

SEQ ID NO: 2032420 - RNA, 18 nt, Human
acuguaaagcuuugugca

SEQ ID NO: 2032421 - RNA, 20 nt, Human
acuauagugugagccaggaa

SEQ ID NO: 2032422 - RNA, 21 nt, Human
cugcgcucggccugcucgccc

SEQ ID NO: 2032423 - RNA, 15 nt, Human
cgcgcuccgcgcagc

SEQ ID NO: 2032424 - RNA, 23 nt, Human
auuauauggcuugaguuuaaauu

SEQ ID NO: 2032425 - RNA, 17 nt, Human
gccaugugcagccacca

SEQ ID NO: 2032426 - RNA, 18 nt, Human
gaugcaguucugaagaag

SEQ ID NO: 2032427 - RNA, 16 nt, Human
caauaacgauaaaaga

SEQ ID NO: 2032428 - RNA, 21 nt, Human
gauuauauauauuuuuuucug

SEQ ID NO: 2032429 - RNA, 17 nt, Human
uauuuauuaaguauuuu

SEQ ID NO: 2032430 - RNA, 14 nt, Human
aaaagacagugaaa

SEQ ID NO: 2032431 - RNA, 19 nt, Human
ugcagcgaguacuucccgc

SEQ ID NO: 2032432 - RNA, 13 nt, Human
uaguuuauauaga

SEQ ID NO: 2032433 - RNA, 18 nt, Human
uauauuuccuuauucaga

SEQ ID NO: 2032434 - RNA, 11 nt, Human
gggaaagaaga

SEQ ID NO: 2032435 - RNA, 22 nt, Human
auauaaauaaaaauaauccuca

SEQ ID NO: 2032436 - RNA, 17 nt, Human
guauuauuuuuuaaaaa

SEQ ID NO: 2032437 - RNA, 12 nt, Human
ucaccccuugcc

SEQ ID NO: 2032438 - RNA, 16 nt, Human
ugcauagguuuaauaa

SEQ ID NO: 2032439 - RNA, 21 nt, Human
ucuuauaucuauauuuuacau

SEQ ID NO: 2032440 - RNA, 19 nt, Human
cuguuauuuuaucugcuau

SEQ ID NO: 2032441 - RNA, 15 nt, Human
aaugaauggcuaagc

SEQ ID NO: 2032442 - RNA, 22 nt, Human
agagccggagccuccagcugcc

SEQ ID NO: 2032443 - RNA, 20 nt, Human
cgcgcucaucccacccgccc

SEQ ID NO: 2032444 - RNA, 22 nt, Human
caaugcuguauuuuaaaagaau

SEQ ID NO: 2032445 - RNA, 18 nt, Human
aucagcaucccuagaaag

SEQ ID NO: 2032446 - RNA, 12 nt, Human
aagaaaauaacg

SEQ ID NO: 2032447 - RNA, 12 nt, Human
gcauccuagucu

SEQ ID NO: 2032448 - RNA, 20 nt, Human
uagaagucacauuccugaac

SEQ ID NO: 2032449 - RNA, 15 nt, Human
gccguccccagagcu

SEQ ID NO: 2032450 - RNA, 14 nt, Human
uuccccucugcagc

SEQ ID NO: 2032451 - RNA, 22 nt, Human
auauauaacaaugcuguauuuu

SEQ ID NO: 2032452 - RNA, 20 nt, Human
ucaaaacuucagacauagaa

SEQ ID NO: 2032453 - RNA, 16 nt, Human
guuggcuguuccugca

SEQ ID NO: 2032454 - RNA, 17 nt, Human
gccgggaaagaagagcc

SEQ ID NO: 2032455 - RNA, 15 nt, Human
auagaaguaaaaaca

SEQ ID NO: 2032456 - RNA, 22 nt, Human
gaagugaaaaucuacacuccag

SEQ ID NO: 2032457 - RNA, 15 nt, Human
ucaguuuuugugaaa

SEQ ID NO: 2032458 - RNA, 16 nt, Human
ugcuguauuuuaaaag

SEQ ID NO: 2032459 - RNA, 15 nt, Human
cauuuacuuuuaaac

SEQ ID NO: 2032460 - RNA, 21 nt, Human
cgcccacuuccucccggccgc

SEQ ID NO: 2032461 - RNA, 13 nt, Human
aaaugggaaacaa

SEQ ID NO: 2032462 - RNA, 14 nt, Human
ugaagauguagagg

SEQ ID NO: 2032463 - RNA, 15 nt, Human
cccugcaaagcccag

SEQ ID NO: 2032464 - RNA, 15 nt, Human
uguuaucuucacuuu

SEQ ID NO: 2032465 - RNA, 19 nt, Human
uaccuccaaggaccggccu

SEQ ID NO: 2032466 - RNA, 22 nt, Human
uuuauggcacuaguauuucuau

SEQ ID NO: 2032467 - RNA, 14 nt, Human
gggaagacaagaag

SEQ ID NO: 2032468 - RNA, 14 nt, Human
agugucuugaauug

SEQ ID NO: 2032469 - RNA, 15 nt, Human
acucaacaaacauaa

SEQ ID NO: 2032470 - RNA, 16 nt, Human
acaugaacuuguaaag

SEQ ID NO: 2032471 - RNA, 16 nt, Human
aaagacaaggaaaaaa

SEQ ID NO: 2032472 - RNA, 18 nt, Human
ggagccgggaaagaagag

SEQ ID NO: 2032473 - RNA, 20 nt, Human
augcuucuguuuuauaauuu

SEQ ID NO: 2032474 - RNA, 12 nt, Human
agugcagccccg

SEQ ID NO: 2032475 - RNA, 20 nt, Human
agccuuuuuuugaaaaaaag

SEQ ID NO: 2032476 - RNA, 15 nt, Human
cccaucucaggugug

SEQ ID NO: 2032477 - RNA, 15 nt, Human
auaggaaauauuuua

SEQ ID NO: 2032478 - RNA, 13 nt, Human
aaguucuagugac

SEQ ID NO: 2032479 - RNA, 22 nt, Human
uaauaggcguaacuaauuuuaa

SEQ ID NO: 2032480 - RNA, 21 nt, Human
caguaguuagcuuucuuccug

SEQ ID NO: 2032481 - RNA, 14 nt, Human
acacugaagaagca

SEQ ID NO: 2032482 - RNA, 15 nt, Human
uucggccuccauccu

SEQ ID NO: 2032483 - RNA, 20 nt, Human
ggcuaauaucuuaucuuccu

SEQ ID NO: 2032484 - RNA, 16 nt, Human
guugauggaaauacac

SEQ ID NO: 2032485 - RNA, 13 nt, Human
cuucuuucaugaa

SEQ ID NO: 2032486 - RNA, 19 nt, Human
ccccucuggcuccagcugg

SEQ ID NO: 2032487 - RNA, 20 nt, Human
aagcuucacuguaaaauaau

SEQ ID NO: 2032488 - RNA, 13 nt, Human
aucaggcuggcca

SEQ ID NO: 2032489 - RNA, 22 nt, Human
agaauuuuaugcggcauuuucu

SEQ ID NO: 2032490 - RNA, 17 nt, Human
aucaaggguacacugcc

SEQ ID NO: 2032491 - RNA, 15 nt, Human
ggcuggcgugcagca

SEQ ID NO: 2032492 - RNA, 12 nt, Human
uuuuuuuuaaaa

SEQ ID NO: 2032493 - RNA, 12 nt, Human
uugggcaggcag

SEQ ID NO: 2032494 - RNA, 20 nt, Human
acggcuccggacgcugcugc

SEQ ID NO: 2032495 - RNA, 21 nt, Human
auaauuuuuauauuugaaaua

SEQ ID NO: 2032496 - RNA, 22 nt, Human
uugaaaaucuuauaauuuaaaa

SEQ ID NO: 2032497 - RNA, 13 nt, Human
cugaauuuaaaua

SEQ ID NO: 2032498 - RNA, 19 nt, Human
uggccacaucugagccccg

SEQ ID NO: 2032499 - RNA, 23 nt, Human
uagauaggucagugcaaauacuc

SEQ ID NO: 2032500 - RNA, 14 nt, Human
uaaccucuaaauuc

SEQ ID NO: 2032501 - RNA, 21 nt, Human
ccuagucucuaucauuaaagu

SEQ ID NO: 2032502 - RNA, 21 nt, Human
agggugauauuaaccaggggc

SEQ ID NO: 2032503 - RNA, 20 nt, Human
aaaagacagugaaagaaaau

SEQ ID NO: 2032504 - RNA, 23 nt, Human
ggccugcucgcccacuuccuccc

SEQ ID NO: 2032505 - RNA, 13 nt, Human
uaugaaauauuau

SEQ ID NO: 2032506 - RNA, 22 nt, Human
uaaaauaauuuuuauauuugaa

SEQ ID NO: 2032507 - RNA, 15 nt, Human
aggcagauguuccua

SEQ ID NO: 2032508 - RNA, 14 nt, Human
ccagcuggccggga

SEQ ID NO: 2032509 - RNA, 20 nt, Human
cugcacacagcacgggggcc

SEQ ID NO: 2032510 - RNA, 15 nt, Human
uuauagcuacuaauu

SEQ ID NO: 2032511 - RNA, 17 nt, Human
uuaaauggucaauuuug

SEQ ID NO: 2032512 - RNA, 20 nt, Human
uuucuucaacucccugcccc

SEQ ID NO: 2032513 - RNA, 22 nt, Human
accuuaucuauguagaauauau

SEQ ID NO: 2032514 - RNA, 15 nt, Human
cuugaaaacuuuaug

SEQ ID NO: 2032515 - RNA, 23 nt, Human
aucuaugccacaagaacccccuu

SEQ ID NO: 2032516 - RNA, 20 nt, Human
agaggagaaacuggaacucu

SEQ ID NO: 2032517 - RNA, 13 nt, Human
acacuuaaaaaug

SEQ ID NO: 2032518 - RNA, 23 nt, Human
uccaaacugacucuuaagaagac

SEQ ID NO: 2032519 - RNA, 18 nt, Human
aucuggcucuggacaggc

SEQ ID NO: 2032520 - RNA, 23 nt, Human
aucgcagacacaugugcuggcca

SEQ ID NO: 2032521 - RNA, 13 nt, Human
auauuuuauuaua

SEQ ID NO: 2032522 - RNA, 15 nt, Human
cauguccacugguuc

SEQ ID NO: 2032523 - RNA, 13 nt, Human
aauaucucuucuc

SEQ ID NO: 2032524 - RNA, 15 nt, Human
gacucaccuccccca

SEQ ID NO: 2032525 - RNA, 14 nt, Human
cuggaaaucagggu

SEQ ID NO: 2032526 - RNA, 13 nt, Human
uuaaaaaagaaac

SEQ ID NO: 2032527 - RNA, 20 nt, Human
auacugugugcuaaaacaag

SEQ ID NO: 2032528 - RNA, 21 nt, Human
gcuggccaccugcugagcccc

SEQ ID NO: 2032529 - RNA, 22 nt, Human
ugagacucugucucaguccaug

SEQ ID NO: 2032530 - RNA, 16 nt, Human
aauauaaauaaaaaua

SEQ ID NO: 2032531 - RNA, 18 nt, Human
acugccuucucaacucca

SEQ ID NO: 2032532 - RNA, 15 nt, Human
cugcagauaaacagu

SEQ ID NO: 2032533 - RNA, 15 nt, Human
agcucuaucaccaag

SEQ ID NO: 2032534 - RNA, 16 nt, Human
uauuuuugugauuuug

SEQ ID NO: 2032535 - RNA, 13 nt, Human
caccaaggagcca

SEQ ID NO: 2032536 - RNA, 18 nt, Human
uuguacucugaaaguuuu

SEQ ID NO: 2032537 - RNA, 16 nt, Human
aggccaugggacaggg

SEQ ID NO: 2032538 - RNA, 22 nt, Human
agacccacuggacucaccuccc

SEQ ID NO: 2032539 - RNA, 20 nt, Human
cucggacggcuccggacgcu

SEQ ID NO: 2032540 - RNA, 16 nt, Human
cugcucucaguucacu

SEQ ID NO: 2032541 - RNA, 22 nt, Human
ucauucccguugaacgucacau

SEQ ID NO: 2032542 - RNA, 13 nt, Human
accaacacccuga

SEQ ID NO: 2032543 - RNA, 19 nt, Human
ccaccugccuauauuuuuu

SEQ ID NO: 2032544 - RNA, 17 nt, Human
caaauauaaauaaaaau

SEQ ID NO: 2032545 - RNA, 22 nt, Human
gaaaacaauaacgauaaaagac

SEQ ID NO: 2032546 - RNA, 16 nt, Human
accucugccucagaaa

SEQ ID NO: 2032547 - RNA, 14 nt, Human
uaaauuuaucauuu

SEQ ID NO: 2032548 - RNA, 17 nt, Human
agccuccagcugccccg

SEQ ID NO: 2032549 - RNA, 14 nt, Human
aauuguauuacaaa

SEQ ID NO: 2032550 - RNA, 14 nt, Human
cucugccucagaaa

SEQ ID NO: 2032551 - RNA, 19 nt, Human
ccuccauccugaggcucca

SEQ ID NO: 2032552 - RNA, 19 nt, Human
cggccugcucgcccacuuc

SEQ ID NO: 2032553 - RNA, 17 nt, Human
cuaguuguaauuuuuuu

SEQ ID NO: 2032554 - RNA, 15 nt, Human
aaauaauuuuuauau

SEQ ID NO: 2032555 - RNA, 18 nt, Human
aguucuccacuagcuaug

SEQ ID NO: 2032556 - RNA, 14 nt, Human
augggccauaugaa

SEQ ID NO: 2032557 - RNA, 15 nt, Human
cagugucugcuggag

SEQ ID NO: 2032558 - RNA, 16 nt, Human
cuggaugcucucguug

SEQ ID NO: 2032559 - RNA, 18 nt, Human
uauagcuacuaauuuuaa

SEQ ID NO: 2032560 - RNA, 20 nt, Human
agccuuggggcugaugcagu

SEQ ID NO: 2032561 - RNA, 15 nt, Human
aaaacaggcaaauuc

SEQ ID NO: 2032562 - RNA, 22 nt, Human
aaagagugaaggauuuauguuu

SEQ ID NO: 2032563 - RNA, 21 nt, Human
ugaaauggacuuuuguacaua

SEQ ID NO: 2032564 - RNA, 13 nt, Human
acuauuauauuuc

SEQ ID NO: 2032565 - RNA, 16 nt, Human
guuaucuucacuuuua

SEQ ID NO: 2032566 - RNA, 13 nt, Human
uguauauuuuaua

SEQ ID NO: 2032567 - RNA, 16 nt, Human
uuucuauaauuuaaau

SEQ ID NO: 2032568 - RNA, 11 nt, Human
uucacagggga

SEQ ID NO: 2032569 - RNA, 19 nt, Human
uaggugacuauuauauuuc

SEQ ID NO: 2032570 - RNA, 21 nt, Human
gccugaucaccugcccugcug

SEQ ID NO: 2032571 - RNA, 15 nt, Human
aguuuauauagaaau

SEQ ID NO: 2032572 - RNA, 16 nt, Human
ucugcagauaaacagu

SEQ ID NO: 2032573 - RNA, 20 nt, Human
gaacguaaucguguccccua

SEQ ID NO: 2032574 - RNA, 21 nt, Human
auuauauuuauuacuguaaga

SEQ ID NO: 2032575 - RNA, 17 nt, Human
ccagggaagacaagaag

SEQ ID NO: 2032576 - RNA, 21 nt, Human
augucauuugcuggagcucug

SEQ ID NO: 2032577 - RNA, 16 nt, Human
guugagguaccuccaa

SEQ ID NO: 2032578 - RNA, 21 nt, Human
cugguagcuaaauauauauuu

SEQ ID NO: 2032579 - RNA, 14 nt, Human
gauuaguacacacu

SEQ ID NO: 2032580 - RNA, 12 nt, Human
cuccaaggaccg

SEQ ID NO: 2032581 - RNA, 15 nt, Human
gcugcgcucggccug

SEQ ID NO: 2032582 - RNA, 17 nt, Human
ucuuuaucuuuuuagua

SEQ ID NO: 2032583 - RNA, 13 nt, Human
ugaaagaaaauaa

SEQ ID NO: 2032584 - RNA, 22 nt, Human
gaauuaaguuuuuuuuuaaaaa

SEQ ID NO: 2032585 - RNA, 15 nt, Human
uguauuuuaaaagaa

SEQ ID NO: 2032586 - RNA, 17 nt, Human
gcaugguuuagaaagcu

SEQ ID NO: 2032587 - RNA, 22 nt, Human
acagauuugagcucagcccugg

SEQ ID NO: 2032588 - RNA, 16 nt, Human
aaauaguuuaugauuc

SEQ ID NO: 2032589 - RNA, 17 nt, Human
ccacuggacucaccucc

SEQ ID NO: 2032590 - RNA, 19 nt, Human
ccgcagggugaacugcagc

SEQ ID NO: 2032591 - RNA, 12 nt, Human
cuuaucuuccua

SEQ ID NO: 2032592 - RNA, 16 nt, Human
ccaugugcagccacca

SEQ ID NO: 2032593 - RNA, 15 nt, Human
uccauccugaggcuc

SEQ ID NO: 2032594 - RNA, 20 nt, Human
ucugguagcuaaauauauau

SEQ ID NO: 2032595 - RNA, 20 nt, Human
gcccauccugccccugagcc

SEQ ID NO: 2032596 - RNA, 18 nt, Human
acugacucuuaagaagac

SEQ ID NO: 2032597 - RNA, 17 nt, Human
aaaaguugaauuuuaca

SEQ ID NO: 2032598 - RNA, 16 nt, Human
guuccuuccucugagc

SEQ ID NO: 2032599 - RNA, 17 nt, Human
gacagucaccucaugga

SEQ ID NO: 2032600 - RNA, 15 nt, Human
agucccugcugcccu

SEQ ID NO: 2032601 - RNA, 13 nt, Human
auaauuuuagaca

SEQ ID NO: 2032602 - RNA, 14 nt, Human
ccaugggacaggga

SEQ ID NO: 2032603 - RNA, 23 nt, Human
uccaacuaucucauuuccaagca

SEQ ID NO: 2032604 - RNA, 18 nt, Human
uggcucuggacaggcacu

SEQ ID NO: 2032605 - RNA, 15 nt, Human
aaaauaacaaugaaa

SEQ ID NO: 2032606 - RNA, 20 nt, Human
auuuucaguuauuauauuua

SEQ ID NO: 2032607 - RNA, 23 nt, Human
cagagucaagggugugugcagca

SEQ ID NO: 2032608 - RNA, 14 nt, Human
cccugccccccagc

SEQ ID NO: 2032609 - RNA, 16 nt, Human
caggaaguagaggagg

SEQ ID NO: 2032610 - RNA, 16 nt, Human
uaaaauccauacauuu

SEQ ID NO: 2032611 - RNA, 17 nt, Human
uuaauaauuuuuaauua

SEQ ID NO: 2032612 - RNA, 18 nt, Human
cuucacuguaaaauaaua

SEQ ID NO: 2032613 - RNA, 15 nt, Human
cuuaagaagacugca

SEQ ID NO: 2032614 - RNA, 16 nt, Human
cccuauccuacuuccc

SEQ ID NO: 2032615 - RNA, 20 nt, Human
ccauuguggucacaggaagu

SEQ ID NO: 2032616 - RNA, 12 nt, Human
auuuuaaaagaa

SEQ ID NO: 2032617 - RNA, 20 nt, Human
ucuaugagggcuaauaucuu

SEQ ID NO: 2032618 - RNA, 19 nt, Human
ggaauuucuucaacucccu

SEQ ID NO: 2032619 - RNA, 14 nt, Human
auuuauguuuaauu

SEQ ID NO: 2032620 - RNA, 21 nt, Human
cagcucaggcuggcaccgcug

SEQ ID NO: 2032621 - RNA, 14 nt, Human
cugcaaagcccagc

SEQ ID NO: 2032622 - RNA, 16 nt, Human
uuucacauuuaaauaa

SEQ ID NO: 2032623 - RNA, 21 nt, Human
aaaugucuugcuugauuguau

SEQ ID NO: 2032624 - RNA, 19 nt, Human
gcauggccacaucugagcc

SEQ ID NO: 2032625 - RNA, 23 nt, Human
uauuuuauuaggaguaccauaau

SEQ ID NO: 2032626 - RNA, 18 nt, Human
uaggaaauauuuuaaugu

SEQ ID NO: 2032627 - RNA, 18 nt, Human
uggucaauuuuguuaugu

SEQ ID NO: 2032628 - RNA, 14 nt, Human
cagauuugagcuca

SEQ ID NO: 2032629 - RNA, 18 nt, Human
uggccaccugcugagccc

SEQ ID NO: 2032630 - RNA, 15 nt, Human
gcaagcucuaucacc

SEQ ID NO: 2032631 - RNA, 17 nt, Human
ccaaaagguauuuuaau

SEQ ID NO: 2032632 - RNA, 19 nt, Human
gucuuucacauuuaaauaa

SEQ ID NO: 2032633 - RNA, 22 nt, Human
uauuucuaugaaauauuauguu

SEQ ID NO: 2032634 - RNA, 18 nt, Human
cagggaggacgcucucug

SEQ ID NO: 2032635 - RNA, 15 nt, Human
uugacacuuaaaaau

SEQ ID NO: 2032636 - RNA, 19 nt, Human
gcuguacgcgagcgcgcgc

SEQ ID NO: 2032637 - RNA, 23 nt, Human
uccagguagaggguguguaagua

SEQ ID NO: 2032638 - RNA, 13 nt, Human
uacagagacagaa

SEQ ID NO: 2032639 - RNA, 15 nt, Human
cagucucccucccuu

SEQ ID NO: 2032640 - RNA, 18 nt, Human
cucccuuggggccuaugc

SEQ ID NO: 2032641 - RNA, 20 nt, Human
guguggaaggugaucuggcu

SEQ ID NO: 2032642 - RNA, 14 nt, Human
acuaauuuuaaaau

SEQ ID NO: 2032643 - RNA, 16 nt, Human
uagagaauuuccuuac

SEQ ID NO: 2032644 - RNA, 23 nt, Human
uaaaagacagugaaagaaaauaa

SEQ ID NO: 2032645 - RNA, 21 nt, Human
gaauuuaaauagcuuuuuucu

SEQ ID NO: 2032646 - RNA, 18 nt, Human
uaaaagacagugaaagaa

SEQ ID NO: 2032647 - RNA, 17 nt, Human
cagacaucaacagauaa

SEQ ID NO: 2032648 - RNA, 19 nt, Human
auguuuacagauccccaag

SEQ ID NO: 2032649 - RNA, 16 nt, Human
aagaaaauaacaauaa

SEQ ID NO: 2032650 - RNA, 19 nt, Human
aaaagacagugaaagaaaa

SEQ ID NO: 2032651 - RNA, 16 nt, Human
cuguucgcgcgccucc

SEQ ID NO: 2032652 - RNA, 15 nt, Human
aaugauuaugaauua

SEQ ID NO: 2032653 - RNA, 21 nt, Human
cacuaucuggguuuugggggg

SEQ ID NO: 2032654 - RNA, 21 nt, Human
cuaagcuucacuguaaaauaa

SEQ ID NO: 2032655 - RNA, 17 nt, Human
auguuuacagaucccca

SEQ ID NO: 2032656 - RNA, 15 nt, Human
acgagauacagaauu

SEQ ID NO: 2032657 - RNA, 14 nt, Human
uuuuauaugcuauu

SEQ ID NO: 2032658 - RNA, 11 nt, Human
caauaaaagac

SEQ ID NO: 2032659 - RNA, 21 nt, Human
gacagaaagcagaacagugau

SEQ ID NO: 2032660 - RNA, 20 nt, Human
agcccuggugggcagagagg

SEQ ID NO: 2032661 - RNA, 16 nt, Human
cuccauccugaggcuc

SEQ ID NO: 2032662 - RNA, 14 nt, Human
ggaaguagaggagg

SEQ ID NO: 2032663 - RNA, 13 nt, Human
cgcuuccgcaucc

SEQ ID NO: 2032664 - RNA, 14 nt, Human
cgcuccgcgcagcu

SEQ ID NO: 2032665 - RNA, 17 nt, Human
ccugugccguccccaga

SEQ ID NO: 2032666 - RNA, 20 nt, Human
uaguuauaaaaauauauagc

SEQ ID NO: 2032667 - RNA, 18 nt, Human
ggccuugugaggagcugg

SEQ ID NO: 2032668 - RNA, 22 nt, Human
gcuccgcgcagcucaggcuggc

SEQ ID NO: 2032669 - RNA, 22 nt, Human
cugugccguccccagagcuaca

SEQ ID NO: 2032670 - RNA, 12 nt, Human
guugauggaaau

SEQ ID NO: 2032671 - RNA, 21 nt, Human
agccucuuagaugcaguucug

SEQ ID NO: 2032672 - RNA, 19 nt, Human
aaacaauaacgauaaaaga

SEQ ID NO: 2032673 - RNA, 17 nt, Human
guugcugggggggauug

SEQ ID NO: 2032674 - RNA, 22 nt, Human
uccaugaguugcaguuuuuucc

SEQ ID NO: 2032675 - RNA, 21 nt, Human
gccacgcucugggucgccggc

SEQ ID NO: 2032676 - RNA, 23 nt, Human
cauuguggucacaggaaguagag

SEQ ID NO: 2032677 - RNA, 13 nt, Human
cggccggcgcgcu

SEQ ID NO: 2032678 - RNA, 22 nt, Human
cagcacgggggccaaggaugcc

SEQ ID NO: 2032679 - RNA, 14 nt, Human
gagcucagcccugg

SEQ ID NO: 2032680 - RNA, 14 nt, Human
ccuugaugaagaag

SEQ ID NO: 2032681 - RNA, 22 nt, Human
cccagcccuccuuaucaaagga

SEQ ID NO: 2032682 - RNA, 22 nt, Human
aaagcuuugugcagauucuuua

SEQ ID NO: 2032683 - RNA, 14 nt, Human
gccgcgcuccucgg

SEQ ID NO: 2032684 - RNA, 16 nt, Human
aguugaauuuuacaug

SEQ ID NO: 2032685 - RNA, 14 nt, Human
agcucuaucaccaa

SEQ ID NO: 2032686 - RNA, 15 nt, Human
ugccccccagcccuc

SEQ ID NO: 2032687 - RNA, 18 nt, Human
auguuucauaagaauucu

SEQ ID NO: 2032688 - RNA, 17 nt, Human
gcgcucaucccacccgc

SEQ ID NO: 2032689 - RNA, 19 nt, Human
cuguccauucuuccuccca

SEQ ID NO: 2032690 - RNA, 11 nt, Human
augggacaggg

SEQ ID NO: 2032691 - RNA, 15 nt, Human
cauuccaagccucau

SEQ ID NO: 2032692 - RNA, 14 nt, Human
caaaugcauuucua

SEQ ID NO: 2032693 - RNA, 17 nt, Human
gggaaauccacacugag

SEQ ID NO: 2032694 - RNA, 13 nt, Human
aacaauaaaagac

SEQ ID NO: 2032695 - RNA, 17 nt, Human
ucuauaauuuaaauaua

SEQ ID NO: 2032696 - RNA, 21 nt, Human
auacauaaaguaugugcauau

SEQ ID NO: 2032697 - RNA, 12 nt, Human
cuccagcugccc

SEQ ID NO: 2032698 - RNA, 22 nt, Human
acaugagguacugagagugaac

SEQ ID NO: 2032699 - RNA, 23 nt, Human
gguggcgcuggcugcgcucggcc

SEQ ID NO: 2032700 - RNA, 14 nt, Human
ccuuaucaaaggac

SEQ ID NO: 2032701 - RNA, 22 nt, Human
agucuuucacauuuaaauaaag

SEQ ID NO: 2032702 - RNA, 16 nt, Human
auaucaauuuaaaaaa

SEQ ID NO: 2032703 - RNA, 18 nt, Human
cuuuccacagaagcucca

SEQ ID NO: 2032704 - RNA, 22 nt, Human
agaugaucaguaugaaaauguc

SEQ ID NO: 2032705 - RNA, 21 nt, Human
agcauuuguguugaagagguu

SEQ ID NO: 2032706 - RNA, 14 nt, Human
gaaaacaauaacga

SEQ ID NO: 2032707 - RNA, 20 nt, Human
cagcuuccaggcuggcgugc

SEQ ID NO: 2032708 - RNA, 12 nt, Human
uucucuaggaaa

SEQ ID NO: 2032709 - RNA, 19 nt, Human
uguaguguuggagaagaac

SEQ ID NO: 2032710 - RNA, 20 nt, Human
ggccaugggacagggaggac

SEQ ID NO: 2032711 - RNA, 14 nt, Human
aaaagaaacauuug

SEQ ID NO: 2032712 - RNA, 18 nt, Human
aaagaaaaucaggcuggc

SEQ ID NO: 2032713 - RNA, 12 nt, Human
cugcccuucccc

SEQ ID NO: 2032714 - RNA, 14 nt, Human
cuaggacugaauua

SEQ ID NO: 2032715 - RNA, 13 nt, Human
ugggaggcugaga

SEQ ID NO: 2032716 - RNA, 13 nt, Human
aacucccugcccc

SEQ ID NO: 2032717 - RNA, 14 nt, Human
cugguggcucugug

SEQ ID NO: 2032718 - RNA, 16 nt, Human
cugcugagucccaggc

SEQ ID NO: 2032719 - RNA, 21 nt, Human
uaggugacuauuauauuucca

SEQ ID NO: 2032720 - RNA, 18 nt, Human
ccggagccuccagcugcc

SEQ ID NO: 2032721 - RNA, 14 nt, Human
ccucagucucccuc

SEQ ID NO: 2032722 - RNA, 16 nt, Human
auaauccuaaacauau

SEQ ID NO: 2032723 - RNA, 18 nt, Human
caaaaagcuacuuauugu

SEQ ID NO: 2032724 - RNA, 21 nt, Human
uccauccugaggcuccacuug

SEQ ID NO: 2032725 - RNA, 14 nt, Human
uuuguauaaaauaa

SEQ ID NO: 2032726 - RNA, 17 nt, Human
cagggcugaagcugugu

SEQ ID NO: 2032727 - RNA, 16 nt, Human
gcaggcagauguuccu

SEQ ID NO: 2032728 - RNA, 17 nt, Human
cgcgagcgcgcgcgccc

SEQ ID NO: 2032729 - RNA, 20 nt, Human
aagaugguaccaccagucug

SEQ ID NO: 2032730 - RNA, 22 nt, Human
aauaugccccauucaacaucua

SEQ ID NO: 2032731 - RNA, 21 nt, Human
agucucccucccuuggggccu

SEQ ID NO: 2032732 - RNA, 13 nt, Human
ucaucccacccgc

SEQ ID NO: 2032733 - RNA, 20 nt, Human
caaauauaaauaaaaauaau

SEQ ID NO: 2032734 - RNA, 16 nt, Human
uauaugucacuuugcu

SEQ ID NO: 2032735 - RNA, 11 nt, Human
uaguuagcuuu

SEQ ID NO: 2032736 - RNA, 23 nt, Human
aguacucauacauguuacaacac

SEQ ID NO: 2032737 - RNA, 21 nt, Human
acagugauuaccagggacuga

SEQ ID NO: 2032738 - RNA, 17 nt, Human
uauauauuuuuuucuga

SEQ ID NO: 2032739 - RNA, 23 nt, Human
gggaaacaaaaggauaaugaaua

SEQ ID NO: 2032740 - RNA, 20 nt, Human
uaauaaguugcauagguuua

SEQ ID NO: 2032741 - RNA, 15 nt, Human
agccucagucucccu

SEQ ID NO: 2032742 - RNA, 14 nt, Human
agcugccucucuca

SEQ ID NO: 2032743 - RNA, 14 nt, Human
aacgauaaaagaca

SEQ ID NO: 2032744 - RNA, 16 nt, Human
agcccugccucaagcu

SEQ ID NO: 2032745 - RNA, 16 nt, Human
uagaaagccaugugca

SEQ ID NO: 2032746 - RNA, 13 nt, Human
ugccuaauuuguu

SEQ ID NO: 2032747 - RNA, 20 nt, Human
agaagagccggagccuccag

SEQ ID NO: 2032748 - RNA, 13 nt, Human
agcgacagugaga

SEQ ID NO: 2032749 - RNA, 22 nt, Human
cuucaacucccugccccccagc

SEQ ID NO: 2032750 - RNA, 22 nt, Human
gaugguucccuugaugaagaag

SEQ ID NO: 2032751 - RNA, 21 nt, Human
uacuucccgcuguuccucgcc

SEQ ID NO: 2032752 - RNA, 19 nt, Human
cuucuuacaaugcauucug

SEQ ID NO: 2032753 - RNA, 17 nt, Human
auucagaauuucuaaaa

SEQ ID NO: 2032754 - RNA, 18 nt, Human
ccuugggaccccugagcu

SEQ ID NO: 2032755 - RNA, 20 nt, Human
cugcucgcccacuuccuccc

SEQ ID NO: 2032756 - RNA, 13 nt, Human
cccggccgcgcug

SEQ ID NO: 2032757 - RNA, 16 nt, Human
auacuauuuaauuauu

SEQ ID NO: 2032758 - RNA, 19 nt, Human
cuuuuggaagguauuuaau

SEQ ID NO: 2032759 - RNA, 12 nt, Human
gguauuuuaauc

SEQ ID NO: 2032760 - RNA, 18 nt, Human
aguccauugggcaggcag

SEQ ID NO: 2032761 - RNA, 16 nt, Human
agaugagagaacaggg

SEQ ID NO: 2032762 - RNA, 17 nt, Human
augauuaaguaaugaua

SEQ ID NO: 2032763 - RNA, 20 nt, Human
cugguggcgcuggcugcgcu

SEQ ID NO: 2032764 - RNA, 18 nt, Human
cuccauccugaggcucca

SEQ ID NO: 2032765 - RNA, 20 nt, Human
aaugauguuucauaagaauu

SEQ ID NO: 2032766 - RNA, 21 nt, Human
ucccuggggcuuuaacuccug

SEQ ID NO: 2032767 - RNA, 22 nt, Human
ugguagcuaaauauauauuuua

SEQ ID NO: 2032768 - RNA, 16 nt, Human
uaggaaauauuuuaau

SEQ ID NO: 2032769 - RNA, 15 nt, Human
agggcucacagaauu

SEQ ID NO: 2032770 - RNA, 16 nt, Human
ccccaucucuucuggg

SEQ ID NO: 2032771 - RNA, 20 nt, Human
auacucuuauaucuauauuu

SEQ ID NO: 2032772 - RNA, 17 nt, Human
uugugaagcaaaauuuu

SEQ ID NO: 2032773 - RNA, 16 nt, Human
ccucaaaacuucagac

SEQ ID NO: 2032774 - RNA, 17 nt, Human
ucugugagaugcuagaa

SEQ ID NO: 2032775 - RNA, 14 nt, Human
aauauaaauaaaaa

SEQ ID NO: 2032776 - RNA, 16 nt, Human
agaugcuagaacuccc

SEQ ID NO: 2032777 - RNA, 19 nt, Human
aaaacguauugcauuuaau

SEQ ID NO: 2032778 - RNA, 18 nt, Human
acauuuauauuuuuguga

SEQ ID NO: 2032779 - RNA, 14 nt, Human
uucuaugaaauauu

SEQ ID NO: 2032780 - RNA, 14 nt, Human
aagcaacccaaaug

SEQ ID NO: 2032781 - RNA, 16 nt, Human
uaccccuggccaagga

SEQ ID NO: 2032782 - RNA, 18 nt, Human
cggcuggagcugccucuc

SEQ ID NO: 2032783 - RNA, 22 nt, Human
cccaugauguuuagaaacacaa

SEQ ID NO: 2032784 - RNA, 21 nt, Human
acaagaaggaaagauuuuguu

SEQ ID NO: 2032785 - RNA, 12 nt, Human
guccccagagcu

SEQ ID NO: 2032786 - RNA, 14 nt, Human
caucucaggugugu

SEQ ID NO: 2032787 - RNA, 19 nt, Human
acugccaucauuuacuuuu

SEQ ID NO: 2032788 - RNA, 14 nt, Human
agaaauaggaaaua

SEQ ID NO: 2032789 - RNA, 22 nt, Human
cacagauuugagcucagcccug

SEQ ID NO: 2032790 - RNA, 20 nt, Human
aacaagccuccuuuuaaagu

SEQ ID NO: 2032791 - RNA, 23 nt, Human
cugagaaggcuguggauuuaaug

SEQ ID NO: 2032792 - RNA, 20 nt, Human
cagugaaagaaaauaacgau

SEQ ID NO: 2032793 - RNA, 13 nt, Human
gacaaggaaaaaa

SEQ ID NO: 2032794 - RNA, 15 nt, Human
auuguagcauccugg

SEQ ID NO: 2032795 - RNA, 13 nt, Human
uauauauuuuuuu

SEQ ID NO: 2032796 - RNA, 22 nt, Human
caaauuuacagagacagaaagc

SEQ ID NO: 2032797 - RNA, 13 nt, Human
auaaaaauauaua

SEQ ID NO: 2032798 - RNA, 15 nt, Human
uuuaguauuuuguuu

SEQ ID NO: 2032799 - RNA, 23 nt, Human
cagcugccccggggaggggcgcu

SEQ ID NO: 2032800 - RNA, 17 nt, Human
aguugauaaguacauga

SEQ ID NO: 2032801 - RNA, 20 nt, Human
gucauucagauaugauucaa

SEQ ID NO: 2032802 - RNA, 20 nt, Human
agcccuuccccucugcagcu

SEQ ID NO: 2032803 - RNA, 21 nt, Human
acugccaaaacaucaaccugc

SEQ ID NO: 2032804 - RNA, 17 nt, Human
guagaaugggggcagca

SEQ ID NO: 2032805 - RNA, 14 nt, Human
cagagaaguuuucu

SEQ ID NO: 2032806 - RNA, 18 nt, Human
uaagcuucacuguaaaau

SEQ ID NO: 2032807 - RNA, 20 nt, Human
cggcccugugcggccugguc

SEQ ID NO: 2032808 - RNA, 22 nt, Human
ccacagcuguaugauucccagc

SEQ ID NO: 2032809 - RNA, 12 nt, Human
uuauucacugua

SEQ ID NO: 2032810 - RNA, 16 nt, Human
agaauauauuuccuua

SEQ ID NO: 2032811 - RNA, 21 nt, Human
gaugcccacggcuggagcugc

SEQ ID NO: 2032812 - RNA, 14 nt, Human
gcucgcccacuucc

SEQ ID NO: 2032813 - RNA, 14 nt, Human
ugcaccuccaugga

SEQ ID NO: 2032814 - RNA, 18 nt, Human
ggaaacaagucagucauu

SEQ ID NO: 2032815 - RNA, 17 nt, Human
uaacugauuuguaacaa

SEQ ID NO: 2032816 - RNA, 22 nt, Human
ucuggguuccuuccucugagcc

SEQ ID NO: 2032817 - RNA, 14 nt, Human
cuuucauaauaagu

SEQ ID NO: 2032818 - RNA, 19 nt, Human
uaguuuaugauuccaccua

SEQ ID NO: 2032819 - RNA, 17 nt, Human
uccuacaagacacagug

SEQ ID NO: 2032820 - RNA, 17 nt, Human
auaaaguaugugcauau

SEQ ID NO: 2032821 - RNA, 15 nt, Human
auauugacuuuuuau

SEQ ID NO: 2032822 - RNA, 13 nt, Human
gggcugaagcugu

SEQ ID NO: 2032823 - RNA, 17 nt, Human
agcuacaggccccaucu

SEQ ID NO: 2032824 - RNA, 20 nt, Human
uaauaucuuaucuuccuaua

SEQ ID NO: 2032825 - RNA, 22 nt, Human
ucugcuggagacauugaggcag

SEQ ID NO: 2032826 - RNA, 15 nt, Human
gcacagccucuuaga

SEQ ID NO: 2032827 - RNA, 20 nt, Human
ccugccuaagugcagccccg

SEQ ID NO: 2032828 - RNA, 20 nt, Human
accggccuuugcaccuccau

SEQ ID NO: 2032829 - RNA, 15 nt, Human
cuuuucccaacucca

SEQ ID NO: 2032830 - RNA, 18 nt, Human
aguuuauauagaaaugua

SEQ ID NO: 2032831 - RNA, 14 nt, Human
cuaagucuuauaua

SEQ ID NO: 2032832 - RNA, 19 nt, Human
agagccggagccuccagcu

SEQ ID NO: 2032833 - RNA, 19 nt, Human
acuucccgcuguuccucgc

SEQ ID NO: 2032834 - RNA, 23 nt, Human
ccgcagggugaacugcagcgagu

SEQ ID NO: 2032835 - RNA, 20 nt, Human
uggaaacacauguuccccuu

SEQ ID NO: 2032836 - RNA, 23 nt, Human
guaauuccguagguuauuuucag

SEQ ID NO: 2032837 - RNA, 20 nt, Human
auaaauggcuuccuggcaau

SEQ ID NO: 2032838 - RNA, 13 nt, Human
gcuacgcgcgcuc

SEQ ID NO: 2032839 - RNA, 13 nt, Human
gcagaacagugau

SEQ ID NO: 2032840 - RNA, 12 nt, Human
aucuucacuuuu

SEQ ID NO: 2032841 - RNA, 14 nt, Human
auauauuuccuuau

SEQ ID NO: 2032842 - RNA, 18 nt, Human
cugcugguggcgcuggcu

SEQ ID NO: 2032843 - RNA, 16 nt, Human
uauccuacuuccccuu

SEQ ID NO: 2032844 - RNA, 14 nt, Human
uauuugcuguuauu

SEQ ID NO: 2032845 - RNA, 16 nt, Human
aaaaugugauauguac

SEQ ID NO: 2032846 - RNA, 23 nt, Human
ggaggcagagguugcagugagcc

SEQ ID NO: 2032847 - RNA, 18 nt, Human
ucaaggguacacugccuu

SEQ ID NO: 2032848 - RNA, 19 nt, Human
agauuugagcucagcccug

SEQ ID NO: 2032849 - RNA, 12 nt, Human
cauagaaguaaa

SEQ ID NO: 2032850 - RNA, 19 nt, Human
agaaaauaacgauaaaaga

SEQ ID NO: 2032851 - RNA, 14 nt, Human
cgagcgcgcgcgcc

SEQ ID NO: 2032852 - RNA, 15 nt, Human
auuuaauuauuucac

SEQ ID NO: 2032853 - RNA, 13 nt, Human
caguuauuauauu

SEQ ID NO: 2032854 - RNA, 18 nt, Human
agcauuguuggcuguucc

SEQ ID NO: 2032855 - RNA, 17 nt, Human
acucaccucccccaucu

SEQ ID NO: 2032856 - RNA, 18 nt, Human
gaaguaaauguuguuuua

SEQ ID NO: 2032857 - RNA, 11 nt, Human
ggggaggggcg

SEQ ID NO: 2032858 - RNA, 15 nt, Human
caggcaaauuccuga

SEQ ID NO: 2032859 - RNA, 22 nt, Human
ucuacuaaaaauacaaaaaaaa

SEQ ID NO: 2032860 - RNA, 23 nt, Human
aguuauuuuuaauuugguuuuca

SEQ ID NO: 2032861 - RNA, 14 nt, Human
auuugaaauuguau

SEQ ID NO: 2032862 - RNA, 16 nt, Human
ugacuuaaugccacua

SEQ ID NO: 2032863 - RNA, 19 nt, Human
gaccggccuuugcaccucc

SEQ ID NO: 2032864 - RNA, 17 nt, Human
agggcauagaaguaaaa

SEQ ID NO: 2032865 - RNA, 18 nt, Human
acggcuccggacgcugcu

SEQ ID NO: 2032866 - RNA, 18 nt, Human
uuuugugaagcaaaauuu

SEQ ID NO: 2032867 - RNA, 20 nt, Human
agcugccccggggaggggcg

SEQ ID NO: 2032868 - RNA, 17 nt, Human
cuccuuaucaaaggaca

SEQ ID NO: 2032869 - RNA, 10 nt, Human
acuuccuccc

SEQ ID NO: 2032870 - RNA, 22 nt, Human
gcagagagguagggauggggcu

SEQ ID NO: 2032871 - RNA, 13 nt, Human
agcuaaauauaua

SEQ ID NO: 2032872 - RNA, 14 nt, Human
ggaaucuuguaaag

SEQ ID NO: 2032873 - RNA, 12 nt, Human
auuuaucauuua

SEQ ID NO: 2032874 - RNA, 19 nt, Human
aaugaauggcuaagcaaaa

SEQ ID NO: 2032875 - RNA, 21 nt, Human
uauuguagcauccuggaauau

SEQ ID NO: 2032876 - RNA, 18 nt, Human
agccgggaaagaagagcc

SEQ ID NO: 2032877 - RNA, 18 nt, Human
auaccccuggccaaggaa

SEQ ID NO: 2032878 - RNA, 21 nt, Human
gauguggggaaguuaggaacu

SEQ ID NO: 2032879 - RNA, 16 nt, Human
ugcaaauugucacagg

SEQ ID NO: 2032880 - RNA, 17 nt, Human
gcucaccagucccuccc

SEQ ID NO: 2032881 - RNA, 19 nt, Human
cccccucuggcuccagcug

SEQ ID NO: 2032882 - RNA, 13 nt, Human
ccagcccuccuua

SEQ ID NO: 2032883 - RNA, 12 nt, Human
ggggcggcggcc

SEQ ID NO: 2032884 - RNA, 16 nt, Human
cucucucauccacuuu

SEQ ID NO: 2032885 - RNA, 23 nt, Human
uguagguagaucuggucuuuaga

SEQ ID NO: 2032886 - RNA, 12 nt, Human
caggacagcccu

SEQ ID NO: 2032887 - RNA, 22 nt, Human
caguauggcagcuuuccucaaa

SEQ ID NO: 2032888 - RNA, 19 nt, Human
ggacucaccucccccaucu

SEQ ID NO: 2032889 - RNA, 14 nt, Human
aauauuauuuuaua

SEQ ID NO: 2032890 - RNA, 14 nt, Human
ccggagccuccagc

SEQ ID NO: 2032891 - RNA, 21 nt, Human
uguauaaaauaauuuuuauau

SEQ ID NO: 2032892 - RNA, 21 nt, Human
ccucuguucugcacacagcac

SEQ ID NO: 2032893 - RNA, 15 nt, Human
uacaggauuugaaau

SEQ ID NO: 2032894 - RNA, 14 nt, Human
aaauauuauuuuau

SEQ ID NO: 2032895 - RNA, 11 nt, Human
gcauccuaguc

SEQ ID NO: 2032896 - RNA, 20 nt, Human
gaauucauucacucaacaaa

SEQ ID NO: 2032897 - RNA, 20 nt, Human
uggauuuaauguggaaauga

SEQ ID NO: 2032898 - RNA, 22 nt, Human
ccggcgcgcucaucccacccgc

SEQ ID NO: 2032899 - RNA, 18 nt, Human
ugaggcaggcacugccaa

SEQ ID NO: 2032900 - RNA, 14 nt, Human
aacucauauuuuca

SEQ ID NO: 2032901 - RNA, 21 nt, Human
aaaaacguauugcauuuaauu

SEQ ID NO: 2032902 - RNA, 21 nt, Human
uuccugacugcuaguuuauau

SEQ ID NO: 2032903 - RNA, 12 nt, Human
uccaaagggcau

SEQ ID NO: 2032904 - RNA, 23 nt, Human
aucuuccuauaauuuuagacauu

SEQ ID NO: 2032905 - RNA, 13 nt, Human
uuauucacaagac

SEQ ID NO: 2032906 - RNA, 19 nt, Human
agacucgggauuaguacac

SEQ ID NO: 2032907 - RNA, 17 nt, Human
caaacauauauaacaau

SEQ ID NO: 2032908 - RNA, 18 nt, Human
cugagucccaggcugagc

SEQ ID NO: 2032909 - RNA, 22 nt, Human
cccaggcggguccgggucgcag

SEQ ID NO: 2032910 - RNA, 12 nt, Human
cagacacaugug

SEQ ID NO: 2032911 - RNA, 22 nt, Human
aaugggcacaggguuuauguuu

SEQ ID NO: 2032912 - RNA, 16 nt, Human
agaguuccuucugcuc

SEQ ID NO: 2032913 - RNA, 19 nt, Human
caaggaugccccguccccc

SEQ ID NO: 2032914 - RNA, 16 nt, Human
cauuuguauaaaauaa

SEQ ID NO: 2032915 - RNA, 13 nt, Human
caagaaggaaaga

SEQ ID NO: 2032916 - RNA, 14 nt, Human
acccaaaaggcaga

SEQ ID NO: 2032917 - RNA, 20 nt, Human
agaagaacugaaaucauacu

SEQ ID NO: 2032918 - RNA, 21 nt, Human
ugaccauacuaauuauacccc

SEQ ID NO: 2032919 - RNA, 14 nt, Human
uaaauaaaaauaau

SEQ ID NO: 2032920 - RNA, 16 nt, Human
ggggcagcaccuccua

SEQ ID NO: 2032921 - RNA, 12 nt, Human
aaaaaaacguau

SEQ ID NO: 2032922 - RNA, 17 nt, Human
aaauccuacuuucauaa

SEQ ID NO: 2032923 - RNA, 12 nt, Human
cggccggcgcgc

SEQ ID NO: 2032924 - RNA, 20 nt, Human
uagucucuaucauuaaaguu

SEQ ID NO: 2032925 - RNA, 16 nt, Human
agggaggacgcucucu

SEQ ID NO: 2032926 - RNA, 16 nt, Human
aauuuuuaauuauaug

SEQ ID NO: 2032927 - RNA, 14 nt, Human
cgagccccaggcgg

SEQ ID NO: 2032928 - RNA, 13 nt, Human
aggauuugaaauu

SEQ ID NO: 2032929 - RNA, 16 nt, Human
ucagcagagaaguuuu

SEQ ID NO: 2032930 - RNA, 16 nt, Human
ugacacuuaaaaaugg

SEQ ID NO: 2032931 - RNA, 17 nt, Human
cugcgcucggccugcuc

SEQ ID NO: 2032932 - RNA, 14 nt, Human
cugagucccaggcu

SEQ ID NO: 2032933 - RNA, 16 nt, Human
ucuuggucucaguguc

SEQ ID NO: 2032934 - RNA, 18 nt, Human
cacuccagugagacagcu

SEQ ID NO: 2032935 - RNA, 14 nt, Human
cgcugcgcgccgcg

SEQ ID NO: 2032936 - RNA, 17 nt, Human
ccaaggaugccccgucc

SEQ ID NO: 2032937 - RNA, 13 nt, Human
auaacuggaaacu

SEQ ID NO: 2032938 - RNA, 19 nt, Human
augaaguacucauacaugu

SEQ ID NO: 2032939 - RNA, 13 nt, Human
uaguuuuuaaagu

SEQ ID NO: 2032940 - RNA, 23 nt, Human
uguugcccacagcuguaugauuc

SEQ ID NO: 2032941 - RNA, 17 nt, Human
uuuccaugaguugcagu

SEQ ID NO: 2032942 - RNA, 21 nt, Human
aauauauuuccuuauucagaa

SEQ ID NO: 2032943 - RNA, 15 nt, Human
caaggaaaaaauaac

SEQ ID NO: 2032944 - RNA, 15 nt, Human
agagacagaaagcag

SEQ ID NO: 2032945 - RNA, 17 nt, Human
accugagccccaaaagg

SEQ ID NO: 2032946 - RNA, 22 nt, Human
aaucacuggcuguuaaucuuuc

SEQ ID NO: 2032947 - RNA, 19 nt, Human
ugaucaguaugaaaauguc

SEQ ID NO: 2032948 - RNA, 19 nt, Human
cauggccacaucugagccc

SEQ ID NO: 2032949 - RNA, 20 nt, Human
gccuaauuuguuuucccuuc

SEQ ID NO: 2032950 - RNA, 18 nt, Human
uuggggccuaugcagagg

SEQ ID NO: 2032951 - RNA, 22 nt, Human
agaaugagagacacacugaaga

SEQ ID NO: 2032952 - RNA, 23 nt, Human
gggccuaugcagagguccacaac

SEQ ID NO: 2032953 - RNA, 13 nt, Human
auauauauuuuuu

SEQ ID NO: 2032954 - RNA, 16 nt, Human
ccccugcacuccagcc

SEQ ID NO: 2032955 - RNA, 17 nt, Human
aguaaaaggaaaugcuc

SEQ ID NO: 2032956 - RNA, 17 nt, Human
gaagcaccaaucaugaa

SEQ ID NO: 2032957 - RNA, 18 nt, Human
agcaaaauuuuuucucua

SEQ ID NO: 2032958 - RNA, 15 nt, Human
acaagacccaaaagg

SEQ ID NO: 2032959 - RNA, 19 nt, Human
aagugugacucauuaaaug

SEQ ID NO: 2032960 - RNA, 15 nt, Human
aguucugaagaagau

SEQ ID NO: 2032961 - RNA, 23 nt, Human
ccacaccaaccuucugaggagcu

SEQ ID NO: 2032962 - RNA, 15 nt, Human
gccucagucucccuc

SEQ ID NO: 2032963 - RNA, 19 nt, Human
augaauuacauuuguauaa

SEQ ID NO: 2032964 - RNA, 21 nt, Human
cagcccuuagcccuuccccuc

SEQ ID NO: 2032965 - RNA, 18 nt, Human
cccaagccuggcaaggga

SEQ ID NO: 2032966 - RNA, 17 nt, Human
cacaccaaccuucugag

SEQ ID NO: 2032967 - RNA, 21 nt, Human
auuauauuuccaagaaauauu

SEQ ID NO: 2032968 - RNA, 16 nt, Human
agucucuaucauuaaa

SEQ ID NO: 2032969 - RNA, 19 nt, Human
uaaugaaguguuuagcaua

SEQ ID NO: 2032970 - RNA, 19 nt, Human
gcugcaccugugccguccc

SEQ ID NO: 2032971 - RNA, 15 nt, Human
acaucaacagauaaa

SEQ ID NO: 2032972 - RNA, 17 nt, Human
gaaugagagacacacug

SEQ ID NO: 2032973 - RNA, 19 nt, Human
uacaaaaaaaaaaaaaaau

SEQ ID NO: 2032974 - RNA, 23 nt, Human
auuccugaacaggauauucucac

SEQ ID NO: 2032975 - RNA, 20 nt, Human
ugagcgcccacuagacccac

SEQ ID NO: 2032976 - RNA, 18 nt, Human
uuuucucuccucucccca

SEQ ID NO: 2032977 - RNA, 15 nt, Human
uuuuaggaauacaua

SEQ ID NO: 2032978 - RNA, 23 nt, Human
ugaauuauguuugcauguucacu

SEQ ID NO: 2032979 - RNA, 13 nt, Human
uauuuaauuauuu

SEQ ID NO: 2032980 - RNA, 16 nt, Human
uguccccuauccuacu

SEQ ID NO: 2032981 - RNA, 23 nt, Human
ggccuccauccugaggcuccacu

SEQ ID NO: 2032982 - RNA, 22 nt, Human
aauuacauuuguauaaaauaau

SEQ ID NO: 2032983 - RNA, 11 nt, Human
uuuuuuuaaaa

SEQ ID NO: 2032984 - RNA, 23 nt, Human
cacauuggaaacaagucagucau

SEQ ID NO: 2032985 - RNA, 13 nt, Human
uagcauggccaca

SEQ ID NO: 2032986 - RNA, 15 nt, Human
uuuaugguuguauua

SEQ ID NO: 2032987 - RNA, 12 nt, Human
guagacacacau

SEQ ID NO: 2032988 - RNA, 19 nt, Human
ccauccugccccugagccc

SEQ ID NO: 2032989 - RNA, 17 nt, Human
cugaacaggauauucuc

SEQ ID NO: 2032990 - RNA, 18 nt, Human
aaaucuuauaauuuaaaa

SEQ ID NO: 2032991 - RNA, 16 nt, Human
cuguacgcgagcgcgc

SEQ ID NO: 2032992 - RNA, 14 nt, Human
ugaggcuuuaaaac

SEQ ID NO: 2032993 - RNA, 22 nt, Human
gagucccaggcugagccucagu

SEQ ID NO: 2032994 - RNA, 18 nt, Human
auuauuucacuuuagaaa

SEQ ID NO: 2032995 - RNA, 19 nt, Human
aagguccuggcaaagauga

SEQ ID NO: 2032996 - RNA, 16 nt, Human
gaaauguauucuuuua

SEQ ID NO: 2032997 - RNA, 22 nt, Human
aauugacccacaagaaaugaaa

SEQ ID NO: 2032998 - RNA, 18 nt, Human
gccuucggccuccauccu

SEQ ID NO: 2032999 - RNA, 16 nt, Human
ucuaaaaguuuaaguu

SEQ ID NO: 2033000 - RNA, 20 nt, Human
agagccggagccuccagcug

SEQ ID NO: 2033001 - RNA, 12 nt, Human
aucguguccccu

SEQ ID NO: 2033002 - RNA, 13 nt, Human
aacacaacuauau

SEQ ID NO: 2033003 - RNA, 16 nt, Human
aaauauaaauaaaaau

SEQ ID NO: 2033004 - RNA, 19 nt, Human
gcccacuuccucccggccg

SEQ ID NO: 2033005 - RNA, 16 nt, Human
uuuuagugaaauauua

SEQ ID NO: 2033006 - RNA, 14 nt, Human
cuucucuucacagu

SEQ ID NO: 2033007 - RNA, 15 nt, Human
cagcuggccuuguga

SEQ ID NO: 2033008 - RNA, 19 nt, Human
uucacauuggaaacaaguc

SEQ ID NO: 2033009 - RNA, 17 nt, Human
cucguggaacaguuacc

SEQ ID NO: 2033010 - RNA, 23 nt, Human
aggaccggccuuugcaccuccau

SEQ ID NO: 2033011 - RNA, 18 nt, Human
accauuuuugaaaccaaa

SEQ ID NO: 2033012 - RNA, 17 nt, Human
aauaaaguguuugaaag

SEQ ID NO: 2033013 - RNA, 15 nt, Human
gcucgcuuccgcauc

SEQ ID NO: 2033014 - RNA, 15 nt, Human
ccuugccaugugcua

SEQ ID NO: 2033015 - RNA, 10 nt, Human
auguuuucag

SEQ ID NO: 2033016 - RNA, 23 nt, Human
ccccucuggcuccagcuggccgg

SEQ ID NO: 2033017 - RNA, 22 nt, Human
agccaaacauccuacaagacac

SEQ ID NO: 2033018 - RNA, 19 nt, Human
auuuucaugcuguucauga

SEQ ID NO: 2033019 - RNA, 17 nt, Human
cucuuuugggauuuuug

SEQ ID NO: 2033020 - RNA, 19 nt, Human
auuguaguccuguaaugga

SEQ ID NO: 2033021 - RNA, 18 nt, Human
ggcgcuggcugcgcucgg

SEQ ID NO: 2033022 - RNA, 21 nt, Human
cuggguuuuggggggacgcua

SEQ ID NO: 2033023 - RNA, 12 nt, Human
aggggcgcucgc

SEQ ID NO: 2033024 - RNA, 20 nt, Human
uaaaacaagcacuaaacaaa

SEQ ID NO: 2033025 - RNA, 20 nt, Human
cccggccgcgcugcgcgccg

SEQ ID NO: 2033026 - RNA, 18 nt, Human
acugugugcuaaaacaag

SEQ ID NO: 2033027 - RNA, 16 nt, Human
uuccgcauccuagucu

SEQ ID NO: 2033028 - RNA, 16 nt, Human
accuguucgcgcgccu

SEQ ID NO: 2033029 - RNA, 16 nt, Human
cccccagcccuccuua

SEQ ID NO: 2033030 - RNA, 18 nt, Human
ugaagaagcuagaaaaca

SEQ ID NO: 2033031 - RNA, 21 nt, Human
ccauccugccccugagcccau

SEQ ID NO: 2033032 - RNA, 15 nt, Human
ccagauccuggaaau

SEQ ID NO: 2033033 - RNA, 15 nt, Human
cugccagcuggccuu

SEQ ID NO: 2033034 - RNA, 16 nt, Human
ucaguuuuugugaaaa

SEQ ID NO: 2033035 - RNA, 21 nt, Human
gcccugcugagucccaggcug

SEQ ID NO: 2033036 - RNA, 16 nt, Human
cgcuuccgcauccuag

SEQ ID NO: 2033037 - RNA, 14 nt, Human
ggggcggggagcga

SEQ ID NO: 2033038 - RNA, 16 nt, Human
uauaucaauuuaaaaa

SEQ ID NO: 2033039 - RNA, 18 nt, Human
ccugucacgugugggcaa

SEQ ID NO: 2033040 - RNA, 17 nt, Human
ugcccacggcuggagcu

SEQ ID NO: 2033041 - RNA, 21 nt, Human
uucccgcuguuccucgccacg

SEQ ID NO: 2033042 - RNA, 17 nt, Human
agucugacuguuuccau

SEQ ID NO: 2033043 - RNA, 19 nt, Human
gucaaauugugugaaaggu

SEQ ID NO: 2033044 - RNA, 21 nt, Human
caauuuuguuauguauauuuu

SEQ ID NO: 2033045 - RNA, 16 nt, Human
auuccuuaagauauua

SEQ ID NO: 2033046 - RNA, 23 nt, Human
uuagaugcaguucugaagaagau

SEQ ID NO: 2033047 - RNA, 21 nt, Human
agcccuucuuuccacagaagc

SEQ ID NO: 2033048 - RNA, 14 nt, Human
cuguaaucacagcu

SEQ ID NO: 2033049 - RNA, 19 nt, Human
aagcauuccaacuaucuca

SEQ ID NO: 2033050 - RNA, 16 nt, Human
gagaaacuggaacucu

SEQ ID NO: 2033051 - RNA, 14 nt, Human
aaugauuaugaauu

SEQ ID NO: 2033052 - RNA, 22 nt, Human
acauggcuggagcuagaauuug

SEQ ID NO: 2033053 - RNA, 22 nt, Human
caagcacuaaacaaagagugaa

SEQ ID NO: 2033054 - RNA, 21 nt, Human
cccacuggacucaccuccccc

SEQ ID NO: 2033055 - RNA, 16 nt, Human
agccuacuaaaugcuc

SEQ ID NO: 2033056 - RNA, 22 nt, Human
gaauaaccaacacccugagguu

SEQ ID NO: 2033057 - RNA, 23 nt, Human
cuugauaaauggcuuccuggcaa

SEQ ID NO: 2033058 - RNA, 20 nt, Human
aaucuuucacaggggacagg

SEQ ID NO: 2033059 - RNA, 16 nt, Human
uggaaacgaagcacca

SEQ ID NO: 2033060 - RNA, 21 nt, Human
cccccucuggcuccagcuggc

SEQ ID NO: 2033061 - RNA, 17 nt, Human
gacaaggaaaaaauaac

SEQ ID NO: 2033062 - RNA, 19 nt, Human
ugagucccaggcugagccu

SEQ ID NO: 2033063 - RNA, 18 nt, Human
auagucaaauugugugaa

SEQ ID NO: 2033064 - RNA, 13 nt, Human
aaauaaaaauaau

SEQ ID NO: 2033065 - RNA, 22 nt, Human
agcgcgcgcgcccucuggcugc

SEQ ID NO: 2033066 - RNA, 21 nt, Human
aaugucauuguucuugugaac

SEQ ID NO: 2033067 - RNA, 17 nt, Human
cucaugagggcuggaug

SEQ ID NO: 2033068 - RNA, 23 nt, Human
auuuuauagcuacuaauuuuaaa

SEQ ID NO: 2033069 - RNA, 14 nt, Human
ugugaaaagcucca

SEQ ID NO: 2033070 - RNA, 22 nt, Human
ggcuaagcuucacuguaaaaua

SEQ ID NO: 2033071 - RNA, 15 nt, Human
ucagucucccucccu

SEQ ID NO: 2033072 - RNA, 18 nt, Human
ugccuaauuuguuuuccc

SEQ ID NO: 2033073 - RNA, 21 nt, Human
caggcacuaucuggguuuugg

SEQ ID NO: 2033074 - RNA, 14 nt, Human
gaucuaugccacaa

SEQ ID NO: 2033075 - RNA, 16 nt, Human
acugcuaguuuauaua

SEQ ID NO: 2033076 - RNA, 15 nt, Human
aagccagauuuuccu

SEQ ID NO: 2033077 - RNA, 23 nt, Human
ucaugcccauaccccuggccaag

SEQ ID NO: 2033078 - RNA, 19 nt, Human
auaucaguuauuuuuaaac

SEQ ID NO: 2033079 - RNA, 17 nt, Human
uccauccugaggcucca

SEQ ID NO: 2033080 - RNA, 16 nt, Human
ccugagaccaaggccc

SEQ ID NO: 2033081 - RNA, 18 nt, Human
cuggguuaggccuugccu

SEQ ID NO: 2033082 - RNA, 16 nt, Human
uaucuuccuauaauuu

SEQ ID NO: 2033083 - RNA, 15 nt, Human
gaucuggcucuggac

SEQ ID NO: 2033084 - RNA, 21 nt, Human
agacaagaaggaaagauuuug

SEQ ID NO: 2033085 - RNA, 22 nt, Human
cccccugcaaagcccagcuuga

SEQ ID NO: 2033086 - RNA, 22 nt, Human
accauuucuugagguaaaagca

SEQ ID NO: 2033087 - RNA, 20 nt, Human
ccagcuggccgggagccuga

SEQ ID NO: 2033088 - RNA, 14 nt, Human
aucuauguagaaua

SEQ ID NO: 2033089 - RNA, 20 nt, Human
caggcugagccucagucucc

SEQ ID NO: 2033090 - RNA, 16 nt, Human
cgcuguuccucgccac

SEQ ID NO: 2033091 - RNA, 17 nt, Human
aaagcagggacuugaac

SEQ ID NO: 2033092 - RNA, 19 nt, Human
cucuguucugcacacagca

SEQ ID NO: 2033093 - RNA, 23 nt, Human
cucagcccuggugggcagagagg

SEQ ID NO: 2033094 - RNA, 20 nt, Human
gaauacucuuauaucuauau

SEQ ID NO: 2033095 - RNA, 22 nt, Human
ccacacuguccauucuuccucc

SEQ ID NO: 2033096 - RNA, 23 nt, Human
cacuggacucaccucccccaucu

SEQ ID NO: 2033097 - RNA, 23 nt, Human
gauauuaaccaggggccaugaau

SEQ ID NO: 2033098 - RNA, 18 nt, Human
guuuaugguuguauuauu

SEQ ID NO: 2033099 - RNA, 18 nt, Human
ggcucuggacaggcacua

SEQ ID NO: 2033100 - RNA, 15 nt, Human
auaucaauuuaaaaa

SEQ ID NO: 2033101 - RNA, 18 nt, Human
agguccacaacacacaga

SEQ ID NO: 2033102 - RNA, 18 nt, Human
gcacuccagccugagcga

SEQ ID NO: 2033103 - RNA, 20 nt, Human
caagccuccuuuuaaaguaa

SEQ ID NO: 2033104 - RNA, 11 nt, Human
ucaccugcccu

SEQ ID NO: 2033105 - RNA, 22 nt, Human
cuucagccugaaagaggaauga

SEQ ID NO: 2033106 - RNA, 22 nt, Human
agaaagugacaagcucacagac

SEQ ID NO: 2033107 - RNA, 17 nt, Human
caagacccaaaaggcag

SEQ ID NO: 2033108 - RNA, 16 nt, Human
gucuaucuuugagcgc

SEQ ID NO: 2033109 - RNA, 14 nt, Human
auauuugaaauauu

SEQ ID NO: 2033110 - RNA, 21 nt, Human
cuaccaaaaaucucaauauuu

SEQ ID NO: 2033111 - RNA, 12 nt, Human
ucuacacuccag

SEQ ID NO: 2033112 - RNA, 15 nt, Human
auguuagagaauuuc

SEQ ID NO: 2033113 - RNA, 22 nt, Human
uguucugauauuggacaguaaa

SEQ ID NO: 2033114 - RNA, 22 nt, Human
uuuauaagaaauaggaaauauu

SEQ ID NO: 2033115 - RNA, 12 nt, Human
cagaacagugau

SEQ ID NO: 2033116 - RNA, 22 nt, Human
cuaagcuucacuguaaaauaau

SEQ ID NO: 2033117 - RNA, 16 nt, Human
auccaaugaaaugagu

SEQ ID NO: 2033118 - RNA, 16 nt, Human
guuucacaccuuaucu

SEQ ID NO: 2033119 - RNA, 18 nt, Human
ggaacuggugucuucagg

SEQ ID NO: 2033120 - RNA, 15 nt, Human
cuuccucccggccgc

SEQ ID NO: 2033121 - RNA, 23 nt, Human
cgagccccaggcggguccggguc

SEQ ID NO: 2033122 - RNA, 18 nt, Human
aagaaauaggaaauauuu

SEQ ID NO: 2033123 - RNA, 23 nt, Human
gccccugcacuccagccugagcg

SEQ ID NO: 2033124 - RNA, 19 nt, Human
ucuuaucuuccuauaauuu

SEQ ID NO: 2033125 - RNA, 21 nt, Human
gcuacaggccccaucuggucc

SEQ ID NO: 2033126 - RNA, 21 nt, Human
augcuacaggauuugaaauug

SEQ ID NO: 2033127 - RNA, 18 nt, Human
aauuuuagacauucuuua

SEQ ID NO: 2033128 - RNA, 16 nt, Human
uguguaagacaaaaag

SEQ ID NO: 2033129 - RNA, 14 nt, Human
uaaaggaauuuaaa

SEQ ID NO: 2033130 - RNA, 16 nt, Human
cccuuuacccccauga

SEQ ID NO: 2033131 - RNA, 22 nt, Human
acggcuggagcugccucucuca

SEQ ID NO: 2033132 - RNA, 20 nt, Human
ccuccugccuaagugcagcc

SEQ ID NO: 2033133 - RNA, 12 nt, Human
cauuauauuuau

SEQ ID NO: 2033134 - RNA, 15 nt, Human
ugcuugucccugugg

SEQ ID NO: 2033135 - RNA, 19 nt, Human
cagcuacuugggaggcuga

SEQ ID NO: 2033136 - RNA, 22 nt, Human
agggagucucagcuucacccug

SEQ ID NO: 2033137 - RNA, 20 nt, Human
acaccuuaucuauguagaau

SEQ ID NO: 2033138 - RNA, 21 nt, Human
uacauaaaguaugugcauauu

SEQ ID NO: 2033139 - RNA, 21 nt, Human
agcccuuccccucugcagcuu

SEQ ID NO: 2033140 - RNA, 19 nt, Human
uauauuuuuuguuaaauga

SEQ ID NO: 2033141 - RNA, 22 nt, Human
ugaagcaaaauuuuuucucuag

SEQ ID NO: 2033142 - RNA, 21 nt, Human
uuuuaauuugguuuucacauu

SEQ ID NO: 2033143 - RNA, 16 nt, Human
gcuucuguuccgugcu

SEQ ID NO: 2033144 - RNA, 22 nt, Human
ccucccuuggggccuaugcaga

SEQ ID NO: 2033145 - RNA, 23 nt, Human
caucaacagauaaauaguuuaug

SEQ ID NO: 2033146 - RNA, 15 nt, Human
gccccugcacuccag

SEQ ID NO: 2033147 - RNA, 18 nt, Human
agauccccaagccuggca

SEQ ID NO: 2033148 - RNA, 12 nt, Human
agaaaacaauaa

SEQ ID NO: 2033149 - RNA, 20 nt, Human
caucccuagaaagccaugug

SEQ ID NO: 2033150 - RNA, 18 nt, Human
acacuguuaucuucacuu

SEQ ID NO: 2033151 - RNA, 18 nt, Human
ucucuaggaaauauuuau

SEQ ID NO: 2033152 - RNA, 21 nt, Human
gaaaaaaagcuuuuuuugaau

SEQ ID NO: 2033153 - RNA, 18 nt, Human
uauaggauguggggaagu

SEQ ID NO: 2033154 - RNA, 16 nt, Human
gcuucacuguaaaaua

SEQ ID NO: 2033155 - RNA, 20 nt, Human
caagcucuaucaccaaggag

SEQ ID NO: 2033156 - RNA, 22 nt, Human
cuuguaaaggaauuuaaaaauc

SEQ ID NO: 2033157 - RNA, 22 nt, Human
uauuccuuuuucucuccucucc

SEQ ID NO: 2033158 - RNA, 15 nt, Human
ucaagggugugugca

SEQ ID NO: 2033159 - RNA, 18 nt, Human
ggccacaucugagccccg

SEQ ID NO: 2033160 - RNA, 22 nt, Human
aguauguuagugcaaauuguca

SEQ ID NO: 2033161 - RNA, 15 nt, Human
gucucuugaggcaca

SEQ ID NO: 2033162 - RNA, 15 nt, Human
uacaaaugcauuucu

SEQ ID NO: 2033163 - RNA, 22 nt, Human
aagcugguggcucugugugcuc

SEQ ID NO: 2033164 - RNA, 20 nt, Human
agcuacuaauuuuaaaaugu

SEQ ID NO: 2033165 - RNA, 21 nt, Human
ccgacggagccgggaaagaag

SEQ ID NO: 2033166 - RNA, 13 nt, Human
cauuuguauaaaa

SEQ ID NO: 2033167 - RNA, 15 nt, Human
gccuaauuuguuuuc

SEQ ID NO: 2033168 - RNA, 17 nt, Human
augcagagguccacaac

SEQ ID NO: 2033169 - RNA, 14 nt, Human
guugaauuuuacau

SEQ ID NO: 2033170 - RNA, 17 nt, Human
agagacagaaagcagaa

SEQ ID NO: 2033171 - RNA, 16 nt, Human
cugagcauuuaauaug

SEQ ID NO: 2033172 - RNA, 18 nt, Human
cugagaccaaggcccccg

SEQ ID NO: 2033173 - RNA, 14 nt, Human
ccugccccccagcc

SEQ ID NO: 2033174 - RNA, 19 nt, Human
ucgcccacuuccucccggc

SEQ ID NO: 2033175 - RNA, 18 nt, Human
ccacuuggucugugagau

SEQ ID NO: 2033176 - RNA, 19 nt, Human
cugccaaaacaucaaccug

SEQ ID NO: 2033177 - RNA, 18 nt, Human
uggagggaagccuugggg

SEQ ID NO: 2033178 - RNA, 13 nt, Human
cucgccacgcucu

SEQ ID NO: 2033179 - RNA, 17 nt, Human
ccacugcagaagacagu

SEQ ID NO: 2033180 - RNA, 20 nt, Human
uggggcuuuaacuccugcua

SEQ ID NO: 2033181 - RNA, 14 nt, Human
ccaugaccaacauc

SEQ ID NO: 2033182 - RNA, 15 nt, Human
ucauaagaauucugu

SEQ ID NO: 2033183 - RNA, 15 nt, Human
aaggaaaaaauaaca

SEQ ID NO: 2033184 - RNA, 23 nt, Human
cagagguugcagugagccgagau

SEQ ID NO: 2033185 - RNA, 14 nt, Human
uggccaccugcuga

SEQ ID NO: 2033186 - RNA, 13 nt, Human
uuuagugaaauau

SEQ ID NO: 2033187 - RNA, 17 nt, Human
gcgcgcuccgcgcagcu

SEQ ID NO: 2033188 - RNA, 13 nt, Human
uaauuuuuauauu

SEQ ID NO: 2033189 - RNA, 21 nt, Human
uauuacuguaagaaaauauca

SEQ ID NO: 2033190 - RNA, 16 nt, Human
uguaguccuguaaugg

SEQ ID NO: 2033191 - RNA, 19 nt, Human
ucaauucuugccaaauaua

SEQ ID NO: 2033192 - RNA, 21 nt, Human
uaaaagacagugaaagaaaau

SEQ ID NO: 2033193 - RNA, 19 nt, Human
acaaauuuacagagacaga

SEQ ID NO: 2033194 - RNA, 16 nt, Human
accuccuaagaaggca

SEQ ID NO: 2033195 - RNA, 14 nt, Human
gacggagccgggaa

SEQ ID NO: 2033196 - RNA, 20 nt, Human
acaaugacuuguacucugaa

SEQ ID NO: 2033197 - RNA, 17 nt, Human
cucagucucccucccuu

SEQ ID NO: 2033198 - RNA, 22 nt, Human
uguugcccacagcuguaugauu

SEQ ID NO: 2033199 - RNA, 14 nt, Human
ccacuggacucacc

SEQ ID NO: 2033200 - RNA, 19 nt, Human
uauauuuccaagaaauauu

SEQ ID NO: 2033201 - RNA, 18 nt, Human
ccgcuacuuccagggcua

SEQ ID NO: 2033202 - RNA, 15 nt, Human
uggacgagaaaacaa

SEQ ID NO: 2033203 - RNA, 17 nt, Human
caagaaaugaaagcagg

SEQ ID NO: 2033204 - RNA, 13 nt, Human
uucuauaauuuaa

SEQ ID NO: 2033205 - RNA, 14 nt, Human
acuuuuauaagaaa

SEQ ID NO: 2033206 - RNA, 14 nt, Human
cuuuuaguuuuuaa

SEQ ID NO: 2033207 - RNA, 15 nt, Human
gaaagaaaauaacga

SEQ ID NO: 2033208 - RNA, 23 nt, Human
cccggccggcgcgcucaucccac

SEQ ID NO: 2033209 - RNA, 22 nt, Human
ugaauuguaggugacuauuaua

SEQ ID NO: 2033210 - RNA, 16 nt, Human
cucagcccuggugggc

SEQ ID NO: 2033211 - RNA, 15 nt, Human
cuaguaauuggaaag

SEQ ID NO: 2033212 - RNA, 22 nt, Human
aagaauuucuaggacugaauua

SEQ ID NO: 2033213 - RNA, 14 nt, Human
auuuucuauaauuu

SEQ ID NO: 2033214 - RNA, 14 nt, Human
agggcuaauaucuu

SEQ ID NO: 2033215 - RNA, 14 nt, Human
cggacggcuccgga

SEQ ID NO: 2033216 - RNA, 21 nt, Human
uugaagcacagugaucaaguu

SEQ ID NO: 2033217 - RNA, 17 nt, Human
ccuauccuacuuccccu

SEQ ID NO: 2033218 - RNA, 13 nt, Human
aacaagccuccuu

SEQ ID NO: 2033219 - RNA, 23 nt, Human
cucuacuaaaaauacaaaaaaaa

SEQ ID NO: 2033220 - RNA, 18 nt, Human
uuuaguuauaaaaauaua

SEQ ID NO: 2033221 - RNA, 21 nt, Human
auaugcucuaaacauguuuau

SEQ ID NO: 2033222 - RNA, 23 nt, Human
caacacccugagguugugugugg

SEQ ID NO: 2033223 - RNA, 19 nt, Human
ucaccaaggcugauuaaac

SEQ ID NO: 2033224 - RNA, 19 nt, Human
ggccugcucgcccacuucc

SEQ ID NO: 2033225 - RNA, 20 nt, Human
ucgcaggaccaucccggccg

SEQ ID NO: 2033226 - RNA, 18 nt, Human
gagccucagucucccucc

SEQ ID NO: 2033227 - RNA, 23 nt, Human
gagaaaugagcacgcauggaaaa

SEQ ID NO: 2033228 - RNA, 17 nt, Human
cauuaaaguucuaguga

SEQ ID NO: 2033229 - RNA, 19 nt, Human
gcuguuccucgccacgcuc

SEQ ID NO: 2033230 - RNA, 16 nt, Human
cauggguuuuauuaua

SEQ ID NO: 2033231 - RNA, 22 nt, Human
cauuuaguuauaaaaauauaua

SEQ ID NO: 2033232 - RNA, 21 nt, Human
auuccuuuuucucuccucucc

SEQ ID NO: 2033233 - RNA, 20 nt, Human
gacaggcacuaucuggguuu

SEQ ID NO: 2033234 - RNA, 17 nt, Human
cucugauccgagcucag

SEQ ID NO: 2033235 - RNA, 18 nt, Human
ugugaccacugcagaaga

SEQ ID NO: 2033236 - RNA, 11 nt, Human
auuuaaaaauc

SEQ ID NO: 2033237 - RNA, 16 nt, Human
guccauugggcaggca

SEQ ID NO: 2033238 - RNA, 20 nt, Human
cucccugccccccagcccuc

SEQ ID NO: 2033239 - RNA, 21 nt, Human
cuccagcuggccgggagccug

SEQ ID NO: 2033240 - RNA, 15 nt, Human
auaauuuugugaagc

SEQ ID NO: 2033241 - RNA, 15 nt, Human
uuaauuuguaguguu

SEQ ID NO: 2033242 - RNA, 19 nt, Human
caauaaagaguuccuucug

SEQ ID NO: 2033243 - RNA, 19 nt, Human
cuagucuguuuucccuccu

SEQ ID NO: 2033244 - RNA, 17 nt, Human
caaggcccccgggccga

SEQ ID NO: 2033245 - RNA, 14 nt, Human
ugagcucagcccug

SEQ ID NO: 2033246 - RNA, 23 nt, Human
aaagauucaaugccccugaauuu

SEQ ID NO: 2033247 - RNA, 14 nt, Human
ucagucucccuccc

SEQ ID NO: 2033248 - RNA, 19 nt, Human
aaaauaacaauaaaagaca

SEQ ID NO: 2033249 - RNA, 12 nt, Human
caacccaaaugu

SEQ ID NO: 2033250 - RNA, 13 nt, Human
cuuccucccauuc

SEQ ID NO: 2033251 - RNA, 16 nt, Human
aaaauaauccucaguu

SEQ ID NO: 2033252 - RNA, 17 nt, Human
acuuccagauccuggaa

SEQ ID NO: 2033253 - RNA, 19 nt, Human
gcugcccuuccccuuccca

SEQ ID NO: 2033254 - RNA, 12 nt, Human
ccccuugccaua

SEQ ID NO: 2033255 - RNA, 18 nt, Human
ucuucuggguuccuuccu

SEQ ID NO: 2033256 - RNA, 22 nt, Human
caccucccccaucucuucuggg

SEQ ID NO: 2033257 - RNA, 18 nt, Human
cuccccaaaugcuuucca

SEQ ID NO: 2033258 - RNA, 23 nt, Human
uuguaacaagccuccuuuuaaag

SEQ ID NO: 2033259 - RNA, 20 nt, Human
cagccugagcgacagugaga

SEQ ID NO: 2033260 - RNA, 19 nt, Human
auaaaagacaaggaaaaaa

SEQ ID NO: 2033261 - RNA, 22 nt, Human
cugaggcuccacuuggucugug

SEQ ID NO: 2033262 - RNA, 21 nt, Human
uuuauauaagcuuguauuccu

SEQ ID NO: 2033263 - RNA, 16 nt, Human
agcuacaggccccauc

SEQ ID NO: 2033264 - RNA, 14 nt, Human
gaaacgaagcacca

SEQ ID NO: 2033265 - RNA, 22 nt, Human
aucucuucuggguuccuuccuc

SEQ ID NO: 2033266 - RNA, 15 nt, Human
aauugacccacaaga

SEQ ID NO: 2033267 - RNA, 12 nt, Human
cagauuuuccug

SEQ ID NO: 2033268 - RNA, 15 nt, Human
ugcaauuccacuuau

SEQ ID NO: 2033269 - RNA, 14 nt, Human
agucugacuguuuc

SEQ ID NO: 2033270 - RNA, 18 nt, Human
cugcccuuccccuuccca

SEQ ID NO: 2033271 - RNA, 17 nt, Human
uaaccucuaaauucuuu

SEQ ID NO: 2033272 - RNA, 19 nt, Human
guaguccuguaauggaagc

SEQ ID NO: 2033273 - RNA, 19 nt, Human
aauuugauaugugaacagu

SEQ ID NO: 2033274 - RNA, 22 nt, Human
aaauaacaaugaaaguugauaa

SEQ ID NO: 2033275 - RNA, 23 nt, Human
agucccugcugcccuuccccuuc

SEQ ID NO: 2033276 - RNA, 23 nt, Human
ucuccauguacuggcaagaccug

SEQ ID NO: 2033277 - RNA, 14 nt, Human
auauuuauuuuaau

SEQ ID NO: 2033278 - RNA, 16 nt, Human
auauuuccaagaaaua

SEQ ID NO: 2033279 - RNA, 15 nt, Human
ggaaauauuuuaaug

SEQ ID NO: 2033280 - RNA, 24 nt, Human
uaauuuaaaauaugcucuaaacau

SEQ ID NO: 2033281 - RNA, 15 nt, Human
acaugugcuggccac

SEQ ID NO: 2033282 - RNA, 16 nt, Human
acaaauccaaugaaau

SEQ ID NO: 2033283 - RNA, 18 nt, Human
aucuuauaauuuaaaaua

SEQ ID NO: 2033284 - RNA, 23 nt, Human
uagauguauagguugaugguggu

SEQ ID NO: 2033285 - RNA, 14 nt, Staphylococcus aureus subsp. aureus Mu50
uuuuuuaaauacau

SEQ ID NO: 2033286 - RNA, 11 nt, Staphylococcus aureus subsp. aureus Mu50
uuuuuuauuuu

SEQ ID NO: 2033287 - RNA, 19 nt, Staphylococcus aureus subsp. aureus Mu50
uuuuuucaauucuagucag

SEQ ID NO: 2033288 - RNA, 22 nt, Staphylococcus aureus subsp. aureus Mu50
uuuuugaguauccaauacuacu

SEQ ID NO: 2033289 - RNA, 21 nt, Staphylococcus aureus subsp. aureus Mu50
uuuuuguaaacaugguuuucu

SEQ ID NO: 2033290 - RNA, 16 nt, Staphylococcus aureus subsp. aureus Mu50
uuuuugcguuaauaau

SEQ ID NO: 2033291 - RNA, 17 nt, Staphylococcus aureus subsp. aureus Mu50
uuuuucuuuuguuuuca

SEQ ID NO: 2033292 - RNA, 22 nt, Staphylococcus aureus subsp. aureus Mu50
uuuuucguaacauuuaaaaaau

SEQ ID NO: 2033293 - RNA, 22 nt, Staphylococcus aureus subsp. aureus Mu50
uuuucuucaguuaaaucuuuaa

SEQ ID NO: 2033294 - RNA, 13 nt, Staphylococcus aureus subsp. aureus Mu50
uuuucuuaaaaga

SEQ ID NO: 2033295 - RNA, 19 nt, Staphylococcus aureus subsp. aureus Mu50
uuuugaaaccuuggcuuca

SEQ ID NO: 2033296 - RNA, 16 nt, Staphylococcus aureus subsp. aureus Mu50
uuuucuuucuuuuuua

SEQ ID NO: 2033297 - RNA, 18 nt, Staphylococcus aureus subsp. aureus Mu50
uuuugaaguuacuauauu

SEQ ID NO: 2033298 - RNA, 12 nt, Staphylococcus aureus subsp. aureus Mu50
uuuugaauaauu

SEQ ID NO: 2033299 - RNA, 21 nt, Staphylococcus aureus subsp. aureus Mu50
uuuugaauauuugcuuuuugu

SEQ ID NO: 2033300 - RNA, 16 nt, Staphylococcus aureus subsp. aureus Mu50
uuuugaugaucauuag

SEQ ID NO: 2033301 - RNA, 19 nt, Staphylococcus aureus subsp. aureus Mu50
uuuugauguuuaugacaaa

SEQ ID NO: 2033302 - RNA, 18 nt, Staphylococcus aureus subsp. aureus Mu50
uuucgcuuuuuuuauuuu

SEQ ID NO: 2033303 - RNA, 17 nt, Staphylococcus aureus subsp. aureus Mu50
uuucguauguuucuuua

SEQ ID NO: 2033304 - RNA, 22 nt, Staphylococcus aureus subsp. aureus Mu50
uuugccccgccauucauaaaug

SEQ ID NO: 2033305 - RNA, 14 nt, Staphylococcus aureus subsp. aureus Mu50
uuuggucaccaaau

SEQ ID NO: 2033306 - RNA, 22 nt, Staphylococcus aureus subsp. aureus Mu50
uuuguaauugaugauuacucca

SEQ ID NO: 2033307 - RNA, 15 nt, Staphylococcus aureus subsp. aureus Mu50
uuuguaccaaauaaa

SEQ ID NO: 2033308 - RNA, 23 nt, Staphylococcus aureus subsp. aureus Mu50
uuuguaccaaauaaauuaaauuu

SEQ ID NO: 2033309 - RNA, 20 nt, Staphylococcus aureus subsp. aureus Mu50
uuuggcuuuuuauaccaaua

SEQ ID NO: 2033310 - RNA, 18 nt, Staphylococcus aureus subsp. aureus Mu50
uuugggaagcgucuuuuu

SEQ ID NO: 2033311 - RNA, 17 nt, Staphylococcus aureus subsp. aureus Mu50
uuuuagcaacaguauuu

SEQ ID NO: 2033312 - RNA, 15 nt, Staphylococcus aureus subsp. aureus Mu50
uuuuagaaucaaaaa

SEQ ID NO: 2033313 - RNA, 14 nt, Staphylococcus aureus subsp. aureus Mu50
uuuuagguaauaau

SEQ ID NO: 2033314 - RNA, 14 nt, Staphylococcus aureus subsp. aureus Mu50
uuuuauaaaugaau

SEQ ID NO: 2033315 - RNA, 20 nt, Staphylococcus aureus subsp. aureus Mu50
uuuuauaagaauuuaaaaga

SEQ ID NO: 2033316 - RNA, 15 nt, Staphylococcus aureus subsp. aureus Mu50
uuuuauaauauuauu

SEQ ID NO: 2033317 - RNA, 17 nt, Staphylococcus aureus subsp. aureus Mu50
uuuuauacauaaauauu

SEQ ID NO: 2033318 - RNA, 22 nt, Staphylococcus aureus subsp. aureus Mu50
uuuuacaaacuucacaucaugu

SEQ ID NO: 2033319 - RNA, 23 nt, Staphylococcus aureus subsp. aureus Mu50
uuuuacaaagugauuuaaaaaau

SEQ ID NO: 2033320 - RNA, 16 nt, Staphylococcus aureus subsp. aureus Mu50
uuuuacaaguuguuca

SEQ ID NO: 2033321 - RNA, 18 nt, Staphylococcus aureus subsp. aureus Mu50
uuuuacgaaaauaucauu

SEQ ID NO: 2033322 - RNA, 16 nt, Staphylococcus aureus subsp. aureus Mu50
uuuguaugauaaccau

SEQ ID NO: 2033323 - RNA, 15 nt, Staphylococcus aureus subsp. aureus Mu50
uuugucaucuuuugu

SEQ ID NO: 2033324 - RNA, 13 nt, Staphylococcus aureus subsp. aureus Mu50
uuugucguuacua

SEQ ID NO: 2033325 - RNA, 15 nt, Staphylococcus aureus subsp. aureus Mu50
uuuuaauuaauuauu

SEQ ID NO: 2033326 - RNA, 16 nt, Staphylococcus aureus subsp. aureus Mu50
uuuuaauugaaugaaa

SEQ ID NO: 2033327 - RNA, 18 nt, Staphylococcus aureus subsp. aureus Mu50
uuuuaugacguaauuaau

SEQ ID NO: 2033328 - RNA, 18 nt, Staphylococcus aureus subsp. aureus Mu50
uuuuaucuaaacauuuuu

SEQ ID NO: 2033329 - RNA, 17 nt, Staphylococcus aureus subsp. aureus Mu50
uuuuaugauuuucuuua

SEQ ID NO: 2033330 - RNA, 13 nt, Staphylococcus aureus subsp. aureus Mu50
uuuuaugcacaaa

SEQ ID NO: 2033331 - RNA, 21 nt, Staphylococcus aureus subsp. aureus Mu50
uuuuaucgaaagguauaucuu

SEQ ID NO: 2033332 - RNA, 15 nt, Staphylococcus aureus subsp. aureus Mu50
uuuuaucgaaauauu

SEQ ID NO: 2033333 - RNA, 22 nt, Staphylococcus aureus subsp. aureus Mu50
uuuuauauucaacuuauuauuu

SEQ ID NO: 2033334 - RNA, 22 nt, Staphylococcus aureus subsp. aureus Mu50
uuuuauauugcgaaaaauaauu

SEQ ID NO: 2033335 - RNA, 13 nt, Staphylococcus aureus subsp. aureus Mu50
uuuuauuaauuaa

SEQ ID NO: 2033336 - RNA, 14 nt, Staphylococcus aureus subsp. aureus Mu50
uuuuauucacuuuu

SEQ ID NO: 2033337 - RNA, 20 nt, Staphylococcus aureus subsp. aureus Mu50
uuuuauguuuaaacauuuuu

SEQ ID NO: 2033338 - RNA, 18 nt, Staphylococcus aureus subsp. aureus Mu50
uuuuaugcuuuaaaucga

SEQ ID NO: 2033339 - RNA, 14 nt, Staphylococcus aureus subsp. aureus Mu50
uuuucaaacauauu

SEQ ID NO: 2033340 - RNA, 18 nt, Staphylococcus aureus subsp. aureus Mu50
uuuucaaagcgaucauua

SEQ ID NO: 2033341 - RNA, 16 nt, Staphylococcus aureus subsp. aureus Mu50
uuuuauuuuaauauuu

SEQ ID NO: 2033342 - RNA, 15 nt, Staphylococcus aureus subsp. aureus Mu50
uuuuauuuaauuauu

SEQ ID NO: 2033343 - RNA, 17 nt, Staphylococcus aureus subsp. aureus Mu50
uuuucaacauaauauuu

SEQ ID NO: 2033344 - RNA, 16 nt, Staphylococcus aureus subsp. aureus Mu50
uuuucaacauuuuuua

SEQ ID NO: 2033345 - RNA, 18 nt, Staphylococcus aureus subsp. aureus Mu50
uuuucaagaccaaauauu

SEQ ID NO: 2033346 - RNA, 20 nt, Staphylococcus aureus subsp. aureus Mu50
uuuucaagagguuuuauuua

SEQ ID NO: 2033347 - RNA, 20 nt, Staphylococcus aureus subsp. aureus Mu50
uuuucaauaaauuuuauaua

SEQ ID NO: 2033348 - RNA, 23 nt, Staphylococcus aureus subsp. aureus Mu50
uuuucacgaauaucuuaaagaau

SEQ ID NO: 2033349 - RNA, 13 nt, Staphylococcus aureus subsp. aureus Mu50
uuuucucaacagu

SEQ ID NO: 2033350 - RNA, 12 nt, Staphylococcus aureus subsp. aureus Mu50
uuuaaaaaacag

SEQ ID NO: 2033351 - RNA, 14 nt, Staphylococcus aureus subsp. aureus Mu50
uuguuuucaauaau

SEQ ID NO: 2033352 - RNA, 13 nt, Staphylococcus aureus subsp. aureus Mu50
uuuaaaaaguaau

SEQ ID NO: 2033353 - RNA, 16 nt, Staphylococcus aureus subsp. aureus Mu50
uuuaaaaauugauauu

SEQ ID NO: 2033354 - RNA, 19 nt, Staphylococcus aureus subsp. aureus Mu50
uuuaaaacuuguaaauuua

SEQ ID NO: 2033355 - RNA, 12 nt, Staphylococcus aureus subsp. aureus Mu50
uuuaaaaguaac

SEQ ID NO: 2033356 - RNA, 17 nt, Staphylococcus aureus subsp. aureus Mu50
uuuaaaaaauuuaaugu

SEQ ID NO: 2033357 - RNA, 13 nt, Staphylococcus aureus subsp. aureus Mu50
uuuaaacgcucau

SEQ ID NO: 2033358 - RNA, 17 nt, Staphylococcus aureus subsp. aureus Mu50
uuuaaaauuaucaauug

SEQ ID NO: 2033359 - RNA, 15 nt, Staphylococcus aureus subsp. aureus Mu50
uuuaaaauuaugauu

SEQ ID NO: 2033360 - RNA, 14 nt, Staphylococcus aureus subsp. aureus Mu50
uuuaaaauaauaga

SEQ ID NO: 2033361 - RNA, 17 nt, Staphylococcus aureus subsp. aureus Mu50
uuuaaaauauaaauuuc

SEQ ID NO: 2033362 - RNA, 19 nt, Staphylococcus aureus subsp. aureus Mu50
uuuaaaauauaaauuucuu

SEQ ID NO: 2033363 - RNA, 17 nt, Staphylococcus aureus subsp. aureus Mu50
uuuaaaaucucauaaua

SEQ ID NO: 2033364 - RNA, 16 nt, Staphylococcus aureus subsp. aureus Mu50
uuguguccauaaauau

SEQ ID NO: 2033365 - RNA, 14 nt, Staphylococcus aureus subsp. aureus Mu50
uuguuuuaaauacu

SEQ ID NO: 2033366 - RNA, 20 nt, Staphylococcus aureus subsp. aureus Mu50
uuguggcuacuaaucuuuuu

SEQ ID NO: 2033367 - RNA, 16 nt, Staphylococcus aureus subsp. aureus Mu50
uuguauuucaucaugu

SEQ ID NO: 2033368 - RNA, 18 nt, Staphylococcus aureus subsp. aureus Mu50
uuguauuuccuuaauaug

SEQ ID NO: 2033369 - RNA, 16 nt, Staphylococcus aureus subsp. aureus Mu50
uuguaugauaaccauu

SEQ ID NO: 2033370 - RNA, 19 nt, Staphylococcus aureus subsp. aureus Mu50
uuguauucugaaacuuuaa

SEQ ID NO: 2033371 - RNA, 19 nt, Staphylococcus aureus subsp. aureus Mu50
uuguauugaucuacauaau

SEQ ID NO: 2033372 - RNA, 20 nt, Staphylococcus aureus subsp. aureus Mu50
uugucaucguauuucuagcu

SEQ ID NO: 2033373 - RNA, 17 nt, Staphylococcus aureus subsp. aureus Mu50
uugucauaauagauaau

SEQ ID NO: 2033374 - RNA, 21 nt, Staphylococcus aureus subsp. aureus Mu50
uugucauaccaaauaaauaag

SEQ ID NO: 2033375 - RNA, 16 nt, Staphylococcus aureus subsp. aureus Mu50
uugugaaaguuuuugu

SEQ ID NO: 2033376 - RNA, 17 nt, Staphylococcus aureus subsp. aureus Mu50
uugugacuuuguucaug

SEQ ID NO: 2033377 - RNA, 20 nt, Staphylococcus aureus subsp. aureus Mu50
uuggucaaguaaauguuuua

SEQ ID NO: 2033378 - RNA, 20 nt, Staphylococcus aureus subsp. aureus Mu50
uugguauaucgaaagguaac

SEQ ID NO: 2033379 - RNA, 19 nt, Staphylococcus aureus subsp. aureus Mu50
uuggggaugggccccaaca

SEQ ID NO: 2033380 - RNA, 20 nt, Staphylococcus aureus subsp. aureus Mu50
uuggggcccacaccccaacu

SEQ ID NO: 2033381 - RNA, 20 nt, Staphylococcus aureus subsp. aureus Mu50
uugguggagauuguaaaaau

SEQ ID NO: 2033382 - RNA, 13 nt, Staphylococcus aureus subsp. aureus Mu50
uugguuuaaaaau

SEQ ID NO: 2033383 - RNA, 18 nt, Staphylococcus aureus subsp. aureus Mu50
uugguuuaucagcuuuaa

SEQ ID NO: 2033384 - RNA, 22 nt, Staphylococcus aureus subsp. aureus Mu50
uugguuauuaaaauuaaauaau

SEQ ID NO: 2033385 - RNA, 21 nt, Staphylococcus aureus subsp. aureus Mu50
uugguuaauacguuuaauaau

SEQ ID NO: 2033386 - RNA, 16 nt, Staphylococcus aureus subsp. aureus Mu50
uuggugugguaaaagc

SEQ ID NO: 2033387 - RNA, 17 nt, Staphylococcus aureus subsp. aureus Mu50
uuguaaaaauacauaau

SEQ ID NO: 2033388 - RNA, 15 nt, Staphylococcus aureus subsp. aureus Mu50
uuguauauucuuuuu

SEQ ID NO: 2033389 - RNA, 23 nt, Staphylococcus aureus subsp. aureus Mu50
uuguaucaacauuaauaaauaau

SEQ ID NO: 2033390 - RNA, 24 nt, Staphylococcus aureus subsp. aureus Mu50
uuguaucucugaaaaacuucuuaa

SEQ ID NO: 2033391 - RNA, 23 nt, Staphylococcus aureus subsp. aureus Mu50
uuguaucuucucggcaagugcuu

SEQ ID NO: 2033392 - RNA, 15 nt, Staphylococcus aureus subsp. aureus Mu50
uuuaacgucauuuuu

SEQ ID NO: 2033393 - RNA, 20 nt, Staphylococcus aureus subsp. aureus Mu50
uuuaacauagcuuaauaauu

SEQ ID NO: 2033394 - RNA, 23 nt, Staphylococcus aureus subsp. aureus Mu50
uuuaacaauacuacuuaaugacu

SEQ ID NO: 2033395 - RNA, 17 nt, Staphylococcus aureus subsp. aureus Mu50
uuuaaauuuucaucaua

SEQ ID NO: 2033396 - RNA, 20 nt, Staphylococcus aureus subsp. aureus Mu50
uuuaacaaugcgauuaaacu

SEQ ID NO: 2033397 - RNA, 22 nt, Staphylococcus aureus subsp. aureus Mu50
uuuaaagcuaaauguuaaugcu

SEQ ID NO: 2033398 - RNA, 22 nt, Staphylococcus aureus subsp. aureus Mu50
uuuaaagguuaaauauuuaauu

SEQ ID NO: 2033399 - RNA, 19 nt, Staphylococcus aureus subsp. aureus Mu50
uuuaaauuaugacuuauuu

SEQ ID NO: 2033400 - RNA, 12 nt, Staphylococcus aureus subsp. aureus Mu50
uuuaaaugauau

SEQ ID NO: 2033401 - RNA, 22 nt, Staphylococcus aureus subsp. aureus Mu50
uuuaaguaucggugauuuaauu

SEQ ID NO: 2033402 - RNA, 16 nt, Staphylococcus aureus subsp. aureus Mu50
uuuaauaaguuaaugu

SEQ ID NO: 2033403 - RNA, 24 nt, Staphylococcus aureus subsp. aureus Mu50
uuuaauaauuaaauauaaagacga

SEQ ID NO: 2033404 - RNA, 21 nt, Staphylococcus aureus subsp. aureus Mu50
uuuaauagcauuccuaauuau

SEQ ID NO: 2033405 - RNA, 22 nt, Staphylococcus aureus subsp. aureus Mu50
uuuaauagcauuccuaauuaua

SEQ ID NO: 2033406 - RNA, 14 nt, Staphylococcus aureus subsp. aureus Mu50
uuuagguaauaauu

SEQ ID NO: 2033407 - RNA, 18 nt, Staphylococcus aureus subsp. aureus Mu50
uuuaggugcuuuaaugcc

SEQ ID NO: 2033408 - RNA, 13 nt, Staphylococcus aureus subsp. aureus Mu50
uuuaagaaugcga

SEQ ID NO: 2033409 - RNA, 22 nt, Staphylococcus aureus subsp. aureus Mu50
uuuaacauuuguccgauuuauu

SEQ ID NO: 2033410 - RNA, 21 nt, Staphylococcus aureus subsp. aureus Mu50
uuuaaccacuccuuaaacaaa

SEQ ID NO: 2033411 - RNA, 19 nt, Staphylococcus aureus subsp. aureus Mu50
uuuaacuucugauucuuca

SEQ ID NO: 2033412 - RNA, 17 nt, Staphylococcus aureus subsp. aureus Mu50
uuuauuuuagcagcagu

SEQ ID NO: 2033413 - RNA, 19 nt, Staphylococcus aureus subsp. aureus Mu50
uuuauuugagaaccacuau

SEQ ID NO: 2033414 - RNA, 20 nt, Staphylococcus aureus subsp. aureus Mu50
uuuauuuguacaugaacaaa

SEQ ID NO: 2033415 - RNA, 14 nt, Staphylococcus aureus subsp. aureus Mu50
uuuauacauaaaua

SEQ ID NO: 2033416 - RNA, 13 nt, Staphylococcus aureus subsp. aureus Mu50
uuuauaucaaaaa

SEQ ID NO: 2033417 - RNA, 18 nt, Staphylococcus aureus subsp. aureus Mu50
uuuauucuaauacaaacc

SEQ ID NO: 2033418 - RNA, 15 nt, Staphylococcus aureus subsp. aureus Mu50
uuuauuaguuuuuac

SEQ ID NO: 2033419 - RNA, 21 nt, Staphylococcus aureus subsp. aureus Mu50
uuuauuauacauaggcgcugu

SEQ ID NO: 2033420 - RNA, 22 nt, Staphylococcus aureus subsp. aureus Mu50
uuuauagauucauguaaauagu

SEQ ID NO: 2033421 - RNA, 15 nt, Staphylococcus aureus subsp. aureus Mu50
uuuauagcauuucuu

SEQ ID NO: 2033422 - RNA, 14 nt, Staphylococcus aureus subsp. aureus Mu50
uuuauaauaaauuu

SEQ ID NO: 2033423 - RNA, 13 nt, Staphylococcus aureus subsp. aureus Mu50
uuuauaauaaucg

SEQ ID NO: 2033424 - RNA, 14 nt, Staphylococcus aureus subsp. aureus Mu50
uuuauaaucaguuu

SEQ ID NO: 2033425 - RNA, 23 nt, Staphylococcus aureus subsp. aureus Mu50
uuuauaagccuuuucaaacauau

SEQ ID NO: 2033426 - RNA, 21 nt, Staphylococcus aureus subsp. aureus Mu50
uuuauaaguaucgccaucauu

SEQ ID NO: 2033427 - RNA, 20 nt, Staphylococcus aureus subsp. aureus Mu50
uuuaggugcuuuaaugccgg

SEQ ID NO: 2033428 - RNA, 23 nt, Staphylococcus aureus subsp. aureus Mu50
uuuaguacauagaccuuuauuuu

SEQ ID NO: 2033429 - RNA, 17 nt, Staphylococcus aureus subsp. aureus Mu50
uuuaguaucucauuuuu

SEQ ID NO: 2033430 - RNA, 21 nt, Staphylococcus aureus subsp. aureus Mu50
uuuagguuuguugcuuauuaa

SEQ ID NO: 2033431 - RNA, 13 nt, Staphylococcus aureus subsp. aureus Mu50
uuuauaaaucaaa

SEQ ID NO: 2033432 - RNA, 12 nt, Staphylococcus aureus subsp. aureus Mu50
uuucaaacaaag

SEQ ID NO: 2033433 - RNA, 20 nt, Staphylococcus aureus subsp. aureus Mu50
uuucaacaaacauaaauaag

SEQ ID NO: 2033434 - RNA, 17 nt, Staphylococcus aureus subsp. aureus Mu50
uuucaacacacuauuau

SEQ ID NO: 2033435 - RNA, 18 nt, Staphylococcus aureus subsp. aureus Mu50
uuucaaguaaugauauua

SEQ ID NO: 2033436 - RNA, 20 nt, Staphylococcus aureus subsp. aureus Mu50
uuucaacuuuuuaauaauac

SEQ ID NO: 2033437 - RNA, 22 nt, Staphylococcus aureus subsp. aureus Mu50
uuucaauauguggcgcucuuau

SEQ ID NO: 2033438 - RNA, 21 nt, Staphylococcus aureus subsp. aureus Mu50
uuucaguaauuguuacuaguu

SEQ ID NO: 2033439 - RNA, 19 nt, Staphylococcus aureus subsp. aureus Mu50
uuucaguucaucauagaca

SEQ ID NO: 2033440 - RNA, 22 nt, Staphylococcus aureus subsp. aureus Mu50
uuucauaccuugauuauaugcu

SEQ ID NO: 2033441 - RNA, 22 nt, Staphylococcus aureus subsp. aureus Mu50
uuucauaaaguuuauuuauguu

SEQ ID NO: 2033442 - RNA, 15 nt, Staphylococcus aureus subsp. aureus Mu50
uuucaucauuaaaau

SEQ ID NO: 2033443 - RNA, 19 nt, Staphylococcus aureus subsp. aureus Mu50
uuucaucauuaaaaucaac

SEQ ID NO: 2033444 - RNA, 16 nt, Staphylococcus aureus subsp. aureus Mu50
uuucauauaaugaaug

SEQ ID NO: 2033445 - RNA, 13 nt, Staphylococcus aureus subsp. aureus Mu50
uuucaucuuuuau

SEQ ID NO: 2033446 - RNA, 12 nt, Staphylococcus aureus subsp. aureus Mu50
uuucauuguaaa

SEQ ID NO: 2033447 - RNA, 13 nt, Staphylococcus aureus subsp. aureus Mu50
uuucauuuggaaa

SEQ ID NO: 2033448 - RNA, 18 nt, Staphylococcus aureus subsp. aureus Mu50
uuucauuuuuaucccacu

SEQ ID NO: 2033449 - RNA, 19 nt, Staphylococcus aureus subsp. aureus Mu50
uuuccaaucuauuaaugcu

SEQ ID NO: 2033450 - RNA, 20 nt, Staphylococcus aureus subsp. aureus Mu50
uuuccaaauugcaaaguaac

SEQ ID NO: 2033451 - RNA, 14 nt, Staphylococcus aureus subsp. aureus Mu50
uuucgauuaauuua

SEQ ID NO: 2033452 - RNA, 21 nt, Staphylococcus aureus subsp. aureus Mu50
uugaagcuaauucauauucaa

SEQ ID NO: 2033453 - RNA, 21 nt, Staphylococcus aureus subsp. aureus Mu50
uugaagaaucaggaccaaaua

SEQ ID NO: 2033454 - RNA, 19 nt, Staphylococcus aureus subsp. aureus Mu50
uugaagucaauaauuuuau

SEQ ID NO: 2033455 - RNA, 15 nt, Staphylococcus aureus subsp. aureus Mu50
uugaagugaguuuau

SEQ ID NO: 2033456 - RNA, 15 nt, Staphylococcus aureus subsp. aureus Mu50
uugaaggugauaaug

SEQ ID NO: 2033457 - RNA, 22 nt, Staphylococcus aureus subsp. aureus Mu50
uugaauauggaaaauguauuau

SEQ ID NO: 2033458 - RNA, 22 nt, Staphylococcus aureus subsp. aureus Mu50
uugaauccaagugacaacauua

SEQ ID NO: 2033459 - RNA, 15 nt, Staphylococcus aureus subsp. aureus Mu50
uugaaucuuguugaa

SEQ ID NO: 2033460 - RNA, 21 nt, Staphylococcus aureus subsp. aureus Mu50
uugacaguuuccauaaauaaa

SEQ ID NO: 2033461 - RNA, 13 nt, Staphylococcus aureus subsp. aureus Mu50
uuccuagcuuuua

SEQ ID NO: 2033462 - RNA, 20 nt, Staphylococcus aureus subsp. aureus Mu50
uugaacgauaacaauuuauu

SEQ ID NO: 2033463 - RNA, 19 nt, Staphylococcus aureus subsp. aureus Mu50
uugaacgguuguauuucau

SEQ ID NO: 2033464 - RNA, 18 nt, Staphylococcus aureus subsp. aureus Mu50
uugaacguuuauuuuuau

SEQ ID NO: 2033465 - RNA, 22 nt, Staphylococcus aureus subsp. aureus Mu50
uugaacuaaaacgauaauaaua

SEQ ID NO: 2033466 - RNA, 15 nt, Staphylococcus aureus subsp. aureus Mu50
uugaacaauaauaug

SEQ ID NO: 2033467 - RNA, 14 nt, Staphylococcus aureus subsp. aureus Mu50
uugagaauauuuau

SEQ ID NO: 2033468 - RNA, 22 nt, Staphylococcus aureus subsp. aureus Mu50
uugagauauauuaauguuugau

SEQ ID NO: 2033469 - RNA, 15 nt, Staphylococcus aureus subsp. aureus Mu50
uugacuuuaucaauu

SEQ ID NO: 2033470 - RNA, 23 nt, Staphylococcus aureus subsp. aureus Mu50
uugacuacucaauccuaaauuau

SEQ ID NO: 2033471 - RNA, 19 nt, Staphylococcus aureus subsp. aureus Mu50
uugacgccagaauaaaucc

SEQ ID NO: 2033472 - RNA, 15 nt, Staphylococcus aureus subsp. aureus Mu50
uugagucaauuucuu

SEQ ID NO: 2033473 - RNA, 11 nt, Staphylococcus aureus subsp. aureus Mu50
uugaguaauuu

SEQ ID NO: 2033474 - RNA, 15 nt, Staphylococcus aureus subsp. aureus Mu50
uugauaaaauaaaua

SEQ ID NO: 2033475 - RNA, 17 nt, Staphylococcus aureus subsp. aureus Mu50
uugauaaaauaaauaag

SEQ ID NO: 2033476 - RNA, 13 nt, Staphylococcus aureus subsp. aureus Mu50
uugauaucuacag

SEQ ID NO: 2033477 - RNA, 19 nt, Staphylococcus aureus subsp. aureus Mu50
uugauagcaccguaacaua

SEQ ID NO: 2033478 - RNA, 21 nt, Staphylococcus aureus subsp. aureus Mu50
uugaucgaauaacuguuuauc

SEQ ID NO: 2033479 - RNA, 15 nt, Staphylococcus aureus subsp. aureus Mu50
uugaugaauaaauag

SEQ ID NO: 2033480 - RNA, 21 nt, Staphylococcus aureus subsp. aureus Mu50
uugauuaaaaacgucucuaua

SEQ ID NO: 2033481 - RNA, 14 nt, Staphylococcus aureus subsp. aureus Mu50
uugauuaaacgguu

SEQ ID NO: 2033482 - RNA, 18 nt, Staphylococcus aureus subsp. aureus Mu50
uugauuacaauuguucuc

SEQ ID NO: 2033483 - RNA, 15 nt, Staphylococcus aureus subsp. aureus Mu50
uugauuaguaaauau

SEQ ID NO: 2033484 - RNA, 20 nt, Staphylococcus aureus subsp. aureus Mu50
uugauuuugaaucacauuaa

SEQ ID NO: 2033485 - RNA, 22 nt, Staphylococcus aureus subsp. aureus Mu50
uugcaaucguauguaacaauuu

SEQ ID NO: 2033486 - RNA, 19 nt, Staphylococcus aureus subsp. aureus Mu50
uugauuguaccaguaacaa

SEQ ID NO: 2033487 - RNA, 15 nt, Staphylococcus aureus subsp. aureus Mu50
uugauuuauuauuuc

SEQ ID NO: 2033488 - RNA, 21 nt, Staphylococcus aureus subsp. aureus Mu50
uugcacgucuuguaucaacau

SEQ ID NO: 2033489 - RNA, 22 nt, Staphylococcus aureus subsp. aureus Mu50
uugcauaccuauaaacauaucu

SEQ ID NO: 2033490 - RNA, 19 nt, Staphylococcus aureus subsp. aureus Mu50
uuggaaauaucuuacugcu

SEQ ID NO: 2033491 - RNA, 17 nt, Staphylococcus aureus subsp. aureus Mu50
uugcguuuuuaaauaau

SEQ ID NO: 2033492 - RNA, 18 nt, Staphylococcus aureus subsp. aureus Mu50
uugcuaaaauaucaaaau

SEQ ID NO: 2033493 - RNA, 12 nt, Staphylococcus aureus subsp. aureus Mu50
uugcuaaauagc

SEQ ID NO: 2033494 - RNA, 20 nt, Staphylococcus aureus subsp. aureus Mu50
uugcucuaauccaaaauaau

SEQ ID NO: 2033495 - RNA, 19 nt, Staphylococcus aureus subsp. aureus Mu50
uugcucgcgcucuucuuca

SEQ ID NO: 2033496 - RNA, 18 nt, Staphylococcus aureus subsp. aureus Mu50
uugcuguauauauaugua

SEQ ID NO: 2033497 - RNA, 23 nt, Staphylococcus aureus subsp. aureus Mu50
uugcuguucaacaucuuuaugug

SEQ ID NO: 2033498 - RNA, 15 nt, Staphylococcus aureus subsp. aureus Mu50
uugcuuauuuauuuu

SEQ ID NO: 2033499 - RNA, 19 nt, Staphylococcus aureus subsp. aureus Mu50
uugcuuaaaccuuaauaau

SEQ ID NO: 2033500 - RNA, 16 nt, Staphylococcus aureus subsp. aureus Mu50
uugccguauuucaaau

SEQ ID NO: 2033501 - RNA, 22 nt, Staphylococcus aureus subsp. aureus Mu50
uugccggggugggacgacgaaa

SEQ ID NO: 2033502 - RNA, 15 nt, Staphylococcus aureus subsp. aureus Mu50
uugcgucguuuauua

SEQ ID NO: 2033503 - RNA, 20 nt, Staphylococcus aureus subsp. aureus Mu50
uucagaaaugacaucaucua

SEQ ID NO: 2033504 - RNA, 19 nt, Staphylococcus aureus subsp. aureus Mu50
uucagguuuuaugaauuga

SEQ ID NO: 2033505 - RNA, 20 nt, Staphylococcus aureus subsp. aureus Mu50
uucaggguuuaagauuuuau

SEQ ID NO: 2033506 - RNA, 13 nt, Staphylococcus aureus subsp. aureus Mu50
uucaguuaaauca

SEQ ID NO: 2033507 - RNA, 14 nt, Staphylococcus aureus subsp. aureus Mu50
uucacuaauuucuu

SEQ ID NO: 2033508 - RNA, 16 nt, Staphylococcus aureus subsp. aureus Mu50
uucacuaaaaauauau

SEQ ID NO: 2033509 - RNA, 16 nt, Staphylococcus aureus subsp. aureus Mu50
uucacuaauauuucuu

SEQ ID NO: 2033510 - RNA, 15 nt, Staphylococcus aureus subsp. aureus Mu50
uucacguagcuuuuc

SEQ ID NO: 2033511 - RNA, 19 nt, Staphylococcus aureus subsp. aureus Mu50
uucaccaucuguaacuaau

SEQ ID NO: 2033512 - RNA, 15 nt, Staphylococcus aureus subsp. aureus Mu50
uucaccaacuuuuuu

SEQ ID NO: 2033513 - RNA, 20 nt, Staphylococcus aureus subsp. aureus Mu50
uucacaucuuuagcuaugua

SEQ ID NO: 2033514 - RNA, 20 nt, Staphylococcus aureus subsp. aureus Mu50
uuaugcccuagguuuauaua

SEQ ID NO: 2033515 - RNA, 16 nt, Staphylococcus aureus subsp. aureus Mu50
uuaugcacuuuuuuua

SEQ ID NO: 2033516 - RNA, 15 nt, Staphylococcus aureus subsp. aureus Mu50
uuaugguuuaauuua

SEQ ID NO: 2033517 - RNA, 18 nt, Staphylococcus aureus subsp. aureus Mu50
uuauggcgguuugaaaau

SEQ ID NO: 2033518 - RNA, 17 nt, Staphylococcus aureus subsp. aureus Mu50
uuauguauuuuuauuua

SEQ ID NO: 2033519 - RNA, 22 nt, Staphylococcus aureus subsp. aureus Mu50
uuaugugcaccgccaagugguu

SEQ ID NO: 2033520 - RNA, 23 nt, Staphylococcus aureus subsp. aureus Mu50
uuauguuuaauuugauuaaauuc

SEQ ID NO: 2033521 - RNA, 22 nt, Staphylococcus aureus subsp. aureus Mu50
uuauggcagauccauaaggauu

SEQ ID NO: 2033522 - RNA, 13 nt, Staphylococcus aureus subsp. aureus Mu50
uuauguuuaucua

SEQ ID NO: 2033523 - RNA, 21 nt, Staphylococcus aureus subsp. aureus Mu50
uuauguuuuuaacagcuuuuu

SEQ ID NO: 2033524 - RNA, 14 nt, Staphylococcus aureus subsp. aureus Mu50
uuauuaaacccaau

SEQ ID NO: 2033525 - RNA, 12 nt, Staphylococcus aureus subsp. aureus Mu50
uuauuaaauaac

SEQ ID NO: 2033526 - RNA, 12 nt, Staphylococcus aureus subsp. aureus Mu50
uuauuaaaucag

SEQ ID NO: 2033527 - RNA, 21 nt, Staphylococcus aureus subsp. aureus Mu50
uucaaaugcuuaauaaaauca

SEQ ID NO: 2033528 - RNA, 21 nt, Staphylococcus aureus subsp. aureus Mu50
uucaacuucgauaugauuaaa

SEQ ID NO: 2033529 - RNA, 13 nt, Staphylococcus aureus subsp. aureus Mu50
uucaacuaugaaa

SEQ ID NO: 2033530 - RNA, 20 nt, Staphylococcus aureus subsp. aureus Mu50
uucaacucaggcuuaauuaa

SEQ ID NO: 2033531 - RNA, 17 nt, Staphylococcus aureus subsp. aureus Mu50
uucaaccaucucuuucu

SEQ ID NO: 2033532 - RNA, 14 nt, Staphylococcus aureus subsp. aureus Mu50
uucaacaucuuuau

SEQ ID NO: 2033533 - RNA, 14 nt, Staphylococcus aureus subsp. aureus Mu50
uucaacauaacuca

SEQ ID NO: 2033534 - RNA, 19 nt, Staphylococcus aureus subsp. aureus Mu50
uucaaauggacuaacguca

SEQ ID NO: 2033535 - RNA, 13 nt, Staphylococcus aureus subsp. aureus Mu50
uucaaauuauaac

SEQ ID NO: 2033536 - RNA, 16 nt, Staphylococcus aureus subsp. aureus Mu50
uucauauucacaucuu

SEQ ID NO: 2033537 - RNA, 21 nt, Staphylococcus aureus subsp. aureus Mu50
uucaucaaguauaaauguuau

SEQ ID NO: 2033538 - RNA, 12 nt, Staphylococcus aureus subsp. aureus Mu50
uucaucaauaac

SEQ ID NO: 2033539 - RNA, 15 nt, Staphylococcus aureus subsp. aureus Mu50
uucauacauaacaca

SEQ ID NO: 2033540 - RNA, 16 nt, Staphylococcus aureus subsp. aureus Mu50
uucauacacuaucauu

SEQ ID NO: 2033541 - RNA, 13 nt, Staphylococcus aureus subsp. aureus Mu50
uucauaaaugcuu

SEQ ID NO: 2033542 - RNA, 17 nt, Staphylococcus aureus subsp. aureus Mu50
uucaucaaacaacauca

SEQ ID NO: 2033543 - RNA, 14 nt, Staphylococcus aureus subsp. aureus Mu50
uucauaguuauuaa

SEQ ID NO: 2033544 - RNA, 22 nt, Staphylococcus aureus subsp. aureus Mu50
uucauacgcuaaugcuauauua

SEQ ID NO: 2033545 - RNA, 11 nt, Staphylococcus aureus subsp. aureus Mu50
uuaaucgcauu

SEQ ID NO: 2033546 - RNA, 17 nt, Staphylococcus aureus subsp. aureus Mu50
uuaauccaguaaucaaa

SEQ ID NO: 2033547 - RNA, 15 nt, Staphylococcus aureus subsp. aureus Mu50
uuaaucgggcuauau

SEQ ID NO: 2033548 - RNA, 18 nt, Staphylococcus aureus subsp. aureus Mu50
uuaaucgcucuaaauagu

SEQ ID NO: 2033549 - RNA, 19 nt, Staphylococcus aureus subsp. aureus Mu50
uuaaucguucccauucuuu

SEQ ID NO: 2033550 - RNA, 13 nt, Staphylococcus aureus subsp. aureus Mu50
uuaaucuaaaaau

SEQ ID NO: 2033551 - RNA, 19 nt, Staphylococcus aureus subsp. aureus Mu50
uuaaucucuuuuugauuau

SEQ ID NO: 2033552 - RNA, 13 nt, Staphylococcus aureus subsp. aureus Mu50
uuaauuuuucauu

SEQ ID NO: 2033553 - RNA, 22 nt, Staphylococcus aureus subsp. aureus Mu50
uuaaugauugacgauuuaauua

SEQ ID NO: 2033554 - RNA, 17 nt, Staphylococcus aureus subsp. aureus Mu50
uuacaaaugaagguguu

SEQ ID NO: 2033555 - RNA, 17 nt, Staphylococcus aureus subsp. aureus Mu50
uuaauggucuaauauca

SEQ ID NO: 2033556 - RNA, 20 nt, Staphylococcus aureus subsp. aureus Mu50
uuaauggucuaauaucaauu

SEQ ID NO: 2033557 - RNA, 18 nt, Staphylococcus aureus subsp. aureus Mu50
uuaauguacuucaauuua

SEQ ID NO: 2033558 - RNA, 14 nt, Staphylococcus aureus subsp. aureus Mu50
uuaauguauaaauu

SEQ ID NO: 2033559 - RNA, 15 nt, Staphylococcus aureus subsp. aureus Mu50
uuaauguaucacauu

SEQ ID NO: 2033560 - RNA, 19 nt, Staphylococcus aureus subsp. aureus Mu50
uuaauuuuucuaaaugauu

SEQ ID NO: 2033561 - RNA, 20 nt, Staphylococcus aureus subsp. aureus Mu50
uuaacgucaacagcauaaau

SEQ ID NO: 2033562 - RNA, 22 nt, Staphylococcus aureus subsp. aureus Mu50
uuaacuaguguaaugucucuuu

SEQ ID NO: 2033563 - RNA, 19 nt, Staphylococcus aureus subsp. aureus Mu50
uuaacuguacgauucaauu

SEQ ID NO: 2033564 - RNA, 15 nt, Staphylococcus aureus subsp. aureus Mu50
uuaacugcaaacuug

SEQ ID NO: 2033565 - RNA, 14 nt, Staphylococcus aureus subsp. aureus Mu50
uuaacauuucugau

SEQ ID NO: 2033566 - RNA, 13 nt, Staphylococcus aureus subsp. aureus Mu50
uuaacauuuugaa

SEQ ID NO: 2033567 - RNA, 20 nt, Staphylococcus aureus subsp. aureus Mu50
uuaaccacuccuuaaacaaa

SEQ ID NO: 2033568 - RNA, 18 nt, Staphylococcus aureus subsp. aureus Mu50
uuaagauguauaugaauu

SEQ ID NO: 2033569 - RNA, 17 nt, Staphylococcus aureus subsp. aureus Mu50
uuaaucaauuuaauuaa

SEQ ID NO: 2033570 - RNA, 20 nt, Staphylococcus aureus subsp. aureus Mu50
uuaacuuucuuuuguuuuua

SEQ ID NO: 2033571 - RNA, 15 nt, Staphylococcus aureus subsp. aureus Mu50
uuaacuugaaauguu

SEQ ID NO: 2033572 - RNA, 14 nt, Staphylococcus aureus subsp. aureus Mu50
uguugcuuugguaa

SEQ ID NO: 2033573 - RNA, 23 nt, Staphylococcus aureus subsp. aureus Mu50
uguuggaucuuucaaaguauauu

SEQ ID NO: 2033574 - RNA, 20 nt, Staphylococcus aureus subsp. aureus Mu50
uguuggaucggcauuguaaa

SEQ ID NO: 2033575 - RNA, 16 nt, Staphylococcus aureus subsp. aureus Mu50
uguuugacucuuuucu

SEQ ID NO: 2033576 - RNA, 16 nt, Staphylococcus aureus subsp. aureus Mu50
uguuucguauguuucu

SEQ ID NO: 2033577 - RNA, 20 nt, Staphylococcus aureus subsp. aureus Mu50
uguuucuuuuauuuucauaa

SEQ ID NO: 2033578 - RNA, 18 nt, Staphylococcus aureus subsp. aureus Mu50
uguuucaggauaaugaaa

SEQ ID NO: 2033579 - RNA, 22 nt, Staphylococcus aureus subsp. aureus Mu50
uguuuccuacacuguuuuauaa

SEQ ID NO: 2033580 - RNA, 15 nt, Staphylococcus aureus subsp. aureus Mu50
uguuggcuuuuuuaa

SEQ ID NO: 2033581 - RNA, 15 nt, Staphylococcus aureus subsp. aureus Mu50
uguuuauuacauaau

SEQ ID NO: 2033582 - RNA, 20 nt, Staphylococcus aureus subsp. aureus Mu50
uguuuauuaggauucaauaa

SEQ ID NO: 2033583 - RNA, 15 nt, Staphylococcus aureus subsp. aureus Mu50
uguuucaaaauaauu

SEQ ID NO: 2033584 - RNA, 19 nt, Staphylococcus aureus subsp. aureus Mu50
uguuuaucuccuaaaggua

SEQ ID NO: 2033585 - RNA, 16 nt, Staphylococcus aureus subsp. aureus Mu50
uguugguauuuuuuua

SEQ ID NO: 2033586 - RNA, 20 nt, Staphylococcus aureus subsp. aureus Mu50
uuaacaaugcgauuaaacuc

SEQ ID NO: 2033587 - RNA, 12 nt, Staphylococcus aureus subsp. aureus Mu50
uuaacaacuuua

SEQ ID NO: 2033588 - RNA, 15 nt, Staphylococcus aureus subsp. aureus Mu50
uuaaauuuaacucaa

SEQ ID NO: 2033589 - RNA, 19 nt, Staphylococcus aureus subsp. aureus Mu50
uuaaauuuaacucaacuua

SEQ ID NO: 2033590 - RNA, 20 nt, Staphylococcus aureus subsp. aureus Mu50
uuaacaaaauauacuaaauu

SEQ ID NO: 2033591 - RNA, 15 nt, Staphylococcus aureus subsp. aureus Mu50
uuaaauugaaauguu

SEQ ID NO: 2033592 - RNA, 23 nt, Staphylococcus aureus subsp. aureus Mu50
uuaacauccugcuuauuaauugu

SEQ ID NO: 2033593 - RNA, 13 nt, Staphylococcus aureus subsp. aureus Mu50
uuaacaucugaau

SEQ ID NO: 2033594 - RNA, 18 nt, Staphylococcus aureus subsp. aureus Mu50
uuaacaauuuuaucugaa

SEQ ID NO: 2033595 - RNA, 15 nt, Staphylococcus aureus subsp. aureus Mu50
uguuugagauauauu

SEQ ID NO: 2033596 - RNA, 16 nt, Staphylococcus aureus subsp. aureus Mu50
uguuugagauauauua

SEQ ID NO: 2033597 - RNA, 12 nt, Staphylococcus aureus subsp. aureus Mu50
uguuugauauug

SEQ ID NO: 2033598 - RNA, 20 nt, Staphylococcus aureus subsp. aureus Mu50
uguuugcccugcuguuuuau

SEQ ID NO: 2033599 - RNA, 17 nt, Staphylococcus aureus subsp. aureus Mu50
uguuuuaauaauaucuu

SEQ ID NO: 2033600 - RNA, 21 nt, Staphylococcus aureus subsp. aureus Mu50
uguuuuaauaauaucuuuugc

SEQ ID NO: 2033601 - RNA, 17 nt, Staphylococcus aureus subsp. aureus Mu50
uguuuguuuuuguggaa

SEQ ID NO: 2033602 - RNA, 14 nt, Staphylococcus aureus subsp. aureus Mu50
uguuugcuuuuugu

SEQ ID NO: 2033603 - RNA, 16 nt, Staphylococcus aureus subsp. aureus Mu50
uuaaauuacaacuuuu

SEQ ID NO: 2033604 - RNA, 12 nt, Staphylococcus aureus subsp. aureus Mu50
uuaaauuauugu

SEQ ID NO: 2033605 - RNA, 21 nt, Staphylococcus aureus subsp. aureus Mu50
uuaaauucaucuuaucaagaa

SEQ ID NO: 2033606 - RNA, 21 nt, Staphylococcus aureus subsp. aureus Mu50
uguuuucagccacugucaugu

SEQ ID NO: 2033607 - RNA, 20 nt, Staphylococcus aureus subsp. aureus Mu50
uguuuuauaaaugaauuauu

SEQ ID NO: 2033608 - RNA, 12 nt, Staphylococcus aureus subsp. aureus Mu50
uguuuuaauuuc

SEQ ID NO: 2033609 - RNA, 20 nt, Staphylococcus aureus subsp. aureus Mu50
uuaucacuuauuauuuugua

SEQ ID NO: 2033610 - RNA, 14 nt, Staphylococcus aureus subsp. aureus Mu50
uuaucagguuaaca

SEQ ID NO: 2033611 - RNA, 15 nt, Staphylococcus aureus subsp. aureus Mu50
uuaucauaugaacaa

SEQ ID NO: 2033612 - RNA, 18 nt, Staphylococcus aureus subsp. aureus Mu50
uuauaucuuuuauacaug

SEQ ID NO: 2033613 - RNA, 15 nt, Staphylococcus aureus subsp. aureus Mu50
uuauauugcaaaaau

SEQ ID NO: 2033614 - RNA, 18 nt, Staphylococcus aureus subsp. aureus Mu50
uuauauugcaaaaauaau

SEQ ID NO: 2033615 - RNA, 19 nt, Staphylococcus aureus subsp. aureus Mu50
uuauauugcgaaaaauaau

SEQ ID NO: 2033616 - RNA, 15 nt, Staphylococcus aureus subsp. aureus Mu50
uuaucuguaauuaau

SEQ ID NO: 2033617 - RNA, 22 nt, Staphylococcus aureus subsp. aureus Mu50
uuaucuaucgguaauuuuugua

SEQ ID NO: 2033618 - RNA, 22 nt, Staphylococcus aureus subsp. aureus Mu50
uuaugaauugaguauuaaauuu

SEQ ID NO: 2033619 - RNA, 18 nt, Staphylococcus aureus subsp. aureus Mu50
uuaugagcuucuuuaaau

SEQ ID NO: 2033620 - RNA, 14 nt, Staphylococcus aureus subsp. aureus Mu50
uuaugaggcugagu

SEQ ID NO: 2033621 - RNA, 17 nt, Staphylococcus aureus subsp. aureus Mu50
uuaucuuuagagacuua

SEQ ID NO: 2033622 - RNA, 12 nt, Staphylococcus aureus subsp. aureus Mu50
uuaucuuuagua

SEQ ID NO: 2033623 - RNA, 14 nt, Staphylococcus aureus subsp. aureus Mu50
uuaucuuuuaaaau

SEQ ID NO: 2033624 - RNA, 21 nt, Staphylococcus aureus subsp. aureus Mu50
uuaucuuuuguuguuuccuua

SEQ ID NO: 2033625 - RNA, 19 nt, Staphylococcus aureus subsp. aureus Mu50
uuauagcauuucuuuauua

SEQ ID NO: 2033626 - RNA, 16 nt, Staphylococcus aureus subsp. aureus Mu50
uuagucuuuuuaagua

SEQ ID NO: 2033627 - RNA, 13 nt, Staphylococcus aureus subsp. aureus Mu50
uuagucaauguau

SEQ ID NO: 2033628 - RNA, 13 nt, Staphylococcus aureus subsp. aureus Mu50
uuauauaauucuu

SEQ ID NO: 2033629 - RNA, 23 nt, Staphylococcus aureus subsp. aureus Mu50
uuauauauaaaaucauuaauaau

SEQ ID NO: 2033630 - RNA, 23 nt, Staphylococcus aureus subsp. aureus Mu50
uuauaugcuguuggcaaaacaau

SEQ ID NO: 2033631 - RNA, 17 nt, Staphylococcus aureus subsp. aureus Mu50
uuauauggguguuggaa

SEQ ID NO: 2033632 - RNA, 19 nt, Staphylococcus aureus subsp. aureus Mu50
uuauauaaacaaaaaucua

SEQ ID NO: 2033633 - RNA, 23 nt, Staphylococcus aureus subsp. aureus Mu50
uuauauaagucauacgcaaugau

SEQ ID NO: 2033634 - RNA, 15 nt, Staphylococcus aureus subsp. aureus Mu50
uuaguaauaacaucu

SEQ ID NO: 2033635 - RNA, 19 nt, Staphylococcus aureus subsp. aureus Mu50
uuaggucuacgaucaaaau

SEQ ID NO: 2033636 - RNA, 16 nt, Staphylococcus aureus subsp. aureus Mu50
uuagguuauauuuaaa

SEQ ID NO: 2033637 - RNA, 17 nt, Staphylococcus aureus subsp. aureus Mu50
uuagggaaauguagauu

SEQ ID NO: 2033638 - RNA, 21 nt, Staphylococcus aureus subsp. aureus Mu50
uuaggcggccaguccauuauu

SEQ ID NO: 2033639 - RNA, 23 nt, Staphylococcus aureus subsp. aureus Mu50
uuaggaagcaagccguugguugu

SEQ ID NO: 2033640 - RNA, 14 nt, Staphylococcus aureus subsp. aureus Mu50
uuagcuuguuguuu

SEQ ID NO: 2033641 - RNA, 20 nt, Staphylococcus aureus subsp. aureus Mu50
uuacuucuaauaguaaugau

SEQ ID NO: 2033642 - RNA, 12 nt, Staphylococcus aureus subsp. aureus Mu50
uuacuuaaucug

SEQ ID NO: 2033643 - RNA, 21 nt, Staphylococcus aureus subsp. aureus Mu50
uuacugcuguuuuuuauagua

SEQ ID NO: 2033644 - RNA, 22 nt, Staphylococcus aureus subsp. aureus Mu50
uuacuuuucuaaacaacuucug

SEQ ID NO: 2033645 - RNA, 17 nt, Staphylococcus aureus subsp. aureus Mu50
uuacuugcacaccagug

SEQ ID NO: 2033646 - RNA, 14 nt, Staphylococcus aureus subsp. aureus Mu50
uuacuuuaagauua

SEQ ID NO: 2033647 - RNA, 13 nt, Staphylococcus aureus subsp. aureus Mu50
uuacuuuaauuua

SEQ ID NO: 2033648 - RNA, 23 nt, Staphylococcus aureus subsp. aureus Mu50
uuagaaauucucaguguuggggg

SEQ ID NO: 2033649 - RNA, 15 nt, Staphylococcus aureus subsp. aureus Mu50
uuagaauaaacuuua

SEQ ID NO: 2033650 - RNA, 17 nt, Staphylococcus aureus subsp. aureus Mu50
uuagaauaagaaauaaa

SEQ ID NO: 2033651 - RNA, 22 nt, Staphylococcus aureus subsp. aureus Mu50
uuagaaucaaccguuuuauugu

SEQ ID NO: 2033652 - RNA, 19 nt, Staphylococcus aureus subsp. aureus Mu50
uuagaauuaguacuugaaa

SEQ ID NO: 2033653 - RNA, 20 nt, Staphylococcus aureus subsp. aureus Mu50
uuagagaagaauucucuauu

SEQ ID NO: 2033654 - RNA, 17 nt, Staphylococcus aureus subsp. aureus Mu50
uuagacaaauguucuau

SEQ ID NO: 2033655 - RNA, 22 nt, Staphylococcus aureus subsp. aureus Mu50
uuagagccuacucauauucauu

SEQ ID NO: 2033656 - RNA, 19 nt, Staphylococcus aureus subsp. aureus Mu50
uuacccacuuauaaacaaa

SEQ ID NO: 2033657 - RNA, 21 nt, Staphylococcus aureus subsp. aureus Mu50
uuacaggagcgagccauuauu

SEQ ID NO: 2033658 - RNA, 20 nt, Staphylococcus aureus subsp. aureus Mu50
uuacaucuauauuuguuugu

SEQ ID NO: 2033659 - RNA, 15 nt, Staphylococcus aureus subsp. aureus Mu50
uuaccaaugaauaaa

SEQ ID NO: 2033660 - RNA, 17 nt, Staphylococcus aureus subsp. aureus Mu50
uuaccaaugaauaaauu

SEQ ID NO: 2033661 - RNA, 14 nt, Staphylococcus aureus subsp. aureus Mu50
uuacauuuuauguc

SEQ ID NO: 2033662 - RNA, 14 nt, Staphylococcus aureus subsp. aureus Mu50
uuacauuuucaaaa

SEQ ID NO: 2033663 - RNA, 19 nt, Staphylococcus aureus subsp. aureus Mu50
ugguggagaaccuuuuugu

SEQ ID NO: 2033664 - RNA, 19 nt, Staphylococcus aureus subsp. aureus Mu50
ugguggguauauaauuuaa

SEQ ID NO: 2033665 - RNA, 20 nt, Staphylococcus aureus subsp. aureus Mu50
uggguuuuaccauaaauuga

SEQ ID NO: 2033666 - RNA, 19 nt, Staphylococcus aureus subsp. aureus Mu50
ugguaccuuuccaauuugu

SEQ ID NO: 2033667 - RNA, 21 nt, Staphylococcus aureus subsp. aureus Mu50
ugguaacucuucaguacgaac

SEQ ID NO: 2033668 - RNA, 19 nt, Staphylococcus aureus subsp. aureus Mu50
ugguaaguauaauuaaacu

SEQ ID NO: 2033669 - RNA, 21 nt, Staphylococcus aureus subsp. aureus Mu50
ugguuucaucauaucgauuaa

SEQ ID NO: 2033670 - RNA, 14 nt, Staphylococcus aureus subsp. aureus Mu50
ugguuucuuauuaa

SEQ ID NO: 2033671 - RNA, 16 nt, Staphylococcus aureus subsp. aureus Mu50
ugguuguuaauguauu

SEQ ID NO: 2033672 - RNA, 19 nt, Staphylococcus aureus subsp. aureus Mu50
ugguuguuuuccaauaaua

SEQ ID NO: 2033673 - RNA, 19 nt, Staphylococcus aureus subsp. aureus Mu50
uguacgcuucaauuauuuc

SEQ ID NO: 2033674 - RNA, 20 nt, Staphylococcus aureus subsp. aureus Mu50
uguaccaucacuaaaguaaa

SEQ ID NO: 2033675 - RNA, 16 nt, Staphylococcus aureus subsp. aureus Mu50
uguacaugaacaaaua

SEQ ID NO: 2033676 - RNA, 14 nt, Staphylococcus aureus subsp. aureus Mu50
uguaccaauugauu

SEQ ID NO: 2033677 - RNA, 20 nt, Staphylococcus aureus subsp. aureus Mu50
uguaauuagugcaaguaauu

SEQ ID NO: 2033678 - RNA, 14 nt, Staphylococcus aureus subsp. aureus Mu50
uguaauugaugauu

SEQ ID NO: 2033679 - RNA, 15 nt, Staphylococcus aureus subsp. aureus Mu50
uguaauguuggcaaa

SEQ ID NO: 2033680 - RNA, 23 nt, Staphylococcus aureus subsp. aureus Mu50
uguaauuuucacuuucaaugaca

SEQ ID NO: 2033681 - RNA, 16 nt, Staphylococcus aureus subsp. aureus Mu50
uguaauauaacaagua

SEQ ID NO: 2033682 - RNA, 14 nt, Staphylococcus aureus subsp. aureus Mu50
uguaaucccauuuu

SEQ ID NO: 2033683 - RNA, 21 nt, Staphylococcus aureus subsp. aureus Mu50
uguaauacaucuaauaaauau

SEQ ID NO: 2033684 - RNA, 17 nt, Staphylococcus aureus subsp. aureus Mu50
ugucauuugaauccaag

SEQ ID NO: 2033685 - RNA, 14 nt, Staphylococcus aureus subsp. aureus Mu50
ugucaucuaauuac

SEQ ID NO: 2033686 - RNA, 20 nt, Staphylococcus aureus subsp. aureus Mu50
uguccagccauuaaaccuaa

SEQ ID NO: 2033687 - RNA, 22 nt, Staphylococcus aureus subsp. aureus Mu50
uguugaaaaguaauuaaauacu

SEQ ID NO: 2033688 - RNA, 16 nt, Staphylococcus aureus subsp. aureus Mu50
uguugaaaaugacuac

SEQ ID NO: 2033689 - RNA, 22 nt, Staphylococcus aureus subsp. aureus Mu50
uguugaaacgguaucaacauau

SEQ ID NO: 2033690 - RNA, 23 nt, Staphylococcus aureus subsp. aureus Mu50
uguugaaacgguaucaacauauu

SEQ ID NO: 2033691 - RNA, 17 nt, Staphylococcus aureus subsp. aureus Mu50
uguugaagucaauaauu

SEQ ID NO: 2033692 - RNA, 18 nt, Staphylococcus aureus subsp. aureus Mu50
uguugaauaauuaauguu

SEQ ID NO: 2033693 - RNA, 21 nt, Staphylococcus aureus subsp. aureus Mu50
uguucuucccacauacuuuua

SEQ ID NO: 2033694 - RNA, 17 nt, Staphylococcus aureus subsp. aureus Mu50
uguucuuuuuguuguuu

SEQ ID NO: 2033695 - RNA, 15 nt, Staphylococcus aureus subsp. aureus Mu50
uguucugcuuuuucu

SEQ ID NO: 2033696 - RNA, 18 nt, Staphylococcus aureus subsp. aureus Mu50
uguucuaaaauaaaacgu

SEQ ID NO: 2033697 - RNA, 17 nt, Staphylococcus aureus subsp. aureus Mu50
uguucuaaguguuuuau

SEQ ID NO: 2033698 - RNA, 17 nt, Staphylococcus aureus subsp. aureus Mu50
uguucuauagaaaaagc

SEQ ID NO: 2033699 - RNA, 20 nt, Staphylococcus aureus subsp. aureus Mu50
uguugcauuaagugcaauaa

SEQ ID NO: 2033700 - RNA, 16 nt, Staphylococcus aureus subsp. aureus Mu50
uguugcaauaaaauca

SEQ ID NO: 2033701 - RNA, 14 nt, Staphylococcus aureus subsp. aureus Mu50
uguugcaaugauua

SEQ ID NO: 2033702 - RNA, 11 nt, Staphylococcus aureus subsp. aureus Mu50
uguugaugaag

SEQ ID NO: 2033703 - RNA, 22 nt, Staphylococcus aureus subsp. aureus Mu50
uguugauccuggaaucgaaaau

SEQ ID NO: 2033704 - RNA, 13 nt, Staphylococcus aureus subsp. aureus Mu50
uguugauaauagc

SEQ ID NO: 2033705 - RNA, 16 nt, Staphylococcus aureus subsp. aureus Mu50
uguucucucaaugcau

SEQ ID NO: 2033706 - RNA, 19 nt, Staphylococcus aureus subsp. aureus Mu50
uguugaaauuaaauucaaa

SEQ ID NO: 2033707 - RNA, 13 nt, Staphylococcus aureus subsp. aureus Mu50
uguugaauauacu

SEQ ID NO: 2033708 - RNA, 12 nt, Staphylococcus aureus subsp. aureus Mu50
uguugaaucaac

SEQ ID NO: 2033709 - RNA, 22 nt, Staphylococcus aureus subsp. aureus Mu50
uguuaggagagauguauaaaac

SEQ ID NO: 2033710 - RNA, 14 nt, Staphylococcus aureus subsp. aureus Mu50
uguuauauaaauag

SEQ ID NO: 2033711 - RNA, 16 nt, Staphylococcus aureus subsp. aureus Mu50
uguuauauuaaacuua

SEQ ID NO: 2033712 - RNA, 17 nt, Staphylococcus aureus subsp. aureus Mu50
uguuauccaaaacauuu

SEQ ID NO: 2033713 - RNA, 20 nt, Staphylococcus aureus subsp. aureus Mu50
uguuaguuuucuuaaaagag

SEQ ID NO: 2033714 - RNA, 17 nt, Staphylococcus aureus subsp. aureus Mu50
uguuauaaguaaauaau

SEQ ID NO: 2033715 - RNA, 20 nt, Staphylococcus aureus subsp. aureus Mu50
uguuacgagugcacuuguaa

SEQ ID NO: 2033716 - RNA, 23 nt, Staphylococcus aureus subsp. aureus Mu50
uguuacacaucgaucuaaauaua

SEQ ID NO: 2033717 - RNA, 14 nt, Staphylococcus aureus subsp. aureus Mu50
uguuaauuuuuuau

SEQ ID NO: 2033718 - RNA, 22 nt, Staphylococcus aureus subsp. aureus Mu50
uguuaaucaacguauauaaguu

SEQ ID NO: 2033719 - RNA, 16 nt, Staphylococcus aureus subsp. aureus Mu50
uguuacugaugaacau

SEQ ID NO: 2033720 - RNA, 21 nt, Staphylococcus aureus subsp. aureus Mu50
uguuagauaaucucauucuuu

SEQ ID NO: 2033721 - RNA, 14 nt, Staphylococcus aureus subsp. aureus Mu50
uguguuuuaaaauu

SEQ ID NO: 2033722 - RNA, 23 nt, Staphylococcus aureus subsp. aureus Mu50
uguuaaaaaauggauuuggucaa

SEQ ID NO: 2033723 - RNA, 14 nt, Staphylococcus aureus subsp. aureus Mu50
uguuaaaugacgcu

SEQ ID NO: 2033724 - RNA, 16 nt, Staphylococcus aureus subsp. aureus Mu50
uguuaaagauuauuau

SEQ ID NO: 2033725 - RNA, 17 nt, Staphylococcus aureus subsp. aureus Mu50
uguuaacugaauuucgu

SEQ ID NO: 2033726 - RNA, 16 nt, Staphylococcus aureus subsp. aureus Mu50
uguuaaauuaaaucga

SEQ ID NO: 2033727 - RNA, 16 nt, Staphylococcus aureus subsp. aureus Mu50
uguuaauaaccgaaau

SEQ ID NO: 2033728 - RNA, 22 nt, Staphylococcus aureus subsp. aureus Mu50
uguucacauucuugaauaaauu

SEQ ID NO: 2033729 - RNA, 21 nt, Staphylococcus aureus subsp. aureus Mu50
uguuaugaaguauccuuauuu

SEQ ID NO: 2033730 - RNA, 20 nt, Staphylococcus aureus subsp. aureus Mu50
uguucaacuaaauuuucuaa

SEQ ID NO: 2033731 - RNA, 17 nt, Staphylococcus aureus subsp. aureus Mu50
uguucaaucacuauauu

SEQ ID NO: 2033732 - RNA, 18 nt, Staphylococcus aureus subsp. aureus Mu50
uguucaaugauuuuauaa

SEQ ID NO: 2033733 - RNA, 21 nt, Staphylococcus aureus subsp. aureus Mu50
uguucaaaucacaaguuuaca

SEQ ID NO: 2033734 - RNA, 13 nt, Staphylococcus aureus subsp. aureus Mu50
uguuauuaaaccc

SEQ ID NO: 2033735 - RNA, 16 nt, Staphylococcus aureus subsp. aureus Mu50
uguuauuaaccaucau

SEQ ID NO: 2033736 - RNA, 19 nt, Staphylococcus aureus subsp. aureus Mu50
uguuauugcaauaaaauua

SEQ ID NO: 2033737 - RNA, 21 nt, Staphylococcus aureus subsp. aureus Mu50
uguucauacgcucaaucgcau

SEQ ID NO: 2033738 - RNA, 20 nt, Staphylococcus aureus subsp. aureus Mu50
uguucccuucaaaguagaca

SEQ ID NO: 2033739 - RNA, 13 nt, Staphylococcus aureus subsp. aureus Mu50
uguggcucgaaaa

SEQ ID NO: 2033740 - RNA, 19 nt, Staphylococcus aureus subsp. aureus Mu50
uguggcuacuaaucuuuuu

SEQ ID NO: 2033741 - RNA, 16 nt, Staphylococcus aureus subsp. aureus Mu50
ugugcaaguuggggau

SEQ ID NO: 2033742 - RNA, 11 nt, Staphylococcus aureus subsp. aureus Mu50
uguguuggggc

SEQ ID NO: 2033743 - RNA, 15 nt, Staphylococcus aureus subsp. aureus Mu50
uguguacuuaaaaau

SEQ ID NO: 2033744 - RNA, 23 nt, Staphylococcus aureus subsp. aureus Mu50
uguguaucuguaacauaaacaau

SEQ ID NO: 2033745 - RNA, 22 nt, Staphylococcus aureus subsp. aureus Mu50
uguguacguuucaauguaucaa

SEQ ID NO: 2033746 - RNA, 22 nt, Staphylococcus aureus subsp. aureus Mu50
uguguauuugaaagacauuuaa

SEQ ID NO: 2033747 - RNA, 15 nt, Staphylococcus aureus subsp. aureus Mu50
uguguccaucauuug

SEQ ID NO: 2033748 - RNA, 16 nt, Staphylococcus aureus subsp. aureus Mu50
uguguccaucauuugu

SEQ ID NO: 2033749 - RNA, 14 nt, Staphylococcus aureus subsp. aureus Mu50
uguggucuaaccau

SEQ ID NO: 2033750 - RNA, 17 nt, Staphylococcus aureus subsp. aureus Mu50
uguguaaaauaaaucau

SEQ ID NO: 2033751 - RNA, 17 nt, Staphylococcus aureus subsp. aureus Mu50
uguguaaauauaaauau

SEQ ID NO: 2033752 - RNA, 21 nt, Staphylococcus aureus subsp. aureus Mu50
uguguaaauauaaauaugaau

SEQ ID NO: 2033753 - RNA, 23 nt, Staphylococcus aureus subsp. aureus Mu50
ugugaacaucuaguuauuucaua

SEQ ID NO: 2033754 - RNA, 19 nt, Staphylococcus aureus subsp. aureus Mu50
ugugaauuuauuuuguagu

SEQ ID NO: 2033755 - RNA, 19 nt, Staphylococcus aureus subsp. aureus Mu50
ugugacgcugguaauauuu

SEQ ID NO: 2033756 - RNA, 15 nt, Staphylococcus aureus subsp. aureus Mu50
ugugauacuuucuaa

SEQ ID NO: 2033757 - RNA, 13 nt, Staphylococcus aureus subsp. aureus Mu50
ugugcaacuuuaa

SEQ ID NO: 2033758 - RNA, 19 nt, Staphylococcus aureus subsp. aureus Mu50
uggccaaccaccauaugcu

SEQ ID NO: 2033759 - RNA, 16 nt, Staphylococcus aureus subsp. aureus Mu50
uggcacauaaaucaau

SEQ ID NO: 2033760 - RNA, 13 nt, Staphylococcus aureus subsp. aureus Mu50
uggcaauauacuu

SEQ ID NO: 2033761 - RNA, 22 nt, Staphylococcus aureus subsp. aureus Mu50
uggcaaauacaacucccuuuua

SEQ ID NO: 2033762 - RNA, 16 nt, Staphylococcus aureus subsp. aureus Mu50
uggauuuuuuuguacu

SEQ ID NO: 2033763 - RNA, 18 nt, Staphylococcus aureus subsp. aureus Mu50
uggauguguuuuaauaau

SEQ ID NO: 2033764 - RNA, 15 nt, Staphylococcus aureus subsp. aureus Mu50
uggaucuuucaaagu

SEQ ID NO: 2033765 - RNA, 14 nt, Staphylococcus aureus subsp. aureus Mu50
uggaugaauauauu

SEQ ID NO: 2033766 - RNA, 14 nt, Staphylococcus aureus subsp. aureus Mu50
uggauaaaaauuua

SEQ ID NO: 2033767 - RNA, 16 nt, Staphylococcus aureus subsp. aureus Mu50
uggagaaccauuuuau

SEQ ID NO: 2033768 - RNA, 17 nt, Staphylococcus aureus subsp. aureus Mu50
uggagaucuaacaauau

SEQ ID NO: 2033769 - RNA, 16 nt, Staphylococcus aureus subsp. aureus Mu50
uggagcguaaaguuuu

SEQ ID NO: 2033770 - RNA, 13 nt, Staphylococcus aureus subsp. aureus Mu50
uggaacgugcuuu

SEQ ID NO: 2033771 - RNA, 12 nt, Staphylococcus aureus subsp. aureus Mu50
uggaaguguuuu

SEQ ID NO: 2033772 - RNA, 22 nt, Staphylococcus aureus subsp. aureus Mu50
uggaauaccuaauucaauaccu

SEQ ID NO: 2033773 - RNA, 14 nt, Staphylococcus aureus subsp. aureus Mu50
uggaauaccuuuuu

SEQ ID NO: 2033774 - RNA, 19 nt, Staphylococcus aureus subsp. aureus Mu50
uggcucuuuuuauuuauaa

SEQ ID NO: 2033775 - RNA, 15 nt, Staphylococcus aureus subsp. aureus Mu50
ugggaagcgucuuuu

SEQ ID NO: 2033776 - RNA, 21 nt, Staphylococcus aureus subsp. aureus Mu50
ugggacauaaaauuaacuuaa

SEQ ID NO: 2033777 - RNA, 17 nt, Staphylococcus aureus subsp. aureus Mu50
uaaaccguauagucauu

SEQ ID NO: 2033778 - RNA, 15 nt, Staphylococcus aureus subsp. aureus Mu50
uaaaccuacaauaua

SEQ ID NO: 2033779 - RNA, 13 nt, Staphylococcus aureus subsp. aureus Mu50
uaaacguugcacc

SEQ ID NO: 2033780 - RNA, 23 nt, Staphylococcus aureus subsp. aureus Mu50
uaaacucauaccaaaaacauuaa

SEQ ID NO: 2033781 - RNA, 16 nt, Staphylococcus aureus subsp. aureus Mu50
uaaacuuauaacuuua

SEQ ID NO: 2033782 - RNA, 13 nt, Staphylococcus aureus subsp. aureus Mu50
uaaagaaaauuuc

SEQ ID NO: 2033783 - RNA, 15 nt, Staphylococcus aureus subsp. aureus Mu50
uaaagaaacaugauu

SEQ ID NO: 2033784 - RNA, 16 nt, Staphylococcus aureus subsp. aureus Mu50
uaaacuuuucuucaag

SEQ ID NO: 2033785 - RNA, 18 nt, Staphylococcus aureus subsp. aureus Mu50
uaaagauggcugcaucaa

SEQ ID NO: 2033786 - RNA, 23 nt, Staphylococcus aureus subsp. aureus Mu50
uaaaauauaaauuucuucauagu

SEQ ID NO: 2033787 - RNA, 20 nt, Staphylococcus aureus subsp. aureus Mu50
uaaaauaaugauauauuaca

SEQ ID NO: 2033788 - RNA, 22 nt, Staphylococcus aureus subsp. aureus Mu50
uaaaauaaugucuuacuuuuaa

SEQ ID NO: 2033789 - RNA, 14 nt, Staphylococcus aureus subsp. aureus Mu50
uaaaaucaacuuuu

SEQ ID NO: 2033790 - RNA, 18 nt, Staphylococcus aureus subsp. aureus Mu50
uaaaaucucauaauaauu

SEQ ID NO: 2033791 - RNA, 20 nt, Staphylococcus aureus subsp. aureus Mu50
uaaaccaucugugucagcau

SEQ ID NO: 2033792 - RNA, 18 nt, Staphylococcus aureus subsp. aureus Mu50
uaaacauuuauauagauu

SEQ ID NO: 2033793 - RNA, 18 nt, Staphylococcus aureus subsp. aureus Mu50
uaaacauaucuucugaua

SEQ ID NO: 2033794 - RNA, 16 nt, Staphylococcus aureus subsp. aureus Mu50
uaaacauccaauuaug

SEQ ID NO: 2033795 - RNA, 16 nt, Staphylococcus aureus subsp. aureus Mu50
uaaacauugaaaguac

SEQ ID NO: 2033796 - RNA, 22 nt, Staphylococcus aureus subsp. aureus Mu50
uaaacauugcuuaacuuccuuu

SEQ ID NO: 2033797 - RNA, 18 nt, Staphylococcus aureus subsp. aureus Mu50
uaaacauuuagauuucau

SEQ ID NO: 2033798 - RNA, 19 nt, Staphylococcus aureus subsp. aureus Mu50
uaaacauuuagauuucaug

SEQ ID NO: 2033799 - RNA, 16 nt, Staphylococcus aureus subsp. aureus Mu50
guuuaauucguuuuac

SEQ ID NO: 2033800 - RNA, 22 nt, Staphylococcus aureus subsp. aureus Mu50
guuucaaacaaagcucaauaaa

SEQ ID NO: 2033801 - RNA, 14 nt, Staphylococcus aureus subsp. aureus Mu50
guuuaauuaaaaua

SEQ ID NO: 2033802 - RNA, 12 nt, Staphylococcus aureus subsp. aureus Mu50
guuucaaugccu

SEQ ID NO: 2033803 - RNA, 20 nt, Staphylococcus aureus subsp. aureus Mu50
uaaaaacuuauuugccauau

SEQ ID NO: 2033804 - RNA, 23 nt, Staphylococcus aureus subsp. aureus Mu50
uaaaaagaagcucccauuaauga

SEQ ID NO: 2033805 - RNA, 14 nt, Staphylococcus aureus subsp. aureus Mu50
uaaaaauauugaau

SEQ ID NO: 2033806 - RNA, 20 nt, Staphylococcus aureus subsp. aureus Mu50
uaaaaaguauacuaaacuuu

SEQ ID NO: 2033807 - RNA, 22 nt, Staphylococcus aureus subsp. aureus Mu50
uaaaaaugcucaaguugauuau

SEQ ID NO: 2033808 - RNA, 12 nt, Staphylococcus aureus subsp. aureus Mu50
uaaaaauguaaa

SEQ ID NO: 2033809 - RNA, 16 nt, Staphylococcus aureus subsp. aureus Mu50
uaaaaauguaaauaaa

SEQ ID NO: 2033810 - RNA, 18 nt, Staphylococcus aureus subsp. aureus Mu50
uaaaaaucuuaugauguc

SEQ ID NO: 2033811 - RNA, 15 nt, Staphylococcus aureus subsp. aureus Mu50
uaaaaagaucauuaa

SEQ ID NO: 2033812 - RNA, 20 nt, Staphylococcus aureus subsp. aureus Mu50
uaaaaaucuuaugaugucau

SEQ ID NO: 2033813 - RNA, 22 nt, Staphylococcus aureus subsp. aureus Mu50
uaaaaggaugugacaaauacuu

SEQ ID NO: 2033814 - RNA, 19 nt, Staphylococcus aureus subsp. aureus Mu50
uaaaaggggaaaucauuug

SEQ ID NO: 2033815 - RNA, 18 nt, Staphylococcus aureus subsp. aureus Mu50
uaaaaguaagcaccuguu

SEQ ID NO: 2033816 - RNA, 21 nt, Staphylococcus aureus subsp. aureus Mu50
uaaaaguacuaacccaacgau

SEQ ID NO: 2033817 - RNA, 16 nt, Staphylococcus aureus subsp. aureus Mu50
uaaaacagaauuucau

SEQ ID NO: 2033818 - RNA, 19 nt, Staphylococcus aureus subsp. aureus Mu50
uaaaauaacaacgauaauu

SEQ ID NO: 2033819 - RNA, 12 nt, Staphylococcus aureus subsp. aureus Mu50
uaaaauaaaaaa

SEQ ID NO: 2033820 - RNA, 15 nt, Staphylococcus aureus subsp. aureus Mu50
uaaaauaaaaaaugc

SEQ ID NO: 2033821 - RNA, 15 nt, Staphylococcus aureus subsp. aureus Mu50
uaaaguuuuguucaa

SEQ ID NO: 2033822 - RNA, 21 nt, Staphylococcus aureus subsp. aureus Mu50
uaaagucuguauauggcgaua

SEQ ID NO: 2033823 - RNA, 19 nt, Staphylococcus aureus subsp. aureus Mu50
uaaauacgccaaauaucag

SEQ ID NO: 2033824 - RNA, 15 nt, Staphylococcus aureus subsp. aureus Mu50
uaaauaaaauuguug

SEQ ID NO: 2033825 - RNA, 16 nt, Staphylococcus aureus subsp. aureus Mu50
uaaauacaauuucuuc

SEQ ID NO: 2033826 - RNA, 22 nt, Staphylococcus aureus subsp. aureus Mu50
uaaauaagcaaucauaauacuu

SEQ ID NO: 2033827 - RNA, 19 nt, Staphylococcus aureus subsp. aureus Mu50
uaaauaaucgaaaauuuca

SEQ ID NO: 2033828 - RNA, 19 nt, Staphylococcus aureus subsp. aureus Mu50
uaaauacaaaaauauagcu

SEQ ID NO: 2033829 - RNA, 16 nt, Staphylococcus aureus subsp. aureus Mu50
uaaaucugauucauua

SEQ ID NO: 2033830 - RNA, 19 nt, Staphylococcus aureus subsp. aureus Mu50
uaaaucgaauugauggaaa

SEQ ID NO: 2033831 - RNA, 19 nt, Staphylococcus aureus subsp. aureus Mu50
uaaauagagaacagcagua

SEQ ID NO: 2033832 - RNA, 16 nt, Staphylococcus aureus subsp. aureus Mu50
uaaauaguauagcgca

SEQ ID NO: 2033833 - RNA, 21 nt, Staphylococcus aureus subsp. aureus Mu50
uaaauagugcuuuuucaaaau

SEQ ID NO: 2033834 - RNA, 16 nt, Staphylococcus aureus subsp. aureus Mu50
uaaauccgcuuguuca

SEQ ID NO: 2033835 - RNA, 20 nt, Staphylococcus aureus subsp. aureus Mu50
uaaaugcccaccauguacau

SEQ ID NO: 2033836 - RNA, 17 nt, Staphylococcus aureus subsp. aureus Mu50
uaaaugcaauacauuaa

SEQ ID NO: 2033837 - RNA, 17 nt, Staphylococcus aureus subsp. aureus Mu50
uaaaucuucuaguaauu

SEQ ID NO: 2033838 - RNA, 23 nt, Staphylococcus aureus subsp. aureus Mu50
uaaaucuuuuagcuuuuguaaag

SEQ ID NO: 2033839 - RNA, 17 nt, Staphylococcus aureus subsp. aureus Mu50
uaaauuuguguucaaau

SEQ ID NO: 2033840 - RNA, 14 nt, Staphylococcus aureus subsp. aureus Mu50
uaaaugcuauauuu

SEQ ID NO: 2033841 - RNA, 19 nt, Staphylococcus aureus subsp. aureus Mu50
uaacaauagugacuuuuau

SEQ ID NO: 2033842 - RNA, 18 nt, Staphylococcus aureus subsp. aureus Mu50
uaacaaucaguaauaaug

SEQ ID NO: 2033843 - RNA, 17 nt, Staphylococcus aureus subsp. aureus Mu50
uaacaacuuuaauuuuu

SEQ ID NO: 2033844 - RNA, 14 nt, Staphylococcus aureus subsp. aureus Mu50
uaacaagaaguaau

SEQ ID NO: 2033845 - RNA, 13 nt, Staphylococcus aureus subsp. aureus Mu50
uaacaagcuuuuc

SEQ ID NO: 2033846 - RNA, 18 nt, Staphylococcus aureus subsp. aureus Mu50
uaacaaggccugcaucac

SEQ ID NO: 2033847 - RNA, 17 nt, Staphylococcus aureus subsp. aureus Mu50
uaacaaaauuaagaaga

SEQ ID NO: 2033848 - RNA, 14 nt, Staphylococcus aureus subsp. aureus Mu50
uaacaaauaguuca

SEQ ID NO: 2033849 - RNA, 14 nt, Staphylococcus aureus subsp. aureus Mu50
uaacaaauuagaau

SEQ ID NO: 2033850 - RNA, 19 nt, Staphylococcus aureus subsp. aureus Mu50
uaaauuuuaucuaaacauu

SEQ ID NO: 2033851 - RNA, 21 nt, Staphylococcus aureus subsp. aureus Mu50
uaaauuuugcgaaaauaucau

SEQ ID NO: 2033852 - RNA, 18 nt, Staphylococcus aureus subsp. aureus Mu50
uaaauuuuuaguuaaagu

SEQ ID NO: 2033853 - RNA, 13 nt, Staphylococcus aureus subsp. aureus Mu50
uaacccacauuaa

SEQ ID NO: 2033854 - RNA, 16 nt, Staphylococcus aureus subsp. aureus Mu50
uaacaccaauugaaua

SEQ ID NO: 2033855 - RNA, 20 nt, Staphylococcus aureus subsp. aureus Mu50
uaacauuugcuaguagaguu

SEQ ID NO: 2033856 - RNA, 22 nt, Staphylococcus aureus subsp. aureus Mu50
uaacaauuuagcaaauauuucu

SEQ ID NO: 2033857 - RNA, 21 nt, Staphylococcus aureus subsp. aureus Mu50
uaacaauuacgacaagaauua

SEQ ID NO: 2033858 - RNA, 14 nt, Staphylococcus aureus subsp. aureus Mu50
uaaccaaucaucgc

SEQ ID NO: 2033859 - RNA, 14 nt, Staphylococcus aureus subsp. aureus Mu50
uaacauuugucaua

SEQ ID NO: 2033860 - RNA, 23 nt, Staphylococcus aureus subsp. aureus Mu50
uaacuagugccucuuuuauuauu

SEQ ID NO: 2033861 - RNA, 18 nt, Staphylococcus aureus subsp. aureus Mu50
uaacuauguuacuuauau

SEQ ID NO: 2033862 - RNA, 19 nt, Staphylococcus aureus subsp. aureus Mu50
uaaccuuuaaaacaucauu

SEQ ID NO: 2033863 - RNA, 14 nt, Staphylococcus aureus subsp. aureus Mu50
uaacccacauuaaa

SEQ ID NO: 2033864 - RNA, 15 nt, Staphylococcus aureus subsp. aureus Mu50
uaacgcaaugucuug

SEQ ID NO: 2033865 - RNA, 19 nt, Staphylococcus aureus subsp. aureus Mu50
uaauuaagaaaaucauuca

SEQ ID NO: 2033866 - RNA, 17 nt, Staphylococcus aureus subsp. aureus Mu50
uaauuaauaagcauuaa

SEQ ID NO: 2033867 - RNA, 15 nt, Staphylococcus aureus subsp. aureus Mu50
uaauuaauaauuuaa

SEQ ID NO: 2033868 - RNA, 20 nt, Staphylococcus aureus subsp. aureus Mu50
uaauuaaaauacaaauuaca

SEQ ID NO: 2033869 - RNA, 12 nt, Staphylococcus aureus subsp. aureus Mu50
uaauuaacacau

SEQ ID NO: 2033870 - RNA, 19 nt, Staphylococcus aureus subsp. aureus Mu50
uaaugcacugcuaauauua

SEQ ID NO: 2033871 - RNA, 18 nt, Staphylococcus aureus subsp. aureus Mu50
uaauguuugcuuuuugua

SEQ ID NO: 2033872 - RNA, 16 nt, Staphylococcus aureus subsp. aureus Mu50
uaauguuuuuacaaau

SEQ ID NO: 2033873 - RNA, 23 nt, Staphylococcus aureus subsp. aureus Mu50
uaauuaaaagugcaaguccaaau

SEQ ID NO: 2033874 - RNA, 19 nt, Staphylococcus aureus subsp. aureus Mu50
uaauguuuccauuuauuaa

SEQ ID NO: 2033875 - RNA, 23 nt, Staphylococcus aureus subsp. aureus Mu50
uaauguuucuucaauugucucaa

SEQ ID NO: 2033876 - RNA, 13 nt, Staphylococcus aureus subsp. aureus Mu50
uaauguuccauau

SEQ ID NO: 2033877 - RNA, 18 nt, Staphylococcus aureus subsp. aureus Mu50
uaauguuccauauaaccu

SEQ ID NO: 2033878 - RNA, 18 nt, Staphylococcus aureus subsp. aureus Mu50
uaaugaugugaauuggau

SEQ ID NO: 2033879 - RNA, 12 nt, Staphylococcus aureus subsp. aureus Mu50
uaaugauuaacu

SEQ ID NO: 2033880 - RNA, 17 nt, Staphylococcus aureus subsp. aureus Mu50
uaaugcaccugugauaa

SEQ ID NO: 2033881 - RNA, 18 nt, Staphylococcus aureus subsp. aureus Mu50
uaaugcaccugugauaac

SEQ ID NO: 2033882 - RNA, 19 nt, Staphylococcus aureus subsp. aureus Mu50
uaaugcaacuugaucauua

SEQ ID NO: 2033883 - RNA, 21 nt, Staphylococcus aureus subsp. aureus Mu50
uaaugccaccguggaauuuac

SEQ ID NO: 2033884 - RNA, 23 nt, Staphylococcus aureus subsp. aureus Mu50
uaaugccaccguggaauuuacca

SEQ ID NO: 2033885 - RNA, 19 nt, Staphylococcus aureus subsp. aureus Mu50
uaaugucgcacuauaaaau

SEQ ID NO: 2033886 - RNA, 18 nt, Staphylococcus aureus subsp. aureus Mu50
uaaugugcaaguugggga

SEQ ID NO: 2033887 - RNA, 14 nt, Staphylococcus aureus subsp. aureus Mu50
uaauguuaaaauaa

SEQ ID NO: 2033888 - RNA, 15 nt, Staphylococcus aureus subsp. aureus Mu50
uaauguauaaaaagu

SEQ ID NO: 2033889 - RNA, 22 nt, Staphylococcus aureus subsp. aureus Mu50
uaauguauaaaacagaauuuca

SEQ ID NO: 2033890 - RNA, 20 nt, Staphylococcus aureus subsp. aureus Mu50
uaauucguuuugcuaaccau

SEQ ID NO: 2033891 - RNA, 16 nt, Staphylococcus aureus subsp. aureus Mu50
uaauucugguuuaaug

SEQ ID NO: 2033892 - RNA, 13 nt, Staphylococcus aureus subsp. aureus Mu50
uaauucuuaaucg

SEQ ID NO: 2033893 - RNA, 14 nt, Staphylococcus aureus subsp. aureus Mu50
uaauugaaaugaua

SEQ ID NO: 2033894 - RNA, 17 nt, Staphylococcus aureus subsp. aureus Mu50
uaauucuucaucaauaa

SEQ ID NO: 2033895 - RNA, 19 nt, Staphylococcus aureus subsp. aureus Mu50
uaauucuucaucuucuuca

SEQ ID NO: 2033896 - RNA, 13 nt, Staphylococcus aureus subsp. aureus Mu50
uaauugaaugaaa

SEQ ID NO: 2033897 - RNA, 17 nt, Staphylococcus aureus subsp. aureus Mu50
uaauuucuucuucugua

SEQ ID NO: 2033898 - RNA, 12 nt, Staphylococcus aureus subsp. aureus Mu50
uaauuauauuaa

SEQ ID NO: 2033899 - RNA, 13 nt, Staphylococcus aureus subsp. aureus Mu50
uaauuauuauaau

SEQ ID NO: 2033900 - RNA, 14 nt, Staphylococcus aureus subsp. aureus Mu50
uaauuaucauauaa

SEQ ID NO: 2033901 - RNA, 17 nt, Staphylococcus aureus subsp. aureus Mu50
uaauuaucuuaagucau

SEQ ID NO: 2033902 - RNA, 21 nt, Staphylococcus aureus subsp. aureus Mu50
uaauuccugauacaaugauua

SEQ ID NO: 2033903 - RNA, 15 nt, Staphylococcus aureus subsp. aureus Mu50
uaauucagaugaaua

SEQ ID NO: 2033904 - RNA, 19 nt, Staphylococcus aureus subsp. aureus Mu50
uaauuccaguauuaacugu

SEQ ID NO: 2033905 - RNA, 21 nt, Staphylococcus aureus subsp. aureus Mu50
uaauuauuuuucucaacaguu

SEQ ID NO: 2033906 - RNA, 16 nt, Staphylococcus aureus subsp. aureus Mu50
uacagccauugacaca

SEQ ID NO: 2033907 - RNA, 21 nt, Staphylococcus aureus subsp. aureus Mu50
uacagauuccugcaaaauguu

SEQ ID NO: 2033908 - RNA, 13 nt, Staphylococcus aureus subsp. aureus Mu50
uacagaugaugcu

SEQ ID NO: 2033909 - RNA, 16 nt, Staphylococcus aureus subsp. aureus Mu50
uacagauuuuaaaaau

SEQ ID NO: 2033910 - RNA, 15 nt, Staphylococcus aureus subsp. aureus Mu50
uacaccacuuaggau

SEQ ID NO: 2033911 - RNA, 22 nt, Staphylococcus aureus subsp. aureus Mu50
uacagauaggaaacuuaaauau

SEQ ID NO: 2033912 - RNA, 18 nt, Staphylococcus aureus subsp. aureus Mu50
uacagaucucaauccaau

SEQ ID NO: 2033913 - RNA, 17 nt, Staphylococcus aureus subsp. aureus Mu50
uacagagaaucaauuau

SEQ ID NO: 2033914 - RNA, 17 nt, Staphylococcus aureus subsp. aureus Mu50
uacagauaagaauauuu

SEQ ID NO: 2033915 - RNA, 13 nt, Staphylococcus aureus subsp. aureus Mu50
uacagauaauuau

SEQ ID NO: 2033916 - RNA, 18 nt, Staphylococcus aureus subsp. aureus Mu50
uacaauauucaauaauuc

SEQ ID NO: 2033917 - RNA, 18 nt, Staphylococcus aureus subsp. aureus Mu50
uacaaugcgguauugcau

SEQ ID NO: 2033918 - RNA, 15 nt, Staphylococcus aureus subsp. aureus Mu50
uaauuuuucaaaagc

SEQ ID NO: 2033919 - RNA, 19 nt, Staphylococcus aureus subsp. aureus Mu50
uacacaucgaucuaaauau

SEQ ID NO: 2033920 - RNA, 24 nt, Staphylococcus aureus subsp. aureus Mu50
uacacaucgaucuaaauauauuag

SEQ ID NO: 2033921 - RNA, 20 nt, Staphylococcus aureus subsp. aureus Mu50
uacacacuaaggaaaauuau

SEQ ID NO: 2033922 - RNA, 21 nt, Staphylococcus aureus subsp. aureus Mu50
uacacaaugcccuuaaagcac

SEQ ID NO: 2033923 - RNA, 14 nt, Staphylococcus aureus subsp. aureus Mu50
uaauuuuuuauuaa

SEQ ID NO: 2033924 - RNA, 23 nt, Staphylococcus aureus subsp. aureus Mu50
uaauuuuuuauuuuuuucacuaa

SEQ ID NO: 2033925 - RNA, 18 nt, Staphylococcus aureus subsp. aureus Mu50
uaauuuuuugacacgucg

SEQ ID NO: 2033926 - RNA, 20 nt, Staphylococcus aureus subsp. aureus Mu50
uaauuuuggauuuuuuugua

SEQ ID NO: 2033927 - RNA, 13 nt, Staphylococcus aureus subsp. aureus Mu50
uaauuuuguuuca

SEQ ID NO: 2033928 - RNA, 15 nt, Staphylococcus aureus subsp. aureus Mu50
uaauuuuguuuugcu

SEQ ID NO: 2033929 - RNA, 14 nt, Staphylococcus aureus subsp. aureus Mu50
uaauuuuuaaucuu

SEQ ID NO: 2033930 - RNA, 21 nt, Staphylococcus aureus subsp. aureus Mu50
uaauuuuacguuuauuuccac

SEQ ID NO: 2033931 - RNA, 19 nt, Staphylococcus aureus subsp. aureus Mu50
uaauuuucacuuucaauga

SEQ ID NO: 2033932 - RNA, 20 nt, Staphylococcus aureus subsp. aureus Mu50
uaauuuuaucuuauuauuaa

SEQ ID NO: 2033933 - RNA, 22 nt, Staphylococcus aureus subsp. aureus Mu50
uaauuuuauuuaauuccauuaa

SEQ ID NO: 2033934 - RNA, 13 nt, Staphylococcus aureus subsp. aureus Mu50
uaauuuucacuuu

SEQ ID NO: 2033935 - RNA, 20 nt, Staphylococcus aureus subsp. aureus Mu50
uaauuuguuuuaaauacuug

SEQ ID NO: 2033936 - RNA, 19 nt, Staphylococcus aureus subsp. aureus Mu50
uaauuugaauuaguugaug

SEQ ID NO: 2033937 - RNA, 16 nt, Staphylococcus aureus subsp. aureus Mu50
uaauuuguaauuccuc

SEQ ID NO: 2033938 - RNA, 18 nt, Staphylococcus aureus subsp. aureus Mu50
uaauuuuaccuguuucuu

SEQ ID NO: 2033939 - RNA, 13 nt, Staphylococcus aureus subsp. aureus Mu50
uaagccauaugcu

SEQ ID NO: 2033940 - RNA, 17 nt, Staphylococcus aureus subsp. aureus Mu50
uaagcauucaguuaaug

SEQ ID NO: 2033941 - RNA, 21 nt, Staphylococcus aureus subsp. aureus Mu50
uaacuguacgauucaauuuaa

SEQ ID NO: 2033942 - RNA, 16 nt, Staphylococcus aureus subsp. aureus Mu50
uaacuguucuaaccau

SEQ ID NO: 2033943 - RNA, 21 nt, Staphylococcus aureus subsp. aureus Mu50
uaacuguucuuucgucuugua

SEQ ID NO: 2033944 - RNA, 23 nt, Staphylococcus aureus subsp. aureus Mu50
uaacucuaaauauaauagaaaua

SEQ ID NO: 2033945 - RNA, 20 nt, Staphylococcus aureus subsp. aureus Mu50
uaacugaccuaacaauuuga

SEQ ID NO: 2033946 - RNA, 13 nt, Staphylococcus aureus subsp. aureus Mu50
uaacugaguuuua

SEQ ID NO: 2033947 - RNA, 16 nt, Staphylococcus aureus subsp. aureus Mu50
uaacugcaaacuugau

SEQ ID NO: 2033948 - RNA, 22 nt, Staphylococcus aureus subsp. aureus Mu50
uaacugauuuuguuucaaacgu

SEQ ID NO: 2033949 - RNA, 23 nt, Staphylococcus aureus subsp. aureus Mu50
uaaguuaugacuaacgaaaaaga

SEQ ID NO: 2033950 - RNA, 19 nt, Staphylococcus aureus subsp. aureus Mu50
uaagugggacuuuuuauau

SEQ ID NO: 2033951 - RNA, 21 nt, Staphylococcus aureus subsp. aureus Mu50
uaaguucaccuaaaugauuaa

SEQ ID NO: 2033952 - RNA, 18 nt, Staphylococcus aureus subsp. aureus Mu50
uaaguuuauaaucaguuu

SEQ ID NO: 2033953 - RNA, 21 nt, Staphylococcus aureus subsp. aureus Mu50
uaaguuugaaggagauauuuu

SEQ ID NO: 2033954 - RNA, 16 nt, Staphylococcus aureus subsp. aureus Mu50
uaaguuugaaucauuu

SEQ ID NO: 2033955 - RNA, 17 nt, Staphylococcus aureus subsp. aureus Mu50
uaaguauauaauugauu

SEQ ID NO: 2033956 - RNA, 22 nt, Staphylococcus aureus subsp. aureus Mu50
uaaguaguugguggaugucaug

SEQ ID NO: 2033957 - RNA, 17 nt, Staphylococcus aureus subsp. aureus Mu50
uaagugacacaccacca

SEQ ID NO: 2033958 - RNA, 16 nt, Staphylococcus aureus subsp. aureus Mu50
uaagugauaaauaaug

SEQ ID NO: 2033959 - RNA, 17 nt, Staphylococcus aureus subsp. aureus Mu50
uaagugauauacgacaa

SEQ ID NO: 2033960 - RNA, 18 nt, Staphylococcus aureus subsp. aureus Mu50
uaaguuaaaaccuuuuca

SEQ ID NO: 2033961 - RNA, 22 nt, Staphylococcus aureus subsp. aureus Mu50
uaaguuaauuuaucguuuagua

SEQ ID NO: 2033962 - RNA, 14 nt, Staphylococcus aureus subsp. aureus Mu50
uaaguagaugauua

SEQ ID NO: 2033963 - RNA, 13 nt, Staphylococcus aureus subsp. aureus Mu50
uaaucccauuuua

SEQ ID NO: 2033964 - RNA, 20 nt, Staphylococcus aureus subsp. aureus Mu50
uaauccuucuccaaaaauaa

SEQ ID NO: 2033965 - RNA, 23 nt, Staphylococcus aureus subsp. aureus Mu50
uaaugacgagaauuaaagucugu

SEQ ID NO: 2033966 - RNA, 15 nt, Staphylococcus aureus subsp. aureus Mu50
uaaugauaguguaug

SEQ ID NO: 2033967 - RNA, 18 nt, Staphylococcus aureus subsp. aureus Mu50
uaaugaugacaucaauau

SEQ ID NO: 2033968 - RNA, 17 nt, Staphylococcus aureus subsp. aureus Mu50
uaaugauaguguaugaa

SEQ ID NO: 2033969 - RNA, 15 nt, Staphylococcus aureus subsp. aureus Mu50
uaauauaauuauuaa

SEQ ID NO: 2033970 - RNA, 17 nt, Staphylococcus aureus subsp. aureus Mu50
uaaucagugaaauauca

SEQ ID NO: 2033971 - RNA, 14 nt, Staphylococcus aureus subsp. aureus Mu50
uaauaucaauaaug

SEQ ID NO: 2033972 - RNA, 21 nt, Staphylococcus aureus subsp. aureus Mu50
uaauaucaauuuuuacuaaau

SEQ ID NO: 2033973 - RNA, 21 nt, Staphylococcus aureus subsp. aureus Mu50
uaauaucacgaucuuuaaagu

SEQ ID NO: 2033974 - RNA, 15 nt, Staphylococcus aureus subsp. aureus Mu50
uaauauccugcaguu

SEQ ID NO: 2033975 - RNA, 16 nt, Staphylococcus aureus subsp. aureus Mu50
uaauauaaaauaaagu

SEQ ID NO: 2033976 - RNA, 21 nt, Staphylococcus aureus subsp. aureus Mu50
uaauauauccugccaauauau

SEQ ID NO: 2033977 - RNA, 13 nt, Staphylococcus aureus subsp. aureus Mu50
uaauauaaauaaa

SEQ ID NO: 2033978 - RNA, 20 nt, Staphylococcus aureus subsp. aureus Mu50
uaauauaacaaguauaaaug

SEQ ID NO: 2033979 - RNA, 18 nt, Staphylococcus aureus subsp. aureus Mu50
uaauauaacuucuauuaa

SEQ ID NO: 2033980 - RNA, 16 nt, Staphylococcus aureus subsp. aureus Mu50
uaauaguacagucauc

SEQ ID NO: 2033981 - RNA, 14 nt, Staphylococcus aureus subsp. aureus Mu50
uaauaguacuuaau

SEQ ID NO: 2033982 - RNA, 14 nt, Staphylococcus aureus subsp. aureus Mu50
uaauaguuaacgau

SEQ ID NO: 2033983 - RNA, 13 nt, Staphylococcus aureus subsp. aureus Mu50
uaauaaaaucauc

SEQ ID NO: 2033984 - RNA, 17 nt, Staphylococcus aureus subsp. aureus Mu50
uaauacgaauuucauag

SEQ ID NO: 2033985 - RNA, 16 nt, Staphylococcus aureus subsp. aureus Mu50
uaauacgauaauaacu

SEQ ID NO: 2033986 - RNA, 17 nt, Staphylococcus aureus subsp. aureus Mu50
uaaguuugguuucuuaa

SEQ ID NO: 2033987 - RNA, 20 nt, Staphylococcus aureus subsp. aureus Mu50
uaauaaaagucgauaaauau

SEQ ID NO: 2033988 - RNA, 22 nt, Staphylococcus aureus subsp. aureus Mu50
uaauacguguguuuucuuuuca

SEQ ID NO: 2033989 - RNA, 18 nt, Staphylococcus aureus subsp. aureus Mu50
uaauacuguuuaaauaaa

SEQ ID NO: 2033990 - RNA, 13 nt, Staphylococcus aureus subsp. aureus Mu50
uaauacuucucaa

SEQ ID NO: 2033991 - RNA, 18 nt, Staphylococcus aureus subsp. aureus Mu50
uaauaggauuauuaucaa

SEQ ID NO: 2033992 - RNA, 16 nt, Staphylococcus aureus subsp. aureus Mu50
uaauaggcuauguaaa

SEQ ID NO: 2033993 - RNA, 20 nt, Staphylococcus aureus subsp. aureus Mu50
uaauaggcuauguaaaucgu

SEQ ID NO: 2033994 - RNA, 22 nt, Staphylococcus aureus subsp. aureus Mu50
uaauagcaaaauuauguaaaaa

SEQ ID NO: 2033995 - RNA, 18 nt, Staphylococcus aureus subsp. aureus Mu50
uaauagcaaccauauuuu

SEQ ID NO: 2033996 - RNA, 15 nt, Staphylococcus aureus subsp. aureus Mu50
uaauagauaaugcac

SEQ ID NO: 2033997 - RNA, 13 nt, Staphylococcus aureus subsp. aureus Mu50
uagccacaauuuu

SEQ ID NO: 2033998 - RNA, 15 nt, Staphylococcus aureus subsp. aureus Mu50
uagcauaaaauuucu

SEQ ID NO: 2033999 - RNA, 19 nt, Staphylococcus aureus subsp. aureus Mu50
uagcaugacauuaaggcuu

SEQ ID NO: 2034000 - RNA, 18 nt, Staphylococcus aureus subsp. aureus Mu50
uagcauuccuaauuauau

SEQ ID NO: 2034001 - RNA, 20 nt, Staphylococcus aureus subsp. aureus Mu50
uagcauuucuuuauuagaau

SEQ ID NO: 2034002 - RNA, 20 nt, Staphylococcus aureus subsp. aureus Mu50
uagauaaguaguggauaauc

SEQ ID NO: 2034003 - RNA, 23 nt, Staphylococcus aureus subsp. aureus Mu50
uagauagaaauugugcuuuucca

SEQ ID NO: 2034004 - RNA, 11 nt, Staphylococcus aureus subsp. aureus Mu50
uagcaaauuga

SEQ ID NO: 2034005 - RNA, 20 nt, Staphylococcus aureus subsp. aureus Mu50
uagcaacgagcuuagcaguu

SEQ ID NO: 2034006 - RNA, 18 nt, Staphylococcus aureus subsp. aureus Mu50
uagcaaugaauuaauagc

SEQ ID NO: 2034007 - RNA, 12 nt, Staphylococcus aureus subsp. aureus Mu50
uagcaauaucau

SEQ ID NO: 2034008 - RNA, 16 nt, Staphylococcus aureus subsp. aureus Mu50
uagcaggcaacuuuua

SEQ ID NO: 2034009 - RNA, 18 nt, Staphylococcus aureus subsp. aureus Mu50
uagacugacacaguaauu

SEQ ID NO: 2034010 - RNA, 20 nt, Staphylococcus aureus subsp. aureus Mu50
uagacuuauuugaaugcaaa

SEQ ID NO: 2034011 - RNA, 19 nt, Staphylococcus aureus subsp. aureus Mu50
uagacaguaguuaauugaa

SEQ ID NO: 2034012 - RNA, 19 nt, Staphylococcus aureus subsp. aureus Mu50
uagacauugaauaaaugaa

SEQ ID NO: 2034013 - RNA, 16 nt, Staphylococcus aureus subsp. aureus Mu50
uagaauuucuuuucga

SEQ ID NO: 2034014 - RNA, 14 nt, Staphylococcus aureus subsp. aureus Mu50
uagaaaaaguauua

SEQ ID NO: 2034015 - RNA, 18 nt, Staphylococcus aureus subsp. aureus Mu50
uacuuugauauguuuccu

SEQ ID NO: 2034016 - RNA, 23 nt, Staphylococcus aureus subsp. aureus Mu50
uacuuuggcagacguaucaucaa

SEQ ID NO: 2034017 - RNA, 13 nt, Staphylococcus aureus subsp. aureus Mu50
uacuuuuaaauua

SEQ ID NO: 2034018 - RNA, 17 nt, Staphylococcus aureus subsp. aureus Mu50
uacuuuuuugagcauuu

SEQ ID NO: 2034019 - RNA, 20 nt, Staphylococcus aureus subsp. aureus Mu50
uagaauucacgcaauaucau

SEQ ID NO: 2034020 - RNA, 13 nt, Staphylococcus aureus subsp. aureus Mu50
uagaauucauuaa

SEQ ID NO: 2034021 - RNA, 18 nt, Staphylococcus aureus subsp. aureus Mu50
uagaauucuaaaagaauu

SEQ ID NO: 2034022 - RNA, 19 nt, Staphylococcus aureus subsp. aureus Mu50
uagaauucuaaaagaauua

SEQ ID NO: 2034023 - RNA, 15 nt, Staphylococcus aureus subsp. aureus Mu50
uacuuuaucguugua

SEQ ID NO: 2034024 - RNA, 19 nt, Staphylococcus aureus subsp. aureus Mu50
uacuuuaacaguuguaauc

SEQ ID NO: 2034025 - RNA, 20 nt, Staphylococcus aureus subsp. aureus Mu50
uacuuuaaaauuguauagaa

SEQ ID NO: 2034026 - RNA, 23 nt, Staphylococcus aureus subsp. aureus Mu50
uacuugaagcaucgauuuauuau

SEQ ID NO: 2034027 - RNA, 21 nt, Staphylococcus aureus subsp. aureus Mu50
uacuugcuuuuucaaauaaua

SEQ ID NO: 2034028 - RNA, 14 nt, Staphylococcus aureus subsp. aureus Mu50
uacuauuaaauaau

SEQ ID NO: 2034029 - RNA, 20 nt, Staphylococcus aureus subsp. aureus Mu50
uacucaaaccaucuuaucuu

SEQ ID NO: 2034030 - RNA, 14 nt, Staphylococcus aureus subsp. aureus Mu50
uacuauuuaaucuu

SEQ ID NO: 2034031 - RNA, 12 nt, Staphylococcus aureus subsp. aureus Mu50
uacuauuaaagg

SEQ ID NO: 2034032 - RNA, 14 nt, Staphylococcus aureus subsp. aureus Mu50
uacuaucuucauca

SEQ ID NO: 2034033 - RNA, 18 nt, Staphylococcus aureus subsp. aureus Mu50
uacuaucuucaucauauu

SEQ ID NO: 2034034 - RNA, 17 nt, Staphylococcus aureus subsp. aureus Mu50
uacuacauauaaugcca

SEQ ID NO: 2034035 - RNA, 14 nt, Staphylococcus aureus subsp. aureus Mu50
uacuacauuauuac

SEQ ID NO: 2034036 - RNA, 16 nt, Staphylococcus aureus subsp. aureus Mu50
uacuacauucuaugua

SEQ ID NO: 2034037 - RNA, 21 nt, Staphylococcus aureus subsp. aureus Mu50
uacuaccguuuuuauauacuu

SEQ ID NO: 2034038 - RNA, 12 nt, Staphylococcus aureus subsp. aureus Mu50
uacuacgcauua

SEQ ID NO: 2034039 - RNA, 23 nt, Staphylococcus aureus subsp. aureus Mu50
uacuaaucguuguggcuuuuuau

SEQ ID NO: 2034040 - RNA, 23 nt, Staphylococcus aureus subsp. aureus Mu50
uacuacugucucaucuucuaaau

SEQ ID NO: 2034041 - RNA, 14 nt, Staphylococcus aureus subsp. aureus Mu50
uacuauaagcaauu

SEQ ID NO: 2034042 - RNA, 13 nt, Staphylococcus aureus subsp. aureus Mu50
uacuauaauaauu

SEQ ID NO: 2034043 - RNA, 13 nt, Staphylococcus aureus subsp. aureus Mu50
uacuauacugaug

SEQ ID NO: 2034044 - RNA, 22 nt, Staphylococcus aureus subsp. aureus Mu50
uacuacuuuauaaauaucuuuu

SEQ ID NO: 2034045 - RNA, 14 nt, Staphylococcus aureus subsp. aureus Mu50
uacuacuuuauuug

SEQ ID NO: 2034046 - RNA, 14 nt, Staphylococcus aureus subsp. aureus Mu50
uacuaaucuuaguu

SEQ ID NO: 2034047 - RNA, 14 nt, Staphylococcus aureus subsp. aureus Mu50
uacgccuaaauauu

SEQ ID NO: 2034048 - RNA, 21 nt, Staphylococcus aureus subsp. aureus Mu50
uacugcuuuuuuauucuaaua

SEQ ID NO: 2034049 - RNA, 23 nt, Staphylococcus aureus subsp. aureus Mu50
uacugcuucgcuaauaucaucuu

SEQ ID NO: 2034050 - RNA, 15 nt, Staphylococcus aureus subsp. aureus Mu50
uacugcaauuauuuu

SEQ ID NO: 2034051 - RNA, 22 nt, Staphylococcus aureus subsp. aureus Mu50
uacugcaauuauuuuucaaaua

SEQ ID NO: 2034052 - RNA, 18 nt, Staphylococcus aureus subsp. aureus Mu50
uacucaauccuaaauuau

SEQ ID NO: 2034053 - RNA, 19 nt, Staphylococcus aureus subsp. aureus Mu50
uacucacugcacuuaugau

SEQ ID NO: 2034054 - RNA, 19 nt, Staphylococcus aureus subsp. aureus Mu50
uacgcauuuuaaauaaaau

SEQ ID NO: 2034055 - RNA, 13 nt, Staphylococcus aureus subsp. aureus Mu50
uacgaucauaaau

SEQ ID NO: 2034056 - RNA, 20 nt, Staphylococcus aureus subsp. aureus Mu50
uaccgacaccuauacauaac

SEQ ID NO: 2034057 - RNA, 18 nt, Staphylococcus aureus subsp. aureus Mu50
uacauaauuugaauuagu

SEQ ID NO: 2034058 - RNA, 16 nt, Staphylococcus aureus subsp. aureus Mu50
uacauacaacucguuu

SEQ ID NO: 2034059 - RNA, 21 nt, Staphylococcus aureus subsp. aureus Mu50
uacauaauuaacuuucuuuug

SEQ ID NO: 2034060 - RNA, 11 nt, Staphylococcus aureus subsp. aureus Mu50
uacauaaaucu

SEQ ID NO: 2034061 - RNA, 23 nt, Staphylococcus aureus subsp. aureus Mu50
uacauaaauuaggucauuuuuau

SEQ ID NO: 2034062 - RNA, 22 nt, Staphylococcus aureus subsp. aureus Mu50
uacauaauagacuuauauuaau

SEQ ID NO: 2034063 - RNA, 19 nt, Staphylococcus aureus subsp. aureus Mu50
uacagucaacugcugcuaa

SEQ ID NO: 2034064 - RNA, 19 nt, Staphylococcus aureus subsp. aureus Mu50
uacagucaucuugagauuu

SEQ ID NO: 2034065 - RNA, 15 nt, Staphylococcus aureus subsp. aureus Mu50
uacagguaaugcaag

SEQ ID NO: 2034066 - RNA, 14 nt, Staphylococcus aureus subsp. aureus Mu50
uacagguaaugcaa

SEQ ID NO: 2034067 - RNA, 17 nt, Staphylococcus aureus subsp. aureus Mu50
uacauauacgacauuuu

SEQ ID NO: 2034068 - RNA, 21 nt, Staphylococcus aureus subsp. aureus Mu50
uacauauucucugcuucuaaa

SEQ ID NO: 2034069 - RNA, 16 nt, Staphylococcus aureus subsp. aureus Mu50
uacauaucuuuugcaa

SEQ ID NO: 2034070 - RNA, 16 nt, Staphylococcus aureus subsp. aureus Mu50
uacauauguguaugau

SEQ ID NO: 2034071 - RNA, 17 nt, Staphylococcus aureus subsp. aureus Mu50
uaccaauuuuuagcauu

SEQ ID NO: 2034072 - RNA, 17 nt, Staphylococcus aureus subsp. aureus Mu50
uaccacauuuuccuugu

SEQ ID NO: 2034073 - RNA, 16 nt, Staphylococcus aureus subsp. aureus Mu50
uaccacuugaauacuu

SEQ ID NO: 2034074 - RNA, 15 nt, Staphylococcus aureus subsp. aureus Mu50
uaccacuguauuuac

SEQ ID NO: 2034075 - RNA, 14 nt, Staphylococcus aureus subsp. aureus Mu50
uaccacuuauaaca

SEQ ID NO: 2034076 - RNA, 14 nt, Staphylococcus aureus subsp. aureus Mu50
uacccaccacauuu

SEQ ID NO: 2034077 - RNA, 19 nt, Staphylococcus aureus subsp. aureus Mu50
uaccauugugaauaauuuc

SEQ ID NO: 2034078 - RNA, 22 nt, Staphylococcus aureus subsp. aureus Mu50
uaccaucuucgacuacaaguuu

SEQ ID NO: 2034079 - RNA, 15 nt, Staphylococcus aureus subsp. aureus Mu50
uaccaguaucauugu

SEQ ID NO: 2034080 - RNA, 16 nt, Staphylococcus aureus subsp. aureus Mu50
uacccauuacauuugg

SEQ ID NO: 2034081 - RNA, 18 nt, Staphylococcus aureus subsp. aureus Mu50
guuaaaaauguaaauaaa

SEQ ID NO: 2034082 - RNA, 19 nt, Staphylococcus aureus subsp. aureus Mu50
guuaacauuugucauaaua

SEQ ID NO: 2034083 - RNA, 23 nt, Staphylococcus aureus subsp. aureus Mu50
guuaaaauuugaauugacuuaca

SEQ ID NO: 2034084 - RNA, 23 nt, Staphylococcus aureus subsp. aureus Mu50
guuaaacgugaauucgaugacuu

SEQ ID NO: 2034085 - RNA, 15 nt, Staphylococcus aureus subsp. aureus Mu50
guuaaaguacuuaca

SEQ ID NO: 2034086 - RNA, 22 nt, Staphylococcus aureus subsp. aureus Mu50
guuaauaaugacugacacuuua

SEQ ID NO: 2034087 - RNA, 14 nt, Staphylococcus aureus subsp. aureus Mu50
guguuauaaauaga

SEQ ID NO: 2034088 - RNA, 17 nt, Staphylococcus aureus subsp. aureus Mu50
guguguccaucauuugu

SEQ ID NO: 2034089 - RNA, 22 nt, Staphylococcus aureus subsp. aureus Mu50
gugugccggcuuuuucuuuugu

SEQ ID NO: 2034090 - RNA, 19 nt, Staphylococcus aureus subsp. aureus Mu50
guguaucaguuauuuuaau

SEQ ID NO: 2034091 - RNA, 17 nt, Staphylococcus aureus subsp. aureus Mu50
guucauauaugauaaau

SEQ ID NO: 2034092 - RNA, 19 nt, Staphylococcus aureus subsp. aureus Mu50
guucauagugguguuuaua

SEQ ID NO: 2034093 - RNA, 15 nt, Staphylococcus aureus subsp. aureus Mu50
guucaucuaaaauga

SEQ ID NO: 2034094 - RNA, 15 nt, Staphylococcus aureus subsp. aureus Mu50
guuccaaauucauuu

SEQ ID NO: 2034095 - RNA, 14 nt, Staphylococcus aureus subsp. aureus Mu50
guucagcaaguuuu

SEQ ID NO: 2034096 - RNA, 22 nt, Staphylococcus aureus subsp. aureus Mu50
guuaauuauuuagauucuuuuc

SEQ ID NO: 2034097 - RNA, 12 nt, Staphylococcus aureus subsp. aureus Mu50
guuaauuuaucg

SEQ ID NO: 2034098 - RNA, 15 nt, Staphylococcus aureus subsp. aureus Mu50
guuaauuucaacauu

SEQ ID NO: 2034099 - RNA, 18 nt, Staphylococcus aureus subsp. aureus Mu50
guuaccaaacaauacaua

SEQ ID NO: 2034100 - RNA, 16 nt, Staphylococcus aureus subsp. aureus Mu50
guuacauauugcauuu

SEQ ID NO: 2034101 - RNA, 20 nt, Staphylococcus aureus subsp. aureus Mu50
guuaccugcgccuucuuuuu

SEQ ID NO: 2034102 - RNA, 21 nt, Staphylococcus aureus subsp. aureus Mu50
guuagguccuuucacauacca

SEQ ID NO: 2034103 - RNA, 16 nt, Staphylococcus aureus subsp. aureus Mu50
guuagacuaaaaaacu

SEQ ID NO: 2034104 - RNA, 18 nt, Staphylococcus aureus subsp. aureus Mu50
guuauucguuaacaauca

SEQ ID NO: 2034105 - RNA, 14 nt, Staphylococcus aureus subsp. aureus Mu50
guuaucugcuuuuc

SEQ ID NO: 2034106 - RNA, 18 nt, Staphylococcus aureus subsp. aureus Mu50
guuauuauaaaauaaaua

SEQ ID NO: 2034107 - RNA, 12 nt, Staphylococcus aureus subsp. aureus Mu50
guuauuaaccau

SEQ ID NO: 2034108 - RNA, 15 nt, Staphylococcus aureus subsp. aureus Mu50
guuauuaaccaucau

SEQ ID NO: 2034109 - RNA, 21 nt, Staphylococcus aureus subsp. aureus Mu50
guuauacuacuauugauauuc

SEQ ID NO: 2034110 - RNA, 14 nt, Staphylococcus aureus subsp. aureus Mu50
guuauaucaucaac

SEQ ID NO: 2034111 - RNA, 15 nt, Staphylococcus aureus subsp. aureus Mu50
guuauccguaacacu

SEQ ID NO: 2034112 - RNA, 14 nt, Staphylococcus aureus subsp. aureus Mu50
guucaaaaaucaua

SEQ ID NO: 2034113 - RNA, 15 nt, Staphylococcus aureus subsp. aureus Mu50
guuauuuauuugauu

SEQ ID NO: 2034114 - RNA, 14 nt, Staphylococcus aureus subsp. aureus Mu50
guucaaucacuaua

SEQ ID NO: 2034115 - RNA, 12 nt, Staphylococcus aureus subsp. aureus Mu50
guucacaacaaa

SEQ ID NO: 2034116 - RNA, 18 nt, Staphylococcus aureus subsp. aureus Mu50
guucaauguuauuaaacc

SEQ ID NO: 2034117 - RNA, 19 nt, Staphylococcus aureus subsp. aureus Mu50
guucccauuuuuaaaauua

SEQ ID NO: 2034118 - RNA, 19 nt, Staphylococcus aureus subsp. aureus Mu50
guucugcuuuuucuuuauc

SEQ ID NO: 2034119 - RNA, 20 nt, Staphylococcus aureus subsp. aureus Mu50
guucuguaaugauauuaagu

SEQ ID NO: 2034120 - RNA, 17 nt, Staphylococcus aureus subsp. aureus Mu50
guucggaauuugcacaa

SEQ ID NO: 2034121 - RNA, 15 nt, Staphylococcus aureus subsp. aureus Mu50
guugauuauauuucu

SEQ ID NO: 2034122 - RNA, 15 nt, Staphylococcus aureus subsp. aureus Mu50
guuguuauauaaaua

SEQ ID NO: 2034123 - RNA, 21 nt, Staphylococcus aureus subsp. aureus Mu50
guuguucccauuuuuaaaauu

SEQ ID NO: 2034124 - RNA, 12 nt, Staphylococcus aureus subsp. aureus Mu50
guuguucuuuuu

SEQ ID NO: 2034125 - RNA, 16 nt, Staphylococcus aureus subsp. aureus Mu50
guuguugaaauuaaau

SEQ ID NO: 2034126 - RNA, 14 nt, Staphylococcus aureus subsp. aureus Mu50
guuuaacuuuaucu

SEQ ID NO: 2034127 - RNA, 16 nt, Staphylococcus aureus subsp. aureus Mu50
guuuaacaauaauagg

SEQ ID NO: 2034128 - RNA, 22 nt, Staphylococcus aureus subsp. aureus Mu50
guuuaauaacaaaauuaaauau

SEQ ID NO: 2034129 - RNA, 14 nt, Staphylococcus aureus subsp. aureus Mu50
guuguugguuuugc

SEQ ID NO: 2034130 - RNA, 18 nt, Staphylococcus aureus subsp. aureus Mu50
guuguuuggaugcuuuuc

SEQ ID NO: 2034131 - RNA, 23 nt, Staphylococcus aureus subsp. aureus Mu50
guugugauauauaguaggguauu

SEQ ID NO: 2034132 - RNA, 14 nt, Staphylococcus aureus subsp. aureus Mu50
guugucuucuuuuu

SEQ ID NO: 2034133 - RNA, 22 nt, Staphylococcus aureus subsp. aureus Mu50
ucccgaaaguuagacuaaaaaa

SEQ ID NO: 2034134 - RNA, 21 nt, Staphylococcus aureus subsp. aureus Mu50
ucccacucccuaauaacugag

SEQ ID NO: 2034135 - RNA, 18 nt, Staphylococcus aureus subsp. aureus Mu50
ucccaaccccuuuauuuu

SEQ ID NO: 2034136 - RNA, 21 nt, Staphylococcus aureus subsp. aureus Mu50
uccauacguuccuaaagucgu

SEQ ID NO: 2034137 - RNA, 11 nt, Staphylococcus aureus subsp. aureus Mu50
uccauaaauau

SEQ ID NO: 2034138 - RNA, 17 nt, Staphylococcus aureus subsp. aureus Mu50
uccauaaucuuuauuaa

SEQ ID NO: 2034139 - RNA, 18 nt, Staphylococcus aureus subsp. aureus Mu50
ucccauaacaaucauuuc

SEQ ID NO: 2034140 - RNA, 13 nt, Staphylococcus aureus subsp. aureus Mu50
ucccauacugauu

SEQ ID NO: 2034141 - RNA, 21 nt, Staphylococcus aureus subsp. aureus Mu50
uccgauaucuuuuaauucuua

SEQ ID NO: 2034142 - RNA, 22 nt, Staphylococcus aureus subsp. aureus Mu50
uccaguggaaaugauaauuuaa

SEQ ID NO: 2034143 - RNA, 15 nt, Staphylococcus aureus subsp. aureus Mu50
uccaauuuaaaauga

SEQ ID NO: 2034144 - RNA, 12 nt, Staphylococcus aureus subsp. aureus Mu50
uccaauuucaag

SEQ ID NO: 2034145 - RNA, 20 nt, Staphylococcus aureus subsp. aureus Mu50
uccaagugacaacauuauuu

SEQ ID NO: 2034146 - RNA, 22 nt, Staphylococcus aureus subsp. aureus Mu50
uccaaggauguuauaaaaugaa

SEQ ID NO: 2034147 - RNA, 15 nt, Staphylococcus aureus subsp. aureus Mu50
ucauuuucauuguau

SEQ ID NO: 2034148 - RNA, 19 nt, Staphylococcus aureus subsp. aureus Mu50
uccaauacuacuguugaca

SEQ ID NO: 2034149 - RNA, 15 nt, Staphylococcus aureus subsp. aureus Mu50
uccaauaucuucuuu

SEQ ID NO: 2034150 - RNA, 21 nt, Staphylococcus aureus subsp. aureus Mu50
uccaauaucuucuuuuaauau

SEQ ID NO: 2034151 - RNA, 16 nt, Staphylococcus aureus subsp. aureus Mu50
uccaaucaacuucaua

SEQ ID NO: 2034152 - RNA, 22 nt, Staphylococcus aureus subsp. aureus Mu50
uccaaucaacuucauauaaugc

SEQ ID NO: 2034153 - RNA, 16 nt, Staphylococcus aureus subsp. aureus Mu50
uccaauuauguuuauc

SEQ ID NO: 2034154 - RNA, 20 nt, Staphylococcus aureus subsp. aureus Mu50
uccaccagucguaaugauga

SEQ ID NO: 2034155 - RNA, 23 nt, Staphylococcus aureus subsp. aureus Mu50
uccaagcaucauugaauguugga

SEQ ID NO: 2034156 - RNA, 19 nt, Staphylococcus aureus subsp. aureus Mu50
uccaaguacacgaauacca

SEQ ID NO: 2034157 - RNA, 18 nt, Staphylococcus aureus subsp. aureus Mu50
ucauuugacauaucauga

SEQ ID NO: 2034158 - RNA, 17 nt, Staphylococcus aureus subsp. aureus Mu50
ucauuuuucguuguuca

SEQ ID NO: 2034159 - RNA, 19 nt, Staphylococcus aureus subsp. aureus Mu50
ucauuucugucccacuccc

SEQ ID NO: 2034160 - RNA, 15 nt, Staphylococcus aureus subsp. aureus Mu50
ucauuucuuuguuuc

SEQ ID NO: 2034161 - RNA, 22 nt, Staphylococcus aureus subsp. aureus Mu50
ucauuugaacaucauuuaauug

SEQ ID NO: 2034162 - RNA, 16 nt, Staphylococcus aureus subsp. aureus Mu50
ucauuuggcguucaac

SEQ ID NO: 2034163 - RNA, 22 nt, Staphylococcus aureus subsp. aureus Mu50
ucauuuuaaguaucggugauuu

SEQ ID NO: 2034164 - RNA, 16 nt, Staphylococcus aureus subsp. aureus Mu50
ucauuuucaauacuug

SEQ ID NO: 2034165 - RNA, 14 nt, Staphylococcus aureus subsp. aureus Mu50
ucauuuucauugua

SEQ ID NO: 2034166 - RNA, 18 nt, Staphylococcus aureus subsp. aureus Mu50
ucauuuguguaaaugaau

SEQ ID NO: 2034167 - RNA, 18 nt, Staphylococcus aureus subsp. aureus Mu50
ucauuuguguauaaaugu

SEQ ID NO: 2034168 - RNA, 14 nt, Staphylococcus aureus subsp. aureus Mu50
ucauuuguguuuuu

SEQ ID NO: 2034169 - RNA, 17 nt, Staphylococcus aureus subsp. aureus Mu50
ucauuagauaaaauaau

SEQ ID NO: 2034170 - RNA, 16 nt, Staphylococcus aureus subsp. aureus Mu50
ucauuagcauuauuau

SEQ ID NO: 2034171 - RNA, 15 nt, Staphylococcus aureus subsp. aureus Mu50
ucauuaguuguauca

SEQ ID NO: 2034172 - RNA, 21 nt, Staphylococcus aureus subsp. aureus Mu50
ucauuagcgaaaacuaaaggg

SEQ ID NO: 2034173 - RNA, 16 nt, Staphylococcus aureus subsp. aureus Mu50
ucauuaguuguaucag

SEQ ID NO: 2034174 - RNA, 16 nt, Staphylococcus aureus subsp. aureus Mu50
ucauugguuucaucau

SEQ ID NO: 2034175 - RNA, 14 nt, Staphylococcus aureus subsp. aureus Mu50
ucauuguaaaugau

SEQ ID NO: 2034176 - RNA, 15 nt, Staphylococcus aureus subsp. aureus Mu50
ucauuucaauauuaa

SEQ ID NO: 2034177 - RNA, 22 nt, Staphylococcus aureus subsp. aureus Mu50
ucauuucccuuaaaucaaguau

SEQ ID NO: 2034178 - RNA, 14 nt, Staphylococcus aureus subsp. aureus Mu50
ucauuguauaaaaa

SEQ ID NO: 2034179 - RNA, 18 nt, Staphylococcus aureus subsp. aureus Mu50
ucauuguuucagcugcaa

SEQ ID NO: 2034180 - RNA, 14 nt, Staphylococcus aureus subsp. aureus Mu50
ucauuuaacaugua

SEQ ID NO: 2034181 - RNA, 20 nt, Staphylococcus aureus subsp. aureus Mu50
ucauuguguauuguuuuacu

SEQ ID NO: 2034182 - RNA, 19 nt, Staphylococcus aureus subsp. aureus Mu50
ucauuguguccauaaauau

SEQ ID NO: 2034183 - RNA, 20 nt, Staphylococcus aureus subsp. aureus Mu50
ucauuguaaauuuguuaucu

SEQ ID NO: 2034184 - RNA, 22 nt, Staphylococcus aureus subsp. aureus Mu50
ucauauuuuuuacguauacuuu

SEQ ID NO: 2034185 - RNA, 22 nt, Staphylococcus aureus subsp. aureus Mu50
ucauauguuuuauaauaaaugu

SEQ ID NO: 2034186 - RNA, 21 nt, Staphylococcus aureus subsp. aureus Mu50
ucauauuacuuuggaaauuua

SEQ ID NO: 2034187 - RNA, 20 nt, Staphylococcus aureus subsp. aureus Mu50
ucauauucacaucuuuagcu

SEQ ID NO: 2034188 - RNA, 20 nt, Staphylococcus aureus subsp. aureus Mu50
ucauauggcaauguuaacug

SEQ ID NO: 2034189 - RNA, 16 nt, Staphylococcus aureus subsp. aureus Mu50
ucauauggugaacugu

SEQ ID NO: 2034190 - RNA, 18 nt, Staphylococcus aureus subsp. aureus Mu50
ucaucgcaaauacauaau

SEQ ID NO: 2034191 - RNA, 21 nt, Staphylococcus aureus subsp. aureus Mu50
ucaucgaguuuguuucuaaau

SEQ ID NO: 2034192 - RNA, 20 nt, Staphylococcus aureus subsp. aureus Mu50
ucaucuaacgacccaaauua

SEQ ID NO: 2034193 - RNA, 23 nt, Staphylococcus aureus subsp. aureus Mu50
ucaucuaacgacccaaauuauau

SEQ ID NO: 2034194 - RNA, 13 nt, Staphylococcus aureus subsp. aureus Mu50
ucaucuauucaac

SEQ ID NO: 2034195 - RNA, 21 nt, Staphylococcus aureus subsp. aureus Mu50
ucaucuaaaaugaguuguuca

SEQ ID NO: 2034196 - RNA, 15 nt, Staphylococcus aureus subsp. aureus Mu50
ucauuaauaaauuga

SEQ ID NO: 2034197 - RNA, 21 nt, Staphylococcus aureus subsp. aureus Mu50
ucauuaauaaauugacucaaa

SEQ ID NO: 2034198 - RNA, 19 nt, Staphylococcus aureus subsp. aureus Mu50
ucauguucuaaugauauuu

SEQ ID NO: 2034199 - RNA, 22 nt, Staphylococcus aureus subsp. aureus Mu50
ucauuaaauguacauuguaaau

SEQ ID NO: 2034200 - RNA, 15 nt, Staphylococcus aureus subsp. aureus Mu50
ucauuacagauaauu

SEQ ID NO: 2034201 - RNA, 14 nt, Staphylococcus aureus subsp. aureus Mu50
ucauuacaaccauu

SEQ ID NO: 2034202 - RNA, 12 nt, Staphylococcus aureus subsp. aureus Mu50
ucauguucauaa

SEQ ID NO: 2034203 - RNA, 15 nt, Staphylococcus aureus subsp. aureus Mu50
ucaucugguauuuua

SEQ ID NO: 2034204 - RNA, 16 nt, Staphylococcus aureus subsp. aureus Mu50
ucaucuucaauucuua

SEQ ID NO: 2034205 - RNA, 13 nt, Staphylococcus aureus subsp. aureus Mu50
ucaucuucuaaau

SEQ ID NO: 2034206 - RNA, 23 nt, Staphylococcus aureus subsp. aureus Mu50
ucaucuuucacaauuguauaaug

SEQ ID NO: 2034207 - RNA, 15 nt, Staphylococcus aureus subsp. aureus Mu50
ucaugccuucauuag

SEQ ID NO: 2034208 - RNA, 13 nt, Staphylococcus aureus subsp. aureus Mu50
ucaguaucauguu

SEQ ID NO: 2034209 - RNA, 15 nt, Staphylococcus aureus subsp. aureus Mu50
ucaguaucuaaauau

SEQ ID NO: 2034210 - RNA, 20 nt, Staphylococcus aureus subsp. aureus Mu50
ucaguaacugauuuuguuuc

SEQ ID NO: 2034211 - RNA, 16 nt, Staphylococcus aureus subsp. aureus Mu50
ucauaaugaacgauau

SEQ ID NO: 2034212 - RNA, 20 nt, Staphylococcus aureus subsp. aureus Mu50
ucauaauuuuguuuugcuuc

SEQ ID NO: 2034213 - RNA, 18 nt, Staphylococcus aureus subsp. aureus Mu50
ucaguaaaaauacauuuu

SEQ ID NO: 2034214 - RNA, 17 nt, Staphylococcus aureus subsp. aureus Mu50
ucauagaacaaaaugua

SEQ ID NO: 2034215 - RNA, 22 nt, Staphylococcus aureus subsp. aureus Mu50
ucauacgcuaaugcuauauuag

SEQ ID NO: 2034216 - RNA, 14 nt, Staphylococcus aureus subsp. aureus Mu50
ucauacuaacuaua

SEQ ID NO: 2034217 - RNA, 17 nt, Staphylococcus aureus subsp. aureus Mu50
ucauagccuauuuaaaa

SEQ ID NO: 2034218 - RNA, 16 nt, Staphylococcus aureus subsp. aureus Mu50
ucauaguauacauaau

SEQ ID NO: 2034219 - RNA, 17 nt, Staphylococcus aureus subsp. aureus Mu50
ucauagugguguuuaua

SEQ ID NO: 2034220 - RNA, 14 nt, Staphylococcus aureus subsp. aureus Mu50
ucauaucuuucaau

SEQ ID NO: 2034221 - RNA, 21 nt, Staphylococcus aureus subsp. aureus Mu50
ucauauaaagucguaucauau

SEQ ID NO: 2034222 - RNA, 19 nt, Staphylococcus aureus subsp. aureus Mu50
ucauauccuucauuaguga

SEQ ID NO: 2034223 - RNA, 17 nt, Staphylococcus aureus subsp. aureus Mu50
ucauauaugauaaauau

SEQ ID NO: 2034224 - RNA, 19 nt, Staphylococcus aureus subsp. aureus Mu50
ucaccguaaucuuuuaacu

SEQ ID NO: 2034225 - RNA, 17 nt, Staphylococcus aureus subsp. aureus Mu50
ucaccauuuacuucaua

SEQ ID NO: 2034226 - RNA, 22 nt, Staphylococcus aureus subsp. aureus Mu50
ucaccagguuuuuuauuuucau

SEQ ID NO: 2034227 - RNA, 15 nt, Staphylococcus aureus subsp. aureus Mu50
ucacaaucauagaua

SEQ ID NO: 2034228 - RNA, 17 nt, Staphylococcus aureus subsp. aureus Mu50
ucacaaucuguucauaa

SEQ ID NO: 2034229 - RNA, 14 nt, Staphylococcus aureus subsp. aureus Mu50
ucaauuucaccuug

SEQ ID NO: 2034230 - RNA, 19 nt, Staphylococcus aureus subsp. aureus Mu50
ucaauuuuaccauguuuua

SEQ ID NO: 2034231 - RNA, 20 nt, Staphylococcus aureus subsp. aureus Mu50
ucaauuuuuucaugauuuac

SEQ ID NO: 2034232 - RNA, 13 nt, Staphylococcus aureus subsp. aureus Mu50
ucacaaauuugaa

SEQ ID NO: 2034233 - RNA, 20 nt, Staphylococcus aureus subsp. aureus Mu50
ucacaaauuugaauauacuu

SEQ ID NO: 2034234 - RNA, 20 nt, Staphylococcus aureus subsp. aureus Mu50
ucaauguauauuuaacauca

SEQ ID NO: 2034235 - RNA, 21 nt, Staphylococcus aureus subsp. aureus Mu50
ucaauguuuaauuuucuaaau

SEQ ID NO: 2034236 - RNA, 20 nt, Staphylococcus aureus subsp. aureus Mu50
ucaauuaauuuaaaugcuua

SEQ ID NO: 2034237 - RNA, 14 nt, Staphylococcus aureus subsp. aureus Mu50
ucaauuaauuuagu

SEQ ID NO: 2034238 - RNA, 20 nt, Staphylococcus aureus subsp. aureus Mu50
ucaauuagccaauaccgaau

SEQ ID NO: 2034239 - RNA, 19 nt, Staphylococcus aureus subsp. aureus Mu50
ucaauucgcauuaaauaac

SEQ ID NO: 2034240 - RNA, 21 nt, Staphylococcus aureus subsp. aureus Mu50
ucaauucgcucacaugugaaa

SEQ ID NO: 2034241 - RNA, 14 nt, Staphylococcus aureus subsp. aureus Mu50
ucaauugaaucuuu

SEQ ID NO: 2034242 - RNA, 16 nt, Staphylococcus aureus subsp. aureus Mu50
ucaauugcgauauacg

SEQ ID NO: 2034243 - RNA, 24 nt, Staphylococcus aureus subsp. aureus Mu50
ucaauuggcaacggcacauucaua

SEQ ID NO: 2034244 - RNA, 14 nt, Staphylococcus aureus subsp. aureus Mu50
ucaauuuaaauaag

SEQ ID NO: 2034245 - RNA, 13 nt, Staphylococcus aureus subsp. aureus Mu50
ucaauuuaauuaa

SEQ ID NO: 2034246 - RNA, 22 nt, Staphylococcus aureus subsp. aureus Mu50
ucacagcacagcgauuaaauga

SEQ ID NO: 2034247 - RNA, 19 nt, Staphylococcus aureus subsp. aureus Mu50
ucacagacuuuuuacuaac

SEQ ID NO: 2034248 - RNA, 22 nt, Staphylococcus aureus subsp. aureus Mu50
ucacagacuuuuuacuaacuga

SEQ ID NO: 2034249 - RNA, 18 nt, Staphylococcus aureus subsp. aureus Mu50
ucacaugccaucuuugua

SEQ ID NO: 2034250 - RNA, 14 nt, Staphylococcus aureus subsp. aureus Mu50
ucacauauaaauau

SEQ ID NO: 2034251 - RNA, 15 nt, Staphylococcus aureus subsp. aureus Mu50
ucacauucaauauuu

SEQ ID NO: 2034252 - RNA, 22 nt, Staphylococcus aureus subsp. aureus Mu50
ucaccugaugucgcuuucauac

SEQ ID NO: 2034253 - RNA, 15 nt, Staphylococcus aureus subsp. aureus Mu50
ucacuuuuuauauca

SEQ ID NO: 2034254 - RNA, 22 nt, Staphylococcus aureus subsp. aureus Mu50
ucacuuuuuuuaauuugauuaa

SEQ ID NO: 2034255 - RNA, 22 nt, Staphylococcus aureus subsp. aureus Mu50
ucagaaaugacaucaucuauaa

SEQ ID NO: 2034256 - RNA, 23 nt, Staphylococcus aureus subsp. aureus Mu50
ucacucacuucaacgucaucugc

SEQ ID NO: 2034257 - RNA, 19 nt, Staphylococcus aureus subsp. aureus Mu50
ucacuccucuauuuuauga

SEQ ID NO: 2034258 - RNA, 17 nt, Staphylococcus aureus subsp. aureus Mu50
ucacuuuuaacgacauc

SEQ ID NO: 2034259 - RNA, 18 nt, Staphylococcus aureus subsp. aureus Mu50
ucacucggcagauguuca

SEQ ID NO: 2034260 - RNA, 17 nt, Staphylococcus aureus subsp. aureus Mu50
ucacuaaaguaaauaac

SEQ ID NO: 2034261 - RNA, 17 nt, Staphylococcus aureus subsp. aureus Mu50
ucacuaauggauaugau

SEQ ID NO: 2034262 - RNA, 23 nt, Staphylococcus aureus subsp. aureus Mu50
ucagcauugggacauaaaauuaa

SEQ ID NO: 2034263 - RNA, 17 nt, Staphylococcus aureus subsp. aureus Mu50
ucagauuuguauuuugc

SEQ ID NO: 2034264 - RNA, 15 nt, Staphylococcus aureus subsp. aureus Mu50
ucaauccuaaauuau

SEQ ID NO: 2034265 - RNA, 19 nt, Staphylococcus aureus subsp. aureus Mu50
ucaaucgucacaucacguu

SEQ ID NO: 2034266 - RNA, 13 nt, Staphylococcus aureus subsp. aureus Mu50
ucaauauuuucau

SEQ ID NO: 2034267 - RNA, 15 nt, Staphylococcus aureus subsp. aureus Mu50
ucaauauuuucaugu

SEQ ID NO: 2034268 - RNA, 14 nt, Staphylococcus aureus subsp. aureus Mu50
ucaauaugaccuuu

SEQ ID NO: 2034269 - RNA, 14 nt, Staphylococcus aureus subsp. aureus Mu50
ucaauauaaaaagu

SEQ ID NO: 2034270 - RNA, 22 nt, Staphylococcus aureus subsp. aureus Mu50
ucaauagcgguuuaaaaaugcu

SEQ ID NO: 2034271 - RNA, 20 nt, Staphylococcus aureus subsp. aureus Mu50
ucaauaucuucuaauuccau

SEQ ID NO: 2034272 - RNA, 15 nt, Staphylococcus aureus subsp. aureus Mu50
ucaauaucaaauuug

SEQ ID NO: 2034273 - RNA, 13 nt, Staphylococcus aureus subsp. aureus Mu50
ucaauaaauuguu

SEQ ID NO: 2034274 - RNA, 19 nt, Staphylococcus aureus subsp. aureus Mu50
ucaauaaugcguuggcggu

SEQ ID NO: 2034275 - RNA, 19 nt, Staphylococcus aureus subsp. aureus Mu50
ucaauaauuauuaauuuaa

SEQ ID NO: 2034276 - RNA, 21 nt, Staphylococcus aureus subsp. aureus Mu50
ucaauaccauaauuaaauaac

SEQ ID NO: 2034277 - RNA, 22 nt, Staphylococcus aureus subsp. aureus Mu50
ucaauaccauaauuaaauaacu

SEQ ID NO: 2034278 - RNA, 15 nt, Staphylococcus aureus subsp. aureus Mu50
ucaauacaaagaauu

SEQ ID NO: 2034279 - RNA, 16 nt, Staphylococcus aureus subsp. aureus Mu50
ucaauacuugaaagau

SEQ ID NO: 2034280 - RNA, 20 nt, Staphylococcus aureus subsp. aureus Mu50
ucaacgucgaauguuucuuc

SEQ ID NO: 2034281 - RNA, 13 nt, Staphylococcus aureus subsp. aureus Mu50
ucaacuuuucuau

SEQ ID NO: 2034282 - RNA, 17 nt, Staphylococcus aureus subsp. aureus Mu50
ucaagcaaugcaugcuu

SEQ ID NO: 2034283 - RNA, 22 nt, Staphylococcus aureus subsp. aureus Mu50
ucaagauguuugcaacauauuu

SEQ ID NO: 2034284 - RNA, 16 nt, Staphylococcus aureus subsp. aureus Mu50
ucaaacaagauucaua

SEQ ID NO: 2034285 - RNA, 22 nt, Staphylococcus aureus subsp. aureus Mu50
ucaaacaagauucauacacugc

SEQ ID NO: 2034286 - RNA, 23 nt, Staphylococcus aureus subsp. aureus Mu50
ucaaaauuaugacuaacauuggu

SEQ ID NO: 2034287 - RNA, 18 nt, Staphylococcus aureus subsp. aureus Mu50
ucaaaauuucgauuuuca

SEQ ID NO: 2034288 - RNA, 14 nt, Staphylococcus aureus subsp. aureus Mu50
ucaaaguuuucauu

SEQ ID NO: 2034289 - RNA, 21 nt, Staphylococcus aureus subsp. aureus Mu50
ucaaaguuuucauuuuuucaa

SEQ ID NO: 2034290 - RNA, 21 nt, Staphylococcus aureus subsp. aureus Mu50
ucaaauaaaucaaacuuuuca

SEQ ID NO: 2034291 - RNA, 13 nt, Staphylococcus aureus subsp. aureus Mu50
ucaaauaacugag

SEQ ID NO: 2034292 - RNA, 13 nt, Staphylococcus aureus subsp. aureus Mu50
ucaaauaauguga

SEQ ID NO: 2034293 - RNA, 14 nt, Staphylococcus aureus subsp. aureus Mu50
ucaaauacauuuca

SEQ ID NO: 2034294 - RNA, 15 nt, Staphylococcus aureus subsp. aureus Mu50
ucaaauacauuucaa

SEQ ID NO: 2034295 - RNA, 17 nt, Staphylococcus aureus subsp. aureus Mu50
ucaaaucggcuauacau

SEQ ID NO: 2034296 - RNA, 20 nt, Staphylococcus aureus subsp. aureus Mu50
ucaaaugcucccuucaaagu

SEQ ID NO: 2034297 - RNA, 23 nt, Staphylococcus aureus subsp. aureus Mu50
ucaacaacuuuacgauaaauagu

SEQ ID NO: 2034298 - RNA, 21 nt, Staphylococcus aureus subsp. aureus Mu50
ucaacaaaucuauaaauauca

SEQ ID NO: 2034299 - RNA, 18 nt, Staphylococcus aureus subsp. aureus Mu50
ucaacaaacauaaauaag

SEQ ID NO: 2034300 - RNA, 15 nt, Staphylococcus aureus subsp. aureus Mu50
ucaacagauacuuca

SEQ ID NO: 2034301 - RNA, 14 nt, Staphylococcus aureus subsp. aureus Mu50
ucaacauaauauuu

SEQ ID NO: 2034302 - RNA, 14 nt, Staphylococcus aureus subsp. aureus Mu50
ucaacauauuauau

SEQ ID NO: 2034303 - RNA, 12 nt, Staphylococcus aureus subsp. aureus Mu50
ucaacauuaaua

SEQ ID NO: 2034304 - RNA, 16 nt, Staphylococcus aureus subsp. aureus Mu50
ucaacauuaauaaaua

SEQ ID NO: 2034305 - RNA, 11 nt, Staphylococcus aureus subsp. aureus Mu50
ucaacaucaug

SEQ ID NO: 2034306 - RNA, 19 nt, Staphylococcus aureus subsp. aureus Mu50
ucaacauguuccgcuacaa

SEQ ID NO: 2034307 - RNA, 12 nt, Staphylococcus aureus subsp. aureus Mu50
ucaacauuaaaa

SEQ ID NO: 2034308 - RNA, 23 nt, Staphylococcus aureus subsp. aureus Mu50
ucaacauuaaaauguguuuucaa

SEQ ID NO: 2034309 - RNA, 19 nt, Staphylococcus aureus subsp. aureus Mu50
ucaacgccauauuuauuua

SEQ ID NO: 2034310 - RNA, 22 nt, Staphylococcus aureus subsp. aureus Mu50
ucaacgcauauucuauuguugu

SEQ ID NO: 2034311 - RNA, 17 nt, Staphylococcus aureus subsp. aureus Mu50
ucaacgauuuugucuuu

SEQ ID NO: 2034312 - RNA, 16 nt, Staphylococcus aureus subsp. aureus Mu50
uauuucagcuuauuaa

SEQ ID NO: 2034313 - RNA, 20 nt, Staphylococcus aureus subsp. aureus Mu50
uauuucagcuuauuaagcuu

SEQ ID NO: 2034314 - RNA, 19 nt, Staphylococcus aureus subsp. aureus Mu50
uauuucauagggaaauauu

SEQ ID NO: 2034315 - RNA, 16 nt, Staphylococcus aureus subsp. aureus Mu50
uauuuauuuugauuaa

SEQ ID NO: 2034316 - RNA, 14 nt, Staphylococcus aureus subsp. aureus Mu50
uauuucaaauguaa

SEQ ID NO: 2034317 - RNA, 16 nt, Staphylococcus aureus subsp. aureus Mu50
uauuucaauaauaaug

SEQ ID NO: 2034318 - RNA, 22 nt, Staphylococcus aureus subsp. aureus Mu50
uauuuauucgcuuguucaguaa

SEQ ID NO: 2034319 - RNA, 17 nt, Staphylococcus aureus subsp. aureus Mu50
uauuuauuuuaauagug

SEQ ID NO: 2034320 - RNA, 21 nt, Staphylococcus aureus subsp. aureus Mu50
uauuucacacagcuucauuaa

SEQ ID NO: 2034321 - RNA, 22 nt, Staphylococcus aureus subsp. aureus Mu50
uauuuucuuuuucuaaauaaac

SEQ ID NO: 2034322 - RNA, 20 nt, Staphylococcus aureus subsp. aureus Mu50
uauuuugaauaugauauuaa

SEQ ID NO: 2034323 - RNA, 19 nt, Staphylococcus aureus subsp. aureus Mu50
uauuuucugccauaaacau

SEQ ID NO: 2034324 - RNA, 21 nt, Staphylococcus aureus subsp. aureus Mu50
uauuuucauagaugcauaaaa

SEQ ID NO: 2034325 - RNA, 11 nt, Staphylococcus aureus subsp. aureus Mu50
uauuuucauaa

SEQ ID NO: 2034326 - RNA, 12 nt, Staphylococcus aureus subsp. aureus Mu50
uauuuucauaaa

SEQ ID NO: 2034327 - RNA, 18 nt, Staphylococcus aureus subsp. aureus Mu50
uauuuucauaaacucuua

SEQ ID NO: 2034328 - RNA, 16 nt, Staphylococcus aureus subsp. aureus Mu50
uauuuaauuccauuaa

SEQ ID NO: 2034329 - RNA, 15 nt, Staphylococcus aureus subsp. aureus Mu50
uauuuaauuuuucua

SEQ ID NO: 2034330 - RNA, 23 nt, Staphylococcus aureus subsp. aureus Mu50
uauuuaauuuuucuaaaugauuu

SEQ ID NO: 2034331 - RNA, 22 nt, Staphylococcus aureus subsp. aureus Mu50
uauuuacaauguuaucuugcuu

SEQ ID NO: 2034332 - RNA, 22 nt, Staphylococcus aureus subsp. aureus Mu50
uauuuagaaacuuccaacauau

SEQ ID NO: 2034333 - RNA, 23 nt, Staphylococcus aureus subsp. aureus Mu50
uauuuagaaacuuccaacauaua

SEQ ID NO: 2034334 - RNA, 21 nt, Staphylococcus aureus subsp. aureus Mu50
uauuuacacacaugauaauuu

SEQ ID NO: 2034335 - RNA, 17 nt, Staphylococcus aureus subsp. aureus Mu50
uauuuauaaaauaaaau

SEQ ID NO: 2034336 - RNA, 20 nt, Staphylococcus aureus subsp. aureus Mu50
uauuuauacagugaaucuaa

SEQ ID NO: 2034337 - RNA, 12 nt, Staphylococcus aureus subsp. aureus Mu50
uauuuauauuaa

SEQ ID NO: 2034338 - RNA, 13 nt, Staphylococcus aureus subsp. aureus Mu50
uauuuaucaauaa

SEQ ID NO: 2034339 - RNA, 15 nt, Staphylococcus aureus subsp. aureus Mu50
uauuuaucucuuucu

SEQ ID NO: 2034340 - RNA, 12 nt, Staphylococcus aureus subsp. aureus Mu50
uauuuuguuuua

SEQ ID NO: 2034341 - RNA, 12 nt, Staphylococcus aureus subsp. aureus Mu50
uauuuuucauca

SEQ ID NO: 2034342 - RNA, 14 nt, Staphylococcus aureus subsp. aureus Mu50
uauuuuuguauucu

SEQ ID NO: 2034343 - RNA, 15 nt, Staphylococcus aureus subsp. aureus Mu50
uauuuuuuaauaauc

SEQ ID NO: 2034344 - RNA, 13 nt, Staphylococcus aureus subsp. aureus Mu50
uauuuuuaauuau

SEQ ID NO: 2034345 - RNA, 14 nt, Staphylococcus aureus subsp. aureus Mu50
uauuuuuauagaug

SEQ ID NO: 2034346 - RNA, 22 nt, Staphylococcus aureus subsp. aureus Mu50
uauuuuuuuguccaauaaauug

SEQ ID NO: 2034347 - RNA, 17 nt, Staphylococcus aureus subsp. aureus Mu50
ucaaaaaauauuuacau

SEQ ID NO: 2034348 - RNA, 17 nt, Staphylococcus aureus subsp. aureus Mu50
ucaaaaucaaauugacg

SEQ ID NO: 2034349 - RNA, 24 nt, Staphylococcus aureus subsp. aureus Mu50
ucaaaacuagcaguaauauguugc

SEQ ID NO: 2034350 - RNA, 19 nt, Staphylococcus aureus subsp. aureus Mu50
ucaaaaauguuaucuagua

SEQ ID NO: 2034351 - RNA, 16 nt, Staphylococcus aureus subsp. aureus Mu50
uaugcuauauuuaguu

SEQ ID NO: 2034352 - RNA, 21 nt, Staphylococcus aureus subsp. aureus Mu50
uaugcuguguaucaucauaau

SEQ ID NO: 2034353 - RNA, 17 nt, Staphylococcus aureus subsp. aureus Mu50
uaugcuuuaaaucgaua

SEQ ID NO: 2034354 - RNA, 19 nt, Staphylococcus aureus subsp. aureus Mu50
uaugcuguuggcaaaacaa

SEQ ID NO: 2034355 - RNA, 19 nt, Staphylococcus aureus subsp. aureus Mu50
uauggaauuucauauaaug

SEQ ID NO: 2034356 - RNA, 20 nt, Staphylococcus aureus subsp. aureus Mu50
uauggaaaauguauuauucu

SEQ ID NO: 2034357 - RNA, 21 nt, Staphylococcus aureus subsp. aureus Mu50
uauggaaaauguuaucaauau

SEQ ID NO: 2034358 - RNA, 15 nt, Staphylococcus aureus subsp. aureus Mu50
uauuacaaugaaaaa

SEQ ID NO: 2034359 - RNA, 22 nt, Staphylococcus aureus subsp. aureus Mu50
uauuacaccauuguuauagcgu

SEQ ID NO: 2034360 - RNA, 18 nt, Staphylococcus aureus subsp. aureus Mu50
uauuacacuaaaaccuau

SEQ ID NO: 2034361 - RNA, 13 nt, Staphylococcus aureus subsp. aureus Mu50
uauuaauuuacuc

SEQ ID NO: 2034362 - RNA, 15 nt, Staphylococcus aureus subsp. aureus Mu50
uauuaauuugauaaa

SEQ ID NO: 2034363 - RNA, 15 nt, Staphylococcus aureus subsp. aureus Mu50
uauuacaucuauauu

SEQ ID NO: 2034364 - RNA, 21 nt, Staphylococcus aureus subsp. aureus Mu50
uauuacuacauaauuuaucaa

SEQ ID NO: 2034365 - RNA, 15 nt, Staphylococcus aureus subsp. aureus Mu50
uaugcuguguaucau

SEQ ID NO: 2034366 - RNA, 21 nt, Staphylococcus aureus subsp. aureus Mu50
uauugaauuugaauaaguggu

SEQ ID NO: 2034367 - RNA, 15 nt, Staphylococcus aureus subsp. aureus Mu50
uauugagaauugcaa

SEQ ID NO: 2034368 - RNA, 14 nt, Staphylococcus aureus subsp. aureus Mu50
uauugaaugaauuc

SEQ ID NO: 2034369 - RNA, 23 nt, Staphylococcus aureus subsp. aureus Mu50
uauugaauggaguauaucagcuu

SEQ ID NO: 2034370 - RNA, 15 nt, Staphylococcus aureus subsp. aureus Mu50
uauucuuaucauuca

SEQ ID NO: 2034371 - RNA, 23 nt, Staphylococcus aureus subsp. aureus Mu50
uauugaaauaauauaaaaacaaa

SEQ ID NO: 2034372 - RNA, 16 nt, Staphylococcus aureus subsp. aureus Mu50
uauugaacuucuaaca

SEQ ID NO: 2034373 - RNA, 14 nt, Staphylococcus aureus subsp. aureus Mu50
uauuaucauugaua

SEQ ID NO: 2034374 - RNA, 15 nt, Staphylococcus aureus subsp. aureus Mu50
uauucuuuaauauag

SEQ ID NO: 2034375 - RNA, 21 nt, Staphylococcus aureus subsp. aureus Mu50
uauugauaaauauugaacaau

SEQ ID NO: 2034376 - RNA, 21 nt, Staphylococcus aureus subsp. aureus Mu50
uauugauugugacuuguauca

SEQ ID NO: 2034377 - RNA, 19 nt, Staphylococcus aureus subsp. aureus Mu50
uauuauacugcucuuuaua

SEQ ID NO: 2034378 - RNA, 21 nt, Staphylococcus aureus subsp. aureus Mu50
uauuauauuuugaaucaguau

SEQ ID NO: 2034379 - RNA, 17 nt, Staphylococcus aureus subsp. aureus Mu50
uauuauuacaaugaaaa

SEQ ID NO: 2034380 - RNA, 22 nt, Staphylococcus aureus subsp. aureus Mu50
uauuauuacaaugaaaaaacga

SEQ ID NO: 2034381 - RNA, 16 nt, Staphylococcus aureus subsp. aureus Mu50
uauuagccaauaaaau

SEQ ID NO: 2034382 - RNA, 16 nt, Staphylococcus aureus subsp. aureus Mu50
uauuauaaaauagaag

SEQ ID NO: 2034383 - RNA, 14 nt, Staphylococcus aureus subsp. aureus Mu50
uauuaguauucaaa

SEQ ID NO: 2034384 - RNA, 13 nt, Staphylococcus aureus subsp. aureus Mu50
uauccuucaaaga

SEQ ID NO: 2034385 - RNA, 18 nt, Staphylococcus aureus subsp. aureus Mu50
uauccuucaaagauuuua

SEQ ID NO: 2034386 - RNA, 20 nt, Staphylococcus aureus subsp. aureus Mu50
uauccuucucaucauuuuca

SEQ ID NO: 2034387 - RNA, 18 nt, Staphylococcus aureus subsp. aureus Mu50
uaucgauucgauuauuua

SEQ ID NO: 2034388 - RNA, 20 nt, Staphylococcus aureus subsp. aureus Mu50
uaucgauuuaacauaaaaau

SEQ ID NO: 2034389 - RNA, 23 nt, Staphylococcus aureus subsp. aureus Mu50
uaucgagcguaauggauuauuau

SEQ ID NO: 2034390 - RNA, 16 nt, Staphylococcus aureus subsp. aureus Mu50
uaucgcgcaucaaaaa

SEQ ID NO: 2034391 - RNA, 19 nt, Staphylococcus aureus subsp. aureus Mu50
uaucgccuaaaaauaaaau

SEQ ID NO: 2034392 - RNA, 20 nt, Staphylococcus aureus subsp. aureus Mu50
uaucgcccauaccaccaguc

SEQ ID NO: 2034393 - RNA, 19 nt, Staphylococcus aureus subsp. aureus Mu50
uaucucuuuucuauucaaa

SEQ ID NO: 2034394 - RNA, 22 nt, Staphylococcus aureus subsp. aureus Mu50
uaucuucagauucccaaauagu

SEQ ID NO: 2034395 - RNA, 21 nt, Staphylococcus aureus subsp. aureus Mu50
uaugccgccuaauaauaaaau

SEQ ID NO: 2034396 - RNA, 22 nt, Staphylococcus aureus subsp. aureus Mu50
uaugaugaacuuaaugcuucaa

SEQ ID NO: 2034397 - RNA, 16 nt, Staphylococcus aureus subsp. aureus Mu50
uaucuggauuaacugu

SEQ ID NO: 2034398 - RNA, 10 nt, Staphylococcus aureus subsp. aureus Mu50
uaugauauug

SEQ ID NO: 2034399 - RNA, 14 nt, Staphylococcus aureus subsp. aureus Mu50
uaugauauugauug

SEQ ID NO: 2034400 - RNA, 22 nt, Staphylococcus aureus subsp. aureus Mu50
uaucuuuaugauaauuaauuaa

SEQ ID NO: 2034401 - RNA, 12 nt, Staphylococcus aureus subsp. aureus Mu50
uaucuuuauuug

SEQ ID NO: 2034402 - RNA, 19 nt, Staphylococcus aureus subsp. aureus Mu50
uaucuuucaaauuaauuaa

SEQ ID NO: 2034403 - RNA, 22 nt, Staphylococcus aureus subsp. aureus Mu50
uaugauugcaaauuaucauuaa

SEQ ID NO: 2034404 - RNA, 13 nt, Staphylococcus aureus subsp. aureus Mu50
uaugcaaaugaaa

SEQ ID NO: 2034405 - RNA, 13 nt, Staphylococcus aureus subsp. aureus Mu50
ugaagaaaucuau

SEQ ID NO: 2034406 - RNA, 12 nt, Staphylococcus aureus subsp. aureus Mu50
ugaagaaauuug

SEQ ID NO: 2034407 - RNA, 15 nt, Staphylococcus aureus subsp. aureus Mu50
ugaagaauacaaaua

SEQ ID NO: 2034408 - RNA, 19 nt, Staphylococcus aureus subsp. aureus Mu50
ugaaggccauuuuuauuua

SEQ ID NO: 2034409 - RNA, 22 nt, Staphylococcus aureus subsp. aureus Mu50
ugaaguuaacuauaacaauagu

SEQ ID NO: 2034410 - RNA, 21 nt, Staphylococcus aureus subsp. aureus Mu50
ugaagucuugugauaauucuu

SEQ ID NO: 2034411 - RNA, 15 nt, Staphylococcus aureus subsp. aureus Mu50
ugaauaauguuuuca

SEQ ID NO: 2034412 - RNA, 16 nt, Staphylococcus aureus subsp. aureus Mu50
ugaaguuuaaucguau

SEQ ID NO: 2034413 - RNA, 12 nt, Staphylococcus aureus subsp. aureus Mu50
ugaauaaauaac

SEQ ID NO: 2034414 - RNA, 20 nt, Staphylococcus aureus subsp. aureus Mu50
ugaauaaauagauaauauau

SEQ ID NO: 2034415 - RNA, 21 nt, Staphylococcus aureus subsp. aureus Mu50
ugaauaaauagauaauauaua

SEQ ID NO: 2034416 - RNA, 15 nt, Staphylococcus aureus subsp. aureus Mu50
ugaaguaguuucauu

SEQ ID NO: 2034417 - RNA, 14 nt, Staphylococcus aureus subsp. aureus Mu50
ugacaaacauuugu

SEQ ID NO: 2034418 - RNA, 17 nt, Staphylococcus aureus subsp. aureus Mu50
ugaauuucuuuaaguga

SEQ ID NO: 2034419 - RNA, 15 nt, Staphylococcus aureus subsp. aureus Mu50
ugaauuuuacugacu

SEQ ID NO: 2034420 - RNA, 17 nt, Staphylococcus aureus subsp. aureus Mu50
ugaauuuuuauuuuuag

SEQ ID NO: 2034421 - RNA, 17 nt, Staphylococcus aureus subsp. aureus Mu50
ugacaacauaacaaaga

SEQ ID NO: 2034422 - RNA, 12 nt, Staphylococcus aureus subsp. aureus Mu50
ugacaacauuau

SEQ ID NO: 2034423 - RNA, 18 nt, Staphylococcus aureus subsp. aureus Mu50
ugacaagguaugaaauaa

SEQ ID NO: 2034424 - RNA, 13 nt, Staphylococcus aureus subsp. aureus Mu50
ugaauuaaaaaau

SEQ ID NO: 2034425 - RNA, 18 nt, Staphylococcus aureus subsp. aureus Mu50
ugaauguaacguacaauu

SEQ ID NO: 2034426 - RNA, 15 nt, Staphylococcus aureus subsp. aureus Mu50
ugaaugguugauuau

SEQ ID NO: 2034427 - RNA, 17 nt, Staphylococcus aureus subsp. aureus Mu50
ugaauuguuaguuuucu

SEQ ID NO: 2034428 - RNA, 13 nt, Staphylococcus aureus subsp. aureus Mu50
ugaauugacuuac

SEQ ID NO: 2034429 - RNA, 20 nt, Staphylococcus aureus subsp. aureus Mu50
ugaaucgaguuugaaauaau

SEQ ID NO: 2034430 - RNA, 17 nt, Staphylococcus aureus subsp. aureus Mu50
ugaaucugaagguaauu

SEQ ID NO: 2034431 - RNA, 15 nt, Staphylococcus aureus subsp. aureus Mu50
ugaauaugcuuuuaa

SEQ ID NO: 2034432 - RNA, 17 nt, Staphylococcus aureus subsp. aureus Mu50
ugaauaugauauuaagu

SEQ ID NO: 2034433 - RNA, 21 nt, Staphylococcus aureus subsp. aureus Mu50
ugaaauaauauaaaaacaaaa

SEQ ID NO: 2034434 - RNA, 16 nt, Staphylococcus aureus subsp. aureus Mu50
ugaaagauuuguagcu

SEQ ID NO: 2034435 - RNA, 22 nt, Staphylococcus aureus subsp. aureus Mu50
ucuuuuaauauuugauaacaaa

SEQ ID NO: 2034436 - RNA, 12 nt, Staphylococcus aureus subsp. aureus Mu50
ucuuuuaauuaa

SEQ ID NO: 2034437 - RNA, 23 nt, Staphylococcus aureus subsp. aureus Mu50
ucuuuuaccucugauaaaugaau

SEQ ID NO: 2034438 - RNA, 13 nt, Staphylococcus aureus subsp. aureus Mu50
ugaaacuaauaau

SEQ ID NO: 2034439 - RNA, 20 nt, Staphylococcus aureus subsp. aureus Mu50
ugaaacuaauaauuuguaau

SEQ ID NO: 2034440 - RNA, 22 nt, Staphylococcus aureus subsp. aureus Mu50
ucuuuguauaccuauuccuauu

SEQ ID NO: 2034441 - RNA, 23 nt, Staphylococcus aureus subsp. aureus Mu50
ucuuuguuggggcccacacccca

SEQ ID NO: 2034442 - RNA, 13 nt, Staphylococcus aureus subsp. aureus Mu50
ucuuuuaaauuua

SEQ ID NO: 2034443 - RNA, 16 nt, Staphylococcus aureus subsp. aureus Mu50
ucuuuauuaauaaauu

SEQ ID NO: 2034444 - RNA, 19 nt, Staphylococcus aureus subsp. aureus Mu50
ucuuucaacgcauauucua

SEQ ID NO: 2034445 - RNA, 21 nt, Staphylococcus aureus subsp. aureus Mu50
ucuuucaacgcauauucuauu

SEQ ID NO: 2034446 - RNA, 14 nt, Staphylococcus aureus subsp. aureus Mu50
ucuuugaacauauu

SEQ ID NO: 2034447 - RNA, 20 nt, Staphylococcus aureus subsp. aureus Mu50
ucuuugaacauauuauaaaa

SEQ ID NO: 2034448 - RNA, 21 nt, Staphylococcus aureus subsp. aureus Mu50
ucuuugaacauauuauaaaag

SEQ ID NO: 2034449 - RNA, 20 nt, Staphylococcus aureus subsp. aureus Mu50
ucuuucuucagaaccuugaa

SEQ ID NO: 2034450 - RNA, 13 nt, Staphylococcus aureus subsp. aureus Mu50
ugaacuuaaugcu

SEQ ID NO: 2034451 - RNA, 13 nt, Staphylococcus aureus subsp. aureus Mu50
ugaacuuuuauuu

SEQ ID NO: 2034452 - RNA, 23 nt, Staphylococcus aureus subsp. aureus Mu50
ugaacgaaaauucgcuuguaaca

SEQ ID NO: 2034453 - RNA, 19 nt, Staphylococcus aureus subsp. aureus Mu50
ugaaccagcuaaccaaaua

SEQ ID NO: 2034454 - RNA, 22 nt, Staphylococcus aureus subsp. aureus Mu50
ugaaccccauucacuacuuuuu

SEQ ID NO: 2034455 - RNA, 17 nt, Staphylococcus aureus subsp. aureus Mu50
ugaaauuuauuauaauu

SEQ ID NO: 2034456 - RNA, 14 nt, Staphylococcus aureus subsp. aureus Mu50
ugaaauucuuuugu

SEQ ID NO: 2034457 - RNA, 22 nt, Staphylococcus aureus subsp. aureus Mu50
ugaaccaagaaugugaugauua

SEQ ID NO: 2034458 - RNA, 22 nt, Staphylococcus aureus subsp. aureus Mu50
ugaacaacaaauugugauuuac

SEQ ID NO: 2034459 - RNA, 14 nt, Staphylococcus aureus subsp. aureus Mu50
ugaacaacaucuuu

SEQ ID NO: 2034460 - RNA, 20 nt, Staphylococcus aureus subsp. aureus Mu50
ugaacaacaucuuuuguugu

SEQ ID NO: 2034461 - RNA, 18 nt, Staphylococcus aureus subsp. aureus Mu50
ugaaauuucuguaaccaa

SEQ ID NO: 2034462 - RNA, 22 nt, Staphylococcus aureus subsp. aureus Mu50
ugaaaucaguuuuugaauauuu

SEQ ID NO: 2034463 - RNA, 18 nt, Staphylococcus aureus subsp. aureus Mu50
ugaaauauucuuuaauau

SEQ ID NO: 2034464 - RNA, 20 nt, Staphylococcus aureus subsp. aureus Mu50
ugaaagucaacaauugcuaa

SEQ ID NO: 2034465 - RNA, 22 nt, Staphylococcus aureus subsp. aureus Mu50
ugaaauaccuccugauugcugc

SEQ ID NO: 2034466 - RNA, 23 nt, Staphylococcus aureus subsp. aureus Mu50
ugaaauggaaaguaauaaguaau

SEQ ID NO: 2034467 - RNA, 12 nt, Staphylococcus aureus subsp. aureus Mu50
ugacauuucuga

SEQ ID NO: 2034468 - RNA, 15 nt, Staphylococcus aureus subsp. aureus Mu50
ugacauauuuuuuaa

SEQ ID NO: 2034469 - RNA, 19 nt, Staphylococcus aureus subsp. aureus Mu50
ugacauaacagcuaaaaau

SEQ ID NO: 2034470 - RNA, 18 nt, Staphylococcus aureus subsp. aureus Mu50
ugacauaaaacuuacauu

SEQ ID NO: 2034471 - RNA, 22 nt, Staphylococcus aureus subsp. aureus Mu50
ugaccaccuuuaucuguaacaa

SEQ ID NO: 2034472 - RNA, 18 nt, Staphylococcus aureus subsp. aureus Mu50
ugaccaauagaauucauu

SEQ ID NO: 2034473 - RNA, 21 nt, Staphylococcus aureus subsp. aureus Mu50
ugaccaauagaauucauuaau

SEQ ID NO: 2034474 - RNA, 16 nt, Staphylococcus aureus subsp. aureus Mu50
ugaccuucaguuucua

SEQ ID NO: 2034475 - RNA, 13 nt, Staphylococcus aureus subsp. aureus Mu50
ugacgaguagauu

SEQ ID NO: 2034476 - RNA, 15 nt, Staphylococcus aureus subsp. aureus Mu50
ugacgaaaagucagc

SEQ ID NO: 2034477 - RNA, 23 nt, Staphylococcus aureus subsp. aureus Mu50
ugacgaaaugaaugagugcuuau

SEQ ID NO: 2034478 - RNA, 14 nt, Staphylococcus aureus subsp. aureus Mu50
ugaugaaacugauu

SEQ ID NO: 2034479 - RNA, 13 nt, Staphylococcus aureus subsp. aureus Mu50
ugaucuuuuauaa

SEQ ID NO: 2034480 - RNA, 12 nt, Staphylococcus aureus subsp. aureus Mu50
ugaucuuuuuua

SEQ ID NO: 2034481 - RNA, 19 nt, Staphylococcus aureus subsp. aureus Mu50
ugaucgcauguuuguaaau

SEQ ID NO: 2034482 - RNA, 16 nt, Staphylococcus aureus subsp. aureus Mu50
ugauccgccuugauuu

SEQ ID NO: 2034483 - RNA, 21 nt, Staphylococcus aureus subsp. aureus Mu50
ugauccgccuugauuuuuuga

SEQ ID NO: 2034484 - RNA, 23 nt, Staphylococcus aureus subsp. aureus Mu50
ugauccuggaaucgaaaauauca

SEQ ID NO: 2034485 - RNA, 20 nt, Staphylococcus aureus subsp. aureus Mu50
ugaguugaaaauaaucgaac

SEQ ID NO: 2034486 - RNA, 12 nt, Staphylococcus aureus subsp. aureus Mu50
ugauaaauaaaa

SEQ ID NO: 2034487 - RNA, 11 nt, Staphylococcus aureus subsp. aureus Mu50
ugauaaauaau

SEQ ID NO: 2034488 - RNA, 14 nt, Staphylococcus aureus subsp. aureus Mu50
ugauaaaauaaaua

SEQ ID NO: 2034489 - RNA, 23 nt, Staphylococcus aureus subsp. aureus Mu50
ugaguuuuuuaaaauaaugauau

SEQ ID NO: 2034490 - RNA, 14 nt, Staphylococcus aureus subsp. aureus Mu50
ugauaaaacuaaug

SEQ ID NO: 2034491 - RNA, 13 nt, Staphylococcus aureus subsp. aureus Mu50
ugcacaaacaaaa

SEQ ID NO: 2034492 - RNA, 19 nt, Staphylococcus aureus subsp. aureus Mu50
ugcacaaagauauguuuau

SEQ ID NO: 2034493 - RNA, 11 nt, Staphylococcus aureus subsp. aureus Mu50
ugcaaugcaaa

SEQ ID NO: 2034494 - RNA, 14 nt, Staphylococcus aureus subsp. aureus Mu50
ugcaaugcaaaucu

SEQ ID NO: 2034495 - RNA, 22 nt, Staphylococcus aureus subsp. aureus Mu50
ugcaagucguucucuuaaauau

SEQ ID NO: 2034496 - RNA, 19 nt, Staphylococcus aureus subsp. aureus Mu50
ugcaauaggaugaaacuuu

SEQ ID NO: 2034497 - RNA, 16 nt, Staphylococcus aureus subsp. aureus Mu50
ugaugcgcuucuaacu

SEQ ID NO: 2034498 - RNA, 19 nt, Staphylococcus aureus subsp. aureus Mu50
ugauggaaaaguuuuuuac

SEQ ID NO: 2034499 - RNA, 15 nt, Staphylococcus aureus subsp. aureus Mu50
ugauggaaaauuauu

SEQ ID NO: 2034500 - RNA, 23 nt, Staphylococcus aureus subsp. aureus Mu50
ugauggaaaauuauuugauauuu

SEQ ID NO: 2034501 - RNA, 15 nt, Staphylococcus aureus subsp. aureus Mu50
ugauuaguaaauaua

SEQ ID NO: 2034502 - RNA, 17 nt, Staphylococcus aureus subsp. aureus Mu50
ugauuaguaauuuuuaa

SEQ ID NO: 2034503 - RNA, 15 nt, Staphylococcus aureus subsp. aureus Mu50
ugauuauaaauacau

SEQ ID NO: 2034504 - RNA, 14 nt, Staphylococcus aureus subsp. aureus Mu50
ugauuauauauauu

SEQ ID NO: 2034505 - RNA, 15 nt, Staphylococcus aureus subsp. aureus Mu50
ugauuauauuuuucu

SEQ ID NO: 2034506 - RNA, 14 nt, Staphylococcus aureus subsp. aureus Mu50
ugauuauucuucau

SEQ ID NO: 2034507 - RNA, 17 nt, Staphylococcus aureus subsp. aureus Mu50
ugauucaaauaaaucaa

SEQ ID NO: 2034508 - RNA, 22 nt, Staphylococcus aureus subsp. aureus Mu50
ugauuagcgcaccaauuaucaa

SEQ ID NO: 2034509 - RNA, 11 nt, Staphylococcus aureus subsp. aureus Mu50
ugauuaagugu

SEQ ID NO: 2034510 - RNA, 16 nt, Staphylococcus aureus subsp. aureus Mu50
ugauuaauaaaguaau

SEQ ID NO: 2034511 - RNA, 12 nt, Staphylococcus aureus subsp. aureus Mu50
ugauuaacacaa

SEQ ID NO: 2034512 - RNA, 22 nt, Staphylococcus aureus subsp. aureus Mu50
ugauuaacauuuugaaucauac

SEQ ID NO: 2034513 - RNA, 12 nt, Staphylococcus aureus subsp. aureus Mu50
ugauuaaucuau

SEQ ID NO: 2034514 - RNA, 15 nt, Staphylococcus aureus subsp. aureus Mu50
ugauggauauucaau

SEQ ID NO: 2034515 - RNA, 19 nt, Staphylococcus aureus subsp. aureus Mu50
ugauuaaaauguuagguga

SEQ ID NO: 2034516 - RNA, 16 nt, Staphylococcus aureus subsp. aureus Mu50
ugauuaaagcgauaau

SEQ ID NO: 2034517 - RNA, 17 nt, Staphylococcus aureus subsp. aureus Mu50
ugauuaaaguguuucaa

SEQ ID NO: 2034518 - RNA, 20 nt, Staphylococcus aureus subsp. aureus Mu50
ugcaaaucaaauacaucaau

SEQ ID NO: 2034519 - RNA, 19 nt, Staphylococcus aureus subsp. aureus Mu50
ugauuuugcuuuauuuucu

SEQ ID NO: 2034520 - RNA, 18 nt, Staphylococcus aureus subsp. aureus Mu50
ugauuuuuguaauugaug

SEQ ID NO: 2034521 - RNA, 18 nt, Staphylococcus aureus subsp. aureus Mu50
ugcaaaaucaacccauca

SEQ ID NO: 2034522 - RNA, 14 nt, Staphylococcus aureus subsp. aureus Mu50
ugauucuacagcau

SEQ ID NO: 2034523 - RNA, 15 nt, Staphylococcus aureus subsp. aureus Mu50
ugauuuuacuugaau

SEQ ID NO: 2034524 - RNA, 22 nt, Staphylococcus aureus subsp. aureus Mu50
ugauuuuuauuauugucaucau

SEQ ID NO: 2034525 - RNA, 14 nt, Staphylococcus aureus subsp. aureus Mu50
ugauuuuucaucaa

SEQ ID NO: 2034526 - RNA, 14 nt, Staphylococcus aureus subsp. aureus Mu50
ugauuuuucauuga

SEQ ID NO: 2034527 - RNA, 21 nt, Staphylococcus aureus subsp. aureus Mu50
ugauuugugguaaucauguaa

SEQ ID NO: 2034528 - RNA, 16 nt, Staphylococcus aureus subsp. aureus Mu50
ugauuuguuacuucua

SEQ ID NO: 2034529 - RNA, 14 nt, Staphylococcus aureus subsp. aureus Mu50
ugauuccacuacaa

SEQ ID NO: 2034530 - RNA, 22 nt, Staphylococcus aureus subsp. aureus Mu50
ugauucaccagguuuuuuauuu

SEQ ID NO: 2034531 - RNA, 15 nt, Staphylococcus aureus subsp. aureus Mu50
ugauucguauucaaa

SEQ ID NO: 2034532 - RNA, 20 nt, Staphylococcus aureus subsp. aureus Mu50
ugacugauuuuuuuuaugca

SEQ ID NO: 2034533 - RNA, 12 nt, Staphylococcus aureus subsp. aureus Mu50
ugacugaaugag

SEQ ID NO: 2034534 - RNA, 14 nt, Staphylococcus aureus subsp. aureus Mu50
ugacuguaaaacaa

SEQ ID NO: 2034535 - RNA, 18 nt, Staphylococcus aureus subsp. aureus Mu50
ugacuuauuuuucaucau

SEQ ID NO: 2034536 - RNA, 17 nt, Staphylococcus aureus subsp. aureus Mu50
ugagggccccaacacag

SEQ ID NO: 2034537 - RNA, 21 nt, Staphylococcus aureus subsp. aureus Mu50
ugccuauuugacacauuauug

SEQ ID NO: 2034538 - RNA, 17 nt, Staphylococcus aureus subsp. aureus Mu50
ugcgccugcuaaaaagu

SEQ ID NO: 2034539 - RNA, 21 nt, Staphylococcus aureus subsp. aureus Mu50
ugcccaucucgugaaaauaau

SEQ ID NO: 2034540 - RNA, 13 nt, Staphylococcus aureus subsp. aureus Mu50
ugcauacauaucu

SEQ ID NO: 2034541 - RNA, 17 nt, Staphylococcus aureus subsp. aureus Mu50
ugcauaccuauaaacau

SEQ ID NO: 2034542 - RNA, 15 nt, Staphylococcus aureus subsp. aureus Mu50
ugcauaaaaaaagaa

SEQ ID NO: 2034543 - RNA, 15 nt, Staphylococcus aureus subsp. aureus Mu50
ugcaccuauaauagc

SEQ ID NO: 2034544 - RNA, 21 nt, Staphylococcus aureus subsp. aureus Mu50
ugcauagguaaccuuaaauau

SEQ ID NO: 2034545 - RNA, 16 nt, Staphylococcus aureus subsp. aureus Mu50
ugcaugcgcaaaagcg

SEQ ID NO: 2034546 - RNA, 15 nt, Staphylococcus aureus subsp. aureus Mu50
ugccgagauuauuau

SEQ ID NO: 2034547 - RNA, 15 nt, Staphylococcus aureus subsp. aureus Mu50
ucgauuuuauaucuu

SEQ ID NO: 2034548 - RNA, 16 nt, Staphylococcus aureus subsp. aureus Mu50
ucgauugguaaaucua

SEQ ID NO: 2034549 - RNA, 17 nt, Staphylococcus aureus subsp. aureus Mu50
ucgauucaugaauaauu

SEQ ID NO: 2034550 - RNA, 18 nt, Staphylococcus aureus subsp. aureus Mu50
ucgauuauucuuaauuua

SEQ ID NO: 2034551 - RNA, 20 nt, Staphylococcus aureus subsp. aureus Mu50
ucgauuauuuagauaaaaau

SEQ ID NO: 2034552 - RNA, 15 nt, Staphylococcus aureus subsp. aureus Mu50
ucgaugacuuuuuaa

SEQ ID NO: 2034553 - RNA, 21 nt, Staphylococcus aureus subsp. aureus Mu50
ucgauacuaaacgauaaauua

SEQ ID NO: 2034554 - RNA, 21 nt, Staphylococcus aureus subsp. aureus Mu50
ucgauaguucuauauaauuua

SEQ ID NO: 2034555 - RNA, 14 nt, Staphylococcus aureus subsp. aureus Mu50
ucgaguaauacuuu

SEQ ID NO: 2034556 - RNA, 20 nt, Staphylococcus aureus subsp. aureus Mu50
ucgagcuaggguuaaaauua

SEQ ID NO: 2034557 - RNA, 15 nt, Staphylococcus aureus subsp. aureus Mu50
uccggggccccaaca

SEQ ID NO: 2034558 - RNA, 21 nt, Staphylococcus aureus subsp. aureus Mu50
ucgcauacugucaucuuucaa

SEQ ID NO: 2034559 - RNA, 17 nt, Staphylococcus aureus subsp. aureus Mu50
ucgcgcaucaaaaauga

SEQ ID NO: 2034560 - RNA, 18 nt, Staphylococcus aureus subsp. aureus Mu50
ucucauugaaaucgucuu

SEQ ID NO: 2034561 - RNA, 16 nt, Staphylococcus aureus subsp. aureus Mu50
ucuaacgguaaauaac

SEQ ID NO: 2034562 - RNA, 23 nt, Staphylococcus aureus subsp. aureus Mu50
ucuaacuuuaccaauaucaugca

SEQ ID NO: 2034563 - RNA, 13 nt, Staphylococcus aureus subsp. aureus Mu50
ucuaagaguugaa

SEQ ID NO: 2034564 - RNA, 23 nt, Staphylococcus aureus subsp. aureus Mu50
ucuaagucucuugucauuucaau

SEQ ID NO: 2034565 - RNA, 16 nt, Staphylococcus aureus subsp. aureus Mu50
ucuagacuuauuugaa

SEQ ID NO: 2034566 - RNA, 21 nt, Staphylococcus aureus subsp. aureus Mu50
ucuagacuuauuugaaugcaa

SEQ ID NO: 2034567 - RNA, 17 nt, Staphylococcus aureus subsp. aureus Mu50
ucuagagauaacuagaa

SEQ ID NO: 2034568 - RNA, 23 nt, Staphylococcus aureus subsp. aureus Mu50
ucuaauacuuucacuuuuuauau

SEQ ID NO: 2034569 - RNA, 13 nt, Staphylococcus aureus subsp. aureus Mu50
ucuauauuaauag

SEQ ID NO: 2034570 - RNA, 20 nt, Staphylococcus aureus subsp. aureus Mu50
ucuauacaauuauggauaaa

SEQ ID NO: 2034571 - RNA, 20 nt, Staphylococcus aureus subsp. aureus Mu50
ucuauagguuuauaaaaaau

SEQ ID NO: 2034572 - RNA, 13 nt, Staphylococcus aureus subsp. aureus Mu50
ucuaucaaauaau

SEQ ID NO: 2034573 - RNA, 14 nt, Staphylococcus aureus subsp. aureus Mu50
ucuagguuagaauu

SEQ ID NO: 2034574 - RNA, 19 nt, Staphylococcus aureus subsp. aureus Mu50
ucuagguuagaauuauuuu

SEQ ID NO: 2034575 - RNA, 16 nt, Staphylococcus aureus subsp. aureus Mu50
ucuaguuauuucauag

SEQ ID NO: 2034576 - RNA, 13 nt, Staphylococcus aureus subsp. aureus Mu50
ucuaguuguuuua

SEQ ID NO: 2034577 - RNA, 17 nt, Staphylococcus aureus subsp. aureus Mu50
ucuaguuuucaugaaaa

SEQ ID NO: 2034578 - RNA, 12 nt, Staphylococcus aureus subsp. aureus Mu50
ucuaaaugauuu

SEQ ID NO: 2034579 - RNA, 16 nt, Staphylococcus aureus subsp. aureus Mu50
ucuaacaauauauaau

SEQ ID NO: 2034580 - RNA, 15 nt, Staphylococcus aureus subsp. aureus Mu50
ucuaacaguuaauau

SEQ ID NO: 2034581 - RNA, 16 nt, Staphylococcus aureus subsp. aureus Mu50
ucuaaacuauaauaau

SEQ ID NO: 2034582 - RNA, 12 nt, Staphylococcus aureus subsp. aureus Mu50
ucuaaauauauu

SEQ ID NO: 2034583 - RNA, 15 nt, Staphylococcus aureus subsp. aureus Mu50
ucuaaauaaaauuaa

SEQ ID NO: 2034584 - RNA, 23 nt, Staphylococcus aureus subsp. aureus Mu50
ucuaaaaguuguaauuuaaaaua

SEQ ID NO: 2034585 - RNA, 13 nt, Staphylococcus aureus subsp. aureus Mu50
ucguuuuacuacu

SEQ ID NO: 2034586 - RNA, 17 nt, Staphylococcus aureus subsp. aureus Mu50
ucguuguucauaaucau

SEQ ID NO: 2034587 - RNA, 17 nt, Staphylococcus aureus subsp. aureus Mu50
ucguuguaaaacuaagu

SEQ ID NO: 2034588 - RNA, 19 nt, Staphylococcus aureus subsp. aureus Mu50
ucguuguaccaccccaacu

SEQ ID NO: 2034589 - RNA, 22 nt, Staphylococcus aureus subsp. aureus Mu50
ucguagcaugacauuaaggcuu

SEQ ID NO: 2034590 - RNA, 17 nt, Staphylococcus aureus subsp. aureus Mu50
ucguauuagccaauaaa

SEQ ID NO: 2034591 - RNA, 14 nt, Staphylococcus aureus subsp. aureus Mu50
ucguauucuuuuaa

SEQ ID NO: 2034592 - RNA, 21 nt, Staphylococcus aureus subsp. aureus Mu50
ucggcaugaugcgcuucuaac

SEQ ID NO: 2034593 - RNA, 14 nt, Staphylococcus aureus subsp. aureus Mu50
gcuucuaacaaauu

SEQ ID NO: 2034594 - RNA, 22 nt, Staphylococcus aureus subsp. aureus Mu50
gcuucaucaguuguguaauaaa

SEQ ID NO: 2034595 - RNA, 14 nt, Staphylococcus aureus subsp. aureus Mu50
gcuucauguucuaa

SEQ ID NO: 2034596 - RNA, 12 nt, Staphylococcus aureus subsp. aureus Mu50
gcuuauugaaaa

SEQ ID NO: 2034597 - RNA, 16 nt, Staphylococcus aureus subsp. aureus Mu50
gcuucaaagucaaaaa

SEQ ID NO: 2034598 - RNA, 13 nt, Staphylococcus aureus subsp. aureus Mu50
gcuuaaaccuuaa

SEQ ID NO: 2034599 - RNA, 16 nt, Staphylococcus aureus subsp. aureus Mu50
gcuuacaauaaucacu

SEQ ID NO: 2034600 - RNA, 17 nt, Staphylococcus aureus subsp. aureus Mu50
gcuguucaacaucuuua

SEQ ID NO: 2034601 - RNA, 20 nt, Staphylococcus aureus subsp. aureus Mu50
gcuguccgaggcuaauuuua

SEQ ID NO: 2034602 - RNA, 19 nt, Staphylococcus aureus subsp. aureus Mu50
gcuuugucuuggauguuuu

SEQ ID NO: 2034603 - RNA, 22 nt, Staphylococcus aureus subsp. aureus Mu50
gcuuugaguguguccaucauuu

SEQ ID NO: 2034604 - RNA, 18 nt, Staphylococcus aureus subsp. aureus Mu50
ggaaaccguuuagaaaga

SEQ ID NO: 2034605 - RNA, 17 nt, Staphylococcus aureus subsp. aureus Mu50
gcuugugaaugguugau

SEQ ID NO: 2034606 - RNA, 16 nt, Staphylococcus aureus subsp. aureus Mu50
ggaaauauuugaaaau

SEQ ID NO: 2034607 - RNA, 21 nt, Staphylococcus aureus subsp. aureus Mu50
ggaacauuucaauccuuuguu

SEQ ID NO: 2034608 - RNA, 12 nt, Staphylococcus aureus subsp. aureus Mu50
ggaacauauuca

SEQ ID NO: 2034609 - RNA, 21 nt, Staphylococcus aureus subsp. aureus Mu50
ggaauaauuuuaaaaauaaaa

SEQ ID NO: 2034610 - RNA, 14 nt, Staphylococcus aureus subsp. aureus Mu50
ggaauuuaccauuu

SEQ ID NO: 2034611 - RNA, 18 nt, Staphylococcus aureus subsp. aureus Mu50
gcugauacccaaucauuc

SEQ ID NO: 2034612 - RNA, 16 nt, Staphylococcus aureus subsp. aureus Mu50
gcugacauuuuuggcu

SEQ ID NO: 2034613 - RNA, 20 nt, Staphylococcus aureus subsp. aureus Mu50
gcucuauggcuucgcuaaua

SEQ ID NO: 2034614 - RNA, 17 nt, Staphylococcus aureus subsp. aureus Mu50
gcuacaaaacauauuca

SEQ ID NO: 2034615 - RNA, 17 nt, Staphylococcus aureus subsp. aureus Mu50
gcuaauuuuaauuuuca

SEQ ID NO: 2034616 - RNA, 18 nt, Staphylococcus aureus subsp. aureus Mu50
gcuaauccauacguauca

SEQ ID NO: 2034617 - RNA, 14 nt, Staphylococcus aureus subsp. aureus Mu50
gcuaauacuaauca

SEQ ID NO: 2034618 - RNA, 15 nt, Staphylococcus aureus subsp. aureus Mu50
gcuaaugucaugaaa

SEQ ID NO: 2034619 - RNA, 13 nt, Staphylococcus aureus subsp. aureus Mu50
gcguaauuauuau

SEQ ID NO: 2034620 - RNA, 23 nt, Staphylococcus aureus subsp. aureus Mu50
gcgucuaucuccgcuacaauuau

SEQ ID NO: 2034621 - RNA, 15 nt, Staphylococcus aureus subsp. aureus Mu50
gcgugaagagaugaa

SEQ ID NO: 2034622 - RNA, 16 nt, Staphylococcus aureus subsp. aureus Mu50
gcguuguguaacuuua

SEQ ID NO: 2034623 - RNA, 15 nt, Staphylococcus aureus subsp. aureus Mu50
gccuuuugaauaauu

SEQ ID NO: 2034624 - RNA, 19 nt, Staphylococcus aureus subsp. aureus Mu50
gccuugauuuuuugaaaug

SEQ ID NO: 2034625 - RNA, 14 nt, Staphylococcus aureus subsp. aureus Mu50
gccuauuuaaaaga

SEQ ID NO: 2034626 - RNA, 16 nt, Staphylococcus aureus subsp. aureus Mu50
gucgagauuuuauaag

SEQ ID NO: 2034627 - RNA, 13 nt, Staphylococcus aureus subsp. aureus Mu50
gucgcuaauaaac

SEQ ID NO: 2034628 - RNA, 14 nt, Staphylococcus aureus subsp. aureus Mu50
gucccgcuuaaaau

SEQ ID NO: 2034629 - RNA, 14 nt, Staphylococcus aureus subsp. aureus Mu50
gucacguaaaauau

SEQ ID NO: 2034630 - RNA, 19 nt, Staphylococcus aureus subsp. aureus Mu50
guccguuuuauauuuauuu

SEQ ID NO: 2034631 - RNA, 14 nt, Staphylococcus aureus subsp. aureus Mu50
gucgaagaagauua

SEQ ID NO: 2034632 - RNA, 18 nt, Staphylococcus aureus subsp. aureus Mu50
gucgaaauuguucuaaua

SEQ ID NO: 2034633 - RNA, 23 nt, Staphylococcus aureus subsp. aureus Mu50
gugacacuguaacgaguccauuu

SEQ ID NO: 2034634 - RNA, 12 nt, Staphylococcus aureus subsp. aureus Mu50
gugacaacauua

SEQ ID NO: 2034635 - RNA, 20 nt, Staphylococcus aureus subsp. aureus Mu50
gucguaacucuuuaauuuua

SEQ ID NO: 2034636 - RNA, 20 nt, Staphylococcus aureus subsp. aureus Mu50
gucgucaaaaacagacgaaa

SEQ ID NO: 2034637 - RNA, 19 nt, Staphylococcus aureus subsp. aureus Mu50
gugauuuaaaaaauuuaau

SEQ ID NO: 2034638 - RNA, 14 nt, Staphylococcus aureus subsp. aureus Mu50
gugauuaauuucau

SEQ ID NO: 2034639 - RNA, 18 nt, Staphylococcus aureus subsp. aureus Mu50
gugcaaauaaaaaaguua

SEQ ID NO: 2034640 - RNA, 22 nt, Staphylococcus aureus subsp. aureus Mu50
gugcaacaaacgcugauuuaau

SEQ ID NO: 2034641 - RNA, 18 nt, Staphylococcus aureus subsp. aureus Mu50
gugacgcugguaauauuu

SEQ ID NO: 2034642 - RNA, 16 nt, Staphylococcus aureus subsp. aureus Mu50
gugacucaaugaauuu

SEQ ID NO: 2034643 - RNA, 15 nt, Staphylococcus aureus subsp. aureus Mu50
gugacuuguaucauc

SEQ ID NO: 2034644 - RNA, 13 nt, Staphylococcus aureus subsp. aureus Mu50
guaccaaauaaau

SEQ ID NO: 2034645 - RNA, 14 nt, Staphylococcus aureus subsp. aureus Mu50
guacauuuauuuuc

SEQ ID NO: 2034646 - RNA, 18 nt, Staphylococcus aureus subsp. aureus Mu50
guacauuuaauggucuaa

SEQ ID NO: 2034647 - RNA, 15 nt, Staphylococcus aureus subsp. aureus Mu50
guacauaaauaccug

SEQ ID NO: 2034648 - RNA, 18 nt, Staphylococcus aureus subsp. aureus Mu50
guacauauguguaugaua

SEQ ID NO: 2034649 - RNA, 19 nt, Staphylococcus aureus subsp. aureus Mu50
guacaccucuaaguucacc

SEQ ID NO: 2034650 - RNA, 14 nt, Staphylococcus aureus subsp. aureus Mu50
guacaccauaaaug

SEQ ID NO: 2034651 - RNA, 18 nt, Staphylococcus aureus subsp. aureus Mu50
guacaaauaacaaacauu

SEQ ID NO: 2034652 - RNA, 12 nt, Staphylococcus aureus subsp. aureus Mu50
guaaugauauua

SEQ ID NO: 2034653 - RNA, 13 nt, Staphylococcus aureus subsp. aureus Mu50
guaaugucccguu

SEQ ID NO: 2034654 - RNA, 23 nt, Staphylococcus aureus subsp. aureus Mu50
guaaugcuuaaaaacaauauuga

SEQ ID NO: 2034655 - RNA, 16 nt, Staphylococcus aureus subsp. aureus Mu50
guaauggauugauaau

SEQ ID NO: 2034656 - RNA, 22 nt, Staphylococcus aureus subsp. aureus Mu50
guaagagcucucguguauacaa

SEQ ID NO: 2034657 - RNA, 16 nt, Staphylococcus aureus subsp. aureus Mu50
guaagacgauuucaau

SEQ ID NO: 2034658 - RNA, 13 nt, Staphylococcus aureus subsp. aureus Mu50
guaacuauugaaa

SEQ ID NO: 2034659 - RNA, 21 nt, Staphylococcus aureus subsp. aureus Mu50
gguucauuagcauuauuauuu

SEQ ID NO: 2034660 - RNA, 15 nt, Staphylococcus aureus subsp. aureus Mu50
guaaaggugauauuu

SEQ ID NO: 2034661 - RNA, 13 nt, Staphylococcus aureus subsp. aureus Mu50
guaaaucaucaua

SEQ ID NO: 2034662 - RNA, 14 nt, Staphylococcus aureus subsp. aureus Mu50
guaaaucaugacau

SEQ ID NO: 2034663 - RNA, 15 nt, Staphylococcus aureus subsp. aureus Mu50
guaaauuuaucauuu

SEQ ID NO: 2034664 - RNA, 21 nt, Staphylococcus aureus subsp. aureus Mu50
guaaagggagguauauacaau

SEQ ID NO: 2034665 - RNA, 20 nt, Staphylococcus aureus subsp. aureus Mu50
gguuugaguaaauuaauaga

SEQ ID NO: 2034666 - RNA, 13 nt, Staphylococcus aureus subsp. aureus Mu50
ggugcuaaauuua

SEQ ID NO: 2034667 - RNA, 22 nt, Staphylococcus aureus subsp. aureus Mu50
gguggagauuguaaaaauacau

SEQ ID NO: 2034668 - RNA, 12 nt, Staphylococcus aureus subsp. aureus Mu50
gguuaacacguu

SEQ ID NO: 2034669 - RNA, 18 nt, Staphylococcus aureus subsp. aureus Mu50
gucacauguaccacauuu

SEQ ID NO: 2034670 - RNA, 16 nt, Staphylococcus aureus subsp. aureus Mu50
guaugguugauuacaa

SEQ ID NO: 2034671 - RNA, 12 nt, Staphylococcus aureus subsp. aureus Mu50
guauauugcuua

SEQ ID NO: 2034672 - RNA, 22 nt, Staphylococcus aureus subsp. aureus Mu50
guaucacauucaauauuugaac

SEQ ID NO: 2034673 - RNA, 17 nt, Staphylococcus aureus subsp. aureus Mu50
guauagaugcuaaugua

SEQ ID NO: 2034674 - RNA, 15 nt, Staphylococcus aureus subsp. aureus Mu50
guauauaauugauug

SEQ ID NO: 2034675 - RNA, 21 nt, Staphylococcus aureus subsp. aureus Mu50
guauaaccauaaugaacagua

SEQ ID NO: 2034676 - RNA, 15 nt, Staphylococcus aureus subsp. aureus Mu50
guauacuaaacuuuu

SEQ ID NO: 2034677 - RNA, 16 nt, Staphylococcus aureus subsp. aureus Mu50
guauacaaauugauuu

SEQ ID NO: 2034678 - RNA, 15 nt, Staphylococcus aureus subsp. aureus Mu50
guauaaaacuaauua

SEQ ID NO: 2034679 - RNA, 10 nt, Staphylococcus aureus subsp. aureus Mu50
guauaaaaca

SEQ ID NO: 2034680 - RNA, 20 nt, Staphylococcus aureus subsp. aureus Mu50
guaguugguggaugucaugu

SEQ ID NO: 2034681 - RNA, 16 nt, Staphylococcus aureus subsp. aureus Mu50
guaugacugcaaauac

SEQ ID NO: 2034682 - RNA, 17 nt, Staphylococcus aureus subsp. aureus Mu50
guaugacaguaaucaaa

SEQ ID NO: 2034683 - RNA, 21 nt, Staphylococcus aureus subsp. aureus Mu50
guagcuugaauaauauauuua

SEQ ID NO: 2034684 - RNA, 15 nt, Staphylococcus aureus subsp. aureus Mu50
guaggacauauaaau

SEQ ID NO: 2034685 - RNA, 20 nt, Staphylococcus aureus subsp. aureus Mu50
guaguacacgaauucauuaa

SEQ ID NO: 2034686 - RNA, 20 nt, Staphylococcus aureus subsp. aureus Mu50
guagauucaaauugguuuuc

SEQ ID NO: 2034687 - RNA, 12 nt, Staphylococcus aureus subsp. aureus Mu50
guacuucuaauu

SEQ ID NO: 2034688 - RNA, 12 nt, Staphylococcus aureus subsp. aureus Mu50
guacuuaauuua

SEQ ID NO: 2034689 - RNA, 15 nt, Staphylococcus aureus subsp. aureus Mu50
guagccaaauaaauu

SEQ ID NO: 2034690 - RNA, 16 nt, Staphylococcus aureus subsp. aureus Mu50
guacgacgguauaaaa

SEQ ID NO: 2034691 - RNA, 16 nt, Staphylococcus aureus subsp. aureus Mu50
guacguuaaucaguga

SEQ ID NO: 2034692 - RNA, 17 nt, Staphylococcus aureus subsp. aureus Mu50
guacuaacccaacgaug

SEQ ID NO: 2034693 - RNA, 20 nt, Staphylococcus aureus subsp. aureus Mu50
guacuacauaccgauuuuca

SEQ ID NO: 2034694 - RNA, 21 nt, Staphylococcus aureus subsp. aureus Mu50
gguacaccuacaaauauuucu

SEQ ID NO: 2034695 - RNA, 20 nt, Staphylococcus aureus subsp. aureus Mu50
gguaaaacaucguaaagauc

SEQ ID NO: 2034696 - RNA, 17 nt, Staphylococcus aureus subsp. aureus Mu50
gggugggacgacgaaau

SEQ ID NO: 2034697 - RNA, 19 nt, Staphylococcus aureus subsp. aureus Mu50
gggugggacgacgaaauaa

SEQ ID NO: 2034698 - RNA, 16 nt, Staphylococcus aureus subsp. aureus Mu50
gguaugaaauaacaau

SEQ ID NO: 2034699 - RNA, 22 nt, Staphylococcus aureus subsp. aureus Mu50
gguauccuucucaucauuuuca

SEQ ID NO: 2034700 - RNA, 20 nt, Staphylococcus aureus subsp. aureus Mu50
ggucaaugacugagaaaaau

SEQ ID NO: 2034701 - RNA, 14 nt, Staphylococcus aureus subsp. aureus Mu50
gguauauuaaaaau

SEQ ID NO: 2034702 - RNA, 17 nt, Staphylococcus aureus subsp. aureus Mu50
ggucuucgcaaucauua

SEQ ID NO: 2034703 - RNA, 21 nt, Staphylococcus aureus subsp. aureus Mu50
ggucuacgaucaaaaucaugc

SEQ ID NO: 2034704 - RNA, 19 nt, Staphylococcus aureus subsp. aureus Mu50
ggcaauugagaaauagcaa

SEQ ID NO: 2034705 - RNA, 19 nt, Staphylococcus aureus subsp. aureus Mu50
ggcuuugaagggagcauuu

SEQ ID NO: 2034706 - RNA, 14 nt, Staphylococcus aureus subsp. aureus Mu50
ggcuuuuucuuuug

SEQ ID NO: 2034707 - RNA, 18 nt, Staphylococcus aureus subsp. aureus Mu50
cucucaaugcauuuaauu

SEQ ID NO: 2034708 - RNA, 20 nt, Staphylococcus aureus subsp. aureus Mu50
cucucaaugcauuuaauuua

SEQ ID NO: 2034709 - RNA, 17 nt, Staphylococcus aureus subsp. aureus Mu50
cucguuaaaucacauau

SEQ ID NO: 2034710 - RNA, 19 nt, Staphylococcus aureus subsp. aureus Mu50
cugaaacgccucaacacuu

SEQ ID NO: 2034711 - RNA, 17 nt, Staphylococcus aureus subsp. aureus Mu50
cucuucguuuuaauaaa

SEQ ID NO: 2034712 - RNA, 14 nt, Staphylococcus aureus subsp. aureus Mu50
cucguaguucgaca

SEQ ID NO: 2034713 - RNA, 14 nt, Staphylococcus aureus subsp. aureus Mu50
cugauaaugcaugu

SEQ ID NO: 2034714 - RNA, 19 nt, Staphylococcus aureus subsp. aureus Mu50
cugauaaaugaauugucuu

SEQ ID NO: 2034715 - RNA, 18 nt, Staphylococcus aureus subsp. aureus Mu50
cugaguucaauuaaauua

SEQ ID NO: 2034716 - RNA, 18 nt, Staphylococcus aureus subsp. aureus Mu50
cugaguauaccaauugcu

SEQ ID NO: 2034717 - RNA, 16 nt, Staphylococcus aureus subsp. aureus Mu50
cugauucgauggauac

SEQ ID NO: 2034718 - RNA, 20 nt, Staphylococcus aureus subsp. aureus Mu50
cugauuuuauaaaguuugua

SEQ ID NO: 2034719 - RNA, 16 nt, Staphylococcus aureus subsp. aureus Mu50
cugauuuaauagcuaa

SEQ ID NO: 2034720 - RNA, 20 nt, Staphylococcus aureus subsp. aureus Mu50
cugauuacauauacgacauu

SEQ ID NO: 2034721 - RNA, 21 nt, Staphylococcus aureus subsp. aureus Mu50
cugaagguaauuuaacauuuu

SEQ ID NO: 2034722 - RNA, 22 nt, Staphylococcus aureus subsp. aureus Mu50
cugaagggaucggucuugaaaa

SEQ ID NO: 2034723 - RNA, 20 nt, Staphylococcus aureus subsp. aureus Mu50
cugaagacaccuuaucacuu

SEQ ID NO: 2034724 - RNA, 20 nt, Staphylococcus aureus subsp. aureus Mu50
cugagaaaaauauuucuaau

SEQ ID NO: 2034725 - RNA, 15 nt, Staphylococcus aureus subsp. aureus Mu50
cugagcuuuaauuuu

SEQ ID NO: 2034726 - RNA, 18 nt, Staphylococcus aureus subsp. aureus Mu50
cuccaguggaaaugauaa

SEQ ID NO: 2034727 - RNA, 17 nt, Staphylococcus aureus subsp. aureus Mu50
cuccaacucuaacagcu

SEQ ID NO: 2034728 - RNA, 21 nt, Staphylococcus aureus subsp. aureus Mu50
cucauacuauaagcaauuucu

SEQ ID NO: 2034729 - RNA, 14 nt, Staphylococcus aureus subsp. aureus Mu50
cucauagucaucuu

SEQ ID NO: 2034730 - RNA, 18 nt, Staphylococcus aureus subsp. aureus Mu50
cuccaauuaccaaugaau

SEQ ID NO: 2034731 - RNA, 13 nt, Staphylococcus aureus subsp. aureus Mu50
cucacuuaauaaa

SEQ ID NO: 2034732 - RNA, 13 nt, Staphylococcus aureus subsp. aureus Mu50
cucacuucuuaaa

SEQ ID NO: 2034733 - RNA, 16 nt, Staphylococcus aureus subsp. aureus Mu50
cucacuucuuaaaaua

SEQ ID NO: 2034734 - RNA, 20 nt, Staphylococcus aureus subsp. aureus Mu50
cuauuuagcuugcuuacaau

SEQ ID NO: 2034735 - RNA, 19 nt, Staphylococcus aureus subsp. aureus Mu50
cuauuuaucauacuucaaa

SEQ ID NO: 2034736 - RNA, 12 nt, Staphylococcus aureus subsp. aureus Mu50
cuauuugauaag

SEQ ID NO: 2034737 - RNA, 14 nt, Staphylococcus aureus subsp. aureus Mu50
cucaaaauguuuaa

SEQ ID NO: 2034738 - RNA, 17 nt, Staphylococcus aureus subsp. aureus Mu50
cuauuuuuugagcacuu

SEQ ID NO: 2034739 - RNA, 16 nt, Staphylococcus aureus subsp. aureus Mu50
cuacgcugaugaauga

SEQ ID NO: 2034740 - RNA, 17 nt, Staphylococcus aureus subsp. aureus Mu50
cuacgcugaugaaugau

SEQ ID NO: 2034741 - RNA, 22 nt, Staphylococcus aureus subsp. aureus Mu50
cuacgccuugaccuacuuuuuc

SEQ ID NO: 2034742 - RNA, 15 nt, Staphylococcus aureus subsp. aureus Mu50
cuacgaucaaaauca

SEQ ID NO: 2034743 - RNA, 12 nt, Staphylococcus aureus subsp. aureus Mu50
cuacgcauuuua

SEQ ID NO: 2034744 - RNA, 16 nt, Staphylococcus aureus subsp. aureus Mu50
cuacgcauuuuaaaua

SEQ ID NO: 2034745 - RNA, 16 nt, Staphylococcus aureus subsp. aureus Mu50
cuaggaauauaaaacu

SEQ ID NO: 2034746 - RNA, 13 nt, Staphylococcus aureus subsp. aureus Mu50
cuagcuuguuugu

SEQ ID NO: 2034747 - RNA, 16 nt, Staphylococcus aureus subsp. aureus Mu50
cuagcuuguuuguuac

SEQ ID NO: 2034748 - RNA, 22 nt, Staphylococcus aureus subsp. aureus Mu50
cuaucgccuaaaaauaaaauca

SEQ ID NO: 2034749 - RNA, 20 nt, Staphylococcus aureus subsp. aureus Mu50
cuauaaucauuaaguaaucu

SEQ ID NO: 2034750 - RNA, 17 nt, Staphylococcus aureus subsp. aureus Mu50
cuaguuuaacaauacua

SEQ ID NO: 2034751 - RNA, 13 nt, Staphylococcus aureus subsp. aureus Mu50
cuauaaauacaaa

SEQ ID NO: 2034752 - RNA, 19 nt, Staphylococcus aureus subsp. aureus Mu50
cuauaacucuaaauauaau

SEQ ID NO: 2034753 - RNA, 18 nt, Staphylococcus aureus subsp. aureus Mu50
cuauaauaccuaauugcu

SEQ ID NO: 2034754 - RNA, 23 nt, Staphylococcus aureus subsp. aureus Mu50
cuauaauaccuaauugcuuaaua

SEQ ID NO: 2034755 - RNA, 15 nt, Staphylococcus aureus subsp. aureus Mu50
cuauaauagcgucau

SEQ ID NO: 2034756 - RNA, 12 nt, Staphylococcus aureus subsp. aureus Mu50
cuagucuuuaac

SEQ ID NO: 2034757 - RNA, 16 nt, Staphylococcus aureus subsp. aureus Mu50
cuagucuuuaacuuua

SEQ ID NO: 2034758 - RNA, 19 nt, Staphylococcus aureus subsp. aureus Mu50
cuagugcgcgauaaauaau

SEQ ID NO: 2034759 - RNA, 18 nt, Staphylococcus aureus subsp. aureus Mu50
cuauuaaaggaaaucaau

SEQ ID NO: 2034760 - RNA, 13 nt, Staphylococcus aureus subsp. aureus Mu50
cuauuauauugaa

SEQ ID NO: 2034761 - RNA, 15 nt, Staphylococcus aureus subsp. aureus Mu50
cuauucaauugcuau

SEQ ID NO: 2034762 - RNA, 15 nt, Staphylococcus aureus subsp. aureus Mu50
cuauuacuacauaau

SEQ ID NO: 2034763 - RNA, 18 nt, Staphylococcus aureus subsp. aureus Mu50
cuauuacuacauaauuua

SEQ ID NO: 2034764 - RNA, 19 nt, Staphylococcus aureus subsp. aureus Mu50
cuauuacuauaaaaaacag

SEQ ID NO: 2034765 - RNA, 19 nt, Staphylococcus aureus subsp. aureus Mu50
cuauuaauuacgucauaaa

SEQ ID NO: 2034766 - RNA, 13 nt, Staphylococcus aureus subsp. aureus Mu50
cuauuaauuuacu

SEQ ID NO: 2034767 - RNA, 16 nt, Staphylococcus aureus subsp. aureus Mu50
cuauuaauuugauaaa

SEQ ID NO: 2034768 - RNA, 20 nt, Staphylococcus aureus subsp. aureus Mu50
cuauguauuuuucuuaauua

SEQ ID NO: 2034769 - RNA, 13 nt, Staphylococcus aureus subsp. aureus Mu50
cuauguaaaauua

SEQ ID NO: 2034770 - RNA, 13 nt, Staphylococcus aureus subsp. aureus Mu50
cuauggucaucaa

SEQ ID NO: 2034771 - RNA, 15 nt, Staphylococcus aureus subsp. aureus Mu50
cuauggucaucaauu

SEQ ID NO: 2034772 - RNA, 12 nt, Staphylococcus aureus subsp. aureus Mu50
cuaaugcuauau

SEQ ID NO: 2034773 - RNA, 19 nt, Staphylococcus aureus subsp. aureus Mu50
cuaaugauaguacauuuau

SEQ ID NO: 2034774 - RNA, 16 nt, Staphylococcus aureus subsp. aureus Mu50
cuaauguguacuuaaa

SEQ ID NO: 2034775 - RNA, 14 nt, Staphylococcus aureus subsp. aureus Mu50
cuaauguuaaaaua

SEQ ID NO: 2034776 - RNA, 21 nt, Staphylococcus aureus subsp. aureus Mu50
cuaauuaagaaugccauaccu

SEQ ID NO: 2034777 - RNA, 19 nt, Staphylococcus aureus subsp. aureus Mu50
cuaaugcuuuaauaaaucg

SEQ ID NO: 2034778 - RNA, 16 nt, Staphylococcus aureus subsp. aureus Mu50
cuacaauuauaaauga

SEQ ID NO: 2034779 - RNA, 15 nt, Staphylococcus aureus subsp. aureus Mu50
cuacaauuaaaguga

SEQ ID NO: 2034780 - RNA, 20 nt, Staphylococcus aureus subsp. aureus Mu50
cuacaauauucaauaauuca

SEQ ID NO: 2034781 - RNA, 18 nt, Staphylococcus aureus subsp. aureus Mu50
cuaauuuacguacuucau

SEQ ID NO: 2034782 - RNA, 22 nt, Staphylococcus aureus subsp. aureus Mu50
cuaauuuaguaucuauacaauu

SEQ ID NO: 2034783 - RNA, 16 nt, Staphylococcus aureus subsp. aureus Mu50
cuaauuugcaaaauca

SEQ ID NO: 2034784 - RNA, 15 nt, Staphylococcus aureus subsp. aureus Mu50
cuaagcgcucauaaa

SEQ ID NO: 2034785 - RNA, 18 nt, Staphylococcus aureus subsp. aureus Mu50
cuaacuuuaccaauauca

SEQ ID NO: 2034786 - RNA, 15 nt, Staphylococcus aureus subsp. aureus Mu50
cuaacugugcaacaa

SEQ ID NO: 2034787 - RNA, 16 nt, Staphylococcus aureus subsp. aureus Mu50
cuaagaauguaaugag

SEQ ID NO: 2034788 - RNA, 12 nt, Staphylococcus aureus subsp. aureus Mu50
cuaagauuaaug

SEQ ID NO: 2034789 - RNA, 17 nt, Staphylococcus aureus subsp. aureus Mu50
cuaaccaucauaaaugu

SEQ ID NO: 2034790 - RNA, 20 nt, Staphylococcus aureus subsp. aureus Mu50
cuaaccauucguaauaaaca

SEQ ID NO: 2034791 - RNA, 15 nt, Staphylococcus aureus subsp. aureus Mu50
cuaacucgaagucag

SEQ ID NO: 2034792 - RNA, 13 nt, Staphylococcus aureus subsp. aureus Mu50
cuaacguuuuaaa

SEQ ID NO: 2034793 - RNA, 22 nt, Staphylococcus aureus subsp. aureus Mu50
cuaaucguuccaacaacuaaga

SEQ ID NO: 2034794 - RNA, 19 nt, Staphylococcus aureus subsp. aureus Mu50
cuaaucugcaacgauuuua

SEQ ID NO: 2034795 - RNA, 21 nt, Staphylococcus aureus subsp. aureus Mu50
cuaaucaaauuagucauccaa

SEQ ID NO: 2034796 - RNA, 14 nt, Staphylococcus aureus subsp. aureus Mu50
cuaauaucaauaau

SEQ ID NO: 2034797 - RNA, 19 nt, Staphylococcus aureus subsp. aureus Mu50
cuaauacuuucaaacaaau

SEQ ID NO: 2034798 - RNA, 17 nt, Staphylococcus aureus subsp. aureus Mu50
cuaauagguuauguuau

SEQ ID NO: 2034799 - RNA, 15 nt, Staphylococcus aureus subsp. aureus Mu50
cuaauagcauuugua

SEQ ID NO: 2034800 - RNA, 17 nt, Staphylococcus aureus subsp. aureus Mu50
cuaauacacuugauaaa

SEQ ID NO: 2034801 - RNA, 16 nt, Staphylococcus aureus subsp. aureus Mu50
cuaauaccauugugau

SEQ ID NO: 2034802 - RNA, 18 nt, Staphylococcus aureus subsp. aureus Mu50
cuaagucguucaauuguu

SEQ ID NO: 2034803 - RNA, 14 nt, Staphylococcus aureus subsp. aureus Mu50
cuaauaaauaucuu

SEQ ID NO: 2034804 - RNA, 22 nt, Staphylococcus aureus subsp. aureus Mu50
cuaauaaaaccgguacuuucau

SEQ ID NO: 2034805 - RNA, 19 nt, Staphylococcus aureus subsp. aureus Mu50
cguucgugauagaaguuuu

SEQ ID NO: 2034806 - RNA, 16 nt, Staphylococcus aureus subsp. aureus Mu50
cguuuuaaauaaauga

SEQ ID NO: 2034807 - RNA, 12 nt, Staphylococcus aureus subsp. aureus Mu50
cguuuuaauaaa

SEQ ID NO: 2034808 - RNA, 22 nt, Staphylococcus aureus subsp. aureus Mu50
cuaaaaaaggaagaacagcaca

SEQ ID NO: 2034809 - RNA, 20 nt, Staphylococcus aureus subsp. aureus Mu50
cuaaaaacagcaguaagaca

SEQ ID NO: 2034810 - RNA, 22 nt, Staphylococcus aureus subsp. aureus Mu50
cuaaaaaguacuuuuuaauucc

SEQ ID NO: 2034811 - RNA, 21 nt, Staphylococcus aureus subsp. aureus Mu50
cguuucgucagauucaaacgu

SEQ ID NO: 2034812 - RNA, 11 nt, Staphylococcus aureus subsp. aureus Mu50
cuaaauauaua

SEQ ID NO: 2034813 - RNA, 15 nt, Staphylococcus aureus subsp. aureus Mu50
cuaaauauuaaauua

SEQ ID NO: 2034814 - RNA, 17 nt, Staphylococcus aureus subsp. aureus Mu50
cuaaauauuaaauuauu

SEQ ID NO: 2034815 - RNA, 14 nt, Staphylococcus aureus subsp. aureus Mu50
cuaaaguaaauaac

SEQ ID NO: 2034816 - RNA, 21 nt, Staphylococcus aureus subsp. aureus Mu50
cuaaagcgauuuccaucauuu

SEQ ID NO: 2034817 - RNA, 14 nt, Staphylococcus aureus subsp. aureus Mu50
cuaaagauauagaa

SEQ ID NO: 2034818 - RNA, 19 nt, Staphylococcus aureus subsp. aureus Mu50
cuaaacuucuauuaauaau

SEQ ID NO: 2034819 - RNA, 21 nt, Staphylococcus aureus subsp. aureus Mu50
cuaaaugauggguaguuaaua

SEQ ID NO: 2034820 - RNA, 21 nt, Staphylococcus aureus subsp. aureus Mu50
cuaaaugcacgagcaacaucu

SEQ ID NO: 2034821 - RNA, 17 nt, Staphylococcus aureus subsp. aureus Mu50
cuaaaccucuaaauaaa

SEQ ID NO: 2034822 - RNA, 19 nt, Staphylococcus aureus subsp. aureus Mu50
cuaaacuauaauaauugga

SEQ ID NO: 2034823 - RNA, 15 nt, Staphylococcus aureus subsp. aureus Mu50
cuaaacgcuaaaauu

SEQ ID NO: 2034824 - RNA, 15 nt, Staphylococcus aureus subsp. aureus Mu50
cuaaaccucaacauu

SEQ ID NO: 2034825 - RNA, 17 nt, Staphylococcus aureus subsp. aureus Mu50
cuaaacauuuuauacuc

SEQ ID NO: 2034826 - RNA, 19 nt, Staphylococcus aureus subsp. aureus Mu50
cuaaaccgauuaauauaau

SEQ ID NO: 2034827 - RNA, 21 nt, Staphylococcus aureus subsp. aureus Mu50
cuaaaccaucugugucagcau

SEQ ID NO: 2034828 - RNA, 14 nt, Staphylococcus aureus subsp. aureus Mu50
cuaaaagaauuauu

SEQ ID NO: 2034829 - RNA, 16 nt, Staphylococcus aureus subsp. aureus Mu50
cuaaaacgauaauaau

SEQ ID NO: 2034830 - RNA, 18 nt, Staphylococcus aureus subsp. aureus Mu50
cuaaaaguaugaguuauu

SEQ ID NO: 2034831 - RNA, 18 nt, Staphylococcus aureus subsp. aureus Mu50
cuaaaaguguuaugaauu

SEQ ID NO: 2034832 - RNA, 21 nt, Staphylococcus aureus subsp. aureus Mu50
cuaaaaguuguaauuuaaaau

SEQ ID NO: 2034833 - RNA, 12 nt, Staphylococcus aureus subsp. aureus Mu50
cuaaaauaucaa
